United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 118

SEQ ID NO: 4184528 - RNA, 23 nt, Yersinia pestis KIM
gcaguuggaucugcacaccacac

SEQ ID NO: 4184529 - RNA, 20 nt, Yersinia pestis KIM
gcaguuugaguguggugagc

SEQ ID NO: 4184530 - RNA, 16 nt, Yersinia pestis KIM
gcaguuuuccucccug

SEQ ID NO: 4184531 - RNA, 19 nt, Yersinia pestis KIM
gcaguuuuuuauggcauaa

SEQ ID NO: 4184532 - RNA, 21 nt, Yersinia pestis KIM
gcauaaaccggugacuggaaa

SEQ ID NO: 4184533 - RNA, 20 nt, Yersinia pestis KIM
gcauaaauauucauuaaaaa

SEQ ID NO: 4184534 - RNA, 21 nt, Yersinia pestis KIM
gcauaaauauucauuaaaaaa

SEQ ID NO: 4184535 - RNA, 19 nt, Yersinia pestis KIM
gcauacgugccaaaaugcc

SEQ ID NO: 4184536 - RNA, 24 nt, Yersinia pestis KIM
gcauacucaaaaauggcaacauca

SEQ ID NO: 4184537 - RNA, 14 nt, Yersinia pestis KIM
gcauacucacuuaa

SEQ ID NO: 4184538 - RNA, 17 nt, Yersinia pestis KIM
gcauagcuaaccuuaac

SEQ ID NO: 4184539 - RNA, 22 nt, Yersinia pestis KIM
gcauagcuaaccuuaacuacac

SEQ ID NO: 4184540 - RNA, 14 nt, Yersinia pestis KIM
gcauaggccaauag

SEQ ID NO: 4184541 - RNA, 15 nt, Yersinia pestis KIM
gcauaggccaauaga

SEQ ID NO: 4184542 - RNA, 20 nt, Yersinia pestis KIM
gcauauacguuaguuauccu

SEQ ID NO: 4184543 - RNA, 23 nt, Yersinia pestis KIM
gcauauacuggagcuauggaaga

SEQ ID NO: 4184544 - RNA, 18 nt, Yersinia pestis KIM
gcauaucccuguuuucua

SEQ ID NO: 4184545 - RNA, 13 nt, Yersinia pestis KIM
gcauauucaccag

SEQ ID NO: 4184546 - RNA, 12 nt, Yersinia pestis KIM
gcauauucauag

SEQ ID NO: 4184547 - RNA, 15 nt, Yersinia pestis KIM
gcaucaaccaagaca

SEQ ID NO: 4184548 - RNA, 21 nt, Yersinia pestis KIM
gcaucaacgacagcagcaggc

SEQ ID NO: 4184549 - RNA, 12 nt, Yersinia pestis KIM
gcaucaacuuug

SEQ ID NO: 4184550 - RNA, 16 nt, Yersinia pestis KIM
gcaucaauaaauagag

SEQ ID NO: 4184551 - RNA, 14 nt, Yersinia pestis KIM
gcaucaaugaaaau

SEQ ID NO: 4184552 - RNA, 14 nt, Yersinia pestis KIM
gcaucaccaaagau

SEQ ID NO: 4184553 - RNA, 20 nt, Yersinia pestis KIM
gcaucacccgcgagcgaccu

SEQ ID NO: 4184554 - RNA, 19 nt, Yersinia pestis KIM
gcaucacgauagccaguga

SEQ ID NO: 4184555 - RNA, 22 nt, Yersinia pestis KIM
gcaucacuucauacacggcggc

SEQ ID NO: 4184556 - RNA, 17 nt, Yersinia pestis KIM
gcaucagacggcagcaa

SEQ ID NO: 4184557 - RNA, 18 nt, Yersinia pestis KIM
gcaucagcaaaguauuua

SEQ ID NO: 4184558 - RNA, 13 nt, Yersinia pestis KIM
gcaucagccagcc

SEQ ID NO: 4184559 - RNA, 16 nt, Yersinia pestis KIM
gcaucagcccauugcu

SEQ ID NO: 4184560 - RNA, 18 nt, Yersinia pestis KIM
gcaucagcccauugcugu

SEQ ID NO: 4184561 - RNA, 21 nt, Yersinia pestis KIM
gcaucaucaguauugacgaug

SEQ ID NO: 4184562 - RNA, 16 nt, Yersinia pestis KIM
gcaucauccagcucaa

SEQ ID NO: 4184563 - RNA, 17 nt, Yersinia pestis KIM
gcaucauuaagaugcau

SEQ ID NO: 4184564 - RNA, 14 nt, Yersinia pestis KIM
gcauccaaccugca

SEQ ID NO: 4184565 - RNA, 18 nt, Yersinia pestis KIM
gcauccaagccaucauua

SEQ ID NO: 4184566 - RNA, 19 nt, Yersinia pestis KIM
gcauccagcucauauaauc

SEQ ID NO: 4184567 - RNA, 23 nt, Yersinia pestis KIM
gcauccccacugacaucauuuua

SEQ ID NO: 4184568 - RNA, 19 nt, Yersinia pestis KIM
gcauccccacuuguaccug

SEQ ID NO: 4184569 - RNA, 16 nt, Yersinia pestis KIM
gcauccccaucgccaa

SEQ ID NO: 4184570 - RNA, 21 nt, Yersinia pestis KIM
gcauccccggcaucccaccuu

SEQ ID NO: 4184571 - RNA, 14 nt, Yersinia pestis KIM
gcauccgcccacac

SEQ ID NO: 4184572 - RNA, 18 nt, Yersinia pestis KIM
gcauccgcuucgcugguc

SEQ ID NO: 4184573 - RNA, 19 nt, Yersinia pestis KIM
gcauccgcuuucacauuac

SEQ ID NO: 4184574 - RNA, 15 nt, Yersinia pestis KIM
gcauccguacccgcu

SEQ ID NO: 4184575 - RNA, 17 nt, Yersinia pestis KIM
gcauccuugaucgccaa

SEQ ID NO: 4184576 - RNA, 15 nt, Yersinia pestis KIM
gcaucgacgagcggc

SEQ ID NO: 4184577 - RNA, 20 nt, Yersinia pestis KIM
gcaucgcgguuuuuccgccg

SEQ ID NO: 4184578 - RNA, 21 nt, Yersinia pestis KIM
gcaucgguaauacucuggcca

SEQ ID NO: 4184579 - RNA, 21 nt, Yersinia pestis KIM
gcaucuagcagugauuucagu

SEQ ID NO: 4184580 - RNA, 19 nt, Yersinia pestis KIM
gcaucuccgcgaccacaug

SEQ ID NO: 4184581 - RNA, 22 nt, Yersinia pestis KIM
gcaucucgauacauaccauaag

SEQ ID NO: 4184582 - RNA, 14 nt, Yersinia pestis KIM
gcaucucugcaucu

SEQ ID NO: 4184583 - RNA, 16 nt, Yersinia pestis KIM
gcaucugaaagcuuca

SEQ ID NO: 4184584 - RNA, 21 nt, Yersinia pestis KIM
gcaucugcaauggcuggcaag

SEQ ID NO: 4184585 - RNA, 13 nt, Yersinia pestis KIM
gcaucugccacac

SEQ ID NO: 4184586 - RNA, 15 nt, Yersinia pestis KIM
gcaucuuauuauuac

SEQ ID NO: 4184587 - RNA, 19 nt, Yersinia pestis KIM
gcaucuugaaggauggcgg

SEQ ID NO: 4184588 - RNA, 21 nt, Yersinia pestis KIM
gcaucuuuaccccauugcacc

SEQ ID NO: 4184589 - RNA, 18 nt, Yersinia pestis KIM
gcaucuuuugcuauugaa

SEQ ID NO: 4184590 - RNA, 16 nt, Yersinia pestis KIM
gcaugaaaacccuguu

SEQ ID NO: 4184591 - RNA, 16 nt, Yersinia pestis KIM
gcaugaccaaaggcua

SEQ ID NO: 4184592 - RNA, 24 nt, Yersinia pestis KIM
gcaugacuagugccacaacaagcc

SEQ ID NO: 4184593 - RNA, 15 nt, Yersinia pestis KIM
gcaugaugaauacgg

SEQ ID NO: 4184594 - RNA, 14 nt, Yersinia pestis KIM
gcaugccauccugc

SEQ ID NO: 4184595 - RNA, 18 nt, Yersinia pestis KIM
gcaugccauccugccaac

SEQ ID NO: 4184596 - RNA, 20 nt, Yersinia pestis KIM
gcauggaagauaucuaauuu

SEQ ID NO: 4184597 - RNA, 19 nt, Yersinia pestis KIM
gcauggacgagcacauggc

SEQ ID NO: 4184598 - RNA, 14 nt, Yersinia pestis KIM
gcauggaucacccg

SEQ ID NO: 4184599 - RNA, 15 nt, Yersinia pestis KIM
gcauggcgcugggca

SEQ ID NO: 4184600 - RNA, 17 nt, Yersinia pestis KIM
gcaugguaaggccucgg

SEQ ID NO: 4184601 - RNA, 16 nt, Yersinia pestis KIM
gcauggucccuacggu

SEQ ID NO: 4184602 - RNA, 13 nt, Yersinia pestis KIM
gcaugugggcagg

SEQ ID NO: 4184603 - RNA, 17 nt, Yersinia pestis KIM
gcauguuauuggcuaaa

SEQ ID NO: 4184604 - RNA, 23 nt, Yersinia pestis KIM
gcauguuauuggcuaaaguguac

SEQ ID NO: 4184605 - RNA, 20 nt, Yersinia pestis KIM
gcauguuccugcacuaaacc

SEQ ID NO: 4184606 - RNA, 23 nt, Yersinia pestis KIM
gcauuaauaccguuuucuuucaa

SEQ ID NO: 4184607 - RNA, 20 nt, Yersinia pestis KIM
gcauuaccacgguaaugaau

SEQ ID NO: 4184608 - RNA, 18 nt, Yersinia pestis KIM
gcauuacucuuauaaaga

SEQ ID NO: 4184609 - RNA, 19 nt, Yersinia pestis KIM
gcauuagacauucaagccu

SEQ ID NO: 4184610 - RNA, 20 nt, Yersinia pestis KIM
gccagcaaccacgguaucaa

SEQ ID NO: 4184611 - RNA, 21 nt, Yersinia pestis KIM
gccagcaauaagccacgcugu

SEQ ID NO: 4184612 - RNA, 21 nt, Yersinia pestis KIM
gccagcaauguguugaaugac

SEQ ID NO: 4184613 - RNA, 17 nt, Yersinia pestis KIM
gccagcaccgguauccc

SEQ ID NO: 4184614 - RNA, 18 nt, Yersinia pestis KIM
gccagcagcauaaccagu

SEQ ID NO: 4184615 - RNA, 13 nt, Yersinia pestis KIM
gccagcauggcgc

SEQ ID NO: 4184616 - RNA, 18 nt, Yersinia pestis KIM
gccagcaugugguuacca

SEQ ID NO: 4184617 - RNA, 23 nt, Yersinia pestis KIM
gccagcauucaggcuuuuuucua

SEQ ID NO: 4184618 - RNA, 14 nt, Yersinia pestis KIM
gccagcccaucacc

SEQ ID NO: 4184619 - RNA, 20 nt, Yersinia pestis KIM
gccagccggugauuggggcu

SEQ ID NO: 4184620 - RNA, 14 nt, Yersinia pestis KIM
gccagccucugcgc

SEQ ID NO: 4184621 - RNA, 19 nt, Yersinia pestis KIM
gccagcgccccaucaauuu

SEQ ID NO: 4184622 - RNA, 20 nt, Yersinia pestis KIM
gccagcgggaaucaaacucu

SEQ ID NO: 4184623 - RNA, 17 nt, Yersinia pestis KIM
gccagcggguacacugu

SEQ ID NO: 4184624 - RNA, 21 nt, Yersinia pestis KIM
gccagcguucaacuucggcag

SEQ ID NO: 4184625 - RNA, 13 nt, Yersinia pestis KIM
gccagcuccugcc

SEQ ID NO: 4184626 - RNA, 14 nt, Yersinia pestis KIM
gccagcuccugcca

SEQ ID NO: 4184627 - RNA, 14 nt, Yersinia pestis KIM
gccagcugcaauug

SEQ ID NO: 4184628 - RNA, 21 nt, Yersinia pestis KIM
gccagcuuuuuaucauuuaaa

SEQ ID NO: 4184629 - RNA, 17 nt, Yersinia pestis KIM
gccaggaaauuugcacu

SEQ ID NO: 4184630 - RNA, 22 nt, Yersinia pestis KIM
gccaggaaauuugcacugcagg

SEQ ID NO: 4184631 - RNA, 17 nt, Yersinia pestis KIM
gccaggcaaugagugca

SEQ ID NO: 4184632 - RNA, 20 nt, Yersinia pestis KIM
gccaggcaaugagugcagcc

SEQ ID NO: 4184633 - RNA, 15 nt, Yersinia pestis KIM
gccaggcagcuauca

SEQ ID NO: 4184634 - RNA, 16 nt, Yersinia pestis KIM
gccagggagggcgcgc

SEQ ID NO: 4184635 - RNA, 17 nt, Yersinia pestis KIM
gccagguaagaaagaga

SEQ ID NO: 4184636 - RNA, 21 nt, Yersinia pestis KIM
gccagguaagaaagagaugac

SEQ ID NO: 4184637 - RNA, 13 nt, Yersinia pestis KIM
gccaggucaggaa

SEQ ID NO: 4184638 - RNA, 14 nt, Yersinia pestis KIM
gccaggucaggaag

SEQ ID NO: 4184639 - RNA, 23 nt, Yersinia pestis KIM
gccaggucgaugaacugcacguc

SEQ ID NO: 4184640 - RNA, 19 nt, Yersinia pestis KIM
gccaggugauaauggcauu

SEQ ID NO: 4184641 - RNA, 18 nt, Yersinia pestis KIM
gccaguaaacagccagca

SEQ ID NO: 4184642 - RNA, 23 nt, Yersinia pestis KIM
gccaguaacgcuucaucauggau

SEQ ID NO: 4184643 - RNA, 17 nt, Yersinia pestis KIM
gccaguaauuaaugcca

SEQ ID NO: 4184644 - RNA, 21 nt, Yersinia pestis KIM
gccaguagcaauaaggugcca

SEQ ID NO: 4184645 - RNA, 17 nt, Yersinia pestis KIM
gccagucaaaagaaacu

SEQ ID NO: 4184646 - RNA, 23 nt, Yersinia pestis KIM
gccagucaaaagaaacugucagu

SEQ ID NO: 4184647 - RNA, 19 nt, Yersinia pestis KIM
gccagucauucaucaccuu

SEQ ID NO: 4184648 - RNA, 14 nt, Yersinia pestis KIM
gccagugaacccgc

SEQ ID NO: 4184649 - RNA, 19 nt, Yersinia pestis KIM
gccagugacaacuuagguu

SEQ ID NO: 4184650 - RNA, 15 nt, Yersinia pestis KIM
gccagugacugagca

SEQ ID NO: 4184651 - RNA, 20 nt, Yersinia pestis KIM
gccagugaugcugcacauca

SEQ ID NO: 4184652 - RNA, 17 nt, Yersinia pestis KIM
gccagugccgcggcggc

SEQ ID NO: 4184653 - RNA, 18 nt, Yersinia pestis KIM
gccagugccgcggcggcc

SEQ ID NO: 4184654 - RNA, 20 nt, Yersinia pestis KIM
gccaguggcuuugcaccauc

SEQ ID NO: 4184655 - RNA, 15 nt, Yersinia pestis KIM
gccaguuaauaccag

SEQ ID NO: 4184656 - RNA, 19 nt, Yersinia pestis KIM
gccaguucuggaucggcau

SEQ ID NO: 4184657 - RNA, 19 nt, Yersinia pestis KIM
gccaguugccacucauauu

SEQ ID NO: 4184658 - RNA, 23 nt, Yersinia pestis KIM
gccaguugggauguucagcucaa

SEQ ID NO: 4184659 - RNA, 17 nt, Yersinia pestis KIM
gccaguuuagugcucau

SEQ ID NO: 4184660 - RNA, 19 nt, Yersinia pestis KIM
gccaguuuagugcucauga

SEQ ID NO: 4184661 - RNA, 20 nt, Yersinia pestis KIM
gccaguuuagugcucaugag

SEQ ID NO: 4184662 - RNA, 16 nt, Yersinia pestis KIM
gccaguuucgguacca

SEQ ID NO: 4184663 - RNA, 12 nt, Yersinia pestis KIM
gccauaaauaaa

SEQ ID NO: 4184664 - RNA, 13 nt, Yersinia pestis KIM
gccauaacgcaca

SEQ ID NO: 4184665 - RNA, 20 nt, Yersinia pestis KIM
gccauaagcccccguaucau

SEQ ID NO: 4184666 - RNA, 17 nt, Yersinia pestis KIM
gccauaagugcacugaa

SEQ ID NO: 4184667 - RNA, 22 nt, Yersinia pestis KIM
gccauaagugcacugaacccca

SEQ ID NO: 4184668 - RNA, 18 nt, Yersinia pestis KIM
gccauaauccagaagcca

SEQ ID NO: 4184669 - RNA, 21 nt, Yersinia pestis KIM
gccauaauccagaagccauua

SEQ ID NO: 4184670 - RNA, 14 nt, Yersinia pestis KIM
gccauaccaggcca

SEQ ID NO: 4184671 - RNA, 22 nt, Yersinia pestis KIM
gccauacccaaaccaacaauau

SEQ ID NO: 4184672 - RNA, 19 nt, Yersinia pestis KIM
gccauauacgcauaaugcg

SEQ ID NO: 4184673 - RNA, 13 nt, Yersinia pestis KIM
gccauauccaacu

SEQ ID NO: 4184674 - RNA, 12 nt, Yersinia pestis KIM
gccauaugcaug

SEQ ID NO: 4184675 - RNA, 21 nt, Yersinia pestis KIM
gccauauguugccaccagcgu

SEQ ID NO: 4184676 - RNA, 12 nt, Yersinia pestis KIM
gccaucaauaaa

SEQ ID NO: 4184677 - RNA, 22 nt, Yersinia pestis KIM
gccaucaauaaagcuggcuaac

SEQ ID NO: 4184678 - RNA, 16 nt, Yersinia pestis KIM
gccaucaggcaaaagc

SEQ ID NO: 4184679 - RNA, 18 nt, Yersinia pestis KIM
gccaucaggcgcuuuucu

SEQ ID NO: 4184680 - RNA, 20 nt, Yersinia pestis KIM
gccaucccccuuuggccgcu

SEQ ID NO: 4184681 - RNA, 21 nt, Yersinia pestis KIM
gccauccuucagacugcugac

SEQ ID NO: 4184682 - RNA, 16 nt, Yersinia pestis KIM
gccauccuuuugacug

SEQ ID NO: 4184683 - RNA, 21 nt, Yersinia pestis KIM
gccaucgcaccaaacggaaug

SEQ ID NO: 4184684 - RNA, 14 nt, Yersinia pestis KIM
gccaucgccaacag

SEQ ID NO: 4184685 - RNA, 17 nt, Yersinia pestis KIM
gccaucgccaacaggcc

SEQ ID NO: 4184686 - RNA, 17 nt, Yersinia pestis KIM
gccaucgccccaaagau

SEQ ID NO: 4184687 - RNA, 19 nt, Yersinia pestis KIM
gccaucuuguucuaauaau

SEQ ID NO: 4184688 - RNA, 20 nt, Yersinia pestis KIM
gccaucuuguucuaauaaua

SEQ ID NO: 4184689 - RNA, 16 nt, Yersinia pestis KIM
gccaugaaucaaauua

SEQ ID NO: 4184690 - RNA, 15 nt, Yersinia pestis KIM
gccaugauguggcug

SEQ ID NO: 4184691 - RNA, 22 nt, Yersinia pestis KIM
gccaugccugcgaauuaucauc

SEQ ID NO: 4184692 - RNA, 17 nt, Yersinia pestis KIM
gccauggcgaaaauccu

SEQ ID NO: 4184693 - RNA, 21 nt, Yersinia pestis KIM
gccauggcgaaaauccuucau

SEQ ID NO: 4184694 - RNA, 23 nt, Yersinia pestis KIM
gccauguguuuguuuggauaaaa

SEQ ID NO: 4184695 - RNA, 21 nt, Yersinia pestis KIM
gccauuaaccuaaaaacguca

SEQ ID NO: 4184696 - RNA, 18 nt, Yersinia pestis KIM
gccauuaauuggccggga

SEQ ID NO: 4184697 - RNA, 12 nt, Yersinia pestis KIM
gccauuacccuc

SEQ ID NO: 4184698 - RNA, 18 nt, Yersinia pestis KIM
gccauucaauguccaugu

SEQ ID NO: 4184699 - RNA, 13 nt, Yersinia pestis KIM
gccauugcauauu

SEQ ID NO: 4184700 - RNA, 22 nt, Yersinia pestis KIM
gccauugccgaaccugcauguu

SEQ ID NO: 4184701 - RNA, 12 nt, Yersinia pestis KIM
gccauugcucau

SEQ ID NO: 4184702 - RNA, 19 nt, Yersinia pestis KIM
gccauuggcaaaggccagc

SEQ ID NO: 4184703 - RNA, 16 nt, Yersinia pestis KIM
gccauuucaaaacgcc

SEQ ID NO: 4184704 - RNA, 15 nt, Yersinia pestis KIM
gccauuucaccaaua

SEQ ID NO: 4184705 - RNA, 20 nt, Yersinia pestis KIM
gccauuucaccaauauguuc

SEQ ID NO: 4184706 - RNA, 15 nt, Yersinia pestis KIM
gcccaaaucugccug

SEQ ID NO: 4184707 - RNA, 16 nt, Yersinia pestis KIM
gcccaaaugagcagca

SEQ ID NO: 4184708 - RNA, 21 nt, Yersinia pestis KIM
gcccaacaacuucaccacugu

SEQ ID NO: 4184709 - RNA, 22 nt, Yersinia pestis KIM
gcccaaccccccauugccaaau

SEQ ID NO: 4184710 - RNA, 23 nt, Yersinia pestis KIM
gcccaacgucauuuccguuaacc

SEQ ID NO: 4184711 - RNA, 19 nt, Yersinia pestis KIM
gcccaacucuuuagccgcu

SEQ ID NO: 4184712 - RNA, 23 nt, Yersinia pestis KIM
gcccaagauacuggaagaaaccc

SEQ ID NO: 4184713 - RNA, 14 nt, Yersinia pestis KIM
gcccaagccauccu

SEQ ID NO: 4184714 - RNA, 15 nt, Yersinia pestis KIM
gcccaagccauccuu

SEQ ID NO: 4184715 - RNA, 13 nt, Yersinia pestis KIM
gcccaaugucagg

SEQ ID NO: 4184716 - RNA, 20 nt, Yersinia pestis KIM
gcccacauaaagauagccac

SEQ ID NO: 4184717 - RNA, 18 nt, Yersinia pestis KIM
gcccacauuuagggcaga

SEQ ID NO: 4184718 - RNA, 19 nt, Yersinia pestis KIM
gcccacuggccugagaacc

SEQ ID NO: 4184719 - RNA, 12 nt, Yersinia pestis KIM
gcccagaaaacc

SEQ ID NO: 4184720 - RNA, 16 nt, Yersinia pestis KIM
gcccagaaaggcaaaa

SEQ ID NO: 4184721 - RNA, 16 nt, Yersinia pestis KIM
gcccagacucaaaaua

SEQ ID NO: 4184722 - RNA, 16 nt, Yersinia pestis KIM
gcccagaucauccaga

SEQ ID NO: 4184723 - RNA, 21 nt, Yersinia pestis KIM
gcccagauucauuagccagcc

SEQ ID NO: 4184724 - RNA, 21 nt, Yersinia pestis KIM
gccgggucguaccggcccaac

SEQ ID NO: 4184725 - RNA, 16 nt, Yersinia pestis KIM
gccgguauucagccaa

SEQ ID NO: 4184726 - RNA, 12 nt, Yersinia pestis KIM
gccgguggcuga

SEQ ID NO: 4184727 - RNA, 21 nt, Yersinia pestis KIM
gccguaaacugccguaaacaa

SEQ ID NO: 4184728 - RNA, 17 nt, Yersinia pestis KIM
gccguaaauacauccau

SEQ ID NO: 4184729 - RNA, 22 nt, Yersinia pestis KIM
gccguaaugacucgauaaccca

SEQ ID NO: 4184730 - RNA, 13 nt, Yersinia pestis KIM
gccguacaacaau

SEQ ID NO: 4184731 - RNA, 23 nt, Yersinia pestis KIM
gccguaucuucugccagccccaa

SEQ ID NO: 4184732 - RNA, 22 nt, Yersinia pestis KIM
gccgugagcaaucuggcggccg

SEQ ID NO: 4184733 - RNA, 21 nt, Yersinia pestis KIM
gccgugcaaucuguuauaaaa

SEQ ID NO: 4184734 - RNA, 13 nt, Yersinia pestis KIM
gccgugccugcug

SEQ ID NO: 4184735 - RNA, 18 nt, Yersinia pestis KIM
gccgugccugcuggcaaa

SEQ ID NO: 4184736 - RNA, 17 nt, Yersinia pestis KIM
gccgugcgguuguaaag

SEQ ID NO: 4184737 - RNA, 14 nt, Yersinia pestis KIM
gccgugcugucagc

SEQ ID NO: 4184738 - RNA, 15 nt, Yersinia pestis KIM
gccguggcgaagccc

SEQ ID NO: 4184739 - RNA, 15 nt, Yersinia pestis KIM
gccgugggcaauaac

SEQ ID NO: 4184740 - RNA, 22 nt, Yersinia pestis KIM
gccguucuccaguugccagcag

SEQ ID NO: 4184741 - RNA, 14 nt, Yersinia pestis KIM
gccguuuugcucgg

SEQ ID NO: 4184742 - RNA, 19 nt, Yersinia pestis KIM
gccguuuuggcuauuuauu

SEQ ID NO: 4184743 - RNA, 18 nt, Yersinia pestis KIM
gccuaaaaaugauuucag

SEQ ID NO: 4184744 - RNA, 12 nt, Yersinia pestis KIM
gccuaaacccca

SEQ ID NO: 4184745 - RNA, 21 nt, Yersinia pestis KIM
gccuaaauaccgcuugccgau

SEQ ID NO: 4184746 - RNA, 15 nt, Yersinia pestis KIM
gccuaacaacacgcu

SEQ ID NO: 4184747 - RNA, 15 nt, Yersinia pestis KIM
gccuaacaacugccg

SEQ ID NO: 4184748 - RNA, 19 nt, Yersinia pestis KIM
gccuaaggccaucaauaaa

SEQ ID NO: 4184749 - RNA, 23 nt, Yersinia pestis KIM
gccuaauuucgguagcucggccc

SEQ ID NO: 4184750 - RNA, 19 nt, Yersinia pestis KIM
gccuaccaucaaaauaugu

SEQ ID NO: 4184751 - RNA, 21 nt, Yersinia pestis KIM
gccuaccaucaaaauauguuc

SEQ ID NO: 4184752 - RNA, 15 nt, Yersinia pestis KIM
gccuagcaucauaaa

SEQ ID NO: 4184753 - RNA, 13 nt, Yersinia pestis KIM
gccuauccucacc

SEQ ID NO: 4184754 - RNA, 14 nt, Yersinia pestis KIM
gccuauccucauga

SEQ ID NO: 4184755 - RNA, 15 nt, Yersinia pestis KIM
gccuauccucaugau

SEQ ID NO: 4184756 - RNA, 17 nt, Yersinia pestis KIM
gccuaucugaaugaauu

SEQ ID NO: 4184757 - RNA, 23 nt, Yersinia pestis KIM
gccuauuaagauaauuauccauu

SEQ ID NO: 4184758 - RNA, 17 nt, Yersinia pestis KIM
gccuauuugcagaaagu

SEQ ID NO: 4184759 - RNA, 16 nt, Yersinia pestis KIM
gccucaacgcacccca

SEQ ID NO: 4184760 - RNA, 17 nt, Yersinia pestis KIM
gccucaacgcaccccac

SEQ ID NO: 4184761 - RNA, 19 nt, Yersinia pestis KIM
gccucacaacuuucccagu

SEQ ID NO: 4184762 - RNA, 14 nt, Yersinia pestis KIM
gccucacugucuuu

SEQ ID NO: 4184763 - RNA, 21 nt, Yersinia pestis KIM
gccucaucagaggcucauccu

SEQ ID NO: 4184764 - RNA, 19 nt, Yersinia pestis KIM
gccucaugaaugaggcuga

SEQ ID NO: 4184765 - RNA, 21 nt, Yersinia pestis KIM
gccuccaacuuaucacuggag

SEQ ID NO: 4184766 - RNA, 20 nt, Yersinia pestis KIM
gccucgcggaaaucagcuuc

SEQ ID NO: 4184767 - RNA, 13 nt, Yersinia pestis KIM
gccucgcuucugc

SEQ ID NO: 4184768 - RNA, 22 nt, Yersinia pestis KIM
gccucggcgauugaacaugaug

SEQ ID NO: 4184769 - RNA, 15 nt, Yersinia pestis KIM
gccucuagcuaacag

SEQ ID NO: 4184770 - RNA, 17 nt, Yersinia pestis KIM
gccucucagacugcuga

SEQ ID NO: 4184771 - RNA, 12 nt, Yersinia pestis KIM
gccucucucacu

SEQ ID NO: 4184772 - RNA, 12 nt, Yersinia pestis KIM
gccucugcuccg

SEQ ID NO: 4184773 - RNA, 18 nt, Yersinia pestis KIM
gccucuggccucgcccuu

SEQ ID NO: 4184774 - RNA, 13 nt, Yersinia pestis KIM
gccucuucugucg

SEQ ID NO: 4184775 - RNA, 20 nt, Yersinia pestis KIM
gccugaaucugaauggcccg

SEQ ID NO: 4184776 - RNA, 17 nt, Yersinia pestis KIM
gccugacugcccgccug

SEQ ID NO: 4184777 - RNA, 21 nt, Yersinia pestis KIM
gccugagguucccaacggcag

SEQ ID NO: 4184778 - RNA, 15 nt, Yersinia pestis KIM
gccugauccaacauc

SEQ ID NO: 4184779 - RNA, 20 nt, Yersinia pestis KIM
gccugaucgauaacccccaa

SEQ ID NO: 4184780 - RNA, 18 nt, Yersinia pestis KIM
gccugcaccagugccaau

SEQ ID NO: 4184781 - RNA, 23 nt, Yersinia pestis KIM
gccugcaccagugccaaucccca

SEQ ID NO: 4184782 - RNA, 13 nt, Yersinia pestis KIM
gccugccauguca

SEQ ID NO: 4184783 - RNA, 20 nt, Yersinia pestis KIM
gccugcgaauuaucauccag

SEQ ID NO: 4184784 - RNA, 14 nt, Yersinia pestis KIM
gccugcgacagcac

SEQ ID NO: 4184785 - RNA, 23 nt, Yersinia pestis KIM
gccugcgcuaauacggcuugcaa

SEQ ID NO: 4184786 - RNA, 22 nt, Yersinia pestis KIM
gccugcguuguuuuucaaucua

SEQ ID NO: 4184787 - RNA, 17 nt, Yersinia pestis KIM
gccugcucaacacaggu

SEQ ID NO: 4184788 - RNA, 14 nt, Yersinia pestis KIM
gccugcugagccaa

SEQ ID NO: 4184789 - RNA, 15 nt, Yersinia pestis KIM
gccuggcaggaagcc

SEQ ID NO: 4184790 - RNA, 21 nt, Yersinia pestis KIM
gccuggcgcauaguuucaaua

SEQ ID NO: 4184791 - RNA, 22 nt, Yersinia pestis KIM
gccuggcgcauaguuucaauau

SEQ ID NO: 4184792 - RNA, 16 nt, Yersinia pestis KIM
gccuggcuugaccuug

SEQ ID NO: 4184793 - RNA, 16 nt, Yersinia pestis KIM
gccuguaaaucuuguu

SEQ ID NO: 4184794 - RNA, 14 nt, Yersinia pestis KIM
gccuguaccaccac

SEQ ID NO: 4184795 - RNA, 17 nt, Yersinia pestis KIM
gccugucuuaggugaca

SEQ ID NO: 4184796 - RNA, 20 nt, Yersinia pestis KIM
gccugugacgcuugaauaua

SEQ ID NO: 4184797 - RNA, 21 nt, Yersinia pestis KIM
gccugugcggcagugaaccug

SEQ ID NO: 4184798 - RNA, 19 nt, Yersinia pestis KIM
gccuguuacugaccgugca

SEQ ID NO: 4184799 - RNA, 23 nt, Yersinia pestis KIM
gccuguucucuccgucgcgggca

SEQ ID NO: 4184800 - RNA, 20 nt, Yersinia pestis KIM
gccuguuuacguaaauagau

SEQ ID NO: 4184801 - RNA, 22 nt, Yersinia pestis KIM
gccuuaacccgcgggagucagu

SEQ ID NO: 4184802 - RNA, 23 nt, Yersinia pestis KIM
gccuuaucagcgaaaaauuucac

SEQ ID NO: 4184803 - RNA, 14 nt, Yersinia pestis KIM
gccuuauucgccag

SEQ ID NO: 4184804 - RNA, 16 nt, Yersinia pestis KIM
gccuuauugaccgugu

SEQ ID NO: 4184805 - RNA, 21 nt, Yersinia pestis KIM
gccuucagcgauacaaccggc

SEQ ID NO: 4184806 - RNA, 18 nt, Yersinia pestis KIM
gccuucauguugcaacau

SEQ ID NO: 4184807 - RNA, 17 nt, Yersinia pestis KIM
gccuucguuugucaaug

SEQ ID NO: 4184808 - RNA, 17 nt, Yersinia pestis KIM
gccuucuccuuucuguu

SEQ ID NO: 4184809 - RNA, 22 nt, Yersinia pestis KIM
gccuucuuggguggcaauuucu

SEQ ID NO: 4184810 - RNA, 13 nt, Yersinia pestis KIM
gccuugaaucaaa

SEQ ID NO: 4184811 - RNA, 15 nt, Yersinia pestis KIM
gccuuggucucagaa

SEQ ID NO: 4184812 - RNA, 22 nt, Yersinia pestis KIM
gccuuguccaucacgcagcuuu

SEQ ID NO: 4184813 - RNA, 16 nt, Yersinia pestis KIM
gccuuuaaccacgagc

SEQ ID NO: 4184814 - RNA, 13 nt, Yersinia pestis KIM
gccuuuauucauu

SEQ ID NO: 4184815 - RNA, 19 nt, Yersinia pestis KIM
gccuuucagcgcugcgccc

SEQ ID NO: 4184816 - RNA, 22 nt, Yersinia pestis KIM
gccuuucggcaauauaaagcca

SEQ ID NO: 4184817 - RNA, 17 nt, Yersinia pestis KIM
gccuuucguuucugucu

SEQ ID NO: 4184818 - RNA, 14 nt, Yersinia pestis KIM
gccuuucucggugu

SEQ ID NO: 4184819 - RNA, 17 nt, Yersinia pestis KIM
gccuuuucuuccgccag

SEQ ID NO: 4184820 - RNA, 19 nt, Yersinia pestis KIM
gccuuuuuauaagcguuau

SEQ ID NO: 4184821 - RNA, 18 nt, Yersinia pestis KIM
gccuuuuugcaucaccau

SEQ ID NO: 4184822 - RNA, 18 nt, Yersinia pestis KIM
gccuuuuuuauaauaaug

SEQ ID NO: 4184823 - RNA, 22 nt, Yersinia pestis KIM
gccuuuuuugaacgauauuuuu

SEQ ID NO: 4184824 - RNA, 16 nt, Yersinia pestis KIM
gcgaaaauccuucauu

SEQ ID NO: 4184825 - RNA, 14 nt, Yersinia pestis KIM
gcgaaaggaacaaa

SEQ ID NO: 4184826 - RNA, 11 nt, Yersinia pestis KIM
gcgaacagcag

SEQ ID NO: 4184827 - RNA, 20 nt, Yersinia pestis KIM
gcgaacagccccgcaggugg

SEQ ID NO: 4184828 - RNA, 13 nt, Yersinia pestis KIM
gcgaacaucaucc

SEQ ID NO: 4184829 - RNA, 16 nt, Yersinia pestis KIM
gcgaaccgaguguaau

SEQ ID NO: 4184830 - RNA, 17 nt, Yersinia pestis KIM
gcgaagcgcacccaaaa

SEQ ID NO: 4184831 - RNA, 17 nt, Yersinia pestis KIM
gcgaagcguaaauuuac

SEQ ID NO: 4184832 - RNA, 18 nt, Yersinia pestis KIM
gcgaauccagguaaacaa

SEQ ID NO: 4184833 - RNA, 23 nt, Yersinia pestis KIM
gcgaauuaucauccagauucaga

SEQ ID NO: 4184834 - RNA, 12 nt, Yersinia pestis KIM
gcgaauuggcaa

SEQ ID NO: 4184835 - RNA, 13 nt, Yersinia pestis KIM
gcgacaaccugua

SEQ ID NO: 4184836 - RNA, 20 nt, Yersinia pestis KIM
gcgacacccacuuguucaga

SEQ ID NO: 4184837 - RNA, 22 nt, Yersinia pestis KIM
gcgacacccacuuguucagaga

SEQ ID NO: 4184838 - RNA, 16 nt, Yersinia pestis KIM
gcggcuaaagcugcuu

SEQ ID NO: 4184839 - RNA, 16 nt, Yersinia pestis KIM
gcggcuccaggcauua

SEQ ID NO: 4184840 - RNA, 18 nt, Yersinia pestis KIM
gcggcucucuuucuccaa

SEQ ID NO: 4184841 - RNA, 13 nt, Yersinia pestis KIM
gcggcuucagcac

SEQ ID NO: 4184842 - RNA, 15 nt, Yersinia pestis KIM
gcggcuuucauccca

SEQ ID NO: 4184843 - RNA, 18 nt, Yersinia pestis KIM
gcgggaucuccagaagca

SEQ ID NO: 4184844 - RNA, 22 nt, Yersinia pestis KIM
gcgggcaaaacgacgggcugcu

SEQ ID NO: 4184845 - RNA, 19 nt, Yersinia pestis KIM
gcgggcaguaacgccauaa

SEQ ID NO: 4184846 - RNA, 15 nt, Yersinia pestis KIM
gcgggcaucagccca

SEQ ID NO: 4184847 - RNA, 13 nt, Yersinia pestis KIM
gcgggccugaggu

SEQ ID NO: 4184848 - RNA, 22 nt, Yersinia pestis KIM
gcgggccuuugcuuuucugccu

SEQ ID NO: 4184849 - RNA, 21 nt, Yersinia pestis KIM
gcggguagcauauacguuagu

SEQ ID NO: 4184850 - RNA, 20 nt, Yersinia pestis KIM
gcgggugaucgucaucagcg

SEQ ID NO: 4184851 - RNA, 17 nt, Yersinia pestis KIM
gcgggugguccccagag

SEQ ID NO: 4184852 - RNA, 13 nt, Yersinia pestis KIM
gcgguaguucagu

SEQ ID NO: 4184853 - RNA, 20 nt, Yersinia pestis KIM
gcgguauuccgagcaaucaa

SEQ ID NO: 4184854 - RNA, 21 nt, Yersinia pestis KIM
gcggucuggcaacugcaaaug

SEQ ID NO: 4184855 - RNA, 15 nt, Yersinia pestis KIM
gcggugacaaugaau

SEQ ID NO: 4184856 - RNA, 17 nt, Yersinia pestis KIM
gcggugagggagucagg

SEQ ID NO: 4184857 - RNA, 18 nt, Yersinia pestis KIM
gcgguuccaaagcaccaa

SEQ ID NO: 4184858 - RNA, 18 nt, Yersinia pestis KIM
gcgguugccaagcuacgg

SEQ ID NO: 4184859 - RNA, 18 nt, Yersinia pestis KIM
gcgguuggcccuuuucaa

SEQ ID NO: 4184860 - RNA, 20 nt, Yersinia pestis KIM
gcgguugucggcauaacagg

SEQ ID NO: 4184861 - RNA, 23 nt, Yersinia pestis KIM
gcgguuucaaccccuucuucacc

SEQ ID NO: 4184862 - RNA, 16 nt, Yersinia pestis KIM
gcgguuucauggcugg

SEQ ID NO: 4184863 - RNA, 18 nt, Yersinia pestis KIM
gcguaaaauuagagcaaa

SEQ ID NO: 4184864 - RNA, 12 nt, Yersinia pestis KIM
gcguaaagcacc

SEQ ID NO: 4184865 - RNA, 12 nt, Yersinia pestis KIM
gcguaaauaaaa

SEQ ID NO: 4184866 - RNA, 21 nt, Yersinia pestis KIM
gcguaaauuuaccguccguac

SEQ ID NO: 4184867 - RNA, 14 nt, Yersinia pestis KIM
gcguaacuccuuug

SEQ ID NO: 4184868 - RNA, 16 nt, Yersinia pestis KIM
gcguaaucagccgcgg

SEQ ID NO: 4184869 - RNA, 16 nt, Yersinia pestis KIM
gcguacaucaggguga

SEQ ID NO: 4184870 - RNA, 13 nt, Yersinia pestis KIM
gcguacuguuagu

SEQ ID NO: 4184871 - RNA, 20 nt, Yersinia pestis KIM
gcguaggcagcgcuccgcuu

SEQ ID NO: 4184872 - RNA, 13 nt, Yersinia pestis KIM
gcguauaaacaga

SEQ ID NO: 4184873 - RNA, 15 nt, Yersinia pestis KIM
gcguauugaagucgg

SEQ ID NO: 4184874 - RNA, 13 nt, Yersinia pestis KIM
gcguauugaauug

SEQ ID NO: 4184875 - RNA, 14 nt, Yersinia pestis KIM
gcgucaaauuagca

SEQ ID NO: 4184876 - RNA, 23 nt, Yersinia pestis KIM
gcgucaagccaacccccauuagc

SEQ ID NO: 4184877 - RNA, 22 nt, Yersinia pestis KIM
gcgucacuaaauccaaaugccc

SEQ ID NO: 4184878 - RNA, 17 nt, Yersinia pestis KIM
gcgucagguaaguagaa

SEQ ID NO: 4184879 - RNA, 13 nt, Yersinia pestis KIM
gcgucauaccauu

SEQ ID NO: 4184880 - RNA, 19 nt, Yersinia pestis KIM
gcgucauggucucacugcg

SEQ ID NO: 4184881 - RNA, 16 nt, Yersinia pestis KIM
gcguccgcgccaagga

SEQ ID NO: 4184882 - RNA, 13 nt, Yersinia pestis KIM
gcgucgccacccc

SEQ ID NO: 4184883 - RNA, 22 nt, Yersinia pestis KIM
gcgucgccugggaaugcaccca

SEQ ID NO: 4184884 - RNA, 19 nt, Yersinia pestis KIM
gcgucuacgggcgcuuuuc

SEQ ID NO: 4184885 - RNA, 16 nt, Yersinia pestis KIM
gcgucugagguggcac

SEQ ID NO: 4184886 - RNA, 20 nt, Yersinia pestis KIM
gcgucuuuacgaucugccug

SEQ ID NO: 4184887 - RNA, 18 nt, Yersinia pestis KIM
gcgucuuuagauuucacc

SEQ ID NO: 4184888 - RNA, 20 nt, Yersinia pestis KIM
gcgucuuucgggcugaugaa

SEQ ID NO: 4184889 - RNA, 22 nt, Yersinia pestis KIM
gcgugaaacgauaugcuccaga

SEQ ID NO: 4184890 - RNA, 23 nt, Yersinia pestis KIM
gcgugaaacguauuauucuuccc

SEQ ID NO: 4184891 - RNA, 21 nt, Yersinia pestis KIM
gcgugacuauucugccuaucc

SEQ ID NO: 4184892 - RNA, 17 nt, Yersinia pestis KIM
gcgugagcagcaccggu

SEQ ID NO: 4184893 - RNA, 12 nt, Yersinia pestis KIM
gcgugccgcagu

SEQ ID NO: 4184894 - RNA, 20 nt, Yersinia pestis KIM
gcgugcgcccgguaauaaug

SEQ ID NO: 4184895 - RNA, 15 nt, Yersinia pestis KIM
gcgugcugcuuccug

SEQ ID NO: 4184896 - RNA, 14 nt, Yersinia pestis KIM
gcguggaauuaaua

SEQ ID NO: 4184897 - RNA, 16 nt, Yersinia pestis KIM
gcguuaaugccacccc

SEQ ID NO: 4184898 - RNA, 15 nt, Yersinia pestis KIM
gcguuaauuaagacc

SEQ ID NO: 4184899 - RNA, 22 nt, Yersinia pestis KIM
gcguuacacaucaggcuguuga

SEQ ID NO: 4184900 - RNA, 19 nt, Yersinia pestis KIM
gcguuacagcaaggcagaa

SEQ ID NO: 4184901 - RNA, 20 nt, Yersinia pestis KIM
gcguuacaguaaggcagcaa

SEQ ID NO: 4184902 - RNA, 20 nt, Yersinia pestis KIM
gcguuauugcgacauaaagc

SEQ ID NO: 4184903 - RNA, 21 nt, Yersinia pestis KIM
gcguucaaucgugcacccccu

SEQ ID NO: 4184904 - RNA, 21 nt, Yersinia pestis KIM
gcguucccgguuucagugcca

SEQ ID NO: 4184905 - RNA, 15 nt, Yersinia pestis KIM
gcguucgcgccauau

SEQ ID NO: 4184906 - RNA, 20 nt, Yersinia pestis KIM
gcguucuucugauucaauuu

SEQ ID NO: 4184907 - RNA, 23 nt, Yersinia pestis KIM
gcguugacuuucuaagcugccug

SEQ ID NO: 4184908 - RNA, 16 nt, Yersinia pestis KIM
gcguugucagccaugc

SEQ ID NO: 4184909 - RNA, 16 nt, Yersinia pestis KIM
gcguuguuuuucaauc

SEQ ID NO: 4184910 - RNA, 18 nt, Yersinia pestis KIM
gcguuuaaaguaaaucag

SEQ ID NO: 4184911 - RNA, 14 nt, Yersinia pestis KIM
gcguuuaaauaccc

SEQ ID NO: 4184912 - RNA, 22 nt, Yersinia pestis KIM
gcguuucauuuuaacaauuuua

SEQ ID NO: 4184913 - RNA, 16 nt, Yersinia pestis KIM
gcguuuucaccgugac

SEQ ID NO: 4184914 - RNA, 13 nt, Yersinia pestis KIM
gcguuuuuucggg

SEQ ID NO: 4184915 - RNA, 15 nt, Yersinia pestis KIM
gcguuuuuuugccag

SEQ ID NO: 4184916 - RNA, 14 nt, Yersinia pestis KIM
gcuaaaaugaucuu

SEQ ID NO: 4184917 - RNA, 10 nt, Yersinia pestis KIM
gcuaaacaag

SEQ ID NO: 4184918 - RNA, 18 nt, Yersinia pestis KIM
gcuaaacaggguugagcc

SEQ ID NO: 4184919 - RNA, 19 nt, Yersinia pestis KIM
gcuaaaccacggcguacug

SEQ ID NO: 4184920 - RNA, 14 nt, Yersinia pestis KIM
gcuaaagcugcuuu

SEQ ID NO: 4184921 - RNA, 15 nt, Yersinia pestis KIM
gcuaaauacugcugg

SEQ ID NO: 4184922 - RNA, 22 nt, Yersinia pestis KIM
gcuaaauacugcuggaacguug

SEQ ID NO: 4184923 - RNA, 15 nt, Yersinia pestis KIM
gcuaaaucaucaaau

SEQ ID NO: 4184924 - RNA, 20 nt, Yersinia pestis KIM
gcuaaaugacauauugugcu

SEQ ID NO: 4184925 - RNA, 19 nt, Yersinia pestis KIM
gcuaaaugcucgcuaauca

SEQ ID NO: 4184926 - RNA, 14 nt, Yersinia pestis KIM
gcuaacaccgcugu

SEQ ID NO: 4184927 - RNA, 22 nt, Yersinia pestis KIM
gcuaacaugguaugccacuuaa

SEQ ID NO: 4184928 - RNA, 18 nt, Yersinia pestis KIM
gcuaaccaccgucaccaa

SEQ ID NO: 4184929 - RNA, 21 nt, Yersinia pestis KIM
gcuaaccaccgucaccaaaua

SEQ ID NO: 4184930 - RNA, 21 nt, Yersinia pestis KIM
gcuaacgcuuucagguuguua

SEQ ID NO: 4184931 - RNA, 22 nt, Yersinia pestis KIM
gcuaacguuuauuuauaagaac

SEQ ID NO: 4184932 - RNA, 19 nt, Yersinia pestis KIM
gcuaagcggcguacugucu

SEQ ID NO: 4184933 - RNA, 20 nt, Yersinia pestis KIM
gcuaagugucaauaacaguu

SEQ ID NO: 4184934 - RNA, 15 nt, Yersinia pestis KIM
gcuaauaauuguuca

SEQ ID NO: 4184935 - RNA, 14 nt, Yersinia pestis KIM
gcuaauacggcuug

SEQ ID NO: 4184936 - RNA, 16 nt, Yersinia pestis KIM
gcuaauauuuucagcc

SEQ ID NO: 4184937 - RNA, 19 nt, Yersinia pestis KIM
gcuaauauuuucagcccua

SEQ ID NO: 4184938 - RNA, 14 nt, Yersinia pestis KIM
gcuaaucaguuccc

SEQ ID NO: 4184939 - RNA, 18 nt, Yersinia pestis KIM
gcuaaugagauuaauuca

SEQ ID NO: 4184940 - RNA, 21 nt, Yersinia pestis KIM
gcuaaugaguagcuaauaaaa

SEQ ID NO: 4184941 - RNA, 22 nt, Yersinia pestis KIM
gcuaaugcccgacgugagcguu

SEQ ID NO: 4184942 - RNA, 13 nt, Yersinia pestis KIM
gcuaaugugauga

SEQ ID NO: 4184943 - RNA, 20 nt, Yersinia pestis KIM
gcuaaugugaugaaacuaaa

SEQ ID NO: 4184944 - RNA, 21 nt, Yersinia pestis KIM
gcuaauuauuuuauuuaaaau

SEQ ID NO: 4184945 - RNA, 23 nt, Yersinia pestis KIM
gcuaauucuggguacaacacaaa

SEQ ID NO: 4184946 - RNA, 22 nt, Yersinia pestis KIM
gcuaauuugggugccauagcaa

SEQ ID NO: 4184947 - RNA, 17 nt, Yersinia pestis KIM
gcuacaagcaugugaug

SEQ ID NO: 4184948 - RNA, 13 nt, Yersinia pestis KIM
gcuacagcagcag

SEQ ID NO: 4184949 - RNA, 17 nt, Yersinia pestis KIM
gcuacagcucagacugg

SEQ ID NO: 4184950 - RNA, 21 nt, Yersinia pestis KIM
gcuaccaggaagcggccaggu

SEQ ID NO: 4184951 - RNA, 14 nt, Yersinia pestis KIM
gcuaccaugaguga

SEQ ID NO: 4184952 - RNA, 15 nt, Yersinia pestis KIM
acggaacucaucuuu

SEQ ID NO: 4184953 - RNA, 17 nt, Yersinia pestis KIM
acggaaggggaauauaa

SEQ ID NO: 4184954 - RNA, 21 nt, Yersinia pestis KIM
acggacacauaaguguauucg

SEQ ID NO: 4184955 - RNA, 17 nt, Yersinia pestis KIM
acggacaguugugucag

SEQ ID NO: 4184956 - RNA, 20 nt, Yersinia pestis KIM
acggacauuuagcacuguuc

SEQ ID NO: 4184957 - RNA, 19 nt, Yersinia pestis KIM
acggacuaauacggguuuc

SEQ ID NO: 4184958 - RNA, 14 nt, Yersinia pestis KIM
acggagcguacacg

SEQ ID NO: 4184959 - RNA, 13 nt, Yersinia pestis KIM
acggagcuaucac

SEQ ID NO: 4184960 - RNA, 16 nt, Yersinia pestis KIM
acggaggucaaaugag

SEQ ID NO: 4184961 - RNA, 17 nt, Yersinia pestis KIM
acggaggucaaaugagu

SEQ ID NO: 4184962 - RNA, 19 nt, Yersinia pestis KIM
acggauacgcaaaccaugg

SEQ ID NO: 4184963 - RNA, 17 nt, Yersinia pestis KIM
acggauagcgcuucagu

SEQ ID NO: 4184964 - RNA, 14 nt, Yersinia pestis KIM
acggauaucaacau

SEQ ID NO: 4184965 - RNA, 14 nt, Yersinia pestis KIM
acggaucacgcugu

SEQ ID NO: 4184966 - RNA, 24 nt, Yersinia pestis KIM
acggaucagugugggcuggugcgg

SEQ ID NO: 4184967 - RNA, 22 nt, Yersinia pestis KIM
acggaugaaaagugauccacuu

SEQ ID NO: 4184968 - RNA, 22 nt, Yersinia pestis KIM
acggcaccggguauugaccacu

SEQ ID NO: 4184969 - RNA, 16 nt, Yersinia pestis KIM
acggcaccuuuuuugu

SEQ ID NO: 4184970 - RNA, 18 nt, Yersinia pestis KIM
acggcacucuauuuucgu

SEQ ID NO: 4184971 - RNA, 23 nt, Yersinia pestis KIM
acggcagauuggaugucaggauc

SEQ ID NO: 4184972 - RNA, 14 nt, Yersinia pestis KIM
acggcagcaacgaa

SEQ ID NO: 4184973 - RNA, 13 nt, Yersinia pestis KIM
acggcaggcgguu

SEQ ID NO: 4184974 - RNA, 16 nt, Yersinia pestis KIM
acggcagugaucgcac

SEQ ID NO: 4184975 - RNA, 22 nt, Yersinia pestis KIM
acggcagugaucgcacuucaac

SEQ ID NO: 4184976 - RNA, 15 nt, Yersinia pestis KIM
acggcauuagugaau

SEQ ID NO: 4184977 - RNA, 21 nt, Yersinia pestis KIM
acggccggaacggucagggaa

SEQ ID NO: 4184978 - RNA, 17 nt, Yersinia pestis KIM
acggccuguaccaccac

SEQ ID NO: 4184979 - RNA, 12 nt, Yersinia pestis KIM
acggccuucuuu

SEQ ID NO: 4184980 - RNA, 14 nt, Yersinia pestis KIM
acggcgaacuucgc

SEQ ID NO: 4184981 - RNA, 22 nt, Yersinia pestis KIM
acggcgguuaaucggaugguca

SEQ ID NO: 4184982 - RNA, 15 nt, Yersinia pestis KIM
acggcguaagccuuc

SEQ ID NO: 4184983 - RNA, 14 nt, Yersinia pestis KIM
acggcgucuuuacg

SEQ ID NO: 4184984 - RNA, 16 nt, Yersinia pestis KIM
acggcguuugacaaua

SEQ ID NO: 4184985 - RNA, 19 nt, Yersinia pestis KIM
acggcguuugacaauauca

SEQ ID NO: 4184986 - RNA, 14 nt, Yersinia pestis KIM
acggcucaggugcu

SEQ ID NO: 4184987 - RNA, 22 nt, Yersinia pestis KIM
acggcucaucgcuaaccgccag

SEQ ID NO: 4184988 - RNA, 17 nt, Yersinia pestis KIM
acggcucuauuucauga

SEQ ID NO: 4184989 - RNA, 18 nt, Yersinia pestis KIM
acggcuucucgaccaccg

SEQ ID NO: 4184990 - RNA, 21 nt, Yersinia pestis KIM
acgggaucgagaguugcucac

SEQ ID NO: 4184991 - RNA, 13 nt, Yersinia pestis KIM
acgggcaaacucc

SEQ ID NO: 4184992 - RNA, 20 nt, Yersinia pestis KIM
acgggcaaugguagccaauc

SEQ ID NO: 4184993 - RNA, 19 nt, Yersinia pestis KIM
acgggccgcauucaccacc

SEQ ID NO: 4184994 - RNA, 17 nt, Yersinia pestis KIM
acgggcgcaauggaaga

SEQ ID NO: 4184995 - RNA, 18 nt, Yersinia pestis KIM
acgggcuuccaucaggaa

SEQ ID NO: 4184996 - RNA, 19 nt, Yersinia pestis KIM
acgggcuuuaaugaguaaa

SEQ ID NO: 4184997 - RNA, 22 nt, Yersinia pestis KIM
acggggaaacaguaaauuauuu

SEQ ID NO: 4184998 - RNA, 19 nt, Yersinia pestis KIM
acggguauauugcccggua

SEQ ID NO: 4184999 - RNA, 13 nt, Yersinia pestis KIM
acgggucagcuga

SEQ ID NO: 4185000 - RNA, 14 nt, Yersinia pestis KIM
acgggucagcugac

SEQ ID NO: 4185001 - RNA, 13 nt, Yersinia pestis KIM
acgggugauuucc

SEQ ID NO: 4185002 - RNA, 20 nt, Yersinia pestis KIM
acgggugccgcgucugaggu

SEQ ID NO: 4185003 - RNA, 15 nt, Yersinia pestis KIM
acgguaaggccgcga

SEQ ID NO: 4185004 - RNA, 12 nt, Yersinia pestis KIM
acgguaaugaau

SEQ ID NO: 4185005 - RNA, 16 nt, Yersinia pestis KIM
acgguaccgcagguca

SEQ ID NO: 4185006 - RNA, 13 nt, Yersinia pestis KIM
acgguagcaauac

SEQ ID NO: 4185007 - RNA, 22 nt, Yersinia pestis KIM
acgguagugacucaucaaaaca

SEQ ID NO: 4185008 - RNA, 22 nt, Yersinia pestis KIM
acgguauuggagcugaaaauag

SEQ ID NO: 4185009 - RNA, 17 nt, Yersinia pestis KIM
acggucagagauauaaa

SEQ ID NO: 4185010 - RNA, 18 nt, Yersinia pestis KIM
acggucauucacuguggc

SEQ ID NO: 4185011 - RNA, 13 nt, Yersinia pestis KIM
acggugaacagau

SEQ ID NO: 4185012 - RNA, 15 nt, Yersinia pestis KIM
acggugaauaaaccc

SEQ ID NO: 4185013 - RNA, 11 nt, Yersinia pestis KIM
acggugagaau

SEQ ID NO: 4185014 - RNA, 15 nt, Yersinia pestis KIM
acggugaggauaggc

SEQ ID NO: 4185015 - RNA, 14 nt, Yersinia pestis KIM
acggugccucaaau

SEQ ID NO: 4185016 - RNA, 16 nt, Yersinia pestis KIM
acgguggcccucugcc

SEQ ID NO: 4185017 - RNA, 17 nt, Yersinia pestis KIM
acggugguaaucguccc

SEQ ID NO: 4185018 - RNA, 15 nt, Yersinia pestis KIM
acggugugcaaugca

SEQ ID NO: 4185019 - RNA, 17 nt, Yersinia pestis KIM
acgguguguugaaauuu

SEQ ID NO: 4185020 - RNA, 22 nt, Yersinia pestis KIM
acgguuuaucccccucguuaga

SEQ ID NO: 4185021 - RNA, 18 nt, Yersinia pestis KIM
acgguuuuaaucuccugg

SEQ ID NO: 4185022 - RNA, 13 nt, Yersinia pestis KIM
acguaauacccuc

SEQ ID NO: 4185023 - RNA, 16 nt, Yersinia pestis KIM
acguagcuaacaccgc

SEQ ID NO: 4185024 - RNA, 14 nt, Yersinia pestis KIM
acgucaacagaacu

SEQ ID NO: 4185025 - RNA, 18 nt, Yersinia pestis KIM
acgucaguuaaauaugac

SEQ ID NO: 4185026 - RNA, 20 nt, Yersinia pestis KIM
acgucaucgccacacgcauu

SEQ ID NO: 4185027 - RNA, 14 nt, Yersinia pestis KIM
acguccccugagcg

SEQ ID NO: 4185028 - RNA, 16 nt, Yersinia pestis KIM
acgucccuaaagccau

SEQ ID NO: 4185029 - RNA, 17 nt, Yersinia pestis KIM
acgucgccgguggcuga

SEQ ID NO: 4185030 - RNA, 17 nt, Yersinia pestis KIM
acgucuaauugcugccc

SEQ ID NO: 4185031 - RNA, 16 nt, Yersinia pestis KIM
acgucucuuccagugg

SEQ ID NO: 4185032 - RNA, 17 nt, Yersinia pestis KIM
acgucugcaauagcuca

SEQ ID NO: 4185033 - RNA, 21 nt, Yersinia pestis KIM
acgugaagugagcugaacuga

SEQ ID NO: 4185034 - RNA, 16 nt, Yersinia pestis KIM
acgugagaauugcugc

SEQ ID NO: 4185035 - RNA, 21 nt, Yersinia pestis KIM
acgugagcguucaaaaucaaa

SEQ ID NO: 4185036 - RNA, 13 nt, Yersinia pestis KIM
acgugaucaucuu

SEQ ID NO: 4185037 - RNA, 14 nt, Yersinia pestis KIM
acgugaucaucuuu

SEQ ID NO: 4185038 - RNA, 23 nt, Yersinia pestis KIM
acgugaucgccgcuaauuuuccc

SEQ ID NO: 4185039 - RNA, 14 nt, Yersinia pestis KIM
acgugccaaaaugc

SEQ ID NO: 4185040 - RNA, 13 nt, Yersinia pestis KIM
acguggcguucac

SEQ ID NO: 4185041 - RNA, 22 nt, Yersinia pestis KIM
acgugggcgauaguaauuuuua

SEQ ID NO: 4185042 - RNA, 15 nt, Yersinia pestis KIM
acgugguugcggcac

SEQ ID NO: 4185043 - RNA, 22 nt, Yersinia pestis KIM
acguguacucauauuguccaaa

SEQ ID NO: 4185044 - RNA, 12 nt, Yersinia pestis KIM
acguuaacugca

SEQ ID NO: 4185045 - RNA, 14 nt, Yersinia pestis KIM
acguuaacugcagu

SEQ ID NO: 4185046 - RNA, 16 nt, Yersinia pestis KIM
acguuaaguucaagaa

SEQ ID NO: 4185047 - RNA, 19 nt, Yersinia pestis KIM
acguuaucaauacugcaaa

SEQ ID NO: 4185048 - RNA, 18 nt, Yersinia pestis KIM
acguuaucucaaccaguu

SEQ ID NO: 4185049 - RNA, 16 nt, Yersinia pestis KIM
acguuauuauugauua

SEQ ID NO: 4185050 - RNA, 13 nt, Yersinia pestis KIM
acguucaaaugau

SEQ ID NO: 4185051 - RNA, 12 nt, Yersinia pestis KIM
acguucaccaaa

SEQ ID NO: 4185052 - RNA, 16 nt, Yersinia pestis KIM
acguuccaacaucucg

SEQ ID NO: 4185053 - RNA, 16 nt, Yersinia pestis KIM
acguuccacugcuuua

SEQ ID NO: 4185054 - RNA, 12 nt, Yersinia pestis KIM
acguucugccaa

SEQ ID NO: 4185055 - RNA, 13 nt, Yersinia pestis KIM
acguugagauaau

SEQ ID NO: 4185056 - RNA, 14 nt, Yersinia pestis KIM
acguugccagccau

SEQ ID NO: 4185057 - RNA, 21 nt, Yersinia pestis KIM
acguuggcggcuccaggcauu

SEQ ID NO: 4185058 - RNA, 21 nt, Yersinia pestis KIM
acguuguuaucaucaccaccc

SEQ ID NO: 4185059 - RNA, 19 nt, Yersinia pestis KIM
acguuguuucugaagggca

SEQ ID NO: 4185060 - RNA, 15 nt, Yersinia pestis KIM
acguuuccaaaacuc

SEQ ID NO: 4185061 - RNA, 18 nt, Yersinia pestis KIM
acguuuccccuucauuug

SEQ ID NO: 4185062 - RNA, 23 nt, Yersinia pestis KIM
acuaaaauaaucuugugaugaaa

SEQ ID NO: 4185063 - RNA, 16 nt, Yersinia pestis KIM
acuaaaauucaaacaa

SEQ ID NO: 4185064 - RNA, 20 nt, Yersinia pestis KIM
acuaaagccgauuuagacaa

SEQ ID NO: 4185065 - RNA, 18 nt, Yersinia pestis KIM
acuaaauagauaaaaaca

SEQ ID NO: 4185066 - RNA, 22 nt, Yersinia pestis KIM
acuaaaucaaaaggaacguggc

SEQ ID NO: 4185067 - RNA, 18 nt, Yersinia pestis KIM
acuaaauuagaaaacaag

SEQ ID NO: 4185068 - RNA, 18 nt, Yersinia pestis KIM
acuaacacgacuuuuggc

SEQ ID NO: 4185069 - RNA, 16 nt, Yersinia pestis KIM
acuaacagaauauuga

SEQ ID NO: 4185070 - RNA, 14 nt, Yersinia pestis KIM
acuaacaucagcga

SEQ ID NO: 4185071 - RNA, 22 nt, Yersinia pestis KIM
acuaacaucagcgauucauuga

SEQ ID NO: 4185072 - RNA, 16 nt, Yersinia pestis KIM
acuaaccucugcaaug

SEQ ID NO: 4185073 - RNA, 19 nt, Yersinia pestis KIM
acuaaccucugcaaugccc

SEQ ID NO: 4185074 - RNA, 23 nt, Yersinia pestis KIM
acuaacgauugacggaaaauuaa

SEQ ID NO: 4185075 - RNA, 15 nt, Yersinia pestis KIM
acuaacgucaacaga

SEQ ID NO: 4185076 - RNA, 16 nt, Yersinia pestis KIM
acuaacgucaacagaa

SEQ ID NO: 4185077 - RNA, 22 nt, Yersinia pestis KIM
acuaagggcgauagacuuucac

SEQ ID NO: 4185078 - RNA, 15 nt, Yersinia pestis KIM
acuaauaauaauuaa

SEQ ID NO: 4185079 - RNA, 21 nt, Yersinia pestis KIM
acuaauaauaauuaaucuuaa

SEQ ID NO: 4185080 - RNA, 22 nt, Yersinia pestis KIM
acuaauacucuguuaccaaugg

SEQ ID NO: 4185081 - RNA, 17 nt, Yersinia pestis KIM
acuaauagcauuuuucg

SEQ ID NO: 4185082 - RNA, 15 nt, Yersinia pestis KIM
acuaauaucaacaga

SEQ ID NO: 4185083 - RNA, 16 nt, Yersinia pestis KIM
acuaauaucaacagaa

SEQ ID NO: 4185084 - RNA, 18 nt, Yersinia pestis KIM
acuaauaucaacagaacu

SEQ ID NO: 4185085 - RNA, 19 nt, Yersinia pestis KIM
acuaauggccagacacuga

SEQ ID NO: 4185086 - RNA, 22 nt, Yersinia pestis KIM
acuaauggguuagcgguuaaaa

SEQ ID NO: 4185087 - RNA, 15 nt, Yersinia pestis KIM
acuaauuaauaacca

SEQ ID NO: 4185088 - RNA, 16 nt, Yersinia pestis KIM
acuacacacagcaaua

SEQ ID NO: 4185089 - RNA, 13 nt, Yersinia pestis KIM
acuacaucgaguu

SEQ ID NO: 4185090 - RNA, 18 nt, Yersinia pestis KIM
acuaccccacauucagua

SEQ ID NO: 4185091 - RNA, 18 nt, Yersinia pestis KIM
acuaccgaucaucaggca

SEQ ID NO: 4185092 - RNA, 17 nt, Yersinia pestis KIM
acuaccgcucagauaaa

SEQ ID NO: 4185093 - RNA, 19 nt, Yersinia pestis KIM
acuacgguguuuggugaag

SEQ ID NO: 4185094 - RNA, 23 nt, Yersinia pestis KIM
acuacugcaagccguaauucaga

SEQ ID NO: 4185095 - RNA, 14 nt, Yersinia pestis KIM
acuacuuauuuccg

SEQ ID NO: 4185096 - RNA, 14 nt, Yersinia pestis KIM
acuacuugguuuaa

SEQ ID NO: 4185097 - RNA, 20 nt, Yersinia pestis KIM
acuagagcguuacacaucag

SEQ ID NO: 4185098 - RNA, 22 nt, Yersinia pestis KIM
acuagcggauuuauaaggaaau

SEQ ID NO: 4185099 - RNA, 15 nt, Yersinia pestis KIM
acuauagauacccac

SEQ ID NO: 4185100 - RNA, 21 nt, Yersinia pestis KIM
acuauauucucauugcccccu

SEQ ID NO: 4185101 - RNA, 17 nt, Yersinia pestis KIM
acuaucacuauccuuug

SEQ ID NO: 4185102 - RNA, 15 nt, Yersinia pestis KIM
acuaucccacucugu

SEQ ID NO: 4185103 - RNA, 16 nt, Yersinia pestis KIM
acuaucccuucaauca

SEQ ID NO: 4185104 - RNA, 18 nt, Yersinia pestis KIM
acuauccuuugauagaaa

SEQ ID NO: 4185105 - RNA, 14 nt, Yersinia pestis KIM
acuaucgaaacacc

SEQ ID NO: 4185106 - RNA, 17 nt, Yersinia pestis KIM
acuaucuuuauugcucc

SEQ ID NO: 4185107 - RNA, 17 nt, Yersinia pestis KIM
acuaugggggauuaucg

SEQ ID NO: 4185108 - RNA, 23 nt, Yersinia pestis KIM
acuauuaucuuuuaaaaaauuau

SEQ ID NO: 4185109 - RNA, 18 nt, Yersinia pestis KIM
acuauuccgucgauaucu

SEQ ID NO: 4185110 - RNA, 19 nt, Yersinia pestis KIM
acuauucugccuauccuca

SEQ ID NO: 4185111 - RNA, 17 nt, Yersinia pestis KIM
acuauugcaucuuuaau

SEQ ID NO: 4185112 - RNA, 18 nt, Yersinia pestis KIM
acuauuggucaaucuaga

SEQ ID NO: 4185113 - RNA, 19 nt, Yersinia pestis KIM
acuauuuaaauacaaaaau

SEQ ID NO: 4185114 - RNA, 21 nt, Yersinia pestis KIM
acuauuucguguauaucacua

SEQ ID NO: 4185115 - RNA, 18 nt, Yersinia pestis KIM
acuauuuucauuguucuu

SEQ ID NO: 4185116 - RNA, 22 nt, Yersinia pestis KIM
acucaaaaauggcaacaucagg

SEQ ID NO: 4185117 - RNA, 12 nt, Yersinia pestis KIM
acucaaaacaau

SEQ ID NO: 4185118 - RNA, 15 nt, Yersinia pestis KIM
acucaaaauacuuaa

SEQ ID NO: 4185119 - RNA, 18 nt, Yersinia pestis KIM
acucaaauaaaccaauau

SEQ ID NO: 4185120 - RNA, 19 nt, Yersinia pestis KIM
acucaaauagauagcaauc

SEQ ID NO: 4185121 - RNA, 14 nt, Yersinia pestis KIM
acucaaauuauuuu

SEQ ID NO: 4185122 - RNA, 18 nt, Yersinia pestis KIM
acucaaccccagccggug

SEQ ID NO: 4185123 - RNA, 13 nt, Yersinia pestis KIM
acucaagccucua

SEQ ID NO: 4185124 - RNA, 17 nt, Yersinia pestis KIM
acucaagcguacaucag

SEQ ID NO: 4185125 - RNA, 18 nt, Yersinia pestis KIM
acucaaugcuuaacagcc

SEQ ID NO: 4185126 - RNA, 23 nt, Yersinia pestis KIM
acucaaugucaugcaauuacugc

SEQ ID NO: 4185127 - RNA, 14 nt, Yersinia pestis KIM
acucacaacccgcu

SEQ ID NO: 4185128 - RNA, 18 nt, Yersinia pestis KIM
acucacacagccagccuu

SEQ ID NO: 4185129 - RNA, 16 nt, Yersinia pestis KIM
acucaccuaaaucaua

SEQ ID NO: 4185130 - RNA, 18 nt, Yersinia pestis KIM
acucaccuaaaucauaca

SEQ ID NO: 4185131 - RNA, 16 nt, Yersinia pestis KIM
acucacguauuuucau

SEQ ID NO: 4185132 - RNA, 18 nt, Yersinia pestis KIM
acucacucuucgcaaaau

SEQ ID NO: 4185133 - RNA, 20 nt, Yersinia pestis KIM
acucacuuaagccacaaacc

SEQ ID NO: 4185134 - RNA, 14 nt, Yersinia pestis KIM
acucagaaaacagc

SEQ ID NO: 4185135 - RNA, 15 nt, Yersinia pestis KIM
acucagacaaucaug

SEQ ID NO: 4185136 - RNA, 15 nt, Yersinia pestis KIM
acucagcauccuccu

SEQ ID NO: 4185137 - RNA, 20 nt, Yersinia pestis KIM
acucagcgacuccuggcaau

SEQ ID NO: 4185138 - RNA, 14 nt, Yersinia pestis KIM
acucagucaucgcu

SEQ ID NO: 4185139 - RNA, 15 nt, Yersinia pestis KIM
acucauauuguccaa

SEQ ID NO: 4185140 - RNA, 17 nt, Yersinia pestis KIM
acucauauuguccaaag

SEQ ID NO: 4185141 - RNA, 13 nt, Yersinia pestis KIM
acucaucaaaaca

SEQ ID NO: 4185142 - RNA, 14 nt, Yersinia pestis KIM
acucaucaaaacaa

SEQ ID NO: 4185143 - RNA, 15 nt, Yersinia pestis KIM
acucaucaaaacaau

SEQ ID NO: 4185144 - RNA, 16 nt, Yersinia pestis KIM
acucaugacaucccag

SEQ ID NO: 4185145 - RNA, 12 nt, Yersinia pestis KIM
acucauuuuuug

SEQ ID NO: 4185146 - RNA, 17 nt, Yersinia pestis KIM
acucauuuuuugcguau

SEQ ID NO: 4185147 - RNA, 17 nt, Yersinia pestis KIM
acuccaucgccacuucu

SEQ ID NO: 4185148 - RNA, 20 nt, Yersinia pestis KIM
acuccaucgccacuucuaac

SEQ ID NO: 4185149 - RNA, 15 nt, Yersinia pestis KIM
acuccauuaauuuau

SEQ ID NO: 4185150 - RNA, 14 nt, Yersinia pestis KIM
acucccauucgcgc

SEQ ID NO: 4185151 - RNA, 18 nt, Yersinia pestis KIM
acucccauucgcgcccca

SEQ ID NO: 4185152 - RNA, 20 nt, Yersinia pestis KIM
acucccccauuuccuguguu

SEQ ID NO: 4185153 - RNA, 18 nt, Yersinia pestis KIM
acuccccgucagcaucau

SEQ ID NO: 4185154 - RNA, 23 nt, Yersinia pestis KIM
acucccugacucccugacucccu

SEQ ID NO: 4185155 - RNA, 13 nt, Yersinia pestis KIM
acucccuguuacg

SEQ ID NO: 4185156 - RNA, 18 nt, Yersinia pestis KIM
acucccuuguugccuuuc

SEQ ID NO: 4185157 - RNA, 18 nt, Yersinia pestis KIM
acuccggcaucauccuca

SEQ ID NO: 4185158 - RNA, 13 nt, Yersinia pestis KIM
acuccucugccua

SEQ ID NO: 4185159 - RNA, 15 nt, Yersinia pestis KIM
acuccucugccuauc

SEQ ID NO: 4185160 - RNA, 16 nt, Yersinia pestis KIM
acuccucugccuaucc

SEQ ID NO: 4185161 - RNA, 13 nt, Yersinia pestis KIM
acuccucuucuuc

SEQ ID NO: 4185162 - RNA, 21 nt, Yersinia pestis KIM
acuccucuucuucgauuuuag

SEQ ID NO: 4185163 - RNA, 18 nt, Yersinia pestis KIM
acuccucuuucuuaauaa

SEQ ID NO: 4185164 - RNA, 19 nt, Yersinia pestis KIM
acuccucuuucuuaauaau

SEQ ID NO: 4185165 - RNA, 22 nt, Yersinia pestis KIM
acuccucuuucuuaauaauauc

SEQ ID NO: 4185166 - RNA, 15 nt, Yersinia pestis KIM
acuccugaaauaaag

SEQ ID NO: 4185167 - RNA, 15 nt, Yersinia pestis KIM
acuccuuagucggca

SEQ ID NO: 4185168 - RNA, 22 nt, Yersinia pestis KIM
acuccuuggaacuuacucccuu

SEQ ID NO: 4185169 - RNA, 21 nt, Yersinia pestis KIM
acuccuuuguuauuucuggga

SEQ ID NO: 4185170 - RNA, 13 nt, Yersinia pestis KIM
acucgaauuauuu

SEQ ID NO: 4185171 - RNA, 14 nt, Yersinia pestis KIM
acucgagcauuuga

SEQ ID NO: 4185172 - RNA, 12 nt, Yersinia pestis KIM
acucgauaguga

SEQ ID NO: 4185173 - RNA, 16 nt, Yersinia pestis KIM
acucgaucuugaacgg

SEQ ID NO: 4185174 - RNA, 20 nt, Yersinia pestis KIM
acucgaugacguaauuuuaa

SEQ ID NO: 4185175 - RNA, 22 nt, Yersinia pestis KIM
acucgccaacagagugaaucgc

SEQ ID NO: 4185176 - RNA, 18 nt, Yersinia pestis KIM
acucgcgacuacagaaaa

SEQ ID NO: 4185177 - RNA, 12 nt, Yersinia pestis KIM
acucgcuccgag

SEQ ID NO: 4185178 - RNA, 21 nt, Yersinia pestis KIM
acucggcaaaggcuucggcca

SEQ ID NO: 4185179 - RNA, 22 nt, Yersinia pestis KIM
acucggcgguuugagccaccgc

SEQ ID NO: 4185180 - RNA, 16 nt, Yersinia pestis KIM
acucgguccaucugaa

SEQ ID NO: 4185181 - RNA, 15 nt, Yersinia pestis KIM
acucguauaaaaaau

SEQ ID NO: 4185182 - RNA, 23 nt, Yersinia pestis KIM
acucuaaggguaaaauccccauu

SEQ ID NO: 4185183 - RNA, 22 nt, Yersinia pestis KIM
acucuacauugacuaauuaaua

SEQ ID NO: 4185184 - RNA, 16 nt, Yersinia pestis KIM
acucuagcgccagcaa

SEQ ID NO: 4185185 - RNA, 17 nt, Yersinia pestis KIM
acucuagcgccagcaau

SEQ ID NO: 4185186 - RNA, 18 nt, Yersinia pestis KIM
acucuagcuguguuuuau

SEQ ID NO: 4185187 - RNA, 17 nt, Yersinia pestis KIM
acucuauuuucguaucc

SEQ ID NO: 4185188 - RNA, 13 nt, Yersinia pestis KIM
acucucaagccca

SEQ ID NO: 4185189 - RNA, 19 nt, Yersinia pestis KIM
acucucuucaucagucacu

SEQ ID NO: 4185190 - RNA, 18 nt, Yersinia pestis KIM
acucugccagauagucau

SEQ ID NO: 4185191 - RNA, 21 nt, Yersinia pestis KIM
acucugccagauagucaucuu

SEQ ID NO: 4185192 - RNA, 22 nt, Yersinia pestis KIM
acucugccagauagucaucuuu

SEQ ID NO: 4185193 - RNA, 18 nt, Yersinia pestis KIM
acucuggaauuaaaguau

SEQ ID NO: 4185194 - RNA, 23 nt, Yersinia pestis KIM
acucugggccgugaguuuucgau

SEQ ID NO: 4185195 - RNA, 23 nt, Yersinia pestis KIM
acucuggggcaaucaauguauug

SEQ ID NO: 4185196 - RNA, 20 nt, Yersinia pestis KIM
acucugguccagaucggcaa

SEQ ID NO: 4185197 - RNA, 14 nt, Yersinia pestis KIM
acucuguaccgccc

SEQ ID NO: 4185198 - RNA, 15 nt, Yersinia pestis KIM
acucuguaccgcccg

SEQ ID NO: 4185199 - RNA, 21 nt, Yersinia pestis KIM
acucugucugcuguugccaca

SEQ ID NO: 4185200 - RNA, 13 nt, Yersinia pestis KIM
acucuucagccua

SEQ ID NO: 4185201 - RNA, 18 nt, Yersinia pestis KIM
acucuucgcaaaauuuau

SEQ ID NO: 4185202 - RNA, 16 nt, Yersinia pestis KIM
acucuucggccuauca

SEQ ID NO: 4185203 - RNA, 19 nt, Yersinia pestis KIM
acucuucggccuaucauca

SEQ ID NO: 4185204 - RNA, 22 nt, Yersinia pestis KIM
acucuucuguauaugaagauaa

SEQ ID NO: 4185205 - RNA, 22 nt, Yersinia pestis KIM
acucuuugggggcagugacuga

SEQ ID NO: 4185206 - RNA, 12 nt, Yersinia pestis KIM
acucuuuguuac

SEQ ID NO: 4185207 - RNA, 18 nt, Yersinia pestis KIM
acugaaacggugaggaua

SEQ ID NO: 4185208 - RNA, 16 nt, Yersinia pestis KIM
acugaaacguucuucc

SEQ ID NO: 4185209 - RNA, 23 nt, Yersinia pestis KIM
acugaaaucauagcuaaaugaca

SEQ ID NO: 4185210 - RNA, 17 nt, Yersinia pestis KIM
acugaacgccgaccuga

SEQ ID NO: 4185211 - RNA, 13 nt, Yersinia pestis KIM
acugaacugaacu

SEQ ID NO: 4185212 - RNA, 15 nt, Yersinia pestis KIM
acugaacugaacuga

SEQ ID NO: 4185213 - RNA, 17 nt, Yersinia pestis KIM
acugaaucccagaaccu

SEQ ID NO: 4185214 - RNA, 20 nt, Yersinia pestis KIM
acugaaucccagaaccucaa

SEQ ID NO: 4185215 - RNA, 21 nt, Yersinia pestis KIM
acugaaucccagaaccucaac

SEQ ID NO: 4185216 - RNA, 13 nt, Yersinia pestis KIM
acugaaugugaag

SEQ ID NO: 4185217 - RNA, 17 nt, Yersinia pestis KIM
acugaaugugaagagcg

SEQ ID NO: 4185218 - RNA, 16 nt, Yersinia pestis KIM
acugacaacaucaaau

SEQ ID NO: 4185219 - RNA, 19 nt, Yersinia pestis KIM
acugacaacaucaaaugaa

SEQ ID NO: 4185220 - RNA, 17 nt, Yersinia pestis KIM
acugacaaguuuuuaag

SEQ ID NO: 4185221 - RNA, 15 nt, Yersinia pestis KIM
acugacagcggucgg

SEQ ID NO: 4185222 - RNA, 17 nt, Yersinia pestis KIM
acugacagcggucggua

SEQ ID NO: 4185223 - RNA, 17 nt, Yersinia pestis KIM
acugaccauaaaaggau

SEQ ID NO: 4185224 - RNA, 12 nt, Yersinia pestis KIM
acugaccuauug

SEQ ID NO: 4185225 - RNA, 19 nt, Yersinia pestis KIM
acugacgauuguccaggcu

SEQ ID NO: 4185226 - RNA, 20 nt, Yersinia pestis KIM
acugacgauuguccaggcua

SEQ ID NO: 4185227 - RNA, 18 nt, Yersinia pestis KIM
acugacggcagacaacca

SEQ ID NO: 4185228 - RNA, 13 nt, Yersinia pestis KIM
acugacugaaguu

SEQ ID NO: 4185229 - RNA, 20 nt, Yersinia pestis KIM
acugagaccuuccauaacuc

SEQ ID NO: 4185230 - RNA, 11 nt, Yersinia pestis KIM
acugagcaccg

SEQ ID NO: 4185231 - RNA, 13 nt, Yersinia pestis KIM
acugagcaccgca

SEQ ID NO: 4185232 - RNA, 19 nt, Yersinia pestis KIM
acugaggcaacauuuguug

SEQ ID NO: 4185233 - RNA, 13 nt, Yersinia pestis KIM
acugaguaugagc

SEQ ID NO: 4185234 - RNA, 15 nt, Yersinia pestis KIM
acugagucuugauau

SEQ ID NO: 4185235 - RNA, 18 nt, Yersinia pestis KIM
acugaguuggaaaugaca

SEQ ID NO: 4185236 - RNA, 18 nt, Yersinia pestis KIM
acugauaggucauauaca

SEQ ID NO: 4185237 - RNA, 17 nt, Yersinia pestis KIM
acugauaucuucacuca

SEQ ID NO: 4185238 - RNA, 20 nt, Yersinia pestis KIM
acugauaucuucacucagcg

SEQ ID NO: 4185239 - RNA, 19 nt, Yersinia pestis KIM
acugauaugggaacgucug

SEQ ID NO: 4185240 - RNA, 13 nt, Yersinia pestis KIM
acugaucaucaac

SEQ ID NO: 4185241 - RNA, 21 nt, Yersinia pestis KIM
acugaucaucaacgcgccuuu

SEQ ID NO: 4185242 - RNA, 22 nt, Yersinia pestis KIM
acugaugacgccguacaaauau

SEQ ID NO: 4185243 - RNA, 16 nt, Yersinia pestis KIM
acugaugagcuggcaa

SEQ ID NO: 4185244 - RNA, 13 nt, Yersinia pestis KIM
acugauguuuuag

SEQ ID NO: 4185245 - RNA, 20 nt, Yersinia pestis KIM
acugauuauuuggugaguaa

SEQ ID NO: 4185246 - RNA, 13 nt, Yersinia pestis KIM
acugauucagaaa

SEQ ID NO: 4185247 - RNA, 16 nt, Yersinia pestis KIM
acugauucagaaaggu

SEQ ID NO: 4185248 - RNA, 17 nt, Yersinia pestis KIM
acugauucucuucaccu

SEQ ID NO: 4185249 - RNA, 13 nt, Yersinia pestis KIM
acugauugaccau

SEQ ID NO: 4185250 - RNA, 16 nt, Yersinia pestis KIM
acugauugaccaucaa

SEQ ID NO: 4185251 - RNA, 16 nt, Yersinia pestis KIM
acugauuucaggaaug

SEQ ID NO: 4185252 - RNA, 22 nt, Yersinia pestis KIM
acugcaaauguucaacaagaaa

SEQ ID NO: 4185253 - RNA, 23 nt, Yersinia pestis KIM
acugcaaauguucaacaagaaau

SEQ ID NO: 4185254 - RNA, 21 nt, Yersinia pestis KIM
acugcaagccguaauucagau

SEQ ID NO: 4185255 - RNA, 17 nt, Yersinia pestis KIM
acugcauacggcaguuu

SEQ ID NO: 4185256 - RNA, 12 nt, Yersinia pestis KIM
acugcaugccau

SEQ ID NO: 4185257 - RNA, 21 nt, Yersinia pestis KIM
acugcauuaccuuuaaaacug

SEQ ID NO: 4185258 - RNA, 13 nt, Yersinia pestis KIM
acugcauugcguu

SEQ ID NO: 4185259 - RNA, 20 nt, Yersinia pestis KIM
acugccaaccaccaaagaua

SEQ ID NO: 4185260 - RNA, 13 nt, Yersinia pestis KIM
acugccaaucgcu

SEQ ID NO: 4185261 - RNA, 19 nt, Yersinia pestis KIM
acugccacugacugcuuuu

SEQ ID NO: 4185262 - RNA, 16 nt, Yersinia pestis KIM
acugccauaauccaga

SEQ ID NO: 4185263 - RNA, 19 nt, Yersinia pestis KIM
acugcccagguucaaaaua

SEQ ID NO: 4185264 - RNA, 15 nt, Yersinia pestis KIM
acugccccgaagcuc

SEQ ID NO: 4185265 - RNA, 20 nt, Yersinia pestis KIM
acugccccgaagcucaagcu

SEQ ID NO: 4185266 - RNA, 13 nt, Yersinia pestis KIM
acugcccgccugc

SEQ ID NO: 4185267 - RNA, 16 nt, Yersinia pestis KIM
acugccgucaaugccu

SEQ ID NO: 4185268 - RNA, 13 nt, Yersinia pestis KIM
acugccugcagca

SEQ ID NO: 4185269 - RNA, 20 nt, Yersinia pestis KIM
acugcggauugaaaggagaa

SEQ ID NO: 4185270 - RNA, 16 nt, Yersinia pestis KIM
acugcgguccuacccu

SEQ ID NO: 4185271 - RNA, 18 nt, Yersinia pestis KIM
acugcguccuuugcccau

SEQ ID NO: 4185272 - RNA, 18 nt, Yersinia pestis KIM
acugcuaauaccaccacc

SEQ ID NO: 4185273 - RNA, 14 nt, Yersinia pestis KIM
acugcucaacugcu

SEQ ID NO: 4185274 - RNA, 17 nt, Yersinia pestis KIM
acugcucaacugcucaa

SEQ ID NO: 4185275 - RNA, 20 nt, Yersinia pestis KIM
acugcucacuuuuauccagc

SEQ ID NO: 4185276 - RNA, 16 nt, Yersinia pestis KIM
acugcucgagccaauu

SEQ ID NO: 4185277 - RNA, 15 nt, Yersinia pestis KIM
acugcucuuucccuu

SEQ ID NO: 4185278 - RNA, 13 nt, Yersinia pestis KIM
acugcugacaacc

SEQ ID NO: 4185279 - RNA, 16 nt, Yersinia pestis KIM
acugcugcaacucauu

SEQ ID NO: 4185280 - RNA, 13 nt, Yersinia pestis KIM
acugcugcacugg

SEQ ID NO: 4185281 - RNA, 16 nt, Yersinia pestis KIM
acugcugugccagagu

SEQ ID NO: 4185282 - RNA, 21 nt, Yersinia pestis KIM
acugcugugugggcgggggaa

SEQ ID NO: 4185283 - RNA, 22 nt, Yersinia pestis KIM
acuggaagccgacgaucuugcc

SEQ ID NO: 4185284 - RNA, 15 nt, Yersinia pestis KIM
acuggauauuuuccc

SEQ ID NO: 4185285 - RNA, 16 nt, Yersinia pestis KIM
acuggauauuuuuaac

SEQ ID NO: 4185286 - RNA, 17 nt, Yersinia pestis KIM
acuggaugagccgcagc

SEQ ID NO: 4185287 - RNA, 13 nt, Yersinia pestis KIM
acuggauggccau

SEQ ID NO: 4185288 - RNA, 20 nt, Yersinia pestis KIM
acuggcaauaauucagauga

SEQ ID NO: 4185289 - RNA, 21 nt, Yersinia pestis KIM
acuggcggggcaaauaggccg

SEQ ID NO: 4185290 - RNA, 20 nt, Yersinia pestis KIM
acuggcuagauagccauaau

SEQ ID NO: 4185291 - RNA, 20 nt, Yersinia pestis KIM
acuggcucaucgccgccauc

SEQ ID NO: 4185292 - RNA, 13 nt, Yersinia pestis KIM
acuggcugaaguu

SEQ ID NO: 4185293 - RNA, 14 nt, Yersinia pestis KIM
acuggcugaaguua

SEQ ID NO: 4185294 - RNA, 19 nt, Yersinia pestis KIM
acuggcugccuaccugcaa

SEQ ID NO: 4185295 - RNA, 15 nt, Yersinia pestis KIM
acuggcuuuauuaua

SEQ ID NO: 4185296 - RNA, 21 nt, Yersinia pestis KIM
acugggucaucacccagcaaa

SEQ ID NO: 4185297 - RNA, 18 nt, Yersinia pestis KIM
acuggguggccaguaacg

SEQ ID NO: 4185298 - RNA, 18 nt, Yersinia pestis KIM
acugguaauaaugcuguc

SEQ ID NO: 4185299 - RNA, 19 nt, Yersinia pestis KIM
acugguaccaaauaacaac

SEQ ID NO: 4185300 - RNA, 22 nt, Yersinia pestis KIM
acugguccaacuaaacagggca

SEQ ID NO: 4185301 - RNA, 13 nt, Yersinia pestis KIM
acugguugaaacc

SEQ ID NO: 4185302 - RNA, 14 nt, Yersinia pestis KIM
acugguugaaaccu

SEQ ID NO: 4185303 - RNA, 15 nt, Yersinia pestis KIM
acugguugaaaccuc

SEQ ID NO: 4185304 - RNA, 13 nt, Yersinia pestis KIM
acuguaaaaucuu

SEQ ID NO: 4185305 - RNA, 21 nt, Yersinia pestis KIM
acuguaaacuuguuuauauua

SEQ ID NO: 4185306 - RNA, 20 nt, Yersinia pestis KIM
acuguacugggaugaagaaa

SEQ ID NO: 4185307 - RNA, 19 nt, Yersinia pestis KIM
acugucaaucgaugagcug

SEQ ID NO: 4185308 - RNA, 20 nt, Yersinia pestis KIM
acugucaaucgaugagcugg

SEQ ID NO: 4185309 - RNA, 17 nt, Yersinia pestis KIM
acugucagucaaaagaa

SEQ ID NO: 4185310 - RNA, 13 nt, Yersinia pestis KIM
acugucauugcug

SEQ ID NO: 4185311 - RNA, 18 nt, Yersinia pestis KIM
acugucauugcuguuguu

SEQ ID NO: 4185312 - RNA, 14 nt, Yersinia pestis KIM
acuguccaagaagc

SEQ ID NO: 4185313 - RNA, 17 nt, Yersinia pestis KIM
acugucgcauaagacaa

SEQ ID NO: 4185314 - RNA, 20 nt, Yersinia pestis KIM
acugucuauuuuuauaauca

SEQ ID NO: 4185315 - RNA, 13 nt, Yersinia pestis KIM
acugucugagcaa

SEQ ID NO: 4185316 - RNA, 22 nt, Yersinia pestis KIM
acugugauaaaccccaugguga

SEQ ID NO: 4185317 - RNA, 22 nt, Yersinia pestis KIM
acugugauaaccaacaguuauu

SEQ ID NO: 4185318 - RNA, 12 nt, Yersinia pestis KIM
acugugccaacc

SEQ ID NO: 4185319 - RNA, 19 nt, Yersinia pestis KIM
acuguggcugcucugcucc

SEQ ID NO: 4185320 - RNA, 14 nt, Yersinia pestis KIM
acuguguuaaucag

SEQ ID NO: 4185321 - RNA, 17 nt, Yersinia pestis KIM
acuguguuuauaccaaa

SEQ ID NO: 4185322 - RNA, 14 nt, Yersinia pestis KIM
acuguuaaaacagg

SEQ ID NO: 4185323 - RNA, 22 nt, Yersinia pestis KIM
acuguuaacucgccaacagagu

SEQ ID NO: 4185324 - RNA, 15 nt, Yersinia pestis KIM
acuguucaccgccuu

SEQ ID NO: 4185325 - RNA, 14 nt, Yersinia pestis KIM
acuguucuugaugg

SEQ ID NO: 4185326 - RNA, 20 nt, Yersinia pestis KIM
acuguuuuaugacugauacc

SEQ ID NO: 4185327 - RNA, 14 nt, Yersinia pestis KIM
acuguuuuauuaua

SEQ ID NO: 4185328 - RNA, 16 nt, Yersinia pestis KIM
acuguuuuauuauaua

SEQ ID NO: 4185329 - RNA, 14 nt, Yersinia pestis KIM
acuuaaaaaucaaa

SEQ ID NO: 4185330 - RNA, 19 nt, Yersinia pestis KIM
acuuaaaaaucaaaaguua

SEQ ID NO: 4185331 - RNA, 19 nt, Yersinia pestis KIM
acuuaaauaacucagugac

SEQ ID NO: 4185332 - RNA, 18 nt, Yersinia pestis KIM
acuuaacaaucagugcaa

SEQ ID NO: 4185333 - RNA, 17 nt, Yersinia pestis KIM
acuuaacgauaaaauca

SEQ ID NO: 4185334 - RNA, 21 nt, Yersinia pestis KIM
acuuaacgguaugacggguau

SEQ ID NO: 4185335 - RNA, 15 nt, Yersinia pestis KIM
acuuaacuacugcaa

SEQ ID NO: 4185336 - RNA, 22 nt, Yersinia pestis KIM
acuuaagcauuggcaaaucauc

SEQ ID NO: 4185337 - RNA, 16 nt, Yersinia pestis KIM
acuuaauuccaugcaa

SEQ ID NO: 4185338 - RNA, 15 nt, Yersinia pestis KIM
acuuaauuucaguca

SEQ ID NO: 4185339 - RNA, 19 nt, Yersinia pestis KIM
acuuacaggcugccugccu

SEQ ID NO: 4185340 - RNA, 23 nt, Yersinia pestis KIM
acuuaccccuugcgaucaauugg

SEQ ID NO: 4185341 - RNA, 22 nt, Yersinia pestis KIM
acuuacccuacccauuauaaau

SEQ ID NO: 4185342 - RNA, 18 nt, Yersinia pestis KIM
acuuaccuugauccgcca

SEQ ID NO: 4185343 - RNA, 14 nt, Yersinia pestis KIM
acuuacgucuuuaa

SEQ ID NO: 4185344 - RNA, 19 nt, Yersinia pestis KIM
acuuacucucuccgcaaug

SEQ ID NO: 4185345 - RNA, 16 nt, Yersinia pestis KIM
acuuagcucaaucggc

SEQ ID NO: 4185346 - RNA, 19 nt, Yersinia pestis KIM
acuuagugcuggccuaggc

SEQ ID NO: 4185347 - RNA, 13 nt, Yersinia pestis KIM
acuuauaaacacu

SEQ ID NO: 4185348 - RNA, 19 nt, Yersinia pestis KIM
acuuauaccgacuaucauc

SEQ ID NO: 4185349 - RNA, 17 nt, Yersinia pestis KIM
acuuauaucuccaccaa

SEQ ID NO: 4185350 - RNA, 21 nt, Yersinia pestis KIM
acuuaucgaccaacuggcaau

SEQ ID NO: 4185351 - RNA, 14 nt, Yersinia pestis KIM
acuuaucuaaaaaa

SEQ ID NO: 4185352 - RNA, 15 nt, Yersinia pestis KIM
acuuaucuaaaaaac

SEQ ID NO: 4185353 - RNA, 16 nt, Yersinia pestis KIM
acuuaucuaaaaaacc

SEQ ID NO: 4185354 - RNA, 17 nt, Yersinia pestis KIM
acuuaucuaaaaaacca

SEQ ID NO: 4185355 - RNA, 22 nt, Yersinia pestis KIM
acuuaugaugugauuauuuugu

SEQ ID NO: 4185356 - RNA, 12 nt, Yersinia pestis KIM
acuuauggguuu

SEQ ID NO: 4185357 - RNA, 14 nt, Yersinia pestis KIM
acuuauggguuuuu

SEQ ID NO: 4185358 - RNA, 20 nt, Yersinia pestis KIM
acuuauuacaccuuaaaaca

SEQ ID NO: 4185359 - RNA, 16 nt, Yersinia pestis KIM
acuuauuggaaguacu

SEQ ID NO: 4185360 - RNA, 12 nt, Yersinia pestis KIM
acuuauuugaaa

SEQ ID NO: 4185361 - RNA, 15 nt, Yersinia pestis KIM
acuuauuugaaacac

SEQ ID NO: 4185362 - RNA, 16 nt, Yersinia pestis KIM
acuuauuugaaacacu

SEQ ID NO: 4185363 - RNA, 15 nt, Yersinia pestis KIM
acuucaaaucgccaa

SEQ ID NO: 4185364 - RNA, 13 nt, Yersinia pestis KIM
acuucaauaccaa

SEQ ID NO: 4185365 - RNA, 19 nt, Yersinia pestis KIM
acuucaauaccaaauuuac

SEQ ID NO: 4185366 - RNA, 21 nt, Yersinia pestis KIM
acuucaauuuggccauuaacc

SEQ ID NO: 4185367 - RNA, 24 nt, Yersinia pestis KIM
acuucaauuuggccauuaaccuaa

SEQ ID NO: 4185368 - RNA, 21 nt, Yersinia pestis KIM
acuucacucgcgacuacagaa

SEQ ID NO: 4185369 - RNA, 12 nt, Yersinia pestis KIM
acuucaggccaa

SEQ ID NO: 4185370 - RNA, 20 nt, Yersinia pestis KIM
acuucaggccaauagcccaa

SEQ ID NO: 4185371 - RNA, 16 nt, Yersinia pestis KIM
acuucaguuacucacu

SEQ ID NO: 4185372 - RNA, 12 nt, Yersinia pestis KIM
acuucauaaaua

SEQ ID NO: 4185373 - RNA, 19 nt, Yersinia pestis KIM
acuucaugacuaccuugcu

SEQ ID NO: 4185374 - RNA, 18 nt, Yersinia pestis KIM
acuuccacggccagccug

SEQ ID NO: 4185375 - RNA, 16 nt, Yersinia pestis KIM
acuuccauaaacggaa

SEQ ID NO: 4185376 - RNA, 20 nt, Yersinia pestis KIM
acuuccgccgccaacaguga

SEQ ID NO: 4185377 - RNA, 13 nt, Yersinia pestis KIM
acuuccuuugccc

SEQ ID NO: 4185378 - RNA, 15 nt, Yersinia pestis KIM
acuucgaaagaaaua

SEQ ID NO: 4185379 - RNA, 22 nt, Yersinia pestis KIM
acuucgaaagaaauaaaagaaa

SEQ ID NO: 4185380 - RNA, 19 nt, Yersinia pestis KIM
acuucgauacuacaaucau

SEQ ID NO: 4185381 - RNA, 16 nt, Yersinia pestis KIM
acuucgaugauuauuu

SEQ ID NO: 4185382 - RNA, 21 nt, Yersinia pestis KIM
acuucgccaggucaggaagag

SEQ ID NO: 4185383 - RNA, 17 nt, Yersinia pestis KIM
acuucgccgggucagga

SEQ ID NO: 4185384 - RNA, 18 nt, Yersinia pestis KIM
acuucgccuuaucagcga

SEQ ID NO: 4185385 - RNA, 16 nt, Yersinia pestis KIM
acuucgcugcuaaaca

SEQ ID NO: 4185386 - RNA, 21 nt, Yersinia pestis KIM
acuucggauuaccggcacugg

SEQ ID NO: 4185387 - RNA, 20 nt, Yersinia pestis KIM
acuucggggcguaaaugaug

SEQ ID NO: 4185388 - RNA, 16 nt, Yersinia pestis KIM
acuucguagugacugg

SEQ ID NO: 4185389 - RNA, 13 nt, Yersinia pestis KIM
acuucgucugccc

SEQ ID NO: 4185390 - RNA, 21 nt, Yersinia pestis KIM
acuucuccuguauuugguuau

SEQ ID NO: 4185391 - RNA, 19 nt, Yersinia pestis KIM
acuucuuauuaaucaagau

SEQ ID NO: 4185392 - RNA, 16 nt, Yersinia pestis KIM
acuugagcacauagca

SEQ ID NO: 4185393 - RNA, 19 nt, Yersinia pestis KIM
acuugauuaacaucgccac

SEQ ID NO: 4185394 - RNA, 14 nt, Yersinia pestis KIM
acuugauucaccag

SEQ ID NO: 4185395 - RNA, 16 nt, Yersinia pestis KIM
acuugcaacauuaucc

SEQ ID NO: 4185396 - RNA, 22 nt, Yersinia pestis KIM
acuugcaauucauguugccaau

SEQ ID NO: 4185397 - RNA, 20 nt, Yersinia pestis KIM
acuugcaguggccucgaaga

SEQ ID NO: 4185398 - RNA, 18 nt, Yersinia pestis KIM
acuugccacaacugaaug

SEQ ID NO: 4185399 - RNA, 15 nt, Yersinia pestis KIM
acuugcccaauggca

SEQ ID NO: 4185400 - RNA, 15 nt, Yersinia pestis KIM
acuugcccugagugu

SEQ ID NO: 4185401 - RNA, 15 nt, Yersinia pestis KIM
acuugcugaugccca

SEQ ID NO: 4185402 - RNA, 22 nt, Yersinia pestis KIM
acuuggauacguucaacgaccu

SEQ ID NO: 4185403 - RNA, 18 nt, Yersinia pestis KIM
acuuggcuaauugucaca

SEQ ID NO: 4185404 - RNA, 16 nt, Yersinia pestis KIM
acuugggggaagggcu

SEQ ID NO: 4185405 - RNA, 16 nt, Yersinia pestis KIM
acuugguuuaaauucu

SEQ ID NO: 4185406 - RNA, 18 nt, Yersinia pestis KIM
acuuguaccugugccagu

SEQ ID NO: 4185407 - RNA, 14 nt, Yersinia pestis KIM
acuuguucagagau

SEQ ID NO: 4185408 - RNA, 19 nt, Yersinia pestis KIM
acuuguucagagauaauca

SEQ ID NO: 4185409 - RNA, 18 nt, Yersinia pestis KIM
acuuguucauccuguacc

SEQ ID NO: 4185410 - RNA, 23 nt, Yersinia pestis KIM
acuuuaaaaaaauuaucaucaau

SEQ ID NO: 4185411 - RNA, 12 nt, Yersinia pestis KIM
acuuuaaauacc

SEQ ID NO: 4185412 - RNA, 17 nt, Yersinia pestis KIM
acuuuaagcugcagagg

SEQ ID NO: 4185413 - RNA, 16 nt, Yersinia pestis KIM
acuuuacauauaggaa

SEQ ID NO: 4185414 - RNA, 16 nt, Yersinia pestis KIM
acuuuaccgauuucag

SEQ ID NO: 4185415 - RNA, 13 nt, Yersinia pestis KIM
acuuuacucuuca

SEQ ID NO: 4185416 - RNA, 15 nt, Yersinia pestis KIM
acuuuaucugccaaa

SEQ ID NO: 4185417 - RNA, 22 nt, Yersinia pestis KIM
acuuuaucugccaaauauugca

SEQ ID NO: 4185418 - RNA, 18 nt, Yersinia pestis KIM
acuuuauucacagcagaa

SEQ ID NO: 4185419 - RNA, 22 nt, Yersinia pestis KIM
acuuuauucacagcagaacaaa

SEQ ID NO: 4185420 - RNA, 19 nt, Yersinia pestis KIM
acuuuauugacuguaaaua

SEQ ID NO: 4185421 - RNA, 21 nt, Yersinia pestis KIM
acuuucccauagcuggcuuca

SEQ ID NO: 4185422 - RNA, 16 nt, Yersinia pestis KIM
acuuuccccagaugaa

SEQ ID NO: 4185423 - RNA, 14 nt, Yersinia pestis KIM
acuuucuacggcau

SEQ ID NO: 4185424 - RNA, 12 nt, Yersinia pestis KIM
acuuugaaauua

SEQ ID NO: 4185425 - RNA, 20 nt, Yersinia pestis KIM
acuuugacuuaaauaguucu

SEQ ID NO: 4185426 - RNA, 18 nt, Yersinia pestis KIM
acuuugaugccaaggccg

SEQ ID NO: 4185427 - RNA, 21 nt, Yersinia pestis KIM
acuuugcuaaccuauagcaau

SEQ ID NO: 4185428 - RNA, 13 nt, Yersinia pestis KIM
acuuugcucuaau

SEQ ID NO: 4185429 - RNA, 15 nt, Yersinia pestis KIM
acuuuggguauauga

SEQ ID NO: 4185430 - RNA, 22 nt, Yersinia pestis KIM
acuuuggguuaucccuaccaaa

SEQ ID NO: 4185431 - RNA, 20 nt, Yersinia pestis KIM
acuuuguacccgagccgcac

SEQ ID NO: 4185432 - RNA, 20 nt, Yersinia pestis KIM
acuuuguauuuugcacaaag

SEQ ID NO: 4185433 - RNA, 19 nt, Yersinia pestis KIM
acuuugucaauaaccucag

SEQ ID NO: 4185434 - RNA, 20 nt, Yersinia pestis KIM
acuuuuacgggccuuuuaau

SEQ ID NO: 4185435 - RNA, 20 nt, Yersinia pestis KIM
acuuuuauaccgcagcauaa

SEQ ID NO: 4185436 - RNA, 23 nt, Yersinia pestis KIM
acuuuuauauccgccauccuuca

SEQ ID NO: 4185437 - RNA, 16 nt, Yersinia pestis KIM
acuuuucaguuuuaau

SEQ ID NO: 4185438 - RNA, 21 nt, Yersinia pestis KIM
acuuuucaucgcauaggccaa

SEQ ID NO: 4185439 - RNA, 18 nt, Yersinia pestis KIM
acuuuucuucauugcugc

SEQ ID NO: 4185440 - RNA, 19 nt, Yersinia pestis KIM
acuuuuuaucuaaacagua

SEQ ID NO: 4185441 - RNA, 15 nt, Yersinia pestis KIM
acuuuuucucuccua

SEQ ID NO: 4185442 - RNA, 11 nt, Yersinia pestis KIM
acuuuuuguga

SEQ ID NO: 4185443 - RNA, 15 nt, Yersinia pestis KIM
agaaaaacacuggca

SEQ ID NO: 4185444 - RNA, 17 nt, Yersinia pestis KIM
agaaaaacacuggcagc

SEQ ID NO: 4185445 - RNA, 18 nt, Yersinia pestis KIM
agaaaaccuucagcaaag

SEQ ID NO: 4185446 - RNA, 19 nt, Yersinia pestis KIM
agaaaaccuucagcaaaga

SEQ ID NO: 4185447 - RNA, 20 nt, Yersinia pestis KIM
agaaaaccuucagcaaagag

SEQ ID NO: 4185448 - RNA, 19 nt, Yersinia pestis KIM
agaaaaccuugacucuuca

SEQ ID NO: 4185449 - RNA, 13 nt, Yersinia pestis KIM
agaaaagcagacu

SEQ ID NO: 4185450 - RNA, 18 nt, Yersinia pestis KIM
agaaaagcgaaucuggua

SEQ ID NO: 4185451 - RNA, 16 nt, Yersinia pestis KIM
agaaaagguauauuuu

SEQ ID NO: 4185452 - RNA, 14 nt, Yersinia pestis KIM
agaaaauaauaucg

SEQ ID NO: 4185453 - RNA, 12 nt, Yersinia pestis KIM
agaaaauacugu

SEQ ID NO: 4185454 - RNA, 22 nt, Yersinia pestis KIM
agaaaauacugucgauuugugg

SEQ ID NO: 4185455 - RNA, 17 nt, Yersinia pestis KIM
agaaaaucaggauaucu

SEQ ID NO: 4185456 - RNA, 16 nt, Yersinia pestis KIM
agaaacauuaaaccca

SEQ ID NO: 4185457 - RNA, 16 nt, Yersinia pestis KIM
agaaacccauagcaaa

SEQ ID NO: 4185458 - RNA, 20 nt, Yersinia pestis KIM
agaaacgccccgauaaacca

SEQ ID NO: 4185459 - RNA, 15 nt, Yersinia pestis KIM
agaaacggcuauuuu

SEQ ID NO: 4185460 - RNA, 20 nt, Yersinia pestis KIM
agaaacggugaaaauaccca

SEQ ID NO: 4185461 - RNA, 19 nt, Yersinia pestis KIM
agaaacugugauaaccaac

SEQ ID NO: 4185462 - RNA, 15 nt, Yersinia pestis KIM
agaaacuucauuuca

SEQ ID NO: 4185463 - RNA, 18 nt, Yersinia pestis KIM
agaaacuuugcuuugacu

SEQ ID NO: 4185464 - RNA, 14 nt, Yersinia pestis KIM
agaaagcagcagcu

SEQ ID NO: 4185465 - RNA, 14 nt, Yersinia pestis KIM
agaaagccagguga

SEQ ID NO: 4185466 - RNA, 16 nt, Yersinia pestis KIM
agaaagccggaaaaga

SEQ ID NO: 4185467 - RNA, 23 nt, Yersinia pestis KIM
agaaaggcggauaaucuaggccu

SEQ ID NO: 4185468 - RNA, 21 nt, Yersinia pestis KIM
agaaagguaugugccaaaaaa

SEQ ID NO: 4185469 - RNA, 20 nt, Yersinia pestis KIM
agaaaguugauccuggguuu

SEQ ID NO: 4185470 - RNA, 13 nt, Yersinia pestis KIM
agaaauaaauuca

SEQ ID NO: 4185471 - RNA, 15 nt, Yersinia pestis KIM
agaaauaaguugaac

SEQ ID NO: 4185472 - RNA, 16 nt, Yersinia pestis KIM
agaaauaauaucaagu

SEQ ID NO: 4185473 - RNA, 15 nt, Yersinia pestis KIM
agaaauaaucauauc

SEQ ID NO: 4185474 - RNA, 13 nt, Yersinia pestis KIM
agaaauacccccc

SEQ ID NO: 4185475 - RNA, 13 nt, Yersinia pestis KIM
agaaauagcacca

SEQ ID NO: 4185476 - RNA, 21 nt, Yersinia pestis KIM
agaaaucgccccuuuuuuguu

SEQ ID NO: 4185477 - RNA, 21 nt, Yersinia pestis KIM
agaaauucaacuugccugaaa

SEQ ID NO: 4185478 - RNA, 23 nt, Yersinia pestis KIM
agaaauucauaccuuaauuaacu

SEQ ID NO: 4185479 - RNA, 20 nt, Yersinia pestis KIM
agaacaacccauuuccuuau

SEQ ID NO: 4185480 - RNA, 23 nt, Yersinia pestis KIM
agaacaagacugcuaauaccacc

SEQ ID NO: 4185481 - RNA, 21 nt, Yersinia pestis KIM
agaacaccaacaccacacuga

SEQ ID NO: 4185482 - RNA, 15 nt, Yersinia pestis KIM
agaacagcuuugcuu

SEQ ID NO: 4185483 - RNA, 12 nt, Yersinia pestis KIM
agaacaggcaga

SEQ ID NO: 4185484 - RNA, 13 nt, Yersinia pestis KIM
agaacaggcagca

SEQ ID NO: 4185485 - RNA, 21 nt, Yersinia pestis KIM
agaacagguuuuuuccccaug

SEQ ID NO: 4185486 - RNA, 21 nt, Yersinia pestis KIM
agaaccaguucugguagcugc

SEQ ID NO: 4185487 - RNA, 20 nt, Yersinia pestis KIM
agaacccccgcgaacagcag

SEQ ID NO: 4185488 - RNA, 21 nt, Yersinia pestis KIM
agaacccccgcgaacagcaga

SEQ ID NO: 4185489 - RNA, 22 nt, Yersinia pestis KIM
agaacccccgcgaacagcagaa

SEQ ID NO: 4185490 - RNA, 22 nt, Yersinia pestis KIM
agaaccgacaagcgcugcgcca

SEQ ID NO: 4185491 - RNA, 17 nt, Yersinia pestis KIM
agaaccuguuacaucag

SEQ ID NO: 4185492 - RNA, 15 nt, Yersinia pestis KIM
agaaccuuguuuuac

SEQ ID NO: 4185493 - RNA, 23 nt, Yersinia pestis KIM
agaacgaacgaagcgugaaagca

SEQ ID NO: 4185494 - RNA, 16 nt, Yersinia pestis KIM
agaacggccugccaga

SEQ ID NO: 4185495 - RNA, 23 nt, Yersinia pestis KIM
agaacggccugccagaacagcag

SEQ ID NO: 4185496 - RNA, 16 nt, Yersinia pestis KIM
agaacgggggauuaaa

SEQ ID NO: 4185497 - RNA, 20 nt, Yersinia pestis KIM
agaacuaauaucaacagaac

SEQ ID NO: 4185498 - RNA, 12 nt, Yersinia pestis KIM
agaacuggcugg

SEQ ID NO: 4185499 - RNA, 18 nt, Yersinia pestis KIM
agaagaaaucauuuaggc

SEQ ID NO: 4185500 - RNA, 20 nt, Yersinia pestis KIM
agaagacaauaaaucgccac

SEQ ID NO: 4185501 - RNA, 18 nt, Yersinia pestis KIM
agaagacauaucuugaac

SEQ ID NO: 4185502 - RNA, 19 nt, Yersinia pestis KIM
agaagacgaguaaugaaau

SEQ ID NO: 4185503 - RNA, 22 nt, Yersinia pestis KIM
agaagccauuagccccaaaugc

SEQ ID NO: 4185504 - RNA, 17 nt, Yersinia pestis KIM
agaagccucaugaauga

SEQ ID NO: 4185505 - RNA, 18 nt, Yersinia pestis KIM
agaagccucaugaaugag

SEQ ID NO: 4185506 - RNA, 19 nt, Yersinia pestis KIM
agaagccucaugaaugagg

SEQ ID NO: 4185507 - RNA, 16 nt, Yersinia pestis KIM
agaagcgcacaucggu

SEQ ID NO: 4185508 - RNA, 21 nt, Yersinia pestis KIM
agaagcguaaagcacccacac

SEQ ID NO: 4185509 - RNA, 22 nt, Yersinia pestis KIM
agaagcucauaugcagcaucca

SEQ ID NO: 4185510 - RNA, 15 nt, Yersinia pestis KIM
agaaggauugaccaa

SEQ ID NO: 4185511 - RNA, 21 nt, Yersinia pestis KIM
agaaggauugaccaauaaaau

SEQ ID NO: 4185512 - RNA, 23 nt, Yersinia pestis KIM
agaagggcggccagcaagagcag

SEQ ID NO: 4185513 - RNA, 14 nt, Yersinia pestis KIM
agaagguuaaauuu

SEQ ID NO: 4185514 - RNA, 14 nt, Yersinia pestis KIM
agaaguagaaugag

SEQ ID NO: 4185515 - RNA, 15 nt, Yersinia pestis KIM
agaaguagaaugaga

SEQ ID NO: 4185516 - RNA, 14 nt, Yersinia pestis KIM
agaaguccugauuc

SEQ ID NO: 4185517 - RNA, 16 nt, Yersinia pestis KIM
agaaguucagaccagc

SEQ ID NO: 4185518 - RNA, 15 nt, Yersinia pestis KIM
agaauaaacgagaau

SEQ ID NO: 4185519 - RNA, 23 nt, Yersinia pestis KIM
agaauaaggguagguucaauaau

SEQ ID NO: 4185520 - RNA, 13 nt, Yersinia pestis KIM
agaauacagccag

SEQ ID NO: 4185521 - RNA, 21 nt, Yersinia pestis KIM
agaauacuguguggaucacau

SEQ ID NO: 4185522 - RNA, 17 nt, Yersinia pestis KIM
agaauacuucaggccaa

SEQ ID NO: 4185523 - RNA, 18 nt, Yersinia pestis KIM
agaauagaccugaugacc

SEQ ID NO: 4185524 - RNA, 19 nt, Yersinia pestis KIM
agaauagagaaaucaaagu

SEQ ID NO: 4185525 - RNA, 13 nt, Yersinia pestis KIM
agaauagcaaccu

SEQ ID NO: 4185526 - RNA, 15 nt, Yersinia pestis KIM
agaauaggcagggga

SEQ ID NO: 4185527 - RNA, 16 nt, Yersinia pestis KIM
agaauagugauauccc

SEQ ID NO: 4185528 - RNA, 16 nt, Yersinia pestis KIM
agaaucaaugggauau

SEQ ID NO: 4185529 - RNA, 19 nt, Yersinia pestis KIM
agaaucacugucaaaaagc

SEQ ID NO: 4185530 - RNA, 14 nt, Yersinia pestis KIM
agaaucaguagguu

SEQ ID NO: 4185531 - RNA, 22 nt, Yersinia pestis KIM
agaauccaacccguacucugac

SEQ ID NO: 4185532 - RNA, 15 nt, Yersinia pestis KIM
agaauccacauaaaa

SEQ ID NO: 4185533 - RNA, 20 nt, Yersinia pestis KIM
agaauccacauaaaaagaaa

SEQ ID NO: 4185534 - RNA, 21 nt, Yersinia pestis KIM
agaaucccaucaaacgugaaa

SEQ ID NO: 4185535 - RNA, 21 nt, Yersinia pestis KIM
agaaucccgguugauaucggc

SEQ ID NO: 4185536 - RNA, 21 nt, Yersinia pestis KIM
agaauccucugaauaaaaaau

SEQ ID NO: 4185537 - RNA, 15 nt, Yersinia pestis KIM
agaaucggccagugc

SEQ ID NO: 4185538 - RNA, 15 nt, Yersinia pestis KIM
agaaucucuccagug

SEQ ID NO: 4185539 - RNA, 20 nt, Yersinia pestis KIM
agaaugcaaccaguuaaaga

SEQ ID NO: 4185540 - RNA, 16 nt, Yersinia pestis KIM
agaaugggucguugau

SEQ ID NO: 4185541 - RNA, 15 nt, Yersinia pestis KIM
agaauguuaaacccc

SEQ ID NO: 4185542 - RNA, 23 nt, Yersinia pestis KIM
agaauucgcgucuuacugccuga

SEQ ID NO: 4185543 - RNA, 22 nt, Yersinia pestis KIM
agaauugugccccaagaagaga

SEQ ID NO: 4185544 - RNA, 16 nt, Yersinia pestis KIM
agaauuuaccuccaua

SEQ ID NO: 4185545 - RNA, 20 nt, Yersinia pestis KIM
agaauuuaccuccauauccu

SEQ ID NO: 4185546 - RNA, 23 nt, Yersinia pestis KIM
agaauuuuuuuagauaucagaaa

SEQ ID NO: 4185547 - RNA, 13 nt, Yersinia pestis KIM
agacaaaaauaga

SEQ ID NO: 4185548 - RNA, 22 nt, Yersinia pestis KIM
agacaaccacccgacaucaaga

SEQ ID NO: 4185549 - RNA, 20 nt, Yersinia pestis KIM
agacaacugacaacaucaaa

SEQ ID NO: 4185550 - RNA, 14 nt, Yersinia pestis KIM
agacacagcaacaa

SEQ ID NO: 4185551 - RNA, 16 nt, Yersinia pestis KIM
agacacugacaucauc

SEQ ID NO: 4185552 - RNA, 17 nt, Yersinia pestis KIM
agacacugacaucauca

SEQ ID NO: 4185553 - RNA, 21 nt, Yersinia pestis KIM
agacacuuugguuugcagcga

SEQ ID NO: 4185554 - RNA, 19 nt, Yersinia pestis KIM
agacaguaaauccugauga

SEQ ID NO: 4185555 - RNA, 16 nt, Yersinia pestis KIM
agacaguaacuaaagc

SEQ ID NO: 4185556 - RNA, 24 nt, Yersinia pestis KIM
agacaguuuauuugaguaagacaa

SEQ ID NO: 4185557 - RNA, 13 nt, Yersinia pestis KIM
agacauaaagaaa

SEQ ID NO: 4185558 - RNA, 15 nt, Yersinia pestis KIM
agacauaaagaaaag

SEQ ID NO: 4185559 - RNA, 22 nt, Yersinia pestis KIM
agacauaaagcccgcuucaaag

SEQ ID NO: 4185560 - RNA, 18 nt, Yersinia pestis KIM
agacauaccccacgccgc

SEQ ID NO: 4185561 - RNA, 21 nt, Yersinia pestis KIM
agacauaucuugaaccaauuu

SEQ ID NO: 4185562 - RNA, 16 nt, Yersinia pestis KIM
agacaucgccagauuc

SEQ ID NO: 4185563 - RNA, 14 nt, Yersinia pestis KIM
agacaucuuuacca

SEQ ID NO: 4185564 - RNA, 22 nt, Yersinia pestis KIM
agacaugggcagugcacaguca

SEQ ID NO: 4185565 - RNA, 20 nt, Yersinia pestis KIM
agaccaaauagcaagccaaa

SEQ ID NO: 4185566 - RNA, 14 nt, Yersinia pestis KIM
agaccacagauaaa

SEQ ID NO: 4185567 - RNA, 15 nt, Yersinia pestis KIM
agaccacagauaaau

SEQ ID NO: 4185568 - RNA, 13 nt, Yersinia pestis KIM
agaccaccaacuc

SEQ ID NO: 4185569 - RNA, 16 nt, Yersinia pestis KIM
agaccagauaaucgcc

SEQ ID NO: 4185570 - RNA, 19 nt, Yersinia pestis KIM
agaccagauaaucgccaau

SEQ ID NO: 4185571 - RNA, 17 nt, Yersinia pestis KIM
agaccaguuaauaucaa

SEQ ID NO: 4185572 - RNA, 23 nt, Yersinia pestis KIM
agacccauuucugcuucuacccu

SEQ ID NO: 4185573 - RNA, 10 nt, Yersinia pestis KIM
agacccccaa

SEQ ID NO: 4185574 - RNA, 16 nt, Yersinia pestis KIM
agaccccugcgauaau

SEQ ID NO: 4185575 - RNA, 17 nt, Yersinia pestis KIM
agacccggcaaauaaau

SEQ ID NO: 4185576 - RNA, 21 nt, Yersinia pestis KIM
agaccgguggcuuuuucaccc

SEQ ID NO: 4185577 - RNA, 13 nt, Yersinia pestis KIM
agacgaaggcacg

SEQ ID NO: 4185578 - RNA, 20 nt, Yersinia pestis KIM
agacgacgugcagcgcgcag

SEQ ID NO: 4185579 - RNA, 17 nt, Yersinia pestis KIM
agacgaguauuccccac

SEQ ID NO: 4185580 - RNA, 23 nt, Yersinia pestis KIM
agacgagucuauugaaaaaauaa

SEQ ID NO: 4185581 - RNA, 16 nt, Yersinia pestis KIM
agacgccggcuucccu

SEQ ID NO: 4185582 - RNA, 16 nt, Yersinia pestis KIM
agacgccguaaauaca

SEQ ID NO: 4185583 - RNA, 13 nt, Yersinia pestis KIM
agacgcgguuaac

SEQ ID NO: 4185584 - RNA, 17 nt, Yersinia pestis KIM
agacggcagcaacgaaa

SEQ ID NO: 4185585 - RNA, 12 nt, Yersinia pestis KIM
agacggggagga

SEQ ID NO: 4185586 - RNA, 22 nt, Yersinia pestis KIM
agacgugcguuuuugaaauacc

SEQ ID NO: 4185587 - RNA, 19 nt, Yersinia pestis KIM
agacuaaacgcuaccauga

SEQ ID NO: 4185588 - RNA, 19 nt, Yersinia pestis KIM
agacuaaccucugcaaugc

SEQ ID NO: 4185589 - RNA, 18 nt, Yersinia pestis KIM
agacuacacacagcaaua

SEQ ID NO: 4185590 - RNA, 21 nt, Yersinia pestis KIM
agacucaucgggacuaugagc

SEQ ID NO: 4185591 - RNA, 19 nt, Yersinia pestis KIM
agacucaucuaauuuucuc

SEQ ID NO: 4185592 - RNA, 15 nt, Yersinia pestis KIM
agacucugcuaccag

SEQ ID NO: 4185593 - RNA, 22 nt, Yersinia pestis KIM
agacugaaguuuaccgcaugaa

SEQ ID NO: 4185594 - RNA, 16 nt, Yersinia pestis KIM
agacugcucuuucccu

SEQ ID NO: 4185595 - RNA, 20 nt, Yersinia pestis KIM
agacugcugacaaaccccga

SEQ ID NO: 4185596 - RNA, 15 nt, Yersinia pestis KIM
agacugcugacaacc

SEQ ID NO: 4185597 - RNA, 21 nt, Yersinia pestis KIM
agacuggcgauauggcacagg

SEQ ID NO: 4185598 - RNA, 16 nt, Yersinia pestis KIM
agacuguuuuauuaua

SEQ ID NO: 4185599 - RNA, 21 nt, Yersinia pestis KIM
agacuuacgcgaugccaacaa

SEQ ID NO: 4185600 - RNA, 22 nt, Yersinia pestis KIM
agacuucagcccauggcugaaa

SEQ ID NO: 4185601 - RNA, 19 nt, Yersinia pestis KIM
agacuucgguauggcgcuu

SEQ ID NO: 4185602 - RNA, 22 nt, Yersinia pestis KIM
agacuucgguauggcgcuuaac

SEQ ID NO: 4185603 - RNA, 19 nt, Yersinia pestis KIM
agacuuggguaaccaauca

SEQ ID NO: 4185604 - RNA, 20 nt, Yersinia pestis KIM
agacuuuauucacagcagaa

SEQ ID NO: 4185605 - RNA, 18 nt, Yersinia pestis KIM
agagaaaagcagacuuga

SEQ ID NO: 4185606 - RNA, 23 nt, Yersinia pestis KIM
agagaaauaacccauauuggcaa

SEQ ID NO: 4185607 - RNA, 15 nt, Yersinia pestis KIM
agagaacaggcagau

SEQ ID NO: 4185608 - RNA, 22 nt, Yersinia pestis KIM
agagaacaggcagaucguaaag

SEQ ID NO: 4185609 - RNA, 17 nt, Yersinia pestis KIM
agagaacgggcaaccug

SEQ ID NO: 4185610 - RNA, 18 nt, Yersinia pestis KIM
agagaacgggcaaccugu

SEQ ID NO: 4185611 - RNA, 12 nt, Yersinia pestis KIM
agagacuuugua

SEQ ID NO: 4185612 - RNA, 14 nt, Yersinia pestis KIM
agagagacuuugua

SEQ ID NO: 4185613 - RNA, 17 nt, Yersinia pestis KIM
agagauaaaaaggggcu

SEQ ID NO: 4185614 - RNA, 13 nt, Yersinia pestis KIM
agagauaaacccu

SEQ ID NO: 4185615 - RNA, 13 nt, Yersinia pestis KIM
agagauaauaggu

SEQ ID NO: 4185616 - RNA, 18 nt, Yersinia pestis KIM
agagaucccgugccagau

SEQ ID NO: 4185617 - RNA, 20 nt, Yersinia pestis KIM
agagaucguaggcuuuuuac

SEQ ID NO: 4185618 - RNA, 21 nt, Yersinia pestis KIM
agagaugacccaaagucauug

SEQ ID NO: 4185619 - RNA, 15 nt, Yersinia pestis KIM
agagauguugggccg

SEQ ID NO: 4185620 - RNA, 18 nt, Yersinia pestis KIM
agagcacaacggaaggcc

SEQ ID NO: 4185621 - RNA, 15 nt, Yersinia pestis KIM
agagcacauuaacac

SEQ ID NO: 4185622 - RNA, 18 nt, Yersinia pestis KIM
agagcaccaaaucuucca

SEQ ID NO: 4185623 - RNA, 18 nt, Yersinia pestis KIM
agagcaggcgcgaagaaa

SEQ ID NO: 4185624 - RNA, 22 nt, Yersinia pestis KIM
agagcaguaaguuaaaaagaaa

SEQ ID NO: 4185625 - RNA, 12 nt, Yersinia pestis KIM
agagcauaaccc

SEQ ID NO: 4185626 - RNA, 13 nt, Yersinia pestis KIM
agagcauuaccac

SEQ ID NO: 4185627 - RNA, 13 nt, Yersinia pestis KIM
agagccaccagaa

SEQ ID NO: 4185628 - RNA, 23 nt, Yersinia pestis KIM
agagccucuauuaccucaauacg

SEQ ID NO: 4185629 - RNA, 14 nt, Yersinia pestis KIM
agagcgacucaaua

SEQ ID NO: 4185630 - RNA, 16 nt, Yersinia pestis KIM
agagcgauugacugaa

SEQ ID NO: 4185631 - RNA, 19 nt, Yersinia pestis KIM
agagcgcaaaagaccaagu

SEQ ID NO: 4185632 - RNA, 18 nt, Yersinia pestis KIM
agagcgcagcagugauac

SEQ ID NO: 4185633 - RNA, 20 nt, Yersinia pestis KIM
agagcgcggcuucagcaccu

SEQ ID NO: 4185634 - RNA, 18 nt, Yersinia pestis KIM
agagcggucgacaaaaug

SEQ ID NO: 4185635 - RNA, 22 nt, Yersinia pestis KIM
agagcggucgacaaaaugugaa

SEQ ID NO: 4185636 - RNA, 22 nt, Yersinia pestis KIM
agagcgucccugauggggcaau

SEQ ID NO: 4185637 - RNA, 17 nt, Yersinia pestis KIM
agagcguccugauuuag

SEQ ID NO: 4185638 - RNA, 15 nt, Yersinia pestis KIM
agagcucuucugcca

SEQ ID NO: 4185639 - RNA, 16 nt, Yersinia pestis KIM
agagcucuucugccag

SEQ ID NO: 4185640 - RNA, 13 nt, Yersinia pestis KIM
agaggaaauaaau

SEQ ID NO: 4185641 - RNA, 14 nt, Yersinia pestis KIM
agaggcaaugauuu

SEQ ID NO: 4185642 - RNA, 16 nt, Yersinia pestis KIM
agaggcgcuagucucu

SEQ ID NO: 4185643 - RNA, 22 nt, Yersinia pestis KIM
agagggccccgauuaaggagcc

SEQ ID NO: 4185644 - RNA, 16 nt, Yersinia pestis KIM
agagguuaaauuguuc

SEQ ID NO: 4185645 - RNA, 19 nt, Yersinia pestis KIM
agagguuauugacaaagag

SEQ ID NO: 4185646 - RNA, 17 nt, Yersinia pestis KIM
agaguaaggccaauugg

SEQ ID NO: 4185647 - RNA, 22 nt, Yersinia pestis KIM
agaguacuaacgucaacagaac

SEQ ID NO: 4185648 - RNA, 16 nt, Yersinia pestis KIM
agagucacagcauuca

SEQ ID NO: 4185649 - RNA, 18 nt, Yersinia pestis KIM
agagucacagcauucaga

SEQ ID NO: 4185650 - RNA, 21 nt, Yersinia pestis KIM
agagucgagcggggcaaaaau

SEQ ID NO: 4185651 - RNA, 19 nt, Yersinia pestis KIM
agagucgaugaaacacaac

SEQ ID NO: 4185652 - RNA, 17 nt, Yersinia pestis KIM
agagucgcaaaaaauau

SEQ ID NO: 4185653 - RNA, 13 nt, Yersinia pestis KIM
agagucgcuuugg

SEQ ID NO: 4185654 - RNA, 16 nt, Yersinia pestis KIM
agagugaaauauaccg

SEQ ID NO: 4185655 - RNA, 18 nt, Yersinia pestis KIM
agagugaaugugaguguu

SEQ ID NO: 4185656 - RNA, 16 nt, Yersinia pestis KIM
agagugaccaaagcag

SEQ ID NO: 4185657 - RNA, 24 nt, Yersinia pestis KIM
agagugcuggcaagcccugaguac

SEQ ID NO: 4185658 - RNA, 21 nt, Yersinia pestis KIM
agaguguucauaaauuaaaac

SEQ ID NO: 4185659 - RNA, 13 nt, Yersinia pestis KIM
agaguuagggcug

SEQ ID NO: 4185660 - RNA, 13 nt, Yersinia pestis KIM
agauaaaaaauaa

SEQ ID NO: 4185661 - RNA, 14 nt, Yersinia pestis KIM
agauaaaaauaauc

SEQ ID NO: 4185662 - RNA, 16 nt, Yersinia pestis KIM
agauaaaaauuacccg

SEQ ID NO: 4185663 - RNA, 17 nt, Yersinia pestis KIM
agauaaacaaacaucau

SEQ ID NO: 4185664 - RNA, 17 nt, Yersinia pestis KIM
agauaaauaaaauaaua

SEQ ID NO: 4185665 - RNA, 12 nt, Yersinia pestis KIM
agauaaaucugu

SEQ ID NO: 4185666 - RNA, 12 nt, Yersinia pestis KIM
agauaacaacaa

SEQ ID NO: 4185667 - RNA, 15 nt, Yersinia pestis KIM
agauaacaacaaaga

SEQ ID NO: 4185668 - RNA, 21 nt, Yersinia pestis KIM
agauaaccggcuggaaauuca

SEQ ID NO: 4185669 - RNA, 21 nt, Yersinia pestis KIM
agauaacgauaacuccagggu

SEQ ID NO: 4185670 - RNA, 19 nt, Yersinia pestis KIM
agauaacguaaaaaccaac

SEQ ID NO: 4185671 - RNA, 21 nt, Yersinia pestis KIM
agauaacguaaaaaccaaccg

SEQ ID NO: 4185672 - RNA, 20 nt, Yersinia pestis KIM
agauaacuuuuuauuucuuu

SEQ ID NO: 4185673 - RNA, 23 nt, Yersinia pestis KIM
agauaagaagggguuauucgcgc

SEQ ID NO: 4185674 - RNA, 23 nt, Yersinia pestis KIM
agauaauccccuuguggauaggg

SEQ ID NO: 4185675 - RNA, 22 nt, Yersinia pestis KIM
agauaaugugacugauuaaauc

SEQ ID NO: 4185676 - RNA, 23 nt, Yersinia pestis KIM
agauaauguucguuuuuuggguu

SEQ ID NO: 4185677 - RNA, 22 nt, Yersinia pestis KIM
agauaauuggcaauaaugucac

SEQ ID NO: 4185678 - RNA, 15 nt, Yersinia pestis KIM
agauaauuuagcaaa

SEQ ID NO: 4185679 - RNA, 17 nt, Yersinia pestis KIM
agauaauuuagcaaagc

SEQ ID NO: 4185680 - RNA, 19 nt, Yersinia pestis KIM
agauacagugcgcaaguau

SEQ ID NO: 4185681 - RNA, 15 nt, Yersinia pestis KIM
agauaccacaucaaa

SEQ ID NO: 4185682 - RNA, 16 nt, Yersinia pestis KIM
agauaccacaucaaac

SEQ ID NO: 4185683 - RNA, 19 nt, Yersinia pestis KIM
agauaccacaucaaaccgg

SEQ ID NO: 4185684 - RNA, 18 nt, Yersinia pestis KIM
agauacccauagcgcauu

SEQ ID NO: 4185685 - RNA, 19 nt, Yersinia pestis KIM
agauacccgccauaaauaa

SEQ ID NO: 4185686 - RNA, 17 nt, Yersinia pestis KIM
agauacccuucucuuua

SEQ ID NO: 4185687 - RNA, 22 nt, Yersinia pestis KIM
agauacggcuccagaacaucuu

SEQ ID NO: 4185688 - RNA, 16 nt, Yersinia pestis KIM
agauacuggaagaaac

SEQ ID NO: 4185689 - RNA, 22 nt, Yersinia pestis KIM
agauagaaaucacugaugagcu

SEQ ID NO: 4185690 - RNA, 22 nt, Yersinia pestis KIM
agauagaccccuucuuccagca

SEQ ID NO: 4185691 - RNA, 14 nt, Yersinia pestis KIM
agauagcaaaagaa

SEQ ID NO: 4185692 - RNA, 14 nt, Yersinia pestis KIM
agauagcaucaucc

SEQ ID NO: 4185693 - RNA, 15 nt, Yersinia pestis KIM
agauagucauuuuau

SEQ ID NO: 4185694 - RNA, 18 nt, Yersinia pestis KIM
agauaguuaucucccauu

SEQ ID NO: 4185695 - RNA, 12 nt, Yersinia pestis KIM
agauauaauggu

SEQ ID NO: 4185696 - RNA, 17 nt, Yersinia pestis KIM
agauaucagcgcaccca

SEQ ID NO: 4185697 - RNA, 15 nt, Yersinia pestis KIM
agauaucuaauuuau

SEQ ID NO: 4185698 - RNA, 20 nt, Yersinia pestis KIM
agauaucuaauuuauaaccu

SEQ ID NO: 4185699 - RNA, 15 nt, Yersinia pestis KIM
agauaugaucaaaaa

SEQ ID NO: 4185700 - RNA, 22 nt, Yersinia pestis KIM
agauaugcauuauugauguuau

SEQ ID NO: 4185701 - RNA, 14 nt, Yersinia pestis KIM
agauauuacgcagc

SEQ ID NO: 4185702 - RNA, 15 nt, Yersinia pestis KIM
agauauuacuucuuu

SEQ ID NO: 4185703 - RNA, 19 nt, Yersinia pestis KIM
agauauuagugacagccac

SEQ ID NO: 4185704 - RNA, 14 nt, Yersinia pestis KIM
agauauuugcugcc

SEQ ID NO: 4185705 - RNA, 21 nt, Yersinia pestis KIM
agauauuuuaccaaugcacgu

SEQ ID NO: 4185706 - RNA, 15 nt, Yersinia pestis KIM
agaucaaacauaacc

SEQ ID NO: 4185707 - RNA, 12 nt, Yersinia pestis KIM
agaucagugcca

SEQ ID NO: 4185708 - RNA, 17 nt, Yersinia pestis KIM
agaucagugccaguaau

SEQ ID NO: 4185709 - RNA, 15 nt, Yersinia pestis KIM
agaucauccagauau

SEQ ID NO: 4185710 - RNA, 17 nt, Yersinia pestis KIM
agaucaucgggcauuca

SEQ ID NO: 4185711 - RNA, 21 nt, Yersinia pestis KIM
agaucaucgggcauucacugc

SEQ ID NO: 4185712 - RNA, 22 nt, Yersinia pestis KIM
agaucauguaguacuuaccuuc

SEQ ID NO: 4185713 - RNA, 17 nt, Yersinia pestis KIM
agauccagaauuucauu

SEQ ID NO: 4185714 - RNA, 20 nt, Yersinia pestis KIM
agaucccgugugauuuccau

SEQ ID NO: 4185715 - RNA, 17 nt, Yersinia pestis KIM
agauccggugaagaauu

SEQ ID NO: 4185716 - RNA, 23 nt, Yersinia pestis KIM
agauccgugcgccugaacagccu

SEQ ID NO: 4185717 - RNA, 20 nt, Yersinia pestis KIM
agauccuccauauccucaag

SEQ ID NO: 4185718 - RNA, 18 nt, Yersinia pestis KIM
agauccuggcccgccagc

SEQ ID NO: 4185719 - RNA, 15 nt, Yersinia pestis KIM
agauccuuaaagaaa

SEQ ID NO: 4185720 - RNA, 16 nt, Yersinia pestis KIM
agaucggcauuauuau

SEQ ID NO: 4185721 - RNA, 22 nt, Yersinia pestis KIM
agaucggcauuauuaucuugau

SEQ ID NO: 4185722 - RNA, 19 nt, Yersinia pestis KIM
agaucggggcgcuuaauuc

SEQ ID NO: 4185723 - RNA, 13 nt, Yersinia pestis KIM
agaucguaggcuu

SEQ ID NO: 4185724 - RNA, 16 nt, Yersinia pestis KIM
agaucucagaauuuuu

SEQ ID NO: 4185725 - RNA, 16 nt, Yersinia pestis KIM
agaucucuguuuucca

SEQ ID NO: 4185726 - RNA, 14 nt, Yersinia pestis KIM
agaucuuuuucauu

SEQ ID NO: 4185727 - RNA, 16 nt, Yersinia pestis KIM
agaucuuuuucauucu

SEQ ID NO: 4185728 - RNA, 12 nt, Yersinia pestis KIM
agaugaacacag

SEQ ID NO: 4185729 - RNA, 16 nt, Yersinia pestis KIM
agaugaacacagaaac

SEQ ID NO: 4185730 - RNA, 15 nt, Yersinia pestis KIM
agaugaauacgcuuu

SEQ ID NO: 4185731 - RNA, 20 nt, Yersinia pestis KIM
agaugagaaucucuccagug

SEQ ID NO: 4185732 - RNA, 20 nt, Yersinia pestis KIM
agaugcauauuugcagaaag

SEQ ID NO: 4185733 - RNA, 18 nt, Yersinia pestis KIM
agaugccaaucaaaaaac

SEQ ID NO: 4185734 - RNA, 21 nt, Yersinia pestis KIM
agauggcagugacauuaccug

SEQ ID NO: 4185735 - RNA, 21 nt, Yersinia pestis KIM
agauggccagauucaccagua

SEQ ID NO: 4185736 - RNA, 21 nt, Yersinia pestis KIM
agauggcggucgcacugugag

SEQ ID NO: 4185737 - RNA, 18 nt, Yersinia pestis KIM
agauggcguuuuuaccug

SEQ ID NO: 4185738 - RNA, 18 nt, Yersinia pestis KIM
agauggcuuuggugauca

SEQ ID NO: 4185739 - RNA, 18 nt, Yersinia pestis KIM
agaugggccaggcaauga

SEQ ID NO: 4185740 - RNA, 23 nt, Yersinia pestis KIM
agauggucauaaauaggugcgcc

SEQ ID NO: 4185741 - RNA, 17 nt, Yersinia pestis KIM
agauuaaccuuaucacc

SEQ ID NO: 4185742 - RNA, 21 nt, Yersinia pestis KIM
agauuaacggcgugcgaacaa

SEQ ID NO: 4185743 - RNA, 20 nt, Yersinia pestis KIM
agauuaagaaaacauuaagg

SEQ ID NO: 4185744 - RNA, 19 nt, Yersinia pestis KIM
agauuaauacaucaucaaa

SEQ ID NO: 4185745 - RNA, 19 nt, Yersinia pestis KIM
agauuacgcaucgucaguu

SEQ ID NO: 4185746 - RNA, 22 nt, Yersinia pestis KIM
agauuagagguuauugacaaag

SEQ ID NO: 4185747 - RNA, 23 nt, Yersinia pestis KIM
agauuaguuuuagacgucagauu

SEQ ID NO: 4185748 - RNA, 22 nt, Yersinia pestis KIM
agauuaguuuuagaugucagau

SEQ ID NO: 4185749 - RNA, 14 nt, Yersinia pestis KIM
agauuauuauuacu

SEQ ID NO: 4185750 - RNA, 16 nt, Yersinia pestis KIM
agauuauuucagcuuc

SEQ ID NO: 4185751 - RNA, 14 nt, Yersinia pestis KIM
agauucaaguugca

SEQ ID NO: 4185752 - RNA, 15 nt, Yersinia pestis KIM
agauucaauauuuau

SEQ ID NO: 4185753 - RNA, 12 nt, Yersinia pestis KIM
agauucagcugc

SEQ ID NO: 4185754 - RNA, 14 nt, Yersinia pestis KIM
agauugaacgcugg

SEQ ID NO: 4185755 - RNA, 22 nt, Yersinia pestis KIM
agauugagugcggacagcgcgc

SEQ ID NO: 4185756 - RNA, 19 nt, Yersinia pestis KIM
agauugccaaucagaacua

SEQ ID NO: 4185757 - RNA, 20 nt, Yersinia pestis KIM
agauuggcagcguaaagguu

SEQ ID NO: 4185758 - RNA, 17 nt, Yersinia pestis KIM
agauuguaaguaacuaa

SEQ ID NO: 4185759 - RNA, 15 nt, Yersinia pestis KIM
agauugugcuccagc

SEQ ID NO: 4185760 - RNA, 18 nt, Yersinia pestis KIM
agauuuaaccccaauucu

SEQ ID NO: 4185761 - RNA, 19 nt, Yersinia pestis KIM
agauuucagacugcugaca

SEQ ID NO: 4185762 - RNA, 20 nt, Yersinia pestis KIM
agauuucgguuaauauugaa

SEQ ID NO: 4185763 - RNA, 23 nt, Yersinia pestis KIM
agauuugcccaaucuaacuggcc

SEQ ID NO: 4185764 - RNA, 18 nt, Yersinia pestis KIM
agauuugugcauauucau

SEQ ID NO: 4185765 - RNA, 18 nt, Yersinia pestis KIM
agauuuucuuucaggcug

SEQ ID NO: 4185766 - RNA, 17 nt, Yersinia pestis KIM
agcaaaaaaaaagccug

SEQ ID NO: 4185767 - RNA, 16 nt, Yersinia pestis KIM
agcaaaaaaacugacu

SEQ ID NO: 4185768 - RNA, 13 nt, Yersinia pestis KIM
agcaaaaaggcug

SEQ ID NO: 4185769 - RNA, 18 nt, Yersinia pestis KIM
agcaaaaaggcugcaccu

SEQ ID NO: 4185770 - RNA, 15 nt, Yersinia pestis KIM
agcaaaaguccuuuc

SEQ ID NO: 4185771 - RNA, 21 nt, Yersinia pestis KIM
agcaaaauccgguaauggcca

SEQ ID NO: 4185772 - RNA, 15 nt, Yersinia pestis KIM
agcaaacgaacgaau

SEQ ID NO: 4185773 - RNA, 16 nt, Yersinia pestis KIM
agcaaacgaacgaaua

SEQ ID NO: 4185774 - RNA, 20 nt, Yersinia pestis KIM
agcaaacgauccgaauuuau

SEQ ID NO: 4185775 - RNA, 18 nt, Yersinia pestis KIM
agcaaacggguggccaca

SEQ ID NO: 4185776 - RNA, 14 nt, Yersinia pestis KIM
agcaaaggcccgcu

SEQ ID NO: 4185777 - RNA, 17 nt, Yersinia pestis KIM
agcaaaguauuuauaca

SEQ ID NO: 4185778 - RNA, 16 nt, Yersinia pestis KIM
agcaaauaaacaaaau

SEQ ID NO: 4185779 - RNA, 14 nt, Yersinia pestis KIM
agcaaaucaaacaa

SEQ ID NO: 4185780 - RNA, 15 nt, Yersinia pestis KIM
agcaaaucaaacaaa

SEQ ID NO: 4185781 - RNA, 13 nt, Yersinia pestis KIM
agcaaaucccgau

SEQ ID NO: 4185782 - RNA, 20 nt, Yersinia pestis KIM
agcaaaucgauacaguggcu

SEQ ID NO: 4185783 - RNA, 17 nt, Yersinia pestis KIM
agcaaauucccaccaua

SEQ ID NO: 4185784 - RNA, 14 nt, Yersinia pestis KIM
agcaaauugcugaa

SEQ ID NO: 4185785 - RNA, 15 nt, Yersinia pestis KIM
agcaaauugcugaaa

SEQ ID NO: 4185786 - RNA, 20 nt, Yersinia pestis KIM
agcaaauugcugaaaaaaaa

SEQ ID NO: 4185787 - RNA, 16 nt, Yersinia pestis KIM
agcaacaaccccauga

SEQ ID NO: 4185788 - RNA, 14 nt, Yersinia pestis KIM
agcaacaauaacuu

SEQ ID NO: 4185789 - RNA, 19 nt, Yersinia pestis KIM
agcaacacaucuuccagua

SEQ ID NO: 4185790 - RNA, 22 nt, Yersinia pestis KIM
agcaacaugguuaagagauccc

SEQ ID NO: 4185791 - RNA, 12 nt, Yersinia pestis KIM
agcaagaaacug

SEQ ID NO: 4185792 - RNA, 21 nt, Yersinia pestis KIM
agcaagcggcagcgcuggugc

SEQ ID NO: 4185793 - RNA, 14 nt, Yersinia pestis KIM
agcaaggauucccc

SEQ ID NO: 4185794 - RNA, 11 nt, Yersinia pestis KIM
agcaaggcaga

SEQ ID NO: 4185795 - RNA, 16 nt, Yersinia pestis KIM
agcaaggcagcaagca

SEQ ID NO: 4185796 - RNA, 20 nt, Yersinia pestis KIM
agcaaggcggcaagcaagca

SEQ ID NO: 4185797 - RNA, 11 nt, Yersinia pestis KIM
agcaagugaac

SEQ ID NO: 4185798 - RNA, 16 nt, Yersinia pestis KIM
agcaaguuagcgauau

SEQ ID NO: 4185799 - RNA, 21 nt, Yersinia pestis KIM
agcaaguuagcgauaucugcg

SEQ ID NO: 4185800 - RNA, 20 nt, Yersinia pestis KIM
agcaaucaaaagggaucacc

SEQ ID NO: 4185801 - RNA, 22 nt, Yersinia pestis KIM
agcaaucgggggaggaagcuga

SEQ ID NO: 4185802 - RNA, 11 nt, Yersinia pestis KIM
agcaaucuggc

SEQ ID NO: 4185803 - RNA, 14 nt, Yersinia pestis KIM
agcaaucuggcggc

SEQ ID NO: 4185804 - RNA, 19 nt, Yersinia pestis KIM
agcaaugcaccgacaaaga

SEQ ID NO: 4185805 - RNA, 12 nt, Yersinia pestis KIM
agcacaaaaaga

SEQ ID NO: 4185806 - RNA, 21 nt, Yersinia pestis KIM
agcacaagcgccugcgacagc

SEQ ID NO: 4185807 - RNA, 15 nt, Yersinia pestis KIM
agcacaauuguuaug

SEQ ID NO: 4185808 - RNA, 11 nt, Yersinia pestis KIM
agcacacacag

SEQ ID NO: 4185809 - RNA, 15 nt, Yersinia pestis KIM
agcacaccggccaaa

SEQ ID NO: 4185810 - RNA, 18 nt, Yersinia pestis KIM
agcacaccggccaaaauc

SEQ ID NO: 4185811 - RNA, 16 nt, Yersinia pestis KIM
agcacagacaaacaac

SEQ ID NO: 4185812 - RNA, 20 nt, Yersinia pestis KIM
agcacauccaugccauggcg

SEQ ID NO: 4185813 - RNA, 14 nt, Yersinia pestis KIM
agcacauuaacaca

SEQ ID NO: 4185814 - RNA, 14 nt, Yersinia pestis KIM
agcaccaaaucuuc

SEQ ID NO: 4185815 - RNA, 12 nt, Yersinia pestis KIM
agcaccacaaug

SEQ ID NO: 4185816 - RNA, 16 nt, Yersinia pestis KIM
agcaccacaauggcag

SEQ ID NO: 4185817 - RNA, 18 nt, Yersinia pestis KIM
agcaccagaaaguuguuc

SEQ ID NO: 4185818 - RNA, 14 nt, Yersinia pestis KIM
agcaccauuaucuu

SEQ ID NO: 4185819 - RNA, 16 nt, Yersinia pestis KIM
agcaccauuaucuucc

SEQ ID NO: 4185820 - RNA, 16 nt, Yersinia pestis KIM
agcaccauucaaugua

SEQ ID NO: 4185821 - RNA, 16 nt, Yersinia pestis KIM
agcacccacaccgcag

SEQ ID NO: 4185822 - RNA, 17 nt, Yersinia pestis KIM
agcaccggauggucacc

SEQ ID NO: 4185823 - RNA, 21 nt, Yersinia pestis KIM
agcaccuaucgccgccgccag

SEQ ID NO: 4185824 - RNA, 20 nt, Yersinia pestis KIM
agcacgaaccugagcgauca

SEQ ID NO: 4185825 - RNA, 16 nt, Yersinia pestis KIM
agcacgaccuugccaa

SEQ ID NO: 4185826 - RNA, 16 nt, Yersinia pestis KIM
agcacgcuuuccagcu

SEQ ID NO: 4185827 - RNA, 19 nt, Yersinia pestis KIM
agcacggcugaacgguagc

SEQ ID NO: 4185828 - RNA, 21 nt, Yersinia pestis KIM
agcacgguguguugaaauuug

SEQ ID NO: 4185829 - RNA, 23 nt, Yersinia pestis KIM
agcacgguguguugaaauuuguu

SEQ ID NO: 4185830 - RNA, 21 nt, Yersinia pestis KIM
agcacuaagugcuggccuagg

SEQ ID NO: 4185831 - RNA, 18 nt, Yersinia pestis KIM
agcacuauccccaauuca

SEQ ID NO: 4185832 - RNA, 21 nt, Yersinia pestis KIM
agcacucaaugucaugcaauu

SEQ ID NO: 4185833 - RNA, 13 nt, Yersinia pestis KIM
agcacucaguaca

SEQ ID NO: 4185834 - RNA, 15 nt, Yersinia pestis KIM
agcacucgguggcau

SEQ ID NO: 4185835 - RNA, 12 nt, Yersinia pestis KIM
agcacugccccg

SEQ ID NO: 4185836 - RNA, 17 nt, Yersinia pestis KIM
agcacugccccgaagcu

SEQ ID NO: 4185837 - RNA, 21 nt, Yersinia pestis KIM
agcacugccccgaagcucaag

SEQ ID NO: 4185838 - RNA, 18 nt, Yersinia pestis KIM
agcacugcgcgaucccag

SEQ ID NO: 4185839 - RNA, 21 nt, Yersinia pestis KIM
agcacugcuagguuuacuguu

SEQ ID NO: 4185840 - RNA, 21 nt, Yersinia pestis KIM
agcacuguacugggaugaaga

SEQ ID NO: 4185841 - RNA, 21 nt, Yersinia pestis KIM
agcacuguuacccggaaugga

SEQ ID NO: 4185842 - RNA, 22 nt, Yersinia pestis KIM
agcacuuccaacuuuucauugg

SEQ ID NO: 4185843 - RNA, 19 nt, Yersinia pestis KIM
agcacuuuacgauuucgcu

SEQ ID NO: 4185844 - RNA, 13 nt, Yersinia pestis KIM
agcagaaagcagc

SEQ ID NO: 4185845 - RNA, 14 nt, Yersinia pestis KIM
agcagaaagcagca

SEQ ID NO: 4185846 - RNA, 17 nt, Yersinia pestis KIM
agcagaaagcagcagcu

SEQ ID NO: 4185847 - RNA, 14 nt, Yersinia pestis KIM
agcagaaagggcgc

SEQ ID NO: 4185848 - RNA, 12 nt, Yersinia pestis KIM
agcagaacaaaa

SEQ ID NO: 4185849 - RNA, 13 nt, Yersinia pestis KIM
agcagaacaaaac

SEQ ID NO: 4185850 - RNA, 13 nt, Yersinia pestis KIM
agcagaauacugu

SEQ ID NO: 4185851 - RNA, 16 nt, Yersinia pestis KIM
agcagacaacugacaa

SEQ ID NO: 4185852 - RNA, 13 nt, Yersinia pestis KIM
agcagacagcgag

SEQ ID NO: 4185853 - RNA, 20 nt, Yersinia pestis KIM
agcagacucaagcauuguca

SEQ ID NO: 4185854 - RNA, 18 nt, Yersinia pestis KIM
agcagacuuacgcgaugc

SEQ ID NO: 4185855 - RNA, 13 nt, Yersinia pestis KIM
agcagacuugaac

SEQ ID NO: 4185856 - RNA, 12 nt, Yersinia pestis KIM
agcagagaauga

SEQ ID NO: 4185857 - RNA, 19 nt, Yersinia pestis KIM
agcagagauccggugaaga

SEQ ID NO: 4185858 - RNA, 14 nt, Yersinia pestis KIM
agcagauaauaaau

SEQ ID NO: 4185859 - RNA, 22 nt, Yersinia pestis KIM
agcagauggucaacuaaacaga

SEQ ID NO: 4185860 - RNA, 21 nt, Yersinia pestis KIM
agcagcaucuggcgcagagua

SEQ ID NO: 4185861 - RNA, 17 nt, Yersinia pestis KIM
agcagccaacacaccug

SEQ ID NO: 4185862 - RNA, 18 nt, Yersinia pestis KIM
agcagccaccaaaaaacg

SEQ ID NO: 4185863 - RNA, 15 nt, Yersinia pestis KIM
agcagcccaacacuu

SEQ ID NO: 4185864 - RNA, 22 nt, Yersinia pestis KIM
agcagcccaacacuuuuaagga

SEQ ID NO: 4185865 - RNA, 18 nt, Yersinia pestis KIM
agcagccucuaacauacu

SEQ ID NO: 4185866 - RNA, 22 nt, Yersinia pestis KIM
agcagccucuaacauacucaga

SEQ ID NO: 4185867 - RNA, 13 nt, Yersinia pestis KIM
agcagcgcacugg

SEQ ID NO: 4185868 - RNA, 15 nt, Yersinia pestis KIM
agcagcguggugcgg

SEQ ID NO: 4185869 - RNA, 17 nt, Yersinia pestis KIM
agcaggaaacaugcuga

SEQ ID NO: 4185870 - RNA, 21 nt, Yersinia pestis KIM
agcaggaaacaugcugaagcc

SEQ ID NO: 4185871 - RNA, 14 nt, Yersinia pestis KIM
agcaggaauacccg

SEQ ID NO: 4185872 - RNA, 16 nt, Yersinia pestis KIM
agcaggcagagcaagg

SEQ ID NO: 4185873 - RNA, 16 nt, Yersinia pestis KIM
agcagggccgcccaga

SEQ ID NO: 4185874 - RNA, 22 nt, Yersinia pestis KIM
agcagggccgcccagauaaaga

SEQ ID NO: 4185875 - RNA, 16 nt, Yersinia pestis KIM
agcaggggcaaccucu

SEQ ID NO: 4185876 - RNA, 23 nt, Yersinia pestis KIM
agcaggggguuuucugaauacca

SEQ ID NO: 4185877 - RNA, 22 nt, Yersinia pestis KIM
agcagguagcuguuugcaccuu

SEQ ID NO: 4185878 - RNA, 13 nt, Yersinia pestis KIM
agcagguggcuga

SEQ ID NO: 4185879 - RNA, 19 nt, Yersinia pestis KIM
agcaguaacguccaacuga

SEQ ID NO: 4185880 - RNA, 23 nt, Yersinia pestis KIM
agcaguaaguuaaaaagaaaaag

SEQ ID NO: 4185881 - RNA, 15 nt, Yersinia pestis KIM
agcagucaaaaugaa

SEQ ID NO: 4185882 - RNA, 16 nt, Yersinia pestis KIM
agcagucaaaaugaaa

SEQ ID NO: 4185883 - RNA, 17 nt, Yersinia pestis KIM
agcagucugagccucau

SEQ ID NO: 4185884 - RNA, 19 nt, Yersinia pestis KIM
agcagucugagccucauga

SEQ ID NO: 4185885 - RNA, 21 nt, Yersinia pestis KIM
agcagucugagccucaugaau

SEQ ID NO: 4185886 - RNA, 23 nt, Yersinia pestis KIM
agcagucugagccucaugaauga

SEQ ID NO: 4185887 - RNA, 18 nt, Yersinia pestis KIM
agcagucugaggcccgcu

SEQ ID NO: 4185888 - RNA, 17 nt, Yersinia pestis KIM
agcagucugagggccac

SEQ ID NO: 4185889 - RNA, 17 nt, Yersinia pestis KIM
agcagucugauauccgg

SEQ ID NO: 4185890 - RNA, 15 nt, Yersinia pestis KIM
agcagugauuucagu

SEQ ID NO: 4185891 - RNA, 13 nt, Yersinia pestis KIM
agcagugauuucu

SEQ ID NO: 4185892 - RNA, 20 nt, Yersinia pestis KIM
agcagugauuucuuacagug

SEQ ID NO: 4185893 - RNA, 22 nt, Yersinia pestis KIM
agcagugauuucuuacagugau

SEQ ID NO: 4185894 - RNA, 15 nt, Yersinia pestis KIM
agcagugcagccaag

SEQ ID NO: 4185895 - RNA, 16 nt, Yersinia pestis KIM
agcaguucacucuguu

SEQ ID NO: 4185896 - RNA, 16 nt, Yersinia pestis KIM
agcaguugcugcucug

SEQ ID NO: 4185897 - RNA, 18 nt, Yersinia pestis KIM
agcauaaguaucagcggc

SEQ ID NO: 4185898 - RNA, 15 nt, Yersinia pestis KIM
agcauaccaauaccg

SEQ ID NO: 4185899 - RNA, 21 nt, Yersinia pestis KIM
agcauaccgguuugggcauca

SEQ ID NO: 4185900 - RNA, 23 nt, Yersinia pestis KIM
agcauaccgguuugggcaucaac

SEQ ID NO: 4185901 - RNA, 19 nt, Yersinia pestis KIM
agcauacuguuggcaauuu

SEQ ID NO: 4185902 - RNA, 18 nt, Yersinia pestis KIM
agcauagacgaaggcacg

SEQ ID NO: 4185903 - RNA, 13 nt, Yersinia pestis KIM
agcauauaaaaaa

SEQ ID NO: 4185904 - RNA, 18 nt, Yersinia pestis KIM
agcauauacagcccggua

SEQ ID NO: 4185905 - RNA, 13 nt, Yersinia pestis KIM
agcauauuaccca

SEQ ID NO: 4185906 - RNA, 18 nt, Yersinia pestis KIM
agcauauuacccaguacu

SEQ ID NO: 4185907 - RNA, 20 nt, Yersinia pestis KIM
agcaucacgauagccaguga

SEQ ID NO: 4185908 - RNA, 16 nt, Yersinia pestis KIM
agcaucacugucuauu

SEQ ID NO: 4185909 - RNA, 20 nt, Yersinia pestis KIM
agcaucacugucuauuuuua

SEQ ID NO: 4185910 - RNA, 14 nt, Yersinia pestis KIM
agcaucacuucaua

SEQ ID NO: 4185911 - RNA, 22 nt, Yersinia pestis KIM
agcaucauaagacuaacagaau

SEQ ID NO: 4185912 - RNA, 17 nt, Yersinia pestis KIM
agcauccaauaccacca

SEQ ID NO: 4185913 - RNA, 23 nt, Yersinia pestis KIM
agcauccagcucauauaaucaua

SEQ ID NO: 4185914 - RNA, 14 nt, Yersinia pestis KIM
agcaucgacgagcg

SEQ ID NO: 4185915 - RNA, 23 nt, Yersinia pestis KIM
agcaucgaggauuuuccgcagcu

SEQ ID NO: 4185916 - RNA, 17 nt, Yersinia pestis KIM
agcaucgcggaaccuuu

SEQ ID NO: 4185917 - RNA, 16 nt, Yersinia pestis KIM
agcaucuagcagugau

SEQ ID NO: 4185918 - RNA, 17 nt, Yersinia pestis KIM
agcaugccauccugcca

SEQ ID NO: 4185919 - RNA, 14 nt, Yersinia pestis KIM
agcaugcccagccu

SEQ ID NO: 4185920 - RNA, 15 nt, Yersinia pestis KIM
agcaugcccagccuc

SEQ ID NO: 4185921 - RNA, 22 nt, Yersinia pestis KIM
agcauggcuuuaugaccaauag

SEQ ID NO: 4185922 - RNA, 16 nt, Yersinia pestis KIM
agcaugugguuaccau

SEQ ID NO: 4185923 - RNA, 21 nt, Yersinia pestis KIM
agcauucgcgguuacaccaau

SEQ ID NO: 4185924 - RNA, 15 nt, Yersinia pestis KIM
agcauugagcgccac

SEQ ID NO: 4185925 - RNA, 13 nt, Yersinia pestis KIM
agcauuuuccaau

SEQ ID NO: 4185926 - RNA, 20 nt, Yersinia pestis KIM
agcauuuugcggaucacaua

SEQ ID NO: 4185927 - RNA, 17 nt, Yersinia pestis KIM
agcauuuuguuacccac

SEQ ID NO: 4185928 - RNA, 18 nt, Yersinia pestis KIM
agccaaaauaaucaccag

SEQ ID NO: 4185929 - RNA, 21 nt, Yersinia pestis KIM
agccaaaauaaucaccagaca

SEQ ID NO: 4185930 - RNA, 19 nt, Yersinia pestis KIM
agccaaacaaaugaacccu

SEQ ID NO: 4185931 - RNA, 21 nt, Yersinia pestis KIM
agccaaacaaaugaacccuuu

SEQ ID NO: 4185932 - RNA, 16 nt, Yersinia pestis KIM
agccaaaccccgccuc

SEQ ID NO: 4185933 - RNA, 21 nt, Yersinia pestis KIM
agccaaaccccgccucuucua

SEQ ID NO: 4185934 - RNA, 22 nt, Yersinia pestis KIM
agccaaauuacgugcccaaaaa

SEQ ID NO: 4185935 - RNA, 19 nt, Yersinia pestis KIM
agccaacacgaccugugca

SEQ ID NO: 4185936 - RNA, 13 nt, Yersinia pestis KIM
agccaacggagcg

SEQ ID NO: 4185937 - RNA, 16 nt, Yersinia pestis KIM
agccaacuccuugaau

SEQ ID NO: 4185938 - RNA, 15 nt, Yersinia pestis KIM
agccaacuuucgguu

SEQ ID NO: 4185939 - RNA, 16 nt, Yersinia pestis KIM
agccaagcaaccuugu

SEQ ID NO: 4185940 - RNA, 23 nt, Yersinia pestis KIM
agccaagcaagcggcagcgcugg

SEQ ID NO: 4185941 - RNA, 15 nt, Yersinia pestis KIM
agccaagccuuguaa

SEQ ID NO: 4185942 - RNA, 16 nt, Yersinia pestis KIM
agccaauaauauaauc

SEQ ID NO: 4185943 - RNA, 17 nt, Yersinia pestis KIM
agccaauaauauaauca

SEQ ID NO: 4185944 - RNA, 19 nt, Yersinia pestis KIM
agccaaucccgauaaaaac

SEQ ID NO: 4185945 - RNA, 16 nt, Yersinia pestis KIM
agccaaucggccuuaa

SEQ ID NO: 4185946 - RNA, 14 nt, Yersinia pestis KIM
agccaauguaugac

SEQ ID NO: 4185947 - RNA, 15 nt, Yersinia pestis KIM
agccacaaaccacgu

SEQ ID NO: 4185948 - RNA, 14 nt, Yersinia pestis KIM
agccacaauaauua

SEQ ID NO: 4185949 - RNA, 20 nt, Yersinia pestis KIM
agccacacauucagucacuu

SEQ ID NO: 4185950 - RNA, 18 nt, Yersinia pestis KIM
agccaccaccacggccag

SEQ ID NO: 4185951 - RNA, 22 nt, Yersinia pestis KIM
agccaccaccacggccagaauc

SEQ ID NO: 4185952 - RNA, 14 nt, Yersinia pestis KIM
agccaccagaauca

SEQ ID NO: 4185953 - RNA, 18 nt, Yersinia pestis KIM
agccaccaguuuauuuuc

SEQ ID NO: 4185954 - RNA, 20 nt, Yersinia pestis KIM
agccaccccguggcaggccu

SEQ ID NO: 4185955 - RNA, 11 nt, Yersinia pestis KIM
agccaccucac

SEQ ID NO: 4185956 - RNA, 14 nt, Yersinia pestis KIM
agccacgaguuuuc

SEQ ID NO: 4185957 - RNA, 16 nt, Yersinia pestis KIM
agccacgcugugucaa

SEQ ID NO: 4185958 - RNA, 14 nt, Yersinia pestis KIM
agccacuacugaac

SEQ ID NO: 4185959 - RNA, 22 nt, Yersinia pestis KIM
agccacucaacugauguuuuag

SEQ ID NO: 4185960 - RNA, 17 nt, Yersinia pestis KIM
agccacucacauaagaa

SEQ ID NO: 4185961 - RNA, 18 nt, Yersinia pestis KIM
agccacucggguucuaaa

SEQ ID NO: 4185962 - RNA, 21 nt, Yersinia pestis KIM
agccagauaggcgaaauugac

SEQ ID NO: 4185963 - RNA, 16 nt, Yersinia pestis KIM
agccagcacacagaug

SEQ ID NO: 4185964 - RNA, 17 nt, Yersinia pestis KIM
agccagcacacagaugc

SEQ ID NO: 4185965 - RNA, 15 nt, Yersinia pestis KIM
agccagccaauggcc

SEQ ID NO: 4185966 - RNA, 20 nt, Yersinia pestis KIM
agccagccaauggccaccau

SEQ ID NO: 4185967 - RNA, 16 nt, Yersinia pestis KIM
agccagccaccgcaca

SEQ ID NO: 4185968 - RNA, 20 nt, Yersinia pestis KIM
agccagccaccgcacacuga

SEQ ID NO: 4185969 - RNA, 20 nt, Yersinia pestis KIM
agccagccacugggcuaccc

SEQ ID NO: 4185970 - RNA, 13 nt, Yersinia pestis KIM
agccagccuuaac

SEQ ID NO: 4185971 - RNA, 14 nt, Yersinia pestis KIM
agccagcgucauca

SEQ ID NO: 4185972 - RNA, 16 nt, Yersinia pestis KIM
agccaggcagcuauca

SEQ ID NO: 4185973 - RNA, 12 nt, Yersinia pestis KIM
agccagguuuuu

SEQ ID NO: 4185974 - RNA, 13 nt, Yersinia pestis KIM
agccagugacucc

SEQ ID NO: 4185975 - RNA, 22 nt, Yersinia pestis KIM
agccagugaugcugcacaucaa

SEQ ID NO: 4185976 - RNA, 14 nt, Yersinia pestis KIM
agccauaauaaugc

SEQ ID NO: 4185977 - RNA, 17 nt, Yersinia pestis KIM
agccauacccaaaccaa

SEQ ID NO: 4185978 - RNA, 14 nt, Yersinia pestis KIM
agccauauuuuaaa

SEQ ID NO: 4185979 - RNA, 15 nt, Yersinia pestis KIM
agccauauuuuucaa

SEQ ID NO: 4185980 - RNA, 15 nt, Yersinia pestis KIM
agccauccaggcaag

SEQ ID NO: 4185981 - RNA, 18 nt, Yersinia pestis KIM
agccauccuucagacugc

SEQ ID NO: 4185982 - RNA, 17 nt, Yersinia pestis KIM
agccaugggucauuaau

SEQ ID NO: 4185983 - RNA, 17 nt, Yersinia pestis KIM
agccaugucauggggga

SEQ ID NO: 4185984 - RNA, 16 nt, Yersinia pestis KIM
agccauguguuuguuu

SEQ ID NO: 4185985 - RNA, 16 nt, Yersinia pestis KIM
agccauuucaaaacgc

SEQ ID NO: 4185986 - RNA, 22 nt, Yersinia pestis KIM
agccauuuuuuauaaacacuua

SEQ ID NO: 4185987 - RNA, 13 nt, Yersinia pestis KIM
agcccaaggcgac

SEQ ID NO: 4185988 - RNA, 21 nt, Yersinia pestis KIM
agcccaauucguauuccucaa

SEQ ID NO: 4185989 - RNA, 14 nt, Yersinia pestis KIM
agcccacugacacu

SEQ ID NO: 4185990 - RNA, 17 nt, Yersinia pestis KIM
agcccaggcgacgcagu

SEQ ID NO: 4185991 - RNA, 21 nt, Yersinia pestis KIM
agcccaggcgacgcaguaaga

SEQ ID NO: 4185992 - RNA, 15 nt, Yersinia pestis KIM
agcccaguaaagcaa

SEQ ID NO: 4185993 - RNA, 16 nt, Yersinia pestis KIM
agcccaguauugcaga

SEQ ID NO: 4185994 - RNA, 15 nt, Yersinia pestis KIM
agcccauccuguuca

SEQ ID NO: 4185995 - RNA, 22 nt, Yersinia pestis KIM
agcccaucuuaugcauguuccu

SEQ ID NO: 4185996 - RNA, 12 nt, Yersinia pestis KIM
agcccauugcug

SEQ ID NO: 4185997 - RNA, 18 nt, Yersinia pestis KIM
agccccagugcgcaaaaa

SEQ ID NO: 4185998 - RNA, 18 nt, Yersinia pestis KIM
agcccccagggagggcua

SEQ ID NO: 4185999 - RNA, 15 nt, Yersinia pestis KIM
agcccccucaauacc

SEQ ID NO: 4186000 - RNA, 20 nt, Yersinia pestis KIM
agccccuaaauccugcaaug

SEQ ID NO: 4186001 - RNA, 15 nt, Yersinia pestis KIM
agccccuuugaacug

SEQ ID NO: 4186002 - RNA, 20 nt, Yersinia pestis KIM
agccccuuugaacugcaccc

SEQ ID NO: 4186003 - RNA, 14 nt, Yersinia pestis KIM
agcccgaaauucag

SEQ ID NO: 4186004 - RNA, 17 nt, Yersinia pestis KIM
agcccgauggggagagc

SEQ ID NO: 4186005 - RNA, 16 nt, Yersinia pestis KIM
agcccguucggucaca

SEQ ID NO: 4186006 - RNA, 17 nt, Yersinia pestis KIM
agcccuacuggcugaag

SEQ ID NO: 4186007 - RNA, 14 nt, Yersinia pestis KIM
agcccugaucgcug

SEQ ID NO: 4186008 - RNA, 15 nt, Yersinia pestis KIM
agcccuucuuuaacc

SEQ ID NO: 4186009 - RNA, 21 nt, Yersinia pestis KIM
agcccuuugaccauuuguuuu

SEQ ID NO: 4186010 - RNA, 18 nt, Yersinia pestis KIM
agcccuuugcuuucagga

SEQ ID NO: 4186011 - RNA, 23 nt, Yersinia pestis KIM
agcccuuuggcaaucacaacccc

SEQ ID NO: 4186012 - RNA, 12 nt, Yersinia pestis KIM
agccgaagaaug

SEQ ID NO: 4186013 - RNA, 15 nt, Yersinia pestis KIM
agccgaauaucccac

SEQ ID NO: 4186014 - RNA, 13 nt, Yersinia pestis KIM
agccgauaauccc

SEQ ID NO: 4186015 - RNA, 23 nt, Yersinia pestis KIM
agccgcagaugccagacuugggu

SEQ ID NO: 4186016 - RNA, 18 nt, Yersinia pestis KIM
agccgccagccauuaaau

SEQ ID NO: 4186017 - RNA, 13 nt, Yersinia pestis KIM
agccgcgccaucc

SEQ ID NO: 4186018 - RNA, 18 nt, Yersinia pestis KIM
agccgcgccauccuuggc

SEQ ID NO: 4186019 - RNA, 14 nt, Yersinia pestis KIM
agccgcgcccuccc

SEQ ID NO: 4186020 - RNA, 19 nt, Yersinia pestis KIM
agccgcugcucacauagcg

SEQ ID NO: 4186021 - RNA, 18 nt, Yersinia pestis KIM
agccgcuuuaaucgccug

SEQ ID NO: 4186022 - RNA, 19 nt, Yersinia pestis KIM
agccgcuuuaaucgccuga

SEQ ID NO: 4186023 - RNA, 18 nt, Yersinia pestis KIM
agccguaauucagauaag

SEQ ID NO: 4186024 - RNA, 21 nt, Yersinia pestis KIM
agccgugaccgcagauauccu

SEQ ID NO: 4186025 - RNA, 21 nt, Yersinia pestis KIM
agccguuaaaaagucauuaac

SEQ ID NO: 4186026 - RNA, 21 nt, Yersinia pestis KIM
agccguuucagauaaaaagcc

SEQ ID NO: 4186027 - RNA, 18 nt, Yersinia pestis KIM
agccuaaggccaucaaua

SEQ ID NO: 4186028 - RNA, 15 nt, Yersinia pestis KIM
agccuacauggaugu

SEQ ID NO: 4186029 - RNA, 14 nt, Yersinia pestis KIM
agccuacgagagau

SEQ ID NO: 4186030 - RNA, 15 nt, Yersinia pestis KIM
agccuacgagagauc

SEQ ID NO: 4186031 - RNA, 18 nt, Yersinia pestis KIM
agccuacuacauggaugu

SEQ ID NO: 4186032 - RNA, 21 nt, Yersinia pestis KIM
agccucaucagaggcucaucc

SEQ ID NO: 4186033 - RNA, 15 nt, Yersinia pestis KIM
agccucaugaaugag

SEQ ID NO: 4186034 - RNA, 17 nt, Yersinia pestis KIM
agccucaugaaugaggc

SEQ ID NO: 4186035 - RNA, 22 nt, Yersinia pestis KIM
agccucggucacugccugcaca

SEQ ID NO: 4186036 - RNA, 21 nt, Yersinia pestis KIM
agccucuaccaaugccccgga

SEQ ID NO: 4186037 - RNA, 19 nt, Yersinia pestis KIM
agccucuauuaccucaaua

SEQ ID NO: 4186038 - RNA, 15 nt, Yersinia pestis KIM
agccugaauauucac

SEQ ID NO: 4186039 - RNA, 15 nt, Yersinia pestis KIM
agccugcaccucauc

SEQ ID NO: 4186040 - RNA, 18 nt, Yersinia pestis KIM
agccugccauacccgcug

SEQ ID NO: 4186041 - RNA, 12 nt, Yersinia pestis KIM
agccugccggga

SEQ ID NO: 4186042 - RNA, 13 nt, Yersinia pestis KIM
agccugccgggau

SEQ ID NO: 4186043 - RNA, 17 nt, Yersinia pestis KIM
agccugguguaaaaacu

SEQ ID NO: 4186044 - RNA, 21 nt, Yersinia pestis KIM
agccugguuuuuuaaaaaagu

SEQ ID NO: 4186045 - RNA, 16 nt, Yersinia pestis KIM
agccuguacauaaauu

SEQ ID NO: 4186046 - RNA, 13 nt, Yersinia pestis KIM
agccugugcgaca

SEQ ID NO: 4186047 - RNA, 17 nt, Yersinia pestis KIM
agccuuaacugcauagc

SEQ ID NO: 4186048 - RNA, 14 nt, Yersinia pestis KIM
agccuucagaugaa

SEQ ID NO: 4186049 - RNA, 15 nt, Yersinia pestis KIM
agccuucuaauauua

SEQ ID NO: 4186050 - RNA, 16 nt, Yersinia pestis KIM
agccuugauucagcuc

SEQ ID NO: 4186051 - RNA, 23 nt, Yersinia pestis KIM
agccuuguaacccgcuggcgacc

SEQ ID NO: 4186052 - RNA, 21 nt, Yersinia pestis KIM
agccuuguugaaucagauacg

SEQ ID NO: 4186053 - RNA, 11 nt, Yersinia pestis KIM
agccuuucagc

SEQ ID NO: 4186054 - RNA, 22 nt, Yersinia pestis KIM
agccuuuuuugcuuaaaacagg

SEQ ID NO: 4186055 - RNA, 14 nt, Yersinia pestis KIM
agcgacaaccugua

SEQ ID NO: 4186056 - RNA, 18 nt, Yersinia pestis KIM
agcgacauuucggccacc

SEQ ID NO: 4186057 - RNA, 18 nt, Yersinia pestis KIM
agcgaccaaauggacgaa

SEQ ID NO: 4186058 - RNA, 22 nt, Yersinia pestis KIM
agcgaccaaauggacgaacagc

SEQ ID NO: 4186059 - RNA, 20 nt, Yersinia pestis KIM
agcgaccaggcauuggcgcu

SEQ ID NO: 4186060 - RNA, 20 nt, Yersinia pestis KIM
agcgacgucccuaaagccau

SEQ ID NO: 4186061 - RNA, 21 nt, Yersinia pestis KIM
agcgacgucccuaaagccauc

SEQ ID NO: 4186062 - RNA, 18 nt, Yersinia pestis KIM
agcgacuccuggcaaugc

SEQ ID NO: 4186063 - RNA, 21 nt, Yersinia pestis KIM
agcgacuggucccgacaaaua

SEQ ID NO: 4186064 - RNA, 16 nt, Yersinia pestis KIM
agcgagcacugccccg

SEQ ID NO: 4186065 - RNA, 14 nt, Yersinia pestis KIM
agcgaggcuucuca

SEQ ID NO: 4186066 - RNA, 18 nt, Yersinia pestis KIM
agcgaguucccgauuauu

SEQ ID NO: 4186067 - RNA, 13 nt, Yersinia pestis KIM
agcgauaacagau

SEQ ID NO: 4186068 - RNA, 21 nt, Yersinia pestis KIM
agcgauagaguugauaaacaa

SEQ ID NO: 4186069 - RNA, 19 nt, Yersinia pestis KIM
agcgauagauccacuccag

SEQ ID NO: 4186070 - RNA, 14 nt, Yersinia pestis KIM
agcgauagccugau

SEQ ID NO: 4186071 - RNA, 20 nt, Yersinia pestis KIM
agcgauaguuaaauuauccc

SEQ ID NO: 4186072 - RNA, 12 nt, Yersinia pestis KIM
agcgauauccuu

SEQ ID NO: 4186073 - RNA, 14 nt, Yersinia pestis KIM
agcgaucagcaaua

SEQ ID NO: 4186074 - RNA, 12 nt, Yersinia pestis KIM
agcgaugaccau

SEQ ID NO: 4186075 - RNA, 18 nt, Yersinia pestis KIM
agcgaugaggcucuucug

SEQ ID NO: 4186076 - RNA, 18 nt, Yersinia pestis KIM
agcgauguucgcuccccc

SEQ ID NO: 4186077 - RNA, 18 nt, Yersinia pestis KIM
agcgauuaaaauaaagcg

SEQ ID NO: 4186078 - RNA, 16 nt, Yersinia pestis KIM
agcgauuuuaaaaaau

SEQ ID NO: 4186079 - RNA, 14 nt, Yersinia pestis KIM
agcgcacacccgau

SEQ ID NO: 4186080 - RNA, 18 nt, Yersinia pestis KIM
agcgcacugcaugccauu

SEQ ID NO: 4186081 - RNA, 15 nt, Yersinia pestis KIM
agcgcaggauaaagc

SEQ ID NO: 4186082 - RNA, 12 nt, Yersinia pestis KIM
agcgcagguaac

SEQ ID NO: 4186083 - RNA, 23 nt, Yersinia pestis KIM
agcgcauccaaccugcaaugccu

SEQ ID NO: 4186084 - RNA, 17 nt, Yersinia pestis KIM
agcgccagcggaauaug

SEQ ID NO: 4186085 - RNA, 20 nt, Yersinia pestis KIM
agcgcccggcugaccuguug

SEQ ID NO: 4186086 - RNA, 11 nt, Yersinia pestis KIM
agcgccugccc

SEQ ID NO: 4186087 - RNA, 13 nt, Yersinia pestis KIM
agcgccugcccuc

SEQ ID NO: 4186088 - RNA, 17 nt, Yersinia pestis KIM
agcgccugugggcggcu

SEQ ID NO: 4186089 - RNA, 21 nt, Yersinia pestis KIM
agcgccuucuuguaaaucuug

SEQ ID NO: 4186090 - RNA, 14 nt, Yersinia pestis KIM
agcgcgcuccagau

SEQ ID NO: 4186091 - RNA, 19 nt, Yersinia pestis KIM
agcgcgcuccagauuguca

SEQ ID NO: 4186092 - RNA, 14 nt, Yersinia pestis KIM
agcgcgguaacgaa

SEQ ID NO: 4186093 - RNA, 17 nt, Yersinia pestis KIM
agcgcgucgccugggaa

SEQ ID NO: 4186094 - RNA, 19 nt, Yersinia pestis KIM
agcgcguugcgcugaccau

SEQ ID NO: 4186095 - RNA, 15 nt, Yersinia pestis KIM
agcgcugcaucagca

SEQ ID NO: 4186096 - RNA, 19 nt, Yersinia pestis KIM
agcgcuggugcuggugaau

SEQ ID NO: 4186097 - RNA, 15 nt, Yersinia pestis KIM
agcgcuuccacugcg

SEQ ID NO: 4186098 - RNA, 15 nt, Yersinia pestis KIM
agcgcuugcugguau

SEQ ID NO: 4186099 - RNA, 19 nt, Yersinia pestis KIM
agcgcuugcugguauucau

SEQ ID NO: 4186100 - RNA, 18 nt, Yersinia pestis KIM
agcgcuuuaaccaaagaa

SEQ ID NO: 4186101 - RNA, 19 nt, Yersinia pestis KIM
agcgcuuuuucgggaaaaa

SEQ ID NO: 4186102 - RNA, 21 nt, Yersinia pestis KIM
agcgcuuuuucgggaaaaaau

SEQ ID NO: 4186103 - RNA, 14 nt, Yersinia pestis KIM
agcggcaaauagag

SEQ ID NO: 4186104 - RNA, 17 nt, Yersinia pestis KIM
agcggcaaauagagcac

SEQ ID NO: 4186105 - RNA, 13 nt, Yersinia pestis KIM
agcggcaauaaca

SEQ ID NO: 4186106 - RNA, 14 nt, Yersinia pestis KIM
agcggcaggggcgc

SEQ ID NO: 4186107 - RNA, 21 nt, Yersinia pestis KIM
agcggcaguuaugacgagauc

SEQ ID NO: 4186108 - RNA, 20 nt, Yersinia pestis KIM
agcggcauccaguaagcugu

SEQ ID NO: 4186109 - RNA, 15 nt, Yersinia pestis KIM
agcggcgaccgggga

SEQ ID NO: 4186110 - RNA, 14 nt, Yersinia pestis KIM
agcggcgauuaucg

SEQ ID NO: 4186111 - RNA, 18 nt, Yersinia pestis KIM
agcggcgauuucaucagc

SEQ ID NO: 4186112 - RNA, 16 nt, Yersinia pestis KIM
agcggcgggcuaaccc

SEQ ID NO: 4186113 - RNA, 20 nt, Yersinia pestis KIM
agcggcguauuaucaguaac

SEQ ID NO: 4186114 - RNA, 18 nt, Yersinia pestis KIM
agcggcguuguucucugg

SEQ ID NO: 4186115 - RNA, 22 nt, Yersinia pestis KIM
agcggcuuaaugauggccgcua

SEQ ID NO: 4186116 - RNA, 13 nt, Yersinia pestis KIM
agcgggcggcaau

SEQ ID NO: 4186117 - RNA, 17 nt, Yersinia pestis KIM
agcgggcggccucugcu

SEQ ID NO: 4186118 - RNA, 19 nt, Yersinia pestis KIM
agcgggcuaaaugcucgcu

SEQ ID NO: 4186119 - RNA, 13 nt, Yersinia pestis KIM
agcggggcaaaaa

SEQ ID NO: 4186120 - RNA, 20 nt, Yersinia pestis KIM
agcggggcggauaguuuuua

SEQ ID NO: 4186121 - RNA, 18 nt, Yersinia pestis KIM
agcggguuggcaucaaau

SEQ ID NO: 4186122 - RNA, 15 nt, Yersinia pestis KIM
agcgguagagaucuc

SEQ ID NO: 4186123 - RNA, 17 nt, Yersinia pestis KIM
agcgguaugaccgucac

SEQ ID NO: 4186124 - RNA, 14 nt, Yersinia pestis KIM
agcggugccuugcc

SEQ ID NO: 4186125 - RNA, 18 nt, Yersinia pestis KIM
agcgguuucauggcuggg

SEQ ID NO: 4186126 - RNA, 17 nt, Yersinia pestis KIM
agcgguuuguuaaaaag

SEQ ID NO: 4186127 - RNA, 13 nt, Yersinia pestis KIM
agcguaauucagc

SEQ ID NO: 4186128 - RNA, 15 nt, Yersinia pestis KIM
agcguacucaaugcu

SEQ ID NO: 4186129 - RNA, 16 nt, Yersinia pestis KIM
agcguagacaaugacu

SEQ ID NO: 4186130 - RNA, 20 nt, Yersinia pestis KIM
agcguaggcaacuaagcugc

SEQ ID NO: 4186131 - RNA, 15 nt, Yersinia pestis KIM
agcguauagcggcau

SEQ ID NO: 4186132 - RNA, 18 nt, Yersinia pestis KIM
agcguauuaaaccagugc

SEQ ID NO: 4186133 - RNA, 20 nt, Yersinia pestis KIM
agcguauucaguaaaaacug

SEQ ID NO: 4186134 - RNA, 21 nt, Yersinia pestis KIM
agcguauuuugucaugaaaau

SEQ ID NO: 4186135 - RNA, 12 nt, Yersinia pestis KIM
agcgucaaccca

SEQ ID NO: 4186136 - RNA, 15 nt, Yersinia pestis KIM
agcguccauaaaccc

SEQ ID NO: 4186137 - RNA, 17 nt, Yersinia pestis KIM
agcguccauguaucccg

SEQ ID NO: 4186138 - RNA, 14 nt, Yersinia pestis KIM
agcgugaaagcauc

SEQ ID NO: 4186139 - RNA, 19 nt, Yersinia pestis KIM
agcgugauuuuuauauuuu

SEQ ID NO: 4186140 - RNA, 16 nt, Yersinia pestis KIM
agcgugcgcuccauuu

SEQ ID NO: 4186141 - RNA, 22 nt, Yersinia pestis KIM
agcgugcgguagaccaccaacu

SEQ ID NO: 4186142 - RNA, 22 nt, Yersinia pestis KIM
agcgugcuacauagaaaauaau

SEQ ID NO: 4186143 - RNA, 21 nt, Yersinia pestis KIM
agcguggaauuaauaucccac

SEQ ID NO: 4186144 - RNA, 20 nt, Yersinia pestis KIM
agcguuaauuauagugaaaa

SEQ ID NO: 4186145 - RNA, 15 nt, Yersinia pestis KIM
agcguucaucgcccu

SEQ ID NO: 4186146 - RNA, 21 nt, Yersinia pestis KIM
agcguucuucugauucaauuu

SEQ ID NO: 4186147 - RNA, 22 nt, Yersinia pestis KIM
agcguugacuuucuaagcugcc

SEQ ID NO: 4186148 - RNA, 15 nt, Yersinia pestis KIM
agcguuuacuuuaaa

SEQ ID NO: 4186149 - RNA, 14 nt, Yersinia pestis KIM
agcguuucaccaaa

SEQ ID NO: 4186150 - RNA, 14 nt, Yersinia pestis KIM
agcuaaaaugaucu

SEQ ID NO: 4186151 - RNA, 17 nt, Yersinia pestis KIM
agcuaacaaaaccggga

SEQ ID NO: 4186152 - RNA, 22 nt, Yersinia pestis KIM
agcuaacaccgcuguagcguca

SEQ ID NO: 4186153 - RNA, 24 nt, Yersinia pestis KIM
agcuaacaccgcuguagcgucaag

SEQ ID NO: 4186154 - RNA, 22 nt, Yersinia pestis KIM
agcuaacgcuuucagguuguua

SEQ ID NO: 4186155 - RNA, 20 nt, Yersinia pestis KIM
agcuaauaaccguuucagga

SEQ ID NO: 4186156 - RNA, 14 nt, Yersinia pestis KIM
agcuaaucauugca

SEQ ID NO: 4186157 - RNA, 24 nt, Yersinia pestis KIM
agcuaauuuucauugauacaaaua

SEQ ID NO: 4186158 - RNA, 13 nt, Yersinia pestis KIM
agcuacagcucag

SEQ ID NO: 4186159 - RNA, 13 nt, Yersinia pestis KIM
agcuaccagcacc

SEQ ID NO: 4186160 - RNA, 22 nt, Yersinia pestis KIM
agcuaccggaaugaguugcccu

SEQ ID NO: 4186161 - RNA, 21 nt, Yersinia pestis KIM
agcuacggccuguaccaccac

SEQ ID NO: 4186162 - RNA, 19 nt, Yersinia pestis KIM
agcuacugcacgcauucuu

SEQ ID NO: 4186163 - RNA, 22 nt, Yersinia pestis KIM
agcuagaauaaguugaugcagu

SEQ ID NO: 4186164 - RNA, 19 nt, Yersinia pestis KIM
agcuagauggaaaucacac

SEQ ID NO: 4186165 - RNA, 13 nt, Yersinia pestis KIM
agcuagccugccc

SEQ ID NO: 4186166 - RNA, 14 nt, Yersinia pestis KIM
agcuauaaauaaau

SEQ ID NO: 4186167 - RNA, 14 nt, Yersinia pestis KIM
agcuauccaccauc

SEQ ID NO: 4186168 - RNA, 16 nt, Yersinia pestis KIM
agcuauguucacguaa

SEQ ID NO: 4186169 - RNA, 20 nt, Yersinia pestis KIM
agcuauuucuugcagugcuu

SEQ ID NO: 4186170 - RNA, 13 nt, Yersinia pestis KIM
agcucaagcuggc

SEQ ID NO: 4186171 - RNA, 13 nt, Yersinia pestis KIM
agcucaagcuggu

SEQ ID NO: 4186172 - RNA, 17 nt, Yersinia pestis KIM
agcucaagggcacaguu

SEQ ID NO: 4186173 - RNA, 23 nt, Yersinia pestis KIM
agcucaagggcacaguuuaucuc

SEQ ID NO: 4186174 - RNA, 22 nt, Yersinia pestis KIM
agcucacggaagguugccccca

SEQ ID NO: 4186175 - RNA, 16 nt, Yersinia pestis KIM
agcucagcuggauaga

SEQ ID NO: 4186176 - RNA, 19 nt, Yersinia pestis KIM
agcucauuaauccccgguc

SEQ ID NO: 4186177 - RNA, 19 nt, Yersinia pestis KIM
agcucccccacucgcccca

SEQ ID NO: 4186178 - RNA, 20 nt, Yersinia pestis KIM
agcucccccacucgccccac

SEQ ID NO: 4186179 - RNA, 17 nt, Yersinia pestis KIM
agcucgccaucgcacca

SEQ ID NO: 4186180 - RNA, 20 nt, Yersinia pestis KIM
agcucucacugcuccagcca

SEQ ID NO: 4186181 - RNA, 21 nt, Yersinia pestis KIM
agcucucacugcuccagccaa

SEQ ID NO: 4186182 - RNA, 17 nt, Yersinia pestis KIM
agcucucugagccaucc

SEQ ID NO: 4186183 - RNA, 10 nt, Yersinia pestis KIM
agcucugagg

SEQ ID NO: 4186184 - RNA, 15 nt, Yersinia pestis KIM
agcucuggccagauu

SEQ ID NO: 4186185 - RNA, 15 nt, Yersinia pestis KIM
agcucugggcugaug

SEQ ID NO: 4186186 - RNA, 15 nt, Yersinia pestis KIM
agcucuucuaacacu

SEQ ID NO: 4186187 - RNA, 17 nt, Yersinia pestis KIM
agcucuuuaucacuggg

SEQ ID NO: 4186188 - RNA, 12 nt, Yersinia pestis KIM
agcugaacugag

SEQ ID NO: 4186189 - RNA, 13 nt, Yersinia pestis KIM
agcugacgcagca

SEQ ID NO: 4186190 - RNA, 15 nt, Yersinia pestis KIM
agcugagauaagccu

SEQ ID NO: 4186191 - RNA, 16 nt, Yersinia pestis KIM
agcugaguaaagaucc

SEQ ID NO: 4186192 - RNA, 14 nt, Yersinia pestis KIM
agcugauaugaaaa

SEQ ID NO: 4186193 - RNA, 16 nt, Yersinia pestis KIM
agcugauaugaaaaau

SEQ ID NO: 4186194 - RNA, 21 nt, Yersinia pestis KIM
agcugauaugaaaaaucugac

SEQ ID NO: 4186195 - RNA, 18 nt, Yersinia pestis KIM
agcugauggcgaucaaaa

SEQ ID NO: 4186196 - RNA, 19 nt, Yersinia pestis KIM
agcugauggcgaucaaaau

SEQ ID NO: 4186197 - RNA, 13 nt, Yersinia pestis KIM
agcugccugugcg

SEQ ID NO: 4186198 - RNA, 15 nt, Yersinia pestis KIM
agcugcgauaauccg

SEQ ID NO: 4186199 - RNA, 16 nt, Yersinia pestis KIM
agcugcgcugaccuaa

SEQ ID NO: 4186200 - RNA, 21 nt, Yersinia pestis KIM
agcugcuuuaucguagccaau

SEQ ID NO: 4186201 - RNA, 17 nt, Yersinia pestis KIM
agcuggcggauaaaaau

SEQ ID NO: 4186202 - RNA, 18 nt, Yersinia pestis KIM
agcuguaaaggcaaagaa

SEQ ID NO: 4186203 - RNA, 22 nt, Yersinia pestis KIM
agcuguaaauagcuugcggcca

SEQ ID NO: 4186204 - RNA, 18 nt, Yersinia pestis KIM
agcuguaaauauaaaaua

SEQ ID NO: 4186205 - RNA, 15 nt, Yersinia pestis KIM
agcuguauugcccga

SEQ ID NO: 4186206 - RNA, 16 nt, Yersinia pestis KIM
agcuguuacugcccug

SEQ ID NO: 4186207 - RNA, 18 nt, Yersinia pestis KIM
agcuguuagccagauagg

SEQ ID NO: 4186208 - RNA, 20 nt, Yersinia pestis KIM
agcuguuggcuuuaucucac

SEQ ID NO: 4186209 - RNA, 21 nt, Yersinia pestis KIM
agcuuaacauccgaauuuuua

SEQ ID NO: 4186210 - RNA, 17 nt, Yersinia pestis KIM
agcuuaaucaucaucac

SEQ ID NO: 4186211 - RNA, 17 nt, Yersinia pestis KIM
agcuuaccgcggugaag

SEQ ID NO: 4186212 - RNA, 12 nt, Yersinia pestis KIM
agcuuagcccac

SEQ ID NO: 4186213 - RNA, 19 nt, Yersinia pestis KIM
agcuuaucagcguagauuu

SEQ ID NO: 4186214 - RNA, 18 nt, Yersinia pestis KIM
agcuucagcucuucuaac

SEQ ID NO: 4186215 - RNA, 17 nt, Yersinia pestis KIM
agcuuccaacugauaaa

SEQ ID NO: 4186216 - RNA, 19 nt, Yersinia pestis KIM
agcuucgccaccagauagu

SEQ ID NO: 4186217 - RNA, 15 nt, Yersinia pestis KIM
agcuucuggcugauu

SEQ ID NO: 4186218 - RNA, 12 nt, Yersinia pestis KIM
agcuugcugcug

SEQ ID NO: 4186219 - RNA, 13 nt, Yersinia pestis KIM
agcuugcuggcgg

SEQ ID NO: 4186220 - RNA, 23 nt, Yersinia pestis KIM
agcuuguugauaucaaucucuug

SEQ ID NO: 4186221 - RNA, 17 nt, Yersinia pestis KIM
agcuuuagcauugcaga

SEQ ID NO: 4186222 - RNA, 22 nt, Yersinia pestis KIM
agcuuuagcauugcagauuucu

SEQ ID NO: 4186223 - RNA, 20 nt, Yersinia pestis KIM
agcuuuagcggcgauuucau

SEQ ID NO: 4186224 - RNA, 20 nt, Yersinia pestis KIM
agcuuucuccuuugauuuga

SEQ ID NO: 4186225 - RNA, 21 nt, Yersinia pestis KIM
agcuuucugugguuggcagcu

SEQ ID NO: 4186226 - RNA, 18 nt, Yersinia pestis KIM
agcuuugccuaacggcau

SEQ ID NO: 4186227 - RNA, 16 nt, Yersinia pestis KIM
agcuuugggucaguua

SEQ ID NO: 4186228 - RNA, 18 nt, Yersinia pestis KIM
agcuuuuuacgcaacaag

SEQ ID NO: 4186229 - RNA, 16 nt, Yersinia pestis KIM
aggaaaacgccagcag

SEQ ID NO: 4186230 - RNA, 16 nt, Yersinia pestis KIM
aggaaaacguaaacau

SEQ ID NO: 4186231 - RNA, 17 nt, Yersinia pestis KIM
aggaaaauggaauagug

SEQ ID NO: 4186232 - RNA, 15 nt, Yersinia pestis KIM
aggaaacguauggcu

SEQ ID NO: 4186233 - RNA, 21 nt, Yersinia pestis KIM
aggaaacucaugacaucccag

SEQ ID NO: 4186234 - RNA, 15 nt, Yersinia pestis KIM
aggaaacuccaguca

SEQ ID NO: 4186235 - RNA, 19 nt, Yersinia pestis KIM
aggaaaggccggauguaaa

SEQ ID NO: 4186236 - RNA, 21 nt, Yersinia pestis KIM
aggaaaggccggauguaaaac

SEQ ID NO: 4186237 - RNA, 22 nt, Yersinia pestis KIM
aggaaaggccggauguaaaaca

SEQ ID NO: 4186238 - RNA, 21 nt, Yersinia pestis KIM
aggaaauaaaugacuaucccu

SEQ ID NO: 4186239 - RNA, 14 nt, Yersinia pestis KIM
aggaaauuucaguu

SEQ ID NO: 4186240 - RNA, 22 nt, Yersinia pestis KIM
aggaacccauuugcacagcauu

SEQ ID NO: 4186241 - RNA, 15 nt, Yersinia pestis KIM
aggaagagaaaagca

SEQ ID NO: 4186242 - RNA, 16 nt, Yersinia pestis KIM
aggaagcaaugaaaua

SEQ ID NO: 4186243 - RNA, 23 nt, Yersinia pestis KIM
aggaauaaacagcaguucaucuu

SEQ ID NO: 4186244 - RNA, 15 nt, Yersinia pestis KIM
aggaauaucugugau

SEQ ID NO: 4186245 - RNA, 19 nt, Yersinia pestis KIM
aggaauaucugugauaacc

SEQ ID NO: 4186246 - RNA, 19 nt, Yersinia pestis KIM
aggaaugccgauaagcccu

SEQ ID NO: 4186247 - RNA, 17 nt, Yersinia pestis KIM
aggaaugcgcccuuuuc

SEQ ID NO: 4186248 - RNA, 23 nt, Yersinia pestis KIM
aggaaugcgcccuuuuccgucag

SEQ ID NO: 4186249 - RNA, 16 nt, Yersinia pestis KIM
aggaauggcgugauau

SEQ ID NO: 4186250 - RNA, 20 nt, Yersinia pestis KIM
aggacgacggguauauugcc

SEQ ID NO: 4186251 - RNA, 17 nt, Yersinia pestis KIM
aggacuuauggguuuuu

SEQ ID NO: 4186252 - RNA, 13 nt, Yersinia pestis KIM
aggacuuccugcc

SEQ ID NO: 4186253 - RNA, 21 nt, Yersinia pestis KIM
aggagacagggggauaaaaac

SEQ ID NO: 4186254 - RNA, 19 nt, Yersinia pestis KIM
aggagauuucagacugcug

SEQ ID NO: 4186255 - RNA, 16 nt, Yersinia pestis KIM
aggaggcccaucuuuc

SEQ ID NO: 4186256 - RNA, 19 nt, Yersinia pestis KIM
aggagugaauuucuucccu

SEQ ID NO: 4186257 - RNA, 11 nt, Yersinia pestis KIM
aggauaaaaac

SEQ ID NO: 4186258 - RNA, 14 nt, Yersinia pestis KIM
aggauaaccaauuc

SEQ ID NO: 4186259 - RNA, 14 nt, Yersinia pestis KIM
aggauaaucaucag

SEQ ID NO: 4186260 - RNA, 15 nt, Yersinia pestis KIM
aggauaggcagaaua

SEQ ID NO: 4186261 - RNA, 14 nt, Yersinia pestis KIM
aggauaggcagagg

SEQ ID NO: 4186262 - RNA, 18 nt, Yersinia pestis KIM
aggauaggcagaggagua

SEQ ID NO: 4186263 - RNA, 18 nt, Yersinia pestis KIM
aggauaggcugaagagua

SEQ ID NO: 4186264 - RNA, 14 nt, Yersinia pestis KIM
aggauagggagcca

SEQ ID NO: 4186265 - RNA, 15 nt, Yersinia pestis KIM
aggauauuagggcug

SEQ ID NO: 4186266 - RNA, 16 nt, Yersinia pestis KIM
aggauggcccaagcca

SEQ ID NO: 4186267 - RNA, 18 nt, Yersinia pestis KIM
aggauggcgcggcucgag

SEQ ID NO: 4186268 - RNA, 12 nt, Yersinia pestis KIM
aggauugaccaa

SEQ ID NO: 4186269 - RNA, 22 nt, Yersinia pestis KIM
aggauuuauuucucugauaauc

SEQ ID NO: 4186270 - RNA, 17 nt, Yersinia pestis KIM
aggcaaaaagagucagu

SEQ ID NO: 4186271 - RNA, 15 nt, Yersinia pestis KIM
aggcaaagaagaaua

SEQ ID NO: 4186272 - RNA, 14 nt, Yersinia pestis KIM
aggcaacauuuguu

SEQ ID NO: 4186273 - RNA, 15 nt, Yersinia pestis KIM
aggcaaccaucagga

SEQ ID NO: 4186274 - RNA, 23 nt, Yersinia pestis KIM
aggcaaccuuggugaagaucaau

SEQ ID NO: 4186275 - RNA, 15 nt, Yersinia pestis KIM
aggcaacuaagcugc

SEQ ID NO: 4186276 - RNA, 16 nt, Yersinia pestis KIM
aggcaacuaagcugcc

SEQ ID NO: 4186277 - RNA, 15 nt, Yersinia pestis KIM
aggcaagcaaccgca

SEQ ID NO: 4186278 - RNA, 20 nt, Yersinia pestis KIM
aggcaauacaccgccaguau

SEQ ID NO: 4186279 - RNA, 13 nt, Yersinia pestis KIM
aggcaccaccaug

SEQ ID NO: 4186280 - RNA, 16 nt, Yersinia pestis KIM
aggcaccaccaugaug

SEQ ID NO: 4186281 - RNA, 16 nt, Yersinia pestis KIM
aggcaccagcgcacug

SEQ ID NO: 4186282 - RNA, 17 nt, Yersinia pestis KIM
aggcacgugccgcuggg

SEQ ID NO: 4186283 - RNA, 18 nt, Yersinia pestis KIM
aggcacuaacugcgccua

SEQ ID NO: 4186284 - RNA, 15 nt, Yersinia pestis KIM
aggcacugcagaaaa

SEQ ID NO: 4186285 - RNA, 16 nt, Yersinia pestis KIM
aggcacugcagaaaau

SEQ ID NO: 4186286 - RNA, 22 nt, Yersinia pestis KIM
aggcacuuugucaauaaccuca

SEQ ID NO: 4186287 - RNA, 17 nt, Yersinia pestis KIM
aggcagaaaaucccgau

SEQ ID NO: 4186288 - RNA, 13 nt, Yersinia pestis KIM
aggcagaaauaau

SEQ ID NO: 4186289 - RNA, 12 nt, Yersinia pestis KIM
aggcagauaaau

SEQ ID NO: 4186290 - RNA, 15 nt, Yersinia pestis KIM
aggcagauaaaucca

SEQ ID NO: 4186291 - RNA, 23 nt, Yersinia pestis KIM
aggcagauugagugcggacagcg

SEQ ID NO: 4186292 - RNA, 18 nt, Yersinia pestis KIM
aggcaggcccgcuucccu

SEQ ID NO: 4186293 - RNA, 22 nt, Yersinia pestis KIM
aggcaggggaguaaaggauggc

SEQ ID NO: 4186294 - RNA, 12 nt, Yersinia pestis KIM
aggcauaucacu

SEQ ID NO: 4186295 - RNA, 23 nt, Yersinia pestis KIM
aggcaucgguaauacucuggcca

SEQ ID NO: 4186296 - RNA, 22 nt, Yersinia pestis KIM
aggcaucugccacacugaauuu

SEQ ID NO: 4186297 - RNA, 18 nt, Yersinia pestis KIM
aggcaugauaagcaggaa

SEQ ID NO: 4186298 - RNA, 14 nt, Yersinia pestis KIM
aggcaugcucccuc

SEQ ID NO: 4186299 - RNA, 15 nt, Yersinia pestis KIM
aggcaugguaagaau

SEQ ID NO: 4186300 - RNA, 13 nt, Yersinia pestis KIM
aggcauuaucuga

SEQ ID NO: 4186301 - RNA, 15 nt, Yersinia pestis KIM
aggcauuggcgcuca

SEQ ID NO: 4186302 - RNA, 22 nt, Yersinia pestis KIM
aggcauuggcgcucagguggcu

SEQ ID NO: 4186303 - RNA, 13 nt, Yersinia pestis KIM
aggccaacacuca

SEQ ID NO: 4186304 - RNA, 12 nt, Yersinia pestis KIM
aggccaaccucu

SEQ ID NO: 4186305 - RNA, 20 nt, Yersinia pestis KIM
aggccaauagaaaaacacug

SEQ ID NO: 4186306 - RNA, 11 nt, Yersinia pestis KIM
aggccaaugga

SEQ ID NO: 4186307 - RNA, 20 nt, Yersinia pestis KIM
aggccacccccauaaccauu

SEQ ID NO: 4186308 - RNA, 22 nt, Yersinia pestis KIM
aggccauagcaaccggauacaa

SEQ ID NO: 4186309 - RNA, 16 nt, Yersinia pestis KIM
aggccauccacgcagg

SEQ ID NO: 4186310 - RNA, 17 nt, Yersinia pestis KIM
aggccauucaaugucca

SEQ ID NO: 4186311 - RNA, 12 nt, Yersinia pestis KIM
aggccauuggca

SEQ ID NO: 4186312 - RNA, 23 nt, Yersinia pestis KIM
aggccauuuuacugucggcgauc

SEQ ID NO: 4186313 - RNA, 14 nt, Yersinia pestis KIM
aggccccucggggc

SEQ ID NO: 4186314 - RNA, 20 nt, Yersinia pestis KIM
aggccccuuaaauaugaugu

SEQ ID NO: 4186315 - RNA, 20 nt, Yersinia pestis KIM
aggcccugagauucaaccca

SEQ ID NO: 4186316 - RNA, 12 nt, Yersinia pestis KIM
aggcccuuucac

SEQ ID NO: 4186317 - RNA, 17 nt, Yersinia pestis KIM
aggccgaguaacuccau

SEQ ID NO: 4186318 - RNA, 21 nt, Yersinia pestis KIM
aggccgcgaauaacagacguu

SEQ ID NO: 4186319 - RNA, 14 nt, Yersinia pestis KIM
aggccgcugcaagc

SEQ ID NO: 4186320 - RNA, 18 nt, Yersinia pestis KIM
aggccgugggcaauaaca

SEQ ID NO: 4186321 - RNA, 14 nt, Yersinia pestis KIM
aggccguucacccu

SEQ ID NO: 4186322 - RNA, 17 nt, Yersinia pestis KIM
aggccguucacccuuug

SEQ ID NO: 4186323 - RNA, 23 nt, Yersinia pestis KIM
aggccguucuuugguuaaagcgc

SEQ ID NO: 4186324 - RNA, 20 nt, Yersinia pestis KIM
aggccguuuaaaggucccuu

SEQ ID NO: 4186325 - RNA, 22 nt, Yersinia pestis KIM
aggccugcaccgguguucacuc

SEQ ID NO: 4186326 - RNA, 13 nt, Yersinia pestis KIM
aggcgaccaaugg

SEQ ID NO: 4186327 - RNA, 22 nt, Yersinia pestis KIM
aggcgaguuucccuuuuccauc

SEQ ID NO: 4186328 - RNA, 19 nt, Yersinia pestis KIM
aggcgauagcuucagcauu

SEQ ID NO: 4186329 - RNA, 14 nt, Yersinia pestis KIM
aggcgcagcagggc

SEQ ID NO: 4186330 - RNA, 14 nt, Yersinia pestis KIM
aggcgcaucgcgau

SEQ ID NO: 4186331 - RNA, 13 nt, Yersinia pestis KIM
aggcgcuccccug

SEQ ID NO: 4186332 - RNA, 19 nt, Yersinia pestis KIM
aggcggcccgcagauaauc

SEQ ID NO: 4186333 - RNA, 21 nt, Yersinia pestis KIM
aggcguagguuucagccucug

SEQ ID NO: 4186334 - RNA, 14 nt, Yersinia pestis KIM
aggcguuggcuucu

SEQ ID NO: 4186335 - RNA, 15 nt, Yersinia pestis KIM
aggcguuuuuuugcc

SEQ ID NO: 4186336 - RNA, 17 nt, Yersinia pestis KIM
aggcguuuuuuugccag

SEQ ID NO: 4186337 - RNA, 15 nt, Yersinia pestis KIM
aggcuaaaccggcac

SEQ ID NO: 4186338 - RNA, 18 nt, Yersinia pestis KIM
aggcuaaagacuucagcc

SEQ ID NO: 4186339 - RNA, 12 nt, Yersinia pestis KIM
aggcuaccaagg

SEQ ID NO: 4186340 - RNA, 14 nt, Yersinia pestis KIM
aggcuaccaaggcu

SEQ ID NO: 4186341 - RNA, 21 nt, Yersinia pestis KIM
aggcuaccgucauccagcacu

SEQ ID NO: 4186342 - RNA, 17 nt, Yersinia pestis KIM
aggcuaccugcaccaau

SEQ ID NO: 4186343 - RNA, 16 nt, Yersinia pestis KIM
aggcuaucgaucacuu

SEQ ID NO: 4186344 - RNA, 17 nt, Yersinia pestis KIM
aggcuauuuaagccagc

SEQ ID NO: 4186345 - RNA, 21 nt, Yersinia pestis KIM
aggcucacugucuuuaaaagg

SEQ ID NO: 4186346 - RNA, 17 nt, Yersinia pestis KIM
aggcucagcacaaacau

SEQ ID NO: 4186347 - RNA, 18 nt, Yersinia pestis KIM
aggcucagcacaaacaug

SEQ ID NO: 4186348 - RNA, 18 nt, Yersinia pestis KIM
aggcucaucaccuuccaa

SEQ ID NO: 4186349 - RNA, 19 nt, Yersinia pestis KIM
aggcucaucaccuuccaaa

SEQ ID NO: 4186350 - RNA, 17 nt, Yersinia pestis KIM
aggcucauccugcgggc

SEQ ID NO: 4186351 - RNA, 20 nt, Yersinia pestis KIM
aggcucgagccgcgccaucc

SEQ ID NO: 4186352 - RNA, 19 nt, Yersinia pestis KIM
aggcucuggcaauggcuag

SEQ ID NO: 4186353 - RNA, 17 nt, Yersinia pestis KIM
aggcucuggucacuaaa

SEQ ID NO: 4186354 - RNA, 14 nt, Yersinia pestis KIM
aggcucuguuuuac

SEQ ID NO: 4186355 - RNA, 18 nt, Yersinia pestis KIM
aggcugacuugcagguuc

SEQ ID NO: 4186356 - RNA, 12 nt, Yersinia pestis KIM
aggcugcaccuu

SEQ ID NO: 4186357 - RNA, 21 nt, Yersinia pestis KIM
aggcugcguaacgguucacgc

SEQ ID NO: 4186358 - RNA, 17 nt, Yersinia pestis KIM
aggcugugguggcgguc

SEQ ID NO: 4186359 - RNA, 22 nt, Yersinia pestis KIM
aggcuguugcguaccauaugga

SEQ ID NO: 4186360 - RNA, 21 nt, Yersinia pestis KIM
aggcuugaaguucucaucaaa

SEQ ID NO: 4186361 - RNA, 17 nt, Yersinia pestis KIM
aggcuuggcgggcuggc

SEQ ID NO: 4186362 - RNA, 16 nt, Yersinia pestis KIM
aggcuuuaggugcgca

SEQ ID NO: 4186363 - RNA, 13 nt, Yersinia pestis KIM
aggcuuucaagac

SEQ ID NO: 4186364 - RNA, 15 nt, Yersinia pestis KIM
aggcuuucacggugc

SEQ ID NO: 4186365 - RNA, 20 nt, Yersinia pestis KIM
aggcuuucacggugcgucag

SEQ ID NO: 4186366 - RNA, 15 nt, Yersinia pestis KIM
aggcuuugccugccc

SEQ ID NO: 4186367 - RNA, 14 nt, Yersinia pestis KIM
aggcuuuuuacuuu

SEQ ID NO: 4186368 - RNA, 15 nt, Yersinia pestis KIM
agggaaaaacgcaga

SEQ ID NO: 4186369 - RNA, 15 nt, Yersinia pestis KIM
agggaauaaugguau

SEQ ID NO: 4186370 - RNA, 18 nt, Yersinia pestis KIM
agggacgcgaaucccccc

SEQ ID NO: 4186371 - RNA, 16 nt, Yersinia pestis KIM
agggagccaauagagg

SEQ ID NO: 4186372 - RNA, 18 nt, Yersinia pestis KIM
agggagccaauagaggcu

SEQ ID NO: 4186373 - RNA, 22 nt, Yersinia pestis KIM
agggagccgcccugcauucugg

SEQ ID NO: 4186374 - RNA, 18 nt, Yersinia pestis KIM
agggagcuuugcuaguga

SEQ ID NO: 4186375 - RNA, 14 nt, Yersinia pestis KIM
agggagucagggag

SEQ ID NO: 4186376 - RNA, 15 nt, Yersinia pestis KIM
agggagucagggagu

SEQ ID NO: 4186377 - RNA, 19 nt, Yersinia pestis KIM
agggagucagggagucagg

SEQ ID NO: 4186378 - RNA, 21 nt, Yersinia pestis KIM
agggagucagggagucaggga

SEQ ID NO: 4186379 - RNA, 16 nt, Yersinia pestis KIM
agggaguuacucagca

SEQ ID NO: 4186380 - RNA, 13 nt, Yersinia pestis KIM
agggaguucauca

SEQ ID NO: 4186381 - RNA, 15 nt, Yersinia pestis KIM
agggaguucaucaaa

SEQ ID NO: 4186382 - RNA, 22 nt, Yersinia pestis KIM
agggauaucucaccgccaauau

SEQ ID NO: 4186383 - RNA, 19 nt, Yersinia pestis KIM
agggauaugacagaaaaau

SEQ ID NO: 4186384 - RNA, 21 nt, Yersinia pestis KIM
agggcaauaaaaaaggcagcg

SEQ ID NO: 4186385 - RNA, 15 nt, Yersinia pestis KIM
agggcagccaauuac

SEQ ID NO: 4186386 - RNA, 20 nt, Yersinia pestis KIM
agggccacccugccaaaaaa

SEQ ID NO: 4186387 - RNA, 18 nt, Yersinia pestis KIM
agggccacuucgguggcc

SEQ ID NO: 4186388 - RNA, 18 nt, Yersinia pestis KIM
agggccgcccagauaaag

SEQ ID NO: 4186389 - RNA, 16 nt, Yersinia pestis KIM
agggcgauaccucuac

SEQ ID NO: 4186390 - RNA, 14 nt, Yersinia pestis KIM
agggcgaucaggaa

SEQ ID NO: 4186391 - RNA, 16 nt, Yersinia pestis KIM
agggcgcauccccauc

SEQ ID NO: 4186392 - RNA, 11 nt, Yersinia pestis KIM
agggcgccccg

SEQ ID NO: 4186393 - RNA, 20 nt, Yersinia pestis KIM
agggcgcgcuucgagccccc

SEQ ID NO: 4186394 - RNA, 19 nt, Yersinia pestis KIM
agggcguucugucacaauc

SEQ ID NO: 4186395 - RNA, 21 nt, Yersinia pestis KIM
agggcguuuaccauccagugc

SEQ ID NO: 4186396 - RNA, 21 nt, Yersinia pestis KIM
agggcuauuuuuaugcaggga

SEQ ID NO: 4186397 - RNA, 20 nt, Yersinia pestis KIM
agggcucgguuucacccucu

SEQ ID NO: 4186398 - RNA, 19 nt, Yersinia pestis KIM
agggcugauccguuaucua

SEQ ID NO: 4186399 - RNA, 16 nt, Yersinia pestis KIM
agggcuguuauccggg

SEQ ID NO: 4186400 - RNA, 22 nt, Yersinia pestis KIM
agggcuucuggcgugucaucuu

SEQ ID NO: 4186401 - RNA, 22 nt, Yersinia pestis KIM
aggggaaucuaccgcagaaccu

SEQ ID NO: 4186402 - RNA, 17 nt, Yersinia pestis KIM
aggggauaaaccaauca

SEQ ID NO: 4186403 - RNA, 20 nt, Yersinia pestis KIM
aggggaugacaccuuucaaa

SEQ ID NO: 4186404 - RNA, 20 nt, Yersinia pestis KIM
aggggcaguuguuggagaau

SEQ ID NO: 4186405 - RNA, 18 nt, Yersinia pestis KIM
aggggccaacaggccccu

SEQ ID NO: 4186406 - RNA, 18 nt, Yersinia pestis KIM
aggggccaauaggccccu

SEQ ID NO: 4186407 - RNA, 15 nt, Yersinia pestis KIM
aggggcuagccagcg

SEQ ID NO: 4186408 - RNA, 14 nt, Yersinia pestis KIM
aggggcuuguguuc

SEQ ID NO: 4186409 - RNA, 22 nt, Yersinia pestis KIM
aggggcuuguguucuucaucua

SEQ ID NO: 4186410 - RNA, 19 nt, Yersinia pestis KIM
agggggcaauugaaaaugg

SEQ ID NO: 4186411 - RNA, 16 nt, Yersinia pestis KIM
agggggcuuauucuaa

SEQ ID NO: 4186412 - RNA, 16 nt, Yersinia pestis KIM
agggguacagcaggga

SEQ ID NO: 4186413 - RNA, 14 nt, Yersinia pestis KIM
agggguucuuccaa

SEQ ID NO: 4186414 - RNA, 14 nt, Yersinia pestis KIM
aggguaaccaaugu

SEQ ID NO: 4186415 - RNA, 19 nt, Yersinia pestis KIM
aggguaaguccaucagccu

SEQ ID NO: 4186416 - RNA, 20 nt, Yersinia pestis KIM
aggguaaucagaaguucaga

SEQ ID NO: 4186417 - RNA, 12 nt, Yersinia pestis KIM
aggguauaugga

SEQ ID NO: 4186418 - RNA, 14 nt, Yersinia pestis KIM
aggguauugaagau

SEQ ID NO: 4186419 - RNA, 15 nt, Yersinia pestis KIM
aggguauugaagaua

SEQ ID NO: 4186420 - RNA, 17 nt, Yersinia pestis KIM
aggguauugaagauacc

SEQ ID NO: 4186421 - RNA, 22 nt, Yersinia pestis KIM
agggucagaauacguagcccuu

SEQ ID NO: 4186422 - RNA, 16 nt, Yersinia pestis KIM
agggucauaguuuuua

SEQ ID NO: 4186423 - RNA, 14 nt, Yersinia pestis KIM
agggugaugacaau

SEQ ID NO: 4186424 - RNA, 20 nt, Yersinia pestis KIM
aggguggaaacagguagugg

SEQ ID NO: 4186425 - RNA, 16 nt, Yersinia pestis KIM
aggguggagagaaagg

SEQ ID NO: 4186426 - RNA, 21 nt, Yersinia pestis KIM
agggugggauauuaauuccac

SEQ ID NO: 4186427 - RNA, 19 nt, Yersinia pestis KIM
aggguggucaacugugcca

SEQ ID NO: 4186428 - RNA, 21 nt, Yersinia pestis KIM
aggguucgaaucccucccuca

SEQ ID NO: 4186429 - RNA, 21 nt, Yersinia pestis KIM
aggguugcgggccucuucuuu

SEQ ID NO: 4186430 - RNA, 17 nt, Yersinia pestis KIM
aggguuucuccacagug

SEQ ID NO: 4186431 - RNA, 18 nt, Yersinia pestis KIM
aggguuuugugggagagg

SEQ ID NO: 4186432 - RNA, 18 nt, Yersinia pestis KIM
agguaaaccgguuaaaac

SEQ ID NO: 4186433 - RNA, 17 nt, Yersinia pestis KIM
agguaaauaagauagcc

SEQ ID NO: 4186434 - RNA, 16 nt, Yersinia pestis KIM
agguaaauccuucugg

SEQ ID NO: 4186435 - RNA, 23 nt, Yersinia pestis KIM
agguaacgccgcuguagcgccaa

SEQ ID NO: 4186436 - RNA, 23 nt, Yersinia pestis KIM
agguaacggaaggggaauauaau

SEQ ID NO: 4186437 - RNA, 15 nt, Yersinia pestis KIM
agguaacuaagcugc

SEQ ID NO: 4186438 - RNA, 18 nt, Yersinia pestis KIM
agguaacuuaaaauaugg

SEQ ID NO: 4186439 - RNA, 12 nt, Yersinia pestis KIM
agguaagaaaga

SEQ ID NO: 4186440 - RNA, 15 nt, Yersinia pestis KIM
agguaagaaagagau

SEQ ID NO: 4186441 - RNA, 12 nt, Yersinia pestis KIM
agguaagcagag

SEQ ID NO: 4186442 - RNA, 19 nt, Yersinia pestis KIM
agguaagccuuucuccaca

SEQ ID NO: 4186443 - RNA, 20 nt, Yersinia pestis KIM
agguaagccuuucuccacau

SEQ ID NO: 4186444 - RNA, 14 nt, Yersinia pestis KIM
agguaauaccaaug

SEQ ID NO: 4186445 - RNA, 15 nt, Yersinia pestis KIM
agguaauaccaaugc

SEQ ID NO: 4186446 - RNA, 16 nt, Yersinia pestis KIM
agguaaucagacugcu

SEQ ID NO: 4186447 - RNA, 17 nt, Yersinia pestis KIM
agguaaucagacugcug

SEQ ID NO: 4186448 - RNA, 18 nt, Yersinia pestis KIM
agguaaucagacugcuga

SEQ ID NO: 4186449 - RNA, 19 nt, Yersinia pestis KIM
agguaaucagacugcugac

SEQ ID NO: 4186450 - RNA, 20 nt, Yersinia pestis KIM
agguaaucagacugcugaca

SEQ ID NO: 4186451 - RNA, 19 nt, Yersinia pestis KIM
agguaaugcauucugcugg

SEQ ID NO: 4186452 - RNA, 16 nt, Yersinia pestis KIM
agguaaugucacugcc

SEQ ID NO: 4186453 - RNA, 16 nt, Yersinia pestis KIM
agguaccccauaaauc

SEQ ID NO: 4186454 - RNA, 18 nt, Yersinia pestis KIM
agguaccugaucagcauu

SEQ ID NO: 4186455 - RNA, 22 nt, Yersinia pestis KIM
agguagaucaaacauaaccugc

SEQ ID NO: 4186456 - RNA, 19 nt, Yersinia pestis KIM
agguauacaccucaacgug

SEQ ID NO: 4186457 - RNA, 23 nt, Yersinia pestis KIM
agguauuucuccauugcgguuca

SEQ ID NO: 4186458 - RNA, 22 nt, Yersinia pestis KIM
aggucaaaugagucguaaaauu

SEQ ID NO: 4186459 - RNA, 19 nt, Yersinia pestis KIM
aggucaauaucgauuuuua

SEQ ID NO: 4186460 - RNA, 16 nt, Yersinia pestis KIM
aggucaaucuuauuga

SEQ ID NO: 4186461 - RNA, 21 nt, Yersinia pestis KIM
aggucaauugcggccagccuu

SEQ ID NO: 4186462 - RNA, 18 nt, Yersinia pestis KIM
aggucacuguuucgccuu

SEQ ID NO: 4186463 - RNA, 15 nt, Yersinia pestis KIM
aggucaggaagagaa

SEQ ID NO: 4186464 - RNA, 14 nt, Yersinia pestis KIM
aggucaucccagca

SEQ ID NO: 4186465 - RNA, 16 nt, Yersinia pestis KIM
aggucaucccagcaca

SEQ ID NO: 4186466 - RNA, 16 nt, Yersinia pestis KIM
aggucaucgucacgau

SEQ ID NO: 4186467 - RNA, 21 nt, Yersinia pestis KIM
aggucauucccgagauaacca

SEQ ID NO: 4186468 - RNA, 14 nt, Yersinia pestis KIM
aggucgccucuggg

SEQ ID NO: 4186469 - RNA, 15 nt, Yersinia pestis KIM
aggucgggcgcugag

SEQ ID NO: 4186470 - RNA, 22 nt, Yersinia pestis KIM
aggugacaggcaaagacuacac

SEQ ID NO: 4186471 - RNA, 20 nt, Yersinia pestis KIM
aggugauacaucaaaucaga

SEQ ID NO: 4186472 - RNA, 16 nt, Yersinia pestis KIM
aggugaugucagccgu

SEQ ID NO: 4186473 - RNA, 23 nt, Yersinia pestis KIM
aggugccacacagaaucaccaac

SEQ ID NO: 4186474 - RNA, 14 nt, Yersinia pestis KIM
aggugcccgcuugu

SEQ ID NO: 4186475 - RNA, 21 nt, Yersinia pestis KIM
aggugcgggaugcaguuacug

SEQ ID NO: 4186476 - RNA, 22 nt, Yersinia pestis KIM
aggugcguuaucuucacguaca

SEQ ID NO: 4186477 - RNA, 18 nt, Yersinia pestis KIM
agguggcacccagugacc

SEQ ID NO: 4186478 - RNA, 21 nt, Yersinia pestis KIM
agguggcgauaaagagugaaa

SEQ ID NO: 4186479 - RNA, 13 nt, Yersinia pestis KIM
aggugucaucaag

SEQ ID NO: 4186480 - RNA, 18 nt, Yersinia pestis KIM
aggugugcggauggcugc

SEQ ID NO: 4186481 - RNA, 22 nt, Yersinia pestis KIM
agguguuaacgcgccggaauua

SEQ ID NO: 4186482 - RNA, 20 nt, Yersinia pestis KIM
agguguuacaacaugaaagg

SEQ ID NO: 4186483 - RNA, 21 nt, Yersinia pestis KIM
agguuaacagccccgucucaa

SEQ ID NO: 4186484 - RNA, 14 nt, Yersinia pestis KIM
agguuaacugcagu

SEQ ID NO: 4186485 - RNA, 15 nt, Yersinia pestis KIM
agguuaacugcagug

SEQ ID NO: 4186486 - RNA, 16 nt, Yersinia pestis KIM
agguuauugacaaaga

SEQ ID NO: 4186487 - RNA, 23 nt, Yersinia pestis KIM
agguuauugacaaagagcccgca

SEQ ID NO: 4186488 - RNA, 21 nt, Yersinia pestis KIM
agguuauugacaaagugccug

SEQ ID NO: 4186489 - RNA, 14 nt, Yersinia pestis KIM
agguucaauucccg

SEQ ID NO: 4186490 - RNA, 18 nt, Yersinia pestis KIM
agguucggcgcaaucaua

SEQ ID NO: 4186491 - RNA, 22 nt, Yersinia pestis KIM
agguucuaaaccuauugauguu

SEQ ID NO: 4186492 - RNA, 18 nt, Yersinia pestis KIM
agguucuccaggguuucu

SEQ ID NO: 4186493 - RNA, 14 nt, Yersinia pestis KIM
agguugaaauaaau

SEQ ID NO: 4186494 - RNA, 15 nt, Yersinia pestis KIM
agguugaaauaaaua

SEQ ID NO: 4186495 - RNA, 15 nt, Yersinia pestis KIM
agguugcagcuaaac

SEQ ID NO: 4186496 - RNA, 17 nt, Yersinia pestis KIM
agguuguauuuugcagg

SEQ ID NO: 4186497 - RNA, 16 nt, Yersinia pestis KIM
agguuuggccuaacaa

SEQ ID NO: 4186498 - RNA, 19 nt, Yersinia pestis KIM
agguuuucccuuagggcaa

SEQ ID NO: 4186499 - RNA, 11 nt, Yersinia pestis KIM
aguaaaaaaaa

SEQ ID NO: 4186500 - RNA, 16 nt, Yersinia pestis KIM
aguaaaaacucacugu

SEQ ID NO: 4186501 - RNA, 17 nt, Yersinia pestis KIM
aguaaaacugauauaaa

SEQ ID NO: 4186502 - RNA, 18 nt, Yersinia pestis KIM
aguaaaagauucauaaaa

SEQ ID NO: 4186503 - RNA, 17 nt, Yersinia pestis KIM
aguaaaagucagcaaau

SEQ ID NO: 4186504 - RNA, 16 nt, Yersinia pestis KIM
aguaaaaucaucagcc

SEQ ID NO: 4186505 - RNA, 12 nt, Yersinia pestis KIM
aguaaacagcca

SEQ ID NO: 4186506 - RNA, 18 nt, Yersinia pestis KIM
aguaaagauccccacaaa

SEQ ID NO: 4186507 - RNA, 14 nt, Yersinia pestis KIM
aguaaagcccagca

SEQ ID NO: 4186508 - RNA, 23 nt, Yersinia pestis KIM
aguaaagcccagcaggcugugau

SEQ ID NO: 4186509 - RNA, 21 nt, Yersinia pestis KIM
aguaaauaccuucagacugac

SEQ ID NO: 4186510 - RNA, 13 nt, Yersinia pestis KIM
aguaaauagcaaa

SEQ ID NO: 4186511 - RNA, 14 nt, Yersinia pestis KIM
aguaaauagcaaaa

SEQ ID NO: 4186512 - RNA, 19 nt, Yersinia pestis KIM
aguaaaucuacuuuauuca

SEQ ID NO: 4186513 - RNA, 17 nt, Yersinia pestis KIM
aguaacaccagcauccu

SEQ ID NO: 4186514 - RNA, 20 nt, Yersinia pestis KIM
aguaacaccagcauccugca

SEQ ID NO: 4186515 - RNA, 23 nt, Yersinia pestis KIM
aguaacaccagcauccugcaaau

SEQ ID NO: 4186516 - RNA, 18 nt, Yersinia pestis KIM
aguaacacuucagacuga

SEQ ID NO: 4186517 - RNA, 21 nt, Yersinia pestis KIM
aguaacacuucagacugaaag

SEQ ID NO: 4186518 - RNA, 23 nt, Yersinia pestis KIM
aguaacccagccccuaacagcag

SEQ ID NO: 4186519 - RNA, 14 nt, Yersinia pestis KIM
aguaacucaaguau

SEQ ID NO: 4186520 - RNA, 17 nt, Yersinia pestis KIM
aguaacucgacaaccuu

SEQ ID NO: 4186521 - RNA, 15 nt, Yersinia pestis KIM
aguaacugaucaaua

SEQ ID NO: 4186522 - RNA, 14 nt, Yersinia pestis KIM
aguaagacaacuua

SEQ ID NO: 4186523 - RNA, 13 nt, Yersinia pestis KIM
aguaagaugucau

SEQ ID NO: 4186524 - RNA, 15 nt, Yersinia pestis KIM
aguaaggcagcaagu

SEQ ID NO: 4186525 - RNA, 23 nt, Yersinia pestis KIM
aguaagugauucgggugagugaa

SEQ ID NO: 4186526 - RNA, 18 nt, Yersinia pestis KIM
aguaaguucgucagugau

SEQ ID NO: 4186527 - RNA, 15 nt, Yersinia pestis KIM
aguaauauuauucaa

SEQ ID NO: 4186528 - RNA, 23 nt, Yersinia pestis KIM
aguaaucgccugcugagccaaau

SEQ ID NO: 4186529 - RNA, 12 nt, Yersinia pestis KIM
aguaaugaaauc

SEQ ID NO: 4186530 - RNA, 19 nt, Yersinia pestis KIM
aguaauuucagauaaaaau

SEQ ID NO: 4186531 - RNA, 22 nt, Yersinia pestis KIM
aguaauuucagauaaaaauaau

SEQ ID NO: 4186532 - RNA, 22 nt, Yersinia pestis KIM
aguaauuuccuuggcagcaaua

SEQ ID NO: 4186533 - RNA, 21 nt, Yersinia pestis KIM
aguacaaaaaacaaaccgggg

SEQ ID NO: 4186534 - RNA, 17 nt, Yersinia pestis KIM
aguacaccgauaaaagu

SEQ ID NO: 4186535 - RNA, 18 nt, Yersinia pestis KIM
aguacagcacucaguaca

SEQ ID NO: 4186536 - RNA, 22 nt, Yersinia pestis KIM
aguacaucaauagugcgaucaa

SEQ ID NO: 4186537 - RNA, 19 nt, Yersinia pestis KIM
aguacggugccagcagcaa

SEQ ID NO: 4186538 - RNA, 21 nt, Yersinia pestis KIM
aguacggugccagcagcaagu

SEQ ID NO: 4186539 - RNA, 22 nt, Yersinia pestis KIM
aguacguagcgauaacagauau

SEQ ID NO: 4186540 - RNA, 20 nt, Yersinia pestis KIM
aguacuaacgucaacagaac

SEQ ID NO: 4186541 - RNA, 20 nt, Yersinia pestis KIM
aguacucaccgccguauuca

SEQ ID NO: 4186542 - RNA, 19 nt, Yersinia pestis KIM
aguacuuauuugaaacacu

SEQ ID NO: 4186543 - RNA, 15 nt, Yersinia pestis KIM
aguacuucagguaau

SEQ ID NO: 4186544 - RNA, 22 nt, Yersinia pestis KIM
aguagcaauaaggugccacaca

SEQ ID NO: 4186545 - RNA, 16 nt, Yersinia pestis KIM
aguagcacaaugccua

SEQ ID NO: 4186546 - RNA, 22 nt, Yersinia pestis KIM
aguagcaggcgcacguuaccgu

SEQ ID NO: 4186547 - RNA, 14 nt, Yersinia pestis KIM
aguagcauaaaaau

SEQ ID NO: 4186548 - RNA, 19 nt, Yersinia pestis KIM
aguagcauaaaaaucaaua

SEQ ID NO: 4186549 - RNA, 11 nt, Yersinia pestis KIM
aguagcccagc

SEQ ID NO: 4186550 - RNA, 15 nt, Yersinia pestis KIM
aguagcuaauaaaau

SEQ ID NO: 4186551 - RNA, 21 nt, Yersinia pestis KIM
aguagggauuuaugcaaauaa

SEQ ID NO: 4186552 - RNA, 19 nt, Yersinia pestis KIM
aguaguggaaaaacugaaa

SEQ ID NO: 4186553 - RNA, 16 nt, Yersinia pestis KIM
aguauacuaaaacagc

SEQ ID NO: 4186554 - RNA, 20 nt, Yersinia pestis KIM
aguaucagcgauuuuaaaaa

SEQ ID NO: 4186555 - RNA, 22 nt, Yersinia pestis KIM
aguaucagcgauuuuaaaaaau

SEQ ID NO: 4186556 - RNA, 21 nt, Yersinia pestis KIM
aguauccgcgccagacuggcc

SEQ ID NO: 4186557 - RNA, 23 nt, Yersinia pestis KIM
aguaucgcuaucaccggaugaaa

SEQ ID NO: 4186558 - RNA, 15 nt, Yersinia pestis KIM
aguaucuaugcagcg

SEQ ID NO: 4186559 - RNA, 19 nt, Yersinia pestis KIM
aguaucugggugagagguu

SEQ ID NO: 4186560 - RNA, 12 nt, Yersinia pestis KIM
aguaugcaacag

SEQ ID NO: 4186561 - RNA, 15 nt, Yersinia pestis KIM
aguauguauccaucu

SEQ ID NO: 4186562 - RNA, 17 nt, Yersinia pestis KIM
aguauuaccucaucauu

SEQ ID NO: 4186563 - RNA, 18 nt, Yersinia pestis KIM
aguauucgccagauacaa

SEQ ID NO: 4186564 - RNA, 19 nt, Yersinia pestis KIM
aguauucgccagauacaag

SEQ ID NO: 4186565 - RNA, 18 nt, Yersinia pestis KIM
aguauugcagagcaaaac

SEQ ID NO: 4186566 - RNA, 19 nt, Yersinia pestis KIM
aguauuuaacgccaccaau

SEQ ID NO: 4186567 - RNA, 23 nt, Yersinia pestis KIM
aguauuuaacgccaccaaugcau

SEQ ID NO: 4186568 - RNA, 13 nt, Yersinia pestis KIM
aguauuuguagug

SEQ ID NO: 4186569 - RNA, 14 nt, Yersinia pestis KIM
aguauuuguaguga

SEQ ID NO: 4186570 - RNA, 17 nt, Yersinia pestis KIM
aguauuuuaagaaaacu

SEQ ID NO: 4186571 - RNA, 20 nt, Yersinia pestis KIM
agucaaaacaauaucuauuu

SEQ ID NO: 4186572 - RNA, 15 nt, Yersinia pestis KIM
agucaaaaugaaauu

SEQ ID NO: 4186573 - RNA, 21 nt, Yersinia pestis KIM
agucaaagcgcucagcgccau

SEQ ID NO: 4186574 - RNA, 22 nt, Yersinia pestis KIM
agucaaaucgauuugcugcugc

SEQ ID NO: 4186575 - RNA, 18 nt, Yersinia pestis KIM
agucaauaaauaaaaacg

SEQ ID NO: 4186576 - RNA, 23 nt, Yersinia pestis KIM
agucaauaaauccguggcccccu

SEQ ID NO: 4186577 - RNA, 21 nt, Yersinia pestis KIM
agucaauacaccuugcagcac

SEQ ID NO: 4186578 - RNA, 19 nt, Yersinia pestis KIM
agucaauguucucugggua

SEQ ID NO: 4186579 - RNA, 14 nt, Yersinia pestis KIM
agucaauugagaau

SEQ ID NO: 4186580 - RNA, 13 nt, Yersinia pestis KIM
agucaauuucagc

SEQ ID NO: 4186581 - RNA, 19 nt, Yersinia pestis KIM
agucacaucgcgcuuuuua

SEQ ID NO: 4186582 - RNA, 14 nt, Yersinia pestis KIM
agucacauuuuuaa

SEQ ID NO: 4186583 - RNA, 15 nt, Yersinia pestis KIM
agucacauuuuuaau

SEQ ID NO: 4186584 - RNA, 22 nt, Yersinia pestis KIM
agucacgaaggcaaccagcaca

SEQ ID NO: 4186585 - RNA, 13 nt, Yersinia pestis KIM
agucacuggccgc

SEQ ID NO: 4186586 - RNA, 16 nt, Yersinia pestis KIM
agucacuuugggcuga

SEQ ID NO: 4186587 - RNA, 16 nt, Yersinia pestis KIM
agucagauugucagac

SEQ ID NO: 4186588 - RNA, 19 nt, Yersinia pestis KIM
agucagcaaaucaaacaaa

SEQ ID NO: 4186589 - RNA, 17 nt, Yersinia pestis KIM
agucagcuagccugccc

SEQ ID NO: 4186590 - RNA, 17 nt, Yersinia pestis KIM
agucagggagucaggga

SEQ ID NO: 4186591 - RNA, 15 nt, Yersinia pestis KIM
agucagggugaaagc

SEQ ID NO: 4186592 - RNA, 13 nt, Yersinia pestis KIM
agucagucagggu

SEQ ID NO: 4186593 - RNA, 18 nt, Yersinia pestis KIM
agucagugauucggguga

SEQ ID NO: 4186594 - RNA, 15 nt, Yersinia pestis KIM
agucaguucauuaca

SEQ ID NO: 4186595 - RNA, 15 nt, Yersinia pestis KIM
agucauaagguuaau

SEQ ID NO: 4186596 - RNA, 18 nt, Yersinia pestis KIM
agucauagugauaaaaag

SEQ ID NO: 4186597 - RNA, 13 nt, Yersinia pestis KIM
agucauauauuuu

SEQ ID NO: 4186598 - RNA, 18 nt, Yersinia pestis KIM
agucauauauuuuucuuu

SEQ ID NO: 4186599 - RNA, 17 nt, Yersinia pestis KIM
agucauccaaacggaau

SEQ ID NO: 4186600 - RNA, 23 nt, Yersinia pestis KIM
agucaucgccuucuggcaaaccg

SEQ ID NO: 4186601 - RNA, 18 nt, Yersinia pestis KIM
agucaucgcggguuuuua

SEQ ID NO: 4186602 - RNA, 20 nt, Yersinia pestis KIM
agucauuaacuguuaaaaca

SEQ ID NO: 4186603 - RNA, 22 nt, Yersinia pestis KIM
agucauuggcguuacagcaagg

SEQ ID NO: 4186604 - RNA, 19 nt, Yersinia pestis KIM
agucauugguguuacagca

SEQ ID NO: 4186605 - RNA, 20 nt, Yersinia pestis KIM
agucauugguguuacagcaa

SEQ ID NO: 4186606 - RNA, 21 nt, Yersinia pestis KIM
agucauugguguuacagcaag

SEQ ID NO: 4186607 - RNA, 21 nt, Yersinia pestis KIM
agucauuugcucgauuucacu

SEQ ID NO: 4186608 - RNA, 17 nt, Yersinia pestis KIM
aguccaagacagaacuu

SEQ ID NO: 4186609 - RNA, 23 nt, Yersinia pestis KIM
aguccaagacagaacuuaagaua

SEQ ID NO: 4186610 - RNA, 19 nt, Yersinia pestis KIM
agucccugugcgcccacgc

SEQ ID NO: 4186611 - RNA, 15 nt, Yersinia pestis KIM
aguccguuaaaaaau

SEQ ID NO: 4186612 - RNA, 23 nt, Yersinia pestis KIM
aguccguucgcgguaugaaacaa

SEQ ID NO: 4186613 - RNA, 15 nt, Yersinia pestis KIM
aguccucucaccaag

SEQ ID NO: 4186614 - RNA, 23 nt, Yersinia pestis KIM
aguccugauucgcgaccagcaga

SEQ ID NO: 4186615 - RNA, 17 nt, Yersinia pestis KIM
agucgacaguguaaaaa

SEQ ID NO: 4186616 - RNA, 17 nt, Yersinia pestis KIM
agucgaugaaacacaac

SEQ ID NO: 4186617 - RNA, 12 nt, Yersinia pestis KIM
agucgccuuaaa

SEQ ID NO: 4186618 - RNA, 17 nt, Yersinia pestis KIM
agucgccuuaaaugcgu

SEQ ID NO: 4186619 - RNA, 22 nt, Yersinia pestis KIM
agucgcgauaaaauucagccac

SEQ ID NO: 4186620 - RNA, 23 nt, Yersinia pestis KIM
agucgcgauaaaauucagccacu

SEQ ID NO: 4186621 - RNA, 20 nt, Yersinia pestis KIM
agucgcgaugcgcugcucuu

SEQ ID NO: 4186622 - RNA, 18 nt, Yersinia pestis KIM
agucgcuccucagccuuu

SEQ ID NO: 4186623 - RNA, 17 nt, Yersinia pestis KIM
agucgcuuuuuguauuu

SEQ ID NO: 4186624 - RNA, 20 nt, Yersinia pestis KIM
agucgguagaacggcggacu

SEQ ID NO: 4186625 - RNA, 22 nt, Yersinia pestis KIM
agucucacuaaaucaaaaggaa

SEQ ID NO: 4186626 - RNA, 19 nt, Yersinia pestis KIM
agucucuguggauugccaa

SEQ ID NO: 4186627 - RNA, 20 nt, Yersinia pestis KIM
agucucuguggauugccaaa

SEQ ID NO: 4186628 - RNA, 14 nt, Yersinia pestis KIM
agucugaaaugauc

SEQ ID NO: 4186629 - RNA, 16 nt, Yersinia pestis KIM
agucugaaaugaucac

SEQ ID NO: 4186630 - RNA, 19 nt, Yersinia pestis KIM
agucugaaaugaucaccgc

SEQ ID NO: 4186631 - RNA, 15 nt, Yersinia pestis KIM
agucugaagccuacg

SEQ ID NO: 4186632 - RNA, 23 nt, Yersinia pestis KIM
agucugacaccggggauccauag

SEQ ID NO: 4186633 - RNA, 23 nt, Yersinia pestis KIM
agucugagccucaugaaugaggc

SEQ ID NO: 4186634 - RNA, 14 nt, Yersinia pestis KIM
agucugaggagcca

SEQ ID NO: 4186635 - RNA, 15 nt, Yersinia pestis KIM
agucugaggagccau

SEQ ID NO: 4186636 - RNA, 15 nt, Yersinia pestis KIM
agucugaggcccgcu

SEQ ID NO: 4186637 - RNA, 14 nt, Yersinia pestis KIM
agucugagggccac

SEQ ID NO: 4186638 - RNA, 15 nt, Yersinia pestis KIM
agucugcggauaaac

SEQ ID NO: 4186639 - RNA, 20 nt, Yersinia pestis KIM
agucugucguacuuuccuuc

SEQ ID NO: 4186640 - RNA, 23 nt, Yersinia pestis KIM
agucugucguacuuuccuuccuc

SEQ ID NO: 4186641 - RNA, 20 nt, Yersinia pestis KIM
agucuguuaugcccaacugc

SEQ ID NO: 4186642 - RNA, 16 nt, Yersinia pestis KIM
agucuuaugaugcugg

SEQ ID NO: 4186643 - RNA, 21 nt, Yersinia pestis KIM
agucuucaucauccauaaaga

SEQ ID NO: 4186644 - RNA, 20 nt, Yersinia pestis KIM
agucuuccaugacaaaauac

SEQ ID NO: 4186645 - RNA, 21 nt, Yersinia pestis KIM
agugaaaacguuaacugcagu

SEQ ID NO: 4186646 - RNA, 16 nt, Yersinia pestis KIM
agugaaaagguuaacu

SEQ ID NO: 4186647 - RNA, 18 nt, Yersinia pestis KIM
agugaaaagguuaacugc

SEQ ID NO: 4186648 - RNA, 20 nt, Yersinia pestis KIM
agugaaaagguuaacugcag

SEQ ID NO: 4186649 - RNA, 21 nt, Yersinia pestis KIM
agugaaaccauugguaauaau

SEQ ID NO: 4186650 - RNA, 15 nt, Yersinia pestis KIM
agugaacauagcuaa

SEQ ID NO: 4186651 - RNA, 17 nt, Yersinia pestis KIM
agugaacauagcuaaca

SEQ ID NO: 4186652 - RNA, 16 nt, Yersinia pestis KIM
agugaacccacgacua

SEQ ID NO: 4186653 - RNA, 15 nt, Yersinia pestis KIM
agugaacguagcuaa

SEQ ID NO: 4186654 - RNA, 17 nt, Yersinia pestis KIM
agugaacguagcuaaca

SEQ ID NO: 4186655 - RNA, 17 nt, Yersinia pestis KIM
agugaagacaucgccag

SEQ ID NO: 4186656 - RNA, 17 nt, Yersinia pestis KIM
agugaaggguugaccgc

SEQ ID NO: 4186657 - RNA, 17 nt, Yersinia pestis KIM
agugaaguaauaaaaau

SEQ ID NO: 4186658 - RNA, 15 nt, Yersinia pestis KIM
agugaauaaaucaaa

SEQ ID NO: 4186659 - RNA, 13 nt, Yersinia pestis KIM
agugaaucagcca

SEQ ID NO: 4186660 - RNA, 18 nt, Yersinia pestis KIM
agugaaugacaguauuug

SEQ ID NO: 4186661 - RNA, 21 nt, Yersinia pestis KIM
agugaauuaauaacaguauca

SEQ ID NO: 4186662 - RNA, 23 nt, Yersinia pestis KIM
agugacaugcuuaauuauugcag

SEQ ID NO: 4186663 - RNA, 14 nt, Yersinia pestis KIM
agugaccaaagcag

SEQ ID NO: 4186664 - RNA, 20 nt, Yersinia pestis KIM
agugacuaauuguuugcuuu

SEQ ID NO: 4186665 - RNA, 18 nt, Yersinia pestis KIM
agugacucaucaaaacaa

SEQ ID NO: 4186666 - RNA, 13 nt, Yersinia pestis KIM
agugacuccccug

SEQ ID NO: 4186667 - RNA, 20 nt, Yersinia pestis KIM
agugacugaauggcuauuua

SEQ ID NO: 4186668 - RNA, 18 nt, Yersinia pestis KIM
agugacugguaugcggga

SEQ ID NO: 4186669 - RNA, 17 nt, Yersinia pestis KIM
agugagcgcggguaaug

SEQ ID NO: 4186670 - RNA, 16 nt, Yersinia pestis KIM
agugagcugaacugag

SEQ ID NO: 4186671 - RNA, 15 nt, Yersinia pestis KIM
agugagucaguaacu

SEQ ID NO: 4186672 - RNA, 18 nt, Yersinia pestis KIM
agugauaaauuugauaca

SEQ ID NO: 4186673 - RNA, 15 nt, Yersinia pestis KIM
agugauaacaacccu

SEQ ID NO: 4186674 - RNA, 16 nt, Yersinia pestis KIM
agugaugcaguaaaua

SEQ ID NO: 4186675 - RNA, 20 nt, Yersinia pestis KIM
agugaugggggcaauugauu

SEQ ID NO: 4186676 - RNA, 19 nt, Yersinia pestis KIM
agugauguaauccauacag

SEQ ID NO: 4186677 - RNA, 18 nt, Yersinia pestis KIM
agugauuagcaucugcaa

SEQ ID NO: 4186678 - RNA, 14 nt, Yersinia pestis KIM
agugauucggguga

SEQ ID NO: 4186679 - RNA, 18 nt, Yersinia pestis KIM
agugauucgggugaguga

SEQ ID NO: 4186680 - RNA, 22 nt, Yersinia pestis KIM
agugauucgggugagugagcgc

SEQ ID NO: 4186681 - RNA, 14 nt, Yersinia pestis KIM
agugauuuuaacca

SEQ ID NO: 4186682 - RNA, 17 nt, Yersinia pestis KIM
agugcaaacuuaaaaau

SEQ ID NO: 4186683 - RNA, 16 nt, Yersinia pestis KIM
agugcaacauuaaaaa

SEQ ID NO: 4186684 - RNA, 17 nt, Yersinia pestis KIM
agugcaacauuaaaaau

SEQ ID NO: 4186685 - RNA, 21 nt, Yersinia pestis KIM
agugcaacauuaaaaauacaa

SEQ ID NO: 4186686 - RNA, 17 nt, Yersinia pestis KIM
agugcacagucacucaa

SEQ ID NO: 4186687 - RNA, 14 nt, Yersinia pestis KIM
agugcacaucaaua

SEQ ID NO: 4186688 - RNA, 17 nt, Yersinia pestis KIM
agugcauuaucuuuaau

SEQ ID NO: 4186689 - RNA, 22 nt, Yersinia pestis KIM
agugcauuaucuuuaauuuuuc

SEQ ID NO: 4186690 - RNA, 17 nt, Yersinia pestis KIM
agugccaaaauaucuuc

SEQ ID NO: 4186691 - RNA, 13 nt, Yersinia pestis KIM
agugccaacagcg

SEQ ID NO: 4186692 - RNA, 15 nt, Yersinia pestis KIM
agugccaauccccac

SEQ ID NO: 4186693 - RNA, 19 nt, Yersinia pestis KIM
agugccaaucccgcagcau

SEQ ID NO: 4186694 - RNA, 22 nt, Yersinia pestis KIM
agugccaucgccaacaggccua

SEQ ID NO: 4186695 - RNA, 21 nt, Yersinia pestis KIM
agugcccgcgacggagagaac

SEQ ID NO: 4186696 - RNA, 20 nt, Yersinia pestis KIM
agugccgucaauuaucaaaa

SEQ ID NO: 4186697 - RNA, 21 nt, Yersinia pestis KIM
agugccgucaauuaucaaaaa

SEQ ID NO: 4186698 - RNA, 22 nt, Yersinia pestis KIM
agugccgucaauuaucaaaaaa

SEQ ID NO: 4186699 - RNA, 21 nt, Yersinia pestis KIM
agugccugcaacggagagaac

SEQ ID NO: 4186700 - RNA, 21 nt, Yersinia pestis KIM
agugcgaagcgcacccaaaau

SEQ ID NO: 4186701 - RNA, 18 nt, Yersinia pestis KIM
agugcgaucaaaaacguc

SEQ ID NO: 4186702 - RNA, 16 nt, Yersinia pestis KIM
agugcggacagcgcgc

SEQ ID NO: 4186703 - RNA, 12 nt, Yersinia pestis KIM
agugcggccacc

SEQ ID NO: 4186704 - RNA, 22 nt, Yersinia pestis KIM
agugcgguaaccagcaucagua

SEQ ID NO: 4186705 - RNA, 15 nt, Yersinia pestis KIM
agugcguacgccaac

SEQ ID NO: 4186706 - RNA, 17 nt, Yersinia pestis KIM
agugcguuuuauucaag

SEQ ID NO: 4186707 - RNA, 16 nt, Yersinia pestis KIM
agugcucccugaacgc

SEQ ID NO: 4186708 - RNA, 19 nt, Yersinia pestis KIM
agugcugaacguaaaacaa

SEQ ID NO: 4186709 - RNA, 21 nt, Yersinia pestis KIM
agugcugccgcaacggcaccu

SEQ ID NO: 4186710 - RNA, 22 nt, Yersinia pestis KIM
agugcugccgcaacggcaccuc

SEQ ID NO: 4186711 - RNA, 15 nt, Yersinia pestis KIM
agugcuucaaauccu

SEQ ID NO: 4186712 - RNA, 19 nt, Yersinia pestis KIM
aguggacgauaaauucaaa

SEQ ID NO: 4186713 - RNA, 15 nt, Yersinia pestis KIM
aguggcaucaauaua

SEQ ID NO: 4186714 - RNA, 17 nt, Yersinia pestis KIM
aguggcuuugcaccauc

SEQ ID NO: 4186715 - RNA, 13 nt, Yersinia pestis KIM
aguggguaaaccu

SEQ ID NO: 4186716 - RNA, 23 nt, Yersinia pestis KIM
agugguacuuaacuggccaauua

SEQ ID NO: 4186717 - RNA, 19 nt, Yersinia pestis KIM
aguggucauuaauuucacc

SEQ ID NO: 4186718 - RNA, 14 nt, Yersinia pestis KIM
aguguaaaaagcga

SEQ ID NO: 4186719 - RNA, 12 nt, Yersinia pestis KIM
aguguaaaaccu

SEQ ID NO: 4186720 - RNA, 20 nt, Yersinia pestis KIM
aguguaaaaccugacuguuu

SEQ ID NO: 4186721 - RNA, 20 nt, Yersinia pestis KIM
aguguaucaauaggauuuuc

SEQ ID NO: 4186722 - RNA, 20 nt, Yersinia pestis KIM
aguguauucgcaucuuccaa

SEQ ID NO: 4186723 - RNA, 22 nt, Yersinia pestis KIM
agugucaacgacggaugaaaag

SEQ ID NO: 4186724 - RNA, 13 nt, Yersinia pestis KIM
agugucagcaaac

SEQ ID NO: 4186725 - RNA, 18 nt, Yersinia pestis KIM
agugucagggcaauaaca

SEQ ID NO: 4186726 - RNA, 20 nt, Yersinia pestis KIM
agugucagggcaauaacaaa

SEQ ID NO: 4186727 - RNA, 19 nt, Yersinia pestis KIM
agugucaguaugaaauuuu

SEQ ID NO: 4186728 - RNA, 20 nt, Yersinia pestis KIM
agugucaguaugaaauuuug

SEQ ID NO: 4186729 - RNA, 16 nt, Yersinia pestis KIM
agugucaugcgcagaa

SEQ ID NO: 4186730 - RNA, 15 nt, Yersinia pestis KIM
aguguccacauagcu

SEQ ID NO: 4186731 - RNA, 21 nt, Yersinia pestis KIM
aguguccgcgccauaaaagau

SEQ ID NO: 4186732 - RNA, 22 nt, Yersinia pestis KIM
aguguccgcgccauaaaagaua

SEQ ID NO: 4186733 - RNA, 23 nt, Yersinia pestis KIM
agugucgaaagacgcaaacgggu

SEQ ID NO: 4186734 - RNA, 19 nt, Yersinia pestis KIM
agugugggauucguuagua

SEQ ID NO: 4186735 - RNA, 16 nt, Yersinia pestis KIM
aguguguguauuuaaa

SEQ ID NO: 4186736 - RNA, 15 nt, Yersinia pestis KIM
aguguucauaaauua

SEQ ID NO: 4186737 - RNA, 22 nt, Yersinia pestis KIM
aguguucauaaauuaaaacuga

SEQ ID NO: 4186738 - RNA, 15 nt, Yersinia pestis KIM
aguguuggccucaga

SEQ ID NO: 4186739 - RNA, 14 nt, Yersinia pestis KIM
aguguuuucuccac

SEQ ID NO: 4186740 - RNA, 22 nt, Yersinia pestis KIM
aguuaaaaagaaaaagacauaa

SEQ ID NO: 4186741 - RNA, 22 nt, Yersinia pestis KIM
aguuaaagguaaaaggcccgcu

SEQ ID NO: 4186742 - RNA, 11 nt, Yersinia pestis KIM
aguuaaauaau

SEQ ID NO: 4186743 - RNA, 17 nt, Yersinia pestis KIM
aguuaaaucccugugcu

SEQ ID NO: 4186744 - RNA, 19 nt, Yersinia pestis KIM
aguuaaaucccugugcuga

SEQ ID NO: 4186745 - RNA, 13 nt, Yersinia pestis KIM
aguuaaaugaagg

SEQ ID NO: 4186746 - RNA, 20 nt, Yersinia pestis KIM
aguuaagacaauuauagcca

SEQ ID NO: 4186747 - RNA, 16 nt, Yersinia pestis KIM
aguuaaguaauaacuc

SEQ ID NO: 4186748 - RNA, 17 nt, Yersinia pestis KIM
aguuaauagggcuucca

SEQ ID NO: 4186749 - RNA, 14 nt, Yersinia pestis KIM
aguuaaucgcagca

SEQ ID NO: 4186750 - RNA, 15 nt, Yersinia pestis KIM
aguuaaucgcagcag

SEQ ID NO: 4186751 - RNA, 12 nt, Yersinia pestis KIM
aguuaauguuua

SEQ ID NO: 4186752 - RNA, 14 nt, Yersinia pestis KIM
aguuacagcaaaua

SEQ ID NO: 4186753 - RNA, 22 nt, Yersinia pestis KIM
aguuacaguagugaagauaaua

SEQ ID NO: 4186754 - RNA, 15 nt, Yersinia pestis KIM
aguuacgucagaaau

SEQ ID NO: 4186755 - RNA, 18 nt, Yersinia pestis KIM
aguuacgucagaaauaaa

SEQ ID NO: 4186756 - RNA, 15 nt, Yersinia pestis KIM
aguuacuauauaaau

SEQ ID NO: 4186757 - RNA, 14 nt, Yersinia pestis KIM
aguuacucagcauc

SEQ ID NO: 4186758 - RNA, 16 nt, Yersinia pestis KIM
aguuagcaggcagcac

SEQ ID NO: 4186759 - RNA, 19 nt, Yersinia pestis KIM
aguuagcuacgcugcugaa

SEQ ID NO: 4186760 - RNA, 22 nt, Yersinia pestis KIM
aguuagcuacgcugcugaauuc

SEQ ID NO: 4186761 - RNA, 13 nt, Yersinia pestis KIM
aguuagggcugga

SEQ ID NO: 4186762 - RNA, 15 nt, Yersinia pestis KIM
aguuaucaucaccaa

SEQ ID NO: 4186763 - RNA, 17 nt, Yersinia pestis KIM
aguuauccucgcucaca

SEQ ID NO: 4186764 - RNA, 20 nt, Yersinia pestis KIM
aguuaucuguuucaaauaag

SEQ ID NO: 4186765 - RNA, 20 nt, Yersinia pestis KIM
aguuaugauccuuuagcgcu

SEQ ID NO: 4186766 - RNA, 16 nt, Yersinia pestis KIM
aguuauuauuuuuaau

SEQ ID NO: 4186767 - RNA, 21 nt, Yersinia pestis KIM
aguucaagaaccgaaauauca

SEQ ID NO: 4186768 - RNA, 15 nt, Yersinia pestis KIM
aguucaagcagguuc

SEQ ID NO: 4186769 - RNA, 15 nt, Yersinia pestis KIM
aguucacaugaugaa

SEQ ID NO: 4186770 - RNA, 18 nt, Yersinia pestis KIM
aguucacccaacaaugaa

SEQ ID NO: 4186771 - RNA, 22 nt, Yersinia pestis KIM
aguucacucuguuuuaaaaaaa

SEQ ID NO: 4186772 - RNA, 19 nt, Yersinia pestis KIM
aguucagcccccucaauac

SEQ ID NO: 4186773 - RNA, 16 nt, Yersinia pestis KIM
aguucauuuugaccag

SEQ ID NO: 4186774 - RNA, 20 nt, Yersinia pestis KIM
aguucauuuugaccagcaua

SEQ ID NO: 4186775 - RNA, 13 nt, Yersinia pestis KIM
aguuccagcccca

SEQ ID NO: 4186776 - RNA, 20 nt, Yersinia pestis KIM
aguuccagccccaaacacuu

SEQ ID NO: 4186777 - RNA, 21 nt, Yersinia pestis KIM
aguuccagccccaaacacuua

SEQ ID NO: 4186778 - RNA, 16 nt, Yersinia pestis KIM
aguucgacaccuucaa

SEQ ID NO: 4186779 - RNA, 19 nt, Yersinia pestis KIM
aguucgauauuauucucua

SEQ ID NO: 4186780 - RNA, 16 nt, Yersinia pestis KIM
aguucggucuauaaaa

SEQ ID NO: 4186781 - RNA, 18 nt, Yersinia pestis KIM
aguucgguugccaaaauu

SEQ ID NO: 4186782 - RNA, 17 nt, Yersinia pestis KIM
aguucguguugugccag

SEQ ID NO: 4186783 - RNA, 14 nt, Yersinia pestis KIM
aguucguucccugu

SEQ ID NO: 4186784 - RNA, 21 nt, Yersinia pestis KIM
aguucugcgccccccggauac

SEQ ID NO: 4186785 - RNA, 16 nt, Yersinia pestis KIM
aguucuucgcaaugau

SEQ ID NO: 4186786 - RNA, 14 nt, Yersinia pestis KIM
aguucuuuauccac

SEQ ID NO: 4186787 - RNA, 20 nt, Yersinia pestis KIM
aguucuuuauccacuuggcu

SEQ ID NO: 4186788 - RNA, 14 nt, Yersinia pestis KIM
aguugaaccauaaa

SEQ ID NO: 4186789 - RNA, 23 nt, Yersinia pestis KIM
aguugauauaccgauuaccgggu

SEQ ID NO: 4186790 - RNA, 14 nt, Yersinia pestis KIM
aguugaucacccgc

SEQ ID NO: 4186791 - RNA, 14 nt, Yersinia pestis KIM
aguugaugcaguga

SEQ ID NO: 4186792 - RNA, 23 nt, Yersinia pestis KIM
aguugcagaagggcggccagcaa

SEQ ID NO: 4186793 - RNA, 15 nt, Yersinia pestis KIM
aguugcagugggccu

SEQ ID NO: 4186794 - RNA, 20 nt, Yersinia pestis KIM
aguugcaguuggaucugcac

SEQ ID NO: 4186795 - RNA, 17 nt, Yersinia pestis KIM
aguugcccuaaacagca

SEQ ID NO: 4186796 - RNA, 19 nt, Yersinia pestis KIM
aguugcucacccauuuuau

SEQ ID NO: 4186797 - RNA, 16 nt, Yersinia pestis KIM
aguuggcaucagcucg

SEQ ID NO: 4186798 - RNA, 22 nt, Yersinia pestis KIM
aguugggaaucgguuucagcuu

SEQ ID NO: 4186799 - RNA, 14 nt, Yersinia pestis KIM
aguugggcauugga

SEQ ID NO: 4186800 - RNA, 17 nt, Yersinia pestis KIM
aguugguaaaauauuuu

SEQ ID NO: 4186801 - RNA, 17 nt, Yersinia pestis KIM
aguuggugcuuuggaac

SEQ ID NO: 4186802 - RNA, 23 nt, Yersinia pestis KIM
aguuguagggugccaacgcaauu

SEQ ID NO: 4186803 - RNA, 18 nt, Yersinia pestis KIM
aguugucuauuuucauua

SEQ ID NO: 4186804 - RNA, 19 nt, Yersinia pestis KIM
aguugucuauuuucauuau

SEQ ID NO: 4186805 - RNA, 19 nt, Yersinia pestis KIM
aguugucuguaauaauaau

SEQ ID NO: 4186806 - RNA, 20 nt, Yersinia pestis KIM
aguuguuggagaauaguggg

SEQ ID NO: 4186807 - RNA, 15 nt, Yersinia pestis KIM
aguuuacgcagugcu

SEQ ID NO: 4186808 - RNA, 18 nt, Yersinia pestis KIM
aguuuagcgagaaaguca

SEQ ID NO: 4186809 - RNA, 20 nt, Yersinia pestis KIM
aguuuauuugaguaagacaa

SEQ ID NO: 4186810 - RNA, 15 nt, Yersinia pestis KIM
aguuuauuuucccuu

SEQ ID NO: 4186811 - RNA, 18 nt, Yersinia pestis KIM
aguuucaauaugcucugc

SEQ ID NO: 4186812 - RNA, 16 nt, Yersinia pestis KIM
aguuucacuuucaacu

SEQ ID NO: 4186813 - RNA, 15 nt, Yersinia pestis KIM
aguuucagguuguua

SEQ ID NO: 4186814 - RNA, 14 nt, Yersinia pestis KIM
aguuuccaguucaa

SEQ ID NO: 4186815 - RNA, 16 nt, Yersinia pestis KIM
aguuugagacccccaa

SEQ ID NO: 4186816 - RNA, 17 nt, Yersinia pestis KIM
aguuugaucgcuaaucg

SEQ ID NO: 4186817 - RNA, 23 nt, Yersinia pestis KIM
aguuugcggucuggcaacugcaa

SEQ ID NO: 4186818 - RNA, 20 nt, Yersinia pestis KIM
aguuugcuacuggccuggcu

SEQ ID NO: 4186819 - RNA, 18 nt, Yersinia pestis KIM
aguuuuaaacgucagauu

SEQ ID NO: 4186820 - RNA, 21 nt, Yersinia pestis KIM
aguuuuaaacgucagauuagu

SEQ ID NO: 4186821 - RNA, 14 nt, Yersinia pestis KIM
aguuuuagacguca

SEQ ID NO: 4186822 - RNA, 21 nt, Yersinia pestis KIM
aguuuuagaugucagauuagu

SEQ ID NO: 4186823 - RNA, 18 nt, Yersinia pestis KIM
aguuuuagcccaaaauag

SEQ ID NO: 4186824 - RNA, 11 nt, Yersinia pestis KIM
aguuuuauuca

SEQ ID NO: 4186825 - RNA, 22 nt, Yersinia pestis KIM
aguuuucccugcgccagcagca

SEQ ID NO: 4186826 - RNA, 17 nt, Yersinia pestis KIM
aguuuugcuauuuacuc

SEQ ID NO: 4186827 - RNA, 23 nt, Yersinia pestis KIM
aguuuuuuguuuuucugacaaaa

SEQ ID NO: 4186828 - RNA, 12 nt, Yersinia pestis KIM
auaaaaacauug

SEQ ID NO: 4186829 - RNA, 19 nt, Yersinia pestis KIM
auaaaaacauuuaaauaug

SEQ ID NO: 4186830 - RNA, 12 nt, Yersinia pestis KIM
auaaaaaccauu

SEQ ID NO: 4186831 - RNA, 19 nt, Yersinia pestis KIM
auaaaaaccauuuuuaugc

SEQ ID NO: 4186832 - RNA, 23 nt, Yersinia pestis KIM
auaaaaaccauuuuuaugccauu

SEQ ID NO: 4186833 - RNA, 13 nt, Yersinia pestis KIM
auaaaaaccccuu

SEQ ID NO: 4186834 - RNA, 12 nt, Yersinia pestis KIM
auaaaaacuauc

SEQ ID NO: 4186835 - RNA, 12 nt, Yersinia pestis KIM
auaaaaagccag

SEQ ID NO: 4186836 - RNA, 11 nt, Yersinia pestis KIM
auaaaaaguca

SEQ ID NO: 4186837 - RNA, 13 nt, Yersinia pestis KIM
auaaaaauacaua

SEQ ID NO: 4186838 - RNA, 14 nt, Yersinia pestis KIM
auaaaaauacauau

SEQ ID NO: 4186839 - RNA, 13 nt, Yersinia pestis KIM
auaaaaauagccu

SEQ ID NO: 4186840 - RNA, 18 nt, Yersinia pestis KIM
auaaaaauagccuuccuu

SEQ ID NO: 4186841 - RNA, 11 nt, Yersinia pestis KIM
auaaaacaaua

SEQ ID NO: 4186842 - RNA, 12 nt, Yersinia pestis KIM
auaaaacaauag

SEQ ID NO: 4186843 - RNA, 15 nt, Yersinia pestis KIM
auaaaaccacugacc

SEQ ID NO: 4186844 - RNA, 16 nt, Yersinia pestis KIM
auaaaaccacugaccu

SEQ ID NO: 4186845 - RNA, 19 nt, Yersinia pestis KIM
auaaaaccacugaccuauu

SEQ ID NO: 4186846 - RNA, 12 nt, Yersinia pestis KIM
auaaaaccaucu

SEQ ID NO: 4186847 - RNA, 23 nt, Yersinia pestis KIM
auaaaaccgcccuugaccucauu

SEQ ID NO: 4186848 - RNA, 18 nt, Yersinia pestis KIM
auaaaaccuuuacaauua

SEQ ID NO: 4186849 - RNA, 23 nt, Yersinia pestis KIM
auaaaacggcauaucgagcaucu

SEQ ID NO: 4186850 - RNA, 19 nt, Yersinia pestis KIM
auaaaacugcucacuggag

SEQ ID NO: 4186851 - RNA, 15 nt, Yersinia pestis KIM
auaaaagaaagggca

SEQ ID NO: 4186852 - RNA, 13 nt, Yersinia pestis KIM
auaaaagaaugaa

SEQ ID NO: 4186853 - RNA, 15 nt, Yersinia pestis KIM
auaaaagaaugaauu

SEQ ID NO: 4186854 - RNA, 20 nt, Yersinia pestis KIM
auaaaagcaucucgauacau

SEQ ID NO: 4186855 - RNA, 21 nt, Yersinia pestis KIM
auaaaaggauggcccaagcca

SEQ ID NO: 4186856 - RNA, 17 nt, Yersinia pestis KIM
auaaaaggcuauuuaaa

SEQ ID NO: 4186857 - RNA, 21 nt, Yersinia pestis KIM
auaaaaucgaacccuucagca

SEQ ID NO: 4186858 - RNA, 19 nt, Yersinia pestis KIM
auaaaaugggccugagugg

SEQ ID NO: 4186859 - RNA, 20 nt, Yersinia pestis KIM
auaaaauuaacggaaaagag

SEQ ID NO: 4186860 - RNA, 15 nt, Yersinia pestis KIM
auaaaauuacccagc

SEQ ID NO: 4186861 - RNA, 17 nt, Yersinia pestis KIM
auaaacaaaauagggcg

SEQ ID NO: 4186862 - RNA, 16 nt, Yersinia pestis KIM
auaaacaauaaacaga

SEQ ID NO: 4186863 - RNA, 19 nt, Yersinia pestis KIM
auaaacacugauuuauaaa

SEQ ID NO: 4186864 - RNA, 21 nt, Yersinia pestis KIM
auaaacaucaugagauaaaua

SEQ ID NO: 4186865 - RNA, 18 nt, Yersinia pestis KIM
auaaacauuuacuuauaa

SEQ ID NO: 4186866 - RNA, 16 nt, Yersinia pestis KIM
auaaaccaaaugguua

SEQ ID NO: 4186867 - RNA, 21 nt, Yersinia pestis KIM
auaaaccaacugaaacuggag

SEQ ID NO: 4186868 - RNA, 15 nt, Yersinia pestis KIM
auaaacccuacagca

SEQ ID NO: 4186869 - RNA, 17 nt, Yersinia pestis KIM
auaaaccgcuauaucau

SEQ ID NO: 4186870 - RNA, 18 nt, Yersinia pestis KIM
auaaaccgugauugguuu

SEQ ID NO: 4186871 - RNA, 13 nt, Yersinia pestis KIM
auaaaccugauuu

SEQ ID NO: 4186872 - RNA, 12 nt, Yersinia pestis KIM
auaaaccugcaa

SEQ ID NO: 4186873 - RNA, 18 nt, Yersinia pestis KIM
auaaacgcgaguuaggaa

SEQ ID NO: 4186874 - RNA, 20 nt, Yersinia pestis KIM
auaaacggaacucaucuuuc

SEQ ID NO: 4186875 - RNA, 20 nt, Yersinia pestis KIM
auaaacugaaguuaaaaagc

SEQ ID NO: 4186876 - RNA, 19 nt, Yersinia pestis KIM
auaaacugacucacgucag

SEQ ID NO: 4186877 - RNA, 17 nt, Yersinia pestis KIM
auaaacugugcccuuga

SEQ ID NO: 4186878 - RNA, 14 nt, Yersinia pestis KIM
auaaacuucacaau

SEQ ID NO: 4186879 - RNA, 13 nt, Yersinia pestis KIM
auaaacuucgaua

SEQ ID NO: 4186880 - RNA, 19 nt, Yersinia pestis KIM
auaaacuuuuaugcaucuu

SEQ ID NO: 4186881 - RNA, 12 nt, Yersinia pestis KIM
auaaagaaaaga

SEQ ID NO: 4186882 - RNA, 17 nt, Yersinia pestis KIM
auaaagaauaaugggua

SEQ ID NO: 4186883 - RNA, 14 nt, Yersinia pestis KIM
auaaagcaucagac

SEQ ID NO: 4186884 - RNA, 20 nt, Yersinia pestis KIM
auaaagcaucagacugcucu

SEQ ID NO: 4186885 - RNA, 21 nt, Yersinia pestis KIM
auaaagcaucagacugcucuu

SEQ ID NO: 4186886 - RNA, 16 nt, Yersinia pestis KIM
auaaagcauuuaucau

SEQ ID NO: 4186887 - RNA, 21 nt, Yersinia pestis KIM
auaaagcauuuaucauauuaa

SEQ ID NO: 4186888 - RNA, 17 nt, Yersinia pestis KIM
auaaagcccauacccgc

SEQ ID NO: 4186889 - RNA, 19 nt, Yersinia pestis KIM
auaaagcgaugcucaauac

SEQ ID NO: 4186890 - RNA, 20 nt, Yersinia pestis KIM
auaaagcgaugcucaauacu

SEQ ID NO: 4186891 - RNA, 17 nt, Yersinia pestis KIM
auaaaggcaaaagcauc

SEQ ID NO: 4186892 - RNA, 21 nt, Yersinia pestis KIM
auaaaggcaaaagcaucacca

SEQ ID NO: 4186893 - RNA, 22 nt, Yersinia pestis KIM
auaaaggcaaaagcaucaccaa

SEQ ID NO: 4186894 - RNA, 20 nt, Yersinia pestis KIM
auaaaguaaaagccagucag

SEQ ID NO: 4186895 - RNA, 12 nt, Yersinia pestis KIM
auaaauaaaaua

SEQ ID NO: 4186896 - RNA, 14 nt, Yersinia pestis KIM
auaaauaaaauaau

SEQ ID NO: 4186897 - RNA, 16 nt, Yersinia pestis KIM
auaaauaaaauaauaa

SEQ ID NO: 4186898 - RNA, 23 nt, Yersinia pestis KIM
auaaauaaccgagcgugaagagc

SEQ ID NO: 4186899 - RNA, 14 nt, Yersinia pestis KIM
auaaauaaguucag

SEQ ID NO: 4186900 - RNA, 14 nt, Yersinia pestis KIM
auaaauaauaucaa

SEQ ID NO: 4186901 - RNA, 15 nt, Yersinia pestis KIM
auaaauaauaucaau

SEQ ID NO: 4186902 - RNA, 22 nt, Yersinia pestis KIM
auaaauaaucauuuguuuuuaa

SEQ ID NO: 4186903 - RNA, 14 nt, Yersinia pestis KIM
auaaauaauuacuu

SEQ ID NO: 4186904 - RNA, 13 nt, Yersinia pestis KIM
auaaauaccaauu

SEQ ID NO: 4186905 - RNA, 14 nt, Yersinia pestis KIM
auaaauaccaauuu

SEQ ID NO: 4186906 - RNA, 14 nt, Yersinia pestis KIM
auaaauaccgccaa

SEQ ID NO: 4186907 - RNA, 23 nt, Yersinia pestis KIM
auaaauagagugaaguaucacca

SEQ ID NO: 4186908 - RNA, 20 nt, Yersinia pestis KIM
auaaauagucguuauauaaa

SEQ ID NO: 4186909 - RNA, 21 nt, Yersinia pestis KIM
auaaauagucguuauauaaau

SEQ ID NO: 4186910 - RNA, 17 nt, Yersinia pestis KIM
auaaauaucauuaacaa

SEQ ID NO: 4186911 - RNA, 20 nt, Yersinia pestis KIM
auaaauaucauuaacaaacu

SEQ ID NO: 4186912 - RNA, 20 nt, Yersinia pestis KIM
auaaauauccucggccagug

SEQ ID NO: 4186913 - RNA, 17 nt, Yersinia pestis KIM
auaaauauuuaauaugu

SEQ ID NO: 4186914 - RNA, 14 nt, Yersinia pestis KIM
auaaaucagggcag

SEQ ID NO: 4186915 - RNA, 15 nt, Yersinia pestis KIM
auaaauccugaacau

SEQ ID NO: 4186916 - RNA, 21 nt, Yersinia pestis KIM
auaaaugacuaucccuucaau

SEQ ID NO: 4186917 - RNA, 21 nt, Yersinia pestis KIM
auaaaugguuauuauguaaau

SEQ ID NO: 4186918 - RNA, 16 nt, Yersinia pestis KIM
auaaaugucgcuaaua

SEQ ID NO: 4186919 - RNA, 15 nt, Yersinia pestis KIM
auaaauuaaaacuga

SEQ ID NO: 4186920 - RNA, 23 nt, Yersinia pestis KIM
auaaauuaucugaauagcgcugc

SEQ ID NO: 4186921 - RNA, 22 nt, Yersinia pestis KIM
auaaauucaaaauagaggaaau

SEQ ID NO: 4186922 - RNA, 21 nt, Yersinia pestis KIM
auaaauucgauaaaaggcuau

SEQ ID NO: 4186923 - RNA, 18 nt, Yersinia pestis KIM
auaaauugcacacccaua

SEQ ID NO: 4186924 - RNA, 23 nt, Yersinia pestis KIM
auaaauuuaggugccaucuggcu

SEQ ID NO: 4186925 - RNA, 13 nt, Yersinia pestis KIM
auaaauuuaucga

SEQ ID NO: 4186926 - RNA, 16 nt, Yersinia pestis KIM
auaaauuuaucgauaa

SEQ ID NO: 4186927 - RNA, 22 nt, Yersinia pestis KIM
auaaauuuuaaguuaauguuua

SEQ ID NO: 4186928 - RNA, 19 nt, Yersinia pestis KIM
auaacaaacacauccagga

SEQ ID NO: 4186929 - RNA, 15 nt, Yersinia pestis KIM
auaacaacacaauua

SEQ ID NO: 4186930 - RNA, 17 nt, Yersinia pestis KIM
auaacaacacaauuaau

SEQ ID NO: 4186931 - RNA, 21 nt, Yersinia pestis KIM
auaacaacacaauuaauaugc

SEQ ID NO: 4186932 - RNA, 22 nt, Yersinia pestis KIM
auaacaaguuacauuuuuaaca

SEQ ID NO: 4186933 - RNA, 12 nt, Yersinia pestis KIM
auaacaauggcc

SEQ ID NO: 4186934 - RNA, 16 nt, Yersinia pestis KIM
auaacacagucggcau

SEQ ID NO: 4186935 - RNA, 19 nt, Yersinia pestis KIM
acccucaacucaaaacaau

SEQ ID NO: 4186936 - RNA, 22 nt, Yersinia pestis KIM
acccucaggcucuggugucucu

SEQ ID NO: 4186937 - RNA, 22 nt, Yersinia pestis KIM
acccuccaauaauucgugaaaa

SEQ ID NO: 4186938 - RNA, 21 nt, Yersinia pestis KIM
acccucugucggcaagcgaua

SEQ ID NO: 4186939 - RNA, 16 nt, Yersinia pestis KIM
acccugcguacaacau

SEQ ID NO: 4186940 - RNA, 15 nt, Yersinia pestis KIM
acccuucucuuuauc

SEQ ID NO: 4186941 - RNA, 16 nt, Yersinia pestis KIM
acccuucucuuuauca

SEQ ID NO: 4186942 - RNA, 23 nt, Yersinia pestis KIM
acccuugagguuauugacaaagu

SEQ ID NO: 4186943 - RNA, 20 nt, Yersinia pestis KIM
acccuuuagaggcugauaac

SEQ ID NO: 4186944 - RNA, 20 nt, Yersinia pestis KIM
acccuuuugaauucaccaaa

SEQ ID NO: 4186945 - RNA, 21 nt, Yersinia pestis KIM
acccuuuuugaguaaauucgg

SEQ ID NO: 4186946 - RNA, 16 nt, Yersinia pestis KIM
accgaaagaagacaua

SEQ ID NO: 4186947 - RNA, 15 nt, Yersinia pestis KIM
accgaacgaacccga

SEQ ID NO: 4186948 - RNA, 14 nt, Yersinia pestis KIM
accgaauaaaaccu

SEQ ID NO: 4186949 - RNA, 22 nt, Yersinia pestis KIM
accgacagguuaggggugaugu

SEQ ID NO: 4186950 - RNA, 17 nt, Yersinia pestis KIM
accgacgagggcuucug

SEQ ID NO: 4186951 - RNA, 14 nt, Yersinia pestis KIM
accgacgauaauca

SEQ ID NO: 4186952 - RNA, 18 nt, Yersinia pestis KIM
accgacgauaaucaggcu

SEQ ID NO: 4186953 - RNA, 18 nt, Yersinia pestis KIM
accgaggaugacgacaaa

SEQ ID NO: 4186954 - RNA, 17 nt, Yersinia pestis KIM
accgaggucauucaggu

SEQ ID NO: 4186955 - RNA, 17 nt, Yersinia pestis KIM
accgagguuaucagccu

SEQ ID NO: 4186956 - RNA, 19 nt, Yersinia pestis KIM
accgauaauaaauauccuc

SEQ ID NO: 4186957 - RNA, 18 nt, Yersinia pestis KIM
accgaugagugaaaucuc

SEQ ID NO: 4186958 - RNA, 18 nt, Yersinia pestis KIM
accgcaaccuguugugga

SEQ ID NO: 4186959 - RNA, 11 nt, Yersinia pestis KIM
accgcaccaca

SEQ ID NO: 4186960 - RNA, 14 nt, Yersinia pestis KIM
accgcaccacaaag

SEQ ID NO: 4186961 - RNA, 13 nt, Yersinia pestis KIM
accgcaccacgau

SEQ ID NO: 4186962 - RNA, 16 nt, Yersinia pestis KIM
accgcagauaaaagaa

SEQ ID NO: 4186963 - RNA, 17 nt, Yersinia pestis KIM
accgcagauaaaagaaa

SEQ ID NO: 4186964 - RNA, 11 nt, Yersinia pestis KIM
accgcagauau

SEQ ID NO: 4186965 - RNA, 18 nt, Yersinia pestis KIM
accgcagauauccuuuuu

SEQ ID NO: 4186966 - RNA, 16 nt, Yersinia pestis KIM
accgcaggucagaaug

SEQ ID NO: 4186967 - RNA, 16 nt, Yersinia pestis KIM
accgcagucgauaaac

SEQ ID NO: 4186968 - RNA, 20 nt, Yersinia pestis KIM
accgcagucgauaaacauca

SEQ ID NO: 4186969 - RNA, 18 nt, Yersinia pestis KIM
accgcaugaauauucacc

SEQ ID NO: 4186970 - RNA, 20 nt, Yersinia pestis KIM
accgcauuaugcccccaggu

SEQ ID NO: 4186971 - RNA, 13 nt, Yersinia pestis KIM
accgcauuuucaa

SEQ ID NO: 4186972 - RNA, 17 nt, Yersinia pestis KIM
accgccaaauacaaacc

SEQ ID NO: 4186973 - RNA, 13 nt, Yersinia pestis KIM
accgccaauaucu

SEQ ID NO: 4186974 - RNA, 15 nt, Yersinia pestis KIM
accgccacacaauac

SEQ ID NO: 4186975 - RNA, 16 nt, Yersinia pestis KIM
accgccacacaauaca

SEQ ID NO: 4186976 - RNA, 19 nt, Yersinia pestis KIM
accgccagcaauaagccac

SEQ ID NO: 4186977 - RNA, 23 nt, Yersinia pestis KIM
accgccagcaauaagccacgcug

SEQ ID NO: 4186978 - RNA, 14 nt, Yersinia pestis KIM
accgccagugccac

SEQ ID NO: 4186979 - RNA, 16 nt, Yersinia pestis KIM
accgccccccaucccc

SEQ ID NO: 4186980 - RNA, 17 nt, Yersinia pestis KIM
accgccccccaucccca

SEQ ID NO: 4186981 - RNA, 12 nt, Yersinia pestis KIM
accgcccucuug

SEQ ID NO: 4186982 - RNA, 16 nt, Yersinia pestis KIM
accgccugccgugcuu

SEQ ID NO: 4186983 - RNA, 23 nt, Yersinia pestis KIM
accgccugugacgcuugaauaua

SEQ ID NO: 4186984 - RNA, 19 nt, Yersinia pestis KIM
accgcgaucacaauacagc

SEQ ID NO: 4186985 - RNA, 16 nt, Yersinia pestis KIM
accgcgcucugcuggg

SEQ ID NO: 4186986 - RNA, 16 nt, Yersinia pestis KIM
accgcgcuuuugauuu

SEQ ID NO: 4186987 - RNA, 21 nt, Yersinia pestis KIM
accgcgcuuuugauuuucuua

SEQ ID NO: 4186988 - RNA, 20 nt, Yersinia pestis KIM
accgcguaaaauuagagcaa

SEQ ID NO: 4186989 - RNA, 18 nt, Yersinia pestis KIM
accgcguuauggagaggc

SEQ ID NO: 4186990 - RNA, 14 nt, Yersinia pestis KIM
accgcuaaggccaa

SEQ ID NO: 4186991 - RNA, 15 nt, Yersinia pestis KIM
accgcuauaucauca

SEQ ID NO: 4186992 - RNA, 21 nt, Yersinia pestis KIM
accgcuaugcuaaaaaacagc

SEQ ID NO: 4186993 - RNA, 23 nt, Yersinia pestis KIM
accgcuaugcuaaaaaacagccu

SEQ ID NO: 4186994 - RNA, 18 nt, Yersinia pestis KIM
accgcucaguauucgcca

SEQ ID NO: 4186995 - RNA, 12 nt, Yersinia pestis KIM
accgcugaagug

SEQ ID NO: 4186996 - RNA, 17 nt, Yersinia pestis KIM
accgcugaaguggccgu

SEQ ID NO: 4186997 - RNA, 17 nt, Yersinia pestis KIM
accgcugaaguggcuga

SEQ ID NO: 4186998 - RNA, 23 nt, Yersinia pestis KIM
accgcugaaguggcugaauauca

SEQ ID NO: 4186999 - RNA, 15 nt, Yersinia pestis KIM
accgcugcccggcuc

SEQ ID NO: 4187000 - RNA, 22 nt, Yersinia pestis KIM
accgcuggaagccgccaaguug

SEQ ID NO: 4187001 - RNA, 22 nt, Yersinia pestis KIM
accgcuggucgggugcaggcca

SEQ ID NO: 4187002 - RNA, 20 nt, Yersinia pestis KIM
accgcuguaaacuggcagau

SEQ ID NO: 4187003 - RNA, 15 nt, Yersinia pestis KIM
accgcuguagcguca

SEQ ID NO: 4187004 - RNA, 20 nt, Yersinia pestis KIM
accgcuuaaggcaucaacca

SEQ ID NO: 4187005 - RNA, 21 nt, Yersinia pestis KIM
accgcuuugaugccuaauaau

SEQ ID NO: 4187006 - RNA, 22 nt, Yersinia pestis KIM
accggaaaaugcgccagccaau

SEQ ID NO: 4187007 - RNA, 17 nt, Yersinia pestis KIM
accggaauaaaucagug

SEQ ID NO: 4187008 - RNA, 16 nt, Yersinia pestis KIM
accggagcaagggcgc

SEQ ID NO: 4187009 - RNA, 15 nt, Yersinia pestis KIM
accggauaaaacaau

SEQ ID NO: 4187010 - RNA, 21 nt, Yersinia pestis KIM
accggauaaaacaauagcuga

SEQ ID NO: 4187011 - RNA, 21 nt, Yersinia pestis KIM
accggauaacguuucagggug

SEQ ID NO: 4187012 - RNA, 23 nt, Yersinia pestis KIM
accggauuacauaugauggcauc

SEQ ID NO: 4187013 - RNA, 18 nt, Yersinia pestis KIM
accggauuguucagcaac

SEQ ID NO: 4187014 - RNA, 14 nt, Yersinia pestis KIM
accggcaauaugaa

SEQ ID NO: 4187015 - RNA, 17 nt, Yersinia pestis KIM
accggcauucuucgccg

SEQ ID NO: 4187016 - RNA, 16 nt, Yersinia pestis KIM
accggccgcuugccaa

SEQ ID NO: 4187017 - RNA, 22 nt, Yersinia pestis KIM
accggcgaagggcgcagccccc

SEQ ID NO: 4187018 - RNA, 15 nt, Yersinia pestis KIM
accggcguaaauaaa

SEQ ID NO: 4187019 - RNA, 21 nt, Yersinia pestis KIM
accggcugauguucugccaac

SEQ ID NO: 4187020 - RNA, 15 nt, Yersinia pestis KIM
accggcugauuaccu

SEQ ID NO: 4187021 - RNA, 18 nt, Yersinia pestis KIM
accggcuggcauuuuuau

SEQ ID NO: 4187022 - RNA, 18 nt, Yersinia pestis KIM
accgggauacgggaucga

SEQ ID NO: 4187023 - RNA, 16 nt, Yersinia pestis KIM
accgggcuugauuaaa

SEQ ID NO: 4187024 - RNA, 22 nt, Yersinia pestis KIM
accgggcuuuuuuucggcaucu

SEQ ID NO: 4187025 - RNA, 21 nt, Yersinia pestis KIM
accgggggcguauuaucggau

SEQ ID NO: 4187026 - RNA, 18 nt, Yersinia pestis KIM
accgggguucgcaaugaa

SEQ ID NO: 4187027 - RNA, 16 nt, Yersinia pestis KIM
accgguacugaggcau

SEQ ID NO: 4187028 - RNA, 14 nt, Yersinia pestis KIM
accggucacaccag

SEQ ID NO: 4187029 - RNA, 23 nt, Yersinia pestis KIM
accggucgcguaccuucacauuu

SEQ ID NO: 4187030 - RNA, 17 nt, Yersinia pestis KIM
accgguuuacccugcgc

SEQ ID NO: 4187031 - RNA, 14 nt, Yersinia pestis KIM
accguaucacccgc

SEQ ID NO: 4187032 - RNA, 13 nt, Yersinia pestis KIM
accguaucagccc

SEQ ID NO: 4187033 - RNA, 20 nt, Yersinia pestis KIM
accguaucaucaccaaacag

SEQ ID NO: 4187034 - RNA, 13 nt, Yersinia pestis KIM
accguauccacuu

SEQ ID NO: 4187035 - RNA, 17 nt, Yersinia pestis KIM
accgucaagacaacaaa

SEQ ID NO: 4187036 - RNA, 13 nt, Yersinia pestis KIM
accgucaccuuua

SEQ ID NO: 4187037 - RNA, 16 nt, Yersinia pestis KIM
accgucuuugaccgaa

SEQ ID NO: 4187038 - RNA, 22 nt, Yersinia pestis KIM
accgugaacgauaacggcggua

SEQ ID NO: 4187039 - RNA, 16 nt, Yersinia pestis KIM
accgugacauuuucac

SEQ ID NO: 4187040 - RNA, 18 nt, Yersinia pestis KIM
accgugacuaaaacaagc

SEQ ID NO: 4187041 - RNA, 16 nt, Yersinia pestis KIM
accguggauaaacaaa

SEQ ID NO: 4187042 - RNA, 15 nt, Yersinia pestis KIM
accgugguuugcucu

SEQ ID NO: 4187043 - RNA, 13 nt, Yersinia pestis KIM
accgugugcuucc

SEQ ID NO: 4187044 - RNA, 18 nt, Yersinia pestis KIM
accguuguauguggcugu

SEQ ID NO: 4187045 - RNA, 14 nt, Yersinia pestis KIM
accguuguguauca

SEQ ID NO: 4187046 - RNA, 14 nt, Yersinia pestis KIM
accuaaaaaaaaca

SEQ ID NO: 4187047 - RNA, 16 nt, Yersinia pestis KIM
accuaaaaaaaacaac

SEQ ID NO: 4187048 - RNA, 21 nt, Yersinia pestis KIM
accuaaaaugacgaucacugc

SEQ ID NO: 4187049 - RNA, 16 nt, Yersinia pestis KIM
accuaaaccuuucaga

SEQ ID NO: 4187050 - RNA, 21 nt, Yersinia pestis KIM
accuaacacuuuaucgaccac

SEQ ID NO: 4187051 - RNA, 14 nt, Yersinia pestis KIM
accuaacaugcuga

SEQ ID NO: 4187052 - RNA, 14 nt, Yersinia pestis KIM
acauuuuaaagaau

SEQ ID NO: 4187053 - RNA, 17 nt, Yersinia pestis KIM
acauuuuaaagaaugca

SEQ ID NO: 4187054 - RNA, 20 nt, Yersinia pestis KIM
acauuuuacucccugacucc

SEQ ID NO: 4187055 - RNA, 22 nt, Yersinia pestis KIM
acauuuucaucugaccaaacau

SEQ ID NO: 4187056 - RNA, 21 nt, Yersinia pestis KIM
acauuuugguuucuccaagca

SEQ ID NO: 4187057 - RNA, 15 nt, Yersinia pestis KIM
acauuuugugugagu

SEQ ID NO: 4187058 - RNA, 21 nt, Yersinia pestis KIM
acauuuuuaauaauguguuug

SEQ ID NO: 4187059 - RNA, 17 nt, Yersinia pestis KIM
acauuuuucuauuucug

SEQ ID NO: 4187060 - RNA, 14 nt, Yersinia pestis KIM
accaaaaacuucau

SEQ ID NO: 4187061 - RNA, 15 nt, Yersinia pestis KIM
accaaaaaucuuguu

SEQ ID NO: 4187062 - RNA, 22 nt, Yersinia pestis KIM
accaaaaaucuuguuaauuuaa

SEQ ID NO: 4187063 - RNA, 17 nt, Yersinia pestis KIM
accaaaaguaucuuuca

SEQ ID NO: 4187064 - RNA, 23 nt, Yersinia pestis KIM
accaaaauagcggccaacauaau

SEQ ID NO: 4187065 - RNA, 17 nt, Yersinia pestis KIM
accaaaauauucgcauu

SEQ ID NO: 4187066 - RNA, 18 nt, Yersinia pestis KIM
accaaaauguuuauacgc

SEQ ID NO: 4187067 - RNA, 19 nt, Yersinia pestis KIM
accaaaauucacaacuugu

SEQ ID NO: 4187068 - RNA, 11 nt, Yersinia pestis KIM
accaaacagaa

SEQ ID NO: 4187069 - RNA, 20 nt, Yersinia pestis KIM
accaaacagaccccagaaga

SEQ ID NO: 4187070 - RNA, 21 nt, Yersinia pestis KIM
accaaacagaccccagaagau

SEQ ID NO: 4187071 - RNA, 12 nt, Yersinia pestis KIM
accaaacauugu

SEQ ID NO: 4187072 - RNA, 13 nt, Yersinia pestis KIM
accaaacauuguc

SEQ ID NO: 4187073 - RNA, 19 nt, Yersinia pestis KIM
accaaacauuuucaucuga

SEQ ID NO: 4187074 - RNA, 22 nt, Yersinia pestis KIM
accaaacggaaugguuuggcca

SEQ ID NO: 4187075 - RNA, 22 nt, Yersinia pestis KIM
accaaagcaacagccauauuuu

SEQ ID NO: 4187076 - RNA, 21 nt, Yersinia pestis KIM
accaaagcguacucuucugua

SEQ ID NO: 4187077 - RNA, 18 nt, Yersinia pestis KIM
accaaaggccaaccucuu

SEQ ID NO: 4187078 - RNA, 18 nt, Yersinia pestis KIM
accaaauaaaccagaugu

SEQ ID NO: 4187079 - RNA, 23 nt, Yersinia pestis KIM
accaaauagcaagccaaaacagc

SEQ ID NO: 4187080 - RNA, 12 nt, Yersinia pestis KIM
accaaauauuac

SEQ ID NO: 4187081 - RNA, 13 nt, Yersinia pestis KIM
accaaauccaacu

SEQ ID NO: 4187082 - RNA, 20 nt, Yersinia pestis KIM
accaaaucugacgguuauuu

SEQ ID NO: 4187083 - RNA, 21 nt, Yersinia pestis KIM
accaaaucugacgguuauuuu

SEQ ID NO: 4187084 - RNA, 12 nt, Yersinia pestis KIM
accaaaucuucc

SEQ ID NO: 4187085 - RNA, 18 nt, Yersinia pestis KIM
accaaaucuuccagcggc

SEQ ID NO: 4187086 - RNA, 11 nt, Yersinia pestis KIM
accaaauucag

SEQ ID NO: 4187087 - RNA, 16 nt, Yersinia pestis KIM
accaaauuccccagcc

SEQ ID NO: 4187088 - RNA, 19 nt, Yersinia pestis KIM
accaacaccacacugagca

SEQ ID NO: 4187089 - RNA, 22 nt, Yersinia pestis KIM
accaacaccaucgcagcgacau

SEQ ID NO: 4187090 - RNA, 15 nt, Yersinia pestis KIM
accaacaguuauuuu

SEQ ID NO: 4187091 - RNA, 11 nt, Yersinia pestis KIM
accaaccccac

SEQ ID NO: 4187092 - RNA, 19 nt, Yersinia pestis KIM
accaaccguagucgcacca

SEQ ID NO: 4187093 - RNA, 19 nt, Yersinia pestis KIM
accaagaacccuuuaucuu

SEQ ID NO: 4187094 - RNA, 12 nt, Yersinia pestis KIM
accaagaacgcc

SEQ ID NO: 4187095 - RNA, 23 nt, Yersinia pestis KIM
accaagaccaguucagguauuug

SEQ ID NO: 4187096 - RNA, 18 nt, Yersinia pestis KIM
accaagaggaaaugccgc

SEQ ID NO: 4187097 - RNA, 21 nt, Yersinia pestis KIM
accaagcccaguaaagcaaau

SEQ ID NO: 4187098 - RNA, 20 nt, Yersinia pestis KIM
accaagcccuuuggcaauca

SEQ ID NO: 4187099 - RNA, 15 nt, Yersinia pestis KIM
accaaggaaaccacc

SEQ ID NO: 4187100 - RNA, 18 nt, Yersinia pestis KIM
accaaggaaaccaccuaa

SEQ ID NO: 4187101 - RNA, 17 nt, Yersinia pestis KIM
accaaguucggagauuu

SEQ ID NO: 4187102 - RNA, 18 nt, Yersinia pestis KIM
accaaguuugacuuauga

SEQ ID NO: 4187103 - RNA, 13 nt, Yersinia pestis KIM
accaauaccggcg

SEQ ID NO: 4187104 - RNA, 17 nt, Yersinia pestis KIM
accaauagucacgucuu

SEQ ID NO: 4187105 - RNA, 23 nt, Yersinia pestis KIM
accaauauugcggauucacccau

SEQ ID NO: 4187106 - RNA, 20 nt, Yersinia pestis KIM
accaaucaaaaauugcccca

SEQ ID NO: 4187107 - RNA, 15 nt, Yersinia pestis KIM
accaaucaauacacu

SEQ ID NO: 4187108 - RNA, 14 nt, Yersinia pestis KIM
accaauccaugcca

SEQ ID NO: 4187109 - RNA, 18 nt, Yersinia pestis KIM
accaaucguugcugguua

SEQ ID NO: 4187110 - RNA, 20 nt, Yersinia pestis KIM
accaaucuccaaugaccccg

SEQ ID NO: 4187111 - RNA, 21 nt, Yersinia pestis KIM
accaaugcacguaaagaguua

SEQ ID NO: 4187112 - RNA, 20 nt, Yersinia pestis KIM
accaaugccccggauugcug

SEQ ID NO: 4187113 - RNA, 19 nt, Yersinia pestis KIM
accaauggacggaacacgu

SEQ ID NO: 4187114 - RNA, 19 nt, Yersinia pestis KIM
accaauggcuaaaucauca

SEQ ID NO: 4187115 - RNA, 21 nt, Yersinia pestis KIM
accaaugggguaaucacuaca

SEQ ID NO: 4187116 - RNA, 10 nt, Yersinia pestis KIM
accaauggug

SEQ ID NO: 4187117 - RNA, 10 nt, Yersinia pestis KIM
accaaugguu

SEQ ID NO: 4187118 - RNA, 19 nt, Yersinia pestis KIM
accaaugucucaggauaca

SEQ ID NO: 4187119 - RNA, 12 nt, Yersinia pestis KIM
accaauucaguu

SEQ ID NO: 4187120 - RNA, 14 nt, Yersinia pestis KIM
accaauucaucagc

SEQ ID NO: 4187121 - RNA, 16 nt, Yersinia pestis KIM
accaauugguuugaca

SEQ ID NO: 4187122 - RNA, 22 nt, Yersinia pestis KIM
accaauuguauaaggcggugca

SEQ ID NO: 4187123 - RNA, 23 nt, Yersinia pestis KIM
accaauuugccauaccaggccac

SEQ ID NO: 4187124 - RNA, 18 nt, Yersinia pestis KIM
accacaaaaacaguguca

SEQ ID NO: 4187125 - RNA, 16 nt, Yersinia pestis KIM
accacaaaggcaaaau

SEQ ID NO: 4187126 - RNA, 22 nt, Yersinia pestis KIM
accacaauauggggugcuucaa

SEQ ID NO: 4187127 - RNA, 15 nt, Yersinia pestis KIM
accacaccggcugca

SEQ ID NO: 4187128 - RNA, 20 nt, Yersinia pestis KIM
accacacugagcaccgcagg

SEQ ID NO: 4187129 - RNA, 14 nt, Yersinia pestis KIM
accacacuggaugc

SEQ ID NO: 4187130 - RNA, 18 nt, Yersinia pestis KIM
accacagauaaauaaaau

SEQ ID NO: 4187131 - RNA, 19 nt, Yersinia pestis KIM
accacagauaaauaaaaua

SEQ ID NO: 4187132 - RNA, 19 nt, Yersinia pestis KIM
accacagcgaucucauuua

SEQ ID NO: 4187133 - RNA, 13 nt, Yersinia pestis KIM
accacaucaaacc

SEQ ID NO: 4187134 - RNA, 14 nt, Yersinia pestis KIM
accaccaacagcau

SEQ ID NO: 4187135 - RNA, 15 nt, Yersinia pestis KIM
accaccaacagcauu

SEQ ID NO: 4187136 - RNA, 13 nt, Yersinia pestis KIM
accaccaccaaca

SEQ ID NO: 4187137 - RNA, 15 nt, Yersinia pestis KIM
accaccaccaacagc

SEQ ID NO: 4187138 - RNA, 14 nt, Yersinia pestis KIM
accaccacggccag

SEQ ID NO: 4187139 - RNA, 12 nt, Yersinia pestis KIM
accaccagaggu

SEQ ID NO: 4187140 - RNA, 15 nt, Yersinia pestis KIM
accaccauuaacaag

SEQ ID NO: 4187141 - RNA, 11 nt, Yersinia pestis KIM
accacccacgu

SEQ ID NO: 4187142 - RNA, 17 nt, Yersinia pestis KIM
accacccguugcauuuu

SEQ ID NO: 4187143 - RNA, 19 nt, Yersinia pestis KIM
accaccgccgcaacaauaa

SEQ ID NO: 4187144 - RNA, 13 nt, Yersinia pestis KIM
accaccgucaaga

SEQ ID NO: 4187145 - RNA, 16 nt, Yersinia pestis KIM
accaccgucaagacaa

SEQ ID NO: 4187146 - RNA, 20 nt, Yersinia pestis KIM
accaccuaauacagcaccac

SEQ ID NO: 4187147 - RNA, 22 nt, Yersinia pestis KIM
accaccuaauacagcaccaccg

SEQ ID NO: 4187148 - RNA, 16 nt, Yersinia pestis KIM
accacgauuagccaua

SEQ ID NO: 4187149 - RNA, 16 nt, Yersinia pestis KIM
accacggccagaauca

SEQ ID NO: 4187150 - RNA, 14 nt, Yersinia pestis KIM
accacgguaaugaa

SEQ ID NO: 4187151 - RNA, 16 nt, Yersinia pestis KIM
accacgguaucaauca

SEQ ID NO: 4187152 - RNA, 18 nt, Yersinia pestis KIM
accacgguaucaaucagc

SEQ ID NO: 4187153 - RNA, 15 nt, Yersinia pestis KIM
accacguugaauauu

SEQ ID NO: 4187154 - RNA, 14 nt, Yersinia pestis KIM
accacuaguuaaaa

SEQ ID NO: 4187155 - RNA, 17 nt, Yersinia pestis KIM
accacuaguuaaaacca

SEQ ID NO: 4187156 - RNA, 12 nt, Yersinia pestis KIM
accacugaccua

SEQ ID NO: 4187157 - RNA, 14 nt, Yersinia pestis KIM
accacugaccuauu

SEQ ID NO: 4187158 - RNA, 18 nt, Yersinia pestis KIM
accacugaguugcucaag

SEQ ID NO: 4187159 - RNA, 14 nt, Yersinia pestis KIM
accacugauuaaga

SEQ ID NO: 4187160 - RNA, 16 nt, Yersinia pestis KIM
accacuuaguggcauu

SEQ ID NO: 4187161 - RNA, 14 nt, Yersinia pestis KIM
accagaauaaucca

SEQ ID NO: 4187162 - RNA, 19 nt, Yersinia pestis KIM
accagaauaauccaagcca

SEQ ID NO: 4187163 - RNA, 21 nt, Yersinia pestis KIM
accagaauuugcagaucggca

SEQ ID NO: 4187164 - RNA, 12 nt, Yersinia pestis KIM
accagacaacag

SEQ ID NO: 4187165 - RNA, 23 nt, Yersinia pestis KIM
accagacucugcuaccaggaagc

SEQ ID NO: 4187166 - RNA, 21 nt, Yersinia pestis KIM
accagauagcuguuagccaga

SEQ ID NO: 4187167 - RNA, 19 nt, Yersinia pestis KIM
accagauugccgucacuuu

SEQ ID NO: 4187168 - RNA, 16 nt, Yersinia pestis KIM
accagcaaaggccacc

SEQ ID NO: 4187169 - RNA, 17 nt, Yersinia pestis KIM
accagcaaaggccacca

SEQ ID NO: 4187170 - RNA, 14 nt, Yersinia pestis KIM
accagcaagaaucc

SEQ ID NO: 4187171 - RNA, 17 nt, Yersinia pestis KIM
accagcaagaaucccau

SEQ ID NO: 4187172 - RNA, 16 nt, Yersinia pestis KIM
accagcauacgugcca

SEQ ID NO: 4187173 - RNA, 15 nt, Yersinia pestis KIM
accagcaucaguagc

SEQ ID NO: 4187174 - RNA, 21 nt, Yersinia pestis KIM
accagccccgguuaaauuccc

SEQ ID NO: 4187175 - RNA, 20 nt, Yersinia pestis KIM
accagcccuguugcccagca

SEQ ID NO: 4187176 - RNA, 21 nt, Yersinia pestis KIM
accagcuugggugaagacacu

SEQ ID NO: 4187177 - RNA, 17 nt, Yersinia pestis KIM
accaggaagcggccagg

SEQ ID NO: 4187178 - RNA, 21 nt, Yersinia pestis KIM
accaggcgcuauuccgcgccu

SEQ ID NO: 4187179 - RNA, 14 nt, Yersinia pestis KIM
accaguaaacgcca

SEQ ID NO: 4187180 - RNA, 15 nt, Yersinia pestis KIM
accaguaacugauca

SEQ ID NO: 4187181 - RNA, 14 nt, Yersinia pestis KIM
accaguaagugauu

SEQ ID NO: 4187182 - RNA, 23 nt, Yersinia pestis KIM
accagugaauaaguucugcgacu

SEQ ID NO: 4187183 - RNA, 17 nt, Yersinia pestis KIM
accagugccaaucccca

SEQ ID NO: 4187184 - RNA, 19 nt, Yersinia pestis KIM
accagugccaauccccacc

SEQ ID NO: 4187185 - RNA, 17 nt, Yersinia pestis KIM
accagugccgcccagcg

SEQ ID NO: 4187186 - RNA, 14 nt, Yersinia pestis KIM
accaguguugggcu

SEQ ID NO: 4187187 - RNA, 18 nt, Yersinia pestis KIM
accaguuaauaucaauga

SEQ ID NO: 4187188 - RNA, 13 nt, Yersinia pestis KIM
accaguucuggua

SEQ ID NO: 4187189 - RNA, 22 nt, Yersinia pestis KIM
accaguugaugaaucaaugaaa

SEQ ID NO: 4187190 - RNA, 22 nt, Yersinia pestis KIM
accauaaaauaaauaauuugua

SEQ ID NO: 4187191 - RNA, 18 nt, Yersinia pestis KIM
accauaaacaaguugaac

SEQ ID NO: 4187192 - RNA, 20 nt, Yersinia pestis KIM
accauaaaguuacugcgcuc

SEQ ID NO: 4187193 - RNA, 14 nt, Yersinia pestis KIM
accauaacaauggc

SEQ ID NO: 4187194 - RNA, 14 nt, Yersinia pestis KIM
accauaacgcugcu

SEQ ID NO: 4187195 - RNA, 14 nt, Yersinia pestis KIM
accauaacugcugc

SEQ ID NO: 4187196 - RNA, 17 nt, Yersinia pestis KIM
accauaaggccaggcaa

SEQ ID NO: 4187197 - RNA, 13 nt, Yersinia pestis KIM
accauacagcagu

SEQ ID NO: 4187198 - RNA, 22 nt, Yersinia pestis KIM
accauacagcagucaaaaugaa

SEQ ID NO: 4187199 - RNA, 21 nt, Yersinia pestis KIM
accauagagcaaccguuacaa

SEQ ID NO: 4187200 - RNA, 14 nt, Yersinia pestis KIM
accauaucagaacc

SEQ ID NO: 4187201 - RNA, 21 nt, Yersinia pestis KIM
accauauucccagccaacucc

SEQ ID NO: 4187202 - RNA, 15 nt, Yersinia pestis KIM
accaucaaaauaugu

SEQ ID NO: 4187203 - RNA, 12 nt, Yersinia pestis KIM
accaucaauaua

SEQ ID NO: 4187204 - RNA, 15 nt, Yersinia pestis KIM
accaucaccauauca

SEQ ID NO: 4187205 - RNA, 18 nt, Yersinia pestis KIM
accaucacuuccagcgcc

SEQ ID NO: 4187206 - RNA, 22 nt, Yersinia pestis KIM
accaucaggauuaaugcggaua

SEQ ID NO: 4187207 - RNA, 12 nt, Yersinia pestis KIM
accauccagugc

SEQ ID NO: 4187208 - RNA, 21 nt, Yersinia pestis KIM
accaucgacuggccgauauca

SEQ ID NO: 4187209 - RNA, 20 nt, Yersinia pestis KIM
accaucuccggcugacugga

SEQ ID NO: 4187210 - RNA, 17 nt, Yersinia pestis KIM
accaucugccugcaaau

SEQ ID NO: 4187211 - RNA, 21 nt, Yersinia pestis KIM
accaugagugaaaauauguag

SEQ ID NO: 4187212 - RNA, 13 nt, Yersinia pestis KIM
accaugaugacaa

SEQ ID NO: 4187213 - RNA, 15 nt, Yersinia pestis KIM
accaugaugacaaug

SEQ ID NO: 4187214 - RNA, 22 nt, Yersinia pestis KIM
accaugcgauacgcccgcccca

SEQ ID NO: 4187215 - RNA, 22 nt, Yersinia pestis KIM
accauggcggcucgccugauag

SEQ ID NO: 4187216 - RNA, 23 nt, Yersinia pestis KIM
accauggcggcucgccugauagc

SEQ ID NO: 4187217 - RNA, 14 nt, Yersinia pestis KIM
accauguacauggc

SEQ ID NO: 4187218 - RNA, 15 nt, Yersinia pestis KIM
accauugguaauaau

SEQ ID NO: 4187219 - RNA, 15 nt, Yersinia pestis KIM
accauuuccaggcua

SEQ ID NO: 4187220 - RNA, 14 nt, Yersinia pestis KIM
accauuugcccugg

SEQ ID NO: 4187221 - RNA, 15 nt, Yersinia pestis KIM
accauuuuuaugcca

SEQ ID NO: 4187222 - RNA, 14 nt, Yersinia pestis KIM
acccaaaggggagc

SEQ ID NO: 4187223 - RNA, 20 nt, Yersinia pestis KIM
acccaaaggggagccaaugu

SEQ ID NO: 4187224 - RNA, 14 nt, Yersinia pestis KIM
acccaaagucauug

SEQ ID NO: 4187225 - RNA, 16 nt, Yersinia pestis KIM
acccaacaguaccuuc

SEQ ID NO: 4187226 - RNA, 17 nt, Yersinia pestis KIM
acccaacaguaccuucu

SEQ ID NO: 4187227 - RNA, 18 nt, Yersinia pestis KIM
acccaaccccaucagcau

SEQ ID NO: 4187228 - RNA, 16 nt, Yersinia pestis KIM
acccaauaauaaucca

SEQ ID NO: 4187229 - RNA, 15 nt, Yersinia pestis KIM
acccaauauucgcca

SEQ ID NO: 4187230 - RNA, 22 nt, Yersinia pestis KIM
acccacaucccggcagcaguug

SEQ ID NO: 4187231 - RNA, 18 nt, Yersinia pestis KIM
acccaccagagaccacag

SEQ ID NO: 4187232 - RNA, 14 nt, Yersinia pestis KIM
acccaccugaaucu

SEQ ID NO: 4187233 - RNA, 13 nt, Yersinia pestis KIM
acccacguucaga

SEQ ID NO: 4187234 - RNA, 15 nt, Yersinia pestis KIM
acccacuugcaacau

SEQ ID NO: 4187235 - RNA, 21 nt, Yersinia pestis KIM
acccacuugccauaagugaac

SEQ ID NO: 4187236 - RNA, 22 nt, Yersinia pestis KIM
acccacuugccauaagugaaca

SEQ ID NO: 4187237 - RNA, 12 nt, Yersinia pestis KIM
acccagcaaaau

SEQ ID NO: 4187238 - RNA, 19 nt, Yersinia pestis KIM
acccagcgaacguaaaaag

SEQ ID NO: 4187239 - RNA, 22 nt, Yersinia pestis KIM
acccagcuucuuuuaaagaaga

SEQ ID NO: 4187240 - RNA, 13 nt, Yersinia pestis KIM
acccaguaacuga

SEQ ID NO: 4187241 - RNA, 19 nt, Yersinia pestis KIM
acccauaacuugagcacau

SEQ ID NO: 4187242 - RNA, 18 nt, Yersinia pestis KIM
acccauacgaucagcaag

SEQ ID NO: 4187243 - RNA, 20 nt, Yersinia pestis KIM
acccauauuggcaauauuca

SEQ ID NO: 4187244 - RNA, 13 nt, Yersinia pestis KIM
acccaucaagcgg

SEQ ID NO: 4187245 - RNA, 17 nt, Yersinia pestis KIM
acccaucaauaauuaag

SEQ ID NO: 4187246 - RNA, 22 nt, Yersinia pestis KIM
acccauccaguauuucaguaac

SEQ ID NO: 4187247 - RNA, 20 nt, Yersinia pestis KIM
acccauuuccccuuucuggu

SEQ ID NO: 4187248 - RNA, 20 nt, Yersinia pestis KIM
acccauuucccugccgggac

SEQ ID NO: 4187249 - RNA, 20 nt, Yersinia pestis KIM
acccauuugcacagcauuua

SEQ ID NO: 4187250 - RNA, 14 nt, Yersinia pestis KIM
accccacaaccugc

SEQ ID NO: 4187251 - RNA, 13 nt, Yersinia pestis KIM
accccaccucuua

SEQ ID NO: 4187252 - RNA, 18 nt, Yersinia pestis KIM
accccacucgguuagcug

SEQ ID NO: 4187253 - RNA, 15 nt, Yersinia pestis KIM
accccauaaaucccg

SEQ ID NO: 4187254 - RNA, 15 nt, Yersinia pestis KIM
accccaucagcauau

SEQ ID NO: 4187255 - RNA, 23 nt, Yersinia pestis KIM
accccauuuaucgccaagccagu

SEQ ID NO: 4187256 - RNA, 22 nt, Yersinia pestis KIM
acccccaaugaguagcuguagc

SEQ ID NO: 4187257 - RNA, 14 nt, Yersinia pestis KIM
accccccauugcca

SEQ ID NO: 4187258 - RNA, 14 nt, Yersinia pestis KIM
accccgaugacgcg

SEQ ID NO: 4187259 - RNA, 19 nt, Yersinia pestis KIM
accccgcguugucagccau

SEQ ID NO: 4187260 - RNA, 15 nt, Yersinia pestis KIM
accccuagccagcca

SEQ ID NO: 4187261 - RNA, 16 nt, Yersinia pestis KIM
accccugcgauaaucu

SEQ ID NO: 4187262 - RNA, 12 nt, Yersinia pestis KIM
accccugcugaa

SEQ ID NO: 4187263 - RNA, 18 nt, Yersinia pestis KIM
accccugucuuauuuuuu

SEQ ID NO: 4187264 - RNA, 19 nt, Yersinia pestis KIM
accccuucaagcacccauu

SEQ ID NO: 4187265 - RNA, 14 nt, Yersinia pestis KIM
accccuuggcucuc

SEQ ID NO: 4187266 - RNA, 13 nt, Yersinia pestis KIM
acccgaaagccau

SEQ ID NO: 4187267 - RNA, 14 nt, Yersinia pestis KIM
acccgacaucaaga

SEQ ID NO: 4187268 - RNA, 17 nt, Yersinia pestis KIM
acccgauacaggcucug

SEQ ID NO: 4187269 - RNA, 15 nt, Yersinia pestis KIM
acccgauuucaacgc

SEQ ID NO: 4187270 - RNA, 21 nt, Yersinia pestis KIM
acccgcaauacgggugaacau

SEQ ID NO: 4187271 - RNA, 21 nt, Yersinia pestis KIM
acccgcaguuugagaaacuga

SEQ ID NO: 4187272 - RNA, 16 nt, Yersinia pestis KIM
acccgccucuaaaucu

SEQ ID NO: 4187273 - RNA, 17 nt, Yersinia pestis KIM
acccgcuauauguaaug

SEQ ID NO: 4187274 - RNA, 17 nt, Yersinia pestis KIM
acccgcugcguacggac

SEQ ID NO: 4187275 - RNA, 12 nt, Yersinia pestis KIM
acccgcuggcga

SEQ ID NO: 4187276 - RNA, 17 nt, Yersinia pestis KIM
acccgcuggcgaccacu

SEQ ID NO: 4187277 - RNA, 22 nt, Yersinia pestis KIM
acccgcuugucuugaaaguguc

SEQ ID NO: 4187278 - RNA, 18 nt, Yersinia pestis KIM
acccggugacccgugcgg

SEQ ID NO: 4187279 - RNA, 14 nt, Yersinia pestis KIM
acccguuauauuuc

SEQ ID NO: 4187280 - RNA, 17 nt, Yersinia pestis KIM
acccguugcauuuuucu

SEQ ID NO: 4187281 - RNA, 23 nt, Yersinia pestis KIM
acccguugcauuuuucuguucag

SEQ ID NO: 4187282 - RNA, 13 nt, Yersinia pestis KIM
acccuaauaccaa

SEQ ID NO: 4187283 - RNA, 20 nt, Yersinia pestis KIM
acccuaauaccaacagcagg

SEQ ID NO: 4187284 - RNA, 17 nt, Yersinia pestis KIM
acccucaacucaaaaca

SEQ ID NO: 4187285 - RNA, 18 nt, Yersinia pestis KIM
acccucaacucaaaacaa

SEQ ID NO: 4187286 - RNA, 21 nt, Yersinia pestis KIM
acaguagugaguuaacgagug

SEQ ID NO: 4187287 - RNA, 16 nt, Yersinia pestis KIM
acaguauucugcuucc

SEQ ID NO: 4187288 - RNA, 17 nt, Yersinia pestis KIM
acagucaguucauuaca

SEQ ID NO: 4187289 - RNA, 13 nt, Yersinia pestis KIM
acagucauuaaca

SEQ ID NO: 4187290 - RNA, 14 nt, Yersinia pestis KIM
acagucccugugcg

SEQ ID NO: 4187291 - RNA, 22 nt, Yersinia pestis KIM
acagucccugugcgcccacgcc

SEQ ID NO: 4187292 - RNA, 18 nt, Yersinia pestis KIM
acagucggcauagcuaau

SEQ ID NO: 4187293 - RNA, 20 nt, Yersinia pestis KIM
acagucuagugcgcugugcc

SEQ ID NO: 4187294 - RNA, 18 nt, Yersinia pestis KIM
acagucugucguacuuuc

SEQ ID NO: 4187295 - RNA, 22 nt, Yersinia pestis KIM
acagucugucguacuuuccuuc

SEQ ID NO: 4187296 - RNA, 18 nt, Yersinia pestis KIM
acagucuuauuacucauu

SEQ ID NO: 4187297 - RNA, 16 nt, Yersinia pestis KIM
acagucuuuuucccaa

SEQ ID NO: 4187298 - RNA, 20 nt, Yersinia pestis KIM
acagugcaacauuaaaaaua

SEQ ID NO: 4187299 - RNA, 22 nt, Yersinia pestis KIM
acaguguaaaaagcgaucgacc

SEQ ID NO: 4187300 - RNA, 20 nt, Yersinia pestis KIM
acagugucaguaugaaauuu

SEQ ID NO: 4187301 - RNA, 14 nt, Yersinia pestis KIM
acaguuacgucagg

SEQ ID NO: 4187302 - RNA, 21 nt, Yersinia pestis KIM
acaguuauuuuaauugcugau

SEQ ID NO: 4187303 - RNA, 22 nt, Yersinia pestis KIM
acaguucauaucgauaccgaua

SEQ ID NO: 4187304 - RNA, 22 nt, Yersinia pestis KIM
acaguugugucagaccaaauag

SEQ ID NO: 4187305 - RNA, 15 nt, Yersinia pestis KIM
acaguuguuucaaua

SEQ ID NO: 4187306 - RNA, 15 nt, Yersinia pestis KIM
acauaaaaaagagua

SEQ ID NO: 4187307 - RNA, 15 nt, Yersinia pestis KIM
acauaaaaagaaaaa

SEQ ID NO: 4187308 - RNA, 21 nt, Yersinia pestis KIM
acauaaaaagaaaaaaacaga

SEQ ID NO: 4187309 - RNA, 24 nt, Yersinia pestis KIM
acauaaaaagaaaaaaacagacua

SEQ ID NO: 4187310 - RNA, 15 nt, Yersinia pestis KIM
acauaaaaauagcuu

SEQ ID NO: 4187311 - RNA, 16 nt, Yersinia pestis KIM
acauaaaaucaauauc

SEQ ID NO: 4187312 - RNA, 17 nt, Yersinia pestis KIM
acauaaaaucaauaucg

SEQ ID NO: 4187313 - RNA, 20 nt, Yersinia pestis KIM
acauaaagcaaacgccgcuc

SEQ ID NO: 4187314 - RNA, 19 nt, Yersinia pestis KIM
acauaaccugcaacgcgga

SEQ ID NO: 4187315 - RNA, 17 nt, Yersinia pestis KIM
acauaacguuauaacuc

SEQ ID NO: 4187316 - RNA, 18 nt, Yersinia pestis KIM
acauaacguuauaacuca

SEQ ID NO: 4187317 - RNA, 13 nt, Yersinia pestis KIM
acauaaggcuaga

SEQ ID NO: 4187318 - RNA, 12 nt, Yersinia pestis KIM
acauaauauuua

SEQ ID NO: 4187319 - RNA, 13 nt, Yersinia pestis KIM
acauaaucaaucc

SEQ ID NO: 4187320 - RNA, 14 nt, Yersinia pestis KIM
acauaccagcaaga

SEQ ID NO: 4187321 - RNA, 21 nt, Yersinia pestis KIM
acauaccccauuuaucgccaa

SEQ ID NO: 4187322 - RNA, 19 nt, Yersinia pestis KIM
acauacucuuccaacgcuu

SEQ ID NO: 4187323 - RNA, 21 nt, Yersinia pestis KIM
acauacuuuucauuuccucug

SEQ ID NO: 4187324 - RNA, 12 nt, Yersinia pestis KIM
acauagcgcauc

SEQ ID NO: 4187325 - RNA, 15 nt, Yersinia pestis KIM
acauagcgcauccaa

SEQ ID NO: 4187326 - RNA, 18 nt, Yersinia pestis KIM
acauagcgcauccaaccu

SEQ ID NO: 4187327 - RNA, 14 nt, Yersinia pestis KIM
acauagcuaacacc

SEQ ID NO: 4187328 - RNA, 22 nt, Yersinia pestis KIM
acauagcugcgauaauccgcca

SEQ ID NO: 4187329 - RNA, 23 nt, Yersinia pestis KIM
acauaguuaugaugaguaacaua

SEQ ID NO: 4187330 - RNA, 20 nt, Yersinia pestis KIM
acauauaaaccagccaguga

SEQ ID NO: 4187331 - RNA, 17 nt, Yersinia pestis KIM
acauauaaccaucaaau

SEQ ID NO: 4187332 - RNA, 22 nt, Yersinia pestis KIM
acauauaauccaaaauaauaua

SEQ ID NO: 4187333 - RNA, 14 nt, Yersinia pestis KIM
acauauauuaucua

SEQ ID NO: 4187334 - RNA, 15 nt, Yersinia pestis KIM
acauaucaacacugc

SEQ ID NO: 4187335 - RNA, 21 nt, Yersinia pestis KIM
acauaucuuuauuaucaaugg

SEQ ID NO: 4187336 - RNA, 22 nt, Yersinia pestis KIM
acauauuggucauuuuucccuu

SEQ ID NO: 4187337 - RNA, 14 nt, Yersinia pestis KIM
acaucaaaccggcu

SEQ ID NO: 4187338 - RNA, 18 nt, Yersinia pestis KIM
acaucaaaccggcuaaug

SEQ ID NO: 4187339 - RNA, 19 nt, Yersinia pestis KIM
acaucacaccugggcgcuc

SEQ ID NO: 4187340 - RNA, 23 nt, Yersinia pestis KIM
acaucacgcagcgcuugcuggua

SEQ ID NO: 4187341 - RNA, 22 nt, Yersinia pestis KIM
acaucaggcuguugacauaaac

SEQ ID NO: 4187342 - RNA, 23 nt, Yersinia pestis KIM
acaucaggcuuagcgacacccac

SEQ ID NO: 4187343 - RNA, 13 nt, Yersinia pestis KIM
acaucaugacaaa

SEQ ID NO: 4187344 - RNA, 20 nt, Yersinia pestis KIM
acaucaugaguaaaagauuc

SEQ ID NO: 4187345 - RNA, 15 nt, Yersinia pestis KIM
acauccauguaggcu

SEQ ID NO: 4187346 - RNA, 17 nt, Yersinia pestis KIM
acauccauguaggcucg

SEQ ID NO: 4187347 - RNA, 17 nt, Yersinia pestis KIM
acaucccaauauucacu

SEQ ID NO: 4187348 - RNA, 21 nt, Yersinia pestis KIM
acaucgaagcugucuuuuaaa

SEQ ID NO: 4187349 - RNA, 17 nt, Yersinia pestis KIM
acaucgagcgggcuuca

SEQ ID NO: 4187350 - RNA, 21 nt, Yersinia pestis KIM
acaucgagcgggcuucaccau

SEQ ID NO: 4187351 - RNA, 13 nt, Yersinia pestis KIM
acaucgcaccgau

SEQ ID NO: 4187352 - RNA, 22 nt, Yersinia pestis KIM
acaucgguaucggccaauucag

SEQ ID NO: 4187353 - RNA, 19 nt, Yersinia pestis KIM
acaucuccugguucacucu

SEQ ID NO: 4187354 - RNA, 14 nt, Yersinia pestis KIM
acaucugcuuuacu

SEQ ID NO: 4187355 - RNA, 19 nt, Yersinia pestis KIM
acaucugggucauguggaa

SEQ ID NO: 4187356 - RNA, 15 nt, Yersinia pestis KIM
acaucuugcaucccc

SEQ ID NO: 4187357 - RNA, 17 nt, Yersinia pestis KIM
acaucuuuauaguucau

SEQ ID NO: 4187358 - RNA, 18 nt, Yersinia pestis KIM
acaugaacucaacuuucu

SEQ ID NO: 4187359 - RNA, 16 nt, Yersinia pestis KIM
acaugaugaaugcgaa

SEQ ID NO: 4187360 - RNA, 18 nt, Yersinia pestis KIM
acaugauugaaaaacaga

SEQ ID NO: 4187361 - RNA, 20 nt, Yersinia pestis KIM
acaugcaccguaacuucuuc

SEQ ID NO: 4187362 - RNA, 11 nt, Yersinia pestis KIM
acaugcagcau

SEQ ID NO: 4187363 - RNA, 21 nt, Yersinia pestis KIM
acaugcagcccgaccaaacgg

SEQ ID NO: 4187364 - RNA, 18 nt, Yersinia pestis KIM
acaugccacauagcguca

SEQ ID NO: 4187365 - RNA, 21 nt, Yersinia pestis KIM
acaugccgucaccucaucagu

SEQ ID NO: 4187366 - RNA, 15 nt, Yersinia pestis KIM
acaugcggauugaac

SEQ ID NO: 4187367 - RNA, 18 nt, Yersinia pestis KIM
acauggcucucuuuuuuc

SEQ ID NO: 4187368 - RNA, 13 nt, Yersinia pestis KIM
acaugggcagugc

SEQ ID NO: 4187369 - RNA, 13 nt, Yersinia pestis KIM
acauguacauuau

SEQ ID NO: 4187370 - RNA, 18 nt, Yersinia pestis KIM
acaugucccucugucccc

SEQ ID NO: 4187371 - RNA, 22 nt, Yersinia pestis KIM
acaugugcguuggcuaugcgca

SEQ ID NO: 4187372 - RNA, 15 nt, Yersinia pestis KIM
acauguuccagugcu

SEQ ID NO: 4187373 - RNA, 20 nt, Yersinia pestis KIM
acauuaaaaauacaaccaac

SEQ ID NO: 4187374 - RNA, 16 nt, Yersinia pestis KIM
acauuaacuucagguu

SEQ ID NO: 4187375 - RNA, 17 nt, Yersinia pestis KIM
acauuaauuauuuauaa

SEQ ID NO: 4187376 - RNA, 13 nt, Yersinia pestis KIM
acauuaauuuauc

SEQ ID NO: 4187377 - RNA, 23 nt, Yersinia pestis KIM
acauuacaagugccaaauggaau

SEQ ID NO: 4187378 - RNA, 19 nt, Yersinia pestis KIM
acauuacccacuugcaaca

SEQ ID NO: 4187379 - RNA, 22 nt, Yersinia pestis KIM
acauuacuggcgcugacacugg

SEQ ID NO: 4187380 - RNA, 12 nt, Yersinia pestis KIM
acauuaggcaua

SEQ ID NO: 4187381 - RNA, 20 nt, Yersinia pestis KIM
acauuaggcauauaucccaa

SEQ ID NO: 4187382 - RNA, 22 nt, Yersinia pestis KIM
acauuauccguuugcaacauua

SEQ ID NO: 4187383 - RNA, 13 nt, Yersinia pestis KIM
acauuauuuuuca

SEQ ID NO: 4187384 - RNA, 15 nt, Yersinia pestis KIM
acauuauuuuucacg

SEQ ID NO: 4187385 - RNA, 15 nt, Yersinia pestis KIM
acauucaagccuaau

SEQ ID NO: 4187386 - RNA, 16 nt, Yersinia pestis KIM
acauuccaguaaaaaa

SEQ ID NO: 4187387 - RNA, 18 nt, Yersinia pestis KIM
acauuccaguaaaaaaau

SEQ ID NO: 4187388 - RNA, 19 nt, Yersinia pestis KIM
acauucccauuauuauaag

SEQ ID NO: 4187389 - RNA, 23 nt, Yersinia pestis KIM
acauucucuacucgcucaccacu

SEQ ID NO: 4187390 - RNA, 15 nt, Yersinia pestis KIM
acauugaagugauau

SEQ ID NO: 4187391 - RNA, 22 nt, Yersinia pestis KIM
acauugccgccgauaacauuau

SEQ ID NO: 4187392 - RNA, 21 nt, Yersinia pestis KIM
acauuguuaccuaaccaaaca

SEQ ID NO: 4187393 - RNA, 22 nt, Yersinia pestis KIM
acauuguuaccuaaccaaacau

SEQ ID NO: 4187394 - RNA, 17 nt, Yersinia pestis KIM
acauuuaaacacucaau

SEQ ID NO: 4187395 - RNA, 15 nt, Yersinia pestis KIM
acauuuacuuauaaa

SEQ ID NO: 4187396 - RNA, 22 nt, Yersinia pestis KIM
acauuuacuuauaaacacugau

SEQ ID NO: 4187397 - RNA, 18 nt, Yersinia pestis KIM
acauuuagcacuguucac

SEQ ID NO: 4187398 - RNA, 22 nt, Yersinia pestis KIM
acauuuccuuguggauccagca

SEQ ID NO: 4187399 - RNA, 18 nt, Yersinia pestis KIM
acauuucguuuaaagccu

SEQ ID NO: 4187400 - RNA, 18 nt, Yersinia pestis KIM
acauuucuuuuuauguua

SEQ ID NO: 4187401 - RNA, 20 nt, Yersinia pestis KIM
acauuuggggugcaguucaa

SEQ ID NO: 4187402 - RNA, 20 nt, Yersinia pestis KIM
aaucggauggucauccacaa

SEQ ID NO: 4187403 - RNA, 13 nt, Yersinia pestis KIM
aaucuaaaggcca

SEQ ID NO: 4187404 - RNA, 19 nt, Yersinia pestis KIM
aaucuacaaagucugauac

SEQ ID NO: 4187405 - RNA, 13 nt, Yersinia pestis KIM
aaucuacuuuauu

SEQ ID NO: 4187406 - RNA, 14 nt, Yersinia pestis KIM
aaucuauucuuuuu

SEQ ID NO: 4187407 - RNA, 22 nt, Yersinia pestis KIM
aaucuauucuuuuuagcggaac

SEQ ID NO: 4187408 - RNA, 13 nt, Yersinia pestis KIM
aaucucaucggca

SEQ ID NO: 4187409 - RNA, 19 nt, Yersinia pestis KIM
aaucuccuggugguuuggu

SEQ ID NO: 4187410 - RNA, 17 nt, Yersinia pestis KIM
aaucucuccaugauaua

SEQ ID NO: 4187411 - RNA, 19 nt, Yersinia pestis KIM
aaucucuccaugauauauc

SEQ ID NO: 4187412 - RNA, 18 nt, Yersinia pestis KIM
aaucucuccuagaggcuu

SEQ ID NO: 4187413 - RNA, 12 nt, Yersinia pestis KIM
aaucucugccug

SEQ ID NO: 4187414 - RNA, 22 nt, Yersinia pestis KIM
aaucucuggcaacggcacaucc

SEQ ID NO: 4187415 - RNA, 17 nt, Yersinia pestis KIM
aaucucugggugcugcu

SEQ ID NO: 4187416 - RNA, 19 nt, Yersinia pestis KIM
aaucucuugauuaccaaua

SEQ ID NO: 4187417 - RNA, 17 nt, Yersinia pestis KIM
aaucugagcgaacugaa

SEQ ID NO: 4187418 - RNA, 22 nt, Yersinia pestis KIM
aaucugcaaugucauuaauugg

SEQ ID NO: 4187419 - RNA, 18 nt, Yersinia pestis KIM
aaucugcaguagagcggu

SEQ ID NO: 4187420 - RNA, 17 nt, Yersinia pestis KIM
aaucugcaguuuccaac

SEQ ID NO: 4187421 - RNA, 19 nt, Yersinia pestis KIM
aaucugggguuccaggccc

SEQ ID NO: 4187422 - RNA, 19 nt, Yersinia pestis KIM
aaucugguacuccugcuca

SEQ ID NO: 4187423 - RNA, 17 nt, Yersinia pestis KIM
aaucugguaggaacguu

SEQ ID NO: 4187424 - RNA, 16 nt, Yersinia pestis KIM
aaucugucgcugugaa

SEQ ID NO: 4187425 - RNA, 20 nt, Yersinia pestis KIM
aaucuguggucaacagugaa

SEQ ID NO: 4187426 - RNA, 19 nt, Yersinia pestis KIM
aaucuuaaauugaagaguu

SEQ ID NO: 4187427 - RNA, 21 nt, Yersinia pestis KIM
aaucuuccagcggcaaauaga

SEQ ID NO: 4187428 - RNA, 23 nt, Yersinia pestis KIM
aaucuugagcuauuucuugcagu

SEQ ID NO: 4187429 - RNA, 17 nt, Yersinia pestis KIM
aaucuugauccugcaau

SEQ ID NO: 4187430 - RNA, 12 nt, Yersinia pestis KIM
aaucuuguuaau

SEQ ID NO: 4187431 - RNA, 17 nt, Yersinia pestis KIM
aaucuuguuaauuuaaa

SEQ ID NO: 4187432 - RNA, 14 nt, Yersinia pestis KIM
aaucuuugagcacc

SEQ ID NO: 4187433 - RNA, 18 nt, Yersinia pestis KIM
aaucuuugccuauuucag

SEQ ID NO: 4187434 - RNA, 20 nt, Yersinia pestis KIM
aaucuuuuuguaauguuucu

SEQ ID NO: 4187435 - RNA, 22 nt, Yersinia pestis KIM
aaugaaauugggggucagggcg

SEQ ID NO: 4187436 - RNA, 15 nt, Yersinia pestis KIM
aaugaacaaauaucg

SEQ ID NO: 4187437 - RNA, 20 nt, Yersinia pestis KIM
aaugaacauuauuuuucacg

SEQ ID NO: 4187438 - RNA, 22 nt, Yersinia pestis KIM
aaugaacauuauuuuucacgag

SEQ ID NO: 4187439 - RNA, 19 nt, Yersinia pestis KIM
aaugaaggcucauagucgg

SEQ ID NO: 4187440 - RNA, 23 nt, Yersinia pestis KIM
aaugaagguacgcaccauugagc

SEQ ID NO: 4187441 - RNA, 20 nt, Yersinia pestis KIM
aaugaaguuauccuccauuc

SEQ ID NO: 4187442 - RNA, 16 nt, Yersinia pestis KIM
aaugaauaacgccggc

SEQ ID NO: 4187443 - RNA, 15 nt, Yersinia pestis KIM
aaugaauauuauuca

SEQ ID NO: 4187444 - RNA, 16 nt, Yersinia pestis KIM
aaugacaaaucagcgu

SEQ ID NO: 4187445 - RNA, 22 nt, Yersinia pestis KIM
aaugacagacgcgguuaacgac

SEQ ID NO: 4187446 - RNA, 19 nt, Yersinia pestis KIM
aaugacagcaucaauaucg

SEQ ID NO: 4187447 - RNA, 23 nt, Yersinia pestis KIM
aaugacaguauuuguaguggaug

SEQ ID NO: 4187448 - RNA, 15 nt, Yersinia pestis KIM
aaugacauauugugc

SEQ ID NO: 4187449 - RNA, 21 nt, Yersinia pestis KIM
aaugaccacccacguuccccc

SEQ ID NO: 4187450 - RNA, 22 nt, Yersinia pestis KIM
aaugaccacugauuaagaaauu

SEQ ID NO: 4187451 - RNA, 18 nt, Yersinia pestis KIM
aaugaccggaugauaaaa

SEQ ID NO: 4187452 - RNA, 16 nt, Yersinia pestis KIM
aaugacgaucacugcu

SEQ ID NO: 4187453 - RNA, 17 nt, Yersinia pestis KIM
aaugacgcgaucugaaa

SEQ ID NO: 4187454 - RNA, 22 nt, Yersinia pestis KIM
aaugacuaauugugcagcauca

SEQ ID NO: 4187455 - RNA, 16 nt, Yersinia pestis KIM
aaugacuacuaaucaa

SEQ ID NO: 4187456 - RNA, 20 nt, Yersinia pestis KIM
aaugacuaucccuucaauca

SEQ ID NO: 4187457 - RNA, 18 nt, Yersinia pestis KIM
aaugacucgauaacccaa

SEQ ID NO: 4187458 - RNA, 15 nt, Yersinia pestis KIM
aaugacuuaacugaa

SEQ ID NO: 4187459 - RNA, 17 nt, Yersinia pestis KIM
aaugacuuaacugaaag

SEQ ID NO: 4187460 - RNA, 19 nt, Yersinia pestis KIM
aaugagauuaauucaaaaa

SEQ ID NO: 4187461 - RNA, 23 nt, Yersinia pestis KIM
aaugagauugaucaguggcuuaa

SEQ ID NO: 4187462 - RNA, 12 nt, Yersinia pestis KIM
aaugagccuguc

SEQ ID NO: 4187463 - RNA, 13 nt, Yersinia pestis KIM
aaugaggcugagg

SEQ ID NO: 4187464 - RNA, 15 nt, Yersinia pestis KIM
aaugagggaggaacg

SEQ ID NO: 4187465 - RNA, 12 nt, Yersinia pestis KIM
aaugagggauga

SEQ ID NO: 4187466 - RNA, 13 nt, Yersinia pestis KIM
aaugaguaaaaau

SEQ ID NO: 4187467 - RNA, 18 nt, Yersinia pestis KIM
aaugagugauauccgcca

SEQ ID NO: 4187468 - RNA, 16 nt, Yersinia pestis KIM
aaugaguuaaugagaa

SEQ ID NO: 4187469 - RNA, 22 nt, Yersinia pestis KIM
aaugaguuacgucaaaacuauu

SEQ ID NO: 4187470 - RNA, 13 nt, Yersinia pestis KIM
aaugauauucaua

SEQ ID NO: 4187471 - RNA, 17 nt, Yersinia pestis KIM
aaugauauugaucuuua

SEQ ID NO: 4187472 - RNA, 12 nt, Yersinia pestis KIM
aaugaucaucag

SEQ ID NO: 4187473 - RNA, 18 nt, Yersinia pestis KIM
aaugaucgucaauguaac

SEQ ID NO: 4187474 - RNA, 23 nt, Yersinia pestis KIM
aaugaugagguaauacucaucca

SEQ ID NO: 4187475 - RNA, 17 nt, Yersinia pestis KIM
aaugauuaacggauacc

SEQ ID NO: 4187476 - RNA, 15 nt, Yersinia pestis KIM
aaugauuacaucacu

SEQ ID NO: 4187477 - RNA, 20 nt, Yersinia pestis KIM
aaugauuauugaccagauag

SEQ ID NO: 4187478 - RNA, 15 nt, Yersinia pestis KIM
aaugauucauugagu

SEQ ID NO: 4187479 - RNA, 17 nt, Yersinia pestis KIM
aaugauucauugaguua

SEQ ID NO: 4187480 - RNA, 23 nt, Yersinia pestis KIM
aaugauucauugaguuaucuccu

SEQ ID NO: 4187481 - RNA, 21 nt, Yersinia pestis KIM
aaugauuuaauuucuggauuu

SEQ ID NO: 4187482 - RNA, 14 nt, Yersinia pestis KIM
aaugcaauuuuugc

SEQ ID NO: 4187483 - RNA, 22 nt, Yersinia pestis KIM
aaugcacuucaucauucauuuu

SEQ ID NO: 4187484 - RNA, 18 nt, Yersinia pestis KIM
aaugcagacucuuauaua

SEQ ID NO: 4187485 - RNA, 15 nt, Yersinia pestis KIM
aaugcagauaaccgu

SEQ ID NO: 4187486 - RNA, 14 nt, Yersinia pestis KIM
aaugcagcauccca

SEQ ID NO: 4187487 - RNA, 23 nt, Yersinia pestis KIM
aaugcagguucauuacacagcau

SEQ ID NO: 4187488 - RNA, 14 nt, Yersinia pestis KIM
aaugcagguuuugc

SEQ ID NO: 4187489 - RNA, 19 nt, Yersinia pestis KIM
aaugcagguuuugccagau

SEQ ID NO: 4187490 - RNA, 18 nt, Yersinia pestis KIM
aaugcauccaagccauca

SEQ ID NO: 4187491 - RNA, 14 nt, Yersinia pestis KIM
aaugccacccccag

SEQ ID NO: 4187492 - RNA, 14 nt, Yersinia pestis KIM
aaugccagcgaaaa

SEQ ID NO: 4187493 - RNA, 12 nt, Yersinia pestis KIM
aaugccauucaa

SEQ ID NO: 4187494 - RNA, 19 nt, Yersinia pestis KIM
aaugccccgcauaaauacu

SEQ ID NO: 4187495 - RNA, 20 nt, Yersinia pestis KIM
aaugcccuuuugugcaucca

SEQ ID NO: 4187496 - RNA, 14 nt, Yersinia pestis KIM
aaugccgagaacag

SEQ ID NO: 4187497 - RNA, 14 nt, Yersinia pestis KIM
aaugccgauaagcc

SEQ ID NO: 4187498 - RNA, 21 nt, Yersinia pestis KIM
aaugccgcgcccccagccauu

SEQ ID NO: 4187499 - RNA, 20 nt, Yersinia pestis KIM
aaugccgcgcuuggaagggu

SEQ ID NO: 4187500 - RNA, 18 nt, Yersinia pestis KIM
aaugccgcugaucaggaa

SEQ ID NO: 4187501 - RNA, 16 nt, Yersinia pestis KIM
aaugccguacaacaau

SEQ ID NO: 4187502 - RNA, 14 nt, Yersinia pestis KIM
aaugccuaaagcca

SEQ ID NO: 4187503 - RNA, 18 nt, Yersinia pestis KIM
aaugccuuagguaaguca

SEQ ID NO: 4187504 - RNA, 21 nt, Yersinia pestis KIM
aaugcgaccggccgcuugcca

SEQ ID NO: 4187505 - RNA, 15 nt, Yersinia pestis KIM
aaugcgcgcagcaag

SEQ ID NO: 4187506 - RNA, 22 nt, Yersinia pestis KIM
aaugcgcggguaacaacucacc

SEQ ID NO: 4187507 - RNA, 13 nt, Yersinia pestis KIM
aaugcggcggcug

SEQ ID NO: 4187508 - RNA, 12 nt, Yersinia pestis KIM
aaugcuauauuu

SEQ ID NO: 4187509 - RNA, 15 nt, Yersinia pestis KIM
aauggaaaaacguga

SEQ ID NO: 4187510 - RNA, 11 nt, Yersinia pestis KIM
aauggaagaau

SEQ ID NO: 4187511 - RNA, 18 nt, Yersinia pestis KIM
aauggaaguuaaaaaaau

SEQ ID NO: 4187512 - RNA, 21 nt, Yersinia pestis KIM
aauggagggcagcuugacgac

SEQ ID NO: 4187513 - RNA, 16 nt, Yersinia pestis KIM
aauggaucacaucaca

SEQ ID NO: 4187514 - RNA, 17 nt, Yersinia pestis KIM
aauggcaaaacagauau

SEQ ID NO: 4187515 - RNA, 18 nt, Yersinia pestis KIM
aauggcacgccaguuggg

SEQ ID NO: 4187516 - RNA, 13 nt, Yersinia pestis KIM
aauggcauuaaaa

SEQ ID NO: 4187517 - RNA, 17 nt, Yersinia pestis KIM
aauggccgauggaacca

SEQ ID NO: 4187518 - RNA, 20 nt, Yersinia pestis KIM
aauggccgauggaaccacau

SEQ ID NO: 4187519 - RNA, 17 nt, Yersinia pestis KIM
aauucguuucucuaaaa

SEQ ID NO: 4187520 - RNA, 23 nt, Yersinia pestis KIM
aauucguuuuucauuuuucuugc

SEQ ID NO: 4187521 - RNA, 14 nt, Yersinia pestis KIM
aauucucccauuua

SEQ ID NO: 4187522 - RNA, 18 nt, Yersinia pestis KIM
aauucuguguaacugcca

SEQ ID NO: 4187523 - RNA, 18 nt, Yersinia pestis KIM
aauucuuaggauaaccaa

SEQ ID NO: 4187524 - RNA, 17 nt, Yersinia pestis KIM
aauugaagauuuaaaua

SEQ ID NO: 4187525 - RNA, 18 nt, Yersinia pestis KIM
aauugaagcagauaaaga

SEQ ID NO: 4187526 - RNA, 15 nt, Yersinia pestis KIM
aauugacgccacuua

SEQ ID NO: 4187527 - RNA, 23 nt, Yersinia pestis KIM
aauugacgccacuuaucccaacu

SEQ ID NO: 4187528 - RNA, 19 nt, Yersinia pestis KIM
aauugaguaacugauuaau

SEQ ID NO: 4187529 - RNA, 22 nt, Yersinia pestis KIM
aauugauauuauuuauaugaua

SEQ ID NO: 4187530 - RNA, 14 nt, Yersinia pestis KIM
aauugaucagggca

SEQ ID NO: 4187531 - RNA, 14 nt, Yersinia pestis KIM
aauugaucugauau

SEQ ID NO: 4187532 - RNA, 16 nt, Yersinia pestis KIM
aauugaucugauauua

SEQ ID NO: 4187533 - RNA, 15 nt, Yersinia pestis KIM
aauugcaccccacau

SEQ ID NO: 4187534 - RNA, 17 nt, Yersinia pestis KIM
aauugccccacauuacu

SEQ ID NO: 4187535 - RNA, 13 nt, Yersinia pestis KIM
aauugccuuugcg

SEQ ID NO: 4187536 - RNA, 19 nt, Yersinia pestis KIM
aauugcuacguaaugauga

SEQ ID NO: 4187537 - RNA, 19 nt, Yersinia pestis KIM
aauugcugcuugcgcgccu

SEQ ID NO: 4187538 - RNA, 20 nt, Yersinia pestis KIM
aauugcuggcuaucaucccu

SEQ ID NO: 4187539 - RNA, 22 nt, Yersinia pestis KIM
aauugcuuaaaaaaagcaugug

SEQ ID NO: 4187540 - RNA, 17 nt, Yersinia pestis KIM
aauugcuucaauaccgc

SEQ ID NO: 4187541 - RNA, 21 nt, Yersinia pestis KIM
aauuggaaugaaauagucaca

SEQ ID NO: 4187542 - RNA, 18 nt, Yersinia pestis KIM
aauuggcaaguuaaucau

SEQ ID NO: 4187543 - RNA, 18 nt, Yersinia pestis KIM
aauugggggucagggcgg

SEQ ID NO: 4187544 - RNA, 19 nt, Yersinia pestis KIM
aauuggugcuuuauguauu

SEQ ID NO: 4187545 - RNA, 22 nt, Yersinia pestis KIM
aauugguuuauaacaaggaaau

SEQ ID NO: 4187546 - RNA, 20 nt, Yersinia pestis KIM
aauugguuuuaauaaccauu

SEQ ID NO: 4187547 - RNA, 22 nt, Yersinia pestis KIM
aauugugccccaagaagagaua

SEQ ID NO: 4187548 - RNA, 14 nt, Yersinia pestis KIM
aauuguucaucgcu

SEQ ID NO: 4187549 - RNA, 15 nt, Yersinia pestis KIM
aauuguuucuucccc

SEQ ID NO: 4187550 - RNA, 23 nt, Yersinia pestis KIM
aauuguuugcuaucaauugcugg

SEQ ID NO: 4187551 - RNA, 19 nt, Yersinia pestis KIM
aauuuaaacaaccaaaaau

SEQ ID NO: 4187552 - RNA, 16 nt, Yersinia pestis KIM
aauuuaauuaguuuau

SEQ ID NO: 4187553 - RNA, 16 nt, Yersinia pestis KIM
aauuuacgagagugua

SEQ ID NO: 4187554 - RNA, 14 nt, Yersinia pestis KIM
aauuuacugacggu

SEQ ID NO: 4187555 - RNA, 20 nt, Yersinia pestis KIM
aauuuagacagcuuaaaauc

SEQ ID NO: 4187556 - RNA, 14 nt, Yersinia pestis KIM
aauuuagcaaagcg

SEQ ID NO: 4187557 - RNA, 22 nt, Yersinia pestis KIM
aauuuaggcugauggacuuacc

SEQ ID NO: 4187558 - RNA, 14 nt, Yersinia pestis KIM
aauuuaucaguagu

SEQ ID NO: 4187559 - RNA, 13 nt, Yersinia pestis KIM
aauuuauccaacu

SEQ ID NO: 4187560 - RNA, 15 nt, Yersinia pestis KIM
aauuuaucugcuaau

SEQ ID NO: 4187561 - RNA, 19 nt, Yersinia pestis KIM
aauuuaucugcuaauuaaa

SEQ ID NO: 4187562 - RNA, 20 nt, Yersinia pestis KIM
aauuuaucugcuaauuaaac

SEQ ID NO: 4187563 - RNA, 23 nt, Yersinia pestis KIM
aauuuaucugcuaauuaaaccug

SEQ ID NO: 4187564 - RNA, 18 nt, Yersinia pestis KIM
aauuuaucuuuucuucuu

SEQ ID NO: 4187565 - RNA, 13 nt, Yersinia pestis KIM
aauuuauuauuua

SEQ ID NO: 4187566 - RNA, 13 nt, Yersinia pestis KIM
aauuucagauaaa

SEQ ID NO: 4187567 - RNA, 19 nt, Yersinia pestis KIM
aauuucagcagcacguuca

SEQ ID NO: 4187568 - RNA, 20 nt, Yersinia pestis KIM
aauuucaggucgauuacaua

SEQ ID NO: 4187569 - RNA, 11 nt, Yersinia pestis KIM
aauuucaguaa

SEQ ID NO: 4187570 - RNA, 23 nt, Yersinia pestis KIM
aauuucaugcgaauacuuugcua

SEQ ID NO: 4187571 - RNA, 20 nt, Yersinia pestis KIM
aauuucauuuuaaaaucgua

SEQ ID NO: 4187572 - RNA, 16 nt, Yersinia pestis KIM
aauuucgaaaacucaa

SEQ ID NO: 4187573 - RNA, 23 nt, Yersinia pestis KIM
aauuucucggccaacaucuucca

SEQ ID NO: 4187574 - RNA, 23 nt, Yersinia pestis KIM
aauuucucucaauauauucucuu

SEQ ID NO: 4187575 - RNA, 23 nt, Yersinia pestis KIM
aauuucuugaggugcuugaacaa

SEQ ID NO: 4187576 - RNA, 15 nt, Yersinia pestis KIM
aauuugacauuuccu

SEQ ID NO: 4187577 - RNA, 19 nt, Yersinia pestis KIM
aauuugauacagugauaaa

SEQ ID NO: 4187578 - RNA, 13 nt, Yersinia pestis KIM
aauuugcacugca

SEQ ID NO: 4187579 - RNA, 16 nt, Yersinia pestis KIM
aauuugcacugcaggg

SEQ ID NO: 4187580 - RNA, 14 nt, Yersinia pestis KIM
aauuugccauacca

SEQ ID NO: 4187581 - RNA, 19 nt, Yersinia pestis KIM
aauuugcuccuggcaugca

SEQ ID NO: 4187582 - RNA, 14 nt, Yersinia pestis KIM
aauuugcugcucga

SEQ ID NO: 4187583 - RNA, 15 nt, Yersinia pestis KIM
aauuugcuuuaaaua

SEQ ID NO: 4187584 - RNA, 21 nt, Yersinia pestis KIM
aauuugguucacggaaaguag

SEQ ID NO: 4187585 - RNA, 21 nt, Yersinia pestis KIM
aauuugucguuuacuggcugc

SEQ ID NO: 4187586 - RNA, 19 nt, Yersinia pestis KIM
aauuuuaaaggcaacgaag

SEQ ID NO: 4187587 - RNA, 14 nt, Yersinia pestis KIM
aauuuuagucaaaa

SEQ ID NO: 4187588 - RNA, 19 nt, Yersinia pestis KIM
aauuuuagucaaaacaaua

SEQ ID NO: 4187589 - RNA, 22 nt, Yersinia pestis KIM
aauuuuauucgcguuucauuuu

SEQ ID NO: 4187590 - RNA, 20 nt, Yersinia pestis KIM
aauuuuauuguuuucguuua

SEQ ID NO: 4187591 - RNA, 12 nt, Yersinia pestis KIM
aauuuucuaagc

SEQ ID NO: 4187592 - RNA, 14 nt, Yersinia pestis KIM
aauuuucuaagcug

SEQ ID NO: 4187593 - RNA, 16 nt, Yersinia pestis KIM
aauuuugguacaggug

SEQ ID NO: 4187594 - RNA, 21 nt, Yersinia pestis KIM
aauuuuguacaacuucuucau

SEQ ID NO: 4187595 - RNA, 14 nt, Yersinia pestis KIM
aauuuuuagccgca

SEQ ID NO: 4187596 - RNA, 15 nt, Yersinia pestis KIM
aauuuuuagccgcaa

SEQ ID NO: 4187597 - RNA, 12 nt, Yersinia pestis KIM
aauuuuucccuu

SEQ ID NO: 4187598 - RNA, 11 nt, Yersinia pestis KIM
acaaaaacagu

SEQ ID NO: 4187599 - RNA, 18 nt, Yersinia pestis KIM
acaaaaauaaacgggcuu

SEQ ID NO: 4187600 - RNA, 13 nt, Yersinia pestis KIM
acaaaaccaaccc

SEQ ID NO: 4187601 - RNA, 15 nt, Yersinia pestis KIM
acaaaaucccccacc

SEQ ID NO: 4187602 - RNA, 18 nt, Yersinia pestis KIM
acaaaauggccuugccca

SEQ ID NO: 4187603 - RNA, 12 nt, Yersinia pestis KIM
acaaaaugugaa

SEQ ID NO: 4187604 - RNA, 13 nt, Yersinia pestis KIM
acaaaaugugaaa

SEQ ID NO: 4187605 - RNA, 22 nt, Yersinia pestis KIM
acaaaaugugaaaagcagucga

SEQ ID NO: 4187606 - RNA, 13 nt, Yersinia pestis KIM
acaaacagauaca

SEQ ID NO: 4187607 - RNA, 16 nt, Yersinia pestis KIM
acaaacauggcggcag

SEQ ID NO: 4187608 - RNA, 20 nt, Yersinia pestis KIM
acaaagauacagcccaagag

SEQ ID NO: 4187609 - RNA, 21 nt, Yersinia pestis KIM
acaaagauacagcccaagaga

SEQ ID NO: 4187610 - RNA, 24 nt, Yersinia pestis KIM
acaaagauacagcccaagagaaau

SEQ ID NO: 4187611 - RNA, 17 nt, Yersinia pestis KIM
acaaagccgcuuaauuu

SEQ ID NO: 4187612 - RNA, 13 nt, Yersinia pestis KIM
acaaaggcaaaau

SEQ ID NO: 4187613 - RNA, 12 nt, Yersinia pestis KIM
acaaaggucagc

SEQ ID NO: 4187614 - RNA, 16 nt, Yersinia pestis KIM
acaaaguaccuauggc

SEQ ID NO: 4187615 - RNA, 14 nt, Yersinia pestis KIM
acaaagugagggau

SEQ ID NO: 4187616 - RNA, 23 nt, Yersinia pestis KIM
acaaagugcccgcgacgagagaa

SEQ ID NO: 4187617 - RNA, 18 nt, Yersinia pestis KIM
acaaaguuaaaugaagga

SEQ ID NO: 4187618 - RNA, 14 nt, Yersinia pestis KIM
acaaauaaaaccaa

SEQ ID NO: 4187619 - RNA, 16 nt, Yersinia pestis KIM
acaaauaaaaccaaga

SEQ ID NO: 4187620 - RNA, 16 nt, Yersinia pestis KIM
acaaauagauuuaacu

SEQ ID NO: 4187621 - RNA, 14 nt, Yersinia pestis KIM
acaaauagcgcugc

SEQ ID NO: 4187622 - RNA, 13 nt, Yersinia pestis KIM
acaaauaucggcc

SEQ ID NO: 4187623 - RNA, 21 nt, Yersinia pestis KIM
acaaaucuuaaauugaagagu

SEQ ID NO: 4187624 - RNA, 22 nt, Yersinia pestis KIM
acaaaucuuaaauugaagaguu

SEQ ID NO: 4187625 - RNA, 17 nt, Yersinia pestis KIM
acaaaugagagcgcagc

SEQ ID NO: 4187626 - RNA, 17 nt, Yersinia pestis KIM
acaaauucaccagcaau

SEQ ID NO: 4187627 - RNA, 15 nt, Yersinia pestis KIM
acaaauuugacauuu

SEQ ID NO: 4187628 - RNA, 15 nt, Yersinia pestis KIM
acaacaaaggcgcca

SEQ ID NO: 4187629 - RNA, 20 nt, Yersinia pestis KIM
acaacaagaucccaagcagg

SEQ ID NO: 4187630 - RNA, 12 nt, Yersinia pestis KIM
acaacaauaaua

SEQ ID NO: 4187631 - RNA, 16 nt, Yersinia pestis KIM
acaacacgcuauccgc

SEQ ID NO: 4187632 - RNA, 23 nt, Yersinia pestis KIM
acaacagugcaacauuaaaaaua

SEQ ID NO: 4187633 - RNA, 18 nt, Yersinia pestis KIM
acaacaucaaaugaaggg

SEQ ID NO: 4187634 - RNA, 14 nt, Yersinia pestis KIM
acaacaucauauau

SEQ ID NO: 4187635 - RNA, 12 nt, Yersinia pestis KIM
acaacaucaucg

SEQ ID NO: 4187636 - RNA, 14 nt, Yersinia pestis KIM
acaaccaacaaaca

SEQ ID NO: 4187637 - RNA, 16 nt, Yersinia pestis KIM
acaaccaacaaacaau

SEQ ID NO: 4187638 - RNA, 19 nt, Yersinia pestis KIM
acaaccaacaaacaauccu

SEQ ID NO: 4187639 - RNA, 12 nt, Yersinia pestis KIM
acaaccaauaca

SEQ ID NO: 4187640 - RNA, 17 nt, Yersinia pestis KIM
acaaccaauacacagca

SEQ ID NO: 4187641 - RNA, 22 nt, Yersinia pestis KIM
acaaccauuguggcuaaaccca

SEQ ID NO: 4187642 - RNA, 23 nt, Yersinia pestis KIM
acaaccauuguggcuaaacccaa

SEQ ID NO: 4187643 - RNA, 14 nt, Yersinia pestis KIM
acaacccaauaaua

SEQ ID NO: 4187644 - RNA, 13 nt, Yersinia pestis KIM
acaacccauuucc

SEQ ID NO: 4187645 - RNA, 23 nt, Yersinia pestis KIM
acaacccccgaacacucgaucuu

SEQ ID NO: 4187646 - RNA, 18 nt, Yersinia pestis KIM
acaacccgaauuaauaaa

SEQ ID NO: 4187647 - RNA, 22 nt, Yersinia pestis KIM
acaacccgaauuaauaaaaccu

SEQ ID NO: 4187648 - RNA, 16 nt, Yersinia pestis KIM
acaacccgauccagaa

SEQ ID NO: 4187649 - RNA, 15 nt, Yersinia pestis KIM
acaacccgcuacuga

SEQ ID NO: 4187650 - RNA, 19 nt, Yersinia pestis KIM
acaaccuaaaaaaaacaac

SEQ ID NO: 4187651 - RNA, 17 nt, Yersinia pestis KIM
acaaccuguagcucaua

SEQ ID NO: 4187652 - RNA, 14 nt, Yersinia pestis KIM
acaacgagggcuca

SEQ ID NO: 4187653 - RNA, 12 nt, Yersinia pestis KIM
acaacgcacuga

SEQ ID NO: 4187654 - RNA, 15 nt, Yersinia pestis KIM
acaacgcuccagguu

SEQ ID NO: 4187655 - RNA, 15 nt, Yersinia pestis KIM
acaacgcucuaacgu

SEQ ID NO: 4187656 - RNA, 18 nt, Yersinia pestis KIM
acaacgcugaaaaaucuu

SEQ ID NO: 4187657 - RNA, 21 nt, Yersinia pestis KIM
acaacggguuuucuguuuuug

SEQ ID NO: 4187658 - RNA, 16 nt, Yersinia pestis KIM
acaacguccagaacaa

SEQ ID NO: 4187659 - RNA, 19 nt, Yersinia pestis KIM
acaacguccagaacaauac

SEQ ID NO: 4187660 - RNA, 13 nt, Yersinia pestis KIM
acaacucaccgcc

SEQ ID NO: 4187661 - RNA, 20 nt, Yersinia pestis KIM
acaacugccaaauuuggccu

SEQ ID NO: 4187662 - RNA, 18 nt, Yersinia pestis KIM
acaacugguuaucacugu

SEQ ID NO: 4187663 - RNA, 15 nt, Yersinia pestis KIM
acaacuuccacacaa

SEQ ID NO: 4187664 - RNA, 13 nt, Yersinia pestis KIM
acaacuuucccag

SEQ ID NO: 4187665 - RNA, 15 nt, Yersinia pestis KIM
acaacuuucccaguc

SEQ ID NO: 4187666 - RNA, 18 nt, Yersinia pestis KIM
acaagacaauauguuuag

SEQ ID NO: 4187667 - RNA, 14 nt, Yersinia pestis KIM
acaagauaguccgc

SEQ ID NO: 4187668 - RNA, 14 nt, Yersinia pestis KIM
acaagaucccaagc

SEQ ID NO: 4187669 - RNA, 12 nt, Yersinia pestis KIM
acaagccaaaca

SEQ ID NO: 4187670 - RNA, 15 nt, Yersinia pestis KIM
acaagccauuucacc

SEQ ID NO: 4187671 - RNA, 14 nt, Yersinia pestis KIM
acaagcgaccauca

SEQ ID NO: 4187672 - RNA, 17 nt, Yersinia pestis KIM
acaagcgaccaucauga

SEQ ID NO: 4187673 - RNA, 20 nt, Yersinia pestis KIM
acaagcgaccaucaugaaua

SEQ ID NO: 4187674 - RNA, 20 nt, Yersinia pestis KIM
acaagcgcaguagcggcuca

SEQ ID NO: 4187675 - RNA, 22 nt, Yersinia pestis KIM
acaagcuacagcgucagauauu

SEQ ID NO: 4187676 - RNA, 20 nt, Yersinia pestis KIM
acaagggguuucagacuccu

SEQ ID NO: 4187677 - RNA, 20 nt, Yersinia pestis KIM
acaaguuggugcaguugguc

SEQ ID NO: 4187678 - RNA, 15 nt, Yersinia pestis KIM
acaaguugucuguaa

SEQ ID NO: 4187679 - RNA, 21 nt, Yersinia pestis KIM
acaaguugucuguaauaauaa

SEQ ID NO: 4187680 - RNA, 22 nt, Yersinia pestis KIM
acaaguugucuguaauaauaau

SEQ ID NO: 4187681 - RNA, 15 nt, Yersinia pestis KIM
acaauaaaucgccac

SEQ ID NO: 4187682 - RNA, 18 nt, Yersinia pestis KIM
acaauaauaagccgcagg

SEQ ID NO: 4187683 - RNA, 14 nt, Yersinia pestis KIM
acaauaauuaggaa

SEQ ID NO: 4187684 - RNA, 13 nt, Yersinia pestis KIM
acaauacauagaa

SEQ ID NO: 4187685 - RNA, 17 nt, Yersinia pestis KIM
acaauaccauuuugccg

SEQ ID NO: 4187686 - RNA, 21 nt, Yersinia pestis KIM
acaauaccgccacacaauaca

SEQ ID NO: 4187687 - RNA, 16 nt, Yersinia pestis KIM
acaauauaauaaugcu

SEQ ID NO: 4187688 - RNA, 20 nt, Yersinia pestis KIM
acaauauccguuuacgacaa

SEQ ID NO: 4187689 - RNA, 15 nt, Yersinia pestis KIM
acaauaucuucccug

SEQ ID NO: 4187690 - RNA, 23 nt, Yersinia pestis KIM
acaauauucauuuugcuggaaaa

SEQ ID NO: 4187691 - RNA, 14 nt, Yersinia pestis KIM
acaauccgaacaaa

SEQ ID NO: 4187692 - RNA, 12 nt, Yersinia pestis KIM
acaaucgauucc

SEQ ID NO: 4187693 - RNA, 16 nt, Yersinia pestis KIM
acaaucgucuucgguc

SEQ ID NO: 4187694 - RNA, 22 nt, Yersinia pestis KIM
acaaugaacuguguuuauacca

SEQ ID NO: 4187695 - RNA, 13 nt, Yersinia pestis KIM
acaaugacuuaac

SEQ ID NO: 4187696 - RNA, 16 nt, Yersinia pestis KIM
acaaugacuuaacuga

SEQ ID NO: 4187697 - RNA, 14 nt, Yersinia pestis KIM
acaaugcacagugc

SEQ ID NO: 4187698 - RNA, 16 nt, Yersinia pestis KIM
acaaugcacagugccg

SEQ ID NO: 4187699 - RNA, 16 nt, Yersinia pestis KIM
acaauggccggacuca

SEQ ID NO: 4187700 - RNA, 22 nt, Yersinia pestis KIM
acaaugucacgcuuuaaaacug

SEQ ID NO: 4187701 - RNA, 22 nt, Yersinia pestis KIM
acaaugugccgcgcaaccaucc

SEQ ID NO: 4187702 - RNA, 19 nt, Yersinia pestis KIM
acaauuaauaugccgacaa

SEQ ID NO: 4187703 - RNA, 13 nt, Yersinia pestis KIM
acaauuacacacc

SEQ ID NO: 4187704 - RNA, 14 nt, Yersinia pestis KIM
acaauuauagccaa

SEQ ID NO: 4187705 - RNA, 18 nt, Yersinia pestis KIM
acaauucuugaaauuaua

SEQ ID NO: 4187706 - RNA, 15 nt, Yersinia pestis KIM
acaauugcuccaguu

SEQ ID NO: 4187707 - RNA, 15 nt, Yersinia pestis KIM
acaauuuccauauca

SEQ ID NO: 4187708 - RNA, 18 nt, Yersinia pestis KIM
acaauuucgaaaacucaa

SEQ ID NO: 4187709 - RNA, 10 nt, Yersinia pestis KIM
acaauuuuau

SEQ ID NO: 4187710 - RNA, 21 nt, Yersinia pestis KIM
acaauuuuauuguuuucguuu

SEQ ID NO: 4187711 - RNA, 21 nt, Yersinia pestis KIM
acaauuuugacgaaguuuuag

SEQ ID NO: 4187712 - RNA, 13 nt, Yersinia pestis KIM
acacaaaaaaggg

SEQ ID NO: 4187713 - RNA, 17 nt, Yersinia pestis KIM
acacaaaaaagggcaag

SEQ ID NO: 4187714 - RNA, 14 nt, Yersinia pestis KIM
acacaaaagacgcc

SEQ ID NO: 4187715 - RNA, 22 nt, Yersinia pestis KIM
acacaagggauuuaaaaucccu

SEQ ID NO: 4187716 - RNA, 23 nt, Yersinia pestis KIM
acacaccugcaacguuaaagaug

SEQ ID NO: 4187717 - RNA, 16 nt, Yersinia pestis KIM
acacagaaucaccaac

SEQ ID NO: 4187718 - RNA, 15 nt, Yersinia pestis KIM
acacagcacggcaac

SEQ ID NO: 4187719 - RNA, 14 nt, Yersinia pestis KIM
acacagccagccuu

SEQ ID NO: 4187720 - RNA, 23 nt, Yersinia pestis KIM
acacagcccugccuggcaggaag

SEQ ID NO: 4187721 - RNA, 15 nt, Yersinia pestis KIM
acacagguucuccag

SEQ ID NO: 4187722 - RNA, 16 nt, Yersinia pestis KIM
acacaguauucugcuu

SEQ ID NO: 4187723 - RNA, 19 nt, Yersinia pestis KIM
acacagucugucguacuuu

SEQ ID NO: 4187724 - RNA, 13 nt, Yersinia pestis KIM
acacauaaccauc

SEQ ID NO: 4187725 - RNA, 18 nt, Yersinia pestis KIM
acacauaaccaucaaaca

SEQ ID NO: 4187726 - RNA, 21 nt, Yersinia pestis KIM
acacauacuucgaugauuauu

SEQ ID NO: 4187727 - RNA, 17 nt, Yersinia pestis KIM
acacaucaaaauuaggu

SEQ ID NO: 4187728 - RNA, 19 nt, Yersinia pestis KIM
acacaucuuccaguacaga

SEQ ID NO: 4187729 - RNA, 18 nt, Yersinia pestis KIM
acacauuccaguaaaaaa

SEQ ID NO: 4187730 - RNA, 20 nt, Yersinia pestis KIM
acacauuccaguaaaaaaau

SEQ ID NO: 4187731 - RNA, 22 nt, Yersinia pestis KIM
acacauuccaguaaaaaaauag

SEQ ID NO: 4187732 - RNA, 19 nt, Yersinia pestis KIM
acaccaacacugaauaacu

SEQ ID NO: 4187733 - RNA, 21 nt, Yersinia pestis KIM
acaccaagaacccuuuaucuu

SEQ ID NO: 4187734 - RNA, 15 nt, Yersinia pestis KIM
acaccacacuggaug

SEQ ID NO: 4187735 - RNA, 14 nt, Yersinia pestis KIM
acaccaccaucacu

SEQ ID NO: 4187736 - RNA, 13 nt, Yersinia pestis KIM
acaccagcauccu

SEQ ID NO: 4187737 - RNA, 14 nt, Yersinia pestis KIM
acaccauaaucgca

SEQ ID NO: 4187738 - RNA, 14 nt, Yersinia pestis KIM
acaccaucaacaug

SEQ ID NO: 4187739 - RNA, 18 nt, Yersinia pestis KIM
acaccauugauaauaaua

SEQ ID NO: 4187740 - RNA, 12 nt, Yersinia pestis KIM
acaccauuucca

SEQ ID NO: 4187741 - RNA, 17 nt, Yersinia pestis KIM
acaccauuuccaggcua

SEQ ID NO: 4187742 - RNA, 13 nt, Yersinia pestis KIM
acaccauuuucaa

SEQ ID NO: 4187743 - RNA, 16 nt, Yersinia pestis KIM
acacccaagaauauaa

SEQ ID NO: 4187744 - RNA, 11 nt, Yersinia pestis KIM
acacccgcuug

SEQ ID NO: 4187745 - RNA, 19 nt, Yersinia pestis KIM
acacccucaacucaaaaca

SEQ ID NO: 4187746 - RNA, 21 nt, Yersinia pestis KIM
acacccucaacucaaaacaau

SEQ ID NO: 4187747 - RNA, 17 nt, Yersinia pestis KIM
acacccuccuauuaaua

SEQ ID NO: 4187748 - RNA, 20 nt, Yersinia pestis KIM
acacccucucuuuccagcaa

SEQ ID NO: 4187749 - RNA, 21 nt, Yersinia pestis KIM
acacccucucuuuccagcaaa

SEQ ID NO: 4187750 - RNA, 20 nt, Yersinia pestis KIM
acacccuguguauuuaacca

SEQ ID NO: 4187751 - RNA, 21 nt, Yersinia pestis KIM
acacccuguguauuuaaccaa

SEQ ID NO: 4187752 - RNA, 16 nt, Yersinia pestis KIM
acaccggcaauaugaa

SEQ ID NO: 4187753 - RNA, 21 nt, Yersinia pestis KIM
acaccggccaaaaucacccca

SEQ ID NO: 4187754 - RNA, 20 nt, Yersinia pestis KIM
acaccggggauccauaggau

SEQ ID NO: 4187755 - RNA, 13 nt, Yersinia pestis KIM
acaccggucgccg

SEQ ID NO: 4187756 - RNA, 22 nt, Yersinia pestis KIM
acaccgugguuugcucuucccu

SEQ ID NO: 4187757 - RNA, 22 nt, Yersinia pestis KIM
acaccucaacgugauaugccug

SEQ ID NO: 4187758 - RNA, 17 nt, Yersinia pestis KIM
acaccuccaaaugucag

SEQ ID NO: 4187759 - RNA, 24 nt, Yersinia pestis KIM
acaccugcaacguuaaagaugaag

SEQ ID NO: 4187760 - RNA, 19 nt, Yersinia pestis KIM
acaccugggcgcucuuuac

SEQ ID NO: 4187761 - RNA, 17 nt, Yersinia pestis KIM
acaccuucaaucauuga

SEQ ID NO: 4187762 - RNA, 15 nt, Yersinia pestis KIM
acaccuugcagcaca

SEQ ID NO: 4187763 - RNA, 15 nt, Yersinia pestis KIM
acacgaaaagcagca

SEQ ID NO: 4187764 - RNA, 21 nt, Yersinia pestis KIM
acacgauuccucuguaguuca

SEQ ID NO: 4187765 - RNA, 14 nt, Yersinia pestis KIM
acacgcccaggcca

SEQ ID NO: 4187766 - RNA, 22 nt, Yersinia pestis KIM
acacgccuucauguugcaacau

SEQ ID NO: 4187767 - RNA, 14 nt, Yersinia pestis KIM
acacgguaggcuuc

SEQ ID NO: 4187768 - RNA, 14 nt, Yersinia pestis KIM
acacggugaauaaa

SEQ ID NO: 4187769 - RNA, 16 nt, Yersinia pestis KIM
acacguaaaacaggga

SEQ ID NO: 4187770 - RNA, 19 nt, Yersinia pestis KIM
acacgucuaauuccgccag

SEQ ID NO: 4187771 - RNA, 19 nt, Yersinia pestis KIM
acacguggguauccagugu

SEQ ID NO: 4187772 - RNA, 14 nt, Yersinia pestis KIM
acacguuaaacccu

SEQ ID NO: 4187773 - RNA, 20 nt, Yersinia pestis KIM
acacuaauggcacgccaguu

SEQ ID NO: 4187774 - RNA, 21 nt, Yersinia pestis KIM
acacuaccuucaucugcacug

SEQ ID NO: 4187775 - RNA, 19 nt, Yersinia pestis KIM
acacucagaugaaaaacug

SEQ ID NO: 4187776 - RNA, 21 nt, Yersinia pestis KIM
acacugauuuauaaauaauua

SEQ ID NO: 4187777 - RNA, 19 nt, Yersinia pestis KIM
acacugcaucucugcaucu

SEQ ID NO: 4187778 - RNA, 15 nt, Yersinia pestis KIM
acacugccugaugcu

SEQ ID NO: 4187779 - RNA, 20 nt, Yersinia pestis KIM
acacuggaugcgacgcagaa

SEQ ID NO: 4187780 - RNA, 22 nt, Yersinia pestis KIM
acacuggcggacaucuuacuga

SEQ ID NO: 4187781 - RNA, 13 nt, Yersinia pestis KIM
acacugguugaaa

SEQ ID NO: 4187782 - RNA, 21 nt, Yersinia pestis KIM
acacuuaauugguuuauaaca

SEQ ID NO: 4187783 - RNA, 13 nt, Yersinia pestis KIM
acacuuaccuaua

SEQ ID NO: 4187784 - RNA, 23 nt, Yersinia pestis KIM
acacuuaccuauaaacauuuacu

SEQ ID NO: 4187785 - RNA, 22 nt, Yersinia pestis KIM
acacuucgccgggucaggaaga

SEQ ID NO: 4187786 - RNA, 14 nt, Yersinia pestis KIM
acacuuuugcuggu

SEQ ID NO: 4187787 - RNA, 23 nt, Yersinia pestis KIM
acacuuuugcuggugucacaauc

SEQ ID NO: 4187788 - RNA, 13 nt, Yersinia pestis KIM
acagaaaaauaac

SEQ ID NO: 4187789 - RNA, 17 nt, Yersinia pestis KIM
acagaaaaauaacaucc

SEQ ID NO: 4187790 - RNA, 22 nt, Yersinia pestis KIM
acagaacccccgcgaacagcag

SEQ ID NO: 4187791 - RNA, 13 nt, Yersinia pestis KIM
acagaacgcaauc

SEQ ID NO: 4187792 - RNA, 16 nt, Yersinia pestis KIM
acagaagcguaaagca

SEQ ID NO: 4187793 - RNA, 14 nt, Yersinia pestis KIM
acagacacagcaac

SEQ ID NO: 4187794 - RNA, 16 nt, Yersinia pestis KIM
acagaccccagaagau

SEQ ID NO: 4187795 - RNA, 23 nt, Yersinia pestis KIM
acagacguuuaaauaagcuauca

SEQ ID NO: 4187796 - RNA, 14 nt, Yersinia pestis KIM
acagacuuucuuua

SEQ ID NO: 4187797 - RNA, 15 nt, Yersinia pestis KIM
acagagagauaaucu

SEQ ID NO: 4187798 - RNA, 14 nt, Yersinia pestis KIM
acagagcacaacgg

SEQ ID NO: 4187799 - RNA, 15 nt, Yersinia pestis KIM
acagagcagaaagca

SEQ ID NO: 4187800 - RNA, 21 nt, Yersinia pestis KIM
acagagcagaaagcagcagcu

SEQ ID NO: 4187801 - RNA, 19 nt, Yersinia pestis KIM
acagagguagacguaucau

SEQ ID NO: 4187802 - RNA, 20 nt, Yersinia pestis KIM
acagauaaaaaauaauuaaa

SEQ ID NO: 4187803 - RNA, 23 nt, Yersinia pestis KIM
acagauaaagcuugaucacaauc

SEQ ID NO: 4187804 - RNA, 23 nt, Yersinia pestis KIM
acagauauauccaggcacugcca

SEQ ID NO: 4187805 - RNA, 21 nt, Yersinia pestis KIM
acagaucacccgcaaaacuga

SEQ ID NO: 4187806 - RNA, 19 nt, Yersinia pestis KIM
acagaucagcgugacguua

SEQ ID NO: 4187807 - RNA, 14 nt, Yersinia pestis KIM
acagauugcaggaa

SEQ ID NO: 4187808 - RNA, 13 nt, Yersinia pestis KIM
acagcaacaccau

SEQ ID NO: 4187809 - RNA, 13 nt, Yersinia pestis KIM
acagcaaggcaga

SEQ ID NO: 4187810 - RNA, 13 nt, Yersinia pestis KIM
acagcaaggcagc

SEQ ID NO: 4187811 - RNA, 22 nt, Yersinia pestis KIM
acagcaauauccgugauuaacc

SEQ ID NO: 4187812 - RNA, 12 nt, Yersinia pestis KIM
acagcaccaccg

SEQ ID NO: 4187813 - RNA, 19 nt, Yersinia pestis KIM
acagcaccaccgauggcac

SEQ ID NO: 4187814 - RNA, 17 nt, Yersinia pestis KIM
acagcaccauuaucuuc

SEQ ID NO: 4187815 - RNA, 16 nt, Yersinia pestis KIM
acagcacggcaacagg

SEQ ID NO: 4187816 - RNA, 15 nt, Yersinia pestis KIM
acagcacuaucccca

SEQ ID NO: 4187817 - RNA, 14 nt, Yersinia pestis KIM
acagcacucaguac

SEQ ID NO: 4187818 - RNA, 15 nt, Yersinia pestis KIM
acagcacucaguaca

SEQ ID NO: 4187819 - RNA, 13 nt, Yersinia pestis KIM
acagcagaacaaa

SEQ ID NO: 4187820 - RNA, 18 nt, Yersinia pestis KIM
acagcagaacaaaacaag

SEQ ID NO: 4187821 - RNA, 22 nt, Yersinia pestis KIM
acagcaggccgcgaauauggca

SEQ ID NO: 4187822 - RNA, 15 nt, Yersinia pestis KIM
acagcagguggcuga

SEQ ID NO: 4187823 - RNA, 17 nt, Yersinia pestis KIM
acagcagugaucucaac

SEQ ID NO: 4187824 - RNA, 15 nt, Yersinia pestis KIM
acagcauauaaaaaa

SEQ ID NO: 4187825 - RNA, 15 nt, Yersinia pestis KIM
acagcaucacugucu

SEQ ID NO: 4187826 - RNA, 16 nt, Yersinia pestis KIM
acagcaucacugucua

SEQ ID NO: 4187827 - RNA, 23 nt, Yersinia pestis KIM
acagcaucugcaauggcuggcaa

SEQ ID NO: 4187828 - RNA, 23 nt, Yersinia pestis KIM
acagcauuaccaaggaaaccacc

SEQ ID NO: 4187829 - RNA, 17 nt, Yersinia pestis KIM
acagcauuuaugcugcc

SEQ ID NO: 4187830 - RNA, 21 nt, Yersinia pestis KIM
acagcauuuugcggaucacau

SEQ ID NO: 4187831 - RNA, 13 nt, Yersinia pestis KIM
acagccaccagcc

SEQ ID NO: 4187832 - RNA, 17 nt, Yersinia pestis KIM
acagccaucacccgaua

SEQ ID NO: 4187833 - RNA, 12 nt, Yersinia pestis KIM
acagcccaagag

SEQ ID NO: 4187834 - RNA, 21 nt, Yersinia pestis KIM
acagccgcccccuuucuuauc

SEQ ID NO: 4187835 - RNA, 15 nt, Yersinia pestis KIM
acagccguguagcau

SEQ ID NO: 4187836 - RNA, 20 nt, Yersinia pestis KIM
acagccuauggcgguuccaa

SEQ ID NO: 4187837 - RNA, 14 nt, Yersinia pestis KIM
acagccugugccca

SEQ ID NO: 4187838 - RNA, 20 nt, Yersinia pestis KIM
acagcgagaaucuugauuug

SEQ ID NO: 4187839 - RNA, 19 nt, Yersinia pestis KIM
acagcgagauaaacugugc

SEQ ID NO: 4187840 - RNA, 20 nt, Yersinia pestis KIM
acagcgagauaaacugugcc

SEQ ID NO: 4187841 - RNA, 20 nt, Yersinia pestis KIM
acagcgccucaguaucuuuc

SEQ ID NO: 4187842 - RNA, 21 nt, Yersinia pestis KIM
acagcguuggcagcaaaucuu

SEQ ID NO: 4187843 - RNA, 12 nt, Yersinia pestis KIM
acagcucacucg

SEQ ID NO: 4187844 - RNA, 15 nt, Yersinia pestis KIM
acagcucaucaccaa

SEQ ID NO: 4187845 - RNA, 13 nt, Yersinia pestis KIM
acagcuuugcuuc

SEQ ID NO: 4187846 - RNA, 12 nt, Yersinia pestis KIM
acaggaaacucc

SEQ ID NO: 4187847 - RNA, 16 nt, Yersinia pestis KIM
acaggauaaucaucag

SEQ ID NO: 4187848 - RNA, 21 nt, Yersinia pestis KIM
acaggaucaggccagagacac

SEQ ID NO: 4187849 - RNA, 14 nt, Yersinia pestis KIM
acaggauuaaauaa

SEQ ID NO: 4187850 - RNA, 14 nt, Yersinia pestis KIM
acaggcaauuaucc

SEQ ID NO: 4187851 - RNA, 17 nt, Yersinia pestis KIM
acaggccccaauccacc

SEQ ID NO: 4187852 - RNA, 21 nt, Yersinia pestis KIM
acaggccgcuuccgauaacca

SEQ ID NO: 4187853 - RNA, 18 nt, Yersinia pestis KIM
acaggccuaaugccgcgc

SEQ ID NO: 4187854 - RNA, 18 nt, Yersinia pestis KIM
acaggcgauagcuucagc

SEQ ID NO: 4187855 - RNA, 23 nt, Yersinia pestis KIM
acaggcggguucuucagccgcuc

SEQ ID NO: 4187856 - RNA, 23 nt, Yersinia pestis KIM
acaggcucuaucucuucagggcg

SEQ ID NO: 4187857 - RNA, 19 nt, Yersinia pestis KIM
acaggcuggauugauuuuu

SEQ ID NO: 4187858 - RNA, 16 nt, Yersinia pestis KIM
acaggcuuucaggacu

SEQ ID NO: 4187859 - RNA, 14 nt, Yersinia pestis KIM
acagggcagaaaau

SEQ ID NO: 4187860 - RNA, 15 nt, Yersinia pestis KIM
acagggcagaaaaua

SEQ ID NO: 4187861 - RNA, 19 nt, Yersinia pestis KIM
acaggggcguuauugagaa

SEQ ID NO: 4187862 - RNA, 18 nt, Yersinia pestis KIM
acagguauucuccaguug

SEQ ID NO: 4187863 - RNA, 16 nt, Yersinia pestis KIM
acagguucccaucccu

SEQ ID NO: 4187864 - RNA, 15 nt, Yersinia pestis KIM
acaguaaauucuuua

SEQ ID NO: 4187865 - RNA, 17 nt, Yersinia pestis KIM
acaguacaaaaaacaaa

SEQ ID NO: 4187866 - RNA, 21 nt, Yersinia pestis KIM
acaguacaaaaaacaaaccgg

SEQ ID NO: 4187867 - RNA, 17 nt, Yersinia pestis KIM
acaguacugccaaccac

SEQ ID NO: 4187868 - RNA, 20 nt, Yersinia pestis KIM
acaguagaagcuaccagcac

SEQ ID NO: 4187869 - RNA, 11 nt, Yersinia pestis KIM
aaaaaaauaaa

SEQ ID NO: 4187870 - RNA, 13 nt, Yersinia pestis KIM
aaaaaaauuaaaa

SEQ ID NO: 4187871 - RNA, 10 nt, Yersinia pestis KIM
aaaaaacagc

SEQ ID NO: 4187872 - RNA, 17 nt, Yersinia pestis KIM
aaaaaaccaccaaaaua

SEQ ID NO: 4187873 - RNA, 23 nt, Yersinia pestis KIM
aaaaaaccccgacauuauucaug

SEQ ID NO: 4187874 - RNA, 18 nt, Yersinia pestis KIM
aaaaaacggugaacauuu

SEQ ID NO: 4187875 - RNA, 19 nt, Yersinia pestis KIM
aaaaaagaguaaauaaaua

SEQ ID NO: 4187876 - RNA, 16 nt, Yersinia pestis KIM
aaaaaagcuauaaaua

SEQ ID NO: 4187877 - RNA, 14 nt, Yersinia pestis KIM
aaaaaauaauuaaa

SEQ ID NO: 4187878 - RNA, 13 nt, Yersinia pestis KIM
aaaaaauacgcuu

SEQ ID NO: 4187879 - RNA, 12 nt, Yersinia pestis KIM
aaaaaauaucuu

SEQ ID NO: 4187880 - RNA, 21 nt, Yersinia pestis KIM
aaaaaaugccagccccaauca

SEQ ID NO: 4187881 - RNA, 13 nt, Yersinia pestis KIM
aaaaaauuaaaau

SEQ ID NO: 4187882 - RNA, 18 nt, Yersinia pestis KIM
aaaaaauuaaaauaauga

SEQ ID NO: 4187883 - RNA, 14 nt, Yersinia pestis KIM
aaaaaauuauuaaa

SEQ ID NO: 4187884 - RNA, 23 nt, Yersinia pestis KIM
aaaaacaaaugauuauuuauuua

SEQ ID NO: 4187885 - RNA, 18 nt, Yersinia pestis KIM
aaaaacacagguucucca

SEQ ID NO: 4187886 - RNA, 17 nt, Yersinia pestis KIM
aaaaacacgguugaaaa

SEQ ID NO: 4187887 - RNA, 16 nt, Yersinia pestis KIM
aaaaacagacuaaaaa

SEQ ID NO: 4187888 - RNA, 15 nt, Yersinia pestis KIM
aaaaacagucauuaa

SEQ ID NO: 4187889 - RNA, 19 nt, Yersinia pestis KIM
aaaaacagucauuaacaca

SEQ ID NO: 4187890 - RNA, 21 nt, Yersinia pestis KIM
aaaaacagucauuaacacauc

SEQ ID NO: 4187891 - RNA, 21 nt, Yersinia pestis KIM
aaaaaccaugagaauacuuca

SEQ ID NO: 4187892 - RNA, 18 nt, Yersinia pestis KIM
aaaaaccccuuuugauuu

SEQ ID NO: 4187893 - RNA, 14 nt, Yersinia pestis KIM
aaaaacccucuuca

SEQ ID NO: 4187894 - RNA, 23 nt, Yersinia pestis KIM
aaaaacccucuucaaucggauaa

SEQ ID NO: 4187895 - RNA, 12 nt, Yersinia pestis KIM
aaaaaccgcagc

SEQ ID NO: 4187896 - RNA, 22 nt, Yersinia pestis KIM
aaaaaccgcagcagacaacuga

SEQ ID NO: 4187897 - RNA, 17 nt, Yersinia pestis KIM
aaaaacgccuccaguga

SEQ ID NO: 4187898 - RNA, 21 nt, Yersinia pestis KIM
aaaaacguuacugcucgccca

SEQ ID NO: 4187899 - RNA, 17 nt, Yersinia pestis KIM
aaaaacugaaaaaggca

SEQ ID NO: 4187900 - RNA, 20 nt, Yersinia pestis KIM
aaaaacugcggcaauaagca

SEQ ID NO: 4187901 - RNA, 19 nt, Yersinia pestis KIM
aaaaacugugcaaauggcu

SEQ ID NO: 4187902 - RNA, 14 nt, Yersinia pestis KIM
aaaaacuuuuauug

SEQ ID NO: 4187903 - RNA, 14 nt, Yersinia pestis KIM
aaaaagaaaaaaac

SEQ ID NO: 4187904 - RNA, 17 nt, Yersinia pestis KIM
aaaaagaaaaaaacaga

SEQ ID NO: 4187905 - RNA, 11 nt, Yersinia pestis KIM
aaaaagaaaau

SEQ ID NO: 4187906 - RNA, 14 nt, Yersinia pestis KIM
aaaaagacacuaac

SEQ ID NO: 4187907 - RNA, 22 nt, Yersinia pestis KIM
aaaaagccggguggcccaauaa

SEQ ID NO: 4187908 - RNA, 13 nt, Yersinia pestis KIM
aaaaagccugaau

SEQ ID NO: 4187909 - RNA, 15 nt, Yersinia pestis KIM
aaaaagcgacacuua

SEQ ID NO: 4187910 - RNA, 16 nt, Yersinia pestis KIM
aaaaagcguuucagag

SEQ ID NO: 4187911 - RNA, 16 nt, Yersinia pestis KIM
aaaaaggcaccagcgc

SEQ ID NO: 4187912 - RNA, 21 nt, Yersinia pestis KIM
aaaaagucauuaacuguuaaa

SEQ ID NO: 4187913 - RNA, 21 nt, Yersinia pestis KIM
aaaaagugcuauccucuuaau

SEQ ID NO: 4187914 - RNA, 23 nt, Yersinia pestis KIM
aaaaagugcuauccucuuaaugu

SEQ ID NO: 4187915 - RNA, 14 nt, Yersinia pestis KIM
aaaaaguguugacg

SEQ ID NO: 4187916 - RNA, 14 nt, Yersinia pestis KIM
aaaaauaaauuaga

SEQ ID NO: 4187917 - RNA, 13 nt, Yersinia pestis KIM
aaaaauaauuaaa

SEQ ID NO: 4187918 - RNA, 12 nt, Yersinia pestis KIM
aaaaauacaacc

SEQ ID NO: 4187919 - RNA, 18 nt, Yersinia pestis KIM
aaaaauacaaccaacaaa

SEQ ID NO: 4187920 - RNA, 21 nt, Yersinia pestis KIM
aaaaauacaggugucaucaag

SEQ ID NO: 4187921 - RNA, 17 nt, Yersinia pestis KIM
aaaaauaggccauucaa

SEQ ID NO: 4187922 - RNA, 23 nt, Yersinia pestis KIM
aaaaauauuaacugcagugaaaa

SEQ ID NO: 4187923 - RNA, 19 nt, Yersinia pestis KIM
aaaaaucugcaauaucauc

SEQ ID NO: 4187924 - RNA, 16 nt, Yersinia pestis KIM
aaaaaucuuguuaauu

SEQ ID NO: 4187925 - RNA, 17 nt, Yersinia pestis KIM
aaaaauuaaaauaauga

SEQ ID NO: 4187926 - RNA, 19 nt, Yersinia pestis KIM
aaaaauucacaacagugca

SEQ ID NO: 4187927 - RNA, 23 nt, Yersinia pestis KIM
aaaaauugacgaaaguuaaacaa

SEQ ID NO: 4187928 - RNA, 13 nt, Yersinia pestis KIM
aaaaauuuuccca

SEQ ID NO: 4187929 - RNA, 18 nt, Yersinia pestis KIM
aaaaauuuucccaaagug

SEQ ID NO: 4187930 - RNA, 13 nt, Yersinia pestis KIM
aaaacaaaguagu

SEQ ID NO: 4187931 - RNA, 23 nt, Yersinia pestis KIM
aaaacaacccgaauuaauaaaac

SEQ ID NO: 4187932 - RNA, 15 nt, Yersinia pestis KIM
aaaacaauaaaaaga

SEQ ID NO: 4187933 - RNA, 18 nt, Yersinia pestis KIM
aaaacaauaaaaagaucu

SEQ ID NO: 4187934 - RNA, 18 nt, Yersinia pestis KIM
aaaacaauauaauaacuc

SEQ ID NO: 4187935 - RNA, 12 nt, Yersinia pestis KIM
aaaacaauuucg

SEQ ID NO: 4187936 - RNA, 23 nt, Yersinia pestis KIM
aaaacacagcgaagcguaaauuu

SEQ ID NO: 4187937 - RNA, 14 nt, Yersinia pestis KIM
aaaacacgcaacac

SEQ ID NO: 4187938 - RNA, 16 nt, Yersinia pestis KIM
aaaacacuggcagcca

SEQ ID NO: 4187939 - RNA, 15 nt, Yersinia pestis KIM
aaaacagacuaaaaa

SEQ ID NO: 4187940 - RNA, 15 nt, Yersinia pestis KIM
aaaacagauaaaaaa

SEQ ID NO: 4187941 - RNA, 20 nt, Yersinia pestis KIM
aaaacaggcgaguuucccuu

SEQ ID NO: 4187942 - RNA, 22 nt, Yersinia pestis KIM
aaaacaguucggucuauaaaac

SEQ ID NO: 4187943 - RNA, 10 nt, Yersinia pestis KIM
aaaacaguuu

SEQ ID NO: 4187944 - RNA, 15 nt, Yersinia pestis KIM
aaaacaucacacuug

SEQ ID NO: 4187945 - RNA, 12 nt, Yersinia pestis KIM
aaaaccaauuca

SEQ ID NO: 4187946 - RNA, 11 nt, Yersinia pestis KIM
aaaaccacuga

SEQ ID NO: 4187947 - RNA, 12 nt, Yersinia pestis KIM
aaaaccacugac

SEQ ID NO: 4187948 - RNA, 14 nt, Yersinia pestis KIM
aaaaccacugaccu

SEQ ID NO: 4187949 - RNA, 22 nt, Yersinia pestis KIM
aaaaccacugaccuauugauaa

SEQ ID NO: 4187950 - RNA, 11 nt, Yersinia pestis KIM
aaaaccagcag

SEQ ID NO: 4187951 - RNA, 22 nt, Yersinia pestis KIM
aaaaccauccccagaacagcua

SEQ ID NO: 4187952 - RNA, 23 nt, Yersinia pestis KIM
aaaaccccguacaugaauaaugu

SEQ ID NO: 4187953 - RNA, 19 nt, Yersinia pestis KIM
aaaaccgcagcagacaacu

SEQ ID NO: 4187954 - RNA, 21 nt, Yersinia pestis KIM
aaaaccgccccccauccccaa

SEQ ID NO: 4187955 - RNA, 18 nt, Yersinia pestis KIM
aaaaccgugacuaaaaca

SEQ ID NO: 4187956 - RNA, 15 nt, Yersinia pestis KIM
aaaaccuaacgccaa

SEQ ID NO: 4187957 - RNA, 24 nt, Yersinia pestis KIM
aaaaccuuuaaucagauauuccug

SEQ ID NO: 4187958 - RNA, 16 nt, Yersinia pestis KIM
aaaacgaguaaauaca

SEQ ID NO: 4187959 - RNA, 23 nt, Yersinia pestis KIM
aaaacgauuagcuugugugcuua

SEQ ID NO: 4187960 - RNA, 16 nt, Yersinia pestis KIM
aaaacgcacgaaaaca

SEQ ID NO: 4187961 - RNA, 21 nt, Yersinia pestis KIM
aaaacuacgguaauaaacaga

SEQ ID NO: 4187962 - RNA, 15 nt, Yersinia pestis KIM
aaaacuauucugcuu

SEQ ID NO: 4187963 - RNA, 15 nt, Yersinia pestis KIM
aaaacucaaacugau

SEQ ID NO: 4187964 - RNA, 14 nt, Yersinia pestis KIM
aaaacucaaagauu

SEQ ID NO: 4187965 - RNA, 15 nt, Yersinia pestis KIM
aaaacucaaauagau

SEQ ID NO: 4187966 - RNA, 18 nt, Yersinia pestis KIM
aaaacucgcgccugaaau

SEQ ID NO: 4187967 - RNA, 22 nt, Yersinia pestis KIM
aaaacugacugccauaauccag

SEQ ID NO: 4187968 - RNA, 16 nt, Yersinia pestis KIM
aaaacugauuaauagu

SEQ ID NO: 4187969 - RNA, 14 nt, Yersinia pestis KIM
aaaacuggucagcc

SEQ ID NO: 4187970 - RNA, 18 nt, Yersinia pestis KIM
aaaacugugcaaauggcu

SEQ ID NO: 4187971 - RNA, 16 nt, Yersinia pestis KIM
aaaacugugccugaau

SEQ ID NO: 4187972 - RNA, 22 nt, Yersinia pestis KIM
aaaacugugcgaauggaaaaac

SEQ ID NO: 4187973 - RNA, 16 nt, Yersinia pestis KIM
aaaacuuaucuaaaaa

SEQ ID NO: 4187974 - RNA, 16 nt, Yersinia pestis KIM
aaaagaaaaaaacaga

SEQ ID NO: 4187975 - RNA, 23 nt, Yersinia pestis KIM
aaaagaaaauggcuuuuuuaaua

SEQ ID NO: 4187976 - RNA, 13 nt, Yersinia pestis KIM
aaaagaccgcuuu

SEQ ID NO: 4187977 - RNA, 11 nt, Yersinia pestis KIM
aaaagauaacg

SEQ ID NO: 4187978 - RNA, 17 nt, Yersinia pestis KIM
aaaagcacagacaaaca

SEQ ID NO: 4187979 - RNA, 18 nt, Yersinia pestis KIM
aaaagcacagacaaacaa

SEQ ID NO: 4187980 - RNA, 14 nt, Yersinia pestis KIM
aaaagcagcaaacg

SEQ ID NO: 4187981 - RNA, 14 nt, Yersinia pestis KIM
aaaagcaugcccag

SEQ ID NO: 4187982 - RNA, 19 nt, Yersinia pestis KIM
aaaagcaugcccagccucu

SEQ ID NO: 4187983 - RNA, 19 nt, Yersinia pestis KIM
aaaagcccggucacucaau

SEQ ID NO: 4187984 - RNA, 23 nt, Yersinia pestis KIM
aaaagcccguucguugccaaaac

SEQ ID NO: 4187985 - RNA, 19 nt, Yersinia pestis KIM
aaaagccugaauucuguag

SEQ ID NO: 4187986 - RNA, 17 nt, Yersinia pestis KIM
aaaagcgacugauauua

SEQ ID NO: 4187987 - RNA, 18 nt, Yersinia pestis KIM
aaaagcgccuuuuauucu

SEQ ID NO: 4187988 - RNA, 21 nt, Yersinia pestis KIM
aaaaggaguucugcagcaauc

SEQ ID NO: 4187989 - RNA, 18 nt, Yersinia pestis KIM
aaaaggauagggagccaa

SEQ ID NO: 4187990 - RNA, 18 nt, Yersinia pestis KIM
aaaagggaguucaucaaa

SEQ ID NO: 4187991 - RNA, 17 nt, Yersinia pestis KIM
aaaagggcaagcguuaa

SEQ ID NO: 4187992 - RNA, 14 nt, Yersinia pestis KIM
aaaagguaaacaga

SEQ ID NO: 4187993 - RNA, 21 nt, Yersinia pestis KIM
aaaagugcuauccucuuaaug

SEQ ID NO: 4187994 - RNA, 21 nt, Yersinia pestis KIM
aaaaguuucagcguggaauua

SEQ ID NO: 4187995 - RNA, 19 nt, Yersinia pestis KIM
aaaaguuuuuugaaauuag

SEQ ID NO: 4187996 - RNA, 16 nt, Yersinia pestis KIM
aaaauaaaauucguuu

SEQ ID NO: 4187997 - RNA, 10 nt, Yersinia pestis KIM
aaaauaauga

SEQ ID NO: 4187998 - RNA, 15 nt, Yersinia pestis KIM
aaaauaauuaaaccu

SEQ ID NO: 4187999 - RNA, 13 nt, Yersinia pestis KIM
aaaauacaaaaag

SEQ ID NO: 4188000 - RNA, 13 nt, Yersinia pestis KIM
aaaauacaaccaa

SEQ ID NO: 4188001 - RNA, 15 nt, Yersinia pestis KIM
aaaauacaaccaaca

SEQ ID NO: 4188002 - RNA, 19 nt, Yersinia pestis KIM
aaaauacccaaagucauug

SEQ ID NO: 4188003 - RNA, 16 nt, Yersinia pestis KIM
aaaauacccaacaggu

SEQ ID NO: 4188004 - RNA, 17 nt, Yersinia pestis KIM
aaaauacgcaugauccc

SEQ ID NO: 4188005 - RNA, 16 nt, Yersinia pestis KIM
aaaauacggccaguca

SEQ ID NO: 4188006 - RNA, 17 nt, Yersinia pestis KIM
aaaauacggccagucaa

SEQ ID NO: 4188007 - RNA, 19 nt, Yersinia pestis KIM
aaaauacggccagucaaaa

SEQ ID NO: 4188008 - RNA, 18 nt, Yersinia pestis KIM
aaaauacucauuuuuaag

SEQ ID NO: 4188009 - RNA, 17 nt, Yersinia pestis KIM
aaaauacugccaaucgc

SEQ ID NO: 4188010 - RNA, 13 nt, Yersinia pestis KIM
aaaauagaaaaca

SEQ ID NO: 4188011 - RNA, 15 nt, Yersinia pestis KIM
aaaauagacucaaca

SEQ ID NO: 4188012 - RNA, 19 nt, Yersinia pestis KIM
aaaauagagcauaccaaua

SEQ ID NO: 4188013 - RNA, 17 nt, Yersinia pestis KIM
aaaauagaggaaauaaa

SEQ ID NO: 4188014 - RNA, 12 nt, Yersinia pestis KIM
aaaauagccuuc

SEQ ID NO: 4188015 - RNA, 22 nt, Yersinia pestis KIM
aaaauaggccauucaaugucca

SEQ ID NO: 4188016 - RNA, 11 nt, Yersinia pestis KIM
aaaauagggaa

SEQ ID NO: 4188017 - RNA, 22 nt, Yersinia pestis KIM
aaaauagggaagguguuuaaaa

SEQ ID NO: 4188018 - RNA, 13 nt, Yersinia pestis KIM
aaaauaucacuau

SEQ ID NO: 4188019 - RNA, 20 nt, Yersinia pestis KIM
aaaauaugauaguguaaaaa

SEQ ID NO: 4188020 - RNA, 22 nt, Yersinia pestis KIM
aaaauaugauaguguaaaaacc

SEQ ID NO: 4188021 - RNA, 22 nt, Yersinia pestis KIM
aaaauauuaacugcagugaaaa

SEQ ID NO: 4188022 - RNA, 13 nt, Yersinia pestis KIM
aaaaucaaaacag

SEQ ID NO: 4188023 - RNA, 19 nt, Yersinia pestis KIM
aaaaucaccucaaacugac

SEQ ID NO: 4188024 - RNA, 22 nt, Yersinia pestis KIM
aaaaucacgcggguuaucacau

SEQ ID NO: 4188025 - RNA, 16 nt, Yersinia pestis KIM
aaaaucaguacgcuaa

SEQ ID NO: 4188026 - RNA, 15 nt, Yersinia pestis KIM
aaaaucauggcauaa

SEQ ID NO: 4188027 - RNA, 12 nt, Yersinia pestis KIM
aaaaucauugac

SEQ ID NO: 4188028 - RNA, 19 nt, Yersinia pestis KIM
aaaauccccggaccagccg

SEQ ID NO: 4188029 - RNA, 23 nt, Yersinia pestis KIM
aaaaucccgaugagucuauuuau

SEQ ID NO: 4188030 - RNA, 13 nt, Yersinia pestis KIM
aaaaucgcacuga

SEQ ID NO: 4188031 - RNA, 15 nt, Yersinia pestis KIM
aaaaucgcacugagu

SEQ ID NO: 4188032 - RNA, 18 nt, Yersinia pestis KIM
aaaaucgcgaccagcaga

SEQ ID NO: 4188033 - RNA, 19 nt, Yersinia pestis KIM
aaaaucgcgaccagcagaa

SEQ ID NO: 4188034 - RNA, 20 nt, Yersinia pestis KIM
aaaaucgcgaccagcagaau

SEQ ID NO: 4188035 - RNA, 18 nt, Yersinia pestis KIM
aaaaucguauaacauaau

SEQ ID NO: 4188036 - RNA, 16 nt, Yersinia pestis KIM
aaaaucuuguuaauuu

SEQ ID NO: 4188037 - RNA, 19 nt, Yersinia pestis KIM
aaaaugaaauuuuauuacu

SEQ ID NO: 4188038 - RNA, 17 nt, Yersinia pestis KIM
aaaaugagaauaucuau

SEQ ID NO: 4188039 - RNA, 14 nt, Yersinia pestis KIM
aaaaugagccugaa

SEQ ID NO: 4188040 - RNA, 17 nt, Yersinia pestis KIM
aaaaugaucuuuauuau

SEQ ID NO: 4188041 - RNA, 20 nt, Yersinia pestis KIM
aaaaugcggcggcugaccac

SEQ ID NO: 4188042 - RNA, 12 nt, Yersinia pestis KIM
aaaaugcucuuc

SEQ ID NO: 4188043 - RNA, 15 nt, Yersinia pestis KIM
aaaauggcaacauca

SEQ ID NO: 4188044 - RNA, 19 nt, Yersinia pestis KIM
aaaauggcuuuuuuaauaa

SEQ ID NO: 4188045 - RNA, 22 nt, Yersinia pestis KIM
aaaauggguauauuuaccaaaa

SEQ ID NO: 4188046 - RNA, 18 nt, Yersinia pestis KIM
aaaauguguuuucugugc

SEQ ID NO: 4188047 - RNA, 12 nt, Yersinia pestis KIM
aaaauuaacuua

SEQ ID NO: 4188048 - RNA, 16 nt, Yersinia pestis KIM
aaaauuaauaaauuau

SEQ ID NO: 4188049 - RNA, 22 nt, Yersinia pestis KIM
aaaauuacaguucuuuauccac

SEQ ID NO: 4188050 - RNA, 16 nt, Yersinia pestis KIM
aaaauuacccagcauc

SEQ ID NO: 4188051 - RNA, 15 nt, Yersinia pestis KIM
aaaauuagccaagca

SEQ ID NO: 4188052 - RNA, 13 nt, Yersinia pestis KIM
aaaauucacaaca

SEQ ID NO: 4188053 - RNA, 20 nt, Yersinia pestis KIM
aaaauucaucuuuaacaaca

SEQ ID NO: 4188054 - RNA, 22 nt, Yersinia pestis KIM
aaaauucauucuuuuauacagc

SEQ ID NO: 4188055 - RNA, 18 nt, Yersinia pestis KIM
aaaauuccaccauucuca

SEQ ID NO: 4188056 - RNA, 20 nt, Yersinia pestis KIM
aaaauucgugcucaucaacc

SEQ ID NO: 4188057 - RNA, 22 nt, Yersinia pestis KIM
aaaauucguuucucuaaaauuu

SEQ ID NO: 4188058 - RNA, 17 nt, Yersinia pestis KIM
aaaauugacgaaaguua

SEQ ID NO: 4188059 - RNA, 11 nt, Yersinia pestis KIM
aaaauuuuaag

SEQ ID NO: 4188060 - RNA, 13 nt, Yersinia pestis KIM
aaacaaauacacc

SEQ ID NO: 4188061 - RNA, 21 nt, Yersinia pestis KIM
aaacaaaucuuaaauugaaga

SEQ ID NO: 4188062 - RNA, 19 nt, Yersinia pestis KIM
aaacaacccgaauuaauaa

SEQ ID NO: 4188063 - RNA, 13 nt, Yersinia pestis KIM
aaacaaccuaaaa

SEQ ID NO: 4188064 - RNA, 15 nt, Yersinia pestis KIM
aaacaaccuaaaaaa

SEQ ID NO: 4188065 - RNA, 20 nt, Yersinia pestis KIM
aaacaaccuaaaaaaaacaa

SEQ ID NO: 4188066 - RNA, 19 nt, Yersinia pestis KIM
aaacaacgccgcucaauua

SEQ ID NO: 4188067 - RNA, 17 nt, Yersinia pestis KIM
aaacaagcuuauauuau

SEQ ID NO: 4188068 - RNA, 13 nt, Yersinia pestis KIM
aaacaauuucgaa

SEQ ID NO: 4188069 - RNA, 19 nt, Yersinia pestis KIM
aaacacaaaauagaaaaca

SEQ ID NO: 4188070 - RNA, 23 nt, Yersinia pestis KIM
aaacacaaaauagaaaacagcaa

SEQ ID NO: 4188071 - RNA, 21 nt, Yersinia pestis KIM
aaacacgauauaccucaguua

SEQ ID NO: 4188072 - RNA, 16 nt, Yersinia pestis KIM
aaacacucaauaagua

SEQ ID NO: 4188073 - RNA, 21 nt, Yersinia pestis KIM
aaacacugauuuauaaauaau

SEQ ID NO: 4188074 - RNA, 20 nt, Yersinia pestis KIM
aaacacuuaugaucuugaau

SEQ ID NO: 4188075 - RNA, 21 nt, Yersinia pestis KIM
aaacacuuauuugaaauacuu

SEQ ID NO: 4188076 - RNA, 18 nt, Yersinia pestis KIM
aaacacuuggauccgcag

SEQ ID NO: 4188077 - RNA, 16 nt, Yersinia pestis KIM
aaacagacuaaaaacc

SEQ ID NO: 4188078 - RNA, 14 nt, Yersinia pestis KIM
aaacagauaaaaaa

SEQ ID NO: 4188079 - RNA, 19 nt, Yersinia pestis KIM
aaacagauaacucagggcg

SEQ ID NO: 4188080 - RNA, 15 nt, Yersinia pestis KIM
aaacagcaacaccau

SEQ ID NO: 4188081 - RNA, 17 nt, Yersinia pestis KIM
aaacagcacuaucccca

SEQ ID NO: 4188082 - RNA, 22 nt, Yersinia pestis KIM
aaacagccaccagccaacuuuc

SEQ ID NO: 4188083 - RNA, 13 nt, Yersinia pestis KIM
aaacagccagcau

SEQ ID NO: 4188084 - RNA, 16 nt, Yersinia pestis KIM
aaacagggcagaaaau

SEQ ID NO: 4188085 - RNA, 21 nt, Yersinia pestis KIM
aaacaggguugagccaauuaa

SEQ ID NO: 4188086 - RNA, 23 nt, Yersinia pestis KIM
aaacagguaaugcgcgcagcaag

SEQ ID NO: 4188087 - RNA, 16 nt, Yersinia pestis KIM
aaacagucauuaacac

SEQ ID NO: 4188088 - RNA, 16 nt, Yersinia pestis KIM
aaacagucuuauuacu

SEQ ID NO: 4188089 - RNA, 23 nt, Yersinia pestis KIM
aaacagugcacaucaauaccugu

SEQ ID NO: 4188090 - RNA, 23 nt, Yersinia pestis KIM
aaacauacuuuucauuuccucug

SEQ ID NO: 4188091 - RNA, 14 nt, Yersinia pestis KIM
aaacaucaugacaa

SEQ ID NO: 4188092 - RNA, 18 nt, Yersinia pestis KIM
aaacaucaugacaaaaau

SEQ ID NO: 4188093 - RNA, 20 nt, Yersinia pestis KIM
aaacauccuaaaaagcgcga

SEQ ID NO: 4188094 - RNA, 19 nt, Yersinia pestis KIM
aaacauggcggcagcacag

SEQ ID NO: 4188095 - RNA, 22 nt, Yersinia pestis KIM
aaacauggcucucuuuuuucuc

SEQ ID NO: 4188096 - RNA, 13 nt, Yersinia pestis KIM
aaacauuggcuuu

SEQ ID NO: 4188097 - RNA, 23 nt, Yersinia pestis KIM
aaacauuguuaccuaaccaaaca

SEQ ID NO: 4188098 - RNA, 15 nt, Yersinia pestis KIM
aaacauuuaaauaug

SEQ ID NO: 4188099 - RNA, 19 nt, Yersinia pestis KIM
aaacauuuacuuauaaaca

SEQ ID NO: 4188100 - RNA, 22 nt, Yersinia pestis KIM
aaacauuucauuccagauaaaa

SEQ ID NO: 4188101 - RNA, 22 nt, Yersinia pestis KIM
aaacauuuucaucugaccaaac

SEQ ID NO: 4188102 - RNA, 23 nt, Yersinia pestis KIM
aaacauuuucaucugaccaaaca

SEQ ID NO: 4188103 - RNA, 24 nt, Yersinia pestis KIM
aaaccaaaaagggcacagcgagau

SEQ ID NO: 4188104 - RNA, 14 nt, Yersinia pestis KIM
aaaccaaagauaau

SEQ ID NO: 4188105 - RNA, 21 nt, Yersinia pestis KIM
aaaccaaagauaauacauaaa

SEQ ID NO: 4188106 - RNA, 13 nt, Yersinia pestis KIM
aaaccaacaauau

SEQ ID NO: 4188107 - RNA, 18 nt, Yersinia pestis KIM
aaaccaccaaaauagcgg

SEQ ID NO: 4188108 - RNA, 15 nt, Yersinia pestis KIM
aaaccacgcgguugg

SEQ ID NO: 4188109 - RNA, 14 nt, Yersinia pestis KIM
aaaccacugaccua

SEQ ID NO: 4188110 - RNA, 15 nt, Yersinia pestis KIM
aaaccacuguuuuuc

SEQ ID NO: 4188111 - RNA, 12 nt, Yersinia pestis KIM
aaaccacuuggc

SEQ ID NO: 4188112 - RNA, 22 nt, Yersinia pestis KIM
aaaccagaugaucugaugauca

SEQ ID NO: 4188113 - RNA, 19 nt, Yersinia pestis KIM
aaaccagcagcgcauaaaa

SEQ ID NO: 4188114 - RNA, 17 nt, Yersinia pestis KIM
aaaccaugagaauacuu

SEQ ID NO: 4188115 - RNA, 21 nt, Yersinia pestis KIM
aaaccauggcggcucgccuga

SEQ ID NO: 4188116 - RNA, 22 nt, Yersinia pestis KIM
aaaccauugguaauaaugccca

SEQ ID NO: 4188117 - RNA, 14 nt, Yersinia pestis KIM
aaacccaaccccau

SEQ ID NO: 4188118 - RNA, 19 nt, Yersinia pestis KIM
aaaccccuuuugauuuguu

SEQ ID NO: 4188119 - RNA, 13 nt, Yersinia pestis KIM
aaacccggcauca

SEQ ID NO: 4188120 - RNA, 18 nt, Yersinia pestis KIM
aaaccgaaaugaucuuca

SEQ ID NO: 4188121 - RNA, 23 nt, Yersinia pestis KIM
aaaccgcagcagacaacugacaa

SEQ ID NO: 4188122 - RNA, 16 nt, Yersinia pestis KIM
aaaccgcuauaucauc

SEQ ID NO: 4188123 - RNA, 23 nt, Yersinia pestis KIM
aaaccgcuauaucaucagcagag

SEQ ID NO: 4188124 - RNA, 19 nt, Yersinia pestis KIM
aaaccgcuguuuuaaucgg

SEQ ID NO: 4188125 - RNA, 14 nt, Yersinia pestis KIM
aaaccggacauaau

SEQ ID NO: 4188126 - RNA, 16 nt, Yersinia pestis KIM
aaaccggaugauuuca

SEQ ID NO: 4188127 - RNA, 19 nt, Yersinia pestis KIM
aaaccggaugauuucaaac

SEQ ID NO: 4188128 - RNA, 13 nt, Yersinia pestis KIM
aaaccgugauugg

SEQ ID NO: 4188129 - RNA, 21 nt, Yersinia pestis KIM
aaaccgugauugguuuauccc

SEQ ID NO: 4188130 - RNA, 18 nt, Yersinia pestis KIM
aaaccuagucucacuaaa

SEQ ID NO: 4188131 - RNA, 13 nt, Yersinia pestis KIM
aaaccugauuuac

SEQ ID NO: 4188132 - RNA, 19 nt, Yersinia pestis KIM
aaaccugugugaccuccgu

SEQ ID NO: 4188133 - RNA, 14 nt, Yersinia pestis KIM
aaacgaacgaauaa

SEQ ID NO: 4188134 - RNA, 19 nt, Yersinia pestis KIM
aaacgaauggucugcaacu

SEQ ID NO: 4188135 - RNA, 21 nt, Yersinia pestis KIM
aaacgaccaauuucaauaauu

SEQ ID NO: 4188136 - RNA, 18 nt, Yersinia pestis KIM
aaacgacgggcugcugca

SEQ ID NO: 4188137 - RNA, 23 nt, Yersinia pestis KIM
aaacgcauacucaaaaauggcaa

SEQ ID NO: 4188138 - RNA, 23 nt, Yersinia pestis KIM
aaacgcauucauaucguccaaag

SEQ ID NO: 4188139 - RNA, 17 nt, Yersinia pestis KIM
aaacgccaucaauaauu

SEQ ID NO: 4188140 - RNA, 12 nt, Yersinia pestis KIM
aaacgcccagcu

SEQ ID NO: 4188141 - RNA, 22 nt, Yersinia pestis KIM
aaacgccccgauaaaccaacug

SEQ ID NO: 4188142 - RNA, 22 nt, Yersinia pestis KIM
aaacgccucguuuaacucaaau

SEQ ID NO: 4188143 - RNA, 13 nt, Yersinia pestis KIM
aaacgccugaucc

SEQ ID NO: 4188144 - RNA, 20 nt, Yersinia pestis KIM
aaacgccugauccaacaucg

SEQ ID NO: 4188145 - RNA, 17 nt, Yersinia pestis KIM
aaacgccugggauccau

SEQ ID NO: 4188146 - RNA, 20 nt, Yersinia pestis KIM
aaacgccugggauccauagg

SEQ ID NO: 4188147 - RNA, 21 nt, Yersinia pestis KIM
aaacgcguuaauuaagacccu

SEQ ID NO: 4188148 - RNA, 18 nt, Yersinia pestis KIM
aaacgcucaguuaaacgg

SEQ ID NO: 4188149 - RNA, 14 nt, Yersinia pestis KIM
aaacgcucaucaac

SEQ ID NO: 4188150 - RNA, 15 nt, Yersinia pestis KIM
aaacgcuggccagca

SEQ ID NO: 4188151 - RNA, 14 nt, Yersinia pestis KIM
aaacgcugggcgau

SEQ ID NO: 4188152 - RNA, 19 nt, Yersinia pestis KIM
aaacgcuuuuaacugugca

SEQ ID NO: 4188153 - RNA, 19 nt, Yersinia pestis KIM
aaacggaugagucgcuggu

SEQ ID NO: 4188154 - RNA, 21 nt, Yersinia pestis KIM
aaacggcgcggcaucaccaaa

SEQ ID NO: 4188155 - RNA, 17 nt, Yersinia pestis KIM
aaacggcgguuaaucgg

SEQ ID NO: 4188156 - RNA, 15 nt, Yersinia pestis KIM
aaacggcuuuuuaaa

SEQ ID NO: 4188157 - RNA, 19 nt, Yersinia pestis KIM
aaacggugaggauaggcag

SEQ ID NO: 4188158 - RNA, 19 nt, Yersinia pestis KIM
aaacggugcuggugggccu

SEQ ID NO: 4188159 - RNA, 20 nt, Yersinia pestis KIM
aaacggugugcaucacguuu

SEQ ID NO: 4188160 - RNA, 22 nt, Yersinia pestis KIM
aaacgguuaagcagguagcugu

SEQ ID NO: 4188161 - RNA, 13 nt, Yersinia pestis KIM
aaacgguugcugu

SEQ ID NO: 4188162 - RNA, 16 nt, Yersinia pestis KIM
aaacguauaaaagcau

SEQ ID NO: 4188163 - RNA, 23 nt, Yersinia pestis KIM
aaacgucacuucgccuuaucagc

SEQ ID NO: 4188164 - RNA, 19 nt, Yersinia pestis KIM
aaacguccaggcuuucacg

SEQ ID NO: 4188165 - RNA, 13 nt, Yersinia pestis KIM
aaacuaaaauaau

SEQ ID NO: 4188166 - RNA, 16 nt, Yersinia pestis KIM
aaacuaacgcgugaag

SEQ ID NO: 4188167 - RNA, 17 nt, Yersinia pestis KIM
aaacuaccgaucaucag

SEQ ID NO: 4188168 - RNA, 22 nt, Yersinia pestis KIM
aaacuauucaucccuaaaauca

SEQ ID NO: 4188169 - RNA, 13 nt, Yersinia pestis KIM
aaacuauucugcu

SEQ ID NO: 4188170 - RNA, 17 nt, Yersinia pestis KIM
aaacucagcgaauaaau

SEQ ID NO: 4188171 - RNA, 18 nt, Yersinia pestis KIM
aaacugaaaaaggcacca

SEQ ID NO: 4188172 - RNA, 15 nt, Yersinia pestis KIM
aaacugaaaaguuuc

SEQ ID NO: 4188173 - RNA, 15 nt, Yersinia pestis KIM
aaacugaaguuaaaa

SEQ ID NO: 4188174 - RNA, 23 nt, Yersinia pestis KIM
aaacugaaguuaaaaagccugaa

SEQ ID NO: 4188175 - RNA, 12 nt, Yersinia pestis KIM
aaacugacauaa

SEQ ID NO: 4188176 - RNA, 11 nt, Yersinia pestis KIM
aaacugaccga

SEQ ID NO: 4188177 - RNA, 20 nt, Yersinia pestis KIM
aaacugaccgauaaacgcca

SEQ ID NO: 4188178 - RNA, 14 nt, Yersinia pestis KIM
aaacugaucaucaa

SEQ ID NO: 4188179 - RNA, 15 nt, Yersinia pestis KIM
aaacugaugccggua

SEQ ID NO: 4188180 - RNA, 19 nt, Yersinia pestis KIM
aaacugauuaauaguguug

SEQ ID NO: 4188181 - RNA, 14 nt, Yersinia pestis KIM
aaacugccuauuua

SEQ ID NO: 4188182 - RNA, 13 nt, Yersinia pestis KIM
aaacugucaguca

SEQ ID NO: 4188183 - RNA, 16 nt, Yersinia pestis KIM
aaacugucagucaaaa

SEQ ID NO: 4188184 - RNA, 14 nt, Yersinia pestis KIM
aaacugugcaaaug

SEQ ID NO: 4188185 - RNA, 15 nt, Yersinia pestis KIM
aaacugugcaaaugg

SEQ ID NO: 4188186 - RNA, 15 nt, Yersinia pestis KIM
aaacuguucuuauug

SEQ ID NO: 4188187 - RNA, 14 nt, Yersinia pestis KIM
aaacuuaaaaauca

SEQ ID NO: 4188188 - RNA, 17 nt, Yersinia pestis KIM
aaacuuaucuaaaaaac

SEQ ID NO: 4188189 - RNA, 16 nt, Yersinia pestis KIM
aaacuucaaaaucaag

SEQ ID NO: 4188190 - RNA, 23 nt, Yersinia pestis KIM
aaacuugaucagcgccugcugug

SEQ ID NO: 4188191 - RNA, 21 nt, Yersinia pestis KIM
aaacuuuuaugcaucuuuuag

SEQ ID NO: 4188192 - RNA, 12 nt, Yersinia pestis KIM
aaagaaaaauag

SEQ ID NO: 4188193 - RNA, 16 nt, Yersinia pestis KIM
aaagaaaaaucgccaa

SEQ ID NO: 4188194 - RNA, 21 nt, Yersinia pestis KIM
aaagaaaaucaggauaucuau

SEQ ID NO: 4188195 - RNA, 17 nt, Yersinia pestis KIM
aaagaaauaaaagaaaa

SEQ ID NO: 4188196 - RNA, 19 nt, Yersinia pestis KIM
aaagaaauaaaagaaaacc

SEQ ID NO: 4188197 - RNA, 12 nt, Yersinia pestis KIM
aaagaagaauaa

SEQ ID NO: 4188198 - RNA, 14 nt, Yersinia pestis KIM
aaagaagacauauc

SEQ ID NO: 4188199 - RNA, 15 nt, Yersinia pestis KIM
aaagaagacauaucu

SEQ ID NO: 4188200 - RNA, 20 nt, Yersinia pestis KIM
aaagaagacgaguaaugaaa

SEQ ID NO: 4188201 - RNA, 17 nt, Yersinia pestis KIM
aaagaaggguuagcauu

SEQ ID NO: 4188202 - RNA, 21 nt, Yersinia pestis KIM
aaagaauaacuggagaauuua

SEQ ID NO: 4188203 - RNA, 18 nt, Yersinia pestis KIM
aaagacccaauacaccac

SEQ ID NO: 4188204 - RNA, 18 nt, Yersinia pestis KIM
aaagacgccguaaauaca

SEQ ID NO: 4188205 - RNA, 23 nt, Yersinia pestis KIM
aaagacgccguaaauacauccau

SEQ ID NO: 4188206 - RNA, 23 nt, Yersinia pestis KIM
aaagacgccuuccggcaucuuuu

SEQ ID NO: 4188207 - RNA, 21 nt, Yersinia pestis KIM
aaagacuuuauucacagcaga

SEQ ID NO: 4188208 - RNA, 21 nt, Yersinia pestis KIM
aaagagauguuauuugaauaa

SEQ ID NO: 4188209 - RNA, 16 nt, Yersinia pestis KIM
aaagaguaaauaaaua

SEQ ID NO: 4188210 - RNA, 20 nt, Yersinia pestis KIM
aaagauaauacauaaaauca

SEQ ID NO: 4188211 - RNA, 18 nt, Yersinia pestis KIM
aaagauaauuuagcaaag

SEQ ID NO: 4188212 - RNA, 16 nt, Yersinia pestis KIM
aaagauagcaaaagaa

SEQ ID NO: 4188213 - RNA, 15 nt, Yersinia pestis KIM
aaagauagccacuaa

SEQ ID NO: 4188214 - RNA, 18 nt, Yersinia pestis KIM
aaagauagccacuaacua

SEQ ID NO: 4188215 - RNA, 21 nt, Yersinia pestis KIM
aaagauccccacaaaaucaac

SEQ ID NO: 4188216 - RNA, 19 nt, Yersinia pestis KIM
aaagaucugcauugauuaa

SEQ ID NO: 4188217 - RNA, 20 nt, Yersinia pestis KIM
aaagauggcauuaaaaaucu

SEQ ID NO: 4188218 - RNA, 12 nt, Yersinia pestis KIM
aaagauuaagac

SEQ ID NO: 4188219 - RNA, 18 nt, Yersinia pestis KIM
aaagauuauguagauccc

SEQ ID NO: 4188220 - RNA, 16 nt, Yersinia pestis KIM
aaagauucauaaaaaa

SEQ ID NO: 4188221 - RNA, 16 nt, Yersinia pestis KIM
aaagauuucaucauuc

SEQ ID NO: 4188222 - RNA, 17 nt, Yersinia pestis KIM
aaagauuucaucauuca

SEQ ID NO: 4188223 - RNA, 22 nt, Yersinia pestis KIM
aaagauuucaucauucaauacc

SEQ ID NO: 4188224 - RNA, 20 nt, Yersinia pestis KIM
aaagauuuccuuucgcacuu

SEQ ID NO: 4188225 - RNA, 23 nt, Yersinia pestis KIM
aaagauuuccuuucgcacuuuaa

SEQ ID NO: 4188226 - RNA, 23 nt, Yersinia pestis KIM
aaagcaaacaauuagucacuaaa

SEQ ID NO: 4188227 - RNA, 18 nt, Yersinia pestis KIM
aaagcaaagaucucucga

SEQ ID NO: 4188228 - RNA, 16 nt, Yersinia pestis KIM
aaagcacagacaaaca

SEQ ID NO: 4188229 - RNA, 17 nt, Yersinia pestis KIM
aaagcacagacaaacaa

SEQ ID NO: 4188230 - RNA, 18 nt, Yersinia pestis KIM
aaagcacagacaaacaac

SEQ ID NO: 4188231 - RNA, 20 nt, Yersinia pestis KIM
aaagcagacuugaacuucga

SEQ ID NO: 4188232 - RNA, 13 nt, Yersinia pestis KIM
aaagcagcagcuu

SEQ ID NO: 4188233 - RNA, 12 nt, Yersinia pestis KIM
aaagcagcaguu

SEQ ID NO: 4188234 - RNA, 16 nt, Yersinia pestis KIM
aaagcaggccuucuaa

SEQ ID NO: 4188235 - RNA, 20 nt, Yersinia pestis KIM
aaagcaggccuucuaacucu

SEQ ID NO: 4188236 - RNA, 21 nt, Yersinia pestis KIM
aaagcagucgacaguguaaaa

SEQ ID NO: 4188237 - RNA, 12 nt, Yersinia pestis KIM
aaagcagugcug

SEQ ID NO: 4188238 - RNA, 14 nt, Yersinia pestis KIM
aaagcagugcugaa

SEQ ID NO: 4188239 - RNA, 17 nt, Yersinia pestis KIM
aaagcaucaaucaucug

SEQ ID NO: 4188240 - RNA, 24 nt, Yersinia pestis KIM
aaagcaucaaucaucugcuguaca

SEQ ID NO: 4188241 - RNA, 19 nt, Yersinia pestis KIM
aaagcaucagacugcucuu

SEQ ID NO: 4188242 - RNA, 20 nt, Yersinia pestis KIM
aaagcaucucgauacauacc

SEQ ID NO: 4188243 - RNA, 14 nt, Yersinia pestis KIM
aaagcauuuaucau

SEQ ID NO: 4188244 - RNA, 22 nt, Yersinia pestis KIM
aaagcauuuaucauauuaacau

SEQ ID NO: 4188245 - RNA, 15 nt, Yersinia pestis KIM
aaagccaggugauaa

SEQ ID NO: 4188246 - RNA, 16 nt, Yersinia pestis KIM
aaagccauuagcguug

SEQ ID NO: 4188247 - RNA, 15 nt, Yersinia pestis KIM
aaagcccgcuucaaa

SEQ ID NO: 4188248 - RNA, 15 nt, Yersinia pestis KIM
aaagccgagcaagug

SEQ ID NO: 4188249 - RNA, 15 nt, Yersinia pestis KIM
aaagccgccgccuuc

SEQ ID NO: 4188250 - RNA, 14 nt, Yersinia pestis KIM
aaagccgugggcag

SEQ ID NO: 4188251 - RNA, 17 nt, Yersinia pestis KIM
aaagccugaauucugua

SEQ ID NO: 4188252 - RNA, 19 nt, Yersinia pestis KIM
aaagccugaauucuguaga

SEQ ID NO: 4188253 - RNA, 16 nt, Yersinia pestis KIM
aaagccuguaaaauau

SEQ ID NO: 4188254 - RNA, 17 nt, Yersinia pestis KIM
aaagcgacacuuauugg

SEQ ID NO: 4188255 - RNA, 22 nt, Yersinia pestis KIM
aaagcgacacuuauuggucgcu

SEQ ID NO: 4188256 - RNA, 20 nt, Yersinia pestis KIM
aaagcgauaucguuaucaac

SEQ ID NO: 4188257 - RNA, 20 nt, Yersinia pestis KIM
aaagcgcccuucggacggcu

SEQ ID NO: 4188258 - RNA, 16 nt, Yersinia pestis KIM
aaagcgccugauggcg

SEQ ID NO: 4188259 - RNA, 14 nt, Yersinia pestis KIM
aaagcgccuuccuu

SEQ ID NO: 4188260 - RNA, 18 nt, Yersinia pestis KIM
aaagcgccuuccuuuuau

SEQ ID NO: 4188261 - RNA, 15 nt, Yersinia pestis KIM
aaagcgccuuuuauu

SEQ ID NO: 4188262 - RNA, 15 nt, Yersinia pestis KIM
aaagcggaucguguu

SEQ ID NO: 4188263 - RNA, 18 nt, Yersinia pestis KIM
aaagcgggccagcaacca

SEQ ID NO: 4188264 - RNA, 22 nt, Yersinia pestis KIM
aaagcguccgcgccaaggaagg

SEQ ID NO: 4188265 - RNA, 23 nt, Yersinia pestis KIM
aaagcguccgcgccaaggauggc

SEQ ID NO: 4188266 - RNA, 20 nt, Yersinia pestis KIM
aaagcguccgcgccagggag

SEQ ID NO: 4188267 - RNA, 13 nt, Yersinia pestis KIM
aaagcuauuuuuu

SEQ ID NO: 4188268 - RNA, 20 nt, Yersinia pestis KIM
aauggccgccauuuuuaugu

SEQ ID NO: 4188269 - RNA, 22 nt, Yersinia pestis KIM
aauggccgccauuuuuauguuu

SEQ ID NO: 4188270 - RNA, 12 nt, Yersinia pestis KIM
aauggccuugcc

SEQ ID NO: 4188271 - RNA, 22 nt, Yersinia pestis KIM
aauggcgaaaggaacaaaagag

SEQ ID NO: 4188272 - RNA, 18 nt, Yersinia pestis KIM
aauggcgaauaucaccgu

SEQ ID NO: 4188273 - RNA, 15 nt, Yersinia pestis KIM
aauggcgcaauagca

SEQ ID NO: 4188274 - RNA, 17 nt, Yersinia pestis KIM
aauggcggcgcgauaau

SEQ ID NO: 4188275 - RNA, 13 nt, Yersinia pestis KIM
aauggcugccccc

SEQ ID NO: 4188276 - RNA, 13 nt, Yersinia pestis KIM
aauggguguuauu

SEQ ID NO: 4188277 - RNA, 17 nt, Yersinia pestis KIM
aaugguaccggcaccaa

SEQ ID NO: 4188278 - RNA, 18 nt, Yersinia pestis KIM
aaugguauuugaaauauu

SEQ ID NO: 4188279 - RNA, 12 nt, Yersinia pestis KIM
aauggugaacaa

SEQ ID NO: 4188280 - RNA, 14 nt, Yersinia pestis KIM
aauggugcccauca

SEQ ID NO: 4188281 - RNA, 17 nt, Yersinia pestis KIM
aaugguguaaaugcccg

SEQ ID NO: 4188282 - RNA, 17 nt, Yersinia pestis KIM
aaugguugaaugaccaa

SEQ ID NO: 4188283 - RNA, 22 nt, Yersinia pestis KIM
aaugguuguuaauuaagauuaa

SEQ ID NO: 4188284 - RNA, 23 nt, Yersinia pestis KIM
aaugguuuccuucaccaaaaaaa

SEQ ID NO: 4188285 - RNA, 20 nt, Yersinia pestis KIM
aaugguuugcuguucuugca

SEQ ID NO: 4188286 - RNA, 14 nt, Yersinia pestis KIM
aaugguuuggccau

SEQ ID NO: 4188287 - RNA, 21 nt, Yersinia pestis KIM
aauguaaaacgaguaaauaca

SEQ ID NO: 4188288 - RNA, 23 nt, Yersinia pestis KIM
aauguaaaacgaguaaauacaaa

SEQ ID NO: 4188289 - RNA, 14 nt, Yersinia pestis KIM
aauguauuuauuca

SEQ ID NO: 4188290 - RNA, 15 nt, Yersinia pestis KIM
aauguauuuauucaa

SEQ ID NO: 4188291 - RNA, 15 nt, Yersinia pestis KIM
aaugucaccacggcu

SEQ ID NO: 4188292 - RNA, 16 nt, Yersinia pestis KIM
aaugucacgcuuuaaa

SEQ ID NO: 4188293 - RNA, 15 nt, Yersinia pestis KIM
aaugugaugaaacua

SEQ ID NO: 4188294 - RNA, 22 nt, Yersinia pestis KIM
aaugugaugaaacuaaaauaau

SEQ ID NO: 4188295 - RNA, 18 nt, Yersinia pestis KIM
aaugugccguaacucacc

SEQ ID NO: 4188296 - RNA, 19 nt, Yersinia pestis KIM
aauguuaauauuuuacugc

SEQ ID NO: 4188297 - RNA, 18 nt, Yersinia pestis KIM
aauguucgcugacagagu

SEQ ID NO: 4188298 - RNA, 16 nt, Yersinia pestis KIM
aauguucggucauaau

SEQ ID NO: 4188299 - RNA, 15 nt, Yersinia pestis KIM
aauguugcaaacgga

SEQ ID NO: 4188300 - RNA, 16 nt, Yersinia pestis KIM
aauguugcugaauaaa

SEQ ID NO: 4188301 - RNA, 18 nt, Yersinia pestis KIM
aauguuuuacgaucaacc

SEQ ID NO: 4188302 - RNA, 19 nt, Yersinia pestis KIM
aauuaaaaagaguguucau

SEQ ID NO: 4188303 - RNA, 15 nt, Yersinia pestis KIM
aauuaaaaauuaauu

SEQ ID NO: 4188304 - RNA, 17 nt, Yersinia pestis KIM
aauuaaaacugaaaagu

SEQ ID NO: 4188305 - RNA, 13 nt, Yersinia pestis KIM
aauuaaaccucag

SEQ ID NO: 4188306 - RNA, 16 nt, Yersinia pestis KIM
aauuaaaccucagaaa

SEQ ID NO: 4188307 - RNA, 18 nt, Yersinia pestis KIM
aauuaaacgcucaucaac

SEQ ID NO: 4188308 - RNA, 19 nt, Yersinia pestis KIM
aauuaaacgcucaucaacc

SEQ ID NO: 4188309 - RNA, 14 nt, Yersinia pestis KIM
aauuaaauuuuaua

SEQ ID NO: 4188310 - RNA, 15 nt, Yersinia pestis KIM
aauuaaauuuuauau

SEQ ID NO: 4188311 - RNA, 20 nt, Yersinia pestis KIM
aauuaacacccaauaauaaa

SEQ ID NO: 4188312 - RNA, 21 nt, Yersinia pestis KIM
aauuaacacccaauaauaaaa

SEQ ID NO: 4188313 - RNA, 22 nt, Yersinia pestis KIM
aauuaacacccaauaauaaaaa

SEQ ID NO: 4188314 - RNA, 13 nt, Yersinia pestis KIM
aauuaagcaaaaa

SEQ ID NO: 4188315 - RNA, 20 nt, Yersinia pestis KIM
aauuaagcuauugguuauug

SEQ ID NO: 4188316 - RNA, 12 nt, Yersinia pestis KIM
aauuaaggaaaa

SEQ ID NO: 4188317 - RNA, 17 nt, Yersinia pestis KIM
aauuaaggaaacucaug

SEQ ID NO: 4188318 - RNA, 11 nt, Yersinia pestis KIM
aauuaauaucc

SEQ ID NO: 4188319 - RNA, 22 nt, Yersinia pestis KIM
aauuaaucuuguaaagacgcua

SEQ ID NO: 4188320 - RNA, 20 nt, Yersinia pestis KIM
aauuaauuacuuuauuuaaa

SEQ ID NO: 4188321 - RNA, 13 nt, Yersinia pestis KIM
aauuaauuauaag

SEQ ID NO: 4188322 - RNA, 13 nt, Yersinia pestis KIM
aauuaauuuaaac

SEQ ID NO: 4188323 - RNA, 16 nt, Yersinia pestis KIM
aauuacaaaaucucaa

SEQ ID NO: 4188324 - RNA, 13 nt, Yersinia pestis KIM
aauuacacacccu

SEQ ID NO: 4188325 - RNA, 21 nt, Yersinia pestis KIM
aauuacacacccucaacucaa

SEQ ID NO: 4188326 - RNA, 14 nt, Yersinia pestis KIM
aauuacgcacugcc

SEQ ID NO: 4188327 - RNA, 15 nt, Yersinia pestis KIM
aauuacgcacugccu

SEQ ID NO: 4188328 - RNA, 22 nt, Yersinia pestis KIM
aauuacggcucaguugaugcaa

SEQ ID NO: 4188329 - RNA, 17 nt, Yersinia pestis KIM
aauuacucguauaaaaa

SEQ ID NO: 4188330 - RNA, 20 nt, Yersinia pestis KIM
aauuacucguauaaaaaaua

SEQ ID NO: 4188331 - RNA, 20 nt, Yersinia pestis KIM
aauuacugacgcuuauccug

SEQ ID NO: 4188332 - RNA, 18 nt, Yersinia pestis KIM
aauuacuucgcuuuaccc

SEQ ID NO: 4188333 - RNA, 21 nt, Yersinia pestis KIM
aauuagcgccuccggcgacua

SEQ ID NO: 4188334 - RNA, 19 nt, Yersinia pestis KIM
aauuaggcuucuaacaaua

SEQ ID NO: 4188335 - RNA, 21 nt, Yersinia pestis KIM
aauuagguaacuuuccaucca

SEQ ID NO: 4188336 - RNA, 15 nt, Yersinia pestis KIM
aauuagucucuuauu

SEQ ID NO: 4188337 - RNA, 15 nt, Yersinia pestis KIM
aauuauaaugaugua

SEQ ID NO: 4188338 - RNA, 13 nt, Yersinia pestis KIM
aauuauagugaaa

SEQ ID NO: 4188339 - RNA, 14 nt, Yersinia pestis KIM
aauuauauucuugg

SEQ ID NO: 4188340 - RNA, 13 nt, Yersinia pestis KIM
aauuaucaucaau

SEQ ID NO: 4188341 - RNA, 18 nt, Yersinia pestis KIM
aauuauccauuuucugcc

SEQ ID NO: 4188342 - RNA, 20 nt, Yersinia pestis KIM
aauuaucgaucacaugcuca

SEQ ID NO: 4188343 - RNA, 14 nt, Yersinia pestis KIM
aauuaucuuaucca

SEQ ID NO: 4188344 - RNA, 18 nt, Yersinia pestis KIM
aauuaucuuauccacagc

SEQ ID NO: 4188345 - RNA, 20 nt, Yersinia pestis KIM
aauuaugacggguauauuua

SEQ ID NO: 4188346 - RNA, 12 nt, Yersinia pestis KIM
aauuaugauaaa

SEQ ID NO: 4188347 - RNA, 15 nt, Yersinia pestis KIM
aauuaugauaaaugg

SEQ ID NO: 4188348 - RNA, 12 nt, Yersinia pestis KIM
aauuauuaaaua

SEQ ID NO: 4188349 - RNA, 17 nt, Yersinia pestis KIM
aauuauugccgcagaua

SEQ ID NO: 4188350 - RNA, 17 nt, Yersinia pestis KIM
aauuauuguucaaaaac

SEQ ID NO: 4188351 - RNA, 18 nt, Yersinia pestis KIM
aauuauuucucugaugaa

SEQ ID NO: 4188352 - RNA, 16 nt, Yersinia pestis KIM
aauuauuuuauuuaaa

SEQ ID NO: 4188353 - RNA, 11 nt, Yersinia pestis KIM
aauucaaaaua

SEQ ID NO: 4188354 - RNA, 16 nt, Yersinia pestis KIM
aauucaaaauguauua

SEQ ID NO: 4188355 - RNA, 13 nt, Yersinia pestis KIM
aauucaaauauca

SEQ ID NO: 4188356 - RNA, 14 nt, Yersinia pestis KIM
aauucaaauaucau

SEQ ID NO: 4188357 - RNA, 14 nt, Yersinia pestis KIM
aauucaagagaggu

SEQ ID NO: 4188358 - RNA, 15 nt, Yersinia pestis KIM
aauucaccagcaaua

SEQ ID NO: 4188359 - RNA, 19 nt, Yersinia pestis KIM
aauucacgcaaggccaggu

SEQ ID NO: 4188360 - RNA, 15 nt, Yersinia pestis KIM
aauucacgccuaucu

SEQ ID NO: 4188361 - RNA, 14 nt, Yersinia pestis KIM
aauucacguuuacu

SEQ ID NO: 4188362 - RNA, 15 nt, Yersinia pestis KIM
aauucacugcuuaau

SEQ ID NO: 4188363 - RNA, 22 nt, Yersinia pestis KIM
aauucagacggcagauccugaa

SEQ ID NO: 4188364 - RNA, 18 nt, Yersinia pestis KIM
aauucagauaagaucuca

SEQ ID NO: 4188365 - RNA, 22 nt, Yersinia pestis KIM
aauucagaugagaaucucucca

SEQ ID NO: 4188366 - RNA, 16 nt, Yersinia pestis KIM
aauucagccucauaca

SEQ ID NO: 4188367 - RNA, 20 nt, Yersinia pestis KIM
aauucauacggcgauauuua

SEQ ID NO: 4188368 - RNA, 20 nt, Yersinia pestis KIM
aauucaucagauuguuuaua

SEQ ID NO: 4188369 - RNA, 15 nt, Yersinia pestis KIM
aauucaucuuuaaca

SEQ ID NO: 4188370 - RNA, 16 nt, Yersinia pestis KIM
aauucaugugagauaa

SEQ ID NO: 4188371 - RNA, 18 nt, Yersinia pestis KIM
aauucaugugagauaaca

SEQ ID NO: 4188372 - RNA, 16 nt, Yersinia pestis KIM
aauucauguugccaau

SEQ ID NO: 4188373 - RNA, 14 nt, Yersinia pestis KIM
aauucauuauuacu

SEQ ID NO: 4188374 - RNA, 15 nt, Yersinia pestis KIM
aauucauuauuacuc

SEQ ID NO: 4188375 - RNA, 22 nt, Yersinia pestis KIM
aauucauuauuacucagcacau

SEQ ID NO: 4188376 - RNA, 22 nt, Yersinia pestis KIM
aauuccaccauucucaaaauaa

SEQ ID NO: 4188377 - RNA, 21 nt, Yersinia pestis KIM
aauuccauuuaagccaauaau

SEQ ID NO: 4188378 - RNA, 17 nt, Yersinia pestis KIM
aauucccccaaaaccuc

SEQ ID NO: 4188379 - RNA, 23 nt, Yersinia pestis KIM
aauucccgucagguucaauuccc

SEQ ID NO: 4188380 - RNA, 18 nt, Yersinia pestis KIM
aauuccgccaguggcuuu

SEQ ID NO: 4188381 - RNA, 13 nt, Yersinia pestis KIM
aauuccuauaaau

SEQ ID NO: 4188382 - RNA, 19 nt, Yersinia pestis KIM
aauuccuauaaauuuuaag

SEQ ID NO: 4188383 - RNA, 22 nt, Yersinia pestis KIM
aauuccuauaaauuuuaaguua

SEQ ID NO: 4188384 - RNA, 16 nt, Yersinia pestis KIM
aauucgauaacagcua

SEQ ID NO: 4188385 - RNA, 20 nt, Yersinia pestis KIM
aaagcucugacaaaaugcca

SEQ ID NO: 4188386 - RNA, 22 nt, Yersinia pestis KIM
aaagcucugacaaaaugccaga

SEQ ID NO: 4188387 - RNA, 20 nt, Yersinia pestis KIM
aaagcugucaguccaaaaua

SEQ ID NO: 4188388 - RNA, 14 nt, Yersinia pestis KIM
aaagcugucauaaa

SEQ ID NO: 4188389 - RNA, 19 nt, Yersinia pestis KIM
aaagcugucauaaaaaaag

SEQ ID NO: 4188390 - RNA, 17 nt, Yersinia pestis KIM
aaagcuuacuguucacc

SEQ ID NO: 4188391 - RNA, 21 nt, Yersinia pestis KIM
aaagcuuccaauauugagcag

SEQ ID NO: 4188392 - RNA, 11 nt, Yersinia pestis KIM
aaaggaaggga

SEQ ID NO: 4188393 - RNA, 11 nt, Yersinia pestis KIM
aaaggaagggg

SEQ ID NO: 4188394 - RNA, 19 nt, Yersinia pestis KIM
aaaggaauaucugugauaa

SEQ ID NO: 4188395 - RNA, 18 nt, Yersinia pestis KIM
aaaggauuugaagacaac

SEQ ID NO: 4188396 - RNA, 23 nt, Yersinia pestis KIM
aaaggauuugaagacaacucuuc

SEQ ID NO: 4188397 - RNA, 19 nt, Yersinia pestis KIM
aaaggauuuuauuaaauca

SEQ ID NO: 4188398 - RNA, 23 nt, Yersinia pestis KIM
aaaggcaaaaugaucaucagcag

SEQ ID NO: 4188399 - RNA, 13 nt, Yersinia pestis KIM
aaaggcaaagaag

SEQ ID NO: 4188400 - RNA, 15 nt, Yersinia pestis KIM
aaaggcaaagaagaa

SEQ ID NO: 4188401 - RNA, 21 nt, Yersinia pestis KIM
aaaggcauccccggcaccaac

SEQ ID NO: 4188402 - RNA, 21 nt, Yersinia pestis KIM
aaaggccggauguaaaacacg

SEQ ID NO: 4188403 - RNA, 12 nt, Yersinia pestis KIM
aaaggcgcugga

SEQ ID NO: 4188404 - RNA, 19 nt, Yersinia pestis KIM
aaaggcggugauaaacccu

SEQ ID NO: 4188405 - RNA, 14 nt, Yersinia pestis KIM
aaaggcugcaccuu

SEQ ID NO: 4188406 - RNA, 17 nt, Yersinia pestis KIM
aaaggcugcaccuuaca

SEQ ID NO: 4188407 - RNA, 11 nt, Yersinia pestis KIM
aaagguaaaca

SEQ ID NO: 4188408 - RNA, 21 nt, Yersinia pestis KIM
aaagguaugugccaaaaaaag

SEQ ID NO: 4188409 - RNA, 16 nt, Yersinia pestis KIM
aaaggucccuuugaca

SEQ ID NO: 4188410 - RNA, 19 nt, Yersinia pestis KIM
aaaggucguugccuguagc

SEQ ID NO: 4188411 - RNA, 14 nt, Yersinia pestis KIM
aaagguuaacugca

SEQ ID NO: 4188412 - RNA, 17 nt, Yersinia pestis KIM
aaagguuaacugcagug

SEQ ID NO: 4188413 - RNA, 18 nt, Yersinia pestis KIM
aaagguuggaacaccaaa

SEQ ID NO: 4188414 - RNA, 21 nt, Yersinia pestis KIM
aaagguuucugccuuaucaau

SEQ ID NO: 4188415 - RNA, 22 nt, Yersinia pestis KIM
aaagguuucugccuuaucaauc

SEQ ID NO: 4188416 - RNA, 13 nt, Yersinia pestis KIM
aaaguaauuuauc

SEQ ID NO: 4188417 - RNA, 17 nt, Yersinia pestis KIM
aaaguacgcaaaauaag

SEQ ID NO: 4188418 - RNA, 18 nt, Yersinia pestis KIM
aaaguaucgcuaucaccg

SEQ ID NO: 4188419 - RNA, 13 nt, Yersinia pestis KIM
aaagucacacugu

SEQ ID NO: 4188420 - RNA, 21 nt, Yersinia pestis KIM
aaagucauuggcguuacagca

SEQ ID NO: 4188421 - RNA, 21 nt, Yersinia pestis KIM
aaagucauugguguuacagca

SEQ ID NO: 4188422 - RNA, 21 nt, Yersinia pestis KIM
aaagucgguguaguguuuggu

SEQ ID NO: 4188423 - RNA, 20 nt, Yersinia pestis KIM
aaagucguucuuuggcauca

SEQ ID NO: 4188424 - RNA, 13 nt, Yersinia pestis KIM
aaagucuuaaucu

SEQ ID NO: 4188425 - RNA, 15 nt, Yersinia pestis KIM
aaagugacgaaugag

SEQ ID NO: 4188426 - RNA, 23 nt, Yersinia pestis KIM
aaagugagaaggguauugaagau

SEQ ID NO: 4188427 - RNA, 22 nt, Yersinia pestis KIM
aaagugcuauccucuuaauguc

SEQ ID NO: 4188428 - RNA, 23 nt, Yersinia pestis KIM
aaaguuaggguucaguaaaacca

SEQ ID NO: 4188429 - RNA, 15 nt, Yersinia pestis KIM
aaaguugagcagcaa

SEQ ID NO: 4188430 - RNA, 21 nt, Yersinia pestis KIM
aaaguugagcagcaauaacuc

SEQ ID NO: 4188431 - RNA, 21 nt, Yersinia pestis KIM
aaauaaaaacgcagauuugua

SEQ ID NO: 4188432 - RNA, 11 nt, Yersinia pestis KIM
aaauaaaaaug

SEQ ID NO: 4188433 - RNA, 11 nt, Yersinia pestis KIM
aaauaaaacaa

SEQ ID NO: 4188434 - RNA, 14 nt, Yersinia pestis KIM
aaauaaaauaauaa

SEQ ID NO: 4188435 - RNA, 17 nt, Yersinia pestis KIM
aaauaaaauaauaaugg

SEQ ID NO: 4188436 - RNA, 14 nt, Yersinia pestis KIM
aaauaaaauagcgu

SEQ ID NO: 4188437 - RNA, 14 nt, Yersinia pestis KIM
aaauaaacaucaau

SEQ ID NO: 4188438 - RNA, 20 nt, Yersinia pestis KIM
aaauaaacgcgaguuaggaa

SEQ ID NO: 4188439 - RNA, 21 nt, Yersinia pestis KIM
aaauaaacgggcuuccaucag

SEQ ID NO: 4188440 - RNA, 16 nt, Yersinia pestis KIM
aaauaaagauaaugug

SEQ ID NO: 4188441 - RNA, 11 nt, Yersinia pestis KIM
aaauaaauaag

SEQ ID NO: 4188442 - RNA, 12 nt, Yersinia pestis KIM
aaauaacagcua

SEQ ID NO: 4188443 - RNA, 22 nt, Yersinia pestis KIM
aaauaacccgccuagcaucaua

SEQ ID NO: 4188444 - RNA, 14 nt, Yersinia pestis KIM
aaauaaccgagcgu

SEQ ID NO: 4188445 - RNA, 17 nt, Yersinia pestis KIM
aaauaaccgccaaaaua

SEQ ID NO: 4188446 - RNA, 21 nt, Yersinia pestis KIM
aaauaaccgccaaaauaucgc

SEQ ID NO: 4188447 - RNA, 13 nt, Yersinia pestis KIM
aaauaacgcaaaa

SEQ ID NO: 4188448 - RNA, 15 nt, Yersinia pestis KIM
aaauaacguaguacu

SEQ ID NO: 4188449 - RNA, 16 nt, Yersinia pestis KIM
aaauaacugccagggc

SEQ ID NO: 4188450 - RNA, 17 nt, Yersinia pestis KIM
aaauaagaucaauaugu

SEQ ID NO: 4188451 - RNA, 12 nt, Yersinia pestis KIM
aaauaagccagu

SEQ ID NO: 4188452 - RNA, 14 nt, Yersinia pestis KIM
aaauaagccagugc

SEQ ID NO: 4188453 - RNA, 20 nt, Yersinia pestis KIM
aaauaagcguagggauaaau

SEQ ID NO: 4188454 - RNA, 13 nt, Yersinia pestis KIM
aaauaaggcgcug

SEQ ID NO: 4188455 - RNA, 22 nt, Yersinia pestis KIM
aaauaaguauuucaaauaagug

SEQ ID NO: 4188456 - RNA, 21 nt, Yersinia pestis KIM
aaauaauaauggugaaccaga

SEQ ID NO: 4188457 - RNA, 23 nt, Yersinia pestis KIM
aaauaauaucaagucuugaagag

SEQ ID NO: 4188458 - RNA, 13 nt, Yersinia pestis KIM
aaauaauaucaau

SEQ ID NO: 4188459 - RNA, 23 nt, Yersinia pestis KIM
aaauaaucauaucaaaauaaaaa

SEQ ID NO: 4188460 - RNA, 23 nt, Yersinia pestis KIM
aaauaauccauagauuauuuuua

SEQ ID NO: 4188461 - RNA, 19 nt, Yersinia pestis KIM
aaauaaucggcaaaccgaa

SEQ ID NO: 4188462 - RNA, 14 nt, Yersinia pestis KIM
aaauaauggccaag

SEQ ID NO: 4188463 - RNA, 22 nt, Yersinia pestis KIM
aaauaauguccccuugaguauc

SEQ ID NO: 4188464 - RNA, 12 nt, Yersinia pestis KIM
aaauaauuaaac

SEQ ID NO: 4188465 - RNA, 22 nt, Yersinia pestis KIM
aaauaauuaaaccucagaaaaa

SEQ ID NO: 4188466 - RNA, 23 nt, Yersinia pestis KIM
aaauaauuaaaccucagaaaaau

SEQ ID NO: 4188467 - RNA, 16 nt, Yersinia pestis KIM
aaauaauuacuuauaa

SEQ ID NO: 4188468 - RNA, 15 nt, Yersinia pestis KIM
aaauacaaaaauaca

SEQ ID NO: 4188469 - RNA, 20 nt, Yersinia pestis KIM
aaauacaaauaaaauaaauc

SEQ ID NO: 4188470 - RNA, 13 nt, Yersinia pestis KIM
aaauacaaccaac

SEQ ID NO: 4188471 - RNA, 15 nt, Yersinia pestis KIM
aaauacaaccaacaa

SEQ ID NO: 4188472 - RNA, 17 nt, Yersinia pestis KIM
aaauacaaccaacaaac

SEQ ID NO: 4188473 - RNA, 16 nt, Yersinia pestis KIM
aaauacauaauaauga

SEQ ID NO: 4188474 - RNA, 21 nt, Yersinia pestis KIM
aaauacauaauaaugaugaac

SEQ ID NO: 4188475 - RNA, 17 nt, Yersinia pestis KIM
aaauaccaacccgauac

SEQ ID NO: 4188476 - RNA, 16 nt, Yersinia pestis KIM
aaauaccaauuaauaa

SEQ ID NO: 4188477 - RNA, 22 nt, Yersinia pestis KIM
aaauaccugaguagcauaaaaa

SEQ ID NO: 4188478 - RNA, 23 nt, Yersinia pestis KIM
aaauacggccagucaaaagaaac

SEQ ID NO: 4188479 - RNA, 24 nt, Yersinia pestis KIM
aaauacggcgaaauauaaaacagu

SEQ ID NO: 4188480 - RNA, 23 nt, Yersinia pestis KIM
aaauacugcacguuuaauuucac

SEQ ID NO: 4188481 - RNA, 12 nt, Yersinia pestis KIM
aaauacuuauuu

SEQ ID NO: 4188482 - RNA, 16 nt, Yersinia pestis KIM
aaauagacucaacaaa

SEQ ID NO: 4188483 - RNA, 11 nt, Yersinia pestis KIM
aaauagagcac

SEQ ID NO: 4188484 - RNA, 16 nt, Yersinia pestis KIM
aaauagagcaccaaau

SEQ ID NO: 4188485 - RNA, 18 nt, Yersinia pestis KIM
aaauagagcaccaaaucu

SEQ ID NO: 4188486 - RNA, 21 nt, Yersinia pestis KIM
aaauagagcaccaaaucuucc

SEQ ID NO: 4188487 - RNA, 14 nt, Yersinia pestis KIM
aaauagauaaaaac

SEQ ID NO: 4188488 - RNA, 23 nt, Yersinia pestis KIM
aaauagauaaaaacauuuaaaua

SEQ ID NO: 4188489 - RNA, 20 nt, Yersinia pestis KIM
aaauagauagcaaucaauaa

SEQ ID NO: 4188490 - RNA, 14 nt, Yersinia pestis KIM
aaauagauaucgaa

SEQ ID NO: 4188491 - RNA, 15 nt, Yersinia pestis KIM
aaauagcaagccaaa

SEQ ID NO: 4188492 - RNA, 13 nt, Yersinia pestis KIM
aaauagccuguaa

SEQ ID NO: 4188493 - RNA, 14 nt, Yersinia pestis KIM
aaauagccuuccuu

SEQ ID NO: 4188494 - RNA, 16 nt, Yersinia pestis KIM
aaauagcggccaacau

SEQ ID NO: 4188495 - RNA, 18 nt, Yersinia pestis KIM
aaauagcggccaacauaa

SEQ ID NO: 4188496 - RNA, 21 nt, Yersinia pestis KIM
aaauagcggccaacauaauca

SEQ ID NO: 4188497 - RNA, 23 nt, Yersinia pestis KIM
aaauagcggccaacauaaucaau

SEQ ID NO: 4188498 - RNA, 18 nt, Yersinia pestis KIM
aaauaggcguuaucggcg

SEQ ID NO: 4188499 - RNA, 21 nt, Yersinia pestis KIM
aaauagggaagguguuuaaaa

SEQ ID NO: 4188500 - RNA, 20 nt, Yersinia pestis KIM
aaauaggugcgccaguggca

SEQ ID NO: 4188501 - RNA, 22 nt, Yersinia pestis KIM
aaauagucagugggcuauuuau

SEQ ID NO: 4188502 - RNA, 21 nt, Yersinia pestis KIM
aaauagucguuauauaaaugg

SEQ ID NO: 4188503 - RNA, 15 nt, Yersinia pestis KIM
aaauaguggcacaaa

SEQ ID NO: 4188504 - RNA, 21 nt, Yersinia pestis KIM
aaauaguuacuauauaaauga

SEQ ID NO: 4188505 - RNA, 19 nt, Yersinia pestis KIM
aaauaguugcuaucaauaa

SEQ ID NO: 4188506 - RNA, 18 nt, Yersinia pestis KIM
aaauaguuguuagccacu

SEQ ID NO: 4188507 - RNA, 13 nt, Yersinia pestis KIM
aaauauaaaauaa

SEQ ID NO: 4188508 - RNA, 22 nt, Yersinia pestis KIM
aaauauaagauuccuuaccuga

SEQ ID NO: 4188509 - RNA, 22 nt, Yersinia pestis KIM
aaauauccuccggcauagccgg

SEQ ID NO: 4188510 - RNA, 16 nt, Yersinia pestis KIM
aaauauccugcucagc

SEQ ID NO: 4188511 - RNA, 20 nt, Yersinia pestis KIM
aaauauccugcucagcuaaa

SEQ ID NO: 4188512 - RNA, 17 nt, Yersinia pestis KIM
aaauaugaucuugauaa

SEQ ID NO: 4188513 - RNA, 20 nt, Yersinia pestis KIM
aaauauggguuaaaaacuuu

SEQ ID NO: 4188514 - RNA, 15 nt, Yersinia pestis KIM
aaauauucauuaaaa

SEQ ID NO: 4188515 - RNA, 18 nt, Yersinia pestis KIM
aaauauucauuaaaaaau

SEQ ID NO: 4188516 - RNA, 22 nt, Yersinia pestis KIM
aaauauucauuaaaaaauaauu

SEQ ID NO: 4188517 - RNA, 21 nt, Yersinia pestis KIM
aaauauucuaaguaaaacaaa

SEQ ID NO: 4188518 - RNA, 13 nt, Yersinia pestis KIM
aaaucaaaaauga

SEQ ID NO: 4188519 - RNA, 21 nt, Yersinia pestis KIM
aaaucaaaaggaacguggcgu

SEQ ID NO: 4188520 - RNA, 14 nt, Yersinia pestis KIM
aaaucaaagugaga

SEQ ID NO: 4188521 - RNA, 14 nt, Yersinia pestis KIM
aaaucaagggcgau

SEQ ID NO: 4188522 - RNA, 18 nt, Yersinia pestis KIM
aaaucaagggcgauggca

SEQ ID NO: 4188523 - RNA, 17 nt, Yersinia pestis KIM
aaaucaauaucgcuaaa

SEQ ID NO: 4188524 - RNA, 17 nt, Yersinia pestis KIM
aaaucacaauuucaccc

SEQ ID NO: 4188525 - RNA, 16 nt, Yersinia pestis KIM
aaaucaccaaauccaa

SEQ ID NO: 4188526 - RNA, 18 nt, Yersinia pestis KIM
aaaucacccgcaagaaua

SEQ ID NO: 4188527 - RNA, 15 nt, Yersinia pestis KIM
aaaucaccgccggau

SEQ ID NO: 4188528 - RNA, 22 nt, Yersinia pestis KIM
aaaucacguucauccgcagcaa

SEQ ID NO: 4188529 - RNA, 13 nt, Yersinia pestis KIM
aaaucacuucuuc

SEQ ID NO: 4188530 - RNA, 17 nt, Yersinia pestis KIM
aaaucagaggcuucauu

SEQ ID NO: 4188531 - RNA, 15 nt, Yersinia pestis KIM
aaaucagcuucauua

SEQ ID NO: 4188532 - RNA, 16 nt, Yersinia pestis KIM
aaaucaggcuguucuu

SEQ ID NO: 4188533 - RNA, 11 nt, Yersinia pestis KIM
aaaucagggca

SEQ ID NO: 4188534 - RNA, 22 nt, Yersinia pestis KIM
aaaucagugaaggaugaauaaa

SEQ ID NO: 4188535 - RNA, 23 nt, Yersinia pestis KIM
aaaucagugaaggaugaauaaau

SEQ ID NO: 4188536 - RNA, 16 nt, Yersinia pestis KIM
aaaucaguguaucaau

SEQ ID NO: 4188537 - RNA, 15 nt, Yersinia pestis KIM
aaaucauagccagcg

SEQ ID NO: 4188538 - RNA, 15 nt, Yersinia pestis KIM
aaaucaugaaauuuu

SEQ ID NO: 4188539 - RNA, 18 nt, Yersinia pestis KIM
aaaucauggcauaaaccg

SEQ ID NO: 4188540 - RNA, 23 nt, Yersinia pestis KIM
aaauccaccagcgggcggcagau

SEQ ID NO: 4188541 - RNA, 14 nt, Yersinia pestis KIM
aaauccacuacucg

SEQ ID NO: 4188542 - RNA, 14 nt, Yersinia pestis KIM
aaauccccauucca

SEQ ID NO: 4188543 - RNA, 15 nt, Yersinia pestis KIM
aaauccccauuccaa

SEQ ID NO: 4188544 - RNA, 17 nt, Yersinia pestis KIM
aaaucccccaccaguaa

SEQ ID NO: 4188545 - RNA, 21 nt, Yersinia pestis KIM
aaaucccggcauauuauuugu

SEQ ID NO: 4188546 - RNA, 22 nt, Yersinia pestis KIM
aaauccgacugauagcaaacaa

SEQ ID NO: 4188547 - RNA, 20 nt, Yersinia pestis KIM
aaauccgugcugguccuuuu

SEQ ID NO: 4188548 - RNA, 19 nt, Yersinia pestis KIM
aaauccugaauaauacugu

SEQ ID NO: 4188549 - RNA, 13 nt, Yersinia pestis KIM
aaaucgaaauuaa

SEQ ID NO: 4188550 - RNA, 14 nt, Yersinia pestis KIM
aaaucgauacuuuu

SEQ ID NO: 4188551 - RNA, 16 nt, Yersinia pestis KIM
aaaucgauacuuuuua

SEQ ID NO: 4188552 - RNA, 16 nt, Yersinia pestis KIM
aaaucgccaaacugcu

SEQ ID NO: 4188553 - RNA, 19 nt, Yersinia pestis KIM
aaaucgccaaacugcucau

SEQ ID NO: 4188554 - RNA, 19 nt, Yersinia pestis KIM
aaaucguaaucaccauuaa

SEQ ID NO: 4188555 - RNA, 16 nt, Yersinia pestis KIM
aaaucguauaacauaa

SEQ ID NO: 4188556 - RNA, 20 nt, Yersinia pestis KIM
aaaucgucgaacauuuucua

SEQ ID NO: 4188557 - RNA, 19 nt, Yersinia pestis KIM
aaaucuacaaagucugaua

SEQ ID NO: 4188558 - RNA, 20 nt, Yersinia pestis KIM
aaaucuccuguggcacauca

SEQ ID NO: 4188559 - RNA, 22 nt, Yersinia pestis KIM
aaaucuccuguggcacaucaau

SEQ ID NO: 4188560 - RNA, 18 nt, Yersinia pestis KIM
aaaucucuugauuaccaa

SEQ ID NO: 4188561 - RNA, 23 nt, Yersinia pestis KIM
aaaucucuugauuaccaauaauu

SEQ ID NO: 4188562 - RNA, 21 nt, Yersinia pestis KIM
aaaucugacucuguaaaaauc

SEQ ID NO: 4188563 - RNA, 14 nt, Yersinia pestis KIM
aaaucugcuucucc

SEQ ID NO: 4188564 - RNA, 19 nt, Yersinia pestis KIM
aaaucuuguuaauuuaaac

SEQ ID NO: 4188565 - RNA, 16 nt, Yersinia pestis KIM
aaaucuuuguuacaua

SEQ ID NO: 4188566 - RNA, 21 nt, Yersinia pestis KIM
aaaugaagggggcuuauucua

SEQ ID NO: 4188567 - RNA, 19 nt, Yersinia pestis KIM
aaaugacauauugugcuau

SEQ ID NO: 4188568 - RNA, 16 nt, Yersinia pestis KIM
aaaugacuaucccuuc

SEQ ID NO: 4188569 - RNA, 18 nt, Yersinia pestis KIM
aaaugagaauaucuauau

SEQ ID NO: 4188570 - RNA, 12 nt, Yersinia pestis KIM
aaaugagccugu

SEQ ID NO: 4188571 - RNA, 16 nt, Yersinia pestis KIM
aaaugagucauuaucu

SEQ ID NO: 4188572 - RNA, 22 nt, Yersinia pestis KIM
aaaugauaugcuuauaaaccua

SEQ ID NO: 4188573 - RNA, 21 nt, Yersinia pestis KIM
aaaugaucaucaagccaaugg

SEQ ID NO: 4188574 - RNA, 21 nt, Yersinia pestis KIM
aaaugaugaaaauugcaggug

SEQ ID NO: 4188575 - RNA, 19 nt, Yersinia pestis KIM
aaaugcaccgcccagauuc

SEQ ID NO: 4188576 - RNA, 17 nt, Yersinia pestis KIM
aaaugcauuauaaggaa

SEQ ID NO: 4188577 - RNA, 12 nt, Yersinia pestis KIM
aaaugccagaau

SEQ ID NO: 4188578 - RNA, 20 nt, Yersinia pestis KIM
aaaugcccgucgggauaucu

SEQ ID NO: 4188579 - RNA, 17 nt, Yersinia pestis KIM
aaaugccgauaaaaacu

SEQ ID NO: 4188580 - RNA, 15 nt, Yersinia pestis KIM
aaaugccgccugacu

SEQ ID NO: 4188581 - RNA, 17 nt, Yersinia pestis KIM
aaaugccguacaacaau

SEQ ID NO: 4188582 - RNA, 19 nt, Yersinia pestis KIM
aaaugcggcggcugaccac

SEQ ID NO: 4188583 - RNA, 19 nt, Yersinia pestis KIM
aaaugcguagagucaguga

SEQ ID NO: 4188584 - RNA, 20 nt, Yersinia pestis KIM
aaaugcuuuuugcgcugcgu

SEQ ID NO: 4188585 - RNA, 16 nt, Yersinia pestis KIM
aaauggcaacaucagg

SEQ ID NO: 4188586 - RNA, 18 nt, Yersinia pestis KIM
aaauggcagcccuuauuc

SEQ ID NO: 4188587 - RNA, 22 nt, Yersinia pestis KIM
aaauggcguuuaaaguaaauca

SEQ ID NO: 4188588 - RNA, 13 nt, Yersinia pestis KIM
aaauggcugcguu

SEQ ID NO: 4188589 - RNA, 23 nt, Yersinia pestis KIM
aaauggcuuuuuuaauaaaaaac

SEQ ID NO: 4188590 - RNA, 14 nt, Yersinia pestis KIM
aaauggucaggaac

SEQ ID NO: 4188591 - RNA, 20 nt, Yersinia pestis KIM
aaauguaagcguaauucagc

SEQ ID NO: 4188592 - RNA, 16 nt, Yersinia pestis KIM
aaauguaagcuacuaa

SEQ ID NO: 4188593 - RNA, 19 nt, Yersinia pestis KIM
aaauguacagucauuuacu

SEQ ID NO: 4188594 - RNA, 14 nt, Yersinia pestis KIM
aaaugucagcguuu

SEQ ID NO: 4188595 - RNA, 15 nt, Yersinia pestis KIM
aaauguccacuguac

SEQ ID NO: 4188596 - RNA, 21 nt, Yersinia pestis KIM
aaaugucgaaagauagcaaaa

SEQ ID NO: 4188597 - RNA, 13 nt, Yersinia pestis KIM
aaaugucguacau

SEQ ID NO: 4188598 - RNA, 22 nt, Yersinia pestis KIM
aaauguucaacaagaaaucaaa

SEQ ID NO: 4188599 - RNA, 23 nt, Yersinia pestis KIM
aaauguucaacaagaaaucaaaa

SEQ ID NO: 4188600 - RNA, 15 nt, Yersinia pestis KIM
aaauuaaaaauuaau

SEQ ID NO: 4188601 - RNA, 12 nt, Yersinia pestis KIM
aaauuaaaauaa

SEQ ID NO: 4188602 - RNA, 17 nt, Yersinia pestis KIM
aaauuaaaauaaugagu

SEQ ID NO: 4188603 - RNA, 14 nt, Yersinia pestis KIM
aaauuaaauaacua

SEQ ID NO: 4188604 - RNA, 15 nt, Yersinia pestis KIM
aaauuaaauuauuua

SEQ ID NO: 4188605 - RNA, 20 nt, Yersinia pestis KIM
aaauuaacggaaaagagcgc

SEQ ID NO: 4188606 - RNA, 23 nt, Yersinia pestis KIM
aaauuaauaacgccgaguaaguc

SEQ ID NO: 4188607 - RNA, 19 nt, Yersinia pestis KIM
aaauuaauuacuuuauuua

SEQ ID NO: 4188608 - RNA, 22 nt, Yersinia pestis KIM
aaauuaauuacuuuauuuaaaa

SEQ ID NO: 4188609 - RNA, 16 nt, Yersinia pestis KIM
aaauuacgguuuacca

SEQ ID NO: 4188610 - RNA, 18 nt, Yersinia pestis KIM
aaauuacgugcccaaaaa

SEQ ID NO: 4188611 - RNA, 20 nt, Yersinia pestis KIM
aaauuacucguauaaaaaau

SEQ ID NO: 4188612 - RNA, 23 nt, Yersinia pestis KIM
aaauuacucguauaaaaaauaag

SEQ ID NO: 4188613 - RNA, 14 nt, Yersinia pestis KIM
aaauuagaaaacaa

SEQ ID NO: 4188614 - RNA, 23 nt, Yersinia pestis KIM
aaauuagaugguuaacucauuua

SEQ ID NO: 4188615 - RNA, 23 nt, Yersinia pestis KIM
aaauuagcagggcauucgccuga

SEQ ID NO: 4188616 - RNA, 13 nt, Yersinia pestis KIM
aaauuauaaugau

SEQ ID NO: 4188617 - RNA, 15 nt, Yersinia pestis KIM
aaauuauuaaauaag

SEQ ID NO: 4188618 - RNA, 19 nt, Yersinia pestis KIM
aaauuauugccgcagauaa

SEQ ID NO: 4188619 - RNA, 15 nt, Yersinia pestis KIM
aaauucaaaauagag

SEQ ID NO: 4188620 - RNA, 13 nt, Yersinia pestis KIM
aaauucaaauauc

SEQ ID NO: 4188621 - RNA, 15 nt, Yersinia pestis KIM
aaauucacguuuacu

SEQ ID NO: 4188622 - RNA, 11 nt, Yersinia pestis KIM
aaauucaguuc

SEQ ID NO: 4188623 - RNA, 12 nt, Yersinia pestis KIM
aaauucaucuuu

SEQ ID NO: 4188624 - RNA, 15 nt, Yersinia pestis KIM
aaauucauuaucagg

SEQ ID NO: 4188625 - RNA, 23 nt, Yersinia pestis KIM
aaauucauucuuuuauacagcau

SEQ ID NO: 4188626 - RNA, 13 nt, Yersinia pestis KIM
aaauuccauuuaa

SEQ ID NO: 4188627 - RNA, 17 nt, Yersinia pestis KIM
aaauuccuauaaauuuu

SEQ ID NO: 4188628 - RNA, 23 nt, Yersinia pestis KIM
aaauucgcuuuucgcaucauuaa

SEQ ID NO: 4188629 - RNA, 21 nt, Yersinia pestis KIM
aaauucgggcugaguaaagcc

SEQ ID NO: 4188630 - RNA, 16 nt, Yersinia pestis KIM
aaauucgggcuuuaau

SEQ ID NO: 4188631 - RNA, 15 nt, Yersinia pestis KIM
aaauucgugcucauc

SEQ ID NO: 4188632 - RNA, 18 nt, Yersinia pestis KIM
aaauucuauccggauuaa

SEQ ID NO: 4188633 - RNA, 14 nt, Yersinia pestis KIM
aaauucuaucuggu

SEQ ID NO: 4188634 - RNA, 15 nt, Yersinia pestis KIM
aaauucuaucugguu

SEQ ID NO: 4188635 - RNA, 16 nt, Yersinia pestis KIM
aaauugacuuuaaaaa

SEQ ID NO: 4188636 - RNA, 23 nt, Yersinia pestis KIM
aaauugacuuuaaaaaaauuauc

SEQ ID NO: 4188637 - RNA, 14 nt, Yersinia pestis KIM
aaauugagauauuu

SEQ ID NO: 4188638 - RNA, 23 nt, Yersinia pestis KIM
aaauugcacaugcagcauuucag

SEQ ID NO: 4188639 - RNA, 14 nt, Yersinia pestis KIM
aaauugcugaaaaa

SEQ ID NO: 4188640 - RNA, 16 nt, Yersinia pestis KIM
aaauugcugaaaaaaa

SEQ ID NO: 4188641 - RNA, 17 nt, Yersinia pestis KIM
aaauugcugaaaaaaaa

SEQ ID NO: 4188642 - RNA, 23 nt, Yersinia pestis KIM
aaauuggcuucacccuggcucug

SEQ ID NO: 4188643 - RNA, 14 nt, Yersinia pestis KIM
aaauugucugggau

SEQ ID NO: 4188644 - RNA, 21 nt, Yersinia pestis KIM
aaauuuaucuaauguauuuau

SEQ ID NO: 4188645 - RNA, 14 nt, Yersinia pestis KIM
aaauuuauuuagua

SEQ ID NO: 4188646 - RNA, 16 nt, Yersinia pestis KIM
aaauuucaguuuuuag

SEQ ID NO: 4188647 - RNA, 17 nt, Yersinia pestis KIM
aaauuugacauuuccuu

SEQ ID NO: 4188648 - RNA, 17 nt, Yersinia pestis KIM
aaauuugcacugcaggg

SEQ ID NO: 4188649 - RNA, 10 nt, Yersinia pestis KIM
aaauuuuaaa

SEQ ID NO: 4188650 - RNA, 22 nt, Yersinia pestis KIM
aaauuuucuaagcugccugugc

SEQ ID NO: 4188651 - RNA, 20 nt, Yersinia pestis KIM
aaauuuuguacaacuucuuc

SEQ ID NO: 4188652 - RNA, 13 nt, Yersinia pestis KIM
aaauuuuuauaua

SEQ ID NO: 4188653 - RNA, 22 nt, Yersinia pestis KIM
aacaaaaauuuucccaaaguga

SEQ ID NO: 4188654 - RNA, 16 nt, Yersinia pestis KIM
aacaaaauagggcgcc

SEQ ID NO: 4188655 - RNA, 20 nt, Yersinia pestis KIM
aacaaaaugcgguggcacug

SEQ ID NO: 4188656 - RNA, 22 nt, Yersinia pestis KIM
aacaaacuacuugguuuaaauu

SEQ ID NO: 4188657 - RNA, 13 nt, Yersinia pestis KIM
aacaaagccgcuu

SEQ ID NO: 4188658 - RNA, 15 nt, Yersinia pestis KIM
aacaaaggcgccaag

SEQ ID NO: 4188659 - RNA, 22 nt, Yersinia pestis KIM
aacaaaucuuaaauugaagagu

SEQ ID NO: 4188660 - RNA, 15 nt, Yersinia pestis KIM
aacaaaugaacccuu

SEQ ID NO: 4188661 - RNA, 18 nt, Yersinia pestis KIM
aacaacaaaggcgccaag

SEQ ID NO: 4188662 - RNA, 13 nt, Yersinia pestis KIM
aacaacacaauua

SEQ ID NO: 4188663 - RNA, 15 nt, Yersinia pestis KIM
aacaaccaagcuuug

SEQ ID NO: 4188664 - RNA, 23 nt, Yersinia pestis KIM
aacaaccauuguggcuaaaccca

SEQ ID NO: 4188665 - RNA, 18 nt, Yersinia pestis KIM
aacaaccuaaaaaaaaca

SEQ ID NO: 4188666 - RNA, 14 nt, Yersinia pestis KIM
aacaacgaaacaca

SEQ ID NO: 4188667 - RNA, 21 nt, Yersinia pestis KIM
aacaacggcuggccgagcaga

SEQ ID NO: 4188668 - RNA, 23 nt, Yersinia pestis KIM
aacaagacuuuccccagaugaau

SEQ ID NO: 4188669 - RNA, 21 nt, Yersinia pestis KIM
aacaagaucccaagcaggaaa

SEQ ID NO: 4188670 - RNA, 16 nt, Yersinia pestis KIM
aacaagcgaccaucau

SEQ ID NO: 4188671 - RNA, 21 nt, Yersinia pestis KIM
aacaagcgaccaucaugaaua

SEQ ID NO: 4188672 - RNA, 15 nt, Yersinia pestis KIM
aacaagcuuauauua

SEQ ID NO: 4188673 - RNA, 23 nt, Yersinia pestis KIM
aacaaggaaaucgaaauuaagga

SEQ ID NO: 4188674 - RNA, 18 nt, Yersinia pestis KIM
aacaaguuacauuuuuaa

SEQ ID NO: 4188675 - RNA, 16 nt, Yersinia pestis KIM
aacaaguuucacuuuc

SEQ ID NO: 4188676 - RNA, 15 nt, Yersinia pestis KIM
aacaauaaucucagc

SEQ ID NO: 4188677 - RNA, 18 nt, Yersinia pestis KIM
aacaaugguucaucauuu

SEQ ID NO: 4188678 - RNA, 23 nt, Yersinia pestis KIM
aacaauugcuccaguugauacag

SEQ ID NO: 4188679 - RNA, 20 nt, Yersinia pestis KIM
aacaauuuaucagacaaucu

SEQ ID NO: 4188680 - RNA, 18 nt, Yersinia pestis KIM
aacaauuucgaaaacuca

SEQ ID NO: 4188681 - RNA, 18 nt, Yersinia pestis KIM
aacaauuuuauuguuuuc

SEQ ID NO: 4188682 - RNA, 20 nt, Yersinia pestis KIM
aacacaaaauagaaaacagc

SEQ ID NO: 4188683 - RNA, 23 nt, Yersinia pestis KIM
aacacacuuagcuaagcucuucc

SEQ ID NO: 4188684 - RNA, 21 nt, Yersinia pestis KIM
aacacacuucgccgggucagg

SEQ ID NO: 4188685 - RNA, 23 nt, Yersinia pestis KIM
aacacagagguagacguaucaug

SEQ ID NO: 4188686 - RNA, 13 nt, Yersinia pestis KIM
aacacauaaaauc

SEQ ID NO: 4188687 - RNA, 17 nt, Yersinia pestis KIM
aacacauaaaaucagca

SEQ ID NO: 4188688 - RNA, 17 nt, Yersinia pestis KIM
aacacauauauuaucua

SEQ ID NO: 4188689 - RNA, 12 nt, Yersinia pestis KIM
aacacauccagg

SEQ ID NO: 4188690 - RNA, 18 nt, Yersinia pestis KIM
aacacaucuuccaguaca

SEQ ID NO: 4188691 - RNA, 14 nt, Yersinia pestis KIM
aacacaugcugcuu

SEQ ID NO: 4188692 - RNA, 19 nt, Yersinia pestis KIM
aacacauuaauuuaucugc

SEQ ID NO: 4188693 - RNA, 20 nt, Yersinia pestis KIM
aacacauuccaguaaaaaaa

SEQ ID NO: 4188694 - RNA, 22 nt, Yersinia pestis KIM
aacacauuccaguaaaaaaaua

SEQ ID NO: 4188695 - RNA, 17 nt, Yersinia pestis KIM
aacaccacaacauacaa

SEQ ID NO: 4188696 - RNA, 11 nt, Yersinia pestis KIM
aacaccaucaa

SEQ ID NO: 4188697 - RNA, 14 nt, Yersinia pestis KIM
aacaccaucaacau

SEQ ID NO: 4188698 - RNA, 19 nt, Yersinia pestis KIM
aacacccaacucaacggca

SEQ ID NO: 4188699 - RNA, 13 nt, Yersinia pestis KIM
aacaccgcuguag

SEQ ID NO: 4188700 - RNA, 16 nt, Yersinia pestis KIM
aacaccggcuucuccu

SEQ ID NO: 4188701 - RNA, 21 nt, Yersinia pestis KIM
aacaccgugguuugcucuucc

SEQ ID NO: 4188702 - RNA, 19 nt, Yersinia pestis KIM
aacaccuaguuauucugua

SEQ ID NO: 4188703 - RNA, 15 nt, Yersinia pestis KIM
aacacgaccugugca

SEQ ID NO: 4188704 - RNA, 16 nt, Yersinia pestis KIM
aacacgaccugugcac

SEQ ID NO: 4188705 - RNA, 21 nt, Yersinia pestis KIM
aacacgaccugugcaccacac

SEQ ID NO: 4188706 - RNA, 23 nt, Yersinia pestis KIM
aacacgacgccauaaaagaaugu

SEQ ID NO: 4188707 - RNA, 24 nt, Yersinia pestis KIM
aacacgacgccauaaaagaaugua

SEQ ID NO: 4188708 - RNA, 20 nt, Yersinia pestis KIM
aacacguggguauccagugu

SEQ ID NO: 4188709 - RNA, 20 nt, Yersinia pestis KIM
aacacguucggcgucgccac

SEQ ID NO: 4188710 - RNA, 23 nt, Yersinia pestis KIM
aacacguucggcgucgccacccc

SEQ ID NO: 4188711 - RNA, 20 nt, Yersinia pestis KIM
aacacguuuaacucauccua

SEQ ID NO: 4188712 - RNA, 19 nt, Yersinia pestis KIM
aacacucuuuuuaauuuau

SEQ ID NO: 4188713 - RNA, 23 nt, Yersinia pestis KIM
aacacuuaauuccaugcaaaaua

SEQ ID NO: 4188714 - RNA, 18 nt, Yersinia pestis KIM
aacacuuaccuauaaaca

SEQ ID NO: 4188715 - RNA, 22 nt, Yersinia pestis KIM
aacacuuaccuauaaacauuua

SEQ ID NO: 4188716 - RNA, 14 nt, Yersinia pestis KIM
aacacuugaccaac

SEQ ID NO: 4188717 - RNA, 20 nt, Yersinia pestis KIM
aacacuuuaucgaccacuuu

SEQ ID NO: 4188718 - RNA, 21 nt, Yersinia pestis KIM
aacacuuuaucgaccacuuuu

SEQ ID NO: 4188719 - RNA, 19 nt, Yersinia pestis KIM
aacacuuugcgcuuuuuaa

SEQ ID NO: 4188720 - RNA, 20 nt, Yersinia pestis KIM
aacagaacccccgcgaacag

SEQ ID NO: 4188721 - RNA, 17 nt, Yersinia pestis KIM
aacagaacuaaacgcca

SEQ ID NO: 4188722 - RNA, 22 nt, Yersinia pestis KIM
aacagaauguuggugaucagca

SEQ ID NO: 4188723 - RNA, 22 nt, Yersinia pestis KIM
aacagacgccccgaaccauuua

SEQ ID NO: 4188724 - RNA, 15 nt, Yersinia pestis KIM
aacagacucacucuc

SEQ ID NO: 4188725 - RNA, 17 nt, Yersinia pestis KIM
aacagagcagaaagcag

SEQ ID NO: 4188726 - RNA, 20 nt, Yersinia pestis KIM
aacagagcagaaagcagcag

SEQ ID NO: 4188727 - RNA, 18 nt, Yersinia pestis KIM
aacagagcgcgagugaac

SEQ ID NO: 4188728 - RNA, 14 nt, Yersinia pestis KIM
aacagauaaaaaau

SEQ ID NO: 4188729 - RNA, 15 nt, Yersinia pestis KIM
aacagauaaaaaaua

SEQ ID NO: 4188730 - RNA, 21 nt, Yersinia pestis KIM
aacagauaaaaaauaauuaaa

SEQ ID NO: 4188731 - RNA, 20 nt, Yersinia pestis KIM
aacagauaauuggcaauaau

SEQ ID NO: 4188732 - RNA, 18 nt, Yersinia pestis KIM
aacagauauuacgcagcc

SEQ ID NO: 4188733 - RNA, 19 nt, Yersinia pestis KIM
aacagauauuacgcagcca

SEQ ID NO: 4188734 - RNA, 19 nt, Yersinia pestis KIM
aacagaucacccgcaaaac

SEQ ID NO: 4188735 - RNA, 20 nt, Yersinia pestis KIM
aacagaucacccgcaaaacu

SEQ ID NO: 4188736 - RNA, 23 nt, Yersinia pestis KIM
aacagauguuauuugaauaaaag

SEQ ID NO: 4188737 - RNA, 14 nt, Yersinia pestis KIM
aacagauuguuggu

SEQ ID NO: 4188738 - RNA, 21 nt, Yersinia pestis KIM
aacagcaggauuaagcggagg

SEQ ID NO: 4188739 - RNA, 12 nt, Yersinia pestis KIM
aacagcaggccg

SEQ ID NO: 4188740 - RNA, 19 nt, Yersinia pestis KIM
aacagcaggccgcgaauau

SEQ ID NO: 4188741 - RNA, 16 nt, Yersinia pestis KIM
aacagcaucacugucu

SEQ ID NO: 4188742 - RNA, 22 nt, Yersinia pestis KIM
aacagcaucacugucuauuuuu

SEQ ID NO: 4188743 - RNA, 21 nt, Yersinia pestis KIM
aacagcauuaccaaggaaacc

SEQ ID NO: 4188744 - RNA, 17 nt, Yersinia pestis KIM
aacagccagcaucacga

SEQ ID NO: 4188745 - RNA, 20 nt, Yersinia pestis KIM
aacagccggccauucagcgu

SEQ ID NO: 4188746 - RNA, 17 nt, Yersinia pestis KIM
aacagccguauaucuua

SEQ ID NO: 4188747 - RNA, 23 nt, Yersinia pestis KIM
aacagccuaaggccaucaauaaa

SEQ ID NO: 4188748 - RNA, 20 nt, Yersinia pestis KIM
aacagcggcgauuaucggcu

SEQ ID NO: 4188749 - RNA, 15 nt, Yersinia pestis KIM
aacagcuaaaaugau

SEQ ID NO: 4188750 - RNA, 13 nt, Yersinia pestis KIM
aacagcucacucg

SEQ ID NO: 4188751 - RNA, 21 nt, Yersinia pestis KIM
aacagcuugauagggcugaag

SEQ ID NO: 4188752 - RNA, 21 nt, Yersinia pestis KIM
aacaggcgcaucgcgaucuga

SEQ ID NO: 4188753 - RNA, 14 nt, Yersinia pestis KIM
aacagggcagaaaa

SEQ ID NO: 4188754 - RNA, 15 nt, Yersinia pestis KIM
aacagggcagccaau

SEQ ID NO: 4188755 - RNA, 22 nt, Yersinia pestis KIM
aacagggcagccaauuacgcug

SEQ ID NO: 4188756 - RNA, 17 nt, Yersinia pestis KIM
aacagguagaucaaaca

SEQ ID NO: 4188757 - RNA, 20 nt, Yersinia pestis KIM
aacagguagaucaaacauaa

SEQ ID NO: 4188758 - RNA, 22 nt, Yersinia pestis KIM
aacagguuggcgguacggucac

SEQ ID NO: 4188759 - RNA, 16 nt, Yersinia pestis KIM
aacaguaaauuauuuu

SEQ ID NO: 4188760 - RNA, 21 nt, Yersinia pestis KIM
aacaguagcagggccgcccag

SEQ ID NO: 4188761 - RNA, 22 nt, Yersinia pestis KIM
aacaguagcagggccgcccaga

SEQ ID NO: 4188762 - RNA, 17 nt, Yersinia pestis KIM
aacaguaucaaguaugu

SEQ ID NO: 4188763 - RNA, 15 nt, Yersinia pestis KIM
aacagucacaccaac

SEQ ID NO: 4188764 - RNA, 17 nt, Yersinia pestis KIM
aacagucacaccaacac

SEQ ID NO: 4188765 - RNA, 16 nt, Yersinia pestis KIM
aacagugaugagaauc

SEQ ID NO: 4188766 - RNA, 15 nt, Yersinia pestis KIM
aacagugguuugcuc

SEQ ID NO: 4188767 - RNA, 17 nt, Yersinia pestis KIM
aacagugguuugcucuc

SEQ ID NO: 4188768 - RNA, 22 nt, Yersinia pestis KIM
aacagugucacuuccgccgcca

SEQ ID NO: 4188769 - RNA, 17 nt, Yersinia pestis KIM
aacaguuaaacaacgcu

SEQ ID NO: 4188770 - RNA, 15 nt, Yersinia pestis KIM
aacaguuguuucaau

SEQ ID NO: 4188771 - RNA, 19 nt, Yersinia pestis KIM
aacaguuguuucaauaaau

SEQ ID NO: 4188772 - RNA, 22 nt, Yersinia pestis KIM
aacauaaaaaaugccagcccca

SEQ ID NO: 4188773 - RNA, 17 nt, Yersinia pestis KIM
aacauaaguaauaagua

SEQ ID NO: 4188774 - RNA, 14 nt, Yersinia pestis KIM
aacauaaucaaucc

SEQ ID NO: 4188775 - RNA, 23 nt, Yersinia pestis KIM
aacauaauccgcuccugauuuaa

SEQ ID NO: 4188776 - RNA, 21 nt, Yersinia pestis KIM
aacauacuggcuaauauaucu

SEQ ID NO: 4188777 - RNA, 23 nt, Yersinia pestis KIM
aacauagcuauuggcugauucaa

SEQ ID NO: 4188778 - RNA, 17 nt, Yersinia pestis KIM
aacauaguugaauaacu

SEQ ID NO: 4188779 - RNA, 17 nt, Yersinia pestis KIM
aacauauaaaccagcca

SEQ ID NO: 4188780 - RNA, 20 nt, Yersinia pestis KIM
aacauauaaaccagccagug

SEQ ID NO: 4188781 - RNA, 13 nt, Yersinia pestis KIM
aacauaucaaaca

SEQ ID NO: 4188782 - RNA, 20 nt, Yersinia pestis KIM
aacauaucaauaagugcaaa

SEQ ID NO: 4188783 - RNA, 15 nt, Yersinia pestis KIM
aacauauccugugcc

SEQ ID NO: 4188784 - RNA, 12 nt, Yersinia pestis KIM
aacauaucguuu

SEQ ID NO: 4188785 - RNA, 17 nt, Yersinia pestis KIM
aacauauugguaauuuc

SEQ ID NO: 4188786 - RNA, 13 nt, Yersinia pestis KIM
aacaucacacuug

SEQ ID NO: 4188787 - RNA, 21 nt, Yersinia pestis KIM
aacaucaggccuucuuuucuc

SEQ ID NO: 4188788 - RNA, 16 nt, Yersinia pestis KIM
aacaucauauauuaaa

SEQ ID NO: 4188789 - RNA, 14 nt, Yersinia pestis KIM
aacaucauccccaa

SEQ ID NO: 4188790 - RNA, 13 nt, Yersinia pestis KIM
aacaucaugacaa

SEQ ID NO: 4188791 - RNA, 17 nt, Yersinia pestis KIM
aacauccagaccuucac

SEQ ID NO: 4188792 - RNA, 23 nt, Yersinia pestis KIM
aacauccugauuacguuccacug

SEQ ID NO: 4188793 - RNA, 11 nt, Yersinia pestis KIM
aacaucgaagg

SEQ ID NO: 4188794 - RNA, 16 nt, Yersinia pestis KIM
aacaucgacaccaaga

SEQ ID NO: 4188795 - RNA, 13 nt, Yersinia pestis KIM
aacaucgcccuuu

SEQ ID NO: 4188796 - RNA, 14 nt, Yersinia pestis KIM
aacaucgcccuuuu

SEQ ID NO: 4188797 - RNA, 21 nt, Yersinia pestis KIM
aacaucgguaaaucgcccaau

SEQ ID NO: 4188798 - RNA, 18 nt, Yersinia pestis KIM
aacaucguuaauccauuu

SEQ ID NO: 4188799 - RNA, 16 nt, Yersinia pestis KIM
aacaucucgccaaagu

SEQ ID NO: 4188800 - RNA, 16 nt, Yersinia pestis KIM
aacaugacgggugccg

SEQ ID NO: 4188801 - RNA, 15 nt, Yersinia pestis KIM
aacaugagccacaca

SEQ ID NO: 4188802 - RNA, 22 nt, Yersinia pestis KIM
aacaugagccacacauucaguc

SEQ ID NO: 4188803 - RNA, 16 nt, Yersinia pestis KIM
aacaugccagccuguu

SEQ ID NO: 4188804 - RNA, 17 nt, Yersinia pestis KIM
aacaugcugaagccagc

SEQ ID NO: 4188805 - RNA, 21 nt, Yersinia pestis KIM
aacaugcugaagccagcaccg

SEQ ID NO: 4188806 - RNA, 16 nt, Yersinia pestis KIM
aacauggacggcauau

SEQ ID NO: 4188807 - RNA, 19 nt, Yersinia pestis KIM
aacaugguccacagucagu

SEQ ID NO: 4188808 - RNA, 12 nt, Yersinia pestis KIM
aacauuaaaaau

SEQ ID NO: 4188809 - RNA, 22 nt, Yersinia pestis KIM
aacauuaaggcgauauuauuag

SEQ ID NO: 4188810 - RNA, 23 nt, Yersinia pestis KIM
aacauuaccaccgucaagacaac

SEQ ID NO: 4188811 - RNA, 14 nt, Yersinia pestis KIM
aacauuauccguuu

SEQ ID NO: 4188812 - RNA, 20 nt, Yersinia pestis KIM
aacauuauccguuugcaaca

SEQ ID NO: 4188813 - RNA, 24 nt, Yersinia pestis KIM
aacauuauugaacgcuugcaacaa

SEQ ID NO: 4188814 - RNA, 14 nt, Yersinia pestis KIM
aacauucaucuuuu

SEQ ID NO: 4188815 - RNA, 13 nt, Yersinia pestis KIM
aacauucucuuuu

SEQ ID NO: 4188816 - RNA, 21 nt, Yersinia pestis KIM
aacauugguuacccuaagaau

SEQ ID NO: 4188817 - RNA, 23 nt, Yersinia pestis KIM
aacauugguuacccuaagaauug

SEQ ID NO: 4188818 - RNA, 12 nt, Yersinia pestis KIM
aacauugucacc

SEQ ID NO: 4188819 - RNA, 19 nt, Yersinia pestis KIM
aacauuguccugcaauccu

SEQ ID NO: 4188820 - RNA, 13 nt, Yersinia pestis KIM
aacauuuaaauau

SEQ ID NO: 4188821 - RNA, 21 nt, Yersinia pestis KIM
aacauuuacuuauaaacacug

SEQ ID NO: 4188822 - RNA, 21 nt, Yersinia pestis KIM
aacauuuaucuaucuguucac

SEQ ID NO: 4188823 - RNA, 21 nt, Yersinia pestis KIM
aacauuucauuccagauaaaa

SEQ ID NO: 4188824 - RNA, 23 nt, Yersinia pestis KIM
aacauuuucaucugaccaaacau

SEQ ID NO: 4188825 - RNA, 21 nt, Yersinia pestis KIM
aacauuuucuaagcugccugu

SEQ ID NO: 4188826 - RNA, 15 nt, Yersinia pestis KIM
aacauuuuuagcuuc

SEQ ID NO: 4188827 - RNA, 13 nt, Yersinia pestis KIM
aaccaaacauugu

SEQ ID NO: 4188828 - RNA, 23 nt, Yersinia pestis KIM
aaccaacaguuugguaauacuga

SEQ ID NO: 4188829 - RNA, 14 nt, Yersinia pestis KIM
aaccaacaugagcc

SEQ ID NO: 4188830 - RNA, 12 nt, Yersinia pestis KIM
aaccaaccaugc

SEQ ID NO: 4188831 - RNA, 14 nt, Yersinia pestis KIM
aaccaaccgccaau

SEQ ID NO: 4188832 - RNA, 19 nt, Yersinia pestis KIM
aaccaacgggcacaaucca

SEQ ID NO: 4188833 - RNA, 15 nt, Yersinia pestis KIM
aaccaacugaaacug

SEQ ID NO: 4188834 - RNA, 16 nt, Yersinia pestis KIM
aaccaaggugguaucu

SEQ ID NO: 4188835 - RNA, 16 nt, Yersinia pestis KIM
aaccaauacacagcac

SEQ ID NO: 4188836 - RNA, 13 nt, Yersinia pestis KIM
aaccaaucaagca

SEQ ID NO: 4188837 - RNA, 14 nt, Yersinia pestis KIM
aaccaccaaagaua

SEQ ID NO: 4188838 - RNA, 20 nt, Yersinia pestis KIM
aaccacccgacaucaagaaa

SEQ ID NO: 4188839 - RNA, 19 nt, Yersinia pestis KIM
aaccaccgaaugguuuuuc

SEQ ID NO: 4188840 - RNA, 18 nt, Yersinia pestis KIM
aaccaccuaauacagcac

SEQ ID NO: 4188841 - RNA, 20 nt, Yersinia pestis KIM
aaccaccuaauacagcacca

SEQ ID NO: 4188842 - RNA, 16 nt, Yersinia pestis KIM
aaccaccuuuaccaug

SEQ ID NO: 4188843 - RNA, 20 nt, Yersinia pestis KIM
aaccacgcauuccaucagcc

SEQ ID NO: 4188844 - RNA, 21 nt, Yersinia pestis KIM
aaccacgucuacgcucuccuc

SEQ ID NO: 4188845 - RNA, 13 nt, Yersinia pestis KIM
aaccacugaccua

SEQ ID NO: 4188846 - RNA, 18 nt, Yersinia pestis KIM
aaccacugaccuauugau

SEQ ID NO: 4188847 - RNA, 22 nt, Yersinia pestis KIM
aaccacugguuaaaucaccgac

SEQ ID NO: 4188848 - RNA, 21 nt, Yersinia pestis KIM
aaccagagcggagccucaguu

SEQ ID NO: 4188849 - RNA, 19 nt, Yersinia pestis KIM
aaccagauaacaacaaaga

SEQ ID NO: 4188850 - RNA, 19 nt, Yersinia pestis KIM
aaccagcagcgcauaaaaa

SEQ ID NO: 4188851 - RNA, 18 nt, Yersinia pestis KIM
aaccagcguccugugcaa

SEQ ID NO: 4188852 - RNA, 21 nt, Yersinia pestis KIM
aaccagcguucuaucaaugcc

SEQ ID NO: 4188853 - RNA, 16 nt, Yersinia pestis KIM
aaccaggcgcuauucc

SEQ ID NO: 4188854 - RNA, 17 nt, Yersinia pestis KIM
aaccaggucaguuuuac

SEQ ID NO: 4188855 - RNA, 21 nt, Yersinia pestis KIM
aaccaggucaguuuuacccuu

SEQ ID NO: 4188856 - RNA, 22 nt, Yersinia pestis KIM
aaccagugccgcccagcgacgc

SEQ ID NO: 4188857 - RNA, 20 nt, Yersinia pestis KIM
aaccaguucugguagcugcu

SEQ ID NO: 4188858 - RNA, 20 nt, Yersinia pestis KIM
aaccauccccagaacagcua

SEQ ID NO: 4188859 - RNA, 19 nt, Yersinia pestis KIM
aaccaucggaaccaccaag

SEQ ID NO: 4188860 - RNA, 15 nt, Yersinia pestis KIM
aaccaucugaugcag

SEQ ID NO: 4188861 - RNA, 20 nt, Yersinia pestis KIM
aaccauuaauugguuuuaau

SEQ ID NO: 4188862 - RNA, 11 nt, Yersinia pestis KIM
aaccauuuacc

SEQ ID NO: 4188863 - RNA, 18 nt, Yersinia pestis KIM
aaccauuuucaauugccc

SEQ ID NO: 4188864 - RNA, 12 nt, Yersinia pestis KIM
aaccauuuuuau

SEQ ID NO: 4188865 - RNA, 15 nt, Yersinia pestis KIM
aacccaaagcccuua

SEQ ID NO: 4188866 - RNA, 15 nt, Yersinia pestis KIM
aacccaaaggggagc

SEQ ID NO: 4188867 - RNA, 16 nt, Yersinia pestis KIM
aacccacaucccggca

SEQ ID NO: 4188868 - RNA, 15 nt, Yersinia pestis KIM
aacccagaauggaau

SEQ ID NO: 4188869 - RNA, 15 nt, Yersinia pestis KIM
aacccauauuggcaa

SEQ ID NO: 4188870 - RNA, 14 nt, Yersinia pestis KIM
aacccaucaagcgg

SEQ ID NO: 4188871 - RNA, 21 nt, Yersinia pestis KIM
aacccauuugcacagcauuua

SEQ ID NO: 4188872 - RNA, 12 nt, Yersinia pestis KIM
aaccccaccucu

SEQ ID NO: 4188873 - RNA, 14 nt, Yersinia pestis KIM
aaccccaucagcau

SEQ ID NO: 4188874 - RNA, 20 nt, Yersinia pestis KIM
aacccccgcgaacagcagaa

SEQ ID NO: 4188875 - RNA, 15 nt, Yersinia pestis KIM
aaccccgaugacuca

SEQ ID NO: 4188876 - RNA, 22 nt, Yersinia pestis KIM
aaccccguagcacacacagccu

SEQ ID NO: 4188877 - RNA, 22 nt, Yersinia pestis KIM
aaccccgugcgcucuaaacgaa

SEQ ID NO: 4188878 - RNA, 15 nt, Yersinia pestis KIM
aacccgaauuaauaa

SEQ ID NO: 4188879 - RNA, 17 nt, Yersinia pestis KIM
aacccgcagauaaaccc

SEQ ID NO: 4188880 - RNA, 17 nt, Yersinia pestis KIM
aacccgcgggagucagu

SEQ ID NO: 4188881 - RNA, 17 nt, Yersinia pestis KIM
aacccgcuaacaugcca

SEQ ID NO: 4188882 - RNA, 13 nt, Yersinia pestis KIM
aacccgcugaugc

SEQ ID NO: 4188883 - RNA, 22 nt, Yersinia pestis KIM
aacccgcuggcgaccacuuccu

SEQ ID NO: 4188884 - RNA, 15 nt, Yersinia pestis KIM
aacccggcaucaacc

SEQ ID NO: 4188885 - RNA, 17 nt, Yersinia pestis KIM
aacccguuuagcucuca

SEQ ID NO: 4188886 - RNA, 16 nt, Yersinia pestis KIM
aacccucaguaaaagc

SEQ ID NO: 4188887 - RNA, 12 nt, Yersinia pestis KIM
aacccugacggc

SEQ ID NO: 4188888 - RNA, 19 nt, Yersinia pestis KIM
aacccuuucagcgcuuuuu

SEQ ID NO: 4188889 - RNA, 22 nt, Yersinia pestis KIM
aacccuuucgaguuuauauugc

SEQ ID NO: 4188890 - RNA, 14 nt, Yersinia pestis KIM
aaccgaaaugaucu

SEQ ID NO: 4188891 - RNA, 14 nt, Yersinia pestis KIM
aaccgaagauaacc

SEQ ID NO: 4188892 - RNA, 13 nt, Yersinia pestis KIM
aaccgagaagucg

SEQ ID NO: 4188893 - RNA, 20 nt, Yersinia pestis KIM
aaccgaguaacaaaugguca

SEQ ID NO: 4188894 - RNA, 15 nt, Yersinia pestis KIM
aaccgaugagugaaa

SEQ ID NO: 4188895 - RNA, 15 nt, Yersinia pestis KIM
aaccgaugcaauaaa

SEQ ID NO: 4188896 - RNA, 16 nt, Yersinia pestis KIM
aaccgcagacauaucu

SEQ ID NO: 4188897 - RNA, 20 nt, Yersinia pestis KIM
aaccgcagcagacaacugac

SEQ ID NO: 4188898 - RNA, 15 nt, Yersinia pestis KIM
aaccgcagcaggcag

SEQ ID NO: 4188899 - RNA, 18 nt, Yersinia pestis KIM
aaccgcagcaggcagagc

SEQ ID NO: 4188900 - RNA, 15 nt, Yersinia pestis KIM
aaccgcauucccugc

SEQ ID NO: 4188901 - RNA, 12 nt, Yersinia pestis KIM
aaccgccacagc

SEQ ID NO: 4188902 - RNA, 22 nt, Yersinia pestis KIM
aaccgccaguucuggaucggca

SEQ ID NO: 4188903 - RNA, 23 nt, Yersinia pestis KIM
aaccgcccgacuugcugaaucaa

SEQ ID NO: 4188904 - RNA, 21 nt, Yersinia pestis KIM
aaccgcuauaucaucagcaga

SEQ ID NO: 4188905 - RNA, 23 nt, Yersinia pestis KIM
aaccgcugaaguggcugaauauc

SEQ ID NO: 4188906 - RNA, 14 nt, Yersinia pestis KIM
aaccggauaaaaca

SEQ ID NO: 4188907 - RNA, 22 nt, Yersinia pestis KIM
aaccggaugauuucaaacgugu

SEQ ID NO: 4188908 - RNA, 19 nt, Yersinia pestis KIM
aaccggcguaaauaaaagc

SEQ ID NO: 4188909 - RNA, 18 nt, Yersinia pestis KIM
aaccggcuggaaauucau

SEQ ID NO: 4188910 - RNA, 22 nt, Yersinia pestis KIM
aaccgggggcguauuaucggau

SEQ ID NO: 4188911 - RNA, 22 nt, Yersinia pestis KIM
aaccgggguucgcaaugaaccc

SEQ ID NO: 4188912 - RNA, 13 nt, Yersinia pestis KIM
aaccguucaguuu

SEQ ID NO: 4188913 - RNA, 17 nt, Yersinia pestis KIM
aaccguuuuuucaacug

SEQ ID NO: 4188914 - RNA, 19 nt, Yersinia pestis KIM
aaccguuuuuucaacuggc

SEQ ID NO: 4188915 - RNA, 22 nt, Yersinia pestis KIM
aaccguuuuuucaacuggcugu

SEQ ID NO: 4188916 - RNA, 17 nt, Yersinia pestis KIM
aaccuaaaaaaaacaac

SEQ ID NO: 4188917 - RNA, 15 nt, Yersinia pestis KIM
aaccuaacgccaaaa

SEQ ID NO: 4188918 - RNA, 17 nt, Yersinia pestis KIM
aaccucaaaaggauggc

SEQ ID NO: 4188919 - RNA, 20 nt, Yersinia pestis KIM
aaccucaaaaggauggccca

SEQ ID NO: 4188920 - RNA, 18 nt, Yersinia pestis KIM
aaccucaacgcgaauauc

SEQ ID NO: 4188921 - RNA, 20 nt, Yersinia pestis KIM
aaccucaauuuacucaauau

SEQ ID NO: 4188922 - RNA, 16 nt, Yersinia pestis KIM
aaccucacgggcuucc

SEQ ID NO: 4188923 - RNA, 14 nt, Yersinia pestis KIM
aaccucagaggcgc

SEQ ID NO: 4188924 - RNA, 14 nt, Yersinia pestis KIM
aaccucagccucau

SEQ ID NO: 4188925 - RNA, 18 nt, Yersinia pestis KIM
aaccucagggagccaaua

SEQ ID NO: 4188926 - RNA, 19 nt, Yersinia pestis KIM
aaccuccgcgauaccaaua

SEQ ID NO: 4188927 - RNA, 23 nt, Yersinia pestis KIM
aaccuccgcuuuaaccuuucuaa

SEQ ID NO: 4188928 - RNA, 23 nt, Yersinia pestis KIM
aaccucgggcgcuuaaauaaaac

SEQ ID NO: 4188929 - RNA, 20 nt, Yersinia pestis KIM
aaccucggucugaauaagag

SEQ ID NO: 4188930 - RNA, 17 nt, Yersinia pestis KIM
aaccucuaauaaaccug

SEQ ID NO: 4188931 - RNA, 22 nt, Yersinia pestis KIM
aaccucuaaucuccucuccgga

SEQ ID NO: 4188932 - RNA, 20 nt, Yersinia pestis KIM
aaccucuggcgcaagaguua

SEQ ID NO: 4188933 - RNA, 18 nt, Yersinia pestis KIM
aaccucuucuuccgccac

SEQ ID NO: 4188934 - RNA, 20 nt, Yersinia pestis KIM
aaccugaccguuaucaucga

SEQ ID NO: 4188935 - RNA, 19 nt, Yersinia pestis KIM
aaccugacugguucacacc

SEQ ID NO: 4188936 - RNA, 13 nt, Yersinia pestis KIM
aaccugagcacca

SEQ ID NO: 4188937 - RNA, 22 nt, Yersinia pestis KIM
aaccugagcggcguuguucucu

SEQ ID NO: 4188938 - RNA, 20 nt, Yersinia pestis KIM
aaccugcaauaaccagaaua

SEQ ID NO: 4188939 - RNA, 21 nt, Yersinia pestis KIM
aaccuggcaccggacaaacca

SEQ ID NO: 4188940 - RNA, 15 nt, Yersinia pestis KIM
aaccugugugaccuc

SEQ ID NO: 4188941 - RNA, 22 nt, Yersinia pestis KIM
aaccuguuacaucagagcucaa

SEQ ID NO: 4188942 - RNA, 14 nt, Yersinia pestis KIM
aaccuugcgccaag

SEQ ID NO: 4188943 - RNA, 20 nt, Yersinia pestis KIM
aaccuugggggaccagcaca

SEQ ID NO: 4188944 - RNA, 22 nt, Yersinia pestis KIM
aaccuuguuuuaucgcaguaau

SEQ ID NO: 4188945 - RNA, 20 nt, Yersinia pestis KIM
aaccuuuauguaguucaguc

SEQ ID NO: 4188946 - RNA, 20 nt, Yersinia pestis KIM
aacgaaacacacuucgccgg

SEQ ID NO: 4188947 - RNA, 24 nt, Yersinia pestis KIM
aacgaaacgcauaagaaugugauu

SEQ ID NO: 4188948 - RNA, 18 nt, Yersinia pestis KIM
aacgaaacuaacgcguga

SEQ ID NO: 4188949 - RNA, 18 nt, Yersinia pestis KIM
aacgaacacaguccuguu

SEQ ID NO: 4188950 - RNA, 15 nt, Yersinia pestis KIM
aacgaacgcucuuua

SEQ ID NO: 4188951 - RNA, 18 nt, Yersinia pestis KIM
aacgaacgcucuuuaaca

SEQ ID NO: 4188952 - RNA, 19 nt, Yersinia pestis KIM
aacgaagccacgggcaccu

SEQ ID NO: 4188953 - RNA, 12 nt, Yersinia pestis KIM
aacgaagucagc

SEQ ID NO: 4188954 - RNA, 18 nt, Yersinia pestis KIM
aacgaauaauucagauaa

SEQ ID NO: 4188955 - RNA, 17 nt, Yersinia pestis KIM
aacgacaugugaguggu

SEQ ID NO: 4188956 - RNA, 11 nt, Yersinia pestis KIM
aacgacauuuc

SEQ ID NO: 4188957 - RNA, 17 nt, Yersinia pestis KIM
aacgaccaguaagugau

SEQ ID NO: 4188958 - RNA, 14 nt, Yersinia pestis KIM
aacgacggaugaaa

SEQ ID NO: 4188959 - RNA, 24 nt, Yersinia pestis KIM
aacgacggccaaacguauugguaa

SEQ ID NO: 4188960 - RNA, 20 nt, Yersinia pestis KIM
aacgacguuaucaauacugc

SEQ ID NO: 4188961 - RNA, 21 nt, Yersinia pestis KIM
aacgagggcucaaucucugcc

SEQ ID NO: 4188962 - RNA, 14 nt, Yersinia pestis KIM
aacgauauuuuuau

SEQ ID NO: 4188963 - RNA, 21 nt, Yersinia pestis KIM
aacgaucagaacuaacacuau

SEQ ID NO: 4188964 - RNA, 19 nt, Yersinia pestis KIM
aacgaucgcuuaacgaggc

SEQ ID NO: 4188965 - RNA, 20 nt, Yersinia pestis KIM
aacgauuuucuuucaccacu

SEQ ID NO: 4188966 - RNA, 15 nt, Yersinia pestis KIM
aacgcacaucaaucc

SEQ ID NO: 4188967 - RNA, 13 nt, Yersinia pestis KIM
aacgcacaugccg

SEQ ID NO: 4188968 - RNA, 14 nt, Yersinia pestis KIM
aacgcacgaaaaca

SEQ ID NO: 4188969 - RNA, 13 nt, Yersinia pestis KIM
aacgcagagcgau

SEQ ID NO: 4188970 - RNA, 19 nt, Yersinia pestis KIM
aacgcauucaucagggcag

SEQ ID NO: 4188971 - RNA, 17 nt, Yersinia pestis KIM
aacgccagauaugauca

SEQ ID NO: 4188972 - RNA, 17 nt, Yersinia pestis KIM
aacgccagcagacgcgu

SEQ ID NO: 4188973 - RNA, 19 nt, Yersinia pestis KIM
aacgccagugcaaaaugcu

SEQ ID NO: 4188974 - RNA, 15 nt, Yersinia pestis KIM
aacgcccagcuaauu

SEQ ID NO: 4188975 - RNA, 14 nt, Yersinia pestis KIM
aacgccgaugaagg

SEQ ID NO: 4188976 - RNA, 20 nt, Yersinia pestis KIM
aacgccgcgucaauaacauu

SEQ ID NO: 4188977 - RNA, 14 nt, Yersinia pestis KIM
aacgccggcgccau

SEQ ID NO: 4188978 - RNA, 14 nt, Yersinia pestis KIM
aacgcgaccaacac

SEQ ID NO: 4188979 - RNA, 20 nt, Yersinia pestis KIM
aacgcgccggaauuagcgaa

SEQ ID NO: 4188980 - RNA, 20 nt, Yersinia pestis KIM
aacgcgccuuucggcaauau

SEQ ID NO: 4188981 - RNA, 15 nt, Yersinia pestis KIM
aacgcggaauagccg

SEQ ID NO: 4188982 - RNA, 18 nt, Yersinia pestis KIM
aacgcggaauagccggcg

SEQ ID NO: 4188983 - RNA, 17 nt, Yersinia pestis KIM
aacgcguuaauuaagac

SEQ ID NO: 4188984 - RNA, 22 nt, Yersinia pestis KIM
aacgcuaccaugagugaaaaua

SEQ ID NO: 4188985 - RNA, 16 nt, Yersinia pestis KIM
aacgcucggcaccgau

SEQ ID NO: 4188986 - RNA, 12 nt, Yersinia pestis KIM
aacgcugaccau

SEQ ID NO: 4188987 - RNA, 15 nt, Yersinia pestis KIM
aacgcugaccauggc

SEQ ID NO: 4188988 - RNA, 22 nt, Yersinia pestis KIM
aacgcugcaauuauaagcacaa

SEQ ID NO: 4188989 - RNA, 23 nt, Yersinia pestis KIM
aacgcuuuacuccucugccuauc

SEQ ID NO: 4188990 - RNA, 20 nt, Yersinia pestis KIM
aacgcuuucagguuguuauu

SEQ ID NO: 4188991 - RNA, 23 nt, Yersinia pestis KIM
aacggaaaugauaucugaaucag

SEQ ID NO: 4188992 - RNA, 13 nt, Yersinia pestis KIM
aacggacauuuua

SEQ ID NO: 4188993 - RNA, 17 nt, Yersinia pestis KIM
aacggacgaccuguagc

SEQ ID NO: 4188994 - RNA, 18 nt, Yersinia pestis KIM
aacggacggaauccaaca

SEQ ID NO: 4188995 - RNA, 13 nt, Yersinia pestis KIM
aacggagaugauu

SEQ ID NO: 4188996 - RNA, 14 nt, Yersinia pestis KIM
aacggauaauguug

SEQ ID NO: 4188997 - RNA, 20 nt, Yersinia pestis KIM
aacggauaauguugcaaaca

SEQ ID NO: 4188998 - RNA, 15 nt, Yersinia pestis KIM
aacggauacccagca

SEQ ID NO: 4188999 - RNA, 16 nt, Yersinia pestis KIM
aacggauacccagcac

SEQ ID NO: 4189000 - RNA, 16 nt, Yersinia pestis KIM
aacggcaguuaacgac

SEQ ID NO: 4189001 - RNA, 18 nt, Yersinia pestis KIM
aacggcaguuaacgacgc

SEQ ID NO: 4189002 - RNA, 12 nt, Yersinia pestis KIM
aacggccccuca

SEQ ID NO: 4189003 - RNA, 20 nt, Yersinia pestis KIM
aacggcgcggcaucaccaaa

SEQ ID NO: 4189004 - RNA, 12 nt, Yersinia pestis KIM
aacgggcggcug

SEQ ID NO: 4189005 - RNA, 19 nt, Yersinia pestis KIM
aacgggcuuccaucaggaa

SEQ ID NO: 4189006 - RNA, 16 nt, Yersinia pestis KIM
aacggguaacgaacgc

SEQ ID NO: 4189007 - RNA, 17 nt, Yersinia pestis KIM
aacgggugauguuuaac

SEQ ID NO: 4189008 - RNA, 23 nt, Yersinia pestis KIM
aacggguggccacaauaaaauaa

SEQ ID NO: 4189009 - RNA, 16 nt, Yersinia pestis KIM
aacgguaacccgauaa

SEQ ID NO: 4189010 - RNA, 21 nt, Yersinia pestis KIM
aacggucagauccacauucug

SEQ ID NO: 4189011 - RNA, 20 nt, Yersinia pestis KIM
aacggucauaaucagggaug

SEQ ID NO: 4189012 - RNA, 22 nt, Yersinia pestis KIM
aacggucucuuucgggcaaaaa

SEQ ID NO: 4189013 - RNA, 13 nt, Yersinia pestis KIM
aacggugaacaga

SEQ ID NO: 4189014 - RNA, 17 nt, Yersinia pestis KIM
aacggugaggauaggca

SEQ ID NO: 4189015 - RNA, 18 nt, Yersinia pestis KIM
aacguaauaucugccacc

SEQ ID NO: 4189016 - RNA, 14 nt, Yersinia pestis KIM
aacguacccuccca

SEQ ID NO: 4189017 - RNA, 15 nt, Yersinia pestis KIM
aacguagcuaacacc

SEQ ID NO: 4189018 - RNA, 21 nt, Yersinia pestis KIM
aacguauugguaacgcagaaa

SEQ ID NO: 4189019 - RNA, 14 nt, Yersinia pestis KIM
aacgucaacagaac

SEQ ID NO: 4189020 - RNA, 16 nt, Yersinia pestis KIM
aacgucaacagaacua

SEQ ID NO: 4189021 - RNA, 15 nt, Yersinia pestis KIM
aacgucacuuccauc

SEQ ID NO: 4189022 - RNA, 16 nt, Yersinia pestis KIM
aacgucauaauugcca

SEQ ID NO: 4189023 - RNA, 18 nt, Yersinia pestis KIM
aacgucauaauugccaaa

SEQ ID NO: 4189024 - RNA, 23 nt, Yersinia pestis KIM
aacgucauaauugccaaacgaua

SEQ ID NO: 4189025 - RNA, 21 nt, Yersinia pestis KIM
aacgucauugguguuacagca

SEQ ID NO: 4189026 - RNA, 12 nt, Yersinia pestis KIM
aacgucgccagu

SEQ ID NO: 4189027 - RNA, 19 nt, Yersinia pestis KIM
aacgugacucuuuguuacu

SEQ ID NO: 4189028 - RNA, 20 nt, Yersinia pestis KIM
aacguguuagguaauaccaa

SEQ ID NO: 4189029 - RNA, 18 nt, Yersinia pestis KIM
aacguuaugugccauaag

SEQ ID NO: 4189030 - RNA, 16 nt, Yersinia pestis KIM
aacguucguagauaau

SEQ ID NO: 4189031 - RNA, 14 nt, Yersinia pestis KIM
aacguucugccaau

SEQ ID NO: 4189032 - RNA, 16 nt, Yersinia pestis KIM
aacguucugccaauuu

SEQ ID NO: 4189033 - RNA, 12 nt, Yersinia pestis KIM
aacguuuaucgc

SEQ ID NO: 4189034 - RNA, 16 nt, Yersinia pestis KIM
aacuaaacagaucacc

SEQ ID NO: 4189035 - RNA, 18 nt, Yersinia pestis KIM
aacuaaacagaucacccg

SEQ ID NO: 4189036 - RNA, 20 nt, Yersinia pestis KIM
aacuaaacagggcagaaaau

SEQ ID NO: 4189037 - RNA, 21 nt, Yersinia pestis KIM
aacuaaacagggcagaaaaua

SEQ ID NO: 4189038 - RNA, 14 nt, Yersinia pestis KIM
aacuaacaucagcg

SEQ ID NO: 4189039 - RNA, 15 nt, Yersinia pestis KIM
aacuaacaucagcga

SEQ ID NO: 4189040 - RNA, 13 nt, Yersinia pestis KIM
aacuaacaugcca

SEQ ID NO: 4189041 - RNA, 16 nt, Yersinia pestis KIM
aacuaacguuuuguaa

SEQ ID NO: 4189042 - RNA, 19 nt, Yersinia pestis KIM
aacuaagagucacagcauu

SEQ ID NO: 4189043 - RNA, 16 nt, Yersinia pestis KIM
aacuaauaucaacaga

SEQ ID NO: 4189044 - RNA, 22 nt, Yersinia pestis KIM
aacuaauguuuguuucucugcc

SEQ ID NO: 4189045 - RNA, 19 nt, Yersinia pestis KIM
aacuacaccgcuaaccuua

SEQ ID NO: 4189046 - RNA, 23 nt, Yersinia pestis KIM
aacuacgccucgcagauccagaa

SEQ ID NO: 4189047 - RNA, 22 nt, Yersinia pestis KIM
aacuacuccauccccaacucuu

SEQ ID NO: 4189048 - RNA, 23 nt, Yersinia pestis KIM
aacuacuccauccccaacucuuu

SEQ ID NO: 4189049 - RNA, 21 nt, Yersinia pestis KIM
aacuagcggauuuauaaggaa

SEQ ID NO: 4189050 - RNA, 16 nt, Yersinia pestis KIM
aacucaaacugauaaa

SEQ ID NO: 4189051 - RNA, 21 nt, Yersinia pestis KIM
aacucaaacugauaaagcaaa

SEQ ID NO: 4189052 - RNA, 13 nt, Yersinia pestis KIM
aacucaaagauuu

SEQ ID NO: 4189053 - RNA, 12 nt, Yersinia pestis KIM
aacucaaauuau

SEQ ID NO: 4189054 - RNA, 11 nt, Yersinia pestis KIM
aacucaagcgu

SEQ ID NO: 4189055 - RNA, 17 nt, Yersinia pestis KIM
aacucaccuaaaucaua

SEQ ID NO: 4189056 - RNA, 18 nt, Yersinia pestis KIM
aacucaccuaaaucauac

SEQ ID NO: 4189057 - RNA, 22 nt, Yersinia pestis KIM
aacucagcagagucgcaaaaaa

SEQ ID NO: 4189058 - RNA, 18 nt, Yersinia pestis KIM
aacucagccacaagauag

SEQ ID NO: 4189059 - RNA, 23 nt, Yersinia pestis KIM
aacucagccaucaguucacugaa

SEQ ID NO: 4189060 - RNA, 20 nt, Yersinia pestis KIM
aacucagcgaauaaauaauu

SEQ ID NO: 4189061 - RNA, 11 nt, Yersinia pestis KIM
aacucagggcu

SEQ ID NO: 4189062 - RNA, 17 nt, Yersinia pestis KIM
aacucaggugaguaaau

SEQ ID NO: 4189063 - RNA, 18 nt, Yersinia pestis KIM
aacucaguauauugguac

SEQ ID NO: 4189064 - RNA, 18 nt, Yersinia pestis KIM
aacucagugaaaccauug

SEQ ID NO: 4189065 - RNA, 19 nt, Yersinia pestis KIM
aacucaucggcguuacagu

SEQ ID NO: 4189066 - RNA, 23 nt, Yersinia pestis KIM
aacucaucggcguuacaguaagg

SEQ ID NO: 4189067 - RNA, 21 nt, Yersinia pestis KIM
aacucauuuaucuaaaacugc

SEQ ID NO: 4189068 - RNA, 13 nt, Yersinia pestis KIM
aacucauuuuuug

SEQ ID NO: 4189069 - RNA, 23 nt, Yersinia pestis KIM
aacuccaggguaauaagugauca

SEQ ID NO: 4189070 - RNA, 12 nt, Yersinia pestis KIM
aacuccaucgcc

SEQ ID NO: 4189071 - RNA, 21 nt, Yersinia pestis KIM
aacuccaucgccacuucuaac

SEQ ID NO: 4189072 - RNA, 21 nt, Yersinia pestis KIM
aacucccgauucagcucugcc

SEQ ID NO: 4189073 - RNA, 16 nt, Yersinia pestis KIM
aacucgaacaaccggu

SEQ ID NO: 4189074 - RNA, 13 nt, Yersinia pestis KIM
aacucgacaaccu

SEQ ID NO: 4189075 - RNA, 13 nt, Yersinia pestis KIM
aacucgcgauaac

SEQ ID NO: 4189076 - RNA, 19 nt, Yersinia pestis KIM
aacucgcgcuauuuaucca

SEQ ID NO: 4189077 - RNA, 17 nt, Yersinia pestis KIM
aacucgguuuuaaucgc

SEQ ID NO: 4189078 - RNA, 13 nt, Yersinia pestis KIM
aacucguuaucuu

SEQ ID NO: 4189079 - RNA, 19 nt, Yersinia pestis KIM
aacucuacauugacuaauu

SEQ ID NO: 4189080 - RNA, 15 nt, Yersinia pestis KIM
aacucuauggcguca

SEQ ID NO: 4189081 - RNA, 16 nt, Yersinia pestis KIM
aacugaaaaguuucag

SEQ ID NO: 4189082 - RNA, 21 nt, Yersinia pestis KIM
aacugaaccgccauugcauau

SEQ ID NO: 4189083 - RNA, 16 nt, Yersinia pestis KIM
aacugacaacaucaaa

SEQ ID NO: 4189084 - RNA, 20 nt, Yersinia pestis KIM
aacugacucacgucaguaau

SEQ ID NO: 4189085 - RNA, 23 nt, Yersinia pestis KIM
aacugagccagguuuuuuuuacu

SEQ ID NO: 4189086 - RNA, 15 nt, Yersinia pestis KIM
aacugaggugaacug

SEQ ID NO: 4189087 - RNA, 21 nt, Yersinia pestis KIM
aacugauauaaagcauuuauc

SEQ ID NO: 4189088 - RNA, 18 nt, Yersinia pestis KIM
aacugaucguuugauuaa

SEQ ID NO: 4189089 - RNA, 17 nt, Yersinia pestis KIM
aacugauguauucccuc

SEQ ID NO: 4189090 - RNA, 15 nt, Yersinia pestis KIM
aacugcaguaaaaau

SEQ ID NO: 4189091 - RNA, 19 nt, Yersinia pestis KIM
aacugcauagcgccguggu

SEQ ID NO: 4189092 - RNA, 20 nt, Yersinia pestis KIM
aacugcauagcuaaccuuaa

SEQ ID NO: 4189093 - RNA, 23 nt, Yersinia pestis KIM
aacugccagcuaaaaggggauaa

SEQ ID NO: 4189094 - RNA, 20 nt, Yersinia pestis KIM
aacugccauggaauuuaugc

SEQ ID NO: 4189095 - RNA, 22 nt, Yersinia pestis KIM
aacugcggcauuaaugcagguu

SEQ ID NO: 4189096 - RNA, 14 nt, Yersinia pestis KIM
aacugcucaacugc

SEQ ID NO: 4189097 - RNA, 15 nt, Yersinia pestis KIM
aacugcucaacugcu

SEQ ID NO: 4189098 - RNA, 17 nt, Yersinia pestis KIM
aacugcucaacugcuca

SEQ ID NO: 4189099 - RNA, 18 nt, Yersinia pestis KIM
aacugcucaacugcucaa

SEQ ID NO: 4189100 - RNA, 21 nt, Yersinia pestis KIM
aacugcucaacugcucaacug

SEQ ID NO: 4189101 - RNA, 18 nt, Yersinia pestis KIM
aacugcucacuggaguua

SEQ ID NO: 4189102 - RNA, 20 nt, Yersinia pestis KIM
aacugcuccccccgugauau

SEQ ID NO: 4189103 - RNA, 16 nt, Yersinia pestis KIM
aacugcucuaccaacu

SEQ ID NO: 4189104 - RNA, 22 nt, Yersinia pestis KIM
aacuggcgcaaugucaccugaa

SEQ ID NO: 4189105 - RNA, 15 nt, Yersinia pestis KIM
aacuggcggggcaaa

SEQ ID NO: 4189106 - RNA, 16 nt, Yersinia pestis KIM
aacuggcuccgcacgg

SEQ ID NO: 4189107 - RNA, 20 nt, Yersinia pestis KIM
aacugggcgacaaucaaugg

SEQ ID NO: 4189108 - RNA, 13 nt, Yersinia pestis KIM
aacuguaaaaucu

SEQ ID NO: 4189109 - RNA, 16 nt, Yersinia pestis KIM
aacuguaaauaucaua

SEQ ID NO: 4189110 - RNA, 14 nt, Yersinia pestis KIM
aacuguaaggccaa

SEQ ID NO: 4189111 - RNA, 19 nt, Yersinia pestis KIM
aacuguaaggccaaacccg

SEQ ID NO: 4189112 - RNA, 13 nt, Yersinia pestis KIM
aacugucagucaa

SEQ ID NO: 4189113 - RNA, 21 nt, Yersinia pestis KIM
aacuguccgcaauagccaaga

SEQ ID NO: 4189114 - RNA, 22 nt, Yersinia pestis KIM
aacugugccaaugccucuucaa

SEQ ID NO: 4189115 - RNA, 12 nt, Yersinia pestis KIM
aacugugcgaau

SEQ ID NO: 4189116 - RNA, 13 nt, Yersinia pestis KIM
aacuguucuuauu

SEQ ID NO: 4189117 - RNA, 19 nt, Yersinia pestis KIM
aacuguucuuauugcuauc

SEQ ID NO: 4189118 - RNA, 13 nt, Yersinia pestis KIM
aacuguugcaaac

SEQ ID NO: 4189119 - RNA, 20 nt, Yersinia pestis KIM
aacuguuuuuuaaagaaaaa

SEQ ID NO: 4189120 - RNA, 21 nt, Yersinia pestis KIM
aacuuaaguucuuuuugucag

SEQ ID NO: 4189121 - RNA, 18 nt, Yersinia pestis KIM
aacuuacaggcugccugc

SEQ ID NO: 4189122 - RNA, 16 nt, Yersinia pestis KIM
aacuuacaugaguaag

SEQ ID NO: 4189123 - RNA, 20 nt, Yersinia pestis KIM
aacuuacaugaguaagugau

SEQ ID NO: 4189124 - RNA, 13 nt, Yersinia pestis KIM
aacuuacucccuu

SEQ ID NO: 4189125 - RNA, 15 nt, Yersinia pestis KIM
aacuuacucccuugu

SEQ ID NO: 4189126 - RNA, 18 nt, Yersinia pestis KIM
aacuuauagcucaucggu

SEQ ID NO: 4189127 - RNA, 14 nt, Yersinia pestis KIM
aacuucaaaaucaa

SEQ ID NO: 4189128 - RNA, 20 nt, Yersinia pestis KIM
aacuucaaaaucaaguugau

SEQ ID NO: 4189129 - RNA, 15 nt, Yersinia pestis KIM
aacuucaagccgaua

SEQ ID NO: 4189130 - RNA, 18 nt, Yersinia pestis KIM
aacuucaauaccaaauuu

SEQ ID NO: 4189131 - RNA, 12 nt, Yersinia pestis KIM
aacuucacuuug

SEQ ID NO: 4189132 - RNA, 16 nt, Yersinia pestis KIM
aacuucagccaccaga

SEQ ID NO: 4189133 - RNA, 17 nt, Yersinia pestis KIM
aacuucaguuacucacu

SEQ ID NO: 4189134 - RNA, 19 nt, Yersinia pestis KIM
aacuucaguuacucacuug

SEQ ID NO: 4189135 - RNA, 15 nt, Yersinia pestis KIM
aacuuccacacaaac

SEQ ID NO: 4189136 - RNA, 16 nt, Yersinia pestis KIM
aacuuccccuucucac

SEQ ID NO: 4189137 - RNA, 13 nt, Yersinia pestis KIM
aacuuccuuugcc

SEQ ID NO: 4189138 - RNA, 15 nt, Yersinia pestis KIM
aacuuccuuugcccu

SEQ ID NO: 4189139 - RNA, 22 nt, Yersinia pestis KIM
aacuuccuuugcccuuacuauu

SEQ ID NO: 4189140 - RNA, 17 nt, Yersinia pestis KIM
aacuucgaaagaaauaa

SEQ ID NO: 4189141 - RNA, 18 nt, Yersinia pestis KIM
aacuucgaaagaaauaaa

SEQ ID NO: 4189142 - RNA, 17 nt, Yersinia pestis KIM
aacuucgcacgcccauc

SEQ ID NO: 4189143 - RNA, 22 nt, Yersinia pestis KIM
aacuuggacaucugcuuuacug

SEQ ID NO: 4189144 - RNA, 19 nt, Yersinia pestis KIM
aacuuuaauaugcaaaaaa

SEQ ID NO: 4189145 - RNA, 14 nt, Yersinia pestis KIM
aacuuuaucagucu

SEQ ID NO: 4189146 - RNA, 15 nt, Yersinia pestis KIM
aacuuuaucagucug

SEQ ID NO: 4189147 - RNA, 20 nt, Yersinia pestis KIM
aacuuuauugacuguaaaua

SEQ ID NO: 4189148 - RNA, 22 nt, Yersinia pestis KIM
aacuuugcuuugacuaauacug

SEQ ID NO: 4189149 - RNA, 23 nt, Yersinia pestis KIM
aacuuugcuuugacuaauacugc

SEQ ID NO: 4189150 - RNA, 19 nt, Yersinia pestis KIM
aacuuuggguauaugacug

SEQ ID NO: 4189151 - RNA, 20 nt, Yersinia pestis KIM
aacuuuggguauaugacugu

SEQ ID NO: 4189152 - RNA, 15 nt, Yersinia pestis KIM
aacuuugguuuuuga

SEQ ID NO: 4189153 - RNA, 20 nt, Yersinia pestis KIM
aacuuuuaugcaucuuuuag

SEQ ID NO: 4189154 - RNA, 23 nt, Yersinia pestis KIM
aacuuuucaguuuuaauuuauga

SEQ ID NO: 4189155 - RNA, 19 nt, Yersinia pestis KIM
aacuuuucuucauugcugc

SEQ ID NO: 4189156 - RNA, 21 nt, Yersinia pestis KIM
aacuuuuuucuuaaggacccg

SEQ ID NO: 4189157 - RNA, 19 nt, Yersinia pestis KIM
aagaaaacccauaccacug

SEQ ID NO: 4189158 - RNA, 13 nt, Yersinia pestis KIM
aagaaaagcaccg

SEQ ID NO: 4189159 - RNA, 21 nt, Yersinia pestis KIM
aagaaacgccccgauaaacca

SEQ ID NO: 4189160 - RNA, 16 nt, Yersinia pestis KIM
aagaaacugccagcua

SEQ ID NO: 4189161 - RNA, 19 nt, Yersinia pestis KIM
aagaaacugccagcuaaaa

SEQ ID NO: 4189162 - RNA, 23 nt, Yersinia pestis KIM
aagaaacuucauuucagguaaaa

SEQ ID NO: 4189163 - RNA, 13 nt, Yersinia pestis KIM
aagaaagaaaaau

SEQ ID NO: 4189164 - RNA, 14 nt, Yersinia pestis KIM
aagaaagaaaaaua

SEQ ID NO: 4189165 - RNA, 16 nt, Yersinia pestis KIM
aagaaagaaaaauaga

SEQ ID NO: 4189166 - RNA, 13 nt, Yersinia pestis KIM
aagaaauaaaaga

SEQ ID NO: 4189167 - RNA, 15 nt, Yersinia pestis KIM
aagaaauaccugagu

SEQ ID NO: 4189168 - RNA, 22 nt, Yersinia pestis KIM
aagaacagcccuccagccgguu

SEQ ID NO: 4189169 - RNA, 15 nt, Yersinia pestis KIM
aagaaccgaaauauc

SEQ ID NO: 4189170 - RNA, 16 nt, Yersinia pestis KIM
aagaaccgcagacaua

SEQ ID NO: 4189171 - RNA, 22 nt, Yersinia pestis KIM
aagaacgcgccaaccaucggaa

SEQ ID NO: 4189172 - RNA, 17 nt, Yersinia pestis KIM
aagaacggccugccaga

SEQ ID NO: 4189173 - RNA, 18 nt, Yersinia pestis KIM
aagaacggccugccagaa

SEQ ID NO: 4189174 - RNA, 19 nt, Yersinia pestis KIM
aagaacggccugccagaac

SEQ ID NO: 4189175 - RNA, 14 nt, Yersinia pestis KIM
aagaacucaacaau

SEQ ID NO: 4189176 - RNA, 23 nt, Yersinia pestis KIM
aagaacuggcuggaucagcagac

SEQ ID NO: 4189177 - RNA, 14 nt, Yersinia pestis KIM
aagaagccaagaug

SEQ ID NO: 4189178 - RNA, 12 nt, Yersinia pestis KIM
aagaagccucau

SEQ ID NO: 4189179 - RNA, 14 nt, Yersinia pestis KIM
aagaagccucauga

SEQ ID NO: 4189180 - RNA, 21 nt, Yersinia pestis KIM
aagaagcgggcggccucugcu

SEQ ID NO: 4189181 - RNA, 13 nt, Yersinia pestis KIM
aagaauaaauaau

SEQ ID NO: 4189182 - RNA, 15 nt, Yersinia pestis KIM
aagaauaaauaauau

SEQ ID NO: 4189183 - RNA, 16 nt, Yersinia pestis KIM
aagaauaaaugucacu

SEQ ID NO: 4189184 - RNA, 19 nt, Yersinia pestis KIM
aagaaucaccgaaagaaga

SEQ ID NO: 4189185 - RNA, 14 nt, Yersinia pestis KIM
aagaaucaguaggu

SEQ ID NO: 4189186 - RNA, 14 nt, Yersinia pestis KIM
aagaaucccaucaa

SEQ ID NO: 4189187 - RNA, 15 nt, Yersinia pestis KIM
aagaaucccaucaaa

SEQ ID NO: 4189188 - RNA, 18 nt, Yersinia pestis KIM
aagaaugccugccgcaau

SEQ ID NO: 4189189 - RNA, 14 nt, Yersinia pestis KIM
aagaauguagacgu

SEQ ID NO: 4189190 - RNA, 15 nt, Yersinia pestis KIM
aagaauguauugaga

SEQ ID NO: 4189191 - RNA, 16 nt, Yersinia pestis KIM
aagaauuccggcgcau

SEQ ID NO: 4189192 - RNA, 18 nt, Yersinia pestis KIM
aagaauugagguaaacca

SEQ ID NO: 4189193 - RNA, 23 nt, Yersinia pestis KIM
aagaauugcagauaccacaucaa

SEQ ID NO: 4189194 - RNA, 21 nt, Yersinia pestis KIM
aagaauugguuauccuaagaa

SEQ ID NO: 4189195 - RNA, 22 nt, Yersinia pestis KIM
aagaauuuuauauuauuauaaa

SEQ ID NO: 4189196 - RNA, 16 nt, Yersinia pestis KIM
aagacaacaaacagua

SEQ ID NO: 4189197 - RNA, 17 nt, Yersinia pestis KIM
aagacaauaaaucgcca

SEQ ID NO: 4189198 - RNA, 19 nt, Yersinia pestis KIM
aagacaauuauagccaaau

SEQ ID NO: 4189199 - RNA, 11 nt, Yersinia pestis KIM
aagacacccgu

SEQ ID NO: 4189200 - RNA, 23 nt, Yersinia pestis KIM
aagacagggguuuuuaucccccu

SEQ ID NO: 4189201 - RNA, 22 nt, Yersinia pestis KIM
aagacauaaugccggcggccca

SEQ ID NO: 4189202 - RNA, 20 nt, Yersinia pestis KIM
aagacauugcgcaagccccu

SEQ ID NO: 4189203 - RNA, 19 nt, Yersinia pestis KIM
aagaccacaucaaccugau

SEQ ID NO: 4189204 - RNA, 23 nt, Yersinia pestis KIM
aagaccgcuuuaucaaagaauuc

SEQ ID NO: 4189205 - RNA, 14 nt, Yersinia pestis KIM
aagaccgcuuuugc

SEQ ID NO: 4189206 - RNA, 17 nt, Yersinia pestis KIM
aagacgccguaaauaca

SEQ ID NO: 4189207 - RNA, 13 nt, Yersinia pestis KIM
aagacgcucuccc

SEQ ID NO: 4189208 - RNA, 20 nt, Yersinia pestis KIM
aagacuucaugacuaccuug

SEQ ID NO: 4189209 - RNA, 15 nt, Yersinia pestis KIM
aagagaaaagcagac

SEQ ID NO: 4189210 - RNA, 14 nt, Yersinia pestis KIM
aagagacugggcug

SEQ ID NO: 4189211 - RNA, 18 nt, Yersinia pestis KIM
aagagaggcaaugauuuu

SEQ ID NO: 4189212 - RNA, 14 nt, Yersinia pestis KIM
aagagauagagcag

SEQ ID NO: 4189213 - RNA, 20 nt, Yersinia pestis KIM
aagagauagauuuuaaugaa

SEQ ID NO: 4189214 - RNA, 15 nt, Yersinia pestis KIM
aagagaugaaauuuu

SEQ ID NO: 4189215 - RNA, 17 nt, Yersinia pestis KIM
aagagaugaaauuuuau

SEQ ID NO: 4189216 - RNA, 11 nt, Yersinia pestis KIM
aagagaugacc

SEQ ID NO: 4189217 - RNA, 21 nt, Yersinia pestis KIM
aagagaugacccaaagucauu

SEQ ID NO: 4189218 - RNA, 22 nt, Yersinia pestis KIM
aagagauugcguuauaucuaua

SEQ ID NO: 4189219 - RNA, 20 nt, Yersinia pestis KIM
aagagcccgcaacgggagag

SEQ ID NO: 4189220 - RNA, 21 nt, Yersinia pestis KIM
aagagccugaaucugaauggc

SEQ ID NO: 4189221 - RNA, 14 nt, Yersinia pestis KIM
aagagcgauugacu

SEQ ID NO: 4189222 - RNA, 22 nt, Yersinia pestis KIM
aagagcgauugacugaauguga

SEQ ID NO: 4189223 - RNA, 14 nt, Yersinia pestis KIM
aagaggaaaugccg

SEQ ID NO: 4189224 - RNA, 19 nt, Yersinia pestis KIM
aagagggcgguuaaauaca

SEQ ID NO: 4189225 - RNA, 18 nt, Yersinia pestis KIM
aagaggguuuuuaaauuu

SEQ ID NO: 4189226 - RNA, 22 nt, Yersinia pestis KIM
aagaguacuaacgucaacagaa

SEQ ID NO: 4189227 - RNA, 13 nt, Yersinia pestis KIM
aagaguaucucug

SEQ ID NO: 4189228 - RNA, 14 nt, Yersinia pestis KIM
aagagucacagcau

SEQ ID NO: 4189229 - RNA, 20 nt, Yersinia pestis KIM
aagagucacagcauucagau

SEQ ID NO: 4189230 - RNA, 16 nt, Yersinia pestis KIM
aagagucgcaaaacuu

SEQ ID NO: 4189231 - RNA, 22 nt, Yersinia pestis KIM
aagagucgcuuugggauucaau

SEQ ID NO: 4189232 - RNA, 18 nt, Yersinia pestis KIM
aagagucuggauuugaga

SEQ ID NO: 4189233 - RNA, 14 nt, Yersinia pestis KIM
aagagugaccaaag

SEQ ID NO: 4189234 - RNA, 19 nt, Yersinia pestis KIM
aagagugaccaaagcagua

SEQ ID NO: 4189235 - RNA, 23 nt, Yersinia pestis KIM
aagagugaccaaagcaguaaaca

SEQ ID NO: 4189236 - RNA, 21 nt, Yersinia pestis KIM
aagaguguucauaaauuaaaa

SEQ ID NO: 4189237 - RNA, 20 nt, Yersinia pestis KIM
aagauacccuucucuuuauc

SEQ ID NO: 4189238 - RNA, 16 nt, Yersinia pestis KIM
aagauagcaaaagaau

SEQ ID NO: 4189239 - RNA, 16 nt, Yersinia pestis KIM
aagauagccacuaacu

SEQ ID NO: 4189240 - RNA, 17 nt, Yersinia pestis KIM
aagauaggcagaaaagc

SEQ ID NO: 4189241 - RNA, 21 nt, Yersinia pestis KIM
aagauaggcagaaaagcaaag

SEQ ID NO: 4189242 - RNA, 13 nt, Yersinia pestis KIM
aagaucaaaagca

SEQ ID NO: 4189243 - RNA, 14 nt, Yersinia pestis KIM
aagaucaauauguu

SEQ ID NO: 4189244 - RNA, 18 nt, Yersinia pestis KIM
aagaucacucauggcucu

SEQ ID NO: 4189245 - RNA, 13 nt, Yersinia pestis KIM
aagauccaguuca

SEQ ID NO: 4189246 - RNA, 14 nt, Yersinia pestis KIM
aagauccaguucag

SEQ ID NO: 4189247 - RNA, 18 nt, Yersinia pestis KIM
aagaucggccugccauuu

SEQ ID NO: 4189248 - RNA, 12 nt, Yersinia pestis KIM
aagaugcagggc

SEQ ID NO: 4189249 - RNA, 18 nt, Yersinia pestis KIM
aagaugcauauuugcaga

SEQ ID NO: 4189250 - RNA, 20 nt, Yersinia pestis KIM
aagaugccaaucaaaaaacc

SEQ ID NO: 4189251 - RNA, 21 nt, Yersinia pestis KIM
aagaugccaaucaaaaaaccg

SEQ ID NO: 4189252 - RNA, 17 nt, Yersinia pestis KIM
aagauucucggcaugcu

SEQ ID NO: 4189253 - RNA, 13 nt, Yersinia pestis KIM
aagauuuaaauaa

SEQ ID NO: 4189254 - RNA, 15 nt, Yersinia pestis KIM
aagauuuaaauaaca

SEQ ID NO: 4189255 - RNA, 21 nt, Yersinia pestis KIM
aagauuucaucggcaaaaaca

SEQ ID NO: 4189256 - RNA, 23 nt, Yersinia pestis KIM
aagauuucaucggcaaaaacagu

SEQ ID NO: 4189257 - RNA, 20 nt, Yersinia pestis KIM
aagauuucucuuaggcaacc

SEQ ID NO: 4189258 - RNA, 22 nt, Yersinia pestis KIM
aagauuuuuagcgugccgcagu

SEQ ID NO: 4189259 - RNA, 12 nt, Yersinia pestis KIM
aagcaaacugau

SEQ ID NO: 4189260 - RNA, 19 nt, Yersinia pestis KIM
aagcaaaggcccgcuauca

SEQ ID NO: 4189261 - RNA, 19 nt, Yersinia pestis KIM
aagcaagcggcagcgcugg

SEQ ID NO: 4189262 - RNA, 20 nt, Yersinia pestis KIM
aagcaauaccgacaucaaca

SEQ ID NO: 4189263 - RNA, 22 nt, Yersinia pestis KIM
aagcaauuuagacagcuuaaaa

SEQ ID NO: 4189264 - RNA, 15 nt, Yersinia pestis KIM
aagcacagacaaaca

SEQ ID NO: 4189265 - RNA, 13 nt, Yersinia pestis KIM
aagcacagucgcc

SEQ ID NO: 4189266 - RNA, 14 nt, Yersinia pestis KIM
aagcacggcaggcg

SEQ ID NO: 4189267 - RNA, 16 nt, Yersinia pestis KIM
aagcacuguuacccgg

SEQ ID NO: 4189268 - RNA, 15 nt, Yersinia pestis KIM
aagcagauaaagaaa

SEQ ID NO: 4189269 - RNA, 14 nt, Yersinia pestis KIM
aagcagccgccgcu

SEQ ID NO: 4189270 - RNA, 17 nt, Yersinia pestis KIM
aagcagcgucucgugua

SEQ ID NO: 4189271 - RNA, 14 nt, Yersinia pestis KIM
aagcagcuuuucac

SEQ ID NO: 4189272 - RNA, 23 nt, Yersinia pestis KIM
aagcagcuuuucacgagagagca

SEQ ID NO: 4189273 - RNA, 15 nt, Yersinia pestis KIM
aagcaguaaacauuu

SEQ ID NO: 4189274 - RNA, 14 nt, Yersinia pestis KIM
aagcagucagcaug

SEQ ID NO: 4189275 - RNA, 22 nt, Yersinia pestis KIM
aagcagucgacaguguaaaaag

SEQ ID NO: 4189276 - RNA, 21 nt, Yersinia pestis KIM
aagcagugucagggcaauaac

SEQ ID NO: 4189277 - RNA, 22 nt, Yersinia pestis KIM
aagcaguucacucuguuuuaaa

SEQ ID NO: 4189278 - RNA, 16 nt, Yersinia pestis KIM
aagcaguucacugagu

SEQ ID NO: 4189279 - RNA, 17 nt, Yersinia pestis KIM
aagcauacguugccagc

SEQ ID NO: 4189280 - RNA, 21 nt, Yersinia pestis KIM
aagcauacguugccagccauc

SEQ ID NO: 4189281 - RNA, 13 nt, Yersinia pestis KIM
aagcauauggaug

SEQ ID NO: 4189282 - RNA, 17 nt, Yersinia pestis KIM
aagcauauggaugugau

SEQ ID NO: 4189283 - RNA, 17 nt, Yersinia pestis KIM
aagcaucaccaaagaua

SEQ ID NO: 4189284 - RNA, 18 nt, Yersinia pestis KIM
aagcauccaauaccacca

SEQ ID NO: 4189285 - RNA, 22 nt, Yersinia pestis KIM
aagcaugugauguggcuugcaa

SEQ ID NO: 4189286 - RNA, 19 nt, Yersinia pestis KIM
aagcauucgcgguuacacc

SEQ ID NO: 4189287 - RNA, 18 nt, Yersinia pestis KIM
aagcauugagcgccacau

SEQ ID NO: 4189288 - RNA, 17 nt, Yersinia pestis KIM
aagccaaaacagccuaa

SEQ ID NO: 4189289 - RNA, 15 nt, Yersinia pestis KIM
aagccaauaauauaa

SEQ ID NO: 4189290 - RNA, 20 nt, Yersinia pestis KIM
aagccacgaguuuucccugc

SEQ ID NO: 4189291 - RNA, 15 nt, Yersinia pestis KIM
aagccagauaucacu

SEQ ID NO: 4189292 - RNA, 20 nt, Yersinia pestis KIM
aagccaugacagguugauaa

SEQ ID NO: 4189293 - RNA, 15 nt, Yersinia pestis KIM
aagccauuagcguug

SEQ ID NO: 4189294 - RNA, 18 nt, Yersinia pestis KIM
aagccauuuuuuauaaac

SEQ ID NO: 4189295 - RNA, 13 nt, Yersinia pestis KIM
aagcccaacugac

SEQ ID NO: 4189296 - RNA, 13 nt, Yersinia pestis KIM
aagccccacagua

SEQ ID NO: 4189297 - RNA, 15 nt, Yersinia pestis KIM
aagcccccguaucau

SEQ ID NO: 4189298 - RNA, 16 nt, Yersinia pestis KIM
aagcccccguaucaug

SEQ ID NO: 4189299 - RNA, 18 nt, Yersinia pestis KIM
aagcccggaaacguccag

SEQ ID NO: 4189300 - RNA, 15 nt, Yersinia pestis KIM
aagcccuguuucauu

SEQ ID NO: 4189301 - RNA, 16 nt, Yersinia pestis KIM
aagcccuguuucauuu

SEQ ID NO: 4189302 - RNA, 18 nt, Yersinia pestis KIM
aagcccuugucaggauuu

SEQ ID NO: 4189303 - RNA, 17 nt, Yersinia pestis KIM
aagccgacgaucuugcc

SEQ ID NO: 4189304 - RNA, 20 nt, Yersinia pestis KIM
aagccgauccgggaaaaaau

SEQ ID NO: 4189305 - RNA, 14 nt, Yersinia pestis KIM
aagccgcgccaucu

SEQ ID NO: 4189306 - RNA, 22 nt, Yersinia pestis KIM
aagccguaacugaccgcagccu

SEQ ID NO: 4189307 - RNA, 20 nt, Yersinia pestis KIM
aagccguaauucagauaaga

SEQ ID NO: 4189308 - RNA, 15 nt, Yersinia pestis KIM
aagccgucagcuuac

SEQ ID NO: 4189309 - RNA, 13 nt, Yersinia pestis KIM
aagccgucaguuc

SEQ ID NO: 4189310 - RNA, 16 nt, Yersinia pestis KIM
aagccgugaccaaagu

SEQ ID NO: 4189311 - RNA, 22 nt, Yersinia pestis KIM
aagccgugaccaaagugcucac

SEQ ID NO: 4189312 - RNA, 16 nt, Yersinia pestis KIM
aagccucaugaaugag

SEQ ID NO: 4189313 - RNA, 19 nt, Yersinia pestis KIM
aagccucaugaaugaggcu

SEQ ID NO: 4189314 - RNA, 19 nt, Yersinia pestis KIM
aagccucggucacugccug

SEQ ID NO: 4189315 - RNA, 16 nt, Yersinia pestis KIM
aagccuucaaccugaa

SEQ ID NO: 4189316 - RNA, 16 nt, Yersinia pestis KIM
aagcgacacuuauugg

SEQ ID NO: 4189317 - RNA, 16 nt, Yersinia pestis KIM
aagcgauccugcucaa

SEQ ID NO: 4189318 - RNA, 22 nt, Yersinia pestis KIM
aagcgaucgaccgaguguaaaa

SEQ ID NO: 4189319 - RNA, 23 nt, Yersinia pestis KIM
aagcgauuagucccuaaagagcg

SEQ ID NO: 4189320 - RNA, 12 nt, Yersinia pestis KIM
aagcgcaggaua

SEQ ID NO: 4189321 - RNA, 23 nt, Yersinia pestis KIM
aagcgccguaaaaagcagcaaac

SEQ ID NO: 4189322 - RNA, 23 nt, Yersinia pestis KIM
aagcgccuuccuuuuauuuagag

SEQ ID NO: 4189323 - RNA, 20 nt, Yersinia pestis KIM
aagcgcguuagccuacuggc

SEQ ID NO: 4189324 - RNA, 11 nt, Yersinia pestis KIM
aagcgguuaag

SEQ ID NO: 4189325 - RNA, 17 nt, Yersinia pestis KIM
aagcgguuaucaccuuc

SEQ ID NO: 4189326 - RNA, 17 nt, Yersinia pestis KIM
aagcgguuucauggcug

SEQ ID NO: 4189327 - RNA, 18 nt, Yersinia pestis KIM
aagcgguuuguuaaaaag

SEQ ID NO: 4189328 - RNA, 18 nt, Yersinia pestis KIM
aagcgguuuuaucaauag

SEQ ID NO: 4189329 - RNA, 15 nt, Yersinia pestis KIM
aagcguaaagcaccc

SEQ ID NO: 4189330 - RNA, 15 nt, Yersinia pestis KIM
aagcguaaauuuacc

SEQ ID NO: 4189331 - RNA, 21 nt, Yersinia pestis KIM
aagcguacugcgguuaaucgg

SEQ ID NO: 4189332 - RNA, 19 nt, Yersinia pestis KIM
aagcguauuuugucaugaa

SEQ ID NO: 4189333 - RNA, 18 nt, Yersinia pestis KIM
aagcgucagaugcugacg

SEQ ID NO: 4189334 - RNA, 16 nt, Yersinia pestis KIM
aagcguccgcgccaag

SEQ ID NO: 4189335 - RNA, 22 nt, Yersinia pestis KIM
aagcguuaauuauagugaaaac

SEQ ID NO: 4189336 - RNA, 21 nt, Yersinia pestis KIM
aagcuaauagaucagccaaau

SEQ ID NO: 4189337 - RNA, 17 nt, Yersinia pestis KIM
aagcuacagcgucagau

SEQ ID NO: 4189338 - RNA, 18 nt, Yersinia pestis KIM
aagcuacagcucagacug

SEQ ID NO: 4189339 - RNA, 21 nt, Yersinia pestis KIM
aagcuacggccuguaccacca

SEQ ID NO: 4189340 - RNA, 11 nt, Yersinia pestis KIM
aagcucaagcu

SEQ ID NO: 4189341 - RNA, 12 nt, Yersinia pestis KIM
aagcucaagcug

SEQ ID NO: 4189342 - RNA, 13 nt, Yersinia pestis KIM
aagcucauaugca

SEQ ID NO: 4189343 - RNA, 19 nt, Yersinia pestis KIM
aagcucauaugcagcaucc

SEQ ID NO: 4189344 - RNA, 15 nt, Yersinia pestis KIM
aagcucuacuaauau

SEQ ID NO: 4189345 - RNA, 18 nt, Yersinia pestis KIM
aagcucuacuaauauucc

SEQ ID NO: 4189346 - RNA, 23 nt, Yersinia pestis KIM
aagcucugacaaaaugccagaau

SEQ ID NO: 4189347 - RNA, 22 nt, Yersinia pestis KIM
aagcucugggacgugcauaaaa

SEQ ID NO: 4189348 - RNA, 22 nt, Yersinia pestis KIM
aagcugccugugcggcagugaa

SEQ ID NO: 4189349 - RNA, 15 nt, Yersinia pestis KIM
aagcugcgcugaccu

SEQ ID NO: 4189350 - RNA, 16 nt, Yersinia pestis KIM
aagcugcgcugaccua

SEQ ID NO: 4189351 - RNA, 14 nt, Yersinia pestis KIM
aagcuggcccugau

SEQ ID NO: 4189352 - RNA, 14 nt, Yersinia pestis KIM
aagcugggaaggcg

SEQ ID NO: 4189353 - RNA, 14 nt, Yersinia pestis KIM
aagcugucagucca

SEQ ID NO: 4189354 - RNA, 14 nt, Yersinia pestis KIM
aagcuuaauauuau

SEQ ID NO: 4189355 - RNA, 16 nt, Yersinia pestis KIM
aagcuuaguauccgcg

SEQ ID NO: 4189356 - RNA, 15 nt, Yersinia pestis KIM
aagcuucaacuuaau

SEQ ID NO: 4189357 - RNA, 21 nt, Yersinia pestis KIM
aagcuucaacuuccagugcca

SEQ ID NO: 4189358 - RNA, 23 nt, Yersinia pestis KIM
aaggaaaaguagccaauagacaa

SEQ ID NO: 4189359 - RNA, 22 nt, Yersinia pestis KIM
aaggaaaauacccaaagucauu

SEQ ID NO: 4189360 - RNA, 14 nt, Yersinia pestis KIM
aaggaaacucauga

SEQ ID NO: 4189361 - RNA, 19 nt, Yersinia pestis KIM
aaggaagggguucuuccaa

SEQ ID NO: 4189362 - RNA, 20 nt, Yersinia pestis KIM
aaggaauauacuuuacauau

SEQ ID NO: 4189363 - RNA, 16 nt, Yersinia pestis KIM
aaggacaaugaaucga

SEQ ID NO: 4189364 - RNA, 16 nt, Yersinia pestis KIM
aaggacccguuuauaa

SEQ ID NO: 4189365 - RNA, 21 nt, Yersinia pestis KIM
aaggacgacggguauauugcc

SEQ ID NO: 4189366 - RNA, 13 nt, Yersinia pestis KIM
aaggacuuggcgu

SEQ ID NO: 4189367 - RNA, 23 nt, Yersinia pestis KIM
aaggacuuggcguaacugcauuu

SEQ ID NO: 4189368 - RNA, 16 nt, Yersinia pestis KIM
aaggagaaaggcguga

SEQ ID NO: 4189369 - RNA, 14 nt, Yersinia pestis KIM
aaggagagauuaga

SEQ ID NO: 4189370 - RNA, 13 nt, Yersinia pestis KIM
aaggauaagcagu

SEQ ID NO: 4189371 - RNA, 21 nt, Yersinia pestis KIM
aaggauacgcauuacccuguu

SEQ ID NO: 4189372 - RNA, 14 nt, Yersinia pestis KIM
aaggaugaauaaau

SEQ ID NO: 4189373 - RNA, 16 nt, Yersinia pestis KIM
aaggaugaauaaauga

SEQ ID NO: 4189374 - RNA, 17 nt, Yersinia pestis KIM
aaggauggcccaagcca

SEQ ID NO: 4189375 - RNA, 15 nt, Yersinia pestis KIM
aaggauugaccaaua

SEQ ID NO: 4189376 - RNA, 20 nt, Yersinia pestis KIM
aaggauuugaagacaacucu

SEQ ID NO: 4189377 - RNA, 21 nt, Yersinia pestis KIM
aaggcaaaaauugacgaaagu

SEQ ID NO: 4189378 - RNA, 19 nt, Yersinia pestis KIM
aaggcaaccagcacacagg

SEQ ID NO: 4189379 - RNA, 20 nt, Yersinia pestis KIM
aaggcaacgaaggcaacaac

SEQ ID NO: 4189380 - RNA, 13 nt, Yersinia pestis KIM
aaggcaauaccaa

SEQ ID NO: 4189381 - RNA, 15 nt, Yersinia pestis KIM
aaggcaauaccaaua

SEQ ID NO: 4189382 - RNA, 22 nt, Yersinia pestis KIM
aaggcacaucuccagaauauaa

SEQ ID NO: 4189383 - RNA, 13 nt, Yersinia pestis KIM
aaggcacccaugc

SEQ ID NO: 4189384 - RNA, 19 nt, Yersinia pestis KIM
aaggcacccaugcucccuc

SEQ ID NO: 4189385 - RNA, 13 nt, Yersinia pestis KIM
aaggcagaaaauc

SEQ ID NO: 4189386 - RNA, 16 nt, Yersinia pestis KIM
aaggcagaaaaucccg

SEQ ID NO: 4189387 - RNA, 13 nt, Yersinia pestis KIM
aaggcagugacag

SEQ ID NO: 4189388 - RNA, 13 nt, Yersinia pestis KIM
aaggcauccacau

SEQ ID NO: 4189389 - RNA, 16 nt, Yersinia pestis KIM
aaggcauccacaucuu

SEQ ID NO: 4189390 - RNA, 21 nt, Yersinia pestis KIM
aaggccaaccucuucguuguc

SEQ ID NO: 4189391 - RNA, 17 nt, Yersinia pestis KIM
aaggccagcagaacuaa

SEQ ID NO: 4189392 - RNA, 18 nt, Yersinia pestis KIM
aaggccauagaauaccca

SEQ ID NO: 4189393 - RNA, 16 nt, Yersinia pestis KIM
aaggcccuaaccaauu

SEQ ID NO: 4189394 - RNA, 14 nt, Yersinia pestis KIM
aaggccgaucaaca

SEQ ID NO: 4189395 - RNA, 19 nt, Yersinia pestis KIM
aaggccggauguaaaacac

SEQ ID NO: 4189396 - RNA, 15 nt, Yersinia pestis KIM
aaggcgaccaauggg

SEQ ID NO: 4189397 - RNA, 15 nt, Yersinia pestis KIM
aaggcggaugugggu

SEQ ID NO: 4189398 - RNA, 16 nt, Yersinia pestis KIM
aaggcggcagagccaa

SEQ ID NO: 4189399 - RNA, 15 nt, Yersinia pestis KIM
aaggcggccacugag

SEQ ID NO: 4189400 - RNA, 14 nt, Yersinia pestis KIM
aaggcggugaacag

SEQ ID NO: 4189401 - RNA, 15 nt, Yersinia pestis KIM
aaggcggugaacagu

SEQ ID NO: 4189402 - RNA, 16 nt, Yersinia pestis KIM
aaggcguuacccacau

SEQ ID NO: 4189403 - RNA, 14 nt, Yersinia pestis KIM
aaggcucuguuacc

SEQ ID NO: 4189404 - RNA, 21 nt, Yersinia pestis KIM
aaggcucuguuaccagccgcg

SEQ ID NO: 4189405 - RNA, 17 nt, Yersinia pestis KIM
aaggcuucggccagacg

SEQ ID NO: 4189406 - RNA, 18 nt, Yersinia pestis KIM
aaggcuucggccagacgg

SEQ ID NO: 4189407 - RNA, 22 nt, Yersinia pestis KIM
aagggaaauacccaaagucauu

SEQ ID NO: 4189408 - RNA, 20 nt, Yersinia pestis KIM
aagggagcuuugcuagugaa

SEQ ID NO: 4189409 - RNA, 13 nt, Yersinia pestis KIM
aagggauaugaca

SEQ ID NO: 4189410 - RNA, 16 nt, Yersinia pestis KIM
aagggcaagcgcuguu

SEQ ID NO: 4189411 - RNA, 20 nt, Yersinia pestis KIM
aagggccaccacgaaaaaau

SEQ ID NO: 4189412 - RNA, 22 nt, Yersinia pestis KIM
aagggccacccugccaaaaaau

SEQ ID NO: 4189413 - RNA, 20 nt, Yersinia pestis KIM
aagggccauuuugcugccag

SEQ ID NO: 4189414 - RNA, 15 nt, Yersinia pestis KIM
aagggcgcagccccc

SEQ ID NO: 4189415 - RNA, 21 nt, Yersinia pestis KIM
aagggcggccagcaagagcag

SEQ ID NO: 4189416 - RNA, 15 nt, Yersinia pestis KIM
aagggcugagcggau

SEQ ID NO: 4189417 - RNA, 14 nt, Yersinia pestis KIM
aaggguacagucua

SEQ ID NO: 4189418 - RNA, 16 nt, Yersinia pestis KIM
aaggguauugaagaua

SEQ ID NO: 4189419 - RNA, 20 nt, Yersinia pestis KIM
aagguauagcgauagaguug

SEQ ID NO: 4189420 - RNA, 16 nt, Yersinia pestis KIM
aagguauauuuucccg

SEQ ID NO: 4189421 - RNA, 13 nt, Yersinia pestis KIM
aaggucaguucac

SEQ ID NO: 4189422 - RNA, 21 nt, Yersinia pestis KIM
aagguccaacucccaaauaua

SEQ ID NO: 4189423 - RNA, 19 nt, Yersinia pestis KIM
aaggugcgccacuguucuu

SEQ ID NO: 4189424 - RNA, 18 nt, Yersinia pestis KIM
aaggugugauugaagcgu

SEQ ID NO: 4189425 - RNA, 19 nt, Yersinia pestis KIM
aaggugugcucacaaucuu

SEQ ID NO: 4189426 - RNA, 12 nt, Yersinia pestis KIM
aagguguuuaaa

SEQ ID NO: 4189427 - RNA, 11 nt, Yersinia pestis KIM
aaguaaaaaaa

SEQ ID NO: 4189428 - RNA, 20 nt, Yersinia pestis KIM
aaguaaauuccguggcuuag

SEQ ID NO: 4189429 - RNA, 22 nt, Yersinia pestis KIM
aaguaacuaacagauuguuggu

SEQ ID NO: 4189430 - RNA, 14 nt, Yersinia pestis KIM
aaguaaguuuaaac

SEQ ID NO: 4189431 - RNA, 14 nt, Yersinia pestis KIM
aaguaaucaggcau

SEQ ID NO: 4189432 - RNA, 21 nt, Yersinia pestis KIM
aaguaauuuaucaguagucaa

SEQ ID NO: 4189433 - RNA, 15 nt, Yersinia pestis KIM
aaguaccgaaggcag

SEQ ID NO: 4189434 - RNA, 19 nt, Yersinia pestis KIM
aaguacggugccagcagca

SEQ ID NO: 4189435 - RNA, 16 nt, Yersinia pestis KIM
aaguacuuauuugaaa

SEQ ID NO: 4189436 - RNA, 19 nt, Yersinia pestis KIM
aaguagccacuuaauaaug

SEQ ID NO: 4189437 - RNA, 18 nt, Yersinia pestis KIM
aaguaggcaucugccaca

SEQ ID NO: 4189438 - RNA, 13 nt, Yersinia pestis KIM
aaguaugcagggu

SEQ ID NO: 4189439 - RNA, 23 nt, Yersinia pestis KIM
aaguaugcguggguucuucaaag

SEQ ID NO: 4189440 - RNA, 19 nt, Yersinia pestis KIM
aaguauuaccaauaagcug

SEQ ID NO: 4189441 - RNA, 22 nt, Yersinia pestis KIM
aagucaugguacaacugcggcg

SEQ ID NO: 4189442 - RNA, 18 nt, Yersinia pestis KIM
aagucauuaacuguuaaa

SEQ ID NO: 4189443 - RNA, 23 nt, Yersinia pestis KIM
aagucauuaacuguuaaaacagg

SEQ ID NO: 4189444 - RNA, 21 nt, Yersinia pestis KIM
aagucauucuugguggagccu

SEQ ID NO: 4189445 - RNA, 19 nt, Yersinia pestis KIM
aagucauuggcguuacagc

SEQ ID NO: 4189446 - RNA, 20 nt, Yersinia pestis KIM
aaguccaagaagauaacuuu

SEQ ID NO: 4189447 - RNA, 23 nt, Yersinia pestis KIM
aaguccaagaagauaacuuuuua

SEQ ID NO: 4189448 - RNA, 14 nt, Yersinia pestis KIM
aaguccaucagccu

SEQ ID NO: 4189449 - RNA, 23 nt, Yersinia pestis KIM
aaguccuucggacgcuccucacu

SEQ ID NO: 4189450 - RNA, 18 nt, Yersinia pestis KIM
aagucgucugauauuaaa

SEQ ID NO: 4189451 - RNA, 22 nt, Yersinia pestis KIM
aagucgucugauauuaaaaaag

SEQ ID NO: 4189452 - RNA, 20 nt, Yersinia pestis KIM
aagucgugaucguuuuaugg

SEQ ID NO: 4189453 - RNA, 16 nt, Yersinia pestis KIM
aagucugaaaugauca

SEQ ID NO: 4189454 - RNA, 17 nt, Yersinia pestis KIM
aagucuuaaucuuuaau

SEQ ID NO: 4189455 - RNA, 16 nt, Yersinia pestis KIM
aagugaauaaaucaaa

SEQ ID NO: 4189456 - RNA, 13 nt, Yersinia pestis KIM
aagugaauaacgc

SEQ ID NO: 4189457 - RNA, 15 nt, Yersinia pestis KIM
aagugaauaacgcug

SEQ ID NO: 4189458 - RNA, 20 nt, Yersinia pestis KIM
aagugagaaggguauugaag

SEQ ID NO: 4189459 - RNA, 14 nt, Yersinia pestis KIM
aagugagcugaacu

SEQ ID NO: 4189460 - RNA, 15 nt, Yersinia pestis KIM
aagugagcugaacug

SEQ ID NO: 4189461 - RNA, 21 nt, Yersinia pestis KIM
aagugauucgggugagugaac

SEQ ID NO: 4189462 - RNA, 22 nt, Yersinia pestis KIM
aagugcaaacuuaaaaaucaaa

SEQ ID NO: 4189463 - RNA, 18 nt, Yersinia pestis KIM
aagugcaucgggagccac

SEQ ID NO: 4189464 - RNA, 20 nt, Yersinia pestis KIM
aagugcgaagcgcacccaaa

SEQ ID NO: 4189465 - RNA, 21 nt, Yersinia pestis KIM
aagugcgaagcgcacccaaaa

SEQ ID NO: 4189466 - RNA, 17 nt, Yersinia pestis KIM
aagugcugcaaggcauu

SEQ ID NO: 4189467 - RNA, 19 nt, Yersinia pestis KIM
aagugcugcaaggcauuaa

SEQ ID NO: 4189468 - RNA, 19 nt, Yersinia pestis KIM
aaguggccacucaccucag

SEQ ID NO: 4189469 - RNA, 23 nt, Yersinia pestis KIM
aaguggggauggugagcucaucu

SEQ ID NO: 4189470 - RNA, 22 nt, Yersinia pestis KIM
aaguguauucgcaucuuccaaa

SEQ ID NO: 4189471 - RNA, 21 nt, Yersinia pestis KIM
aaguguucacucaguugauca

SEQ ID NO: 4189472 - RNA, 14 nt, Yersinia pestis KIM
aaguguuucaaaua

SEQ ID NO: 4189473 - RNA, 11 nt, Yersinia pestis KIM
aaguuaaaaaa

SEQ ID NO: 4189474 - RNA, 15 nt, Yersinia pestis KIM
aaguuaaaaagccug

SEQ ID NO: 4189475 - RNA, 17 nt, Yersinia pestis KIM
aaguuaaaaagccugaa

SEQ ID NO: 4189476 - RNA, 21 nt, Yersinia pestis KIM
aaguuaaaaagccugaauucu

SEQ ID NO: 4189477 - RNA, 17 nt, Yersinia pestis KIM
aaguuaaugacaaagug

SEQ ID NO: 4189478 - RNA, 12 nt, Yersinia pestis KIM
aaguuaauguuu

SEQ ID NO: 4189479 - RNA, 15 nt, Yersinia pestis KIM
aaguuacgucagaaa

SEQ ID NO: 4189480 - RNA, 23 nt, Yersinia pestis KIM
aaguuacuuuuuuauuuuacuuu

SEQ ID NO: 4189481 - RNA, 18 nt, Yersinia pestis KIM
aaguuagcgauaucugcg

SEQ ID NO: 4189482 - RNA, 17 nt, Yersinia pestis KIM
aaguuagucgcaaagcg

SEQ ID NO: 4189483 - RNA, 14 nt, Yersinia pestis KIM
aaguuagugguguu

SEQ ID NO: 4189484 - RNA, 13 nt, Yersinia pestis KIM
aaguuaucaccaa

SEQ ID NO: 4189485 - RNA, 21 nt, Yersinia pestis KIM
aaguucacuugagagaaacuu

SEQ ID NO: 4189486 - RNA, 14 nt, Yersinia pestis KIM
aaguucgccuucag

SEQ ID NO: 4189487 - RNA, 17 nt, Yersinia pestis KIM
aaguucuaaggaaaaua

SEQ ID NO: 4189488 - RNA, 19 nt, Yersinia pestis KIM
aaguucucaucaaacucau

SEQ ID NO: 4189489 - RNA, 22 nt, Yersinia pestis KIM
aaguucuccggcggcuucauca

SEQ ID NO: 4189490 - RNA, 15 nt, Yersinia pestis KIM
aaguugaacaguggu

SEQ ID NO: 4189491 - RNA, 22 nt, Yersinia pestis KIM
aaguugaaccaaugaaucgggc

SEQ ID NO: 4189492 - RNA, 14 nt, Yersinia pestis KIM
aaguugagaucaac

SEQ ID NO: 4189493 - RNA, 17 nt, Yersinia pestis KIM
aaguugagcagcaauaa

SEQ ID NO: 4189494 - RNA, 19 nt, Yersinia pestis KIM
aaguugauaacgccggaua

SEQ ID NO: 4189495 - RNA, 15 nt, Yersinia pestis KIM
aaguugaugcaguga

SEQ ID NO: 4189496 - RNA, 23 nt, Yersinia pestis KIM
aaguugaugggaggaaacugccg

SEQ ID NO: 4189497 - RNA, 19 nt, Yersinia pestis KIM
aaguuucagcguggaauua

SEQ ID NO: 4189498 - RNA, 21 nt, Yersinia pestis KIM
aaguuuucuggcaauuucugu

SEQ ID NO: 4189499 - RNA, 22 nt, Yersinia pestis KIM
aaguuuucuggcaauuucuguu

SEQ ID NO: 4189500 - RNA, 13 nt, Yersinia pestis KIM
aauaaaaaaaaau

SEQ ID NO: 4189501 - RNA, 14 nt, Yersinia pestis KIM
aauaaaaaaaaaua

SEQ ID NO: 4189502 - RNA, 14 nt, Yersinia pestis KIM
aauaaaaaacugac

SEQ ID NO: 4189503 - RNA, 20 nt, Yersinia pestis KIM
aauaaaaaaggcagcguagg

SEQ ID NO: 4189504 - RNA, 18 nt, Yersinia pestis KIM
aauaaaaaauuauuaaau

SEQ ID NO: 4189505 - RNA, 13 nt, Yersinia pestis KIM
aauaaaacacccu

SEQ ID NO: 4189506 - RNA, 22 nt, Yersinia pestis KIM
aauaaaagagauguuauuugaa

SEQ ID NO: 4189507 - RNA, 11 nt, Yersinia pestis KIM
aauaaaauaag

SEQ ID NO: 4189508 - RNA, 12 nt, Yersinia pestis KIM
aauaaaaucaaa

SEQ ID NO: 4189509 - RNA, 14 nt, Yersinia pestis KIM
aauaaaaucugcuu

SEQ ID NO: 4189510 - RNA, 13 nt, Yersinia pestis KIM
aauaaacaaaaua

SEQ ID NO: 4189511 - RNA, 14 nt, Yersinia pestis KIM
aauaaacaaaauag

SEQ ID NO: 4189512 - RNA, 19 nt, Yersinia pestis KIM
aauaaacagacaaaaaaua

SEQ ID NO: 4189513 - RNA, 16 nt, Yersinia pestis KIM
aauaaaccauacauaa

SEQ ID NO: 4189514 - RNA, 16 nt, Yersinia pestis KIM
aauaaaccgaaaugau

SEQ ID NO: 4189515 - RNA, 19 nt, Yersinia pestis KIM
aauaaacgggcuuccauca

SEQ ID NO: 4189516 - RNA, 23 nt, Yersinia pestis KIM
aauaaacuaccgaucaucaggca

SEQ ID NO: 4189517 - RNA, 16 nt, Yersinia pestis KIM
aauaaagaguccccau

SEQ ID NO: 4189518 - RNA, 22 nt, Yersinia pestis KIM
aauaaagaguccccauaagcgg

SEQ ID NO: 4189519 - RNA, 18 nt, Yersinia pestis KIM
aauaaagcgauaaauacu

SEQ ID NO: 4189520 - RNA, 17 nt, Yersinia pestis KIM
aauaaagcucugacaaa

SEQ ID NO: 4189521 - RNA, 12 nt, Yersinia pestis KIM
aauaaaggcugu

SEQ ID NO: 4189522 - RNA, 16 nt, Yersinia pestis KIM
aauaaaggggguuuuc

SEQ ID NO: 4189523 - RNA, 22 nt, Yersinia pestis KIM
aauaaaguccaccucgaaauca

SEQ ID NO: 4189524 - RNA, 12 nt, Yersinia pestis KIM
aauaaauaaaaa

SEQ ID NO: 4189525 - RNA, 19 nt, Yersinia pestis KIM
aauaaauaaaaacgcagau

SEQ ID NO: 4189526 - RNA, 14 nt, Yersinia pestis KIM
aauaaauaaguuca

SEQ ID NO: 4189527 - RNA, 13 nt, Yersinia pestis KIM
aauaaauaauugg

SEQ ID NO: 4189528 - RNA, 23 nt, Yersinia pestis KIM
aauaaauagagugaaguaucacc

SEQ ID NO: 4189529 - RNA, 20 nt, Yersinia pestis KIM
aauaaaugaccaacuguaaa

SEQ ID NO: 4189530 - RNA, 19 nt, Yersinia pestis KIM
aauaaaugucacuugcccu

SEQ ID NO: 4189531 - RNA, 15 nt, Yersinia pestis KIM
aauaaauucaaaaua

SEQ ID NO: 4189532 - RNA, 20 nt, Yersinia pestis KIM
aauaaauucagguugaggca

SEQ ID NO: 4189533 - RNA, 21 nt, Yersinia pestis KIM
aauaaauuuaauaaguuaaua

SEQ ID NO: 4189534 - RNA, 20 nt, Yersinia pestis KIM
aauaaauuuucuaagcugcc

SEQ ID NO: 4189535 - RNA, 11 nt, Yersinia pestis KIM
aauaacaauau

SEQ ID NO: 4189536 - RNA, 19 nt, Yersinia pestis KIM
aauaacacggccuauugaa

SEQ ID NO: 4189537 - RNA, 14 nt, Yersinia pestis KIM
aauaaccauuaauu

SEQ ID NO: 4189538 - RNA, 23 nt, Yersinia pestis KIM
aauaaccauuaauugguuuuaau

SEQ ID NO: 4189539 - RNA, 13 nt, Yersinia pestis KIM
aauaaccggguaa

SEQ ID NO: 4189540 - RNA, 16 nt, Yersinia pestis KIM
aauaaccguuucagga

SEQ ID NO: 4189541 - RNA, 17 nt, Yersinia pestis KIM
aauaaccguuucaggag

SEQ ID NO: 4189542 - RNA, 17 nt, Yersinia pestis KIM
aauaaccuacaaaaaua

SEQ ID NO: 4189543 - RNA, 15 nt, Yersinia pestis KIM
aauaaccucaaaagg

SEQ ID NO: 4189544 - RNA, 21 nt, Yersinia pestis KIM
aauaaccucacgcagcguagg

SEQ ID NO: 4189545 - RNA, 23 nt, Yersinia pestis KIM
aauaaccucacgggcuuccauca

SEQ ID NO: 4189546 - RNA, 15 nt, Yersinia pestis KIM
aauaaccucagccuc

SEQ ID NO: 4189547 - RNA, 23 nt, Yersinia pestis KIM
aauaacgauuaauuaguuuuaau

SEQ ID NO: 4189548 - RNA, 18 nt, Yersinia pestis KIM
aauaacggaaaaucaucg

SEQ ID NO: 4189549 - RNA, 21 nt, Yersinia pestis KIM
aauaacgucaauaccgugaga

SEQ ID NO: 4189550 - RNA, 14 nt, Yersinia pestis KIM
aauaacucagggcu

SEQ ID NO: 4189551 - RNA, 16 nt, Yersinia pestis KIM
aauaacuccacuucuu

SEQ ID NO: 4189552 - RNA, 15 nt, Yersinia pestis KIM
aauaacugccagggc

SEQ ID NO: 4189553 - RNA, 23 nt, Yersinia pestis KIM
aauaacugggccacgaugugaag

SEQ ID NO: 4189554 - RNA, 15 nt, Yersinia pestis KIM
aauaacuuaaauaau

SEQ ID NO: 4189555 - RNA, 16 nt, Yersinia pestis KIM
aauaacuuaaauaauu

SEQ ID NO: 4189556 - RNA, 19 nt, Yersinia pestis KIM
aauaacuuauuacaccuua

SEQ ID NO: 4189557 - RNA, 18 nt, Yersinia pestis KIM
aauaacuucaguuacuca

SEQ ID NO: 4189558 - RNA, 20 nt, Yersinia pestis KIM
aauaacuucgcgaacacaau

SEQ ID NO: 4189559 - RNA, 12 nt, Yersinia pestis KIM
aauaagaaugac

SEQ ID NO: 4189560 - RNA, 17 nt, Yersinia pestis KIM
aauaagaucaauauguu

SEQ ID NO: 4189561 - RNA, 15 nt, Yersinia pestis KIM
aauaagaugggcuua

SEQ ID NO: 4189562 - RNA, 21 nt, Yersinia pestis KIM
aauaagccgcaggcaaacaau

SEQ ID NO: 4189563 - RNA, 12 nt, Yersinia pestis KIM
aauaagcguagg

SEQ ID NO: 4189564 - RNA, 22 nt, Yersinia pestis KIM
aauaagcuacgccaugcagcua

SEQ ID NO: 4189565 - RNA, 19 nt, Yersinia pestis KIM
aauaagggauaugaauaaa

SEQ ID NO: 4189566 - RNA, 13 nt, Yersinia pestis KIM
aauaagggccacc

SEQ ID NO: 4189567 - RNA, 23 nt, Yersinia pestis KIM
aauaaguaggcaucugccacacu

SEQ ID NO: 4189568 - RNA, 14 nt, Yersinia pestis KIM
aauaaguauuucaa

SEQ ID NO: 4189569 - RNA, 15 nt, Yersinia pestis KIM
aauaagugaaacaaa

SEQ ID NO: 4189570 - RNA, 20 nt, Yersinia pestis KIM
aauaagugcaaacuuaaaaa

SEQ ID NO: 4189571 - RNA, 20 nt, Yersinia pestis KIM
aauaaguguguguauuuaaa

SEQ ID NO: 4189572 - RNA, 20 nt, Yersinia pestis KIM
aauaaguguuucaaauaagu

SEQ ID NO: 4189573 - RNA, 21 nt, Yersinia pestis KIM
aauaaguuacgucagaaauaa

SEQ ID NO: 4189574 - RNA, 22 nt, Yersinia pestis KIM
aauaaguuacgucagaaauaaa

SEQ ID NO: 4189575 - RNA, 12 nt, Yersinia pestis KIM
aauaaguucaga

SEQ ID NO: 4189576 - RNA, 11 nt, Yersinia pestis KIM
aauaauaaaaa

SEQ ID NO: 4189577 - RNA, 12 nt, Yersinia pestis KIM
aauaauaaaaaa

SEQ ID NO: 4189578 - RNA, 13 nt, Yersinia pestis KIM
aauaauaaaaaaa

SEQ ID NO: 4189579 - RNA, 15 nt, Yersinia pestis KIM
aauaauaaauaaauu

SEQ ID NO: 4189580 - RNA, 11 nt, Yersinia pestis KIM
aauaauaaugc

SEQ ID NO: 4189581 - RNA, 15 nt, Yersinia pestis KIM
aauaauaauggugaa

SEQ ID NO: 4189582 - RNA, 16 nt, Yersinia pestis KIM
aauaauagauaguacu

SEQ ID NO: 4189583 - RNA, 14 nt, Yersinia pestis KIM
aauaauauaauuca

SEQ ID NO: 4189584 - RNA, 20 nt, Yersinia pestis KIM
aauaauaucggcggcaaaga

SEQ ID NO: 4189585 - RNA, 23 nt, Yersinia pestis KIM
aauaauaucggcggcaaagacau

SEQ ID NO: 4189586 - RNA, 14 nt, Yersinia pestis KIM
aauaauauucaaua

SEQ ID NO: 4189587 - RNA, 14 nt, Yersinia pestis KIM
aauaaucauaucaa

SEQ ID NO: 4189588 - RNA, 15 nt, Yersinia pestis KIM
aauaaucauaucaaa

SEQ ID NO: 4189589 - RNA, 19 nt, Yersinia pestis KIM
aauaauccgguuagcaaaa

SEQ ID NO: 4189590 - RNA, 20 nt, Yersinia pestis KIM
aauaaucgggaaauugugau

SEQ ID NO: 4189591 - RNA, 17 nt, Yersinia pestis KIM
aauaaucuggaugagua

SEQ ID NO: 4189592 - RNA, 18 nt, Yersinia pestis KIM
aauaaucuuaaguaaauu

SEQ ID NO: 4189593 - RNA, 14 nt, Yersinia pestis KIM
aauaaucuugugau

SEQ ID NO: 4189594 - RNA, 14 nt, Yersinia pestis KIM
aauaaugaacaaau

SEQ ID NO: 4189595 - RNA, 15 nt, Yersinia pestis KIM
aauaaugaacaaaua

SEQ ID NO: 4189596 - RNA, 16 nt, Yersinia pestis KIM
aauaaugaacaaauau

SEQ ID NO: 4189597 - RNA, 16 nt, Yersinia pestis KIM
aauaaugagccauaaa

SEQ ID NO: 4189598 - RNA, 21 nt, Yersinia pestis KIM
aauaauguccccuugaguauc

SEQ ID NO: 4189599 - RNA, 14 nt, Yersinia pestis KIM
aauaauuaaaccuc

SEQ ID NO: 4189600 - RNA, 22 nt, Yersinia pestis KIM
aauaauuaaaccucagaaaaau

SEQ ID NO: 4189601 - RNA, 15 nt, Yersinia pestis KIM
aauaauuacagcugg

SEQ ID NO: 4189602 - RNA, 16 nt, Yersinia pestis KIM
aauaauuacuuauaaa

SEQ ID NO: 4189603 - RNA, 17 nt, Yersinia pestis KIM
aauaauuacuuauaaac

SEQ ID NO: 4189604 - RNA, 14 nt, Yersinia pestis KIM
aauaauucagguug

SEQ ID NO: 4189605 - RNA, 20 nt, Yersinia pestis KIM
aauaauugccgcucaaguug

SEQ ID NO: 4189606 - RNA, 18 nt, Yersinia pestis KIM
aauaauugguagccacaa

SEQ ID NO: 4189607 - RNA, 20 nt, Yersinia pestis KIM
aauaauuuauacauaucaga

SEQ ID NO: 4189608 - RNA, 18 nt, Yersinia pestis KIM
aauacaaauauaaugcug

SEQ ID NO: 4189609 - RNA, 15 nt, Yersinia pestis KIM
aauacaaccaacaaa

SEQ ID NO: 4189610 - RNA, 17 nt, Yersinia pestis KIM
aauacaaccaacaaaca

SEQ ID NO: 4189611 - RNA, 18 nt, Yersinia pestis KIM
aauacaaccaacaaacaa

SEQ ID NO: 4189612 - RNA, 12 nt, Yersinia pestis KIM
aauacagccagc

SEQ ID NO: 4189613 - RNA, 23 nt, Yersinia pestis KIM
aauacaggcaucgguaauacucu

SEQ ID NO: 4189614 - RNA, 15 nt, Yersinia pestis KIM
aauacauaucaacac

SEQ ID NO: 4189615 - RNA, 17 nt, Yersinia pestis KIM
aauacauaucaacacug

SEQ ID NO: 4189616 - RNA, 20 nt, Yersinia pestis KIM
aauacauaucaacacugccu

SEQ ID NO: 4189617 - RNA, 14 nt, Yersinia pestis KIM
aauacaucaucaaa

SEQ ID NO: 4189618 - RNA, 23 nt, Yersinia pestis KIM
aauacauccauguaggcucgagc

SEQ ID NO: 4189619 - RNA, 13 nt, Yersinia pestis KIM
aauaccaaauuua

SEQ ID NO: 4189620 - RNA, 14 nt, Yersinia pestis KIM
aauaccaaauuuac

SEQ ID NO: 4189621 - RNA, 14 nt, Yersinia pestis KIM
aauaccaaugcugu

SEQ ID NO: 4189622 - RNA, 18 nt, Yersinia pestis KIM
aauaccaauuaauaagau

SEQ ID NO: 4189623 - RNA, 13 nt, Yersinia pestis KIM
aauaccacggcac

SEQ ID NO: 4189624 - RNA, 17 nt, Yersinia pestis KIM
aauaccagaugcauaua

SEQ ID NO: 4189625 - RNA, 14 nt, Yersinia pestis KIM
aauaccauauaccc

SEQ ID NO: 4189626 - RNA, 19 nt, Yersinia pestis KIM
aauaccauuuucagacuga

SEQ ID NO: 4189627 - RNA, 18 nt, Yersinia pestis KIM
aauacccaaaauuugcuu

SEQ ID NO: 4189628 - RNA, 17 nt, Yersinia pestis KIM
aauacccagcuucuuuu

SEQ ID NO: 4189629 - RNA, 14 nt, Yersinia pestis KIM
aauaccccccacca

SEQ ID NO: 4189630 - RNA, 19 nt, Yersinia pestis KIM
aauaccccccaccaauugg

SEQ ID NO: 4189631 - RNA, 21 nt, Yersinia pestis KIM
aauacccggccaauaaagcuc

SEQ ID NO: 4189632 - RNA, 15 nt, Yersinia pestis KIM
aauaccgacgugugc

SEQ ID NO: 4189633 - RNA, 23 nt, Yersinia pestis KIM
aauaccgaugagcugaauagccu

SEQ ID NO: 4189634 - RNA, 17 nt, Yersinia pestis KIM
aauaccgccacacaaua

SEQ ID NO: 4189635 - RNA, 18 nt, Yersinia pestis KIM
aauaccgcgaucaacaag

SEQ ID NO: 4189636 - RNA, 20 nt, Yersinia pestis KIM
aauaccgguggcauuguuca

SEQ ID NO: 4189637 - RNA, 18 nt, Yersinia pestis KIM
aauaccugaauagaaguc

SEQ ID NO: 4189638 - RNA, 16 nt, Yersinia pestis KIM
aauaccugcaccaaug

SEQ ID NO: 4189639 - RNA, 21 nt, Yersinia pestis KIM
aauaccuuacuguaucaauac

SEQ ID NO: 4189640 - RNA, 16 nt, Yersinia pestis KIM
aauacgaccgucacca

SEQ ID NO: 4189641 - RNA, 17 nt, Yersinia pestis KIM
aauacgccccugaucau

SEQ ID NO: 4189642 - RNA, 20 nt, Yersinia pestis KIM
aauacgcuaucgcgaaacuc

SEQ ID NO: 4189643 - RNA, 23 nt, Yersinia pestis KIM
aauacgcuaucgcgaaacucuuc

SEQ ID NO: 4189644 - RNA, 18 nt, Yersinia pestis KIM
aauacgcugucugaauag

SEQ ID NO: 4189645 - RNA, 16 nt, Yersinia pestis KIM
aauacggcacucaaau

SEQ ID NO: 4189646 - RNA, 17 nt, Yersinia pestis KIM
aauacggcguuugacaa

SEQ ID NO: 4189647 - RNA, 17 nt, Yersinia pestis KIM
aauacgggugaacaugc

SEQ ID NO: 4189648 - RNA, 17 nt, Yersinia pestis KIM
aauacgguguaaaccgc

SEQ ID NO: 4189649 - RNA, 20 nt, Yersinia pestis KIM
aauacgguucaaaucaguuc

SEQ ID NO: 4189650 - RNA, 17 nt, Yersinia pestis KIM
aauacgugguuugauaa

SEQ ID NO: 4189651 - RNA, 17 nt, Yersinia pestis KIM
aauacguuccaacgcac

SEQ ID NO: 4189652 - RNA, 15 nt, Yersinia pestis KIM
aauacucauuuuuaa

SEQ ID NO: 4189653 - RNA, 18 nt, Yersinia pestis KIM
aauacucuguuaccaaug

SEQ ID NO: 4189654 - RNA, 16 nt, Yersinia pestis KIM
aauacugccuaacugg

SEQ ID NO: 4189655 - RNA, 19 nt, Yersinia pestis KIM
aauacugcugugccagagu

SEQ ID NO: 4189656 - RNA, 14 nt, Yersinia pestis KIM
aauacuguuaucac

SEQ ID NO: 4189657 - RNA, 17 nt, Yersinia pestis KIM
aauacuuaacaaucagu

SEQ ID NO: 4189658 - RNA, 20 nt, Yersinia pestis KIM
aauacuuauuugaaacagau

SEQ ID NO: 4189659 - RNA, 14 nt, Yersinia pestis KIM
aauacuucaggcca

SEQ ID NO: 4189660 - RNA, 15 nt, Yersinia pestis KIM
aauacuucaggccaa

SEQ ID NO: 4189661 - RNA, 14 nt, Yersinia pestis KIM
aauagaaaacagca

SEQ ID NO: 4189662 - RNA, 16 nt, Yersinia pestis KIM
aauagaaaggcuauca

SEQ ID NO: 4189663 - RNA, 16 nt, Yersinia pestis KIM
aauagacucgguagcg

SEQ ID NO: 4189664 - RNA, 22 nt, Yersinia pestis KIM
aauagagacggaaagagccagc

SEQ ID NO: 4189665 - RNA, 14 nt, Yersinia pestis KIM
aauagagcaccaaa

SEQ ID NO: 4189666 - RNA, 21 nt, Yersinia pestis KIM
aauagagcaccaaaucuucca

SEQ ID NO: 4189667 - RNA, 21 nt, Yersinia pestis KIM
aauagagccucuauuaccuca

SEQ ID NO: 4189668 - RNA, 13 nt, Yersinia pestis KIM
aauagaggacuau

SEQ ID NO: 4189669 - RNA, 15 nt, Yersinia pestis KIM
aauagauaaaaacau

SEQ ID NO: 4189670 - RNA, 20 nt, Yersinia pestis KIM
aauagauaaaaacauuuaaa

SEQ ID NO: 4189671 - RNA, 14 nt, Yersinia pestis KIM
aauagauaacaaac

SEQ ID NO: 4189672 - RNA, 20 nt, Yersinia pestis KIM
aauagauaucgaaacacaua

SEQ ID NO: 4189673 - RNA, 15 nt, Yersinia pestis KIM
aauagaucccauacc

SEQ ID NO: 4189674 - RNA, 19 nt, Yersinia pestis KIM
aauagcaacgcucaauggc

SEQ ID NO: 4189675 - RNA, 14 nt, Yersinia pestis KIM
aauagcaccauuag

SEQ ID NO: 4189676 - RNA, 18 nt, Yersinia pestis KIM
aauagcaccgagcaugcu

SEQ ID NO: 4189677 - RNA, 13 nt, Yersinia pestis KIM
aauagcauaaaua

SEQ ID NO: 4189678 - RNA, 21 nt, Yersinia pestis KIM
aauagccggcucuucucgaau

SEQ ID NO: 4189679 - RNA, 16 nt, Yersinia pestis KIM
aauagccguaggccac

SEQ ID NO: 4189680 - RNA, 15 nt, Yersinia pestis KIM
aauagcgaucagcaa

SEQ ID NO: 4189681 - RNA, 16 nt, Yersinia pestis KIM
aauagcgccugcccuc

SEQ ID NO: 4189682 - RNA, 13 nt, Yersinia pestis KIM
aauagcgcugcau

SEQ ID NO: 4189683 - RNA, 19 nt, Yersinia pestis KIM
aauagcuaccccuucaguc

SEQ ID NO: 4189684 - RNA, 21 nt, Yersinia pestis KIM
aauagcuaccccuucagucag

SEQ ID NO: 4189685 - RNA, 22 nt, Yersinia pestis KIM
aauagcugguagugauccccca

SEQ ID NO: 4189686 - RNA, 17 nt, Yersinia pestis KIM
aauagcuuaaucaucau

SEQ ID NO: 4189687 - RNA, 20 nt, Yersinia pestis KIM
aauagcuuaaucaucaucac

SEQ ID NO: 4189688 - RNA, 15 nt, Yersinia pestis KIM
aauaggcaggggagu

SEQ ID NO: 4189689 - RNA, 14 nt, Yersinia pestis KIM
aauaggcugaucaa

SEQ ID NO: 4189690 - RNA, 10 nt, Yersinia pestis KIM
aauagggaag

SEQ ID NO: 4189691 - RNA, 22 nt, Yersinia pestis KIM
aauaggggcgguggcuaacuga

SEQ ID NO: 4189692 - RNA, 11 nt, Yersinia pestis KIM
aauagguagug

SEQ ID NO: 4189693 - RNA, 20 nt, Yersinia pestis KIM
aauaggucagugguuuuaua

SEQ ID NO: 4189694 - RNA, 22 nt, Yersinia pestis KIM
aauaggucagugguuuuauaaa

SEQ ID NO: 4189695 - RNA, 21 nt, Yersinia pestis KIM
aauaggucagugguuuuauca

SEQ ID NO: 4189696 - RNA, 16 nt, Yersinia pestis KIM
aauagguuggcauuag

SEQ ID NO: 4189697 - RNA, 17 nt, Yersinia pestis KIM
aauaguacuugccacaa

SEQ ID NO: 4189698 - RNA, 15 nt, Yersinia pestis KIM
aauagucauauauuu

SEQ ID NO: 4189699 - RNA, 15 nt, Yersinia pestis KIM
aauagucguuauaua

SEQ ID NO: 4189700 - RNA, 20 nt, Yersinia pestis KIM
aauagugauuguuugauuau

SEQ ID NO: 4189701 - RNA, 20 nt, Yersinia pestis KIM
aauagugcgaucaaaaacgu

SEQ ID NO: 4189702 - RNA, 22 nt, Yersinia pestis KIM
aauagugcuaucugcugcggua

SEQ ID NO: 4189703 - RNA, 15 nt, Yersinia pestis KIM
aauaguuacuauaua

SEQ ID NO: 4189704 - RNA, 20 nt, Yersinia pestis KIM
aauaguuacuauauaaauga

SEQ ID NO: 4189705 - RNA, 13 nt, Yersinia pestis KIM
aauaguucauuuu

SEQ ID NO: 4189706 - RNA, 19 nt, Yersinia pestis KIM
aauaguucuucgcaaugau

SEQ ID NO: 4189707 - RNA, 18 nt, Yersinia pestis KIM
aauauaaaagcacagaca

SEQ ID NO: 4189708 - RNA, 14 nt, Yersinia pestis KIM
aauauaaaauaaua

SEQ ID NO: 4189709 - RNA, 13 nt, Yersinia pestis KIM
aauauaacaaugu

SEQ ID NO: 4189710 - RNA, 12 nt, Yersinia pestis KIM
aauauaaugcug

SEQ ID NO: 4189711 - RNA, 13 nt, Yersinia pestis KIM
aauauacuuuaca

SEQ ID NO: 4189712 - RNA, 17 nt, Yersinia pestis KIM
aauauaugauaccaaac

SEQ ID NO: 4189713 - RNA, 14 nt, Yersinia pestis KIM
aauaucaaaacuga

SEQ ID NO: 4189714 - RNA, 18 nt, Yersinia pestis KIM
aauaucaaaacugauuaa

SEQ ID NO: 4189715 - RNA, 16 nt, Yersinia pestis KIM
aauaucaacagaacua

SEQ ID NO: 4189716 - RNA, 21 nt, Yersinia pestis KIM
aauaucaacagaacuaauauc

SEQ ID NO: 4189717 - RNA, 17 nt, Yersinia pestis KIM
aauaucaagucuugaag

SEQ ID NO: 4189718 - RNA, 12 nt, Yersinia pestis KIM
aauaucaaugau

SEQ ID NO: 4189719 - RNA, 15 nt, Yersinia pestis KIM
aauaucacugauauc

SEQ ID NO: 4189720 - RNA, 16 nt, Yersinia pestis KIM
aauaucagcgauuaaa

SEQ ID NO: 4189721 - RNA, 19 nt, Yersinia pestis KIM
aauaucagucgcuuuuuaa

SEQ ID NO: 4189722 - RNA, 21 nt, Yersinia pestis KIM
aauaucagugacaccauugau

SEQ ID NO: 4189723 - RNA, 19 nt, Yersinia pestis KIM
aauaucauauaguuuuugc

SEQ ID NO: 4189724 - RNA, 12 nt, Yersinia pestis KIM
aauaucaucauc

SEQ ID NO: 4189725 - RNA, 13 nt, Yersinia pestis KIM
aauaucaucaucu

SEQ ID NO: 4189726 - RNA, 20 nt, Yersinia pestis KIM
aauaucauccccuuucugcu

SEQ ID NO: 4189727 - RNA, 18 nt, Yersinia pestis KIM
aauaucaucuuuuucugc

SEQ ID NO: 4189728 - RNA, 14 nt, Yersinia pestis KIM
aauaucauuaacaa

SEQ ID NO: 4189729 - RNA, 13 nt, Yersinia pestis KIM
aauaucauuauuu

SEQ ID NO: 4189730 - RNA, 21 nt, Yersinia pestis KIM
aauauccaaccaaccaugcug

SEQ ID NO: 4189731 - RNA, 13 nt, Yersinia pestis KIM
aauauccaauggu

SEQ ID NO: 4189732 - RNA, 14 nt, Yersinia pestis KIM
aauauccaauggug

SEQ ID NO: 4189733 - RNA, 20 nt, Yersinia pestis KIM
aauauccauauuaaaugcau

SEQ ID NO: 4189734 - RNA, 17 nt, Yersinia pestis KIM
aauaucccgagaaacaa

SEQ ID NO: 4189735 - RNA, 21 nt, Yersinia pestis KIM
aauaucccgagaaacaaaacc

SEQ ID NO: 4189736 - RNA, 14 nt, Yersinia pestis KIM
aauauccuggaagc

SEQ ID NO: 4189737 - RNA, 23 nt, Yersinia pestis KIM
aauaucgauuuuuaagucaauuu

SEQ ID NO: 4189738 - RNA, 17 nt, Yersinia pestis KIM
aauaucgcuaaacuuau

SEQ ID NO: 4189739 - RNA, 15 nt, Yersinia pestis KIM
aauaucgguaaaaaa

SEQ ID NO: 4189740 - RNA, 18 nt, Yersinia pestis KIM
aauaucgguaaaaaauca

SEQ ID NO: 4189741 - RNA, 23 nt, Yersinia pestis KIM
aauaucuauauagggaaauaaca

SEQ ID NO: 4189742 - RNA, 16 nt, Yersinia pestis KIM
aauaucuauuuccauc

SEQ ID NO: 4189743 - RNA, 22 nt, Yersinia pestis KIM
aauaucugccaccgcacaguua

SEQ ID NO: 4189744 - RNA, 20 nt, Yersinia pestis KIM
aauaucuguggugacaugau

SEQ ID NO: 4189745 - RNA, 22 nt, Yersinia pestis KIM
aauaucuuccacaugcuuuuuu

SEQ ID NO: 4189746 - RNA, 16 nt, Yersinia pestis KIM
aauaucuuucauauca

SEQ ID NO: 4189747 - RNA, 17 nt, Yersinia pestis KIM
aauaugaaggccauaau

SEQ ID NO: 4189748 - RNA, 13 nt, Yersinia pestis KIM
aauaugcacguca

SEQ ID NO: 4189749 - RNA, 22 nt, Yersinia pestis KIM
aauaugcggcauaacugaauac

SEQ ID NO: 4189750 - RNA, 20 nt, Yersinia pestis KIM
aauaugcugugguucaauug

SEQ ID NO: 4189751 - RNA, 13 nt, Yersinia pestis KIM
aauauggcaugug

SEQ ID NO: 4189752 - RNA, 18 nt, Yersinia pestis KIM
aauauggcggcaucagca

SEQ ID NO: 4189753 - RNA, 22 nt, Yersinia pestis KIM
aauauguaguuguaccccugaa

SEQ ID NO: 4189754 - RNA, 20 nt, Yersinia pestis KIM
aauaugugacaauaguguug

SEQ ID NO: 4189755 - RNA, 15 nt, Yersinia pestis KIM
aauauguucuucuug

SEQ ID NO: 4189756 - RNA, 17 nt, Yersinia pestis KIM
aauauuaacugcaguga

SEQ ID NO: 4189757 - RNA, 13 nt, Yersinia pestis KIM
aauauuaauaaug

SEQ ID NO: 4189758 - RNA, 13 nt, Yersinia pestis KIM
aauauuauucagu

SEQ ID NO: 4189759 - RNA, 17 nt, Yersinia pestis KIM
aauauucaguaagguuu

SEQ ID NO: 4189760 - RNA, 16 nt, Yersinia pestis KIM
aauauucauucuuauc

SEQ ID NO: 4189761 - RNA, 20 nt, Yersinia pestis KIM
aauauuccaaaaaauagccg

SEQ ID NO: 4189762 - RNA, 18 nt, Yersinia pestis KIM
aauauuccugagcuggcu

SEQ ID NO: 4189763 - RNA, 16 nt, Yersinia pestis KIM
aauauucgcagccaaa

SEQ ID NO: 4189764 - RNA, 18 nt, Yersinia pestis KIM
aauauucgcagccaaaau

SEQ ID NO: 4189765 - RNA, 23 nt, Yersinia pestis KIM
aauauucgcauucgugccauaaa

SEQ ID NO: 4189766 - RNA, 19 nt, Yersinia pestis KIM
aauauucucaauauuaaua

SEQ ID NO: 4189767 - RNA, 14 nt, Yersinia pestis KIM
aauauugaauuaaa

SEQ ID NO: 4189768 - RNA, 22 nt, Yersinia pestis KIM
aauauugacaggaucaggccag

SEQ ID NO: 4189769 - RNA, 12 nt, Yersinia pestis KIM
aauauugcacaa

SEQ ID NO: 4189770 - RNA, 18 nt, Yersinia pestis KIM
aauauugcacaauagcua

SEQ ID NO: 4189771 - RNA, 12 nt, Yersinia pestis KIM
aauauugccgca

SEQ ID NO: 4189772 - RNA, 14 nt, Yersinia pestis KIM
aauauuggauaaua

SEQ ID NO: 4189773 - RNA, 21 nt, Yersinia pestis KIM
aauauuggauaauaaccugau

SEQ ID NO: 4189774 - RNA, 19 nt, Yersinia pestis KIM
aauauugucuuaugauaua

SEQ ID NO: 4189775 - RNA, 19 nt, Yersinia pestis KIM
aauauuuacggugagaaua

SEQ ID NO: 4189776 - RNA, 16 nt, Yersinia pestis KIM
aauauuuauaaaaaau

SEQ ID NO: 4189777 - RNA, 12 nt, Yersinia pestis KIM
aauauuuaucca

SEQ ID NO: 4189778 - RNA, 20 nt, Yersinia pestis KIM
aauauuuguuugaauuuuag

SEQ ID NO: 4189779 - RNA, 15 nt, Yersinia pestis KIM
aauauuuucauuugg

SEQ ID NO: 4189780 - RNA, 17 nt, Yersinia pestis KIM
aauauuuuuaaucugcc

SEQ ID NO: 4189781 - RNA, 23 nt, Yersinia pestis KIM
aaucaaaaaacagaauagugggu

SEQ ID NO: 4189782 - RNA, 13 nt, Yersinia pestis KIM
aaucaaaaaauaa

SEQ ID NO: 4189783 - RNA, 14 nt, Yersinia pestis KIM
aaucaaaaaauaaa

SEQ ID NO: 4189784 - RNA, 17 nt, Yersinia pestis KIM
aaucaaaaauugcccca

SEQ ID NO: 4189785 - RNA, 12 nt, Yersinia pestis KIM
aaucaaaacagg

SEQ ID NO: 4189786 - RNA, 17 nt, Yersinia pestis KIM
aaucaaaagggaucacc

SEQ ID NO: 4189787 - RNA, 13 nt, Yersinia pestis KIM
aaucaacagauau

SEQ ID NO: 4189788 - RNA, 21 nt, Yersinia pestis KIM
aaucaacagauaugcauuauu

SEQ ID NO: 4189789 - RNA, 21 nt, Yersinia pestis KIM
aaucaaccacgguaauagcuu

SEQ ID NO: 4189790 - RNA, 21 nt, Yersinia pestis KIM
aaucaacgaaacgcauaagaa

SEQ ID NO: 4189791 - RNA, 16 nt, Yersinia pestis KIM
aaucaacgcucaauca

SEQ ID NO: 4189792 - RNA, 22 nt, Yersinia pestis KIM
aaucaacgcuccgguuuucacc

SEQ ID NO: 4189793 - RNA, 14 nt, Yersinia pestis KIM
aaucaacggcacca

SEQ ID NO: 4189794 - RNA, 14 nt, Yersinia pestis KIM
aaucaagcccgcaa

SEQ ID NO: 4189795 - RNA, 14 nt, Yersinia pestis KIM
aaucaagcgccauu

SEQ ID NO: 4189796 - RNA, 17 nt, Yersinia pestis KIM
aaucaagcuacgccaag

SEQ ID NO: 4189797 - RNA, 15 nt, Yersinia pestis KIM
aaucaaggcuuuaau

SEQ ID NO: 4189798 - RNA, 19 nt, Yersinia pestis KIM
aaucaagggcgauaccaua

SEQ ID NO: 4189799 - RNA, 23 nt, Yersinia pestis KIM
aaucaagugcgaaaauuuaacua

SEQ ID NO: 4189800 - RNA, 14 nt, Yersinia pestis KIM
aaucaaguugaaug

SEQ ID NO: 4189801 - RNA, 14 nt, Yersinia pestis KIM
aaucaauaagcuac

SEQ ID NO: 4189802 - RNA, 17 nt, Yersinia pestis KIM
aaucaauguauugcucc

SEQ ID NO: 4189803 - RNA, 15 nt, Yersinia pestis KIM
aaucaauugccccca

SEQ ID NO: 4189804 - RNA, 20 nt, Yersinia pestis KIM
aaucacacgggaucuacaua

SEQ ID NO: 4189805 - RNA, 20 nt, Yersinia pestis KIM
aaucacaucaccgacagcau

SEQ ID NO: 4189806 - RNA, 11 nt, Yersinia pestis KIM
aaucaccaaca

SEQ ID NO: 4189807 - RNA, 17 nt, Yersinia pestis KIM
aaucacccgcaagaaua

SEQ ID NO: 4189808 - RNA, 19 nt, Yersinia pestis KIM
aaucaccucaaacugacuu

SEQ ID NO: 4189809 - RNA, 18 nt, Yersinia pestis KIM
aaucaccuuggaaaacag

SEQ ID NO: 4189810 - RNA, 19 nt, Yersinia pestis KIM
aaucaccuuggaaaacagc

SEQ ID NO: 4189811 - RNA, 21 nt, Yersinia pestis KIM
aaucaccuuggaaaacagcaa

SEQ ID NO: 4189812 - RNA, 23 nt, Yersinia pestis KIM
aaucaccuuggauggcgaaacaa

SEQ ID NO: 4189813 - RNA, 16 nt, Yersinia pestis KIM
aaucacgacaagucau

SEQ ID NO: 4189814 - RNA, 18 nt, Yersinia pestis KIM
aaucacgauacgacuucu

SEQ ID NO: 4189815 - RNA, 14 nt, Yersinia pestis KIM
aaucacguuuccaa

SEQ ID NO: 4189816 - RNA, 22 nt, Yersinia pestis KIM
aaucacguuuccaaaacucaug

SEQ ID NO: 4189817 - RNA, 19 nt, Yersinia pestis KIM
aaucacugauucagaaagg

SEQ ID NO: 4189818 - RNA, 16 nt, Yersinia pestis KIM
aaucacuggcaauaau

SEQ ID NO: 4189819 - RNA, 14 nt, Yersinia pestis KIM
aaucacuuacuggu

SEQ ID NO: 4189820 - RNA, 13 nt, Yersinia pestis KIM
aaucacuuauucc

SEQ ID NO: 4189821 - RNA, 18 nt, Yersinia pestis KIM
aaucacuucuucaauaga

SEQ ID NO: 4189822 - RNA, 16 nt, Yersinia pestis KIM
aaucacuuuauuugcc

SEQ ID NO: 4189823 - RNA, 18 nt, Yersinia pestis KIM
aaucagaggugaaaaaau

SEQ ID NO: 4189824 - RNA, 19 nt, Yersinia pestis KIM
aaucagaggugaaaaaaua

SEQ ID NO: 4189825 - RNA, 17 nt, Yersinia pestis KIM
aaucagauacggcucca

SEQ ID NO: 4189826 - RNA, 16 nt, Yersinia pestis KIM
aaucagaucaacagau

SEQ ID NO: 4189827 - RNA, 20 nt, Yersinia pestis KIM
aaucagauggucgccuuucc

SEQ ID NO: 4189828 - RNA, 21 nt, Yersinia pestis KIM
aaucagcaucuuaccggccuc

SEQ ID NO: 4189829 - RNA, 18 nt, Yersinia pestis KIM
aaucagcauuaacccaua

SEQ ID NO: 4189830 - RNA, 14 nt, Yersinia pestis KIM
aaucagcauucuca

SEQ ID NO: 4189831 - RNA, 15 nt, Yersinia pestis KIM
aaucagccccaagcu

SEQ ID NO: 4189832 - RNA, 22 nt, Yersinia pestis KIM
aaucagcgugguauaaauggca

SEQ ID NO: 4189833 - RNA, 23 nt, Yersinia pestis KIM
aaucagcucauuaaacuguucuu

SEQ ID NO: 4189834 - RNA, 17 nt, Yersinia pestis KIM
aaucagcugauaugaaa

SEQ ID NO: 4189835 - RNA, 20 nt, Yersinia pestis KIM
aaucagcugauaugaaaaau

SEQ ID NO: 4189836 - RNA, 13 nt, Yersinia pestis KIM
aaucagcuucauu

SEQ ID NO: 4189837 - RNA, 14 nt, Yersinia pestis KIM
aaucagggcacucu

SEQ ID NO: 4189838 - RNA, 15 nt, Yersinia pestis KIM
aaucagggcacucug

SEQ ID NO: 4189839 - RNA, 15 nt, Yersinia pestis KIM
aaucagguugauucu

SEQ ID NO: 4189840 - RNA, 13 nt, Yersinia pestis KIM
aaucaguaaauau

SEQ ID NO: 4189841 - RNA, 18 nt, Yersinia pestis KIM
aaucaguaaauauggcgg

SEQ ID NO: 4189842 - RNA, 14 nt, Yersinia pestis KIM
aaucaguauuacgg

SEQ ID NO: 4189843 - RNA, 20 nt, Yersinia pestis KIM
aaucagugaaggaugaauaa

SEQ ID NO: 4189844 - RNA, 15 nt, Yersinia pestis KIM
aaucagugacaagaa

SEQ ID NO: 4189845 - RNA, 14 nt, Yersinia pestis KIM
aaucagugcaauaa

SEQ ID NO: 4189846 - RNA, 14 nt, Yersinia pestis KIM
aaucaguuuacaug

SEQ ID NO: 4189847 - RNA, 21 nt, Yersinia pestis KIM
aaucauaggccacuagccauu

SEQ ID NO: 4189848 - RNA, 18 nt, Yersinia pestis KIM
aaucauaucaaaauaaaa

SEQ ID NO: 4189849 - RNA, 10 nt, Yersinia pestis KIM
aaucaucauc

SEQ ID NO: 4189850 - RNA, 15 nt, Yersinia pestis KIM
aaucaucaucacaaa

SEQ ID NO: 4189851 - RNA, 14 nt, Yersinia pestis KIM
aaucaucaucccag

SEQ ID NO: 4189852 - RNA, 21 nt, Yersinia pestis KIM
aaucaucugcuguacacuaac

SEQ ID NO: 4189853 - RNA, 13 nt, Yersinia pestis KIM
aaucaugacgcug

SEQ ID NO: 4189854 - RNA, 19 nt, Yersinia pestis KIM
aaucaugcauugcaugaug

SEQ ID NO: 4189855 - RNA, 14 nt, Yersinia pestis KIM
aaucauggcauaaa

SEQ ID NO: 4189856 - RNA, 16 nt, Yersinia pestis KIM
aaucauggcauaaacc

SEQ ID NO: 4189857 - RNA, 10 nt, Yersinia pestis KIM
aaucaugggg

SEQ ID NO: 4189858 - RNA, 18 nt, Yersinia pestis KIM
aaucaugggguuuauugg

SEQ ID NO: 4189859 - RNA, 22 nt, Yersinia pestis KIM
aaucauguaacacacagcagac

SEQ ID NO: 4189860 - RNA, 22 nt, Yersinia pestis KIM
aaucauguugcaucgcacugau

SEQ ID NO: 4189861 - RNA, 22 nt, Yersinia pestis KIM
aaucauuggcaacuuaagcauu

SEQ ID NO: 4189862 - RNA, 21 nt, Yersinia pestis KIM
aaucauuuaggcguuucuucc

SEQ ID NO: 4189863 - RNA, 17 nt, Yersinia pestis KIM
aauccaaaauaauauaa

SEQ ID NO: 4189864 - RNA, 15 nt, Yersinia pestis KIM
aauccaaacauacau

SEQ ID NO: 4189865 - RNA, 15 nt, Yersinia pestis KIM
aauccaaaugacacu

SEQ ID NO: 4189866 - RNA, 14 nt, Yersinia pestis KIM
aauccaacucaccu

SEQ ID NO: 4189867 - RNA, 16 nt, Yersinia pestis KIM
aauccaagccauggua

SEQ ID NO: 4189868 - RNA, 15 nt, Yersinia pestis KIM
aauccagaagccauu

SEQ ID NO: 4189869 - RNA, 15 nt, Yersinia pestis KIM
aauccagguaaacaa

SEQ ID NO: 4189870 - RNA, 14 nt, Yersinia pestis KIM
aauccaguguauua

SEQ ID NO: 4189871 - RNA, 17 nt, Yersinia pestis KIM
aauccaguugaguaauu

SEQ ID NO: 4189872 - RNA, 23 nt, Yersinia pestis KIM
aauccauaagauugagggcgucu

SEQ ID NO: 4189873 - RNA, 12 nt, Yersinia pestis KIM
aauccauucacg

SEQ ID NO: 4189874 - RNA, 18 nt, Yersinia pestis KIM
aauccccacggccagagc

SEQ ID NO: 4189875 - RNA, 17 nt, Yersinia pestis KIM
aauccccagaagcgcac

SEQ ID NO: 4189876 - RNA, 18 nt, Yersinia pestis KIM
aauccccaugaugauauc

SEQ ID NO: 4189877 - RNA, 15 nt, Yersinia pestis KIM
aauccccucaaaauu

SEQ ID NO: 4189878 - RNA, 14 nt, Yersinia pestis KIM
aaucccgauaaaaa

SEQ ID NO: 4189879 - RNA, 19 nt, Yersinia pestis KIM
aaucccgauauaaauaaaa

SEQ ID NO: 4189880 - RNA, 13 nt, Yersinia pestis KIM
aaucccuacggca

SEQ ID NO: 4189881 - RNA, 16 nt, Yersinia pestis KIM
aauccgaccacugaca

SEQ ID NO: 4189882 - RNA, 15 nt, Yersinia pestis KIM
aauccgacugauagc

SEQ ID NO: 4189883 - RNA, 17 nt, Yersinia pestis KIM
aauccgcgccaaaauua

SEQ ID NO: 4189884 - RNA, 15 nt, Yersinia pestis KIM
aauccuaaugaacac

SEQ ID NO: 4189885 - RNA, 14 nt, Yersinia pestis KIM
aauccuacauucag

SEQ ID NO: 4189886 - RNA, 20 nt, Yersinia pestis KIM
aauccuauauacaaggcaca

SEQ ID NO: 4189887 - RNA, 21 nt, Yersinia pestis KIM
aauccugcaaauuaaccugcu

SEQ ID NO: 4189888 - RNA, 19 nt, Yersinia pestis KIM
aauccuugcuaguuauaua

SEQ ID NO: 4189889 - RNA, 14 nt, Yersinia pestis KIM
aaucgaaacaccac

SEQ ID NO: 4189890 - RNA, 14 nt, Yersinia pestis KIM
aaucgagaagaauu

SEQ ID NO: 4189891 - RNA, 18 nt, Yersinia pestis KIM
aaucgauacgcauugagg

SEQ ID NO: 4189892 - RNA, 15 nt, Yersinia pestis KIM
aaucgaucauaaucu

SEQ ID NO: 4189893 - RNA, 18 nt, Yersinia pestis KIM
aaucgcacugaguucugc

SEQ ID NO: 4189894 - RNA, 17 nt, Yersinia pestis KIM
aaucgcaucgucgcugu

SEQ ID NO: 4189895 - RNA, 15 nt, Yersinia pestis KIM
aaucgcauugucacc

SEQ ID NO: 4189896 - RNA, 15 nt, Yersinia pestis KIM
aaucgccaaacugcu

SEQ ID NO: 4189897 - RNA, 17 nt, Yersinia pestis KIM
aaucgccaaacugcuca

SEQ ID NO: 4189898 - RNA, 15 nt, Yersinia pestis KIM
aaucgcccaauguca

SEQ ID NO: 4189899 - RNA, 18 nt, Yersinia pestis KIM
aaucgcccaaugucagga

SEQ ID NO: 4189900 - RNA, 22 nt, Yersinia pestis KIM
aaucgcucugcguuuuucccug

SEQ ID NO: 4189901 - RNA, 15 nt, Yersinia pestis KIM
aaaaauaaucaauga

SEQ ID NO: 4189902 - RNA, 16 nt, Yersinia pestis KIM
aaaaauaauuaaaccu

SEQ ID NO: 4189903 - RNA, 13 nt, Yersinia pestis KIM
aaaaauacaacca

SEQ ID NO: 4189904 - RNA, 14 nt, Yersinia pestis KIM
aaaaauacauauca

SEQ ID NO: 4189905 - RNA, 14 nt, Yersinia pestis KIM
aaaaauaucuauuu

SEQ ID NO: 4189906 - RNA, 15 nt, Yersinia pestis KIM
aaaaauaucuauuuc

SEQ ID NO: 4189907 - RNA, 18 nt, Yersinia pestis KIM
aaaaauaucuauuuccau

SEQ ID NO: 4189908 - RNA, 15 nt, Yersinia pestis KIM
aaaaauaucuuuaaa

SEQ ID NO: 4189909 - RNA, 19 nt, Yersinia pestis KIM
aaaaauaucuuuaaacccc

SEQ ID NO: 4189910 - RNA, 12 nt, Yersinia pestis KIM
aaaaauauuaau

SEQ ID NO: 4189911 - RNA, 20 nt, Yersinia pestis KIM
aaaaaucuuguuaauuuaaa

SEQ ID NO: 4189912 - RNA, 22 nt, Yersinia pestis KIM
aaaaaucuuguuaauuuaaaca

SEQ ID NO: 4189913 - RNA, 17 nt, Yersinia pestis KIM
aaaaauggaguuuuacu

SEQ ID NO: 4189914 - RNA, 13 nt, Yersinia pestis KIM
aaaaauuaaaaua

SEQ ID NO: 4189915 - RNA, 12 nt, Yersinia pestis KIM
aaaaauuaucau

SEQ ID NO: 4189916 - RNA, 14 nt, Yersinia pestis KIM
aaaaauuaucauca

SEQ ID NO: 4189917 - RNA, 18 nt, Yersinia pestis KIM
aaaaauuauuaaauaaga

SEQ ID NO: 4189918 - RNA, 21 nt, Yersinia pestis KIM
aaaaauucauucuuuuauaca

SEQ ID NO: 4189919 - RNA, 17 nt, Yersinia pestis KIM
aaaacaacccgaauuaa

SEQ ID NO: 4189920 - RNA, 12 nt, Yersinia pestis KIM
aaaacaagcuac

SEQ ID NO: 4189921 - RNA, 13 nt, Yersinia pestis KIM
aaaacaauaaaaa

SEQ ID NO: 4189922 - RNA, 21 nt, Yersinia pestis KIM
aaaacaauuucgaaaacucaa

SEQ ID NO: 4189923 - RNA, 22 nt, Yersinia pestis KIM
aaaacacagucugucguacuuu

SEQ ID NO: 4189924 - RNA, 14 nt, Yersinia pestis KIM
aaaacacucuuuuu

SEQ ID NO: 4189925 - RNA, 19 nt, Yersinia pestis KIM
aaaacacucuuuuugguuu

SEQ ID NO: 4189926 - RNA, 14 nt, Yersinia pestis KIM
aaaacagacuaaaa

SEQ ID NO: 4189927 - RNA, 15 nt, Yersinia pestis KIM
aaaacagcaacacca

SEQ ID NO: 4189928 - RNA, 19 nt, Yersinia pestis KIM
aaaacagcagccaccaaaa

SEQ ID NO: 4189929 - RNA, 20 nt, Yersinia pestis KIM
aaaacagcagccaccaaaaa

SEQ ID NO: 4189930 - RNA, 21 nt, Yersinia pestis KIM
aaaacagccuaaggccaucaa

SEQ ID NO: 4189931 - RNA, 22 nt, Yersinia pestis KIM
aaaacagcgaucuauucucugu

SEQ ID NO: 4189932 - RNA, 13 nt, Yersinia pestis KIM
aaaaccaccaaaa

SEQ ID NO: 4189933 - RNA, 15 nt, Yersinia pestis KIM
aaaaccaccaaaaua

SEQ ID NO: 4189934 - RNA, 15 nt, Yersinia pestis KIM
aaaaccacugaccua

SEQ ID NO: 4189935 - RNA, 12 nt, Yersinia pestis KIM
aaaaccagcagc

SEQ ID NO: 4189936 - RNA, 23 nt, Yersinia pestis KIM
aaaaccagcagcgcauaaaaaua

SEQ ID NO: 4189937 - RNA, 13 nt, Yersinia pestis KIM
aaaaccauuuuua

SEQ ID NO: 4189938 - RNA, 16 nt, Yersinia pestis KIM
aaaacccauuaaaaac

SEQ ID NO: 4189939 - RNA, 20 nt, Yersinia pestis KIM
aaaaccccgacauuauucau

SEQ ID NO: 4189940 - RNA, 21 nt, Yersinia pestis KIM
aaaaccgcagcagacaacuga

SEQ ID NO: 4189941 - RNA, 21 nt, Yersinia pestis KIM
aaaaccggcguaaauaaaagc

SEQ ID NO: 4189942 - RNA, 15 nt, Yersinia pestis KIM
aaaaccgguuuuggu

SEQ ID NO: 4189943 - RNA, 19 nt, Yersinia pestis KIM
aaaaccgugacuaaaacaa

SEQ ID NO: 4189944 - RNA, 21 nt, Yersinia pestis KIM
aaaaccuccgcgauaccaaua

SEQ ID NO: 4189945 - RNA, 22 nt, Yersinia pestis KIM
aaaaccuuauuuuugcauauaa

SEQ ID NO: 4189946 - RNA, 12 nt, Yersinia pestis KIM
aaaaccuuuaau

SEQ ID NO: 4189947 - RNA, 21 nt, Yersinia pestis KIM
aaaaccuuuacaauuacacac

SEQ ID NO: 4189948 - RNA, 22 nt, Yersinia pestis KIM
aaaaccuuuauguaguucaguc

SEQ ID NO: 4189949 - RNA, 15 nt, Yersinia pestis KIM
aaaacgccagcagac

SEQ ID NO: 4189950 - RNA, 16 nt, Yersinia pestis KIM
aaaacgccuccaguga

SEQ ID NO: 4189951 - RNA, 19 nt, Yersinia pestis KIM
aaaacgcgacggucagcca

SEQ ID NO: 4189952 - RNA, 16 nt, Yersinia pestis KIM
aaaacgcuggccagca

SEQ ID NO: 4189953 - RNA, 21 nt, Yersinia pestis KIM
aaaacgggucgucucuugcaa

SEQ ID NO: 4189954 - RNA, 15 nt, Yersinia pestis KIM
aaaacguaaacaucu

SEQ ID NO: 4189955 - RNA, 23 nt, Yersinia pestis KIM
aaaacgugaaacgccuccucuug

SEQ ID NO: 4189956 - RNA, 16 nt, Yersinia pestis KIM
aaaacgugaauauccu

SEQ ID NO: 4189957 - RNA, 17 nt, Yersinia pestis KIM
aaaacgugaauauccug

SEQ ID NO: 4189958 - RNA, 17 nt, Yersinia pestis KIM
aaaacguuaacugcagu

SEQ ID NO: 4189959 - RNA, 15 nt, Yersinia pestis KIM
aaaacuaaggggcca

SEQ ID NO: 4189960 - RNA, 18 nt, Yersinia pestis KIM
aaaacuauuuauuuuauc

SEQ ID NO: 4189961 - RNA, 14 nt, Yersinia pestis KIM
aaaacucaaacuga

SEQ ID NO: 4189962 - RNA, 15 nt, Yersinia pestis KIM
aaaacucaaagauuu

SEQ ID NO: 4189963 - RNA, 23 nt, Yersinia pestis KIM
aaaacucgcgccugaaaucauuu

SEQ ID NO: 4189964 - RNA, 13 nt, Yersinia pestis KIM
aaaacugaaaagu

SEQ ID NO: 4189965 - RNA, 17 nt, Yersinia pestis KIM
aaaacugaagcaucaau

SEQ ID NO: 4189966 - RNA, 18 nt, Yersinia pestis KIM
aaaacugaagcaucaaua

SEQ ID NO: 4189967 - RNA, 12 nt, Yersinia pestis KIM
aaaacugagguc

SEQ ID NO: 4189968 - RNA, 20 nt, Yersinia pestis KIM
aaaacugauauaaagcauuu

SEQ ID NO: 4189969 - RNA, 23 nt, Yersinia pestis KIM
aaaacugugcgaauggaaaaacg

SEQ ID NO: 4189970 - RNA, 17 nt, Yersinia pestis KIM
aaaacuuaucuaaaaaa

SEQ ID NO: 4189971 - RNA, 15 nt, Yersinia pestis KIM
aaaacuucaucgaua

SEQ ID NO: 4189972 - RNA, 16 nt, Yersinia pestis KIM
aaaacuuuggcugagg

SEQ ID NO: 4189973 - RNA, 21 nt, Yersinia pestis KIM
aaaacuuuuauugucuuuaau

SEQ ID NO: 4189974 - RNA, 13 nt, Yersinia pestis KIM
aaaagaaaaaaac

SEQ ID NO: 4189975 - RNA, 14 nt, Yersinia pestis KIM
aaaagaaaaagaca

SEQ ID NO: 4189976 - RNA, 22 nt, Yersinia pestis KIM
aaaagaauaaaugucacuugcc

SEQ ID NO: 4189977 - RNA, 21 nt, Yersinia pestis KIM
aaaagacgccuuccggcaucu

SEQ ID NO: 4189978 - RNA, 20 nt, Yersinia pestis KIM
aaaagagauccguuuaauca

SEQ ID NO: 4189979 - RNA, 17 nt, Yersinia pestis KIM
aaaagagucgaugaaac

SEQ ID NO: 4189980 - RNA, 13 nt, Yersinia pestis KIM
aaaagaucugcau

SEQ ID NO: 4189981 - RNA, 22 nt, Yersinia pestis KIM
aaaagaucugcauugauuaaau

SEQ ID NO: 4189982 - RNA, 13 nt, Yersinia pestis KIM
aaaagcacagaca

SEQ ID NO: 4189983 - RNA, 14 nt, Yersinia pestis KIM
aaaagcacagacaa

SEQ ID NO: 4189984 - RNA, 20 nt, Yersinia pestis KIM
aaaagcacagacaaacaacc

SEQ ID NO: 4189985 - RNA, 22 nt, Yersinia pestis KIM
aaaagcacagacaaacaaccua

SEQ ID NO: 4189986 - RNA, 24 nt, Yersinia pestis KIM
aaaagcaccgcagucgauaaacau

SEQ ID NO: 4189987 - RNA, 16 nt, Yersinia pestis KIM
aaaagcagcaaacgaa

SEQ ID NO: 4189988 - RNA, 12 nt, Yersinia pestis KIM
aaaagcagcagu

SEQ ID NO: 4189989 - RNA, 13 nt, Yersinia pestis KIM
aaaagcaugccca

SEQ ID NO: 4189990 - RNA, 21 nt, Yersinia pestis KIM
aaaagcauguggaagauauuc

SEQ ID NO: 4189991 - RNA, 21 nt, Yersinia pestis KIM
aaaagccccagugcgcaaaaa

SEQ ID NO: 4189992 - RNA, 17 nt, Yersinia pestis KIM
aaaagcgacuaauauca

SEQ ID NO: 4189993 - RNA, 14 nt, Yersinia pestis KIM
aaaagcgaucagca

SEQ ID NO: 4189994 - RNA, 16 nt, Yersinia pestis KIM
aaaagcgaucagcaau

SEQ ID NO: 4189995 - RNA, 23 nt, Yersinia pestis KIM
aaaagcgccuuuuauucuuuggu

SEQ ID NO: 4189996 - RNA, 17 nt, Yersinia pestis KIM
aaaagcugucauaaaaa

SEQ ID NO: 4189997 - RNA, 20 nt, Yersinia pestis KIM
aaaagcugucauaaaaaaag

SEQ ID NO: 4189998 - RNA, 14 nt, Yersinia pestis KIM
aaaaggauggccca

SEQ ID NO: 4189999 - RNA, 17 nt, Yersinia pestis KIM
aaaaggauggcccaagc

SEQ ID NO: 4190000 - RNA, 20 nt, Yersinia pestis KIM
aaaaggauuuuauuaaauca

SEQ ID NO: 4190001 - RNA, 20 nt, Yersinia pestis KIM
aaaaggcaccagcgcacuga

SEQ ID NO: 4190002 - RNA, 18 nt, Yersinia pestis KIM
aaaagggcacagcgagau

SEQ ID NO: 4190003 - RNA, 17 nt, Yersinia pestis KIM
aaaagguuaacugcagu

SEQ ID NO: 4190004 - RNA, 17 nt, Yersinia pestis KIM
aaaaguaucuuucaccc

SEQ ID NO: 4190005 - RNA, 15 nt, Yersinia pestis KIM
aaaagucagcaaauc

SEQ ID NO: 4190006 - RNA, 17 nt, Yersinia pestis KIM
aaaagucagcaaaucaa

SEQ ID NO: 4190007 - RNA, 22 nt, Yersinia pestis KIM
aaaagucagcaaaucaaacaaa

SEQ ID NO: 4190008 - RNA, 17 nt, Yersinia pestis KIM
aaaaguggcuaucugaa

SEQ ID NO: 4190009 - RNA, 18 nt, Yersinia pestis KIM
aaaaguggcuaucugaaa

SEQ ID NO: 4190010 - RNA, 21 nt, Yersinia pestis KIM
aaaaguuaggguucaguaaaa

SEQ ID NO: 4190011 - RNA, 17 nt, Yersinia pestis KIM
aaaaguuucagcgugga

SEQ ID NO: 4190012 - RNA, 14 nt, Yersinia pestis KIM
aaaaguuuuuugaa

SEQ ID NO: 4190013 - RNA, 12 nt, Yersinia pestis KIM
aaaauaaaaauu

SEQ ID NO: 4190014 - RNA, 16 nt, Yersinia pestis KIM
aaaauaaacaucaaug

SEQ ID NO: 4190015 - RNA, 18 nt, Yersinia pestis KIM
aaaauaaagggggcaccg

SEQ ID NO: 4190016 - RNA, 17 nt, Yersinia pestis KIM
aaacccauuaaaaacaa

SEQ ID NO: 4190017 - RNA, 14 nt, Yersinia pestis KIM
aaaccccgaugacg

SEQ ID NO: 4190018 - RNA, 19 nt, Yersinia pestis KIM
aaacccgcgcagccuaaaa

SEQ ID NO: 4190019 - RNA, 22 nt, Yersinia pestis KIM
aaacccucuguagagaaauuca

SEQ ID NO: 4190020 - RNA, 13 nt, Yersinia pestis KIM
aaaccgcaccaca

SEQ ID NO: 4190021 - RNA, 16 nt, Yersinia pestis KIM
aaaccgcagcagacaa

SEQ ID NO: 4190022 - RNA, 19 nt, Yersinia pestis KIM
aaaccgcauuaugccccca

SEQ ID NO: 4190023 - RNA, 19 nt, Yersinia pestis KIM
aaaccgcuggugacggcuu

SEQ ID NO: 4190024 - RNA, 12 nt, Yersinia pestis KIM
aaaccgcuuauc

SEQ ID NO: 4190025 - RNA, 22 nt, Yersinia pestis KIM
aaaccgggccuaauuuaacuuu

SEQ ID NO: 4190026 - RNA, 14 nt, Yersinia pestis KIM
aaaccgguuaaaac

SEQ ID NO: 4190027 - RNA, 17 nt, Yersinia pestis KIM
aaaccgguuaaaacaga

SEQ ID NO: 4190028 - RNA, 22 nt, Yersinia pestis KIM
aaaccguacauuaaaugaauac

SEQ ID NO: 4190029 - RNA, 19 nt, Yersinia pestis KIM
aaaccgugauugguuuauc

SEQ ID NO: 4190030 - RNA, 15 nt, Yersinia pestis KIM
aaaccguuugccguu

SEQ ID NO: 4190031 - RNA, 13 nt, Yersinia pestis KIM
aaaccuaaaccuu

SEQ ID NO: 4190032 - RNA, 17 nt, Yersinia pestis KIM
aaaccuaacgccaaaau

SEQ ID NO: 4190033 - RNA, 14 nt, Yersinia pestis KIM
aaaccuaaugccag

SEQ ID NO: 4190034 - RNA, 22 nt, Yersinia pestis KIM
aaaccuagucucacuaaaucaa

SEQ ID NO: 4190035 - RNA, 19 nt, Yersinia pestis KIM
aaaccucagaaaaaugccu

SEQ ID NO: 4190036 - RNA, 19 nt, Yersinia pestis KIM
aaaccuccgcgauaccaau

SEQ ID NO: 4190037 - RNA, 19 nt, Yersinia pestis KIM
aaaccugacugguucacac

SEQ ID NO: 4190038 - RNA, 16 nt, Yersinia pestis KIM
aaaccugauaggccaa

SEQ ID NO: 4190039 - RNA, 21 nt, Yersinia pestis KIM
aaaccuggcucaguucaaggu

SEQ ID NO: 4190040 - RNA, 16 nt, Yersinia pestis KIM
aaaccugugugaccuc

SEQ ID NO: 4190041 - RNA, 15 nt, Yersinia pestis KIM
aaaccuuauuuuugc

SEQ ID NO: 4190042 - RNA, 20 nt, Yersinia pestis KIM
aaaccuuauuuuugcauaua

SEQ ID NO: 4190043 - RNA, 17 nt, Yersinia pestis KIM
aaaccuuuauguaacac

SEQ ID NO: 4190044 - RNA, 16 nt, Yersinia pestis KIM
aaacgacgggcugcug

SEQ ID NO: 4190045 - RNA, 23 nt, Yersinia pestis KIM
aaacgaguuuccaguucaagaua

SEQ ID NO: 4190046 - RNA, 14 nt, Yersinia pestis KIM
aaacgauuacccac

SEQ ID NO: 4190047 - RNA, 13 nt, Yersinia pestis KIM
aaacgcauaagaa

SEQ ID NO: 4190048 - RNA, 15 nt, Yersinia pestis KIM
aaacgccaacaauac

SEQ ID NO: 4190049 - RNA, 21 nt, Yersinia pestis KIM
aaacgccagauaugaucaaaa

SEQ ID NO: 4190050 - RNA, 13 nt, Yersinia pestis KIM
aaacgccagcaga

SEQ ID NO: 4190051 - RNA, 18 nt, Yersinia pestis KIM
aaacgccagugcaaaaug

SEQ ID NO: 4190052 - RNA, 14 nt, Yersinia pestis KIM
aaacgccccgauaa

SEQ ID NO: 4190053 - RNA, 20 nt, Yersinia pestis KIM
aaacgccccgauaaaccaac

SEQ ID NO: 4190054 - RNA, 17 nt, Yersinia pestis KIM
aaacgccgcgucaauaa

SEQ ID NO: 4190055 - RNA, 18 nt, Yersinia pestis KIM
aaacgccgcgucaauaac

SEQ ID NO: 4190056 - RNA, 15 nt, Yersinia pestis KIM
aaacgccuccaguga

SEQ ID NO: 4190057 - RNA, 18 nt, Yersinia pestis KIM
aaacgccuccucuuggau

SEQ ID NO: 4190058 - RNA, 14 nt, Yersinia pestis KIM
aaacgccucguuua

SEQ ID NO: 4190059 - RNA, 22 nt, Yersinia pestis KIM
aaacgcucaguuaaacgguaac

SEQ ID NO: 4190060 - RNA, 14 nt, Yersinia pestis KIM
aaacgcugcacauc

SEQ ID NO: 4190061 - RNA, 14 nt, Yersinia pestis KIM
aaacgcuugucacc

SEQ ID NO: 4190062 - RNA, 21 nt, Yersinia pestis KIM
aaacggaauggccgauggaac

SEQ ID NO: 4190063 - RNA, 22 nt, Yersinia pestis KIM
aaacggcacaugggucucgccg

SEQ ID NO: 4190064 - RNA, 14 nt, Yersinia pestis KIM
aaacggcgguuaau

SEQ ID NO: 4190065 - RNA, 20 nt, Yersinia pestis KIM
aaacgggccgcgcagauuau

SEQ ID NO: 4190066 - RNA, 20 nt, Yersinia pestis KIM
aaacggguggccacaauaaa

SEQ ID NO: 4190067 - RNA, 21 nt, Yersinia pestis KIM
aaacggucauuguagauggcc

SEQ ID NO: 4190068 - RNA, 22 nt, Yersinia pestis KIM
aaacggucauuguagauggcca

SEQ ID NO: 4190069 - RNA, 21 nt, Yersinia pestis KIM
aaacggucuguuaauccuaau

SEQ ID NO: 4190070 - RNA, 12 nt, Yersinia pestis KIM
aaacgucacuuc

SEQ ID NO: 4190071 - RNA, 14 nt, Yersinia pestis KIM
aaacguuaacugca

SEQ ID NO: 4190072 - RNA, 16 nt, Yersinia pestis KIM
aaacguuaacugcagu

SEQ ID NO: 4190073 - RNA, 15 nt, Yersinia pestis KIM
aaacguuacugcucg

SEQ ID NO: 4190074 - RNA, 13 nt, Yersinia pestis KIM
aaacuaauaucuu

SEQ ID NO: 4190075 - RNA, 18 nt, Yersinia pestis KIM
aaacuacgguaauaaaca

SEQ ID NO: 4190076 - RNA, 14 nt, Yersinia pestis KIM
aaacuauucugcuu

SEQ ID NO: 4190077 - RNA, 15 nt, Yersinia pestis KIM
aaacucaccgagcau

SEQ ID NO: 4190078 - RNA, 20 nt, Yersinia pestis KIM
aaacucaccgagcauauuuu

SEQ ID NO: 4190079 - RNA, 19 nt, Yersinia pestis KIM
aaacucaugacaucccagc

SEQ ID NO: 4190080 - RNA, 22 nt, Yersinia pestis KIM
aaacuccuuggaacuuacuccc

SEQ ID NO: 4190081 - RNA, 13 nt, Yersinia pestis KIM
aaacucuaagggu

SEQ ID NO: 4190082 - RNA, 15 nt, Yersinia pestis KIM
aaacugaaaaaggca

SEQ ID NO: 4190083 - RNA, 22 nt, Yersinia pestis KIM
aaacugaaguuaaaaagccuga

SEQ ID NO: 4190084 - RNA, 17 nt, Yersinia pestis KIM
aaacugaauaucccccu

SEQ ID NO: 4190085 - RNA, 21 nt, Yersinia pestis KIM
aaacugacugccauaauccag

SEQ ID NO: 4190086 - RNA, 17 nt, Yersinia pestis KIM
aaacugagauuugccaa

SEQ ID NO: 4190087 - RNA, 16 nt, Yersinia pestis KIM
aaacugauaaagcaaa

SEQ ID NO: 4190088 - RNA, 16 nt, Yersinia pestis KIM
aaacugauauaaagca

SEQ ID NO: 4190089 - RNA, 15 nt, Yersinia pestis KIM
aaacugaucaucaac

SEQ ID NO: 4190090 - RNA, 22 nt, Yersinia pestis KIM
aaacugaugccgguauccccgc

SEQ ID NO: 4190091 - RNA, 20 nt, Yersinia pestis KIM
aaacugccgccaccauauca

SEQ ID NO: 4190092 - RNA, 16 nt, Yersinia pestis KIM
aaacugcgcuuccagc

SEQ ID NO: 4190093 - RNA, 17 nt, Yersinia pestis KIM
aaacugcucauaaagca

SEQ ID NO: 4190094 - RNA, 18 nt, Yersinia pestis KIM
aaacuggcccagcuuuau

SEQ ID NO: 4190095 - RNA, 22 nt, Yersinia pestis KIM
aaacuguuuuuuaaagaaaaaa

SEQ ID NO: 4190096 - RNA, 13 nt, Yersinia pestis KIM
aaacuuaauuuca

SEQ ID NO: 4190097 - RNA, 14 nt, Yersinia pestis KIM
aaacuucaaaauca

SEQ ID NO: 4190098 - RNA, 17 nt, Yersinia pestis KIM
aaacuucacaaugcaca

SEQ ID NO: 4190099 - RNA, 16 nt, Yersinia pestis KIM
aaacuucacuuucuuu

SEQ ID NO: 4190100 - RNA, 21 nt, Yersinia pestis KIM
aaacuuccagcguauguuccu

SEQ ID NO: 4190101 - RNA, 18 nt, Yersinia pestis KIM
aaacuugauucaccagau

SEQ ID NO: 4190102 - RNA, 14 nt, Yersinia pestis KIM
aaacuuguaucaaa

SEQ ID NO: 4190103 - RNA, 21 nt, Yersinia pestis KIM
aaacuuuuauugucuuuaaua

SEQ ID NO: 4190104 - RNA, 13 nt, Yersinia pestis KIM
aaacuuuucaguu

SEQ ID NO: 4190105 - RNA, 22 nt, Yersinia pestis KIM
aaacuuuucaguuuuaauuuau

SEQ ID NO: 4190106 - RNA, 15 nt, Yersinia pestis KIM
aaagaaaaaucgcca

SEQ ID NO: 4190107 - RNA, 15 nt, Yersinia pestis KIM
aaagaaaauggcuuu

SEQ ID NO: 4190108 - RNA, 14 nt, Yersinia pestis KIM
aaagaaauaaucau

SEQ ID NO: 4190109 - RNA, 20 nt, Yersinia pestis KIM
aaagaagaauccacauaaaa

SEQ ID NO: 4190110 - RNA, 21 nt, Yersinia pestis KIM
aaagaagacgaguaaugaaau

SEQ ID NO: 4190111 - RNA, 23 nt, Yersinia pestis KIM
aaagaagacgaguaaugaaaucu

SEQ ID NO: 4190112 - RNA, 21 nt, Yersinia pestis KIM
aaagaaucagcgguugaaaag

SEQ ID NO: 4190113 - RNA, 16 nt, Yersinia pestis KIM
aaagaaugaauuuuuu

SEQ ID NO: 4190114 - RNA, 16 nt, Yersinia pestis KIM
aaagacauaaagaaaa

SEQ ID NO: 4190115 - RNA, 19 nt, Yersinia pestis KIM
aaagacgccggcuucccug

SEQ ID NO: 4190116 - RNA, 16 nt, Yersinia pestis KIM
aaagacgccguaaaua

SEQ ID NO: 4190117 - RNA, 18 nt, Yersinia pestis KIM
aaagacgcuaauuaaaga

SEQ ID NO: 4190118 - RNA, 20 nt, Yersinia pestis KIM
aaagacuuuauucacagcag

SEQ ID NO: 4190119 - RNA, 23 nt, Yersinia pestis KIM
aaagacuuuauucacagcagaac

SEQ ID NO: 4190120 - RNA, 12 nt, Yersinia pestis KIM
aaagagauaggc

SEQ ID NO: 4190121 - RNA, 19 nt, Yersinia pestis KIM
aaagagauccguuuaauca

SEQ ID NO: 4190122 - RNA, 23 nt, Yersinia pestis KIM
aaagagcccgcaacgggagagaa

SEQ ID NO: 4190123 - RNA, 22 nt, Yersinia pestis KIM
aaagagcgcucuggcgcucuug

SEQ ID NO: 4190124 - RNA, 17 nt, Yersinia pestis KIM
aaagagggucacaagaa

SEQ ID NO: 4190125 - RNA, 15 nt, Yersinia pestis KIM
aaagagucgcuuugg

SEQ ID NO: 4190126 - RNA, 13 nt, Yersinia pestis KIM
aaagagugaaaua

SEQ ID NO: 4190127 - RNA, 18 nt, Yersinia pestis KIM
aaagauaauacauaaaau

SEQ ID NO: 4190128 - RNA, 20 nt, Yersinia pestis KIM
aaagauacaguggaacauuu

SEQ ID NO: 4190129 - RNA, 14 nt, Yersinia pestis KIM
aaagauagcaaaag

SEQ ID NO: 4190130 - RNA, 17 nt, Yersinia pestis KIM
aaagauagcaaaagaau

SEQ ID NO: 4190131 - RNA, 12 nt, Yersinia pestis KIM
aaauacauauca

SEQ ID NO: 4190132 - RNA, 16 nt, Yersinia pestis KIM
aaauacauaucaacac

SEQ ID NO: 4190133 - RNA, 16 nt, Yersinia pestis KIM
aaauacauccauguag

SEQ ID NO: 4190134 - RNA, 20 nt, Yersinia pestis KIM
aaauacauccauguaggcuc

SEQ ID NO: 4190135 - RNA, 18 nt, Yersinia pestis KIM
aaauacccagcuucuuuu

SEQ ID NO: 4190136 - RNA, 20 nt, Yersinia pestis KIM
aaauacccagcuucuuuuaa

SEQ ID NO: 4190137 - RNA, 22 nt, Yersinia pestis KIM
aaauacccagcuucuuuuaaag

SEQ ID NO: 4190138 - RNA, 16 nt, Yersinia pestis KIM
aaauacccgguuucca

SEQ ID NO: 4190139 - RNA, 20 nt, Yersinia pestis KIM
aaauaccgccaaauacaaac

SEQ ID NO: 4190140 - RNA, 18 nt, Yersinia pestis KIM
aaauaccgcgaucaacaa

SEQ ID NO: 4190141 - RNA, 20 nt, Yersinia pestis KIM
aaauaccgcgaucaacaaga

SEQ ID NO: 4190142 - RNA, 13 nt, Yersinia pestis KIM
aaauaccgcugcu

SEQ ID NO: 4190143 - RNA, 14 nt, Yersinia pestis KIM
aaauaccgcuugcc

SEQ ID NO: 4190144 - RNA, 19 nt, Yersinia pestis KIM
aaauaccggauuguucagc

SEQ ID NO: 4190145 - RNA, 17 nt, Yersinia pestis KIM
aaauaccuucagacuga

SEQ ID NO: 4190146 - RNA, 22 nt, Yersinia pestis KIM
aaauacgaucaacucaacuuua

SEQ ID NO: 4190147 - RNA, 13 nt, Yersinia pestis KIM
aaauacugccaau

SEQ ID NO: 4190148 - RNA, 13 nt, Yersinia pestis KIM
aaauacuguuggu

SEQ ID NO: 4190149 - RNA, 16 nt, Yersinia pestis KIM
aaauacuuaacaauca

SEQ ID NO: 4190150 - RNA, 16 nt, Yersinia pestis KIM
aaauacuuauuugaaa

SEQ ID NO: 4190151 - RNA, 14 nt, Yersinia pestis KIM
aaauagaaaacagc

SEQ ID NO: 4190152 - RNA, 19 nt, Yersinia pestis KIM
aaauagaaaacagcaauau

SEQ ID NO: 4190153 - RNA, 22 nt, Yersinia pestis KIM
aaauagaagguaaucagacugc

SEQ ID NO: 4190154 - RNA, 17 nt, Yersinia pestis KIM
aaauagacucaacaaac

SEQ ID NO: 4190155 - RNA, 14 nt, Yersinia pestis KIM
aaauagagcaccaa

SEQ ID NO: 4190156 - RNA, 17 nt, Yersinia pestis KIM
aaauagaggaaauaaau

SEQ ID NO: 4190157 - RNA, 13 nt, Yersinia pestis KIM
aaauagauuuaac

SEQ ID NO: 4190158 - RNA, 22 nt, Yersinia pestis KIM
aaauagccaaccagauuaaaua

SEQ ID NO: 4190159 - RNA, 22 nt, Yersinia pestis KIM
aaauagccguuucagauaaaaa

SEQ ID NO: 4190160 - RNA, 15 nt, Yersinia pestis KIM
aaauagccuucccug

SEQ ID NO: 4190161 - RNA, 15 nt, Yersinia pestis KIM
aaauagccuuccuug

SEQ ID NO: 4190162 - RNA, 18 nt, Yersinia pestis KIM
aaauagcuuccauuaaaa

SEQ ID NO: 4190163 - RNA, 14 nt, Yersinia pestis KIM
aaauagcuucccug

SEQ ID NO: 4190164 - RNA, 23 nt, Yersinia pestis KIM
aaauaggcaggcccgcuucccua

SEQ ID NO: 4190165 - RNA, 15 nt, Yersinia pestis KIM
aaauaggccauucaa

SEQ ID NO: 4190166 - RNA, 13 nt, Yersinia pestis KIM
aaauaggcgucag

SEQ ID NO: 4190167 - RNA, 21 nt, Yersinia pestis KIM
aaauaggcguuaucggcgcag

SEQ ID NO: 4190168 - RNA, 18 nt, Yersinia pestis KIM
aaauagguaguggaaaga

SEQ ID NO: 4190169 - RNA, 16 nt, Yersinia pestis KIM
aaauagguauaaaacu

SEQ ID NO: 4190170 - RNA, 14 nt, Yersinia pestis KIM
aaauagucaguaaa

SEQ ID NO: 4190171 - RNA, 22 nt, Yersinia pestis KIM
aaauagugauuagcaucugcaa

SEQ ID NO: 4190172 - RNA, 23 nt, Yersinia pestis KIM
aaauagugcuaucugcugcggua

SEQ ID NO: 4190173 - RNA, 22 nt, Yersinia pestis KIM
aaauaucacuauaauuauuucu

SEQ ID NO: 4190174 - RNA, 13 nt, Yersinia pestis KIM
aaauaucacuuuu

SEQ ID NO: 4190175 - RNA, 19 nt, Yersinia pestis KIM
aaauaucauccccuuucug

SEQ ID NO: 4190176 - RNA, 12 nt, Yersinia pestis KIM
aaauaucauuaa

SEQ ID NO: 4190177 - RNA, 15 nt, Yersinia pestis KIM
aaauaucauuaacaa

SEQ ID NO: 4190178 - RNA, 18 nt, Yersinia pestis KIM
aaauaucauuaacaaacu

SEQ ID NO: 4190179 - RNA, 18 nt, Yersinia pestis KIM
aaauaucauuauuuugaa

SEQ ID NO: 4190180 - RNA, 22 nt, Yersinia pestis KIM
aaauauccuccgacauagccgg

SEQ ID NO: 4190181 - RNA, 21 nt, Yersinia pestis KIM
aaauauccuccggcauagccg

SEQ ID NO: 4190182 - RNA, 10 nt, Yersinia pestis KIM
aaauauccug

SEQ ID NO: 4190183 - RNA, 15 nt, Yersinia pestis KIM
aaauaucuuuaaacc

SEQ ID NO: 4190184 - RNA, 20 nt, Yersinia pestis KIM
aaauaucuuucagcaccaua

SEQ ID NO: 4190185 - RNA, 16 nt, Yersinia pestis KIM
aaauauggcggcauca

SEQ ID NO: 4190186 - RNA, 16 nt, Yersinia pestis KIM
aaauauggguuaaaaa

SEQ ID NO: 4190187 - RNA, 18 nt, Yersinia pestis KIM
aaauauggguuaaaaacu

SEQ ID NO: 4190188 - RNA, 22 nt, Yersinia pestis KIM
aaauauggguuaaaaacuuuua

SEQ ID NO: 4190189 - RNA, 14 nt, Yersinia pestis KIM
aaauauuaauccau

SEQ ID NO: 4190190 - RNA, 19 nt, Yersinia pestis KIM
aaauauucgucucaucaau

SEQ ID NO: 4190191 - RNA, 21 nt, Yersinia pestis KIM
aaauauucucaauauuaauaa

SEQ ID NO: 4190192 - RNA, 22 nt, Yersinia pestis KIM
aaauauucucaauauuaauaau

SEQ ID NO: 4190193 - RNA, 18 nt, Yersinia pestis KIM
aaauauuggcaacaacag

SEQ ID NO: 4190194 - RNA, 14 nt, Yersinia pestis KIM
aaauauuguugcca

SEQ ID NO: 4190195 - RNA, 15 nt, Yersinia pestis KIM
aaauauuuaauaugu

SEQ ID NO: 4190196 - RNA, 20 nt, Yersinia pestis KIM
aaaucaaacaaaucuuaaau

SEQ ID NO: 4190197 - RNA, 12 nt, Yersinia pestis KIM
aaaucacacugg

SEQ ID NO: 4190198 - RNA, 20 nt, Yersinia pestis KIM
aaaucacaugcggauugaac

SEQ ID NO: 4190199 - RNA, 14 nt, Yersinia pestis KIM
aaaucaccccccug

SEQ ID NO: 4190200 - RNA, 19 nt, Yersinia pestis KIM
aaaucacccgcaagaauaa

SEQ ID NO: 4190201 - RNA, 22 nt, Yersinia pestis KIM
aaaucacccgcaagaauaacug

SEQ ID NO: 4190202 - RNA, 15 nt, Yersinia pestis KIM
aaaucaccuggccag

SEQ ID NO: 4190203 - RNA, 12 nt, Yersinia pestis KIM
aaaucacguuca

SEQ ID NO: 4190204 - RNA, 19 nt, Yersinia pestis KIM
aaaucacguuuccaaaacu

SEQ ID NO: 4190205 - RNA, 22 nt, Yersinia pestis KIM
aaaucacguuuccaaaacucau

SEQ ID NO: 4190206 - RNA, 16 nt, Yersinia pestis KIM
aaaucacucacucuuc

SEQ ID NO: 4190207 - RNA, 17 nt, Yersinia pestis KIM
aaaucagacgagucuau

SEQ ID NO: 4190208 - RNA, 23 nt, Yersinia pestis KIM
aaaucagacgagucuauugaaaa

SEQ ID NO: 4190209 - RNA, 20 nt, Yersinia pestis KIM
aaaucagcguuuuaaucaca

SEQ ID NO: 4190210 - RNA, 21 nt, Yersinia pestis KIM
aaaucaguuccugauucgguu

SEQ ID NO: 4190211 - RNA, 23 nt, Yersinia pestis KIM
aaaucaucgcucaucgccaaagc

SEQ ID NO: 4190212 - RNA, 23 nt, Yersinia pestis KIM
aaaucaucgcugacaauuuacac

SEQ ID NO: 4190213 - RNA, 21 nt, Yersinia pestis KIM
aaaucaugcauugcaugauga

SEQ ID NO: 4190214 - RNA, 17 nt, Yersinia pestis KIM
aaaucauugacguuaca

SEQ ID NO: 4190215 - RNA, 18 nt, Yersinia pestis KIM
aaauccaagccaccacca

SEQ ID NO: 4190216 - RNA, 14 nt, Yersinia pestis KIM
aaauccagaucagc

SEQ ID NO: 4190217 - RNA, 20 nt, Yersinia pestis KIM
aaauccagaucagcgccuga

SEQ ID NO: 4190218 - RNA, 14 nt, Yersinia pestis KIM
aaaucccgaugaac

SEQ ID NO: 4190219 - RNA, 20 nt, Yersinia pestis KIM
aaaucccgcuugucgcccug

SEQ ID NO: 4190220 - RNA, 17 nt, Yersinia pestis KIM
aaauccgacugauagca

SEQ ID NO: 4190221 - RNA, 20 nt, Yersinia pestis KIM
aaauccugaauaauacuguc

SEQ ID NO: 4190222 - RNA, 24 nt, Yersinia pestis KIM
aaaucgcacugaguucugcugcca

SEQ ID NO: 4190223 - RNA, 23 nt, Yersinia pestis KIM
aaaucgccaauagaaaggcuauc

SEQ ID NO: 4190224 - RNA, 22 nt, Yersinia pestis KIM
aaaucguaaucaccauuaauaa

SEQ ID NO: 4190225 - RNA, 19 nt, Yersinia pestis KIM
aaaucguauaacauaauaa

SEQ ID NO: 4190226 - RNA, 14 nt, Yersinia pestis KIM
aaaucuaaguucag

SEQ ID NO: 4190227 - RNA, 21 nt, Yersinia pestis KIM
aaaucuacuuuauucaauacu

SEQ ID NO: 4190228 - RNA, 16 nt, Yersinia pestis KIM
aaaucuagcccuucag

SEQ ID NO: 4190229 - RNA, 20 nt, Yersinia pestis KIM
aaaucuagcccuucagcaaa

SEQ ID NO: 4190230 - RNA, 16 nt, Yersinia pestis KIM
aaaucucaucggcaua

SEQ ID NO: 4190231 - RNA, 18 nt, Yersinia pestis KIM
aaaucuccuccggagagg

SEQ ID NO: 4190232 - RNA, 15 nt, Yersinia pestis KIM
aaaucugauacugaa

SEQ ID NO: 4190233 - RNA, 17 nt, Yersinia pestis KIM
aaaucugcucccggcgc

SEQ ID NO: 4190234 - RNA, 19 nt, Yersinia pestis KIM
aaaucuggaauaggggaaa

SEQ ID NO: 4190235 - RNA, 18 nt, Yersinia pestis KIM
aaaucuggauaaugucgu

SEQ ID NO: 4190236 - RNA, 16 nt, Yersinia pestis KIM
aaaucuuccagcggca

SEQ ID NO: 4190237 - RNA, 21 nt, Yersinia pestis KIM
aaaucuuccuuuccauuuuca

SEQ ID NO: 4190238 - RNA, 23 nt, Yersinia pestis KIM
aaaucuuuuuguaauguuucuau

SEQ ID NO: 4190239 - RNA, 12 nt, Yersinia pestis KIM
aaaugaaaauau

SEQ ID NO: 4190240 - RNA, 20 nt, Yersinia pestis KIM
aaaugaagggggcuuauucu

SEQ ID NO: 4190241 - RNA, 13 nt, Yersinia pestis KIM
aaaugacaaauca

SEQ ID NO: 4190242 - RNA, 13 nt, Yersinia pestis KIM
aaaugacaaugaa

SEQ ID NO: 4190243 - RNA, 12 nt, Yersinia pestis KIM
aaaugacacuuu

SEQ ID NO: 4190244 - RNA, 15 nt, Yersinia pestis KIM
aaaugacauauugug

SEQ ID NO: 4190245 - RNA, 17 nt, Yersinia pestis KIM
aacaauccuauauacaa

SEQ ID NO: 4190246 - RNA, 19 nt, Yersinia pestis KIM
aacaaucgauuccuguuga

SEQ ID NO: 4190247 - RNA, 14 nt, Yersinia pestis KIM
aacaauguuuaucc

SEQ ID NO: 4190248 - RNA, 19 nt, Yersinia pestis KIM
aacaauuuacgguccauaa

SEQ ID NO: 4190249 - RNA, 17 nt, Yersinia pestis KIM
aacaauuuaucagacaa

SEQ ID NO: 4190250 - RNA, 12 nt, Yersinia pestis KIM
aacaauuucgaa

SEQ ID NO: 4190251 - RNA, 20 nt, Yersinia pestis KIM
aacaauuuuauuguuuucgu

SEQ ID NO: 4190252 - RNA, 12 nt, Yersinia pestis KIM
aacacaaaauag

SEQ ID NO: 4190253 - RNA, 12 nt, Yersinia pestis KIM
aacacaauugau

SEQ ID NO: 4190254 - RNA, 14 nt, Yersinia pestis KIM
aacacacagcagac

SEQ ID NO: 4190255 - RNA, 22 nt, Yersinia pestis KIM
aacacaccugcaacguuaaaga

SEQ ID NO: 4190256 - RNA, 15 nt, Yersinia pestis KIM
aacacacuuagcuaa

SEQ ID NO: 4190257 - RNA, 19 nt, Yersinia pestis KIM
aacacacuucgccagguca

SEQ ID NO: 4190258 - RNA, 21 nt, Yersinia pestis KIM
aacacacuucgccaggucagg

SEQ ID NO: 4190259 - RNA, 21 nt, Yersinia pestis KIM
aacacagguucuccaggguuu

SEQ ID NO: 4190260 - RNA, 15 nt, Yersinia pestis KIM
aacacauacaaauau

SEQ ID NO: 4190261 - RNA, 14 nt, Yersinia pestis KIM
aacacauauuucau

SEQ ID NO: 4190262 - RNA, 20 nt, Yersinia pestis KIM
aacacaucuauuuuuuugaa

SEQ ID NO: 4190263 - RNA, 21 nt, Yersinia pestis KIM
aacacauuccaguaaaaaaau

SEQ ID NO: 4190264 - RNA, 13 nt, Yersinia pestis KIM
aacaccaacacca

SEQ ID NO: 4190265 - RNA, 16 nt, Yersinia pestis KIM
aacaccaacaccacac

SEQ ID NO: 4190266 - RNA, 11 nt, Yersinia pestis KIM
aacaccaaccg

SEQ ID NO: 4190267 - RNA, 14 nt, Yersinia pestis KIM
aacaccauacuuuu

SEQ ID NO: 4190268 - RNA, 17 nt, Yersinia pestis KIM
aacacccaacucaacgg

SEQ ID NO: 4190269 - RNA, 19 nt, Yersinia pestis KIM
aacacccuguguauuuaac

SEQ ID NO: 4190270 - RNA, 15 nt, Yersinia pestis KIM
aacacccuuccuuuu

SEQ ID NO: 4190271 - RNA, 14 nt, Yersinia pestis KIM
aacaccggcaauau

SEQ ID NO: 4190272 - RNA, 20 nt, Yersinia pestis KIM
aacaccguaacgcccuccug

SEQ ID NO: 4190273 - RNA, 22 nt, Yersinia pestis KIM
aacaccgugcuggguaauucau

SEQ ID NO: 4190274 - RNA, 15 nt, Yersinia pestis KIM
aacaccuaguuauuc

SEQ ID NO: 4190275 - RNA, 17 nt, Yersinia pestis KIM
aacaccuuuaccuuuac

SEQ ID NO: 4190276 - RNA, 13 nt, Yersinia pestis KIM
aacacgaaaagca

SEQ ID NO: 4190277 - RNA, 14 nt, Yersinia pestis KIM
aacacgaaaagcag

SEQ ID NO: 4190278 - RNA, 16 nt, Yersinia pestis KIM
aacacgaaaagcagca

SEQ ID NO: 4190279 - RNA, 14 nt, Yersinia pestis KIM
aacacgaccuucau

SEQ ID NO: 4190280 - RNA, 22 nt, Yersinia pestis KIM
aacacgacgccauaaaagaaug

SEQ ID NO: 4190281 - RNA, 19 nt, Yersinia pestis KIM
aacacgacuuuuggccccc

SEQ ID NO: 4190282 - RNA, 15 nt, Yersinia pestis KIM
aacacgauauaccuc

SEQ ID NO: 4190283 - RNA, 14 nt, Yersinia pestis KIM
aacacgauccgcuu

SEQ ID NO: 4190284 - RNA, 19 nt, Yersinia pestis KIM
aacacgauccgcuuuuuag

SEQ ID NO: 4190285 - RNA, 21 nt, Yersinia pestis KIM
aacacgcuauccgcgccgagc

SEQ ID NO: 4190286 - RNA, 20 nt, Yersinia pestis KIM
aacacggugaauaaacccuu

SEQ ID NO: 4190287 - RNA, 18 nt, Yersinia pestis KIM
aacacgguugaaaaguuu

SEQ ID NO: 4190288 - RNA, 19 nt, Yersinia pestis KIM
aacacguggguauccagug

SEQ ID NO: 4190289 - RNA, 22 nt, Yersinia pestis KIM
aacacguggguauccaguguca

SEQ ID NO: 4190290 - RNA, 21 nt, Yersinia pestis KIM
aacacguucggcgucgccacc

SEQ ID NO: 4190291 - RNA, 23 nt, Yersinia pestis KIM
aacacuccucuuucuuaauaaua

SEQ ID NO: 4190292 - RNA, 17 nt, Yersinia pestis KIM
aacacugaauaacugaa

SEQ ID NO: 4190293 - RNA, 22 nt, Yersinia pestis KIM
aacacugauuuauaaauaauua

SEQ ID NO: 4190294 - RNA, 14 nt, Yersinia pestis KIM
aacacuggcagcca

SEQ ID NO: 4190295 - RNA, 18 nt, Yersinia pestis KIM
aacacuggcuuagaucuu

SEQ ID NO: 4190296 - RNA, 17 nt, Yersinia pestis KIM
aacacuguuuaucgcau

SEQ ID NO: 4190297 - RNA, 14 nt, Yersinia pestis KIM
aacacuuaauucca

SEQ ID NO: 4190298 - RNA, 19 nt, Yersinia pestis KIM
aacacuuaugaucuugaau

SEQ ID NO: 4190299 - RNA, 15 nt, Yersinia pestis KIM
aacacuucagacuga

SEQ ID NO: 4190300 - RNA, 18 nt, Yersinia pestis KIM
aacacuucagacugaaag

SEQ ID NO: 4190301 - RNA, 18 nt, Yersinia pestis KIM
aacagaacuaaacgccaa

SEQ ID NO: 4190302 - RNA, 19 nt, Yersinia pestis KIM
aacagaacuaaacgccaac

SEQ ID NO: 4190303 - RNA, 19 nt, Yersinia pestis KIM
aacagaacuaauaucaaca

SEQ ID NO: 4190304 - RNA, 20 nt, Yersinia pestis KIM
aacagaacuaauaucaacag

SEQ ID NO: 4190305 - RNA, 16 nt, Yersinia pestis KIM
aacagacacagcaaca

SEQ ID NO: 4190306 - RNA, 16 nt, Yersinia pestis KIM
aacagaccccagaaga

SEQ ID NO: 4190307 - RNA, 17 nt, Yersinia pestis KIM
aacagaccccagaagau

SEQ ID NO: 4190308 - RNA, 19 nt, Yersinia pestis KIM
aacagagcagaaagcagca

SEQ ID NO: 4190309 - RNA, 17 nt, Yersinia pestis KIM
aacagaggguggaaaca

SEQ ID NO: 4190310 - RNA, 17 nt, Yersinia pestis KIM
aacagauaaaaaauaau

SEQ ID NO: 4190311 - RNA, 18 nt, Yersinia pestis KIM
aacagauaacucagggcg

SEQ ID NO: 4190312 - RNA, 20 nt, Yersinia pestis KIM
aacagauagauaaauguuca

SEQ ID NO: 4190313 - RNA, 15 nt, Yersinia pestis KIM
aacagauauacggcg

SEQ ID NO: 4190314 - RNA, 19 nt, Yersinia pestis KIM
aacagauaugcauuauuga

SEQ ID NO: 4190315 - RNA, 21 nt, Yersinia pestis KIM
aacagauguuauuugaauaaa

SEQ ID NO: 4190316 - RNA, 22 nt, Yersinia pestis KIM
aacagauguuauuugaauaaaa

SEQ ID NO: 4190317 - RNA, 12 nt, Yersinia pestis KIM
aacagauucaau

SEQ ID NO: 4190318 - RNA, 16 nt, Yersinia pestis KIM
aacagauucaauauuu

SEQ ID NO: 4190319 - RNA, 15 nt, Yersinia pestis KIM
aacagauuuuccauc

SEQ ID NO: 4190320 - RNA, 15 nt, Yersinia pestis KIM
aacagcaucaucaaa

SEQ ID NO: 4190321 - RNA, 17 nt, Yersinia pestis KIM
aacagcauccgcccaca

SEQ ID NO: 4190322 - RNA, 15 nt, Yersinia pestis KIM
aacagccagcaucac

SEQ ID NO: 4190323 - RNA, 14 nt, Yersinia pestis KIM
aacagccauauuuu

SEQ ID NO: 4190324 - RNA, 17 nt, Yersinia pestis KIM
aacagccccaaccaucu

SEQ ID NO: 4190325 - RNA, 15 nt, Yersinia pestis KIM
aacagcccccugccu

SEQ ID NO: 4190326 - RNA, 16 nt, Yersinia pestis KIM
aacagccggccauuca

SEQ ID NO: 4190327 - RNA, 17 nt, Yersinia pestis KIM
aacagccggccauucag

SEQ ID NO: 4190328 - RNA, 21 nt, Yersinia pestis KIM
aacagccuaaggccaucaaua

SEQ ID NO: 4190329 - RNA, 18 nt, Yersinia pestis KIM
aacagcgccucaguaucu

SEQ ID NO: 4190330 - RNA, 18 nt, Yersinia pestis KIM
aacagcgcucauagcaaa

SEQ ID NO: 4190331 - RNA, 15 nt, Yersinia pestis KIM
aacagcguugaccaa

SEQ ID NO: 4190332 - RNA, 19 nt, Yersinia pestis KIM
aacagcuaaucauugcaau

SEQ ID NO: 4190333 - RNA, 16 nt, Yersinia pestis KIM
aacagcuuaucagcgu

SEQ ID NO: 4190334 - RNA, 14 nt, Yersinia pestis KIM
aacagcuucgccac

SEQ ID NO: 4190335 - RNA, 15 nt, Yersinia pestis KIM
aacagcuucgccacc

SEQ ID NO: 4190336 - RNA, 22 nt, Yersinia pestis KIM
aacagcuucgccaccagauagu

SEQ ID NO: 4190337 - RNA, 23 nt, Yersinia pestis KIM
aacaggcaacgacguuaucaaua

SEQ ID NO: 4190338 - RNA, 13 nt, Yersinia pestis KIM
aacaggcagaucg

SEQ ID NO: 4190339 - RNA, 18 nt, Yersinia pestis KIM
aacaggcgaguuucccuu

SEQ ID NO: 4190340 - RNA, 20 nt, Yersinia pestis KIM
aacagguaguggaaauaggu

SEQ ID NO: 4190341 - RNA, 14 nt, Yersinia pestis KIM
aacaguaaauuauu

SEQ ID NO: 4190342 - RNA, 22 nt, Yersinia pestis KIM
aacaguaacccagccccuaaca

SEQ ID NO: 4190343 - RNA, 17 nt, Yersinia pestis KIM
aacaguaagcuuugugc

SEQ ID NO: 4190344 - RNA, 14 nt, Yersinia pestis KIM
aacaguagcagggc

SEQ ID NO: 4190345 - RNA, 16 nt, Yersinia pestis KIM
aacagucauuaacaca

SEQ ID NO: 4190346 - RNA, 15 nt, Yersinia pestis KIM
aacagugaugagaau

SEQ ID NO: 4190347 - RNA, 18 nt, Yersinia pestis KIM
aacagugcaacauuaaaa

SEQ ID NO: 4190348 - RNA, 21 nt, Yersinia pestis KIM
aacagugcaacauuaaaaaua

SEQ ID NO: 4190349 - RNA, 19 nt, Yersinia pestis KIM
aacagugcacaucaauacc

SEQ ID NO: 4190350 - RNA, 20 nt, Yersinia pestis KIM
aacagugccaacagcgagau

SEQ ID NO: 4190351 - RNA, 23 nt, Yersinia pestis KIM
aacaguuugcggucuggcaacug

SEQ ID NO: 4190352 - RNA, 16 nt, Yersinia pestis KIM
aacauaacuuugccag

SEQ ID NO: 4190353 - RNA, 14 nt, Yersinia pestis KIM
aacauaaucaagaa

SEQ ID NO: 4190354 - RNA, 17 nt, Yersinia pestis KIM
aacauacaaccacugaa

SEQ ID NO: 4190355 - RNA, 18 nt, Yersinia pestis KIM
aacauacggacgcucuau

SEQ ID NO: 4190356 - RNA, 17 nt, Yersinia pestis KIM
aacauacuuuucauuuc

SEQ ID NO: 4190357 - RNA, 12 nt, Yersinia pestis KIM
aacauagcuaac

SEQ ID NO: 4190358 - RNA, 15 nt, Yersinia pestis KIM
aacauagcuaacacc

SEQ ID NO: 4190359 - RNA, 17 nt, Yersinia pestis KIM
aacauaggggguaagua

SEQ ID NO: 4190360 - RNA, 14 nt, Yersinia pestis KIM
aaccgcuuacgcug

SEQ ID NO: 4190361 - RNA, 17 nt, Yersinia pestis KIM
aaccgcuuuuuacccag

SEQ ID NO: 4190362 - RNA, 13 nt, Yersinia pestis KIM
aaccggaauaaau

SEQ ID NO: 4190363 - RNA, 17 nt, Yersinia pestis KIM
aaccggaugauuucaaa

SEQ ID NO: 4190364 - RNA, 21 nt, Yersinia pestis KIM
aaccggcauucuucgccgcau

SEQ ID NO: 4190365 - RNA, 13 nt, Yersinia pestis KIM
aaccggcgcaaau

SEQ ID NO: 4190366 - RNA, 20 nt, Yersinia pestis KIM
aaccgguauugaccagauag

SEQ ID NO: 4190367 - RNA, 15 nt, Yersinia pestis KIM
aaccguacagauaua

SEQ ID NO: 4190368 - RNA, 18 nt, Yersinia pestis KIM
aaccguagucgcaccaag

SEQ ID NO: 4190369 - RNA, 20 nt, Yersinia pestis KIM
aaccgucaccguguucaugg

SEQ ID NO: 4190370 - RNA, 21 nt, Yersinia pestis KIM
aaccgugcaccauacccuuug

SEQ ID NO: 4190371 - RNA, 16 nt, Yersinia pestis KIM
aaccguuucaggagau

SEQ ID NO: 4190372 - RNA, 12 nt, Yersinia pestis KIM
aaccuaauacuu

SEQ ID NO: 4190373 - RNA, 18 nt, Yersinia pestis KIM
aaccuaaugccagacaca

SEQ ID NO: 4190374 - RNA, 19 nt, Yersinia pestis KIM
aaccuacgccauuaaaagg

SEQ ID NO: 4190375 - RNA, 17 nt, Yersinia pestis KIM
aaccuauuaucccaguu

SEQ ID NO: 4190376 - RNA, 22 nt, Yersinia pestis KIM
aaccucaaaaggauggcccaag

SEQ ID NO: 4190377 - RNA, 15 nt, Yersinia pestis KIM
aaccucaaaucgaua

SEQ ID NO: 4190378 - RNA, 17 nt, Yersinia pestis KIM
aaccucacgccaccuuc

SEQ ID NO: 4190379 - RNA, 13 nt, Yersinia pestis KIM
aaccucagccuca

SEQ ID NO: 4190380 - RNA, 15 nt, Yersinia pestis KIM
aaccucagccucauu

SEQ ID NO: 4190381 - RNA, 17 nt, Yersinia pestis KIM
aaccucagccucauuca

SEQ ID NO: 4190382 - RNA, 21 nt, Yersinia pestis KIM
aaccucgcgugcgggcauuga

SEQ ID NO: 4190383 - RNA, 17 nt, Yersinia pestis KIM
aaccucgguggcucaau

SEQ ID NO: 4190384 - RNA, 21 nt, Yersinia pestis KIM
aaccucgguggcucaauccaa

SEQ ID NO: 4190385 - RNA, 14 nt, Yersinia pestis KIM
aaccugagcaccag

SEQ ID NO: 4190386 - RNA, 14 nt, Yersinia pestis KIM
aaccugcaaugccu

SEQ ID NO: 4190387 - RNA, 15 nt, Yersinia pestis KIM
aaccugcguaaacaa

SEQ ID NO: 4190388 - RNA, 11 nt, Yersinia pestis KIM
aaccuggccaa

SEQ ID NO: 4190389 - RNA, 13 nt, Yersinia pestis KIM
aaccuggcucagu

SEQ ID NO: 4190390 - RNA, 14 nt, Yersinia pestis KIM
aaccugguuaucgg

SEQ ID NO: 4190391 - RNA, 21 nt, Yersinia pestis KIM
aaccuuaauuugcuuuaaaua

SEQ ID NO: 4190392 - RNA, 16 nt, Yersinia pestis KIM
aaccuuaucaccaacg

SEQ ID NO: 4190393 - RNA, 24 nt, Yersinia pestis KIM
aaccuuauuuuugcauauaaaaca

SEQ ID NO: 4190394 - RNA, 13 nt, Yersinia pestis KIM
aaccuucucugca

SEQ ID NO: 4190395 - RNA, 14 nt, Yersinia pestis KIM
aaccuucucugcac

SEQ ID NO: 4190396 - RNA, 22 nt, Yersinia pestis KIM
aaccuuguuuuaccuuggaaca

SEQ ID NO: 4190397 - RNA, 16 nt, Yersinia pestis KIM
aaccuuuacaauuaca

SEQ ID NO: 4190398 - RNA, 18 nt, Yersinia pestis KIM
aaccuuuauguaacacau

SEQ ID NO: 4190399 - RNA, 19 nt, Yersinia pestis KIM
aaccuuucgaguugaacuc

SEQ ID NO: 4190400 - RNA, 13 nt, Yersinia pestis KIM
aacgaaacacacu

SEQ ID NO: 4190401 - RNA, 20 nt, Yersinia pestis KIM
aacgaacccgauaacccaca

SEQ ID NO: 4190402 - RNA, 19 nt, Yersinia pestis KIM
aacgaacgcucuuuaacaa

SEQ ID NO: 4190403 - RNA, 21 nt, Yersinia pestis KIM
aacgaacgcucuuuaacaauu

SEQ ID NO: 4190404 - RNA, 15 nt, Yersinia pestis KIM
aacgaaguuagaccc

SEQ ID NO: 4190405 - RNA, 12 nt, Yersinia pestis KIM
aacgaauuucau

SEQ ID NO: 4190406 - RNA, 17 nt, Yersinia pestis KIM
aacgaauuucauuuuaa

SEQ ID NO: 4190407 - RNA, 18 nt, Yersinia pestis KIM
aacgaauuucauuuuaaa

SEQ ID NO: 4190408 - RNA, 13 nt, Yersinia pestis KIM
aacgacagcagca

SEQ ID NO: 4190409 - RNA, 17 nt, Yersinia pestis KIM
aacgacauuucguuuaa

SEQ ID NO: 4190410 - RNA, 19 nt, Yersinia pestis KIM
aacgaccaauuucaauaau

SEQ ID NO: 4190411 - RNA, 14 nt, Yersinia pestis KIM
aacgaccaguaagu

SEQ ID NO: 4190412 - RNA, 18 nt, Yersinia pestis KIM
aacgacguucucacuugg

SEQ ID NO: 4190413 - RNA, 17 nt, Yersinia pestis KIM
aacgacuccaucaccgu

SEQ ID NO: 4190414 - RNA, 12 nt, Yersinia pestis KIM
aacgaguaaaua

SEQ ID NO: 4190415 - RNA, 15 nt, Yersinia pestis KIM
aacgaguuuccaguu

SEQ ID NO: 4190416 - RNA, 18 nt, Yersinia pestis KIM
aacgaguuuccaguucaa

SEQ ID NO: 4190417 - RNA, 14 nt, Yersinia pestis KIM
aacgauaacggcgg

SEQ ID NO: 4190418 - RNA, 19 nt, Yersinia pestis KIM
aacgauaugcuccagauca

SEQ ID NO: 4190419 - RNA, 16 nt, Yersinia pestis KIM
aacgcaacgcacgauc

SEQ ID NO: 4190420 - RNA, 15 nt, Yersinia pestis KIM
aacgcaauuuuaugg

SEQ ID NO: 4190421 - RNA, 23 nt, Yersinia pestis KIM
aacgcaccccacaaccugcgcca

SEQ ID NO: 4190422 - RNA, 14 nt, Yersinia pestis KIM
aacgcacugagagc

SEQ ID NO: 4190423 - RNA, 13 nt, Yersinia pestis KIM
aacgcagauaaau

SEQ ID NO: 4190424 - RNA, 21 nt, Yersinia pestis KIM
aacgcaggcacugcagaaaau

SEQ ID NO: 4190425 - RNA, 16 nt, Yersinia pestis KIM
aacgcauacucaaaaa

SEQ ID NO: 4190426 - RNA, 12 nt, Yersinia pestis KIM
aacgccaaaaua

SEQ ID NO: 4190427 - RNA, 17 nt, Yersinia pestis KIM
aacgccaaacaguaaau

SEQ ID NO: 4190428 - RNA, 16 nt, Yersinia pestis KIM
aacgccaacugcggca

SEQ ID NO: 4190429 - RNA, 15 nt, Yersinia pestis KIM
aacgccagauaacga

SEQ ID NO: 4190430 - RNA, 16 nt, Yersinia pestis KIM
aacgcccaaaucugcc

SEQ ID NO: 4190431 - RNA, 14 nt, Yersinia pestis KIM
aacgcccugcaucu

SEQ ID NO: 4190432 - RNA, 22 nt, Yersinia pestis KIM
aacgcccugccgggcaaugugu

SEQ ID NO: 4190433 - RNA, 15 nt, Yersinia pestis KIM
aacgccgacuuuauu

SEQ ID NO: 4190434 - RNA, 13 nt, Yersinia pestis KIM
aacgccgaguaag

SEQ ID NO: 4190435 - RNA, 19 nt, Yersinia pestis KIM
aacgccgaucauaaaucac

SEQ ID NO: 4190436 - RNA, 15 nt, Yersinia pestis KIM
aacgccgcuaaauca

SEQ ID NO: 4190437 - RNA, 20 nt, Yersinia pestis KIM
aacgccuccucuuggauuau

SEQ ID NO: 4190438 - RNA, 22 nt, Yersinia pestis KIM
aacgcgccggaauuagcgaaau

SEQ ID NO: 4190439 - RNA, 18 nt, Yersinia pestis KIM
aacgcguaccugcuuauu

SEQ ID NO: 4190440 - RNA, 19 nt, Yersinia pestis KIM
aacgcuauucuuagccucg

SEQ ID NO: 4190441 - RNA, 16 nt, Yersinia pestis KIM
aacgcucaaucacgac

SEQ ID NO: 4190442 - RNA, 23 nt, Yersinia pestis KIM
aacgcucauaccaugccaucaau

SEQ ID NO: 4190443 - RNA, 22 nt, Yersinia pestis KIM
aacgcucaucaaccgggauauc

SEQ ID NO: 4190444 - RNA, 23 nt, Yersinia pestis KIM
aacgcuccgguuuucacccccac

SEQ ID NO: 4190445 - RNA, 14 nt, Yersinia pestis KIM
aacgcucggcaccg

SEQ ID NO: 4190446 - RNA, 21 nt, Yersinia pestis KIM
aacgcugauguaggcaauaca

SEQ ID NO: 4190447 - RNA, 15 nt, Yersinia pestis KIM
aacgcuggccagcau

SEQ ID NO: 4190448 - RNA, 15 nt, Yersinia pestis KIM
aacgcuucaucaugg

SEQ ID NO: 4190449 - RNA, 16 nt, Yersinia pestis KIM
aacgcuugcgccaaau

SEQ ID NO: 4190450 - RNA, 18 nt, Yersinia pestis KIM
aacgcuugcgccaaaucc

SEQ ID NO: 4190451 - RNA, 19 nt, Yersinia pestis KIM
aacgcuuuuaacugugcag

SEQ ID NO: 4190452 - RNA, 22 nt, Yersinia pestis KIM
aacggaggggcuacacgguaau

SEQ ID NO: 4190453 - RNA, 16 nt, Yersinia pestis KIM
aacggauaauguugca

SEQ ID NO: 4190454 - RNA, 16 nt, Yersinia pestis KIM
aacggcacaucccaau

SEQ ID NO: 4190455 - RNA, 17 nt, Yersinia pestis KIM
aacggcacguuuccccu

SEQ ID NO: 4190456 - RNA, 20 nt, Yersinia pestis KIM
aacggcaucugccaccgcuc

SEQ ID NO: 4190457 - RNA, 19 nt, Yersinia pestis KIM
aacggcgcgauaaauaguc

SEQ ID NO: 4190458 - RNA, 22 nt, Yersinia pestis KIM
aacggcguugaucgguugccaa

SEQ ID NO: 4190459 - RNA, 14 nt, Yersinia pestis KIM
aacggcucaucgcu

SEQ ID NO: 4190460 - RNA, 17 nt, Yersinia pestis KIM
aacggcuggucaucacg

SEQ ID NO: 4190461 - RNA, 14 nt, Yersinia pestis KIM
aacgggcaaccugu

SEQ ID NO: 4190462 - RNA, 16 nt, Yersinia pestis KIM
aacgggcaaccuguac

SEQ ID NO: 4190463 - RNA, 20 nt, Yersinia pestis KIM
aacgggccgcauucaccacc

SEQ ID NO: 4190464 - RNA, 11 nt, Yersinia pestis KIM
aacgggcuucc

SEQ ID NO: 4190465 - RNA, 14 nt, Yersinia pestis KIM
aacgggcuuccauc

SEQ ID NO: 4190466 - RNA, 17 nt, Yersinia pestis KIM
aacgggucgucucuugc

SEQ ID NO: 4190467 - RNA, 23 nt, Yersinia pestis KIM
aacgggucgucucuugcaaugaa

SEQ ID NO: 4190468 - RNA, 18 nt, Yersinia pestis KIM
aacggguggccgccgcgg

SEQ ID NO: 4190469 - RNA, 15 nt, Yersinia pestis KIM
aacgguaucagucau

SEQ ID NO: 4190470 - RNA, 16 nt, Yersinia pestis KIM
aacggucuguuaaucc

SEQ ID NO: 4190471 - RNA, 18 nt, Yersinia pestis KIM
aacggugaggauaggcag

SEQ ID NO: 4190472 - RNA, 18 nt, Yersinia pestis KIM
aacggugaggauaggcug

SEQ ID NO: 4190473 - RNA, 16 nt, Yersinia pestis KIM
aacgguuaagcaggua

SEQ ID NO: 4190474 - RNA, 19 nt, Yersinia pestis KIM
aacgguuucaacuucaacg

SEQ ID NO: 4190475 - RNA, 10 nt, Yersinia pestis KIM
aacuuacugc

SEQ ID NO: 4190476 - RNA, 16 nt, Yersinia pestis KIM
aacuuagcgccauaac

SEQ ID NO: 4190477 - RNA, 12 nt, Yersinia pestis KIM
aacuuaucacug

SEQ ID NO: 4190478 - RNA, 15 nt, Yersinia pestis KIM
aacuuaucgaccaac

SEQ ID NO: 4190479 - RNA, 24 nt, Yersinia pestis KIM
aacuuaucgaccaacuggcaauca

SEQ ID NO: 4190480 - RNA, 19 nt, Yersinia pestis KIM
aacuuauuacaccuuaaaa

SEQ ID NO: 4190481 - RNA, 22 nt, Yersinia pestis KIM
aacuucaagccgauaaucccug

SEQ ID NO: 4190482 - RNA, 23 nt, Yersinia pestis KIM
aacuucaagccgauaaucccugc

SEQ ID NO: 4190483 - RNA, 19 nt, Yersinia pestis KIM
aacuucaccacugugauaa

SEQ ID NO: 4190484 - RNA, 12 nt, Yersinia pestis KIM
aacuucagagcc

SEQ ID NO: 4190485 - RNA, 16 nt, Yersinia pestis KIM
aacuucagguucaccu

SEQ ID NO: 4190486 - RNA, 20 nt, Yersinia pestis KIM
aacuuccagcguauguuccu

SEQ ID NO: 4190487 - RNA, 15 nt, Yersinia pestis KIM
aacuucccggcgauu

SEQ ID NO: 4190488 - RNA, 14 nt, Yersinia pestis KIM
aacuuccuugauuu

SEQ ID NO: 4190489 - RNA, 17 nt, Yersinia pestis KIM
aacuuccuugauuuuca

SEQ ID NO: 4190490 - RNA, 21 nt, Yersinia pestis KIM
aacuuccuugauuuucauuuc

SEQ ID NO: 4190491 - RNA, 14 nt, Yersinia pestis KIM
aacuugaucagcgc

SEQ ID NO: 4190492 - RNA, 12 nt, Yersinia pestis KIM
aacuugccgcgg

SEQ ID NO: 4190493 - RNA, 23 nt, Yersinia pestis KIM
aacuugcuuugcgaaauaaguua

SEQ ID NO: 4190494 - RNA, 18 nt, Yersinia pestis KIM
aacuugguaccagucuaa

SEQ ID NO: 4190495 - RNA, 14 nt, Yersinia pestis KIM
aacuuguucauaua

SEQ ID NO: 4190496 - RNA, 18 nt, Yersinia pestis KIM
aacuuuaucagucuguag

SEQ ID NO: 4190497 - RNA, 18 nt, Yersinia pestis KIM
aacuuucaucccuuuagc

SEQ ID NO: 4190498 - RNA, 15 nt, Yersinia pestis KIM
aacuuucccagucau

SEQ ID NO: 4190499 - RNA, 12 nt, Yersinia pestis KIM
aacuuugccagu

SEQ ID NO: 4190500 - RNA, 20 nt, Yersinia pestis KIM
aacuuuuauugucuuuaaua

SEQ ID NO: 4190501 - RNA, 13 nt, Yersinia pestis KIM
aacuuuucaguuu

SEQ ID NO: 4190502 - RNA, 22 nt, Yersinia pestis KIM
aacuuuucaucgcauaggccaa

SEQ ID NO: 4190503 - RNA, 18 nt, Yersinia pestis KIM
aacuuuucuucauugcug

SEQ ID NO: 4190504 - RNA, 13 nt, Yersinia pestis KIM
aacuuuuuucauc

SEQ ID NO: 4190505 - RNA, 18 nt, Yersinia pestis KIM
aacuuuuuucauccuaaa

SEQ ID NO: 4190506 - RNA, 12 nt, Yersinia pestis KIM
aagaaaagcacc

SEQ ID NO: 4190507 - RNA, 14 nt, Yersinia pestis KIM
aagaaaaucaggau

SEQ ID NO: 4190508 - RNA, 12 nt, Yersinia pestis KIM
aagaaaaugauu

SEQ ID NO: 4190509 - RNA, 16 nt, Yersinia pestis KIM
aagaaaaugauuuaau

SEQ ID NO: 4190510 - RNA, 12 nt, Yersinia pestis KIM
aagaaaccagcg

SEQ ID NO: 4190511 - RNA, 11 nt, Yersinia pestis KIM
aagaaauaaaa

SEQ ID NO: 4190512 - RNA, 17 nt, Yersinia pestis KIM
aagaaauaaaagaaaac

SEQ ID NO: 4190513 - RNA, 18 nt, Yersinia pestis KIM
aagaaauaaaagaaaacc

SEQ ID NO: 4190514 - RNA, 15 nt, Yersinia pestis KIM
aagaaaucaaaaggg

SEQ ID NO: 4190515 - RNA, 23 nt, Yersinia pestis KIM
aagaaaucauuuaggcguuucuu

SEQ ID NO: 4190516 - RNA, 16 nt, Yersinia pestis KIM
aagaacagcuuugcuu

SEQ ID NO: 4190517 - RNA, 21 nt, Yersinia pestis KIM
aagaacggccugccagaacag

SEQ ID NO: 4190518 - RNA, 20 nt, Yersinia pestis KIM
aagaacuggcuggaucagca

SEQ ID NO: 4190519 - RNA, 19 nt, Yersinia pestis KIM
aagaagaauccacauaaaa

SEQ ID NO: 4190520 - RNA, 16 nt, Yersinia pestis KIM
aagaagccucaugaau

SEQ ID NO: 4190521 - RNA, 17 nt, Yersinia pestis KIM
aagaagccucaugaaug

SEQ ID NO: 4190522 - RNA, 12 nt, Yersinia pestis KIM
aagaauaaauaa

SEQ ID NO: 4190523 - RNA, 14 nt, Yersinia pestis KIM
aagaauaaauaaua

SEQ ID NO: 4190524 - RNA, 23 nt, Yersinia pestis KIM
aagaauaaaugucacuugcccug

SEQ ID NO: 4190525 - RNA, 22 nt, Yersinia pestis KIM
aagaauaaggguagguucaaua

SEQ ID NO: 4190526 - RNA, 14 nt, Yersinia pestis KIM
aagaauacacaaaa

SEQ ID NO: 4190527 - RNA, 18 nt, Yersinia pestis KIM
aagaaucaccgaaagaag

SEQ ID NO: 4190528 - RNA, 19 nt, Yersinia pestis KIM
aagaaucagcgguugaaaa

SEQ ID NO: 4190529 - RNA, 23 nt, Yersinia pestis KIM
aagaaucagcgguugaaaaguuu

SEQ ID NO: 4190530 - RNA, 17 nt, Yersinia pestis KIM
aagaaucccaucaaacg

SEQ ID NO: 4190531 - RNA, 19 nt, Yersinia pestis KIM
aagaauccucugaauaaaa

SEQ ID NO: 4190532 - RNA, 20 nt, Yersinia pestis KIM
aagaauccucugaauaaaaa

SEQ ID NO: 4190533 - RNA, 23 nt, Yersinia pestis KIM
aagaaugcgaagacgaauaaaua

SEQ ID NO: 4190534 - RNA, 23 nt, Yersinia pestis KIM
aagaauguauugagauuuuccca

SEQ ID NO: 4190535 - RNA, 22 nt, Yersinia pestis KIM
aagaaugucaugguuaaacuga

SEQ ID NO: 4190536 - RNA, 16 nt, Yersinia pestis KIM
aagaauugcagauacc

SEQ ID NO: 4190537 - RNA, 14 nt, Yersinia pestis KIM
aagaauugcgcagc

SEQ ID NO: 4190538 - RNA, 19 nt, Yersinia pestis KIM
aagaauugugccccaagaa

SEQ ID NO: 4190539 - RNA, 13 nt, Yersinia pestis KIM
aagacaacaaaca

SEQ ID NO: 4190540 - RNA, 11 nt, Yersinia pestis KIM
aagacaacuua

SEQ ID NO: 4190541 - RNA, 20 nt, Yersinia pestis KIM
aagacaacuuauuuguguaa

SEQ ID NO: 4190542 - RNA, 22 nt, Yersinia pestis KIM
aagacaauaaaucgccacgcca

SEQ ID NO: 4190543 - RNA, 14 nt, Yersinia pestis KIM
aagacauaaagaaa

SEQ ID NO: 4190544 - RNA, 15 nt, Yersinia pestis KIM
aagacauaaagaaaa

SEQ ID NO: 4190545 - RNA, 19 nt, Yersinia pestis KIM
aagacauugcgcaagcccc

SEQ ID NO: 4190546 - RNA, 21 nt, Yersinia pestis KIM
aagaccgcuuuaucaaagaau

SEQ ID NO: 4190547 - RNA, 18 nt, Yersinia pestis KIM
aagaccgguggcuuuuuc

SEQ ID NO: 4190548 - RNA, 16 nt, Yersinia pestis KIM
aagacgaguaaugaaa

SEQ ID NO: 4190549 - RNA, 19 nt, Yersinia pestis KIM
aagacgaguaaugaaaucu

SEQ ID NO: 4190550 - RNA, 13 nt, Yersinia pestis KIM
aagacgccauuaa

SEQ ID NO: 4190551 - RNA, 16 nt, Yersinia pestis KIM
aagacgccauuaauaa

SEQ ID NO: 4190552 - RNA, 18 nt, Yersinia pestis KIM
aagacgccggcuucccug

SEQ ID NO: 4190553 - RNA, 21 nt, Yersinia pestis KIM
aagacgccguaaauacaucca

SEQ ID NO: 4190554 - RNA, 16 nt, Yersinia pestis KIM
aagacguccgucguuu

SEQ ID NO: 4190555 - RNA, 11 nt, Yersinia pestis KIM
aagacugaagu

SEQ ID NO: 4190556 - RNA, 15 nt, Yersinia pestis KIM
aagacuucagcccau

SEQ ID NO: 4190557 - RNA, 13 nt, Yersinia pestis KIM
aagagaaaagcag

SEQ ID NO: 4190558 - RNA, 14 nt, Yersinia pestis KIM
aagagaaaagcaga

SEQ ID NO: 4190559 - RNA, 21 nt, Yersinia pestis KIM
aagagaaaguugauccugggu

SEQ ID NO: 4190560 - RNA, 14 nt, Yersinia pestis KIM
aagagagccauaau

SEQ ID NO: 4190561 - RNA, 22 nt, Yersinia pestis KIM
aagagauagauuuuaaugaaaa

SEQ ID NO: 4190562 - RNA, 18 nt, Yersinia pestis KIM
aagagauguuauuugaau

SEQ ID NO: 4190563 - RNA, 23 nt, Yersinia pestis KIM
aagagcgacucaauaauauggga

SEQ ID NO: 4190564 - RNA, 22 nt, Yersinia pestis KIM
aagagcggucgacaaaauguga

SEQ ID NO: 4190565 - RNA, 16 nt, Yersinia pestis KIM
aagaguaaauaaauau

SEQ ID NO: 4190566 - RNA, 18 nt, Yersinia pestis KIM
aagaguacuaacgucaac

SEQ ID NO: 4190567 - RNA, 20 nt, Yersinia pestis KIM
aagaguacuaacgucaacag

SEQ ID NO: 4190568 - RNA, 12 nt, Yersinia pestis KIM
aagagucacagc

SEQ ID NO: 4190569 - RNA, 21 nt, Yersinia pestis KIM
aagagucgcaaaacuucacuu

SEQ ID NO: 4190570 - RNA, 13 nt, Yersinia pestis KIM
aagagugaaauau

SEQ ID NO: 4190571 - RNA, 21 nt, Yersinia pestis KIM
aagagugaccaaagcaguaaa

SEQ ID NO: 4190572 - RNA, 15 nt, Yersinia pestis KIM
aagaguuagggcugg

SEQ ID NO: 4190573 - RNA, 15 nt, Yersinia pestis KIM
aagauaacccaaugc

SEQ ID NO: 4190574 - RNA, 22 nt, Yersinia pestis KIM
aagauaacgaacagguagauca

SEQ ID NO: 4190575 - RNA, 21 nt, Yersinia pestis KIM
aagauaacuuuuuauuucuuu

SEQ ID NO: 4190576 - RNA, 20 nt, Yersinia pestis KIM
aagauacccgccauaaauaa

SEQ ID NO: 4190577 - RNA, 20 nt, Yersinia pestis KIM
aagauacccuugagguuauu

SEQ ID NO: 4190578 - RNA, 22 nt, Yersinia pestis KIM
aagauagacauauuguccaaca

SEQ ID NO: 4190579 - RNA, 14 nt, Yersinia pestis KIM
aagauagcaaaaga

SEQ ID NO: 4190580 - RNA, 14 nt, Yersinia pestis KIM
aagauagccacuaa

SEQ ID NO: 4190581 - RNA, 13 nt, Yersinia pestis KIM
aagauagccggau

SEQ ID NO: 4190582 - RNA, 16 nt, Yersinia pestis KIM
aagauccaccacauca

SEQ ID NO: 4190583 - RNA, 12 nt, Yersinia pestis KIM
aagaucucagca

SEQ ID NO: 4190584 - RNA, 13 nt, Yersinia pestis KIM
aagaucugcauug

SEQ ID NO: 4190585 - RNA, 17 nt, Yersinia pestis KIM
aagaucugcauugauua

SEQ ID NO: 4190586 - RNA, 21 nt, Yersinia pestis KIM
aagaucuucgaacggcgcuga

SEQ ID NO: 4190587 - RNA, 15 nt, Yersinia pestis KIM
aagaugaccaccaau

SEQ ID NO: 4190588 - RNA, 20 nt, Yersinia pestis KIM
aagaugaccaccaauuucau

SEQ ID NO: 4190589 - RNA, 14 nt, Yersinia pestis KIM
aagaugacuacugu

SEQ ID NO: 4190590 - RNA, 13 nt, Yersinia pestis KIM
aaggccccucggg

SEQ ID NO: 4190591 - RNA, 19 nt, Yersinia pestis KIM
aaggcccgcuaucacuagc

SEQ ID NO: 4190592 - RNA, 20 nt, Yersinia pestis KIM
aaggccgcgauaaaaaauaa

SEQ ID NO: 4190593 - RNA, 21 nt, Yersinia pestis KIM
aaggccucggcgauugaacau

SEQ ID NO: 4190594 - RNA, 21 nt, Yersinia pestis KIM
aaggcgauauuauuaguagca

SEQ ID NO: 4190595 - RNA, 20 nt, Yersinia pestis KIM
aaggcgcguuggcagagugg

SEQ ID NO: 4190596 - RNA, 23 nt, Yersinia pestis KIM
aaggcggagaauguuaaaccccc

SEQ ID NO: 4190597 - RNA, 17 nt, Yersinia pestis KIM
aaggcggcaagcaagca

SEQ ID NO: 4190598 - RNA, 16 nt, Yersinia pestis KIM
aaggcggugaacagua

SEQ ID NO: 4190599 - RNA, 18 nt, Yersinia pestis KIM
aaggcuaaaccggcacag

SEQ ID NO: 4190600 - RNA, 21 nt, Yersinia pestis KIM
aaggcuaaccggguggcccaa

SEQ ID NO: 4190601 - RNA, 14 nt, Yersinia pestis KIM
aaggcuauuuuuau

SEQ ID NO: 4190602 - RNA, 18 nt, Yersinia pestis KIM
aaggcugacggugccaga

SEQ ID NO: 4190603 - RNA, 14 nt, Yersinia pestis KIM
aaggcugauuaaua

SEQ ID NO: 4190604 - RNA, 22 nt, Yersinia pestis KIM
aaggcuggagcaagugcuucaa

SEQ ID NO: 4190605 - RNA, 16 nt, Yersinia pestis KIM
aaggcuuuauauugcc

SEQ ID NO: 4190606 - RNA, 11 nt, Yersinia pestis KIM
aagggagccau

SEQ ID NO: 4190607 - RNA, 15 nt, Yersinia pestis KIM
aagggauaugaauaa

SEQ ID NO: 4190608 - RNA, 17 nt, Yersinia pestis KIM
aagggcaagcguuaaca

SEQ ID NO: 4190609 - RNA, 22 nt, Yersinia pestis KIM
aagggcacagcgagauaaacug

SEQ ID NO: 4190610 - RNA, 15 nt, Yersinia pestis KIM
aagggcgcaucccca

SEQ ID NO: 4190611 - RNA, 16 nt, Yersinia pestis KIM
aaggggagcuuccccc

SEQ ID NO: 4190612 - RNA, 17 nt, Yersinia pestis KIM
aaggggcggaaaugccg

SEQ ID NO: 4190613 - RNA, 18 nt, Yersinia pestis KIM
aagggggggaagcucccc

SEQ ID NO: 4190614 - RNA, 14 nt, Yersinia pestis KIM
aagggguuucagac

SEQ ID NO: 4190615 - RNA, 23 nt, Yersinia pestis KIM
aagggguuucagacuccugcccc

SEQ ID NO: 4190616 - RNA, 23 nt, Yersinia pestis KIM
aaggguaaaauaaauauccuccg

SEQ ID NO: 4190617 - RNA, 18 nt, Yersinia pestis KIM
aaggguaauagaagauaa

SEQ ID NO: 4190618 - RNA, 15 nt, Yersinia pestis KIM
aaggguauaacucau

SEQ ID NO: 4190619 - RNA, 16 nt, Yersinia pestis KIM
aaggguauaacucauc

SEQ ID NO: 4190620 - RNA, 13 nt, Yersinia pestis KIM
aaggguauugaag

SEQ ID NO: 4190621 - RNA, 15 nt, Yersinia pestis KIM
aaggguauugaagau

SEQ ID NO: 4190622 - RNA, 17 nt, Yersinia pestis KIM
aaggguauugaagauac

SEQ ID NO: 4190623 - RNA, 17 nt, Yersinia pestis KIM
aagguaaaaggcccgcu

SEQ ID NO: 4190624 - RNA, 17 nt, Yersinia pestis KIM
aagguaaacagacacag

SEQ ID NO: 4190625 - RNA, 13 nt, Yersinia pestis KIM
aagguaaagaaau

SEQ ID NO: 4190626 - RNA, 16 nt, Yersinia pestis KIM
aagguaacggaagggg

SEQ ID NO: 4190627 - RNA, 18 nt, Yersinia pestis KIM
aagguaaugcgaaaaaag

SEQ ID NO: 4190628 - RNA, 22 nt, Yersinia pestis KIM
aagguagaucggggacaggcug

SEQ ID NO: 4190629 - RNA, 18 nt, Yersinia pestis KIM
aagguauagcgauagagu

SEQ ID NO: 4190630 - RNA, 19 nt, Yersinia pestis KIM
aagguaugugccaaaaaaa

SEQ ID NO: 4190631 - RNA, 22 nt, Yersinia pestis KIM
aaggucaacgacaagucaguga

SEQ ID NO: 4190632 - RNA, 18 nt, Yersinia pestis KIM
aaggugaugaaugacugg

SEQ ID NO: 4190633 - RNA, 20 nt, Yersinia pestis KIM
aaggugcgccacuguucuua

SEQ ID NO: 4190634 - RNA, 16 nt, Yersinia pestis KIM
aagguuaaauuuaaua

SEQ ID NO: 4190635 - RNA, 13 nt, Yersinia pestis KIM
aagguuaacugca

SEQ ID NO: 4190636 - RNA, 12 nt, Yersinia pestis KIM
aagguugaccug

SEQ ID NO: 4190637 - RNA, 21 nt, Yersinia pestis KIM
aagguuggaacaccaaaagua

SEQ ID NO: 4190638 - RNA, 12 nt, Yersinia pestis KIM
aaguaaaaaaaa

SEQ ID NO: 4190639 - RNA, 14 nt, Yersinia pestis KIM
aaguaaaaaaaacc

SEQ ID NO: 4190640 - RNA, 20 nt, Yersinia pestis KIM
aaguaaaacgugaaacgccu

SEQ ID NO: 4190641 - RNA, 12 nt, Yersinia pestis KIM
aaguaaaagcca

SEQ ID NO: 4190642 - RNA, 16 nt, Yersinia pestis KIM
aaguaaaagucagcaa

SEQ ID NO: 4190643 - RNA, 17 nt, Yersinia pestis KIM
aaguaaaagucagcaaa

SEQ ID NO: 4190644 - RNA, 14 nt, Yersinia pestis KIM
aaguaaaucagacc

SEQ ID NO: 4190645 - RNA, 22 nt, Yersinia pestis KIM
aaguaaauguuagcucaauuug

SEQ ID NO: 4190646 - RNA, 20 nt, Yersinia pestis KIM
aaguaaggaucguucagugc

SEQ ID NO: 4190647 - RNA, 12 nt, Yersinia pestis KIM
aaguaauaaaaa

SEQ ID NO: 4190648 - RNA, 21 nt, Yersinia pestis KIM
aaguacuuauuugaaacacuu

SEQ ID NO: 4190649 - RNA, 19 nt, Yersinia pestis KIM
aaguacuuccaauaaguga

SEQ ID NO: 4190650 - RNA, 17 nt, Yersinia pestis KIM
aaguaucugaaaauauu

SEQ ID NO: 4190651 - RNA, 16 nt, Yersinia pestis KIM
aaguaucuuaccgaca

SEQ ID NO: 4190652 - RNA, 19 nt, Yersinia pestis KIM
aaguaucuuucacccugcg

SEQ ID NO: 4190653 - RNA, 20 nt, Yersinia pestis KIM
aaguaugacgggaauauuua

SEQ ID NO: 4190654 - RNA, 23 nt, Yersinia pestis KIM
aaguauugacccucuuaaugaau

SEQ ID NO: 4190655 - RNA, 17 nt, Yersinia pestis KIM
aagucaauaaauaaaaa

SEQ ID NO: 4190656 - RNA, 18 nt, Yersinia pestis KIM
aagucaauuucagcuuuu

SEQ ID NO: 4190657 - RNA, 20 nt, Yersinia pestis KIM
aagucaauuucagcuuuuag

SEQ ID NO: 4190658 - RNA, 13 nt, Yersinia pestis KIM
aagucagcaaauc

SEQ ID NO: 4190659 - RNA, 17 nt, Yersinia pestis KIM
aagucaugguacaacug

SEQ ID NO: 4190660 - RNA, 16 nt, Yersinia pestis KIM
aagucauuaacuguua

SEQ ID NO: 4190661 - RNA, 21 nt, Yersinia pestis KIM
aagucauuggcguuacagcaa

SEQ ID NO: 4190662 - RNA, 23 nt, Yersinia pestis KIM
aagucauuggcguuacagcaagg

SEQ ID NO: 4190663 - RNA, 15 nt, Yersinia pestis KIM
aaguccgucuuguau

SEQ ID NO: 4190664 - RNA, 14 nt, Yersinia pestis KIM
aagucgucugauau

SEQ ID NO: 4190665 - RNA, 18 nt, Yersinia pestis KIM
aagucuugaagagugacc

SEQ ID NO: 4190666 - RNA, 21 nt, Yersinia pestis KIM
aagucuugaagagugaccaaa

SEQ ID NO: 4190667 - RNA, 20 nt, Yersinia pestis KIM
aagugaaacccgcgcagccu

SEQ ID NO: 4190668 - RNA, 15 nt, Yersinia pestis KIM
aagugaacaugauga

SEQ ID NO: 4190669 - RNA, 18 nt, Yersinia pestis KIM
aagugacccaagaugacc

SEQ ID NO: 4190670 - RNA, 13 nt, Yersinia pestis KIM
aagugagaagggu

SEQ ID NO: 4190671 - RNA, 21 nt, Yersinia pestis KIM
aagugagaaggguauugaaga

SEQ ID NO: 4190672 - RNA, 20 nt, Yersinia pestis KIM
aagugaucagcuaacaaaac

SEQ ID NO: 4190673 - RNA, 22 nt, Yersinia pestis KIM
aagugaucagcuaacaaaaccg

SEQ ID NO: 4190674 - RNA, 15 nt, Yersinia pestis KIM
aagugauucggguga

SEQ ID NO: 4190675 - RNA, 19 nt, Yersinia pestis KIM
aagugauucgggugaguga

SEQ ID NO: 4190676 - RNA, 21 nt, Yersinia pestis KIM
aagugauucgggugagugagc

SEQ ID NO: 4190677 - RNA, 17 nt, Yersinia pestis KIM
aagugcaaacuuaaaaa

SEQ ID NO: 4190678 - RNA, 18 nt, Yersinia pestis KIM
aagugcaaacuuaaaaau

SEQ ID NO: 4190679 - RNA, 20 nt, Yersinia pestis KIM
aagugcaaacuuaaaaauca

SEQ ID NO: 4190680 - RNA, 21 nt, Yersinia pestis KIM
aagugcaaacuuaaaaaucaa

SEQ ID NO: 4190681 - RNA, 21 nt, Yersinia pestis KIM
aagugcccccuguaacgcuaa

SEQ ID NO: 4190682 - RNA, 19 nt, Yersinia pestis KIM
aagugcgggaaaguaauau

SEQ ID NO: 4190683 - RNA, 23 nt, Yersinia pestis KIM
aaguggccacucaccucagucau

SEQ ID NO: 4190684 - RNA, 22 nt, Yersinia pestis KIM
aaguggcuaucugaaacugaga

SEQ ID NO: 4190685 - RNA, 16 nt, Yersinia pestis KIM
aaguggcugaauauca

SEQ ID NO: 4190686 - RNA, 23 nt, Yersinia pestis KIM
aagugggggugauauaugccaua

SEQ ID NO: 4190687 - RNA, 19 nt, Yersinia pestis KIM
aaguggguaauguugcaaa

SEQ ID NO: 4190688 - RNA, 21 nt, Yersinia pestis KIM
aagugguagccggacucaaaa

SEQ ID NO: 4190689 - RNA, 23 nt, Yersinia pestis KIM
aagugguagccggacucaaaaua

SEQ ID NO: 4190690 - RNA, 19 nt, Yersinia pestis KIM
aagugugauagaacccugc

SEQ ID NO: 4190691 - RNA, 16 nt, Yersinia pestis KIM
aaguguuucaaauaag

SEQ ID NO: 4190692 - RNA, 12 nt, Yersinia pestis KIM
aaguuaaaaaaa

SEQ ID NO: 4190693 - RNA, 15 nt, Yersinia pestis KIM
aaguuaaacaauguu

SEQ ID NO: 4190694 - RNA, 18 nt, Yersinia pestis KIM
aaguuaaacaauguuaaa

SEQ ID NO: 4190695 - RNA, 22 nt, Yersinia pestis KIM
aaguuaaacaauguuaaacuuu

SEQ ID NO: 4190696 - RNA, 23 nt, Yersinia pestis KIM
aaguuagcuacgcugcugaauuc

SEQ ID NO: 4190697 - RNA, 18 nt, Yersinia pestis KIM
aaguuaggguucaguaaa

SEQ ID NO: 4190698 - RNA, 22 nt, Yersinia pestis KIM
aaguuaggguucaguaaaacca

SEQ ID NO: 4190699 - RNA, 23 nt, Yersinia pestis KIM
aaguuaggguucaguaaaaccaa

SEQ ID NO: 4190700 - RNA, 19 nt, Yersinia pestis KIM
aaguuagugguguuaucca

SEQ ID NO: 4190701 - RNA, 22 nt, Yersinia pestis KIM
aaguuagugguguuauccacuu

SEQ ID NO: 4190702 - RNA, 19 nt, Yersinia pestis KIM
aaguucaagaaccgaaaua

SEQ ID NO: 4190703 - RNA, 17 nt, Yersinia pestis KIM
aaguucacaugaugaau

SEQ ID NO: 4190704 - RNA, 11 nt, Yersinia pestis KIM
aauaauucagg

SEQ ID NO: 4190705 - RNA, 22 nt, Yersinia pestis KIM
aauaauucauaugacaaauaag

SEQ ID NO: 4190706 - RNA, 23 nt, Yersinia pestis KIM
aauaauucauaugacaaauaagg

SEQ ID NO: 4190707 - RNA, 17 nt, Yersinia pestis KIM
aauaauucgaguuucag

SEQ ID NO: 4190708 - RNA, 19 nt, Yersinia pestis KIM
aauaauugguagccacaau

SEQ ID NO: 4190709 - RNA, 13 nt, Yersinia pestis KIM
aauaauuuauaca

SEQ ID NO: 4190710 - RNA, 14 nt, Yersinia pestis KIM
aauaauuuguaaau

SEQ ID NO: 4190711 - RNA, 13 nt, Yersinia pestis KIM
aauaauuuuaugg

SEQ ID NO: 4190712 - RNA, 14 nt, Yersinia pestis KIM
aauacaaaaauaca

SEQ ID NO: 4190713 - RNA, 20 nt, Yersinia pestis KIM
aauacaaccaacaaacaauc

SEQ ID NO: 4190714 - RNA, 22 nt, Yersinia pestis KIM
aauacaacgguuuaugcccaga

SEQ ID NO: 4190715 - RNA, 16 nt, Yersinia pestis KIM
aauacaauuauuuuua

SEQ ID NO: 4190716 - RNA, 17 nt, Yersinia pestis KIM
aauacaauuauuuuuac

SEQ ID NO: 4190717 - RNA, 18 nt, Yersinia pestis KIM
aauacaauuauuuuuaca

SEQ ID NO: 4190718 - RNA, 20 nt, Yersinia pestis KIM
aauacaccuucuuuaucugu

SEQ ID NO: 4190719 - RNA, 23 nt, Yersinia pestis KIM
aauacacgaaugcgacaccugcu

SEQ ID NO: 4190720 - RNA, 20 nt, Yersinia pestis KIM
aauacagaaaaauaggccau

SEQ ID NO: 4190721 - RNA, 13 nt, Yersinia pestis KIM
aauacagcaaaua

SEQ ID NO: 4190722 - RNA, 22 nt, Yersinia pestis KIM
aauacaggggcguuauugagaa

SEQ ID NO: 4190723 - RNA, 18 nt, Yersinia pestis KIM
aauacaggugucaucaag

SEQ ID NO: 4190724 - RNA, 14 nt, Yersinia pestis KIM
aauacauagaagcu

SEQ ID NO: 4190725 - RNA, 22 nt, Yersinia pestis KIM
aauacauagaagcucauaugca

SEQ ID NO: 4190726 - RNA, 18 nt, Yersinia pestis KIM
aauacauauaaccaucaa

SEQ ID NO: 4190727 - RNA, 19 nt, Yersinia pestis KIM
aauacauauaaccaucaaa

SEQ ID NO: 4190728 - RNA, 16 nt, Yersinia pestis KIM
aauacaucaucaaaac

SEQ ID NO: 4190729 - RNA, 12 nt, Yersinia pestis KIM
aauacauccaug

SEQ ID NO: 4190730 - RNA, 14 nt, Yersinia pestis KIM
aauacauccaugua

SEQ ID NO: 4190731 - RNA, 20 nt, Yersinia pestis KIM
aauacauguacuagaucaca

SEQ ID NO: 4190732 - RNA, 16 nt, Yersinia pestis KIM
aauaccaaaaaucucu

SEQ ID NO: 4190733 - RNA, 16 nt, Yersinia pestis KIM
aauaccaauuaauaag

SEQ ID NO: 4190734 - RNA, 17 nt, Yersinia pestis KIM
aauaccauaacgcugcu

SEQ ID NO: 4190735 - RNA, 21 nt, Yersinia pestis KIM
aauaccccccaccaauugguu

SEQ ID NO: 4190736 - RNA, 16 nt, Yersinia pestis KIM
aauacccgguuuccag

SEQ ID NO: 4190737 - RNA, 18 nt, Yersinia pestis KIM
aauacccgguuuccaguu

SEQ ID NO: 4190738 - RNA, 21 nt, Yersinia pestis KIM
aauaccgaugagcugaauagc

SEQ ID NO: 4190739 - RNA, 18 nt, Yersinia pestis KIM
aauaccgccacacaauac

SEQ ID NO: 4190740 - RNA, 19 nt, Yersinia pestis KIM
aauaccgccggcaacagcg

SEQ ID NO: 4190741 - RNA, 18 nt, Yersinia pestis KIM
aauaccgccgguuuuugc

SEQ ID NO: 4190742 - RNA, 14 nt, Yersinia pestis KIM
aauaccgcuaacgu

SEQ ID NO: 4190743 - RNA, 12 nt, Yersinia pestis KIM
aauaccgcugcc

SEQ ID NO: 4190744 - RNA, 19 nt, Yersinia pestis KIM
aauaccgcugcuaccagca

SEQ ID NO: 4190745 - RNA, 21 nt, Yersinia pestis KIM
aauaccggauuguucagcaac

SEQ ID NO: 4190746 - RNA, 14 nt, Yersinia pestis KIM
aauaccgguggcau

SEQ ID NO: 4190747 - RNA, 19 nt, Yersinia pestis KIM
aauaccguguacccgaucu

SEQ ID NO: 4190748 - RNA, 23 nt, Yersinia pestis KIM
aauaccguuuucuuucaacugcu

SEQ ID NO: 4190749 - RNA, 18 nt, Yersinia pestis KIM
aauacgaccgucaccaaa

SEQ ID NO: 4190750 - RNA, 15 nt, Yersinia pestis KIM
aauacgauaaagaag

SEQ ID NO: 4190751 - RNA, 12 nt, Yersinia pestis KIM
aauacgcaggcg

SEQ ID NO: 4190752 - RNA, 21 nt, Yersinia pestis KIM
aauacgccauccgcaccugca

SEQ ID NO: 4190753 - RNA, 13 nt, Yersinia pestis KIM
aauacggcaccaa

SEQ ID NO: 4190754 - RNA, 22 nt, Yersinia pestis KIM
aauacggcacucaaauagauag

SEQ ID NO: 4190755 - RNA, 15 nt, Yersinia pestis KIM
aauacggccagucaa

SEQ ID NO: 4190756 - RNA, 23 nt, Yersinia pestis KIM
aauacggcguuugacaauaucaa

SEQ ID NO: 4190757 - RNA, 19 nt, Yersinia pestis KIM
aauacgguagcaauaccuu

SEQ ID NO: 4190758 - RNA, 18 nt, Yersinia pestis KIM
aauacguucaaaugauuc

SEQ ID NO: 4190759 - RNA, 13 nt, Yersinia pestis KIM
aauacucauuuuu

SEQ ID NO: 4190760 - RNA, 20 nt, Yersinia pestis KIM
aauacucuguuaccaauggu

SEQ ID NO: 4190761 - RNA, 17 nt, Yersinia pestis KIM
aauacugcacguuuaau

SEQ ID NO: 4190762 - RNA, 21 nt, Yersinia pestis KIM
aauacugcacguuuaauuuca

SEQ ID NO: 4190763 - RNA, 20 nt, Yersinia pestis KIM
aauacugcgguccuacccuu

SEQ ID NO: 4190764 - RNA, 15 nt, Yersinia pestis KIM
aauacugucaaaauc

SEQ ID NO: 4190765 - RNA, 20 nt, Yersinia pestis KIM
aauacuguugguaaauaacg

SEQ ID NO: 4190766 - RNA, 18 nt, Yersinia pestis KIM
aauacuuaacaaucagug

SEQ ID NO: 4190767 - RNA, 13 nt, Yersinia pestis KIM
aauacuucaggcc

SEQ ID NO: 4190768 - RNA, 12 nt, Yersinia pestis KIM
aauagaaaaaca

SEQ ID NO: 4190769 - RNA, 17 nt, Yersinia pestis KIM
aauagaaccggaauaaa

SEQ ID NO: 4190770 - RNA, 18 nt, Yersinia pestis KIM
aauagaaccggaauaaau

SEQ ID NO: 4190771 - RNA, 22 nt, Yersinia pestis KIM
aauagaagagaggcaaugauuu

SEQ ID NO: 4190772 - RNA, 15 nt, Yersinia pestis KIM
aauagaagguaauca

SEQ ID NO: 4190773 - RNA, 20 nt, Yersinia pestis KIM
aauagaagguuaaauuuaau

SEQ ID NO: 4190774 - RNA, 17 nt, Yersinia pestis KIM
aauagacgaauggccgc

SEQ ID NO: 4190775 - RNA, 18 nt, Yersinia pestis KIM
aauagagaauagauagca

SEQ ID NO: 4190776 - RNA, 12 nt, Yersinia pestis KIM
aauagagcacca

SEQ ID NO: 4190777 - RNA, 13 nt, Yersinia pestis KIM
aauagagcaccaa

SEQ ID NO: 4190778 - RNA, 22 nt, Yersinia pestis KIM
aauagagcaccaaaucuuccag

SEQ ID NO: 4190779 - RNA, 15 nt, Yersinia pestis KIM
aauagaggaaauaaa

SEQ ID NO: 4190780 - RNA, 16 nt, Yersinia pestis KIM
aauagaggaaauaaau

SEQ ID NO: 4190781 - RNA, 21 nt, Yersinia pestis KIM
aauagagugaaguaucaccac

SEQ ID NO: 4190782 - RNA, 11 nt, Yersinia pestis KIM
aauagauaaaa

SEQ ID NO: 4190783 - RNA, 16 nt, Yersinia pestis KIM
aauagauaaaaacauu

SEQ ID NO: 4190784 - RNA, 12 nt, Yersinia pestis KIM
aauagauaacaa

SEQ ID NO: 4190785 - RNA, 18 nt, Yersinia pestis KIM
aauagauagcaaucaaua

SEQ ID NO: 4190786 - RNA, 14 nt, Yersinia pestis KIM
aauagauaguacgu

SEQ ID NO: 4190787 - RNA, 14 nt, Yersinia pestis KIM
aauagauaguacuu

SEQ ID NO: 4190788 - RNA, 16 nt, Yersinia pestis KIM
aauagcaaaacugagg

SEQ ID NO: 4190789 - RNA, 13 nt, Yersinia pestis KIM
aauagcaaaccca

SEQ ID NO: 4190790 - RNA, 18 nt, Yersinia pestis KIM
aauagcaaacccaccuga

SEQ ID NO: 4190791 - RNA, 14 nt, Yersinia pestis KIM
aauagcaaccugga

SEQ ID NO: 4190792 - RNA, 13 nt, Yersinia pestis KIM
aauagcaagccaa

SEQ ID NO: 4190793 - RNA, 22 nt, Yersinia pestis KIM
aauagcaagccaaaacagccua

SEQ ID NO: 4190794 - RNA, 23 nt, Yersinia pestis KIM
aauagcaccauuaggcuuaggca

SEQ ID NO: 4190795 - RNA, 16 nt, Yersinia pestis KIM
aauagcaguggccauu

SEQ ID NO: 4190796 - RNA, 15 nt, Yersinia pestis KIM
aauagcauaaauauc

SEQ ID NO: 4190797 - RNA, 15 nt, Yersinia pestis KIM
aauagcaucuggcca

SEQ ID NO: 4190798 - RNA, 18 nt, Yersinia pestis KIM
aauagcccaaauaaccuc

SEQ ID NO: 4190799 - RNA, 18 nt, Yersinia pestis KIM
aauagcccgacacguggc

SEQ ID NO: 4190800 - RNA, 14 nt, Yersinia pestis KIM
aauagcccgcgaau

SEQ ID NO: 4190801 - RNA, 17 nt, Yersinia pestis KIM
aauagccuaggccagca

SEQ ID NO: 4190802 - RNA, 21 nt, Yersinia pestis KIM
aauagcggccauuaggcguga

SEQ ID NO: 4190803 - RNA, 16 nt, Yersinia pestis KIM
aauagcguuaacgaua

SEQ ID NO: 4190804 - RNA, 14 nt, Yersinia pestis KIM
aauagcuaauaauu

SEQ ID NO: 4190805 - RNA, 23 nt, Yersinia pestis KIM
aauagcuaucuugccuguugaua

SEQ ID NO: 4190806 - RNA, 19 nt, Yersinia pestis KIM
aauagcuggcggauaaaaa

SEQ ID NO: 4190807 - RNA, 17 nt, Yersinia pestis KIM
aauagcuguaaaauacc

SEQ ID NO: 4190808 - RNA, 13 nt, Yersinia pestis KIM
aauagcuuccauu

SEQ ID NO: 4190809 - RNA, 16 nt, Yersinia pestis KIM
aauaggauuuucauga

SEQ ID NO: 4190810 - RNA, 22 nt, Yersinia pestis KIM
aauaggcaggcccgcuucccua

SEQ ID NO: 4190811 - RNA, 14 nt, Yersinia pestis KIM
aauaggcgucagca

SEQ ID NO: 4190812 - RNA, 16 nt, Yersinia pestis KIM
aauaggcugaucaacg

SEQ ID NO: 4190813 - RNA, 19 nt, Yersinia pestis KIM
aauagggcgccccgauaaa

SEQ ID NO: 4190814 - RNA, 14 nt, Yersinia pestis KIM
aauaggucaguggu

SEQ ID NO: 4190815 - RNA, 15 nt, Yersinia pestis KIM
aauaggucagugguu

SEQ ID NO: 4190816 - RNA, 20 nt, Yersinia pestis KIM
aauagguuggcauuagcgaa

SEQ ID NO: 4190817 - RNA, 20 nt, Yersinia pestis KIM
aauaguaauuaauuaugaua

SEQ ID NO: 4190818 - RNA, 22 nt, Yersinia pestis KIM
aauaguaauuaauuaugauaaa

SEQ ID NO: 4190819 - RNA, 16 nt, Yersinia pestis KIM
aaucaucaucccaguc

SEQ ID NO: 4190820 - RNA, 17 nt, Yersinia pestis KIM
aaucaucgcucaucgcc

SEQ ID NO: 4190821 - RNA, 21 nt, Yersinia pestis KIM
aaucaucgcucaucgccaaag

SEQ ID NO: 4190822 - RNA, 18 nt, Yersinia pestis KIM
aaucaucuacaacaucau

SEQ ID NO: 4190823 - RNA, 17 nt, Yersinia pestis KIM
aaucaugcucugcuaau

SEQ ID NO: 4190824 - RNA, 23 nt, Yersinia pestis KIM
aaucaugcucugcuaauacgcua

SEQ ID NO: 4190825 - RNA, 20 nt, Yersinia pestis KIM
aaucauguaacacacagcag

SEQ ID NO: 4190826 - RNA, 18 nt, Yersinia pestis KIM
aaucauucugucaucaag

SEQ ID NO: 4190827 - RNA, 19 nt, Yersinia pestis KIM
aaucauucugucaucaaga

SEQ ID NO: 4190828 - RNA, 19 nt, Yersinia pestis KIM
aaucauugacguuacagau

SEQ ID NO: 4190829 - RNA, 19 nt, Yersinia pestis KIM
aaucauugagaucaguuca

SEQ ID NO: 4190830 - RNA, 15 nt, Yersinia pestis KIM
aaucauugcaaugcu

SEQ ID NO: 4190831 - RNA, 18 nt, Yersinia pestis KIM
aaucauuggcaacuuaag

SEQ ID NO: 4190832 - RNA, 17 nt, Yersinia pestis KIM
aaucauuuaauuuaucc

SEQ ID NO: 4190833 - RNA, 21 nt, Yersinia pestis KIM
aaucauuuguuucucaccgac

SEQ ID NO: 4190834 - RNA, 21 nt, Yersinia pestis KIM
aauccaaaugcccauuaguaa

SEQ ID NO: 4190835 - RNA, 18 nt, Yersinia pestis KIM
aauccaaccuauauagcc

SEQ ID NO: 4190836 - RNA, 22 nt, Yersinia pestis KIM
aauccaaccuauauagcccagc

SEQ ID NO: 4190837 - RNA, 18 nt, Yersinia pestis KIM
aauccacauaaaaagaaa

SEQ ID NO: 4190838 - RNA, 21 nt, Yersinia pestis KIM
aauccaccacugauaggucau

SEQ ID NO: 4190839 - RNA, 21 nt, Yersinia pestis KIM
aauccaccugacgaaaugccg

SEQ ID NO: 4190840 - RNA, 22 nt, Yersinia pestis KIM
aauccauagugauuauuuaaac

SEQ ID NO: 4190841 - RNA, 23 nt, Yersinia pestis KIM
aauccaugccagcccaucaccau

SEQ ID NO: 4190842 - RNA, 11 nt, Yersinia pestis KIM
aauccauucac

SEQ ID NO: 4190843 - RNA, 16 nt, Yersinia pestis KIM
aauccccggaccagcc

SEQ ID NO: 4190844 - RNA, 22 nt, Yersinia pestis KIM
aauccccggucacuuaaauaac

SEQ ID NO: 4190845 - RNA, 13 nt, Yersinia pestis KIM
aaucccgauaaaa

SEQ ID NO: 4190846 - RNA, 17 nt, Yersinia pestis KIM
aaucccguuccgcuucc

SEQ ID NO: 4190847 - RNA, 15 nt, Yersinia pestis KIM
aaucccucggcuuau

SEQ ID NO: 4190848 - RNA, 23 nt, Yersinia pestis KIM
aaucccugccagaaucagcccca

SEQ ID NO: 4190849 - RNA, 19 nt, Yersinia pestis KIM
aauccgcuaguuaacccua

SEQ ID NO: 4190850 - RNA, 15 nt, Yersinia pestis KIM
aauccggugcaacca

SEQ ID NO: 4190851 - RNA, 17 nt, Yersinia pestis KIM
aauccgguuagcaaaaa

SEQ ID NO: 4190852 - RNA, 18 nt, Yersinia pestis KIM
aauccguaugucacuggu

SEQ ID NO: 4190853 - RNA, 19 nt, Yersinia pestis KIM
aauccuacaauaucuuccc

SEQ ID NO: 4190854 - RNA, 17 nt, Yersinia pestis KIM
aauccugaauaauacug

SEQ ID NO: 4190855 - RNA, 14 nt, Yersinia pestis KIM
aauccuucuggcuu

SEQ ID NO: 4190856 - RNA, 15 nt, Yersinia pestis KIM
aauccuuguaagacc

SEQ ID NO: 4190857 - RNA, 12 nt, Yersinia pestis KIM
aaucgaaacacc

SEQ ID NO: 4190858 - RNA, 18 nt, Yersinia pestis KIM
aaucgaacccuucagcau

SEQ ID NO: 4190859 - RNA, 15 nt, Yersinia pestis KIM
aaucgagaagaauuu

SEQ ID NO: 4190860 - RNA, 15 nt, Yersinia pestis KIM
aaucgauacaguggc

SEQ ID NO: 4190861 - RNA, 21 nt, Yersinia pestis KIM
aaucgauggccgcccuccaau

SEQ ID NO: 4190862 - RNA, 15 nt, Yersinia pestis KIM
aaucgauuacuggcu

SEQ ID NO: 4190863 - RNA, 23 nt, Yersinia pestis KIM
aaucgccguuacccccuucacca

SEQ ID NO: 4190864 - RNA, 14 nt, Yersinia pestis KIM
aaucgcgcauuucu

SEQ ID NO: 4190865 - RNA, 19 nt, Yersinia pestis KIM
aaucgcucugcguuuuucc

SEQ ID NO: 4190866 - RNA, 20 nt, Yersinia pestis KIM
aaucgcucugcguuuuuccc

SEQ ID NO: 4190867 - RNA, 17 nt, Yersinia pestis KIM
aaucgcugccauaugca

SEQ ID NO: 4190868 - RNA, 13 nt, Yersinia pestis KIM
aaucgcuuucgga

SEQ ID NO: 4190869 - RNA, 19 nt, Yersinia pestis KIM
aaucggaaaccgcuguuuu

SEQ ID NO: 4190870 - RNA, 14 nt, Yersinia pestis KIM
aaucggauaaccgc

SEQ ID NO: 4190871 - RNA, 16 nt, Yersinia pestis KIM
aaucgggugauaaagg

SEQ ID NO: 4190872 - RNA, 18 nt, Yersinia pestis KIM
aaucgguagacacaaggg

SEQ ID NO: 4190873 - RNA, 13 nt, Yersinia pestis KIM
aaucgguggcuau

SEQ ID NO: 4190874 - RNA, 22 nt, Yersinia pestis KIM
aaucgguguuagaucggccaau

SEQ ID NO: 4190875 - RNA, 18 nt, Yersinia pestis KIM
aaucguauaacauaauaa

SEQ ID NO: 4190876 - RNA, 13 nt, Yersinia pestis KIM
aaucgucaacggu

SEQ ID NO: 4190877 - RNA, 15 nt, Yersinia pestis KIM
aaucuacuuuauuca

SEQ ID NO: 4190878 - RNA, 12 nt, Yersinia pestis KIM
aaucuagaacua

SEQ ID NO: 4190879 - RNA, 14 nt, Yersinia pestis KIM
aaucuagaacuauu

SEQ ID NO: 4190880 - RNA, 22 nt, Yersinia pestis KIM
aaucuagaggacggcggccuua

SEQ ID NO: 4190881 - RNA, 14 nt, Yersinia pestis KIM
aaucuauuaauauc

SEQ ID NO: 4190882 - RNA, 12 nt, Yersinia pestis KIM
aaucucaucaau

SEQ ID NO: 4190883 - RNA, 16 nt, Yersinia pestis KIM
aaucuccaucauggcu

SEQ ID NO: 4190884 - RNA, 16 nt, Yersinia pestis KIM
aaucuccuccggagag

SEQ ID NO: 4190885 - RNA, 16 nt, Yersinia pestis KIM
aaucucuccaugauau

SEQ ID NO: 4190886 - RNA, 18 nt, Yersinia pestis KIM
aaucucuccaugauauau

SEQ ID NO: 4190887 - RNA, 18 nt, Yersinia pestis KIM
aaucucugccugugauuu

SEQ ID NO: 4190888 - RNA, 21 nt, Yersinia pestis KIM
aaucugacgguuauuuucuga

SEQ ID NO: 4190889 - RNA, 12 nt, Yersinia pestis KIM
aaucugauacug

SEQ ID NO: 4190890 - RNA, 13 nt, Yersinia pestis KIM
aaucugauacuga

SEQ ID NO: 4190891 - RNA, 16 nt, Yersinia pestis KIM
aaucugauacugaacg

SEQ ID NO: 4190892 - RNA, 18 nt, Yersinia pestis KIM
aaucugaugaauuaaaga

SEQ ID NO: 4190893 - RNA, 22 nt, Yersinia pestis KIM
aaucugaugaauuaaagauuaa

SEQ ID NO: 4190894 - RNA, 16 nt, Yersinia pestis KIM
aaucugcacuguaauu

SEQ ID NO: 4190895 - RNA, 19 nt, Yersinia pestis KIM
aaucugcccagccugguuu

SEQ ID NO: 4190896 - RNA, 15 nt, Yersinia pestis KIM
aaucugcgcccuuau

SEQ ID NO: 4190897 - RNA, 19 nt, Yersinia pestis KIM
aaucugcggcauaaauucu

SEQ ID NO: 4190898 - RNA, 18 nt, Yersinia pestis KIM
aaucuguaagucauucuu

SEQ ID NO: 4190899 - RNA, 13 nt, Yersinia pestis KIM
aaucugucgcugu

SEQ ID NO: 4190900 - RNA, 14 nt, Yersinia pestis KIM
aaucugucgcugug

SEQ ID NO: 4190901 - RNA, 18 nt, Yersinia pestis KIM
aaucuguuccugauucca

SEQ ID NO: 4190902 - RNA, 16 nt, Yersinia pestis KIM
aaucuuaaauugaaga

SEQ ID NO: 4190903 - RNA, 14 nt, Yersinia pestis KIM
aaucuucaauggug

SEQ ID NO: 4190904 - RNA, 12 nt, Yersinia pestis KIM
aaucuuccagcg

SEQ ID NO: 4190905 - RNA, 19 nt, Yersinia pestis KIM
aaucuuccagcggcaaaua

SEQ ID NO: 4190906 - RNA, 11 nt, Yersinia pestis KIM
aaucuuccuuu

SEQ ID NO: 4190907 - RNA, 18 nt, Yersinia pestis KIM
aaucuugcagcgaucaca

SEQ ID NO: 4190908 - RNA, 14 nt, Yersinia pestis KIM
aaucuugguuaaua

SEQ ID NO: 4190909 - RNA, 22 nt, Yersinia pestis KIM
aaucuugugaugaaauuaaaau

SEQ ID NO: 4190910 - RNA, 22 nt, Yersinia pestis KIM
aaucuugugaugcauauuauaa

SEQ ID NO: 4190911 - RNA, 20 nt, Yersinia pestis KIM
aaucuuugccuauuucaggg

SEQ ID NO: 4190912 - RNA, 23 nt, Yersinia pestis KIM
aaugaaauugcgauuaggacaaa

SEQ ID NO: 4190913 - RNA, 20 nt, Yersinia pestis KIM
aaugaacacgacgccauaaa

SEQ ID NO: 4190914 - RNA, 17 nt, Yersinia pestis KIM
aaugaacggguuaauca

SEQ ID NO: 4190915 - RNA, 20 nt, Yersinia pestis KIM
aaugaacuguguuuauacca

SEQ ID NO: 4190916 - RNA, 15 nt, Yersinia pestis KIM
aaugaauucauugau

SEQ ID NO: 4190917 - RNA, 17 nt, Yersinia pestis KIM
aaugaauuuuuuuaacu

SEQ ID NO: 4190918 - RNA, 21 nt, Yersinia pestis KIM
aaugacagcaucaauaucgcc

SEQ ID NO: 4190919 - RNA, 14 nt, Yersinia pestis KIM
aaugacauauucaa

SEQ ID NO: 4190920 - RNA, 16 nt, Yersinia pestis KIM
aaugacauugcgaaua

SEQ ID NO: 4190921 - RNA, 18 nt, Yersinia pestis KIM
aaugaccaagguuauaca

SEQ ID NO: 4190922 - RNA, 22 nt, Yersinia pestis KIM
aaugaccacgcaucaauaauaa

SEQ ID NO: 4190923 - RNA, 17 nt, Yersinia pestis KIM
aaugacgaucacugcuu

SEQ ID NO: 4190924 - RNA, 20 nt, Yersinia pestis KIM
aaugacuaauugugcagcau

SEQ ID NO: 4190925 - RNA, 17 nt, Yersinia pestis KIM
aaugacuacuaaucaau

SEQ ID NO: 4190926 - RNA, 16 nt, Yersinia pestis KIM
aaugagaauaucuaua

SEQ ID NO: 4190927 - RNA, 14 nt, Yersinia pestis KIM
aaugagauugauca

SEQ ID NO: 4190928 - RNA, 13 nt, Yersinia pestis KIM
aaugagccugaau

SEQ ID NO: 4190929 - RNA, 15 nt, Yersinia pestis KIM
aaugagccugaauaa

SEQ ID NO: 4190930 - RNA, 20 nt, Yersinia pestis KIM
aaugagggaugaaaagagcu

SEQ ID NO: 4190931 - RNA, 17 nt, Yersinia pestis KIM
aaugaggguaagugaau

SEQ ID NO: 4190932 - RNA, 20 nt, Yersinia pestis KIM
aaugagguuuacauuuaaac

SEQ ID NO: 4190933 - RNA, 17 nt, Yersinia pestis KIM
aaugaguguuuuucuca

SEQ ID NO: 4190934 - RNA, 15 nt, Yersinia pestis KIM
aauuacaaaaucuca

SEQ ID NO: 4190935 - RNA, 18 nt, Yersinia pestis KIM
aauuacggcucaguugau

SEQ ID NO: 4190936 - RNA, 15 nt, Yersinia pestis KIM
aauuacgugcccaaa

SEQ ID NO: 4190937 - RNA, 23 nt, Yersinia pestis KIM
aauuacgugcccaaaaacgcugg

SEQ ID NO: 4190938 - RNA, 16 nt, Yersinia pestis KIM
aauuagcacauaugca

SEQ ID NO: 4190939 - RNA, 22 nt, Yersinia pestis KIM
aauuagccaagcaaccuuguuu

SEQ ID NO: 4190940 - RNA, 14 nt, Yersinia pestis KIM
aauuagcgaaauau

SEQ ID NO: 4190941 - RNA, 23 nt, Yersinia pestis KIM
aauuagcggcaacgaucagaacg

SEQ ID NO: 4190942 - RNA, 24 nt, Yersinia pestis KIM
aauuagggguugcaggcugucagg

SEQ ID NO: 4190943 - RNA, 17 nt, Yersinia pestis KIM
aauuagguaacuuucca

SEQ ID NO: 4190944 - RNA, 21 nt, Yersinia pestis KIM
aauuaguugcccgaauaauug

SEQ ID NO: 4190945 - RNA, 20 nt, Yersinia pestis KIM
aauuaguuuuaauaaccauu

SEQ ID NO: 4190946 - RNA, 21 nt, Yersinia pestis KIM
aauuaguuuuaauaaccauua

SEQ ID NO: 4190947 - RNA, 19 nt, Yersinia pestis KIM
aauuauagccaaaucugga

SEQ ID NO: 4190948 - RNA, 22 nt, Yersinia pestis KIM
aauuauagccaaaucuggauaa

SEQ ID NO: 4190949 - RNA, 15 nt, Yersinia pestis KIM
aauuauauaagagau

SEQ ID NO: 4190950 - RNA, 15 nt, Yersinia pestis KIM
aauuaucaucaauag

SEQ ID NO: 4190951 - RNA, 13 nt, Yersinia pestis KIM
aauuauccguaaa

SEQ ID NO: 4190952 - RNA, 22 nt, Yersinia pestis KIM
aauuaucgaucacaugcucagu

SEQ ID NO: 4190953 - RNA, 18 nt, Yersinia pestis KIM
aauuaucgccuaccauca

SEQ ID NO: 4190954 - RNA, 22 nt, Yersinia pestis KIM
aauuaucuaauaaugagccaua

SEQ ID NO: 4190955 - RNA, 19 nt, Yersinia pestis KIM
aauuaucugaauagcgcug

SEQ ID NO: 4190956 - RNA, 19 nt, Yersinia pestis KIM
aauuaucuuauccacagca

SEQ ID NO: 4190957 - RNA, 20 nt, Yersinia pestis KIM
aauuaucuuauccacagcau

SEQ ID NO: 4190958 - RNA, 19 nt, Yersinia pestis KIM
aauuaugacguucaguagu

SEQ ID NO: 4190959 - RNA, 17 nt, Yersinia pestis KIM
aauuauggcuauacuua

SEQ ID NO: 4190960 - RNA, 13 nt, Yersinia pestis KIM
aauuauuaaauaa

SEQ ID NO: 4190961 - RNA, 13 nt, Yersinia pestis KIM
aauuauuguggcu

SEQ ID NO: 4190962 - RNA, 14 nt, Yersinia pestis KIM
aauuauuucaguag

SEQ ID NO: 4190963 - RNA, 12 nt, Yersinia pestis KIM
aauuauuucucu

SEQ ID NO: 4190964 - RNA, 20 nt, Yersinia pestis KIM
aauuauuuuccagaugaaua

SEQ ID NO: 4190965 - RNA, 23 nt, Yersinia pestis KIM
aauucaaaauguauuauuuugua

SEQ ID NO: 4190966 - RNA, 18 nt, Yersinia pestis KIM
aauucaauccauugaucu

SEQ ID NO: 4190967 - RNA, 22 nt, Yersinia pestis KIM
aauucacgucgccgguggcuga

SEQ ID NO: 4190968 - RNA, 15 nt, Yersinia pestis KIM
aauucagauguuaac

SEQ ID NO: 4190969 - RNA, 20 nt, Yersinia pestis KIM
aauucagguugaucaguaaa

SEQ ID NO: 4190970 - RNA, 18 nt, Yersinia pestis KIM
aauucauaccgcagauaa

SEQ ID NO: 4190971 - RNA, 15 nt, Yersinia pestis KIM
aauucauaugacaaa

SEQ ID NO: 4190972 - RNA, 19 nt, Yersinia pestis KIM
aauucauaugacaaauaag

SEQ ID NO: 4190973 - RNA, 15 nt, Yersinia pestis KIM
aauucaucagcgcug

SEQ ID NO: 4190974 - RNA, 18 nt, Yersinia pestis KIM
aauucaucagcgcuggcu

SEQ ID NO: 4190975 - RNA, 16 nt, Yersinia pestis KIM
aauucaucuuuaacaa

SEQ ID NO: 4190976 - RNA, 19 nt, Yersinia pestis KIM
aauucaucuuuaacaacaa

SEQ ID NO: 4190977 - RNA, 19 nt, Yersinia pestis KIM
aauucaugugagauaacac

SEQ ID NO: 4190978 - RNA, 15 nt, Yersinia pestis KIM
aauucauguugccaa

SEQ ID NO: 4190979 - RNA, 22 nt, Yersinia pestis KIM
aauucauguugccaaugggcca

SEQ ID NO: 4190980 - RNA, 13 nt, Yersinia pestis KIM
aauucauuauuac

SEQ ID NO: 4190981 - RNA, 16 nt, Yersinia pestis KIM
aauucauuauuacuca

SEQ ID NO: 4190982 - RNA, 23 nt, Yersinia pestis KIM
aauuccacauaaaauagcccagu

SEQ ID NO: 4190983 - RNA, 23 nt, Yersinia pestis KIM
aauuccacgcugaaacuuuucag

SEQ ID NO: 4190984 - RNA, 18 nt, Yersinia pestis KIM
aauuccauaauaagugaa

SEQ ID NO: 4190985 - RNA, 19 nt, Yersinia pestis KIM
aauuccauaauaagugaac

SEQ ID NO: 4190986 - RNA, 12 nt, Yersinia pestis KIM
aauuccauaucg

SEQ ID NO: 4190987 - RNA, 22 nt, Yersinia pestis KIM
aauuccaugcaaaauaugguag

SEQ ID NO: 4190988 - RNA, 21 nt, Yersinia pestis KIM
aauuccccagcccaacaacuu

SEQ ID NO: 4190989 - RNA, 16 nt, Yersinia pestis KIM
aauucccgcgccguga

SEQ ID NO: 4190990 - RNA, 23 nt, Yersinia pestis KIM
aauucccgcgccgugagaaaaaa

SEQ ID NO: 4190991 - RNA, 16 nt, Yersinia pestis KIM
aauuccgcccugaaua

SEQ ID NO: 4190992 - RNA, 19 nt, Yersinia pestis KIM
aauuccgcccugaauaucg

SEQ ID NO: 4190993 - RNA, 19 nt, Yersinia pestis KIM
aauucgauaaaaggcuauu

SEQ ID NO: 4190994 - RNA, 23 nt, Yersinia pestis KIM
aauucgccggggacuacacuacc

SEQ ID NO: 4190995 - RNA, 22 nt, Yersinia pestis KIM
aauucgcuucgcuccggucaac

SEQ ID NO: 4190996 - RNA, 15 nt, Yersinia pestis KIM
aauucgggcugagua

SEQ ID NO: 4190997 - RNA, 23 nt, Yersinia pestis KIM
aauucgggcugaguaaagcccag

SEQ ID NO: 4190998 - RNA, 19 nt, Yersinia pestis KIM
aauucuaccuggcucaaau

SEQ ID NO: 4190999 - RNA, 18 nt, Yersinia pestis KIM
aauucuauccggauuaaa

SEQ ID NO: 4191000 - RNA, 20 nt, Yersinia pestis KIM
aauucuauccggauuaaauu

SEQ ID NO: 4191001 - RNA, 15 nt, Yersinia pestis KIM
aauucuaucugguuu

SEQ ID NO: 4191002 - RNA, 18 nt, Yersinia pestis KIM
aauucuccuuucuuuucg

SEQ ID NO: 4191003 - RNA, 18 nt, Yersinia pestis KIM
aauucugccgacuaauau

SEQ ID NO: 4191004 - RNA, 20 nt, Yersinia pestis KIM
aauucuggguacaacacaaa

SEQ ID NO: 4191005 - RNA, 21 nt, Yersinia pestis KIM
aauucuggguacaacacaaaa

SEQ ID NO: 4191006 - RNA, 15 nt, Yersinia pestis KIM
aauucuguagaguaa

SEQ ID NO: 4191007 - RNA, 17 nt, Yersinia pestis KIM
aauucuguagaguaaaa

SEQ ID NO: 4191008 - RNA, 17 nt, Yersinia pestis KIM
aauucuuaggauaacca

SEQ ID NO: 4191009 - RNA, 21 nt, Yersinia pestis KIM
aauucuuucaacgcauccaaa

SEQ ID NO: 4191010 - RNA, 22 nt, Yersinia pestis KIM
aauugaagaguugauccgauaa

SEQ ID NO: 4191011 - RNA, 17 nt, Yersinia pestis KIM
aauugaagcagauaaag

SEQ ID NO: 4191012 - RNA, 16 nt, Yersinia pestis KIM
aauugaccagcgaauc

SEQ ID NO: 4191013 - RNA, 21 nt, Yersinia pestis KIM
aauugacgccacuuaucccaa

SEQ ID NO: 4191014 - RNA, 15 nt, Yersinia pestis KIM
aauugacuguauaua

SEQ ID NO: 4191015 - RNA, 15 nt, Yersinia pestis KIM
aauugacuuuaaaaa

SEQ ID NO: 4191016 - RNA, 23 nt, Yersinia pestis KIM
aauugacuuuaaaaaaauuauca

SEQ ID NO: 4191017 - RNA, 14 nt, Yersinia pestis KIM
aauugacuuugcca

SEQ ID NO: 4191018 - RNA, 18 nt, Yersinia pestis KIM
aauugacuuuuuuaucgc

SEQ ID NO: 4191019 - RNA, 20 nt, Yersinia pestis KIM
aauugagucgcucuuugauu

SEQ ID NO: 4191020 - RNA, 15 nt, Yersinia pestis KIM
aauugauauuauuua

SEQ ID NO: 4191021 - RNA, 17 nt, Yersinia pestis KIM
aauugauauuauuuaua

SEQ ID NO: 4191022 - RNA, 20 nt, Yersinia pestis KIM
aauugauauuauuuauauga

SEQ ID NO: 4191023 - RNA, 21 nt, Yersinia pestis KIM
aauugauauuauuuauaugau

SEQ ID NO: 4191024 - RNA, 23 nt, Yersinia pestis KIM
aauugauauuauuuauaugauaa

SEQ ID NO: 4191025 - RNA, 22 nt, Yersinia pestis KIM
aauugaugcacaguaggcugaa

SEQ ID NO: 4191026 - RNA, 23 nt, Yersinia pestis KIM
aauugcagguggguuuauugauu

SEQ ID NO: 4191027 - RNA, 17 nt, Yersinia pestis KIM
aauugccgcgucuguua

SEQ ID NO: 4191028 - RNA, 17 nt, Yersinia pestis KIM
aauugccugauuuuuau

SEQ ID NO: 4191029 - RNA, 23 nt, Yersinia pestis KIM
aauugcgauuaggacaaauagau

SEQ ID NO: 4191030 - RNA, 15 nt, Yersinia pestis KIM
aauugcucacucacc

SEQ ID NO: 4191031 - RNA, 13 nt, Yersinia pestis KIM
aauugcugaaaaa

SEQ ID NO: 4191032 - RNA, 20 nt, Yersinia pestis KIM
aauugcuguuggaucucucc

SEQ ID NO: 4191033 - RNA, 17 nt, Yersinia pestis KIM
aauuggaagagccugaa

SEQ ID NO: 4191034 - RNA, 15 nt, Yersinia pestis KIM
aauuggaaugaaaua

SEQ ID NO: 4191035 - RNA, 15 nt, Yersinia pestis KIM
aauuggcagcggcaa

SEQ ID NO: 4191036 - RNA, 20 nt, Yersinia pestis KIM
aauuggcagcggcaaauaga

SEQ ID NO: 4191037 - RNA, 21 nt, Yersinia pestis KIM
aauuggcucuggaaaucacgu

SEQ ID NO: 4191038 - RNA, 20 nt, Yersinia pestis KIM
aauuggcuuaacucgccacu

SEQ ID NO: 4191039 - RNA, 17 nt, Yersinia pestis KIM
aauugggggucagggcg

SEQ ID NO: 4191040 - RNA, 23 nt, Yersinia pestis KIM
aauugguuagcgccuuuuuuaua

SEQ ID NO: 4191041 - RNA, 21 nt, Yersinia pestis KIM
aauugguuuuaauaaccauug

SEQ ID NO: 4191042 - RNA, 20 nt, Yersinia pestis KIM
aauuguuauuauuaaauuuu

SEQ ID NO: 4191043 - RNA, 14 nt, Yersinia pestis KIM
aauuguuugcuauc

SEQ ID NO: 4191044 - RNA, 14 nt, Yersinia pestis KIM
aauuuaacuuucau

SEQ ID NO: 4191045 - RNA, 18 nt, Yersinia pestis KIM
aauuuaacuuucaucccu

SEQ ID NO: 4191046 - RNA, 14 nt, Yersinia pestis KIM
aauuuaagaaaucu

SEQ ID NO: 4191047 - RNA, 15 nt, Yersinia pestis KIM
acaagugccaaaugg

SEQ ID NO: 4191048 - RNA, 17 nt, Yersinia pestis KIM
acaaguuacauuuuuaa

SEQ ID NO: 4191049 - RNA, 18 nt, Yersinia pestis KIM
acaaguuacauuuuuaac

SEQ ID NO: 4191050 - RNA, 15 nt, Yersinia pestis KIM
acaauaaauauccuc

SEQ ID NO: 4191051 - RNA, 13 nt, Yersinia pestis KIM
acaauaaaucaau

SEQ ID NO: 4191052 - RNA, 16 nt, Yersinia pestis KIM
acaauaaguugaacag

SEQ ID NO: 4191053 - RNA, 21 nt, Yersinia pestis KIM
acaauaaguugaacagugguu

SEQ ID NO: 4191054 - RNA, 17 nt, Yersinia pestis KIM
acaauaauuaggaauau

SEQ ID NO: 4191055 - RNA, 16 nt, Yersinia pestis KIM
acaauaccgccacaca

SEQ ID NO: 4191056 - RNA, 17 nt, Yersinia pestis KIM
acaauagucucuugggc

SEQ ID NO: 4191057 - RNA, 14 nt, Yersinia pestis KIM
acaauauaauaacu

SEQ ID NO: 4191058 - RNA, 17 nt, Yersinia pestis KIM
acaauauggguauuagg

SEQ ID NO: 4191059 - RNA, 21 nt, Yersinia pestis KIM
acaauauguuuagucuguuac

SEQ ID NO: 4191060 - RNA, 18 nt, Yersinia pestis KIM
acaauauucgcagccaaa

SEQ ID NO: 4191061 - RNA, 22 nt, Yersinia pestis KIM
acaaucagugcaauaaauucaa

SEQ ID NO: 4191062 - RNA, 19 nt, Yersinia pestis KIM
acaaucauuuaacggccag

SEQ ID NO: 4191063 - RNA, 11 nt, Yersinia pestis KIM
acaauccggug

SEQ ID NO: 4191064 - RNA, 19 nt, Yersinia pestis KIM
acaaucucuggcaacggca

SEQ ID NO: 4191065 - RNA, 23 nt, Yersinia pestis KIM
acaaucucuggcaacggcacauc

SEQ ID NO: 4191066 - RNA, 14 nt, Yersinia pestis KIM
acaaucuucuucag

SEQ ID NO: 4191067 - RNA, 14 nt, Yersinia pestis KIM
acaaugacuuaacu

SEQ ID NO: 4191068 - RNA, 23 nt, Yersinia pestis KIM
acaaugacuuaacugaaagccaa

SEQ ID NO: 4191069 - RNA, 15 nt, Yersinia pestis KIM
acaaugccuaaaaug

SEQ ID NO: 4191070 - RNA, 14 nt, Yersinia pestis KIM
acaaugcuguuuug

SEQ ID NO: 4191071 - RNA, 17 nt, Yersinia pestis KIM
acaaugguucaucauuu

SEQ ID NO: 4191072 - RNA, 18 nt, Yersinia pestis KIM
acaaugguugaaugacca

SEQ ID NO: 4191073 - RNA, 22 nt, Yersinia pestis KIM
acaaugguugaaugaccaaggu

SEQ ID NO: 4191074 - RNA, 18 nt, Yersinia pestis KIM
acaauuacgcacugccug

SEQ ID NO: 4191075 - RNA, 15 nt, Yersinia pestis KIM
acaauuauagccaaa

SEQ ID NO: 4191076 - RNA, 14 nt, Yersinia pestis KIM
acaauuauuuuuac

SEQ ID NO: 4191077 - RNA, 13 nt, Yersinia pestis KIM
acaauucacccau

SEQ ID NO: 4191078 - RNA, 20 nt, Yersinia pestis KIM
acaauucccguuagguucaa

SEQ ID NO: 4191079 - RNA, 17 nt, Yersinia pestis KIM
acaauucuugaaauuau

SEQ ID NO: 4191080 - RNA, 19 nt, Yersinia pestis KIM
acaauugccugauuuuuau

SEQ ID NO: 4191081 - RNA, 17 nt, Yersinia pestis KIM
acaauugcuccaguuga

SEQ ID NO: 4191082 - RNA, 14 nt, Yersinia pestis KIM
acaauuucgcuggu

SEQ ID NO: 4191083 - RNA, 21 nt, Yersinia pestis KIM
acaauuugguuucuauuucua

SEQ ID NO: 4191084 - RNA, 17 nt, Yersinia pestis KIM
acacaaaauagaaaaca

SEQ ID NO: 4191085 - RNA, 20 nt, Yersinia pestis KIM
acacaaaauagaaaacagca

SEQ ID NO: 4191086 - RNA, 15 nt, Yersinia pestis KIM
acacaauacauagaa

SEQ ID NO: 4191087 - RNA, 22 nt, Yersinia pestis KIM
acacaauucccguuagguucaa

SEQ ID NO: 4191088 - RNA, 15 nt, Yersinia pestis KIM
acacacagcaauaca

SEQ ID NO: 4191089 - RNA, 18 nt, Yersinia pestis KIM
acacacagcaauacaugu

SEQ ID NO: 4191090 - RNA, 19 nt, Yersinia pestis KIM
acacacagccuacgggguc

SEQ ID NO: 4191091 - RNA, 21 nt, Yersinia pestis KIM
acacaccagucugcauacaga

SEQ ID NO: 4191092 - RNA, 13 nt, Yersinia pestis KIM
acacaccugcaac

SEQ ID NO: 4191093 - RNA, 19 nt, Yersinia pestis KIM
acacagacuggugaacgaa

SEQ ID NO: 4191094 - RNA, 20 nt, Yersinia pestis KIM
acacagcacggcaacaggcu

SEQ ID NO: 4191095 - RNA, 12 nt, Yersinia pestis KIM
acacagcccugc

SEQ ID NO: 4191096 - RNA, 24 nt, Yersinia pestis KIM
acacagcccugccuggcaggaagc

SEQ ID NO: 4191097 - RNA, 20 nt, Yersinia pestis KIM
acacagcgaagcguaaauuu

SEQ ID NO: 4191098 - RNA, 15 nt, Yersinia pestis KIM
acacagcguagacaa

SEQ ID NO: 4191099 - RNA, 14 nt, Yersinia pestis KIM
acacagguucccau

SEQ ID NO: 4191100 - RNA, 22 nt, Yersinia pestis KIM
acacagguucccaucccuuuga

SEQ ID NO: 4191101 - RNA, 14 nt, Yersinia pestis KIM
acacaguauucugc

SEQ ID NO: 4191102 - RNA, 14 nt, Yersinia pestis KIM
acacagucuuuuuc

SEQ ID NO: 4191103 - RNA, 15 nt, Yersinia pestis KIM
acacauaaaaucagc

SEQ ID NO: 4191104 - RNA, 15 nt, Yersinia pestis KIM
acacauaaccaucaa

SEQ ID NO: 4191105 - RNA, 21 nt, Yersinia pestis KIM
acacauaccuucgguaaucaa

SEQ ID NO: 4191106 - RNA, 15 nt, Yersinia pestis KIM
acacauauauuaucu

SEQ ID NO: 4191107 - RNA, 13 nt, Yersinia pestis KIM
acacauauuucau

SEQ ID NO: 4191108 - RNA, 17 nt, Yersinia pestis KIM
acacaucgaagcugucu

SEQ ID NO: 4191109 - RNA, 13 nt, Yersinia pestis KIM
acacaugaaaauc

SEQ ID NO: 4191110 - RNA, 16 nt, Yersinia pestis KIM
acacaugaaaaucaag

SEQ ID NO: 4191111 - RNA, 14 nt, Yersinia pestis KIM
acacauuaauuuau

SEQ ID NO: 4191112 - RNA, 17 nt, Yersinia pestis KIM
acacauucccauuauua

SEQ ID NO: 4191113 - RNA, 15 nt, Yersinia pestis KIM
acaccaaaacucccu

SEQ ID NO: 4191114 - RNA, 23 nt, Yersinia pestis KIM
acaccaaaaguaucuuucacccu

SEQ ID NO: 4191115 - RNA, 18 nt, Yersinia pestis KIM
acaccaacaccacacuga

SEQ ID NO: 4191116 - RNA, 13 nt, Yersinia pestis KIM
acaccaacacuga

SEQ ID NO: 4191117 - RNA, 13 nt, Yersinia pestis KIM
acaccaacuggcg

SEQ ID NO: 4191118 - RNA, 12 nt, Yersinia pestis KIM
acaccacaacau

SEQ ID NO: 4191119 - RNA, 20 nt, Yersinia pestis KIM
acaccacaucacgcagcgcu

SEQ ID NO: 4191120 - RNA, 21 nt, Yersinia pestis KIM
acaccaccgccgcaacaauaa

SEQ ID NO: 4191121 - RNA, 15 nt, Yersinia pestis KIM
acaccauagccacgc

SEQ ID NO: 4191122 - RNA, 18 nt, Yersinia pestis KIM
acaccauagcgguuuauu

SEQ ID NO: 4191123 - RNA, 12 nt, Yersinia pestis KIM
acaccaucagua

SEQ ID NO: 4191124 - RNA, 19 nt, Yersinia pestis KIM
acaccauuuggacugaaua

SEQ ID NO: 4191125 - RNA, 12 nt, Yersinia pestis KIM
acacccaagaau

SEQ ID NO: 4191126 - RNA, 18 nt, Yersinia pestis KIM
acacccaauaauaaaaaa

SEQ ID NO: 4191127 - RNA, 12 nt, Yersinia pestis KIM
acacccagccag

SEQ ID NO: 4191128 - RNA, 22 nt, Yersinia pestis KIM
acacccgaccagacaacaguca

SEQ ID NO: 4191129 - RNA, 22 nt, Yersinia pestis KIM
acacccguuccuucagccacca

SEQ ID NO: 4191130 - RNA, 20 nt, Yersinia pestis KIM
acacccucaacucaaaacaa

SEQ ID NO: 4191131 - RNA, 23 nt, Yersinia pestis KIM
acacccucucuuuccagcaaaag

SEQ ID NO: 4191132 - RNA, 22 nt, Yersinia pestis KIM
acacccuuucguguugcuggau

SEQ ID NO: 4191133 - RNA, 13 nt, Yersinia pestis KIM
acaccgccagcaa

SEQ ID NO: 4191134 - RNA, 22 nt, Yersinia pestis KIM
acaccgccuaucgugaacaggc

SEQ ID NO: 4191135 - RNA, 20 nt, Yersinia pestis KIM
acaccgcuacaggcgcaacu

SEQ ID NO: 4191136 - RNA, 17 nt, Yersinia pestis KIM
acaccgcuguagcguca

SEQ ID NO: 4191137 - RNA, 15 nt, Yersinia pestis KIM
acaccggccaaaauc

SEQ ID NO: 4191138 - RNA, 15 nt, Yersinia pestis KIM
acaccggcugcaaua

SEQ ID NO: 4191139 - RNA, 17 nt, Yersinia pestis KIM
acaccggggauccauag

SEQ ID NO: 4191140 - RNA, 23 nt, Yersinia pestis KIM
acaccggguaagguaaagaaaua

SEQ ID NO: 4191141 - RNA, 15 nt, Yersinia pestis KIM
acaccguuguuggcg

SEQ ID NO: 4191142 - RNA, 13 nt, Yersinia pestis KIM
acaccuuaaaaca

SEQ ID NO: 4191143 - RNA, 14 nt, Yersinia pestis KIM
acaccuuaaaacag

SEQ ID NO: 4191144 - RNA, 15 nt, Yersinia pestis KIM
acaccuuaaaacagc

SEQ ID NO: 4191145 - RNA, 21 nt, Yersinia pestis KIM
acaccuucgagagcuaaugcu

SEQ ID NO: 4191146 - RNA, 17 nt, Yersinia pestis KIM
acaccuugcagcacacc

SEQ ID NO: 4191147 - RNA, 14 nt, Yersinia pestis KIM
acacgaaaagcagc

SEQ ID NO: 4191148 - RNA, 16 nt, Yersinia pestis KIM
acacgaaaagcagcag

SEQ ID NO: 4191149 - RNA, 20 nt, Yersinia pestis KIM
acacgacauguguaguaugc

SEQ ID NO: 4191150 - RNA, 21 nt, Yersinia pestis KIM
acacgccguuuugagauuaau

SEQ ID NO: 4191151 - RNA, 17 nt, Yersinia pestis KIM
acacggcggugcuuuuu

SEQ ID NO: 4191152 - RNA, 17 nt, Yersinia pestis KIM
acacgguaggcuucugc

SEQ ID NO: 4191153 - RNA, 20 nt, Yersinia pestis KIM
acacggucuggcaacgcugu

SEQ ID NO: 4191154 - RNA, 14 nt, Yersinia pestis KIM
acacgguugaaaag

SEQ ID NO: 4191155 - RNA, 19 nt, Yersinia pestis KIM
acacguaucgaugcccgca

SEQ ID NO: 4191156 - RNA, 22 nt, Yersinia pestis KIM
acacgugagaauugcugcuugc

SEQ ID NO: 4191157 - RNA, 18 nt, Yersinia pestis KIM
acacguggguauccagug

SEQ ID NO: 4191158 - RNA, 14 nt, Yersinia pestis KIM
acacguugaccgac

SEQ ID NO: 4191159 - RNA, 17 nt, Yersinia pestis KIM
acacuacagccggauag

SEQ ID NO: 4191160 - RNA, 19 nt, Yersinia pestis KIM
acacuaccuucaucugcac

SEQ ID NO: 4191161 - RNA, 22 nt, Yersinia pestis KIM
acacucagaugaaaaacugugc

SEQ ID NO: 4191162 - RNA, 17 nt, Yersinia pestis KIM
acagugccaaaagaccg

SEQ ID NO: 4191163 - RNA, 16 nt, Yersinia pestis KIM
acagugccaacagcga

SEQ ID NO: 4191164 - RNA, 12 nt, Yersinia pestis KIM
acaguguugacc

SEQ ID NO: 4191165 - RNA, 20 nt, Yersinia pestis KIM
acaguuaaacaacgcugaaa

SEQ ID NO: 4191166 - RNA, 15 nt, Yersinia pestis KIM
acaguuaauuuucac

SEQ ID NO: 4191167 - RNA, 14 nt, Yersinia pestis KIM
acaguuauuaggca

SEQ ID NO: 4191168 - RNA, 20 nt, Yersinia pestis KIM
acaguuccuguuuuugaaua

SEQ ID NO: 4191169 - RNA, 16 nt, Yersinia pestis KIM
acaguugauauuauua

SEQ ID NO: 4191170 - RNA, 17 nt, Yersinia pestis KIM
acaguugauauuauuau

SEQ ID NO: 4191171 - RNA, 18 nt, Yersinia pestis KIM
acaguugugucagaccaa

SEQ ID NO: 4191172 - RNA, 22 nt, Yersinia pestis KIM
acaguuuaucucgcugugcccu

SEQ ID NO: 4191173 - RNA, 13 nt, Yersinia pestis KIM
acauaaacacgca

SEQ ID NO: 4191174 - RNA, 15 nt, Yersinia pestis KIM
acauaaauaaguuca

SEQ ID NO: 4191175 - RNA, 19 nt, Yersinia pestis KIM
acauaaauaaguucagguu

SEQ ID NO: 4191176 - RNA, 13 nt, Yersinia pestis KIM
acauaaccaucaa

SEQ ID NO: 4191177 - RNA, 16 nt, Yersinia pestis KIM
acauaaccaucaaaca

SEQ ID NO: 4191178 - RNA, 21 nt, Yersinia pestis KIM
acauaacguuauaacucaagc

SEQ ID NO: 4191179 - RNA, 13 nt, Yersinia pestis KIM
acauaagaugacc

SEQ ID NO: 4191180 - RNA, 17 nt, Yersinia pestis KIM
acauaaguaagugauuc

SEQ ID NO: 4191181 - RNA, 16 nt, Yersinia pestis KIM
acauaauaaauuaaua

SEQ ID NO: 4191182 - RNA, 21 nt, Yersinia pestis KIM
acauaaucuuuacugcauuga

SEQ ID NO: 4191183 - RNA, 19 nt, Yersinia pestis KIM
acauacccgucauaccguu

SEQ ID NO: 4191184 - RNA, 20 nt, Yersinia pestis KIM
acauaccuucgguaaucaau

SEQ ID NO: 4191185 - RNA, 21 nt, Yersinia pestis KIM
acauaccuucgguaaucaauu

SEQ ID NO: 4191186 - RNA, 17 nt, Yersinia pestis KIM
acauacucaccucccug

SEQ ID NO: 4191187 - RNA, 20 nt, Yersinia pestis KIM
acauagaagcucauaugcag

SEQ ID NO: 4191188 - RNA, 22 nt, Yersinia pestis KIM
acauagcccggcucauccgcca

SEQ ID NO: 4191189 - RNA, 14 nt, Yersinia pestis KIM
acauagguuuuuuc

SEQ ID NO: 4191190 - RNA, 17 nt, Yersinia pestis KIM
acauaguugaauaacuu

SEQ ID NO: 4191191 - RNA, 15 nt, Yersinia pestis KIM
acauauaaaccagcc

SEQ ID NO: 4191192 - RNA, 19 nt, Yersinia pestis KIM
acauauaaaccagccagug

SEQ ID NO: 4191193 - RNA, 21 nt, Yersinia pestis KIM
acauauaaaccagccagugau

SEQ ID NO: 4191194 - RNA, 16 nt, Yersinia pestis KIM
acauauaaccaucaaa

SEQ ID NO: 4191195 - RNA, 17 nt, Yersinia pestis KIM
acauaucaaacagcugu

SEQ ID NO: 4191196 - RNA, 19 nt, Yersinia pestis KIM
acauaucaacacugccuga

SEQ ID NO: 4191197 - RNA, 18 nt, Yersinia pestis KIM
acauauccugugccaaca

SEQ ID NO: 4191198 - RNA, 19 nt, Yersinia pestis KIM
acauauccugugccaacau

SEQ ID NO: 4191199 - RNA, 20 nt, Yersinia pestis KIM
acauauccugugccaacauc

SEQ ID NO: 4191200 - RNA, 19 nt, Yersinia pestis KIM
acauaucuuuauuaucaau

SEQ ID NO: 4191201 - RNA, 10 nt, Yersinia pestis KIM
acauauguug

SEQ ID NO: 4191202 - RNA, 14 nt, Yersinia pestis KIM
acauauucacuaua

SEQ ID NO: 4191203 - RNA, 15 nt, Yersinia pestis KIM
acauauugguaauuu

SEQ ID NO: 4191204 - RNA, 16 nt, Yersinia pestis KIM
acaucaaaccggcuaa

SEQ ID NO: 4191205 - RNA, 16 nt, Yersinia pestis KIM
acaucaaucaccccag

SEQ ID NO: 4191206 - RNA, 15 nt, Yersinia pestis KIM
acaucaauccgcauc

SEQ ID NO: 4191207 - RNA, 22 nt, Yersinia pestis KIM
acaucaauccgcaucguaaccc

SEQ ID NO: 4191208 - RNA, 17 nt, Yersinia pestis KIM
acaucaauguuggccca

SEQ ID NO: 4191209 - RNA, 14 nt, Yersinia pestis KIM
acaucagcgccaca

SEQ ID NO: 4191210 - RNA, 18 nt, Yersinia pestis KIM
acaucaggccuucuuuuc

SEQ ID NO: 4191211 - RNA, 12 nt, Yersinia pestis KIM
acaucaucaccu

SEQ ID NO: 4191212 - RNA, 13 nt, Yersinia pestis KIM
acaucauccaguu

SEQ ID NO: 4191213 - RNA, 18 nt, Yersinia pestis KIM
acaucaucuucuauuauu

SEQ ID NO: 4191214 - RNA, 13 nt, Yersinia pestis KIM
acaucaugaguaa

SEQ ID NO: 4191215 - RNA, 17 nt, Yersinia pestis KIM
acauccaacaacugcca

SEQ ID NO: 4191216 - RNA, 12 nt, Yersinia pestis KIM
acauccaauuca

SEQ ID NO: 4191217 - RNA, 14 nt, Yersinia pestis KIM
acauccaauucagu

SEQ ID NO: 4191218 - RNA, 19 nt, Yersinia pestis KIM
acauccaauucaguacgac

SEQ ID NO: 4191219 - RNA, 20 nt, Yersinia pestis KIM
acauccaauuuuuucaucau

SEQ ID NO: 4191220 - RNA, 11 nt, Yersinia pestis KIM
acauccacauu

SEQ ID NO: 4191221 - RNA, 16 nt, Yersinia pestis KIM
acauccagauauggca

SEQ ID NO: 4191222 - RNA, 16 nt, Yersinia pestis KIM
acauccgaauuuuuac

SEQ ID NO: 4191223 - RNA, 17 nt, Yersinia pestis KIM
acauccuaaauaauucc

SEQ ID NO: 4191224 - RNA, 13 nt, Yersinia pestis KIM
acauccuuauuuu

SEQ ID NO: 4191225 - RNA, 13 nt, Yersinia pestis KIM
acaucgacaccaa

SEQ ID NO: 4191226 - RNA, 20 nt, Yersinia pestis KIM
acaucgaccauagagcaacc

SEQ ID NO: 4191227 - RNA, 22 nt, Yersinia pestis KIM
acaucggauaauguuaauauuu

SEQ ID NO: 4191228 - RNA, 16 nt, Yersinia pestis KIM
acaucgguaucggcca

SEQ ID NO: 4191229 - RNA, 15 nt, Yersinia pestis KIM
acaucguuguauguu

SEQ ID NO: 4191230 - RNA, 16 nt, Yersinia pestis KIM
acaucucggcuuucag

SEQ ID NO: 4191231 - RNA, 21 nt, Yersinia pestis KIM
acaucugcuuuacugcuuuuc

SEQ ID NO: 4191232 - RNA, 14 nt, Yersinia pestis KIM
acaucuuacugaua

SEQ ID NO: 4191233 - RNA, 15 nt, Yersinia pestis KIM
acaucuucauuuggc

SEQ ID NO: 4191234 - RNA, 22 nt, Yersinia pestis KIM
acaucuugcgccgaaauaaaac

SEQ ID NO: 4191235 - RNA, 14 nt, Yersinia pestis KIM
acaugacugaacau

SEQ ID NO: 4191236 - RNA, 16 nt, Yersinia pestis KIM
acaugagacagcgcgg

SEQ ID NO: 4191237 - RNA, 13 nt, Yersinia pestis KIM
acaugagauggca

SEQ ID NO: 4191238 - RNA, 14 nt, Yersinia pestis KIM
acaugagccacaca

SEQ ID NO: 4191239 - RNA, 17 nt, Yersinia pestis KIM
acaugaguaagugauuc

SEQ ID NO: 4191240 - RNA, 14 nt, Yersinia pestis KIM
acaugcaacuugag

SEQ ID NO: 4191241 - RNA, 14 nt, Yersinia pestis KIM
acaugccagaaacg

SEQ ID NO: 4191242 - RNA, 22 nt, Yersinia pestis KIM
acaugcgaugcgagcaaggcau

SEQ ID NO: 4191243 - RNA, 16 nt, Yersinia pestis KIM
acaugcugaagccagc

SEQ ID NO: 4191244 - RNA, 17 nt, Yersinia pestis KIM
acaugcugaagccagca

SEQ ID NO: 4191245 - RNA, 13 nt, Yersinia pestis KIM
acaugcuguucac

SEQ ID NO: 4191246 - RNA, 17 nt, Yersinia pestis KIM
acauggcaacgacuggg

SEQ ID NO: 4191247 - RNA, 19 nt, Yersinia pestis KIM
acauggcggcagcacagag

SEQ ID NO: 4191248 - RNA, 18 nt, Yersinia pestis KIM
acaugggcaagcucuggg

SEQ ID NO: 4191249 - RNA, 22 nt, Yersinia pestis KIM
acaugguccacagucaguucau

SEQ ID NO: 4191250 - RNA, 19 nt, Yersinia pestis KIM
acauuaaaaauacaaccaa

SEQ ID NO: 4191251 - RNA, 16 nt, Yersinia pestis KIM
acauuaaacccacccc

SEQ ID NO: 4191252 - RNA, 13 nt, Yersinia pestis KIM
acauuaaaugaau

SEQ ID NO: 4191253 - RNA, 14 nt, Yersinia pestis KIM
acauuaaaugaaua

SEQ ID NO: 4191254 - RNA, 11 nt, Yersinia pestis KIM
acauuaacaca

SEQ ID NO: 4191255 - RNA, 17 nt, Yersinia pestis KIM
acauuaacacauuaauu

SEQ ID NO: 4191256 - RNA, 22 nt, Yersinia pestis KIM
acauuaagcauauccaacgcuu

SEQ ID NO: 4191257 - RNA, 19 nt, Yersinia pestis KIM
acauuaauuuaucugcuaa

SEQ ID NO: 4191258 - RNA, 24 nt, Yersinia pestis KIM
acauuacaagugccaaauggaaua

SEQ ID NO: 4191259 - RNA, 12 nt, Yersinia pestis KIM
acauuacccacu

SEQ ID NO: 4191260 - RNA, 19 nt, Yersinia pestis KIM
acauuaccgcucuuuaaca

SEQ ID NO: 4191261 - RNA, 22 nt, Yersinia pestis KIM
acauuacgggccucgcggaaau

SEQ ID NO: 4191262 - RNA, 21 nt, Yersinia pestis KIM
acauuagccgguuaggccagu

SEQ ID NO: 4191263 - RNA, 19 nt, Yersinia pestis KIM
acauuaggcauauauccca

SEQ ID NO: 4191264 - RNA, 16 nt, Yersinia pestis KIM
acauuauccguuugca

SEQ ID NO: 4191265 - RNA, 18 nt, Yersinia pestis KIM
acauuauccguuugcaac

SEQ ID NO: 4191266 - RNA, 19 nt, Yersinia pestis KIM
acauuauccguuugcaaca

SEQ ID NO: 4191267 - RNA, 23 nt, Yersinia pestis KIM
acauuauccguuugcaacaguua

SEQ ID NO: 4191268 - RNA, 21 nt, Yersinia pestis KIM
acauuauccguuugcaacauu

SEQ ID NO: 4191269 - RNA, 20 nt, Yersinia pestis KIM
acauuccaguaaaaaaauag

SEQ ID NO: 4191270 - RNA, 19 nt, Yersinia pestis KIM
acauucugauagugauuuu

SEQ ID NO: 4191271 - RNA, 23 nt, Yersinia pestis KIM
acauucugauagugauuuuuuuc

SEQ ID NO: 4191272 - RNA, 21 nt, Yersinia pestis KIM
acauugaccagauuaaucacc

SEQ ID NO: 4191273 - RNA, 17 nt, Yersinia pestis KIM
acauugacgauggaauc

SEQ ID NO: 4191274 - RNA, 20 nt, Yersinia pestis KIM
acauugcaguauuuuggccg

SEQ ID NO: 4191275 - RNA, 23 nt, Yersinia pestis KIM
acauugucaccuaaccaaacauu

SEQ ID NO: 4191276 - RNA, 18 nt, Yersinia pestis KIM
acauugucuaacaacugg

SEQ ID NO: 4191277 - RNA, 21 nt, Yersinia pestis KIM
accagcaaagccucuaccaau

SEQ ID NO: 4191278 - RNA, 16 nt, Yersinia pestis KIM
accagcacauaaagcg

SEQ ID NO: 4191279 - RNA, 23 nt, Yersinia pestis KIM
accagcaguugcugcucugucaa

SEQ ID NO: 4191280 - RNA, 17 nt, Yersinia pestis KIM
accagcauccugcaaau

SEQ ID NO: 4191281 - RNA, 20 nt, Yersinia pestis KIM
accagccgauaauccaccug

SEQ ID NO: 4191282 - RNA, 16 nt, Yersinia pestis KIM
accagcgcacugaaua

SEQ ID NO: 4191283 - RNA, 14 nt, Yersinia pestis KIM
accagcuuggguga

SEQ ID NO: 4191284 - RNA, 23 nt, Yersinia pestis KIM
accagcuugggugaagacacuuu

SEQ ID NO: 4191285 - RNA, 15 nt, Yersinia pestis KIM
accaggaagcggcca

SEQ ID NO: 4191286 - RNA, 21 nt, Yersinia pestis KIM
accaggccacggccgccuuca

SEQ ID NO: 4191287 - RNA, 12 nt, Yersinia pestis KIM
accaggccgcca

SEQ ID NO: 4191288 - RNA, 17 nt, Yersinia pestis KIM
accagguauuucuccau

SEQ ID NO: 4191289 - RNA, 15 nt, Yersinia pestis KIM
accaguaaacgccaa

SEQ ID NO: 4191290 - RNA, 19 nt, Yersinia pestis KIM
accaguaaacgccaaucac

SEQ ID NO: 4191291 - RNA, 14 nt, Yersinia pestis KIM
accaguagcccagc

SEQ ID NO: 4191292 - RNA, 15 nt, Yersinia pestis KIM
accagucagccuuaa

SEQ ID NO: 4191293 - RNA, 13 nt, Yersinia pestis KIM
accagucugcaua

SEQ ID NO: 4191294 - RNA, 20 nt, Yersinia pestis KIM
accagucugcauacagaucg

SEQ ID NO: 4191295 - RNA, 19 nt, Yersinia pestis KIM
accagugaauaaguucugc

SEQ ID NO: 4191296 - RNA, 21 nt, Yersinia pestis KIM
accagugauucgggcaaaugg

SEQ ID NO: 4191297 - RNA, 18 nt, Yersinia pestis KIM
accaguggugcucccgca

SEQ ID NO: 4191298 - RNA, 22 nt, Yersinia pestis KIM
accaguggugcucccgcacucu

SEQ ID NO: 4191299 - RNA, 22 nt, Yersinia pestis KIM
accaguuaaagaauacagccag

SEQ ID NO: 4191300 - RNA, 22 nt, Yersinia pestis KIM
accaguucgcgugcgcccggua

SEQ ID NO: 4191301 - RNA, 21 nt, Yersinia pestis KIM
accaguucugguagcugcuca

SEQ ID NO: 4191302 - RNA, 18 nt, Yersinia pestis KIM
accaguuuauuuucccuu

SEQ ID NO: 4191303 - RNA, 20 nt, Yersinia pestis KIM
accaguuuauuuucccuuuc

SEQ ID NO: 4191304 - RNA, 14 nt, Yersinia pestis KIM
accauaaaaggaug

SEQ ID NO: 4191305 - RNA, 19 nt, Yersinia pestis KIM
accauaaaaggauggccca

SEQ ID NO: 4191306 - RNA, 23 nt, Yersinia pestis KIM
accauaaaauaaauaauuuguaa

SEQ ID NO: 4191307 - RNA, 15 nt, Yersinia pestis KIM
accauaacaauggcc

SEQ ID NO: 4191308 - RNA, 13 nt, Yersinia pestis KIM
accauagagcaac

SEQ ID NO: 4191309 - RNA, 18 nt, Yersinia pestis KIM
accauagauuaagaaaac

SEQ ID NO: 4191310 - RNA, 12 nt, Yersinia pestis KIM
accauagccacg

SEQ ID NO: 4191311 - RNA, 22 nt, Yersinia pestis KIM
accauaucagaaccaagcaaua

SEQ ID NO: 4191312 - RNA, 13 nt, Yersinia pestis KIM
accauaucagcgc

SEQ ID NO: 4191313 - RNA, 17 nt, Yersinia pestis KIM
accauauucccagccaa

SEQ ID NO: 4191314 - RNA, 22 nt, Yersinia pestis KIM
accaucaaauacacauaaccau

SEQ ID NO: 4191315 - RNA, 21 nt, Yersinia pestis KIM
accaucaauagcauuggcaca

SEQ ID NO: 4191316 - RNA, 18 nt, Yersinia pestis KIM
accaucaauauaagagaa

SEQ ID NO: 4191317 - RNA, 19 nt, Yersinia pestis KIM
accaucaauauaagagaaa

SEQ ID NO: 4191318 - RNA, 21 nt, Yersinia pestis KIM
accaucagacaggauaaucau

SEQ ID NO: 4191319 - RNA, 17 nt, Yersinia pestis KIM
accaucagaguccaaua

SEQ ID NO: 4191320 - RNA, 15 nt, Yersinia pestis KIM
accaucaggauuaau

SEQ ID NO: 4191321 - RNA, 19 nt, Yersinia pestis KIM
accaucagguguuguauaa

SEQ ID NO: 4191322 - RNA, 14 nt, Yersinia pestis KIM
accaucauugaguu

SEQ ID NO: 4191323 - RNA, 19 nt, Yersinia pestis KIM
accaucauugaguuuguca

SEQ ID NO: 4191324 - RNA, 16 nt, Yersinia pestis KIM
accauccccagaacag

SEQ ID NO: 4191325 - RNA, 17 nt, Yersinia pestis KIM
accauccccagaacagc

SEQ ID NO: 4191326 - RNA, 19 nt, Yersinia pestis KIM
accaucgacuggccgauau

SEQ ID NO: 4191327 - RNA, 16 nt, Yersinia pestis KIM
accaucugaugcaggu

SEQ ID NO: 4191328 - RNA, 15 nt, Yersinia pestis KIM
accaucugcuuaguu

SEQ ID NO: 4191329 - RNA, 19 nt, Yersinia pestis KIM
accaucuugucauuaccaa

SEQ ID NO: 4191330 - RNA, 22 nt, Yersinia pestis KIM
accaucuugucauuaccaaugg

SEQ ID NO: 4191331 - RNA, 14 nt, Yersinia pestis KIM
accaugagaaugcg

SEQ ID NO: 4191332 - RNA, 18 nt, Yersinia pestis KIM
accaugagaaugcgacau

SEQ ID NO: 4191333 - RNA, 16 nt, Yersinia pestis KIM
accaugagugaaaaua

SEQ ID NO: 4191334 - RNA, 14 nt, Yersinia pestis KIM
accaugaugacaau

SEQ ID NO: 4191335 - RNA, 20 nt, Yersinia pestis KIM
accaugccaucaauguucgg

SEQ ID NO: 4191336 - RNA, 14 nt, Yersinia pestis KIM
accauggcaggucu

SEQ ID NO: 4191337 - RNA, 17 nt, Yersinia pestis KIM
accauuaauaauaugca

SEQ ID NO: 4191338 - RNA, 18 nt, Yersinia pestis KIM
accauuacuucuacucug

SEQ ID NO: 4191339 - RNA, 14 nt, Yersinia pestis KIM
accauucagccacu

SEQ ID NO: 4191340 - RNA, 15 nt, Yersinia pestis KIM
accauucgccaggaa

SEQ ID NO: 4191341 - RNA, 15 nt, Yersinia pestis KIM
accauucucaaaaua

SEQ ID NO: 4191342 - RNA, 12 nt, Yersinia pestis KIM
accauugaccag

SEQ ID NO: 4191343 - RNA, 16 nt, Yersinia pestis KIM
accauugauaauaaua

SEQ ID NO: 4191344 - RNA, 16 nt, Yersinia pestis KIM
accauuuauugccacg

SEQ ID NO: 4191345 - RNA, 16 nt, Yersinia pestis KIM
accauuugcccuggag

SEQ ID NO: 4191346 - RNA, 21 nt, Yersinia pestis KIM
accauuugcccuggagcaaga

SEQ ID NO: 4191347 - RNA, 17 nt, Yersinia pestis KIM
acccaaaccaacaauau

SEQ ID NO: 4191348 - RNA, 23 nt, Yersinia pestis KIM
acccaaaguggugagcugaucug

SEQ ID NO: 4191349 - RNA, 22 nt, Yersinia pestis KIM
acccaacaguaccuucuaucgu

SEQ ID NO: 4191350 - RNA, 15 nt, Yersinia pestis KIM
acccaaccccaucag

SEQ ID NO: 4191351 - RNA, 19 nt, Yersinia pestis KIM
acccaagggcuauugcugu

SEQ ID NO: 4191352 - RNA, 18 nt, Yersinia pestis KIM
acccaauauucgccagau

SEQ ID NO: 4191353 - RNA, 20 nt, Yersinia pestis KIM
acccaaugccauagcugcug

SEQ ID NO: 4191354 - RNA, 16 nt, Yersinia pestis KIM
acccaauggcaacaaa

SEQ ID NO: 4191355 - RNA, 18 nt, Yersinia pestis KIM
acccaauggcaacaaaau

SEQ ID NO: 4191356 - RNA, 13 nt, Yersinia pestis KIM
acccacaccgcag

SEQ ID NO: 4191357 - RNA, 17 nt, Yersinia pestis KIM
acccacaccgcagcagu

SEQ ID NO: 4191358 - RNA, 20 nt, Yersinia pestis KIM
acccacaccgcagcagugcg

SEQ ID NO: 4191359 - RNA, 14 nt, Yersinia pestis KIM
acccacauucaggc

SEQ ID NO: 4191360 - RNA, 17 nt, Yersinia pestis KIM
acccacgccgaaaacaa

SEQ ID NO: 4191361 - RNA, 22 nt, Yersinia pestis KIM
acccacggcgggcaacagagaa

SEQ ID NO: 4191362 - RNA, 14 nt, Yersinia pestis KIM
acccacguucagau

SEQ ID NO: 4191363 - RNA, 14 nt, Yersinia pestis KIM
acccacuuuauuuu

SEQ ID NO: 4191364 - RNA, 22 nt, Yersinia pestis KIM
acccagacaagaaugccugccg

SEQ ID NO: 4191365 - RNA, 21 nt, Yersinia pestis KIM
acccagccguggaucauggcu

SEQ ID NO: 4191366 - RNA, 16 nt, Yersinia pestis KIM
acccagcgguugaggc

SEQ ID NO: 4191367 - RNA, 21 nt, Yersinia pestis KIM
acccagcuucuuuuaaagaag

SEQ ID NO: 4191368 - RNA, 15 nt, Yersinia pestis KIM
acccaguaacugagc

SEQ ID NO: 4191369 - RNA, 15 nt, Yersinia pestis KIM
acccauaccaaccau

SEQ ID NO: 4191370 - RNA, 20 nt, Yersinia pestis KIM
acccauacgaucagcaagau

SEQ ID NO: 4191371 - RNA, 18 nt, Yersinia pestis KIM
acccauauuacucacaca

SEQ ID NO: 4191372 - RNA, 20 nt, Yersinia pestis KIM
acccauauuacucacacagc

SEQ ID NO: 4191373 - RNA, 15 nt, Yersinia pestis KIM
acccaucaauaauua

SEQ ID NO: 4191374 - RNA, 16 nt, Yersinia pestis KIM
acccauccaguauuuc

SEQ ID NO: 4191375 - RNA, 16 nt, Yersinia pestis KIM
acccauuaaaaacaaa

SEQ ID NO: 4191376 - RNA, 22 nt, Yersinia pestis KIM
acccauuauauagauuuauuca

SEQ ID NO: 4191377 - RNA, 13 nt, Yersinia pestis KIM
acccauuugcaca

SEQ ID NO: 4191378 - RNA, 20 nt, Yersinia pestis KIM
acccauuuuauccucuucca

SEQ ID NO: 4191379 - RNA, 13 nt, Yersinia pestis KIM
accccaauucuua

SEQ ID NO: 4191380 - RNA, 23 nt, Yersinia pestis KIM
accccaauucuuaggucaucguc

SEQ ID NO: 4191381 - RNA, 19 nt, Yersinia pestis KIM
accccacaaccugcgccac

SEQ ID NO: 4191382 - RNA, 17 nt, Yersinia pestis KIM
accccacguaauuauug

SEQ ID NO: 4191383 - RNA, 12 nt, Yersinia pestis KIM
accccagaagau

SEQ ID NO: 4191384 - RNA, 14 nt, Yersinia pestis KIM
accccauugcacca

SEQ ID NO: 4191385 - RNA, 16 nt, Yersinia pestis KIM
accccauugcaccaau

SEQ ID NO: 4191386 - RNA, 19 nt, Yersinia pestis KIM
acccccaacccaaggagau

SEQ ID NO: 4191387 - RNA, 17 nt, Yersinia pestis KIM
accccccauugccaaau

SEQ ID NO: 4191388 - RNA, 12 nt, Yersinia pestis KIM
acccccccgacc

SEQ ID NO: 4191389 - RNA, 14 nt, Yersinia pestis KIM
acccccuucaccaa

SEQ ID NO: 4191390 - RNA, 18 nt, Yersinia pestis KIM
accccguagcacacacag

SEQ ID NO: 4191391 - RNA, 15 nt, Yersinia pestis KIM
accccguugcucuac

SEQ ID NO: 4191392 - RNA, 21 nt, Yersinia pestis KIM
accgguaacauauaaaccagc

SEQ ID NO: 4191393 - RNA, 23 nt, Yersinia pestis KIM
accgguacggcccaaugucccca

SEQ ID NO: 4191394 - RNA, 15 nt, Yersinia pestis KIM
accggucauauuuau

SEQ ID NO: 4191395 - RNA, 13 nt, Yersinia pestis KIM
accgguguucacu

SEQ ID NO: 4191396 - RNA, 15 nt, Yersinia pestis KIM
accgguguucacucg

SEQ ID NO: 4191397 - RNA, 15 nt, Yersinia pestis KIM
accgguuaaaacaga

SEQ ID NO: 4191398 - RNA, 20 nt, Yersinia pestis KIM
accgguuuacccugcgccug

SEQ ID NO: 4191399 - RNA, 15 nt, Yersinia pestis KIM
accguaaacauugac

SEQ ID NO: 4191400 - RNA, 14 nt, Yersinia pestis KIM
accguaaccacauu

SEQ ID NO: 4191401 - RNA, 22 nt, Yersinia pestis KIM
accguaacgggccgcauucacc

SEQ ID NO: 4191402 - RNA, 14 nt, Yersinia pestis KIM
accguaacuucuuc

SEQ ID NO: 4191403 - RNA, 16 nt, Yersinia pestis KIM
accguacauuaaauga

SEQ ID NO: 4191404 - RNA, 22 nt, Yersinia pestis KIM
accguacauuaaaugaauaccu

SEQ ID NO: 4191405 - RNA, 18 nt, Yersinia pestis KIM
accguaugcuuucaucuu

SEQ ID NO: 4191406 - RNA, 20 nt, Yersinia pestis KIM
accgucaagacaacaaacag

SEQ ID NO: 4191407 - RNA, 22 nt, Yersinia pestis KIM
accgucaagacaacaaacagua

SEQ ID NO: 4191408 - RNA, 16 nt, Yersinia pestis KIM
accgucaccuuuauga

SEQ ID NO: 4191409 - RNA, 16 nt, Yersinia pestis KIM
accgucauccagcacu

SEQ ID NO: 4191410 - RNA, 15 nt, Yersinia pestis KIM
accgugcagggcgau

SEQ ID NO: 4191411 - RNA, 21 nt, Yersinia pestis KIM
accgugcuggguaauucauua

SEQ ID NO: 4191412 - RNA, 14 nt, Yersinia pestis KIM
accguggauaaaca

SEQ ID NO: 4191413 - RNA, 13 nt, Yersinia pestis KIM
accgugugauaaa

SEQ ID NO: 4191414 - RNA, 20 nt, Yersinia pestis KIM
accguucaagaucgcgucau

SEQ ID NO: 4191415 - RNA, 17 nt, Yersinia pestis KIM
accguucagaucacaac

SEQ ID NO: 4191416 - RNA, 17 nt, Yersinia pestis KIM
accguuguauguggcug

SEQ ID NO: 4191417 - RNA, 15 nt, Yersinia pestis KIM
accuaaaaugacgau

SEQ ID NO: 4191418 - RNA, 17 nt, Yersinia pestis KIM
accuaacacuuuaucga

SEQ ID NO: 4191419 - RNA, 16 nt, Yersinia pestis KIM
accuaaccaaacauug

SEQ ID NO: 4191420 - RNA, 17 nt, Yersinia pestis KIM
accuaauacagcaccac

SEQ ID NO: 4191421 - RNA, 14 nt, Yersinia pestis KIM
accuaauccaaggc

SEQ ID NO: 4191422 - RNA, 15 nt, Yersinia pestis KIM
accuaaugcaauggc

SEQ ID NO: 4191423 - RNA, 14 nt, Yersinia pestis KIM
accuacaaccuggu

SEQ ID NO: 4191424 - RNA, 14 nt, Yersinia pestis KIM
accuacccuuuaga

SEQ ID NO: 4191425 - RNA, 13 nt, Yersinia pestis KIM
accuaccggauaa

SEQ ID NO: 4191426 - RNA, 14 nt, Yersinia pestis KIM
accuaggcuuucaa

SEQ ID NO: 4191427 - RNA, 16 nt, Yersinia pestis KIM
accuagguucuggacu

SEQ ID NO: 4191428 - RNA, 16 nt, Yersinia pestis KIM
accuaguagauaauca

SEQ ID NO: 4191429 - RNA, 23 nt, Yersinia pestis KIM
accuauaaacuugauucaccaga

SEQ ID NO: 4191430 - RNA, 18 nt, Yersinia pestis KIM
accuauaauuaacagcau

SEQ ID NO: 4191431 - RNA, 22 nt, Yersinia pestis KIM
accuaucgguaucucccgcaaa

SEQ ID NO: 4191432 - RNA, 17 nt, Yersinia pestis KIM
accuauuaucccaguuu

SEQ ID NO: 4191433 - RNA, 13 nt, Yersinia pestis KIM
accuauugauaaa

SEQ ID NO: 4191434 - RNA, 18 nt, Yersinia pestis KIM
accuauugauaaaaccac

SEQ ID NO: 4191435 - RNA, 20 nt, Yersinia pestis KIM
accuauugauaaaaccgcuu

SEQ ID NO: 4191436 - RNA, 14 nt, Yersinia pestis KIM
accucaaaucgaua

SEQ ID NO: 4191437 - RNA, 13 nt, Yersinia pestis KIM
accucacgggcuu

SEQ ID NO: 4191438 - RNA, 16 nt, Yersinia pestis KIM
accucagccucauuca

SEQ ID NO: 4191439 - RNA, 18 nt, Yersinia pestis KIM
accucaggcccgcuauca

SEQ ID NO: 4191440 - RNA, 15 nt, Yersinia pestis KIM
accucagggagccaa

SEQ ID NO: 4191441 - RNA, 12 nt, Yersinia pestis KIM
accucaucauua

SEQ ID NO: 4191442 - RNA, 18 nt, Yersinia pestis KIM
accucauuauuaaacuga

SEQ ID NO: 4191443 - RNA, 14 nt, Yersinia pestis KIM
accuccaaauguca

SEQ ID NO: 4191444 - RNA, 16 nt, Yersinia pestis KIM
accucgaaaucauccg

SEQ ID NO: 4191445 - RNA, 16 nt, Yersinia pestis KIM
accucguaguaaugac

SEQ ID NO: 4191446 - RNA, 14 nt, Yersinia pestis KIM
accucuaaugcacg

SEQ ID NO: 4191447 - RNA, 19 nt, Yersinia pestis KIM
accucugcaaugcccagag

SEQ ID NO: 4191448 - RNA, 14 nt, Yersinia pestis KIM
accucugcugaugu

SEQ ID NO: 4191449 - RNA, 19 nt, Yersinia pestis KIM
accucuucuuccgccaccg

SEQ ID NO: 4191450 - RNA, 14 nt, Yersinia pestis KIM
accugaaauacaaa

SEQ ID NO: 4191451 - RNA, 13 nt, Yersinia pestis KIM
accugaaccugac

SEQ ID NO: 4191452 - RNA, 24 nt, Yersinia pestis KIM
accugaaucgauaaacccgugcuc

SEQ ID NO: 4191453 - RNA, 15 nt, Yersinia pestis KIM
accugaaugccauuc

SEQ ID NO: 4191454 - RNA, 21 nt, Yersinia pestis KIM
accugaaugcgccgcggcccu

SEQ ID NO: 4191455 - RNA, 16 nt, Yersinia pestis KIM
accugacgaaaugccg

SEQ ID NO: 4191456 - RNA, 20 nt, Yersinia pestis KIM
accugacuguggcugcucug

SEQ ID NO: 4191457 - RNA, 13 nt, Yersinia pestis KIM
accugagccaauc

SEQ ID NO: 4191458 - RNA, 17 nt, Yersinia pestis KIM
accugaggauaaaaacu

SEQ ID NO: 4191459 - RNA, 15 nt, Yersinia pestis KIM
accugaguaauauua

SEQ ID NO: 4191460 - RNA, 14 nt, Yersinia pestis KIM
accugauaggccaa

SEQ ID NO: 4191461 - RNA, 19 nt, Yersinia pestis KIM
accugauaggccaaaaaug

SEQ ID NO: 4191462 - RNA, 22 nt, Yersinia pestis KIM
accugauaggccaaaaaugcga

SEQ ID NO: 4191463 - RNA, 22 nt, Yersinia pestis KIM
accugauccaguuucaguggcu

SEQ ID NO: 4191464 - RNA, 16 nt, Yersinia pestis KIM
accugaucgugccauu

SEQ ID NO: 4191465 - RNA, 19 nt, Yersinia pestis KIM
accugaugacccgguaaaa

SEQ ID NO: 4191466 - RNA, 18 nt, Yersinia pestis KIM
accugauguaacucagga

SEQ ID NO: 4191467 - RNA, 18 nt, Yersinia pestis KIM
accugauuugccagcacc

SEQ ID NO: 4191468 - RNA, 17 nt, Yersinia pestis KIM
accugcaacguuaaaga

SEQ ID NO: 4191469 - RNA, 19 nt, Yersinia pestis KIM
accugcaauaaccagaaua

SEQ ID NO: 4191470 - RNA, 14 nt, Yersinia pestis KIM
accugcauauccuc

SEQ ID NO: 4191471 - RNA, 14 nt, Yersinia pestis KIM
accugcaucaagcc

SEQ ID NO: 4191472 - RNA, 14 nt, Yersinia pestis KIM
accugcaucaucac

SEQ ID NO: 4191473 - RNA, 18 nt, Yersinia pestis KIM
accugcauccccggcauc

SEQ ID NO: 4191474 - RNA, 16 nt, Yersinia pestis KIM
accugcccgucacuca

SEQ ID NO: 4191475 - RNA, 13 nt, Yersinia pestis KIM
accugcuaaccga

SEQ ID NO: 4191476 - RNA, 10 nt, Yersinia pestis KIM
accugcucaa

SEQ ID NO: 4191477 - RNA, 15 nt, Yersinia pestis KIM
accugcucaacugcu

SEQ ID NO: 4191478 - RNA, 20 nt, Yersinia pestis KIM
accugcugcaccucugcuga

SEQ ID NO: 4191479 - RNA, 17 nt, Yersinia pestis KIM
accugcuggugccacug

SEQ ID NO: 4191480 - RNA, 20 nt, Yersinia pestis KIM
accugcuuuaccauccgucc

SEQ ID NO: 4191481 - RNA, 22 nt, Yersinia pestis KIM
accuggaauggcgcaauagcau

SEQ ID NO: 4191482 - RNA, 13 nt, Yersinia pestis KIM
accugguggacca

SEQ ID NO: 4191483 - RNA, 17 nt, Yersinia pestis KIM
accugguuaucggccau

SEQ ID NO: 4191484 - RNA, 17 nt, Yersinia pestis KIM
accuguagcuuuuuaaa

SEQ ID NO: 4191485 - RNA, 23 nt, Yersinia pestis KIM
accuguagcuuuuuaaauaccag

SEQ ID NO: 4191486 - RNA, 16 nt, Yersinia pestis KIM
accugugcaccacaca

SEQ ID NO: 4191487 - RNA, 19 nt, Yersinia pestis KIM
accugugcaccacacagcg

SEQ ID NO: 4191488 - RNA, 12 nt, Yersinia pestis KIM
accuguuaaaag

SEQ ID NO: 4191489 - RNA, 20 nt, Yersinia pestis KIM
accuguuugcaacauuaucc

SEQ ID NO: 4191490 - RNA, 20 nt, Yersinia pestis KIM
accuguuuuuguuguucuug

SEQ ID NO: 4191491 - RNA, 16 nt, Yersinia pestis KIM
accuuaaccaacauga

SEQ ID NO: 4191492 - RNA, 23 nt, Yersinia pestis KIM
accuuaacuacaccgcuaaccuu

SEQ ID NO: 4191493 - RNA, 16 nt, Yersinia pestis KIM
accuuaaguaaguuua

SEQ ID NO: 4191494 - RNA, 20 nt, Yersinia pestis KIM
accuuacagcagguggcuga

SEQ ID NO: 4191495 - RNA, 16 nt, Yersinia pestis KIM
accuuacgucacccgc

SEQ ID NO: 4191496 - RNA, 17 nt, Yersinia pestis KIM
accuuacugcaucaaua

SEQ ID NO: 4191497 - RNA, 21 nt, Yersinia pestis KIM
accuuauauaacuagcaagga

SEQ ID NO: 4191498 - RNA, 13 nt, Yersinia pestis KIM
accuuaucaccaa

SEQ ID NO: 4191499 - RNA, 19 nt, Yersinia pestis KIM
accuuaucaccaacguuua

SEQ ID NO: 4191500 - RNA, 11 nt, Yersinia pestis KIM
accuuaucacu

SEQ ID NO: 4191501 - RNA, 13 nt, Yersinia pestis KIM
accuuauccaaua

SEQ ID NO: 4191502 - RNA, 23 nt, Yersinia pestis KIM
accuuauuuuugcauauaaaaca

SEQ ID NO: 4191503 - RNA, 17 nt, Yersinia pestis KIM
accuucaaacgggugau

SEQ ID NO: 4191504 - RNA, 15 nt, Yersinia pestis KIM
accuucaaucauuga

SEQ ID NO: 4191505 - RNA, 22 nt, Yersinia pestis KIM
accuucaaucauugagaucagu

SEQ ID NO: 4191506 - RNA, 21 nt, Yersinia pestis KIM
accuucagacugacgcagagc

SEQ ID NO: 4191507 - RNA, 16 nt, Yersinia pestis KIM
acgccguaaauacauc

SEQ ID NO: 4191508 - RNA, 19 nt, Yersinia pestis KIM
acgccguaaauacauccau

SEQ ID NO: 4191509 - RNA, 17 nt, Yersinia pestis KIM
acgccguggugaaaaau

SEQ ID NO: 4191510 - RNA, 18 nt, Yersinia pestis KIM
acgccuacggcuucccau

SEQ ID NO: 4191511 - RNA, 18 nt, Yersinia pestis KIM
acgccuaucucgacaaau

SEQ ID NO: 4191512 - RNA, 17 nt, Yersinia pestis KIM
acgccucaucuucacga

SEQ ID NO: 4191513 - RNA, 22 nt, Yersinia pestis KIM
acgccucguuuaacucaaauaa

SEQ ID NO: 4191514 - RNA, 14 nt, Yersinia pestis KIM
acgccuucauguug

SEQ ID NO: 4191515 - RNA, 19 nt, Yersinia pestis KIM
acgccuucauguugcaaca

SEQ ID NO: 4191516 - RNA, 18 nt, Yersinia pestis KIM
acgccuuggcguuucuga

SEQ ID NO: 4191517 - RNA, 22 nt, Yersinia pestis KIM
acgccuuggcguuucugaagau

SEQ ID NO: 4191518 - RNA, 16 nt, Yersinia pestis KIM
acgcgaauaucaggca

SEQ ID NO: 4191519 - RNA, 22 nt, Yersinia pestis KIM
acgcgaucuugaacggugagga

SEQ ID NO: 4191520 - RNA, 17 nt, Yersinia pestis KIM
acgcgccgcagcagugc

SEQ ID NO: 4191521 - RNA, 15 nt, Yersinia pestis KIM
acgcgcgucaucaac

SEQ ID NO: 4191522 - RNA, 19 nt, Yersinia pestis KIM
acgcggcacauaccccauu

SEQ ID NO: 4191523 - RNA, 19 nt, Yersinia pestis KIM
acgcggcguuccucuugag

SEQ ID NO: 4191524 - RNA, 14 nt, Yersinia pestis KIM
acgcgggauauaag

SEQ ID NO: 4191525 - RNA, 22 nt, Yersinia pestis KIM
acgcgguuaacgacgcauuaau

SEQ ID NO: 4191526 - RNA, 16 nt, Yersinia pestis KIM
acgcgucugcuggcgu

SEQ ID NO: 4191527 - RNA, 14 nt, Yersinia pestis KIM
acgcguuaauuaag

SEQ ID NO: 4191528 - RNA, 15 nt, Yersinia pestis KIM
acgcuaaccaccguc

SEQ ID NO: 4191529 - RNA, 15 nt, Yersinia pestis KIM
acgcuaaccaucacc

SEQ ID NO: 4191530 - RNA, 21 nt, Yersinia pestis KIM
acgcuaauuauuuuauuuaaa

SEQ ID NO: 4191531 - RNA, 13 nt, Yersinia pestis KIM
acgcuaucaacuu

SEQ ID NO: 4191532 - RNA, 18 nt, Yersinia pestis KIM
acgcuaucgcgaaacucu

SEQ ID NO: 4191533 - RNA, 12 nt, Yersinia pestis KIM
acgcucaucaac

SEQ ID NO: 4191534 - RNA, 23 nt, Yersinia pestis KIM
acgcucaucaaccgggauaucaa

SEQ ID NO: 4191535 - RNA, 15 nt, Yersinia pestis KIM
acgcucuaacgucag

SEQ ID NO: 4191536 - RNA, 20 nt, Yersinia pestis KIM
acgcugcccgucaauaucau

SEQ ID NO: 4191537 - RNA, 20 nt, Yersinia pestis KIM
acgcuggcacuggaugugug

SEQ ID NO: 4191538 - RNA, 13 nt, Yersinia pestis KIM
acgcuggccagca

SEQ ID NO: 4191539 - RNA, 15 nt, Yersinia pestis KIM
acgcugggcgauaaa

SEQ ID NO: 4191540 - RNA, 15 nt, Yersinia pestis KIM
acgcugggcgaucau

SEQ ID NO: 4191541 - RNA, 20 nt, Yersinia pestis KIM
acgcugguuaucacagcaaa

SEQ ID NO: 4191542 - RNA, 15 nt, Yersinia pestis KIM
acgcuguuggguugu

SEQ ID NO: 4191543 - RNA, 17 nt, Yersinia pestis KIM
acgcuuaaagcauaaca

SEQ ID NO: 4191544 - RNA, 22 nt, Yersinia pestis KIM
acgcuuuaaaacuguggcugaa

SEQ ID NO: 4191545 - RNA, 15 nt, Yersinia pestis KIM
acgcuuuacuccucu

SEQ ID NO: 4191546 - RNA, 16 nt, Yersinia pestis KIM
acgcuuuacuccucug

SEQ ID NO: 4191547 - RNA, 20 nt, Yersinia pestis KIM
acgcuuuacuccucugccua

SEQ ID NO: 4191548 - RNA, 23 nt, Yersinia pestis KIM
acgcuuuacuccucugccuaucc

SEQ ID NO: 4191549 - RNA, 22 nt, Yersinia pestis KIM
acgcuuucaggagugaauuucu

SEQ ID NO: 4191550 - RNA, 16 nt, Yersinia pestis KIM
acgcuuugacuuuggc

SEQ ID NO: 4191551 - RNA, 15 nt, Yersinia pestis KIM
acgcuuuugcugcaa

SEQ ID NO: 4191552 - RNA, 22 nt, Yersinia pestis KIM
acggaaaugauaucugaaucag

SEQ ID NO: 4191553 - RNA, 18 nt, Yersinia pestis KIM
acggacauuuuacucccu

SEQ ID NO: 4191554 - RNA, 19 nt, Yersinia pestis KIM
acggacauuuuacucccug

SEQ ID NO: 4191555 - RNA, 17 nt, Yersinia pestis KIM
acggacggaauccaaca

SEQ ID NO: 4191556 - RNA, 17 nt, Yersinia pestis KIM
acggacgguaaauuuac

SEQ ID NO: 4191557 - RNA, 13 nt, Yersinia pestis KIM
acggagaagagga

SEQ ID NO: 4191558 - RNA, 17 nt, Yersinia pestis KIM
acggagagucagcaagg

SEQ ID NO: 4191559 - RNA, 20 nt, Yersinia pestis KIM
acggagagucagcaagguga

SEQ ID NO: 4191560 - RNA, 18 nt, Yersinia pestis KIM
acggagcguacacgcagu

SEQ ID NO: 4191561 - RNA, 22 nt, Yersinia pestis KIM
acggagugcugacugcauucac

SEQ ID NO: 4191562 - RNA, 12 nt, Yersinia pestis KIM
acggauaucaac

SEQ ID NO: 4191563 - RNA, 18 nt, Yersinia pestis KIM
acggcaauuaagcaaaaa

SEQ ID NO: 4191564 - RNA, 17 nt, Yersinia pestis KIM
acggcacguuuccccuu

SEQ ID NO: 4191565 - RNA, 20 nt, Yersinia pestis KIM
acggcagacauuccgucagc

SEQ ID NO: 4191566 - RNA, 15 nt, Yersinia pestis KIM
acggcagcaacgaaa

SEQ ID NO: 4191567 - RNA, 16 nt, Yersinia pestis KIM
acggcagcgagcacug

SEQ ID NO: 4191568 - RNA, 19 nt, Yersinia pestis KIM
acggcagcgagcacugccc

SEQ ID NO: 4191569 - RNA, 21 nt, Yersinia pestis KIM
acggcagugaucgcacuucaa

SEQ ID NO: 4191570 - RNA, 23 nt, Yersinia pestis KIM
acggcagugaucgcacuucaacc

SEQ ID NO: 4191571 - RNA, 19 nt, Yersinia pestis KIM
acggcauagaguaaccagu

SEQ ID NO: 4191572 - RNA, 22 nt, Yersinia pestis KIM
acggcaucgaguccguuaaaaa

SEQ ID NO: 4191573 - RNA, 17 nt, Yersinia pestis KIM
acggcaucgcugcaaua

SEQ ID NO: 4191574 - RNA, 14 nt, Yersinia pestis KIM
acggccaauuucag

SEQ ID NO: 4191575 - RNA, 14 nt, Yersinia pestis KIM
acggccagaaucaa

SEQ ID NO: 4191576 - RNA, 20 nt, Yersinia pestis KIM
acggccagagccaccagaau

SEQ ID NO: 4191577 - RNA, 14 nt, Yersinia pestis KIM
acggccagcaaccu

SEQ ID NO: 4191578 - RNA, 22 nt, Yersinia pestis KIM
acggccagcaaccuggcggccc

SEQ ID NO: 4191579 - RNA, 21 nt, Yersinia pestis KIM
acggccaucaauaaagcuggc

SEQ ID NO: 4191580 - RNA, 19 nt, Yersinia pestis KIM
acggccuguaccaccacca

SEQ ID NO: 4191581 - RNA, 15 nt, Yersinia pestis KIM
acggcgacuugccgu

SEQ ID NO: 4191582 - RNA, 20 nt, Yersinia pestis KIM
acggcgcagggcgauaucca

SEQ ID NO: 4191583 - RNA, 12 nt, Yersinia pestis KIM
acggcggccuua

SEQ ID NO: 4191584 - RNA, 16 nt, Yersinia pestis KIM
acggcggcgagcacug

SEQ ID NO: 4191585 - RNA, 19 nt, Yersinia pestis KIM
acggcggcgagcacugccc

SEQ ID NO: 4191586 - RNA, 22 nt, Yersinia pestis KIM
acggcggcuacugguagcagcc

SEQ ID NO: 4191587 - RNA, 15 nt, Yersinia pestis KIM
acggcgggcaacaga

SEQ ID NO: 4191588 - RNA, 23 nt, Yersinia pestis KIM
acggcggguugaacaugggugcc

SEQ ID NO: 4191589 - RNA, 14 nt, Yersinia pestis KIM
acggcguuugacaa

SEQ ID NO: 4191590 - RNA, 13 nt, Yersinia pestis KIM
acggcucacacac

SEQ ID NO: 4191591 - RNA, 12 nt, Yersinia pestis KIM
acggcucaucac

SEQ ID NO: 4191592 - RNA, 17 nt, Yersinia pestis KIM
acggcucaucacaccgc

SEQ ID NO: 4191593 - RNA, 15 nt, Yersinia pestis KIM
acggcuuaucaaucu

SEQ ID NO: 4191594 - RNA, 14 nt, Yersinia pestis KIM
acgggcaaccugua

SEQ ID NO: 4191595 - RNA, 18 nt, Yersinia pestis KIM
acgggccucgcggaaauc

SEQ ID NO: 4191596 - RNA, 13 nt, Yersinia pestis KIM
acgggcugauuac

SEQ ID NO: 4191597 - RNA, 17 nt, Yersinia pestis KIM
acgggcugcugcagccg

SEQ ID NO: 4191598 - RNA, 19 nt, Yersinia pestis KIM
acgggcuuccaucaggaag

SEQ ID NO: 4191599 - RNA, 21 nt, Yersinia pestis KIM
acgggcuuccaucaggaaguc

SEQ ID NO: 4191600 - RNA, 22 nt, Yersinia pestis KIM
acggguuccgcguuuaucgacc

SEQ ID NO: 4191601 - RNA, 16 nt, Yersinia pestis KIM
acgguaaccauccaua

SEQ ID NO: 4191602 - RNA, 18 nt, Yersinia pestis KIM
acgguaccgcaggucaga

SEQ ID NO: 4191603 - RNA, 23 nt, Yersinia pestis KIM
acgguaggcagaaacggcuauuu

SEQ ID NO: 4191604 - RNA, 15 nt, Yersinia pestis KIM
acgguauagcuauca

SEQ ID NO: 4191605 - RNA, 21 nt, Yersinia pestis KIM
acgguauugugcuccugauga

SEQ ID NO: 4191606 - RNA, 23 nt, Yersinia pestis KIM
acggucauucacuguggcggcca

SEQ ID NO: 4191607 - RNA, 13 nt, Yersinia pestis KIM
acggucucuuucg

SEQ ID NO: 4191608 - RNA, 16 nt, Yersinia pestis KIM
acggugagaauaaaua

SEQ ID NO: 4191609 - RNA, 13 nt, Yersinia pestis KIM
acggugaggauag

SEQ ID NO: 4191610 - RNA, 16 nt, Yersinia pestis KIM
acggugccagcagcaa

SEQ ID NO: 4191611 - RNA, 18 nt, Yersinia pestis KIM
acgguggguacuccucgc

SEQ ID NO: 4191612 - RNA, 16 nt, Yersinia pestis KIM
acgguguguugaaauu

SEQ ID NO: 4191613 - RNA, 18 nt, Yersinia pestis KIM
acgguguguugaaauuug

SEQ ID NO: 4191614 - RNA, 21 nt, Yersinia pestis KIM
acgguguuuggugaagaaacc

SEQ ID NO: 4191615 - RNA, 17 nt, Yersinia pestis KIM
acgguucccaugacgau

SEQ ID NO: 4191616 - RNA, 17 nt, Yersinia pestis KIM
acgguuucaacuucaac

SEQ ID NO: 4191617 - RNA, 16 nt, Yersinia pestis KIM
acguaaaaaccaaccg

SEQ ID NO: 4191618 - RNA, 18 nt, Yersinia pestis KIM
acguaacgacgauaagaa

SEQ ID NO: 4191619 - RNA, 19 nt, Yersinia pestis KIM
acguaauauguauuuagga

SEQ ID NO: 4191620 - RNA, 16 nt, Yersinia pestis KIM
acguacauauaucacu

SEQ ID NO: 4191621 - RNA, 16 nt, Yersinia pestis KIM
acucacucuucgcaaa

SEQ ID NO: 4191622 - RNA, 22 nt, Yersinia pestis KIM
acucagaaaacagccaccagcc

SEQ ID NO: 4191623 - RNA, 23 nt, Yersinia pestis KIM
acucagaaaacagccaccagcca

SEQ ID NO: 4191624 - RNA, 12 nt, Yersinia pestis KIM
acucagaucacc

SEQ ID NO: 4191625 - RNA, 16 nt, Yersinia pestis KIM
acucagaugaaaaacu

SEQ ID NO: 4191626 - RNA, 17 nt, Yersinia pestis KIM
acucagcacauuuuuau

SEQ ID NO: 4191627 - RNA, 21 nt, Yersinia pestis KIM
acucagcauccuccugaucuu

SEQ ID NO: 4191628 - RNA, 15 nt, Yersinia pestis KIM
acucagccauugcuu

SEQ ID NO: 4191629 - RNA, 18 nt, Yersinia pestis KIM
acucaggcccugagauuc

SEQ ID NO: 4191630 - RNA, 16 nt, Yersinia pestis KIM
acucaguucagccccc

SEQ ID NO: 4191631 - RNA, 21 nt, Yersinia pestis KIM
acucauacacuaauggcacgc

SEQ ID NO: 4191632 - RNA, 19 nt, Yersinia pestis KIM
acucauauuguccaaagga

SEQ ID NO: 4191633 - RNA, 20 nt, Yersinia pestis KIM
acucauccuaccgccagcug

SEQ ID NO: 4191634 - RNA, 15 nt, Yersinia pestis KIM
acucaucuaauuuuc

SEQ ID NO: 4191635 - RNA, 22 nt, Yersinia pestis KIM
acucauguccagggcaaucagg

SEQ ID NO: 4191636 - RNA, 15 nt, Yersinia pestis KIM
acucauuauggauaa

SEQ ID NO: 4191637 - RNA, 19 nt, Yersinia pestis KIM
acucauuccgccuguuuuc

SEQ ID NO: 4191638 - RNA, 13 nt, Yersinia pestis KIM
acucauuuuuaag

SEQ ID NO: 4191639 - RNA, 17 nt, Yersinia pestis KIM
acuccacuuccucauuc

SEQ ID NO: 4191640 - RNA, 21 nt, Yersinia pestis KIM
acuccagcgccguugggcgga

SEQ ID NO: 4191641 - RNA, 22 nt, Yersinia pestis KIM
acuccaguaagccugaugccuu

SEQ ID NO: 4191642 - RNA, 16 nt, Yersinia pestis KIM
acuccauuuuuuugau

SEQ ID NO: 4191643 - RNA, 21 nt, Yersinia pestis KIM
acucccgauucagcucugcca

SEQ ID NO: 4191644 - RNA, 17 nt, Yersinia pestis KIM
acucccgccaagaaacg

SEQ ID NO: 4191645 - RNA, 17 nt, Yersinia pestis KIM
acucccguccugagcug

SEQ ID NO: 4191646 - RNA, 15 nt, Yersinia pestis KIM
acucccugacucccu

SEQ ID NO: 4191647 - RNA, 14 nt, Yersinia pestis KIM
acuccucugccuau

SEQ ID NO: 4191648 - RNA, 19 nt, Yersinia pestis KIM
acuccucugccuauccuca

SEQ ID NO: 4191649 - RNA, 16 nt, Yersinia pestis KIM
acuccucuuucuuaau

SEQ ID NO: 4191650 - RNA, 22 nt, Yersinia pestis KIM
acuccugcucaaacuugaucag

SEQ ID NO: 4191651 - RNA, 21 nt, Yersinia pestis KIM
acuccuuaccacugcucacuu

SEQ ID NO: 4191652 - RNA, 23 nt, Yersinia pestis KIM
acuccuucucgaugccuucuuuc

SEQ ID NO: 4191653 - RNA, 19 nt, Yersinia pestis KIM
acuccuugaaguguuuaau

SEQ ID NO: 4191654 - RNA, 22 nt, Yersinia pestis KIM
acuccuugaaguguuuaaucau

SEQ ID NO: 4191655 - RNA, 14 nt, Yersinia pestis KIM
acuccuugaauauu

SEQ ID NO: 4191656 - RNA, 20 nt, Yersinia pestis KIM
acuccuuggaacuuacuccc

SEQ ID NO: 4191657 - RNA, 21 nt, Yersinia pestis KIM
acuccuuuaccuacaaccugg

SEQ ID NO: 4191658 - RNA, 22 nt, Yersinia pestis KIM
acuccuuuaccuacaaccuggu

SEQ ID NO: 4191659 - RNA, 15 nt, Yersinia pestis KIM
acucgaacaaccggu

SEQ ID NO: 4191660 - RNA, 19 nt, Yersinia pestis KIM
acucgacaaccuucucccg

SEQ ID NO: 4191661 - RNA, 14 nt, Yersinia pestis KIM
acucgaucuugaac

SEQ ID NO: 4191662 - RNA, 18 nt, Yersinia pestis KIM
acucgcgugccguucagg

SEQ ID NO: 4191663 - RNA, 22 nt, Yersinia pestis KIM
acucgcuuaacugugcagccca

SEQ ID NO: 4191664 - RNA, 13 nt, Yersinia pestis KIM
acucggcccaucc

SEQ ID NO: 4191665 - RNA, 19 nt, Yersinia pestis KIM
acucggcucaccugcggga

SEQ ID NO: 4191666 - RNA, 18 nt, Yersinia pestis KIM
acucgguacaaucucugg

SEQ ID NO: 4191667 - RNA, 20 nt, Yersinia pestis KIM
acucguucucaaccaaauag

SEQ ID NO: 4191668 - RNA, 12 nt, Yersinia pestis KIM
acucguuuuaca

SEQ ID NO: 4191669 - RNA, 16 nt, Yersinia pestis KIM
acucguuuuacauuga

SEQ ID NO: 4191670 - RNA, 18 nt, Yersinia pestis KIM
acucuagcgccagcaauu

SEQ ID NO: 4191671 - RNA, 15 nt, Yersinia pestis KIM
acucucccucaguga

SEQ ID NO: 4191672 - RNA, 23 nt, Yersinia pestis KIM
acucuccgggcauaaaugcaaua

SEQ ID NO: 4191673 - RNA, 21 nt, Yersinia pestis KIM
acucugaacccugcgauuuau

SEQ ID NO: 4191674 - RNA, 23 nt, Yersinia pestis KIM
acucugcgcucauacucagucau

SEQ ID NO: 4191675 - RNA, 15 nt, Yersinia pestis KIM
acucugcuaccagga

SEQ ID NO: 4191676 - RNA, 19 nt, Yersinia pestis KIM
acucugcuaccaggaagcg

SEQ ID NO: 4191677 - RNA, 21 nt, Yersinia pestis KIM
acucuggcguugccgugcugu

SEQ ID NO: 4191678 - RNA, 16 nt, Yersinia pestis KIM
acucuggggcaaucaa

SEQ ID NO: 4191679 - RNA, 20 nt, Yersinia pestis KIM
acucuguagcacauuuaagc

SEQ ID NO: 4191680 - RNA, 15 nt, Yersinia pestis KIM
acucuguuaccaaug

SEQ ID NO: 4191681 - RNA, 12 nt, Yersinia pestis KIM
acucuguuuuaa

SEQ ID NO: 4191682 - RNA, 21 nt, Yersinia pestis KIM
acucuuaguuaugauccuuua

SEQ ID NO: 4191683 - RNA, 18 nt, Yersinia pestis KIM
acucuucagccuauccuc

SEQ ID NO: 4191684 - RNA, 19 nt, Yersinia pestis KIM
acucuucagccuauccuca

SEQ ID NO: 4191685 - RNA, 21 nt, Yersinia pestis KIM
acucuucagccuauccucacc

SEQ ID NO: 4191686 - RNA, 15 nt, Yersinia pestis KIM
acucuuccuugcucu

SEQ ID NO: 4191687 - RNA, 20 nt, Yersinia pestis KIM
acucuucuguauaugaagau

SEQ ID NO: 4191688 - RNA, 15 nt, Yersinia pestis KIM
acucuuuauuuaugg

SEQ ID NO: 4191689 - RNA, 20 nt, Yersinia pestis KIM
acucuuugaguagcaggccg

SEQ ID NO: 4191690 - RNA, 12 nt, Yersinia pestis KIM
acucuuuuuaau

SEQ ID NO: 4191691 - RNA, 17 nt, Yersinia pestis KIM
acugaaaagaggcacac

SEQ ID NO: 4191692 - RNA, 18 nt, Yersinia pestis KIM
acugaaaguagaaauaaa

SEQ ID NO: 4191693 - RNA, 19 nt, Yersinia pestis KIM
acugaaaguagaaauaaaa

SEQ ID NO: 4191694 - RNA, 17 nt, Yersinia pestis KIM
acugaaccgccauugca

SEQ ID NO: 4191695 - RNA, 18 nt, Yersinia pestis KIM
acugaacgauaaauugcu

SEQ ID NO: 4191696 - RNA, 15 nt, Yersinia pestis KIM
acugaagcaucaaua

SEQ ID NO: 4191697 - RNA, 12 nt, Yersinia pestis KIM
acugaaguuauu

SEQ ID NO: 4191698 - RNA, 16 nt, Yersinia pestis KIM
acugaauaaacaccau

SEQ ID NO: 4191699 - RNA, 22 nt, Yersinia pestis KIM
acugaauaaacaccauagccac

SEQ ID NO: 4191700 - RNA, 22 nt, Yersinia pestis KIM
acugaauggaucacaucacagu

SEQ ID NO: 4191701 - RNA, 15 nt, Yersinia pestis KIM
acugaauggcuauuu

SEQ ID NO: 4191702 - RNA, 12 nt, Yersinia pestis KIM
acugaaugugaa

SEQ ID NO: 4191703 - RNA, 16 nt, Yersinia pestis KIM
acugaaugugaagagc

SEQ ID NO: 4191704 - RNA, 17 nt, Yersinia pestis KIM
acugacaaaaacagcac

SEQ ID NO: 4191705 - RNA, 14 nt, Yersinia pestis KIM
acugacaacaucaa

SEQ ID NO: 4191706 - RNA, 14 nt, Yersinia pestis KIM
acugacaucaucac

SEQ ID NO: 4191707 - RNA, 21 nt, Yersinia pestis KIM
acugacauucuggcuuuucau

SEQ ID NO: 4191708 - RNA, 14 nt, Yersinia pestis KIM
acugacauuuaugc

SEQ ID NO: 4191709 - RNA, 20 nt, Yersinia pestis KIM
acugaccgggaacaacgaaa

SEQ ID NO: 4191710 - RNA, 15 nt, Yersinia pestis KIM
acugaccgugcaggg

SEQ ID NO: 4191711 - RNA, 14 nt, Yersinia pestis KIM
acugaccuauugau

SEQ ID NO: 4191712 - RNA, 13 nt, Yersinia pestis KIM
acugaccugcgcu

SEQ ID NO: 4191713 - RNA, 18 nt, Yersinia pestis KIM
acugacguaguguauuca

SEQ ID NO: 4191714 - RNA, 16 nt, Yersinia pestis KIM
acugacucacgucagu

SEQ ID NO: 4191715 - RNA, 12 nt, Yersinia pestis KIM
acugacugccau

SEQ ID NO: 4191716 - RNA, 14 nt, Yersinia pestis KIM
acugagauuugcca

SEQ ID NO: 4191717 - RNA, 22 nt, Yersinia pestis KIM
acugagauuugccaaacgugaa

SEQ ID NO: 4191718 - RNA, 19 nt, Yersinia pestis KIM
acugagcaaacagugcaca

SEQ ID NO: 4191719 - RNA, 21 nt, Yersinia pestis KIM
acugagcagguuaaacagcgc

SEQ ID NO: 4191720 - RNA, 11 nt, Yersinia pestis KIM
acugaggcaga

SEQ ID NO: 4191721 - RNA, 16 nt, Yersinia pestis KIM
acugaguucugcugcc

SEQ ID NO: 4191722 - RNA, 18 nt, Yersinia pestis KIM
acugaguugggccuugcu

SEQ ID NO: 4191723 - RNA, 14 nt, Yersinia pestis KIM
acugauacccaguu

SEQ ID NO: 4191724 - RNA, 18 nt, Yersinia pestis KIM
acugauacccgccaguuu

SEQ ID NO: 4191725 - RNA, 13 nt, Yersinia pestis KIM
acugauagauuca

SEQ ID NO: 4191726 - RNA, 16 nt, Yersinia pestis KIM
acugauagcaaacaaa

SEQ ID NO: 4191727 - RNA, 14 nt, Yersinia pestis KIM
acugauagccaaca

SEQ ID NO: 4191728 - RNA, 16 nt, Yersinia pestis KIM
acugauauaaagcauu

SEQ ID NO: 4191729 - RNA, 20 nt, Yersinia pestis KIM
acugauauagccuucuucac

SEQ ID NO: 4191730 - RNA, 22 nt, Yersinia pestis KIM
acugaucaauaucccgagaaac

SEQ ID NO: 4191731 - RNA, 17 nt, Yersinia pestis KIM
acugaucucaucaaaca

SEQ ID NO: 4191732 - RNA, 20 nt, Yersinia pestis KIM
acugaugcgguagugaugca

SEQ ID NO: 4191733 - RNA, 15 nt, Yersinia pestis KIM
acugaugcuuggccc

SEQ ID NO: 4191734 - RNA, 13 nt, Yersinia pestis KIM
acugauuaagaaa

SEQ ID NO: 4191735 - RNA, 17 nt, Yersinia pestis KIM
acugauuuaaccgaugc

SEQ ID NO: 4191736 - RNA, 20 nt, Yersinia pestis KIM
acuuauucccacuuauuaua

SEQ ID NO: 4191737 - RNA, 16 nt, Yersinia pestis KIM
acuuauugauuauaug

SEQ ID NO: 4191738 - RNA, 11 nt, Yersinia pestis KIM
acuuauugguc

SEQ ID NO: 4191739 - RNA, 14 nt, Yersinia pestis KIM
acuuauuugaaaua

SEQ ID NO: 4191740 - RNA, 23 nt, Yersinia pestis KIM
acuucaauuuggccauuaaccua

SEQ ID NO: 4191741 - RNA, 17 nt, Yersinia pestis KIM
acuucacaaugcacagu

SEQ ID NO: 4191742 - RNA, 15 nt, Yersinia pestis KIM
acuucacuucagaac

SEQ ID NO: 4191743 - RNA, 18 nt, Yersinia pestis KIM
acuucacuuugacuuaaa

SEQ ID NO: 4191744 - RNA, 14 nt, Yersinia pestis KIM
acuucaggccaaua

SEQ ID NO: 4191745 - RNA, 13 nt, Yersinia pestis KIM
acuucaucaucaa

SEQ ID NO: 4191746 - RNA, 14 nt, Yersinia pestis KIM
acuucaucaucaac

SEQ ID NO: 4191747 - RNA, 24 nt, Yersinia pestis KIM
acuucaucaucaacaaccagugcu

SEQ ID NO: 4191748 - RNA, 21 nt, Yersinia pestis KIM
acuucaucauucauuuuaaaa

SEQ ID NO: 4191749 - RNA, 14 nt, Yersinia pestis KIM
acuucaucuuuuuu

SEQ ID NO: 4191750 - RNA, 17 nt, Yersinia pestis KIM
acuucaucuuuuuuaau

SEQ ID NO: 4191751 - RNA, 19 nt, Yersinia pestis KIM
acuucauuggcuugguugu

SEQ ID NO: 4191752 - RNA, 14 nt, Yersinia pestis KIM
acuuccacggccag

SEQ ID NO: 4191753 - RNA, 12 nt, Yersinia pestis KIM
acuuccagcacc

SEQ ID NO: 4191754 - RNA, 19 nt, Yersinia pestis KIM
acuuccagcguauguuccu

SEQ ID NO: 4191755 - RNA, 21 nt, Yersinia pestis KIM
acuuccaucugcuuuugaaac

SEQ ID NO: 4191756 - RNA, 12 nt, Yersinia pestis KIM
acuuccauuccg

SEQ ID NO: 4191757 - RNA, 13 nt, Yersinia pestis KIM
acuuccgccgcca

SEQ ID NO: 4191758 - RNA, 23 nt, Yersinia pestis KIM
acuuccgccgccaacagugaaua

SEQ ID NO: 4191759 - RNA, 21 nt, Yersinia pestis KIM
acuuccugccaacaacuuaau

SEQ ID NO: 4191760 - RNA, 13 nt, Yersinia pestis KIM
acuucgaaagaaa

SEQ ID NO: 4191761 - RNA, 16 nt, Yersinia pestis KIM
acuucgaaagaaauaa

SEQ ID NO: 4191762 - RNA, 17 nt, Yersinia pestis KIM
acuucgaaagaaauaaa

SEQ ID NO: 4191763 - RNA, 21 nt, Yersinia pestis KIM
acuucgaaagaaauaaaagaa

SEQ ID NO: 4191764 - RNA, 13 nt, Yersinia pestis KIM
acuucgcacgccc

SEQ ID NO: 4191765 - RNA, 23 nt, Yersinia pestis KIM
acuucgcacgcccaucaaggccu

SEQ ID NO: 4191766 - RNA, 17 nt, Yersinia pestis KIM
acuucgccaggucagga

SEQ ID NO: 4191767 - RNA, 21 nt, Yersinia pestis KIM
acuucgccgggucaggaagag

SEQ ID NO: 4191768 - RNA, 16 nt, Yersinia pestis KIM
acuucgcgaacacaau

SEQ ID NO: 4191769 - RNA, 13 nt, Yersinia pestis KIM
acuucggucaaga

SEQ ID NO: 4191770 - RNA, 18 nt, Yersinia pestis KIM
acuucguagggcacuuuc

SEQ ID NO: 4191771 - RNA, 20 nt, Yersinia pestis KIM
acuucuaacaagcuguuauu

SEQ ID NO: 4191772 - RNA, 16 nt, Yersinia pestis KIM
acuucuacagggcaua

SEQ ID NO: 4191773 - RNA, 14 nt, Yersinia pestis KIM
acuucuauuuuucg

SEQ ID NO: 4191774 - RNA, 18 nt, Yersinia pestis KIM
acuucugcgaccugaucc

SEQ ID NO: 4191775 - RNA, 14 nt, Yersinia pestis KIM
acuucuuauuaauc

SEQ ID NO: 4191776 - RNA, 15 nt, Yersinia pestis KIM
acuucuuauuaauca

SEQ ID NO: 4191777 - RNA, 20 nt, Yersinia pestis KIM
acuucuucgcuaucgagauu

SEQ ID NO: 4191778 - RNA, 15 nt, Yersinia pestis KIM
acuucuuucacuaau

SEQ ID NO: 4191779 - RNA, 21 nt, Yersinia pestis KIM
acuucuuucacuaaugaggaa

SEQ ID NO: 4191780 - RNA, 20 nt, Yersinia pestis KIM
acuugaauuaugacggguau

SEQ ID NO: 4191781 - RNA, 15 nt, Yersinia pestis KIM
acuugagagaaacuu

SEQ ID NO: 4191782 - RNA, 19 nt, Yersinia pestis KIM
acuugccacaacugaaugu

SEQ ID NO: 4191783 - RNA, 13 nt, Yersinia pestis KIM
acuugccguggcu

SEQ ID NO: 4191784 - RNA, 16 nt, Yersinia pestis KIM
acuugcucuugagugu

SEQ ID NO: 4191785 - RNA, 14 nt, Yersinia pestis KIM
acuuggacaucugc

SEQ ID NO: 4191786 - RNA, 20 nt, Yersinia pestis KIM
acuuggcuaauugucacaga

SEQ ID NO: 4191787 - RNA, 22 nt, Yersinia pestis KIM
acuuguggcccggcauggacga

SEQ ID NO: 4191788 - RNA, 13 nt, Yersinia pestis KIM
acuuguucagaga

SEQ ID NO: 4191789 - RNA, 17 nt, Yersinia pestis KIM
acuuguucagagauaau

SEQ ID NO: 4191790 - RNA, 14 nt, Yersinia pestis KIM
acuuguucauccug

SEQ ID NO: 4191791 - RNA, 15 nt, Yersinia pestis KIM
acuuuaaauccaucg

SEQ ID NO: 4191792 - RNA, 15 nt, Yersinia pestis KIM
acuuuaagcugcaga

SEQ ID NO: 4191793 - RNA, 14 nt, Yersinia pestis KIM
acuuuaucugccaa

SEQ ID NO: 4191794 - RNA, 17 nt, Yersinia pestis KIM
acuuuauuuaaaauuaa

SEQ ID NO: 4191795 - RNA, 21 nt, Yersinia pestis KIM
acuuuauuuuuuuccagguca

SEQ ID NO: 4191796 - RNA, 13 nt, Yersinia pestis KIM
acuuuccuuccuc

SEQ ID NO: 4191797 - RNA, 22 nt, Yersinia pestis KIM
acuuucgauagucagcuucacu

SEQ ID NO: 4191798 - RNA, 16 nt, Yersinia pestis KIM
acuuucggguaucugu

SEQ ID NO: 4191799 - RNA, 13 nt, Yersinia pestis KIM
acuuucuaagcug

SEQ ID NO: 4191800 - RNA, 13 nt, Yersinia pestis KIM
acuuugcauuuuc

SEQ ID NO: 4191801 - RNA, 23 nt, Yersinia pestis KIM
acuuugcauuuucuggugagcau

SEQ ID NO: 4191802 - RNA, 17 nt, Yersinia pestis KIM
acuuugcgcuuuuuaau

SEQ ID NO: 4191803 - RNA, 17 nt, Yersinia pestis KIM
acuuuggcgcagaugau

SEQ ID NO: 4191804 - RNA, 17 nt, Yersinia pestis KIM
acuuugucaauaaccuc

SEQ ID NO: 4191805 - RNA, 21 nt, Yersinia pestis KIM
acuuugucaauaaccucagag

SEQ ID NO: 4191806 - RNA, 22 nt, Yersinia pestis KIM
acuuugucaauaaccucagccu

SEQ ID NO: 4191807 - RNA, 16 nt, Yersinia pestis KIM
acuuuuauauccgcca

SEQ ID NO: 4191808 - RNA, 16 nt, Yersinia pestis KIM
acuuuuauuugauucg

SEQ ID NO: 4191809 - RNA, 15 nt, Yersinia pestis KIM
acuuuuauuuuuuau

SEQ ID NO: 4191810 - RNA, 23 nt, Yersinia pestis KIM
acuuuucaucgcauaggccaaua

SEQ ID NO: 4191811 - RNA, 15 nt, Yersinia pestis KIM
acuuuucauuuccuc

SEQ ID NO: 4191812 - RNA, 20 nt, Yersinia pestis KIM
acuuuuuauuucuuuuaaau

SEQ ID NO: 4191813 - RNA, 14 nt, Yersinia pestis KIM
agaaaaucaggaua

SEQ ID NO: 4191814 - RNA, 12 nt, Yersinia pestis KIM
agaaacaaaacc

SEQ ID NO: 4191815 - RNA, 18 nt, Yersinia pestis KIM
agaaacauccuaaaaagc

SEQ ID NO: 4191816 - RNA, 20 nt, Yersinia pestis KIM
agaaacaucuucauuuggcu

SEQ ID NO: 4191817 - RNA, 21 nt, Yersinia pestis KIM
agaaaccagcggcagcgccug

SEQ ID NO: 4191818 - RNA, 19 nt, Yersinia pestis KIM
agaaaccuaaugccagaca

SEQ ID NO: 4191819 - RNA, 16 nt, Yersinia pestis KIM
agaaacgauuacccac

SEQ ID NO: 4191820 - RNA, 18 nt, Yersinia pestis KIM
agaaacgauuacccacca

SEQ ID NO: 4191821 - RNA, 16 nt, Yersinia pestis KIM
agaaacgccccgauaa

SEQ ID NO: 4191822 - RNA, 20 nt, Yersinia pestis KIM
agaaacggcuauuuuuuuac

SEQ ID NO: 4191823 - RNA, 21 nt, Yersinia pestis KIM
agaaacgugaauugcuacugg

SEQ ID NO: 4191824 - RNA, 15 nt, Yersinia pestis KIM
agaaagaaaaauaga

SEQ ID NO: 4191825 - RNA, 14 nt, Yersinia pestis KIM
agaaaggauuugaa

SEQ ID NO: 4191826 - RNA, 22 nt, Yersinia pestis KIM
agaaaggcuaucacgauaauca

SEQ ID NO: 4191827 - RNA, 23 nt, Yersinia pestis KIM
agaaagguaugugccaaaaaaag

SEQ ID NO: 4191828 - RNA, 13 nt, Yersinia pestis KIM
agaaauaaaaacc

SEQ ID NO: 4191829 - RNA, 13 nt, Yersinia pestis KIM
agaaauaaaagaa

SEQ ID NO: 4191830 - RNA, 14 nt, Yersinia pestis KIM
agaaauaaauucau

SEQ ID NO: 4191831 - RNA, 17 nt, Yersinia pestis KIM
agaaauaaguugaacca

SEQ ID NO: 4191832 - RNA, 19 nt, Yersinia pestis KIM
agaaauaaguugaaccaua

SEQ ID NO: 4191833 - RNA, 14 nt, Yersinia pestis KIM
agaaauaauaucaa

SEQ ID NO: 4191834 - RNA, 16 nt, Yersinia pestis KIM
agaaauacagaaaaau

SEQ ID NO: 4191835 - RNA, 18 nt, Yersinia pestis KIM
agaaauacagaaaaauag

SEQ ID NO: 4191836 - RNA, 22 nt, Yersinia pestis KIM
agaaauaccugaguuaccuugu

SEQ ID NO: 4191837 - RNA, 15 nt, Yersinia pestis KIM
agaaauacuguuggu

SEQ ID NO: 4191838 - RNA, 22 nt, Yersinia pestis KIM
agaaauacuguugguaaauaac

SEQ ID NO: 4191839 - RNA, 16 nt, Yersinia pestis KIM
agaaauagcaccauua

SEQ ID NO: 4191840 - RNA, 13 nt, Yersinia pestis KIM
agaaaucugcagu

SEQ ID NO: 4191841 - RNA, 22 nt, Yersinia pestis KIM
agaaauucaacuugccugaaau

SEQ ID NO: 4191842 - RNA, 17 nt, Yersinia pestis KIM
agaaauuuaaaaacccu

SEQ ID NO: 4191843 - RNA, 13 nt, Yersinia pestis KIM
agaacaaauucau

SEQ ID NO: 4191844 - RNA, 21 nt, Yersinia pestis KIM
agaacaggcagaucguaaaga

SEQ ID NO: 4191845 - RNA, 22 nt, Yersinia pestis KIM
agaacaggcagaucguaaagac

SEQ ID NO: 4191846 - RNA, 14 nt, Yersinia pestis KIM
agaacaggcagcaa

SEQ ID NO: 4191847 - RNA, 21 nt, Yersinia pestis KIM
agaacaggcagcaaauaaagc

SEQ ID NO: 4191848 - RNA, 15 nt, Yersinia pestis KIM
agaaccggaauaaau

SEQ ID NO: 4191849 - RNA, 15 nt, Yersinia pestis KIM
agaaccguaaucuug

SEQ ID NO: 4191850 - RNA, 21 nt, Yersinia pestis KIM
agaaccuguuacaucagagcu

SEQ ID NO: 4191851 - RNA, 16 nt, Yersinia pestis KIM
agagagcacauuaaca

SEQ ID NO: 4191852 - RNA, 23 nt, Yersinia pestis KIM
agagagccaaaauggcguuguag

SEQ ID NO: 4191853 - RNA, 15 nt, Yersinia pestis KIM
agagauaaacccuaa

SEQ ID NO: 4191854 - RNA, 17 nt, Yersinia pestis KIM
agagauagccaauucua

SEQ ID NO: 4191855 - RNA, 22 nt, Yersinia pestis KIM
agagaucauguaguacuuaccu

SEQ ID NO: 4191856 - RNA, 19 nt, Yersinia pestis KIM
agagaucccgugccagauc

SEQ ID NO: 4191857 - RNA, 19 nt, Yersinia pestis KIM
agagauccggugaagaauu

SEQ ID NO: 4191858 - RNA, 15 nt, Yersinia pestis KIM
agagaucguaggcuu

SEQ ID NO: 4191859 - RNA, 23 nt, Yersinia pestis KIM
agagaucguaggcuuuuuacuuu

SEQ ID NO: 4191860 - RNA, 17 nt, Yersinia pestis KIM
agagaugaaacccagaa

SEQ ID NO: 4191861 - RNA, 21 nt, Yersinia pestis KIM
agagaugaaacccagaaugga

SEQ ID NO: 4191862 - RNA, 16 nt, Yersinia pestis KIM
agagaugcaaucuaac

SEQ ID NO: 4191863 - RNA, 13 nt, Yersinia pestis KIM
agagaugcagaga

SEQ ID NO: 4191864 - RNA, 18 nt, Yersinia pestis KIM
agagauguuauuugaaua

SEQ ID NO: 4191865 - RNA, 23 nt, Yersinia pestis KIM
agagauucguuuuuuuaucaaug

SEQ ID NO: 4191866 - RNA, 22 nt, Yersinia pestis KIM
agagauugccggauuccaccug

SEQ ID NO: 4191867 - RNA, 16 nt, Yersinia pestis KIM
agagcaaaacugggcu

SEQ ID NO: 4191868 - RNA, 20 nt, Yersinia pestis KIM
agagcaaaacugggcuugag

SEQ ID NO: 4191869 - RNA, 20 nt, Yersinia pestis KIM
agagcaaagucccggcuagg

SEQ ID NO: 4191870 - RNA, 16 nt, Yersinia pestis KIM
agagcagaaagcagca

SEQ ID NO: 4191871 - RNA, 21 nt, Yersinia pestis KIM
agagcaggcgcgaagaaagcg

SEQ ID NO: 4191872 - RNA, 20 nt, Yersinia pestis KIM
agagcauagacgaaggcacg

SEQ ID NO: 4191873 - RNA, 18 nt, Yersinia pestis KIM
agagccugaaucugaaug

SEQ ID NO: 4191874 - RNA, 18 nt, Yersinia pestis KIM
agagcgauugacugaaug

SEQ ID NO: 4191875 - RNA, 22 nt, Yersinia pestis KIM
agagcgauugacugaaugugaa

SEQ ID NO: 4191876 - RNA, 13 nt, Yersinia pestis KIM
agaggaaagagag

SEQ ID NO: 4191877 - RNA, 17 nt, Yersinia pestis KIM
agaggacucugcgcuca

SEQ ID NO: 4191878 - RNA, 16 nt, Yersinia pestis KIM
agaggcgcuagccucu

SEQ ID NO: 4191879 - RNA, 23 nt, Yersinia pestis KIM
agaggcugaaggcgcuccccugc

SEQ ID NO: 4191880 - RNA, 16 nt, Yersinia pestis KIM
agagggucacaagaau

SEQ ID NO: 4191881 - RNA, 18 nt, Yersinia pestis KIM
agagguaaugucaugaau

SEQ ID NO: 4191882 - RNA, 18 nt, Yersinia pestis KIM
agagguagacguaucaug

SEQ ID NO: 4191883 - RNA, 14 nt, Yersinia pestis KIM
agagguuaaauugu

SEQ ID NO: 4191884 - RNA, 15 nt, Yersinia pestis KIM
agagguuauugacaa

SEQ ID NO: 4191885 - RNA, 13 nt, Yersinia pestis KIM
agaguaaccaguc

SEQ ID NO: 4191886 - RNA, 16 nt, Yersinia pestis KIM
agaguaacggaggggc

SEQ ID NO: 4191887 - RNA, 17 nt, Yersinia pestis KIM
agaguacgcuuugguaa

SEQ ID NO: 4191888 - RNA, 20 nt, Yersinia pestis KIM
agaguacuaacgucaacaga

SEQ ID NO: 4191889 - RNA, 12 nt, Yersinia pestis KIM
agagucacagca

SEQ ID NO: 4191890 - RNA, 13 nt, Yersinia pestis KIM
agagucacagcau

SEQ ID NO: 4191891 - RNA, 20 nt, Yersinia pestis KIM
agagucgagcggggcaaaaa

SEQ ID NO: 4191892 - RNA, 18 nt, Yersinia pestis KIM
agagucuauuauauucaa

SEQ ID NO: 4191893 - RNA, 20 nt, Yersinia pestis KIM
agagucugucauggcacgcu

SEQ ID NO: 4191894 - RNA, 18 nt, Yersinia pestis KIM
agagugaccaaagcagua

SEQ ID NO: 4191895 - RNA, 12 nt, Yersinia pestis KIM
agagugcuggca

SEQ ID NO: 4191896 - RNA, 19 nt, Yersinia pestis KIM
agagugugggauucguuag

SEQ ID NO: 4191897 - RNA, 17 nt, Yersinia pestis KIM
agaguguucauaaauua

SEQ ID NO: 4191898 - RNA, 19 nt, Yersinia pestis KIM
agaguuaccgugagcagca

SEQ ID NO: 4191899 - RNA, 23 nt, Yersinia pestis KIM
agaguugauccgauaaacuucac

SEQ ID NO: 4191900 - RNA, 17 nt, Yersinia pestis KIM
agaguugcucacccauu

SEQ ID NO: 4191901 - RNA, 21 nt, Yersinia pestis KIM
agauaaaaacauuuaaauaug

SEQ ID NO: 4191902 - RNA, 23 nt, Yersinia pestis KIM
agauaaaaacauuuaaauaugaa

SEQ ID NO: 4191903 - RNA, 20 nt, Yersinia pestis KIM
agauaaaaauaaucaaugac

SEQ ID NO: 4191904 - RNA, 22 nt, Yersinia pestis KIM
agauaaacaaggcagaaguaug

SEQ ID NO: 4191905 - RNA, 20 nt, Yersinia pestis KIM
agauaaagcuugaucacaau

SEQ ID NO: 4191906 - RNA, 14 nt, Yersinia pestis KIM
agauaaauauuuaa

SEQ ID NO: 4191907 - RNA, 13 nt, Yersinia pestis KIM
agauaacaacaaa

SEQ ID NO: 4191908 - RNA, 23 nt, Yersinia pestis KIM
agauaaccacuucaauugccaug

SEQ ID NO: 4191909 - RNA, 16 nt, Yersinia pestis KIM
agauaagaucucagca

SEQ ID NO: 4191910 - RNA, 18 nt, Yersinia pestis KIM
agauaaggcauauacaac

SEQ ID NO: 4191911 - RNA, 19 nt, Yersinia pestis KIM
agauaaggggauugcugcc

SEQ ID NO: 4191912 - RNA, 20 nt, Yersinia pestis KIM
agauaauagaggguaaccgc

SEQ ID NO: 4191913 - RNA, 18 nt, Yersinia pestis KIM
agauaaucacugaggcca

SEQ ID NO: 4191914 - RNA, 13 nt, Yersinia pestis KIM
agauaaucgccaa

SEQ ID NO: 4191915 - RNA, 15 nt, Yersinia pestis KIM
agauaauguugaucu

SEQ ID NO: 4191916 - RNA, 14 nt, Yersinia pestis KIM
agauaauuauccau

SEQ ID NO: 4191917 - RNA, 15 nt, Yersinia pestis KIM
agauaauuauccauu

SEQ ID NO: 4191918 - RNA, 19 nt, Yersinia pestis KIM
agauaauuauccauuuucu

SEQ ID NO: 4191919 - RNA, 20 nt, Yersinia pestis KIM
agauaauuauccauuuucug

SEQ ID NO: 4191920 - RNA, 21 nt, Yersinia pestis KIM
agauacaauagauaacugaaa

SEQ ID NO: 4191921 - RNA, 13 nt, Yersinia pestis KIM
agauacaucaaug

SEQ ID NO: 4191922 - RNA, 14 nt, Yersinia pestis KIM
agauacaucaaugg

SEQ ID NO: 4191923 - RNA, 18 nt, Yersinia pestis KIM
agauacccuucucuuuau

SEQ ID NO: 4191924 - RNA, 17 nt, Yersinia pestis KIM
agauaccgaguucucac

SEQ ID NO: 4191925 - RNA, 19 nt, Yersinia pestis KIM
agauaccgaguucucacca

SEQ ID NO: 4191926 - RNA, 16 nt, Yersinia pestis KIM
agauaccgcaaccauu

SEQ ID NO: 4191927 - RNA, 13 nt, Yersinia pestis KIM
agauaccgccaau

SEQ ID NO: 4191928 - RNA, 13 nt, Yersinia pestis KIM
agauacucaugau

SEQ ID NO: 4191929 - RNA, 14 nt, Yersinia pestis KIM
agauacucggcaaa

SEQ ID NO: 4191930 - RNA, 22 nt, Yersinia pestis KIM
agauagagcaguaaguuaaaaa

SEQ ID NO: 4191931 - RNA, 15 nt, Yersinia pestis KIM
agauagcaaucaaua

SEQ ID NO: 4191932 - RNA, 23 nt, Yersinia pestis KIM
agauagcaaucaauaagcuacag

SEQ ID NO: 4191933 - RNA, 16 nt, Yersinia pestis KIM
agauagccggauuauu

SEQ ID NO: 4191934 - RNA, 21 nt, Yersinia pestis KIM
agauaggcacuaacugcgccu

SEQ ID NO: 4191935 - RNA, 18 nt, Yersinia pestis KIM
agauaggcgaaauugacu

SEQ ID NO: 4191936 - RNA, 15 nt, Yersinia pestis KIM
agauaguacuuagca

SEQ ID NO: 4191937 - RNA, 13 nt, Yersinia pestis KIM
agauaguuaccca

SEQ ID NO: 4191938 - RNA, 19 nt, Yersinia pestis KIM
agauaucagccagugcuaa

SEQ ID NO: 4191939 - RNA, 21 nt, Yersinia pestis KIM
agauaucgaaacacauacaaa

SEQ ID NO: 4191940 - RNA, 19 nt, Yersinia pestis KIM
agauaugccaggcaucauc

SEQ ID NO: 4191941 - RNA, 22 nt, Yersinia pestis KIM
agauaugccaggcaucaucugc

SEQ ID NO: 4191942 - RNA, 15 nt, Yersinia pestis KIM
agauauugcauggua

SEQ ID NO: 4191943 - RNA, 18 nt, Yersinia pestis KIM
agaucaaaagcagagaau

SEQ ID NO: 4191944 - RNA, 20 nt, Yersinia pestis KIM
agaucaaaagcagagaauga

SEQ ID NO: 4191945 - RNA, 14 nt, Yersinia pestis KIM
agaucaaacauaac

SEQ ID NO: 4191946 - RNA, 21 nt, Yersinia pestis KIM
agaucaagaaaacgcacgcgg

SEQ ID NO: 4191947 - RNA, 20 nt, Yersinia pestis KIM
agaucaauguuaucgccaac

SEQ ID NO: 4191948 - RNA, 23 nt, Yersinia pestis KIM
agaucacagacguuuaaauaagc

SEQ ID NO: 4191949 - RNA, 11 nt, Yersinia pestis KIM
agaucagugcc

SEQ ID NO: 4191950 - RNA, 14 nt, Yersinia pestis KIM
agaucagugccagu

SEQ ID NO: 4191951 - RNA, 16 nt, Yersinia pestis KIM
agaucagugccaguaa

SEQ ID NO: 4191952 - RNA, 15 nt, Yersinia pestis KIM
agaucaguucaguau

SEQ ID NO: 4191953 - RNA, 19 nt, Yersinia pestis KIM
agaucaucgggcauucacu

SEQ ID NO: 4191954 - RNA, 16 nt, Yersinia pestis KIM
agauccaccacaucau

SEQ ID NO: 4191955 - RNA, 13 nt, Yersinia pestis KIM
agauccagaacac

SEQ ID NO: 4191956 - RNA, 17 nt, Yersinia pestis KIM
agauccaguucagucca

SEQ ID NO: 4191957 - RNA, 18 nt, Yersinia pestis KIM
agaucccaagcaggaaac

SEQ ID NO: 4191958 - RNA, 22 nt, Yersinia pestis KIM
agauccguuuuuuuuaucagcc

SEQ ID NO: 4191959 - RNA, 23 nt, Yersinia pestis KIM
agauccugccgccucugcuccgg

SEQ ID NO: 4191960 - RNA, 20 nt, Yersinia pestis KIM
agauccuggcccgccagcau

SEQ ID NO: 4191961 - RNA, 22 nt, Yersinia pestis KIM
agauccuguggcuauugaccac

SEQ ID NO: 4191962 - RNA, 15 nt, Yersinia pestis KIM
agaucgcgucaucgg

SEQ ID NO: 4191963 - RNA, 14 nt, Yersinia pestis KIM
agaucgcucucacc

SEQ ID NO: 4191964 - RNA, 15 nt, Yersinia pestis KIM
agaucgcucucaccc

SEQ ID NO: 4191965 - RNA, 23 nt, Yersinia pestis KIM
agcacuacguguuuuucaucugu

SEQ ID NO: 4191966 - RNA, 17 nt, Yersinia pestis KIM
agcacuauuuucuacug

SEQ ID NO: 4191967 - RNA, 15 nt, Yersinia pestis KIM
agcacucauaaugcu

SEQ ID NO: 4191968 - RNA, 16 nt, Yersinia pestis KIM
agcacuccccgcccgu

SEQ ID NO: 4191969 - RNA, 19 nt, Yersinia pestis KIM
agcacucgguggcauaaac

SEQ ID NO: 4191970 - RNA, 11 nt, Yersinia pestis KIM
agcacugcccc

SEQ ID NO: 4191971 - RNA, 22 nt, Yersinia pestis KIM
agcacugcgcgaucccagaaug

SEQ ID NO: 4191972 - RNA, 16 nt, Yersinia pestis KIM
agcacuugcagauuau

SEQ ID NO: 4191973 - RNA, 18 nt, Yersinia pestis KIM
agcagaaagcagcagcuu

SEQ ID NO: 4191974 - RNA, 16 nt, Yersinia pestis KIM
agcagaacaaaacaag

SEQ ID NO: 4191975 - RNA, 21 nt, Yersinia pestis KIM
agcagacaacugacaacauca

SEQ ID NO: 4191976 - RNA, 21 nt, Yersinia pestis KIM
agcagagauccggugaagaau

SEQ ID NO: 4191977 - RNA, 18 nt, Yersinia pestis KIM
agcagagucgcaaaaaau

SEQ ID NO: 4191978 - RNA, 14 nt, Yersinia pestis KIM
agcagcaaacgccu

SEQ ID NO: 4191979 - RNA, 14 nt, Yersinia pestis KIM
agcagcaacuguuu

SEQ ID NO: 4191980 - RNA, 14 nt, Yersinia pestis KIM
agcagcccaacacu

SEQ ID NO: 4191981 - RNA, 12 nt, Yersinia pestis KIM
agcagccuguag

SEQ ID NO: 4191982 - RNA, 18 nt, Yersinia pestis KIM
agcagcgcauaaaaauac

SEQ ID NO: 4191983 - RNA, 18 nt, Yersinia pestis KIM
agcagcgcgguagcgaua

SEQ ID NO: 4191984 - RNA, 14 nt, Yersinia pestis KIM
agcagcucaaaauc

SEQ ID NO: 4191985 - RNA, 22 nt, Yersinia pestis KIM
agcaggcaguaaaauauugaua

SEQ ID NO: 4191986 - RNA, 14 nt, Yersinia pestis KIM
agcaggcugcaccc

SEQ ID NO: 4191987 - RNA, 20 nt, Yersinia pestis KIM
agcaggcugugaucugccag

SEQ ID NO: 4191988 - RNA, 23 nt, Yersinia pestis KIM
agcagggcuuucacaucuggguc

SEQ ID NO: 4191989 - RNA, 21 nt, Yersinia pestis KIM
agcagguucggcgcaaucaua

SEQ ID NO: 4191990 - RNA, 20 nt, Yersinia pestis KIM
agcaguaaacauuuugacuu

SEQ ID NO: 4191991 - RNA, 20 nt, Yersinia pestis KIM
agcaguaacguccaacugac

SEQ ID NO: 4191992 - RNA, 21 nt, Yersinia pestis KIM
agcaguaaguuaaaaagaaaa

SEQ ID NO: 4191993 - RNA, 17 nt, Yersinia pestis KIM
agcaguaauagcaaaaa

SEQ ID NO: 4191994 - RNA, 21 nt, Yersinia pestis KIM
agcaguaugucgucgcaugac

SEQ ID NO: 4191995 - RNA, 13 nt, Yersinia pestis KIM
agcagucagcaug

SEQ ID NO: 4191996 - RNA, 15 nt, Yersinia pestis KIM
agcagucugaagggu

SEQ ID NO: 4191997 - RNA, 19 nt, Yersinia pestis KIM
agcagucugagggccacuu

SEQ ID NO: 4191998 - RNA, 20 nt, Yersinia pestis KIM
agcagucugagggccacuuc

SEQ ID NO: 4191999 - RNA, 14 nt, Yersinia pestis KIM
agcagucugauauc

SEQ ID NO: 4192000 - RNA, 19 nt, Yersinia pestis KIM
agcagucugauuaccuucu

SEQ ID NO: 4192001 - RNA, 18 nt, Yersinia pestis KIM
agcagugauuucaguguc

SEQ ID NO: 4192002 - RNA, 23 nt, Yersinia pestis KIM
agcagugauuucuuacagugauc

SEQ ID NO: 4192003 - RNA, 21 nt, Yersinia pestis KIM
agcagugucagggcaauaaca

SEQ ID NO: 4192004 - RNA, 23 nt, Yersinia pestis KIM
agcagugucagggcaauaacaaa

SEQ ID NO: 4192005 - RNA, 18 nt, Yersinia pestis KIM
agcaguucuggcucugcg

SEQ ID NO: 4192006 - RNA, 20 nt, Yersinia pestis KIM
agcaguucuggcucugcgac

SEQ ID NO: 4192007 - RNA, 12 nt, Yersinia pestis KIM
agcauaaauauc

SEQ ID NO: 4192008 - RNA, 19 nt, Yersinia pestis KIM
agcauaaauaucagugaca

SEQ ID NO: 4192009 - RNA, 14 nt, Yersinia pestis KIM
agcauaaccagugc

SEQ ID NO: 4192010 - RNA, 20 nt, Yersinia pestis KIM
agcauaacgguuguauacaa

SEQ ID NO: 4192011 - RNA, 18 nt, Yersinia pestis KIM
agcauacguugccagcca

SEQ ID NO: 4192012 - RNA, 19 nt, Yersinia pestis KIM
agcauacguugccagccau

SEQ ID NO: 4192013 - RNA, 21 nt, Yersinia pestis KIM
agcauacguugccagccaucu

SEQ ID NO: 4192014 - RNA, 22 nt, Yersinia pestis KIM
agcauagaagaagaauugcaga

SEQ ID NO: 4192015 - RNA, 14 nt, Yersinia pestis KIM
agcauauaaaaaag

SEQ ID NO: 4192016 - RNA, 17 nt, Yersinia pestis KIM
agcauauccaacgcuuu

SEQ ID NO: 4192017 - RNA, 17 nt, Yersinia pestis KIM
agcauaucccuguuuuc

SEQ ID NO: 4192018 - RNA, 18 nt, Yersinia pestis KIM
agcauauucaguaacaac

SEQ ID NO: 4192019 - RNA, 15 nt, Yersinia pestis KIM
agcaucaaacuuccc

SEQ ID NO: 4192020 - RNA, 15 nt, Yersinia pestis KIM
agcaucaaauuauuu

SEQ ID NO: 4192021 - RNA, 19 nt, Yersinia pestis KIM
agcaucaaauuauuuuucc

SEQ ID NO: 4192022 - RNA, 15 nt, Yersinia pestis KIM
agcaucaacauggau

SEQ ID NO: 4192023 - RNA, 20 nt, Yersinia pestis KIM
agcaucaacauuguccugca

SEQ ID NO: 4192024 - RNA, 13 nt, Yersinia pestis KIM
agcaucaauaacg

SEQ ID NO: 4192025 - RNA, 22 nt, Yersinia pestis KIM
agcaucaauaacgguaaggccg

SEQ ID NO: 4192026 - RNA, 17 nt, Yersinia pestis KIM
agcaucaauaucgccac

SEQ ID NO: 4192027 - RNA, 12 nt, Yersinia pestis KIM
agcaucaccaaa

SEQ ID NO: 4192028 - RNA, 18 nt, Yersinia pestis KIM
agcaucaguaauuuuuug

SEQ ID NO: 4192029 - RNA, 15 nt, Yersinia pestis KIM
agcaucauccagcuc

SEQ ID NO: 4192030 - RNA, 15 nt, Yersinia pestis KIM
agcauccagcucaua

SEQ ID NO: 4192031 - RNA, 19 nt, Yersinia pestis KIM
agcauccaguucauggcca

SEQ ID NO: 4192032 - RNA, 18 nt, Yersinia pestis KIM
agcaucgucauugccagu

SEQ ID NO: 4192033 - RNA, 20 nt, Yersinia pestis KIM
agcaucuccgcgaccacaug

SEQ ID NO: 4192034 - RNA, 23 nt, Yersinia pestis KIM
agcaucuuuaauaaauuuucuaa

SEQ ID NO: 4192035 - RNA, 14 nt, Yersinia pestis KIM
agcaugaauggcuu

SEQ ID NO: 4192036 - RNA, 20 nt, Yersinia pestis KIM
agcaugauggucaucauaua

SEQ ID NO: 4192037 - RNA, 13 nt, Yersinia pestis KIM
agcaugcauccau

SEQ ID NO: 4192038 - RNA, 13 nt, Yersinia pestis KIM
agcaugcccagcc

SEQ ID NO: 4192039 - RNA, 19 nt, Yersinia pestis KIM
agcaugcccagccucugga

SEQ ID NO: 4192040 - RNA, 15 nt, Yersinia pestis KIM
agcauggaagauauc

SEQ ID NO: 4192041 - RNA, 14 nt, Yersinia pestis KIM
agcaugggcuugca

SEQ ID NO: 4192042 - RNA, 19 nt, Yersinia pestis KIM
agcauguggaagauauucu

SEQ ID NO: 4192043 - RNA, 17 nt, Yersinia pestis KIM
agcaugugguuaccauc

SEQ ID NO: 4192044 - RNA, 13 nt, Yersinia pestis KIM
agcauuaaacaga

SEQ ID NO: 4192045 - RNA, 21 nt, Yersinia pestis KIM
agcauucaggcuuuuuucuag

SEQ ID NO: 4192046 - RNA, 24 nt, Yersinia pestis KIM
agcauugaguacgcuaagacauua

SEQ ID NO: 4192047 - RNA, 15 nt, Yersinia pestis KIM
agcauuuaucauauu

SEQ ID NO: 4192048 - RNA, 13 nt, Yersinia pestis KIM
agcauuucaggau

SEQ ID NO: 4192049 - RNA, 23 nt, Yersinia pestis KIM
agcauuuuagugaugauauuuau

SEQ ID NO: 4192050 - RNA, 12 nt, Yersinia pestis KIM
agcauuuuguca

SEQ ID NO: 4192051 - RNA, 19 nt, Yersinia pestis KIM
agcauuuuucggugaacca

SEQ ID NO: 4192052 - RNA, 14 nt, Yersinia pestis KIM
agccaaaacagccu

SEQ ID NO: 4192053 - RNA, 14 nt, Yersinia pestis KIM
agccaaaauaauca

SEQ ID NO: 4192054 - RNA, 14 nt, Yersinia pestis KIM
agccaaaauaauua

SEQ ID NO: 4192055 - RNA, 22 nt, Yersinia pestis KIM
agccaaauacccuaauucagau

SEQ ID NO: 4192056 - RNA, 11 nt, Yersinia pestis KIM
agccaaaugag

SEQ ID NO: 4192057 - RNA, 15 nt, Yersinia pestis KIM
agccaacgauaauga

SEQ ID NO: 4192058 - RNA, 21 nt, Yersinia pestis KIM
agccaacuccuugaauauuuu

SEQ ID NO: 4192059 - RNA, 16 nt, Yersinia pestis KIM
agccaagaucccaagc

SEQ ID NO: 4192060 - RNA, 13 nt, Yersinia pestis KIM
agccaauaauaua

SEQ ID NO: 4192061 - RNA, 20 nt, Yersinia pestis KIM
agccaauacaggcaucggua

SEQ ID NO: 4192062 - RNA, 17 nt, Yersinia pestis KIM
agccaauccccagaagc

SEQ ID NO: 4192063 - RNA, 13 nt, Yersinia pestis KIM
agccaaucucuug

SEQ ID NO: 4192064 - RNA, 16 nt, Yersinia pestis KIM
agccaauggccacugc

SEQ ID NO: 4192065 - RNA, 23 nt, Yersinia pestis KIM
agccacaaaaguucacaugauga

SEQ ID NO: 4192066 - RNA, 17 nt, Yersinia pestis KIM
agccacaacgcacugaa

SEQ ID NO: 4192067 - RNA, 18 nt, Yersinia pestis KIM
agccacagucauuugaac

SEQ ID NO: 4192068 - RNA, 16 nt, Yersinia pestis KIM
agccaccagaaucauc

SEQ ID NO: 4192069 - RNA, 11 nt, Yersinia pestis KIM
agccaccagau

SEQ ID NO: 4192070 - RNA, 14 nt, Yersinia pestis KIM
agccaccagccaac

SEQ ID NO: 4192071 - RNA, 17 nt, Yersinia pestis KIM
agccaccaguuuauuuu

SEQ ID NO: 4192072 - RNA, 15 nt, Yersinia pestis KIM
agccaccccguggca

SEQ ID NO: 4192073 - RNA, 14 nt, Yersinia pestis KIM
agccaccgcacacu

SEQ ID NO: 4192074 - RNA, 15 nt, Yersinia pestis KIM
agccaccgcauucca

SEQ ID NO: 4192075 - RNA, 20 nt, Yersinia pestis KIM
agccaccgcucgucacacug

SEQ ID NO: 4192076 - RNA, 18 nt, Yersinia pestis KIM
agccacgucugcggauca

SEQ ID NO: 4192077 - RNA, 13 nt, Yersinia pestis KIM
agccacucaacug

SEQ ID NO: 4192078 - RNA, 13 nt, Yersinia pestis KIM
agccacucacaua

SEQ ID NO: 4192079 - RNA, 15 nt, Yersinia pestis KIM
agccacugggcuacc

SEQ ID NO: 4192080 - RNA, 13 nt, Yersinia pestis KIM
agcgagggccuuu

SEQ ID NO: 4192081 - RNA, 21 nt, Yersinia pestis KIM
agcgagggccuuucugaacaa

SEQ ID NO: 4192082 - RNA, 20 nt, Yersinia pestis KIM
agcgauagaguugauaaaca

SEQ ID NO: 4192083 - RNA, 20 nt, Yersinia pestis KIM
agcgauagauccacuccagu

SEQ ID NO: 4192084 - RNA, 17 nt, Yersinia pestis KIM
agcgauaucguuaucaa

SEQ ID NO: 4192085 - RNA, 18 nt, Yersinia pestis KIM
agcgaucaauacaccaga

SEQ ID NO: 4192086 - RNA, 21 nt, Yersinia pestis KIM
agcgaucaccucuugcauacu

SEQ ID NO: 4192087 - RNA, 14 nt, Yersinia pestis KIM
agcgaucagcaacg

SEQ ID NO: 4192088 - RNA, 20 nt, Yersinia pestis KIM
agcgaucucauuuagcauua

SEQ ID NO: 4192089 - RNA, 15 nt, Yersinia pestis KIM
agcgauuuuaaaaaa

SEQ ID NO: 4192090 - RNA, 20 nt, Yersinia pestis KIM
agcgauuuuaaaaaaucagu

SEQ ID NO: 4192091 - RNA, 16 nt, Yersinia pestis KIM
agcgcaauucagccuc

SEQ ID NO: 4192092 - RNA, 12 nt, Yersinia pestis KIM
agcgcacugcau

SEQ ID NO: 4192093 - RNA, 16 nt, Yersinia pestis KIM
agcgcacugucugagc

SEQ ID NO: 4192094 - RNA, 14 nt, Yersinia pestis KIM
agcgcagugcucau

SEQ ID NO: 4192095 - RNA, 17 nt, Yersinia pestis KIM
agcgcauaaaaauacau

SEQ ID NO: 4192096 - RNA, 17 nt, Yersinia pestis KIM
agcgcaucggaaaucug

SEQ ID NO: 4192097 - RNA, 13 nt, Yersinia pestis KIM
agcgccagcaauu

SEQ ID NO: 4192098 - RNA, 17 nt, Yersinia pestis KIM
agcgccaugcgcuuuca

SEQ ID NO: 4192099 - RNA, 17 nt, Yersinia pestis KIM
agcgcccgcaguuuauc

SEQ ID NO: 4192100 - RNA, 18 nt, Yersinia pestis KIM
agcgcccggcugaccugu

SEQ ID NO: 4192101 - RNA, 23 nt, Yersinia pestis KIM
agcgcccuugccagugcaauccg

SEQ ID NO: 4192102 - RNA, 18 nt, Yersinia pestis KIM
agcgccgacacccagcca

SEQ ID NO: 4192103 - RNA, 22 nt, Yersinia pestis KIM
agcgccgauauacaccccauca

SEQ ID NO: 4192104 - RNA, 23 nt, Yersinia pestis KIM
agcgccgauauacaccccaucag

SEQ ID NO: 4192105 - RNA, 22 nt, Yersinia pestis KIM
agcgccgauggugugcagcaag

SEQ ID NO: 4192106 - RNA, 22 nt, Yersinia pestis KIM
agcgccgugcauaauggacgaa

SEQ ID NO: 4192107 - RNA, 20 nt, Yersinia pestis KIM
agcgccucaguaucuuucca

SEQ ID NO: 4192108 - RNA, 18 nt, Yersinia pestis KIM
agcgccuguuguuuuuca

SEQ ID NO: 4192109 - RNA, 15 nt, Yersinia pestis KIM
agcgccuuccuuuua

SEQ ID NO: 4192110 - RNA, 18 nt, Yersinia pestis KIM
agcgcggcuucagcaccu

SEQ ID NO: 4192111 - RNA, 20 nt, Yersinia pestis KIM
agcgcgggugaucgucauca

SEQ ID NO: 4192112 - RNA, 22 nt, Yersinia pestis KIM
agcgcgguaacuaacaucagcg

SEQ ID NO: 4192113 - RNA, 16 nt, Yersinia pestis KIM
agcgcguaaugccugg

SEQ ID NO: 4192114 - RNA, 21 nt, Yersinia pestis KIM
agcgcuauguuggcaaauaau

SEQ ID NO: 4192115 - RNA, 14 nt, Yersinia pestis KIM
agcgcucaaauacg

SEQ ID NO: 4192116 - RNA, 14 nt, Yersinia pestis KIM
agcgcucagcgcca

SEQ ID NO: 4192117 - RNA, 17 nt, Yersinia pestis KIM
agcgcucauagcaaaac

SEQ ID NO: 4192118 - RNA, 14 nt, Yersinia pestis KIM
agcgcuguucaaaa

SEQ ID NO: 4192119 - RNA, 15 nt, Yersinia pestis KIM
agcgcuuggcucugg

SEQ ID NO: 4192120 - RNA, 15 nt, Yersinia pestis KIM
agcgcuuuaggcaag

SEQ ID NO: 4192121 - RNA, 20 nt, Yersinia pestis KIM
agcggaucccaaaagaaaau

SEQ ID NO: 4192122 - RNA, 21 nt, Yersinia pestis KIM
agcggcaaauagagcaccaaa

SEQ ID NO: 4192123 - RNA, 16 nt, Yersinia pestis KIM
agcggccaacauaauc

SEQ ID NO: 4192124 - RNA, 17 nt, Yersinia pestis KIM
agcggccauuaggcgug

SEQ ID NO: 4192125 - RNA, 17 nt, Yersinia pestis KIM
agcggcguucagcaaua

SEQ ID NO: 4192126 - RNA, 14 nt, Yersinia pestis KIM
agcggcuagcagca

SEQ ID NO: 4192127 - RNA, 21 nt, Yersinia pestis KIM
agcggcuuaaugauggccgcu

SEQ ID NO: 4192128 - RNA, 23 nt, Yersinia pestis KIM
agcgggaauacguugagauaauc

SEQ ID NO: 4192129 - RNA, 16 nt, Yersinia pestis KIM
agcgggccagcaacca

SEQ ID NO: 4192130 - RNA, 14 nt, Yersinia pestis KIM
agcgggcggcaaug

SEQ ID NO: 4192131 - RNA, 15 nt, Yersinia pestis KIM
agcgggcggcagaua

SEQ ID NO: 4192132 - RNA, 15 nt, Yersinia pestis KIM
agcggguuaccagua

SEQ ID NO: 4192133 - RNA, 19 nt, Yersinia pestis KIM
agcggguuggcaucaaauu

SEQ ID NO: 4192134 - RNA, 17 nt, Yersinia pestis KIM
agcgguaucccacugga

SEQ ID NO: 4192135 - RNA, 15 nt, Yersinia pestis KIM
agcgguuuguugcua

SEQ ID NO: 4192136 - RNA, 22 nt, Yersinia pestis KIM
agcgguuuuuucuuucuucagc

SEQ ID NO: 4192137 - RNA, 22 nt, Yersinia pestis KIM
agcguaacuccuuuguuauuuc

SEQ ID NO: 4192138 - RNA, 14 nt, Yersinia pestis KIM
agcguacacgcagu

SEQ ID NO: 4192139 - RNA, 21 nt, Yersinia pestis KIM
agcguacacgcaguacgugac

SEQ ID NO: 4192140 - RNA, 16 nt, Yersinia pestis KIM
agcguacaucagggug

SEQ ID NO: 4192141 - RNA, 15 nt, Yersinia pestis KIM
agcguagacaaugac

SEQ ID NO: 4192142 - RNA, 21 nt, Yersinia pestis KIM
agcguagcaggaggcccaucu

SEQ ID NO: 4192143 - RNA, 18 nt, Yersinia pestis KIM
agcguagccguuaaauau

SEQ ID NO: 4192144 - RNA, 18 nt, Yersinia pestis KIM
agcguaggcaacuaagcu

SEQ ID NO: 4192145 - RNA, 19 nt, Yersinia pestis KIM
agcguaggcaacuaagcug

SEQ ID NO: 4192146 - RNA, 22 nt, Yersinia pestis KIM
agcguaggcaacuaagcugccu

SEQ ID NO: 4192147 - RNA, 18 nt, Yersinia pestis KIM
agcguagguaacuaagcu

SEQ ID NO: 4192148 - RNA, 19 nt, Yersinia pestis KIM
agcguagguaacuaagcug

SEQ ID NO: 4192149 - RNA, 20 nt, Yersinia pestis KIM
agcguagguaacuaagcugc

SEQ ID NO: 4192150 - RNA, 22 nt, Yersinia pestis KIM
agcguagguaacuaagcugccu

SEQ ID NO: 4192151 - RNA, 18 nt, Yersinia pestis KIM
agcguauugccuucuccu

SEQ ID NO: 4192152 - RNA, 16 nt, Yersinia pestis KIM
agcgucaacccagaca

SEQ ID NO: 4192153 - RNA, 16 nt, Yersinia pestis KIM
agcgucacggaaagca

SEQ ID NO: 4192154 - RNA, 21 nt, Yersinia pestis KIM
agcgucaugauagacagcaaa

SEQ ID NO: 4192155 - RNA, 20 nt, Yersinia pestis KIM
agcgucauggucucacugcg

SEQ ID NO: 4192156 - RNA, 20 nt, Yersinia pestis KIM
agcgucccugauggggcaau

SEQ ID NO: 4192157 - RNA, 21 nt, Yersinia pestis KIM
agcguccugugcaaagugcug

SEQ ID NO: 4192158 - RNA, 21 nt, Yersinia pestis KIM
agcgucuucugugauuuguca

SEQ ID NO: 4192159 - RNA, 17 nt, Yersinia pestis KIM
agcgugauuuuuauauu

SEQ ID NO: 4192160 - RNA, 20 nt, Yersinia pestis KIM
agcgugcgguagaccaccaa

SEQ ID NO: 4192161 - RNA, 20 nt, Yersinia pestis KIM
agcgugguauaaauggcacu

SEQ ID NO: 4192162 - RNA, 22 nt, Yersinia pestis KIM
agcgugguauaaauggcacugg

SEQ ID NO: 4192163 - RNA, 19 nt, Yersinia pestis KIM
agcguuaucaauuaacuac

SEQ ID NO: 4192164 - RNA, 15 nt, Yersinia pestis KIM
agcguuauuuuugua

SEQ ID NO: 4192165 - RNA, 14 nt, Yersinia pestis KIM
agcguucaucgccc

SEQ ID NO: 4192166 - RNA, 18 nt, Yersinia pestis KIM
agcguugacuuucuaagc

SEQ ID NO: 4192167 - RNA, 16 nt, Yersinia pestis KIM
agcguuuaaauacccg

SEQ ID NO: 4192168 - RNA, 14 nt, Yersinia pestis KIM
agcguuuacucgcu

SEQ ID NO: 4192169 - RNA, 17 nt, Yersinia pestis KIM
agcguuuacuuuaaauu

SEQ ID NO: 4192170 - RNA, 16 nt, Yersinia pestis KIM
agcuaacaccgcugua

SEQ ID NO: 4192171 - RNA, 14 nt, Yersinia pestis KIM
agcuaacagugacc

SEQ ID NO: 4192172 - RNA, 15 nt, Yersinia pestis KIM
agcuaaccuuaacua

SEQ ID NO: 4192173 - RNA, 13 nt, Yersinia pestis KIM
agcuaagcucuuc

SEQ ID NO: 4192174 - RNA, 17 nt, Yersinia pestis KIM
agcuaauaauuguucau

SEQ ID NO: 4192175 - RNA, 22 nt, Yersinia pestis KIM
agcuaaucauugcaaugcuacc

SEQ ID NO: 4192176 - RNA, 20 nt, Yersinia pestis KIM
agcuaaugcucgcucaucau

SEQ ID NO: 4192177 - RNA, 23 nt, Yersinia pestis KIM
agcuacagcaccauuaucuucca

SEQ ID NO: 4192178 - RNA, 17 nt, Yersinia pestis KIM
agcuacgccaagagggc

SEQ ID NO: 4192179 - RNA, 17 nt, Yersinia pestis KIM
agcuacggccuguacca

SEQ ID NO: 4192180 - RNA, 21 nt, Yersinia pestis KIM
agcuacgggcaaacuccucca

SEQ ID NO: 4192181 - RNA, 20 nt, Yersinia pestis KIM
agcuacuaauggagagaugu

SEQ ID NO: 4192182 - RNA, 13 nt, Yersinia pestis KIM
agcuaucauuaaa

SEQ ID NO: 4192183 - RNA, 15 nt, Yersinia pestis KIM
agcuauccaccaucg

SEQ ID NO: 4192184 - RNA, 16 nt, Yersinia pestis KIM
agcuauccaccaucgg

SEQ ID NO: 4192185 - RNA, 13 nt, Yersinia pestis KIM
agcuaucuugccu

SEQ ID NO: 4192186 - RNA, 19 nt, Yersinia pestis KIM
agcuaugcaguuaagguua

SEQ ID NO: 4192187 - RNA, 20 nt, Yersinia pestis KIM
agcuauugcaacgcuugcag

SEQ ID NO: 4192188 - RNA, 17 nt, Yersinia pestis KIM
agcuauuggcugauuca

SEQ ID NO: 4192189 - RNA, 12 nt, Yersinia pestis KIM
agcuauuucuug

SEQ ID NO: 4192190 - RNA, 19 nt, Yersinia pestis KIM
agcuauuucuugcagugcu

SEQ ID NO: 4192191 - RNA, 13 nt, Yersinia pestis KIM
agcucaagaauuu

SEQ ID NO: 4192192 - RNA, 21 nt, Yersinia pestis KIM
agcucaauuugguauuggcua

SEQ ID NO: 4192193 - RNA, 14 nt, Yersinia pestis KIM
agcucauauaauca

SEQ ID NO: 4192194 - RNA, 16 nt, Yersinia pestis KIM
aggcauauacaaccuc

SEQ ID NO: 4192195 - RNA, 17 nt, Yersinia pestis KIM
aggcauauacaaccuca

SEQ ID NO: 4192196 - RNA, 19 nt, Yersinia pestis KIM
aggcauccacaucuugcgc

SEQ ID NO: 4192197 - RNA, 17 nt, Yersinia pestis KIM
aggcaucucugaagccu

SEQ ID NO: 4192198 - RNA, 13 nt, Yersinia pestis KIM
aggcaucugccac

SEQ ID NO: 4192199 - RNA, 19 nt, Yersinia pestis KIM
aggcauuuuuguugaaggc

SEQ ID NO: 4192200 - RNA, 18 nt, Yersinia pestis KIM
aggccaauagcccaaaua

SEQ ID NO: 4192201 - RNA, 15 nt, Yersinia pestis KIM
aggccaauuuggcca

SEQ ID NO: 4192202 - RNA, 23 nt, Yersinia pestis KIM
aggccagcacuaagugcuggccu

SEQ ID NO: 4192203 - RNA, 17 nt, Yersinia pestis KIM
aggccagcgccccauca

SEQ ID NO: 4192204 - RNA, 14 nt, Yersinia pestis KIM
aggccaggcaauaa

SEQ ID NO: 4192205 - RNA, 14 nt, Yersinia pestis KIM
aggccauaaucugc

SEQ ID NO: 4192206 - RNA, 14 nt, Yersinia pestis KIM
aggcccacugcaac

SEQ ID NO: 4192207 - RNA, 15 nt, Yersinia pestis KIM
aggcccagcagugcu

SEQ ID NO: 4192208 - RNA, 18 nt, Yersinia pestis KIM
aggcccauggacgggcca

SEQ ID NO: 4192209 - RNA, 13 nt, Yersinia pestis KIM
aggccccaucaua

SEQ ID NO: 4192210 - RNA, 16 nt, Yersinia pestis KIM
aggccccucggggccu

SEQ ID NO: 4192211 - RNA, 14 nt, Yersinia pestis KIM
aggcccgcuaucac

SEQ ID NO: 4192212 - RNA, 15 nt, Yersinia pestis KIM
aggcccgcuaucacu

SEQ ID NO: 4192213 - RNA, 19 nt, Yersinia pestis KIM
aggcccgcuaucacuagcg

SEQ ID NO: 4192214 - RNA, 16 nt, Yersinia pestis KIM
aggcccgcuucccuac

SEQ ID NO: 4192215 - RNA, 22 nt, Yersinia pestis KIM
aggcccgcuucccuacauaaaa

SEQ ID NO: 4192216 - RNA, 22 nt, Yersinia pestis KIM
aggcccgcuuuaaucagcccuu

SEQ ID NO: 4192217 - RNA, 23 nt, Yersinia pestis KIM
aggcccugguugcagcacgccag

SEQ ID NO: 4192218 - RNA, 21 nt, Yersinia pestis KIM
aggccgaucaacaggccaccu

SEQ ID NO: 4192219 - RNA, 21 nt, Yersinia pestis KIM
aggccgccaucaucaucaaua

SEQ ID NO: 4192220 - RNA, 11 nt, Yersinia pestis KIM
aggccgcgaau

SEQ ID NO: 4192221 - RNA, 13 nt, Yersinia pestis KIM
aggccuaaacccc

SEQ ID NO: 4192222 - RNA, 20 nt, Yersinia pestis KIM
aggccuagcccaguaccgcu

SEQ ID NO: 4192223 - RNA, 18 nt, Yersinia pestis KIM
aggccuauaacccccaca

SEQ ID NO: 4192224 - RNA, 15 nt, Yersinia pestis KIM
aggccuucugggccg

SEQ ID NO: 4192225 - RNA, 13 nt, Yersinia pestis KIM
aggcgacugccca

SEQ ID NO: 4192226 - RNA, 15 nt, Yersinia pestis KIM
aggcgaguuucccuu

SEQ ID NO: 4192227 - RNA, 17 nt, Yersinia pestis KIM
aggcgaugcaaggaagu

SEQ ID NO: 4192228 - RNA, 15 nt, Yersinia pestis KIM
aggcgauuaaacguc

SEQ ID NO: 4192229 - RNA, 19 nt, Yersinia pestis KIM
aggcgccaagauagaacca

SEQ ID NO: 4192230 - RNA, 17 nt, Yersinia pestis KIM
aggcgcuagucucucuc

SEQ ID NO: 4192231 - RNA, 15 nt, Yersinia pestis KIM
aggcgcuguugcaug

SEQ ID NO: 4192232 - RNA, 22 nt, Yersinia pestis KIM
aggcggcaucacuaugggggau

SEQ ID NO: 4192233 - RNA, 23 nt, Yersinia pestis KIM
aggcggcccgcagauaauccccu

SEQ ID NO: 4192234 - RNA, 14 nt, Yersinia pestis KIM
aggcggugaacagu

SEQ ID NO: 4192235 - RNA, 21 nt, Yersinia pestis KIM
aggcggugagggagucaggga

SEQ ID NO: 4192236 - RNA, 22 nt, Yersinia pestis KIM
aggcggugagggagucagggag

SEQ ID NO: 4192237 - RNA, 15 nt, Yersinia pestis KIM
aggcgguuaucugga

SEQ ID NO: 4192238 - RNA, 13 nt, Yersinia pestis KIM
aggcgugggcuaa

SEQ ID NO: 4192239 - RNA, 13 nt, Yersinia pestis KIM
aggcguuacccac

SEQ ID NO: 4192240 - RNA, 18 nt, Yersinia pestis KIM
aggcguuuccccuugcug

SEQ ID NO: 4192241 - RNA, 23 nt, Yersinia pestis KIM
aggcuaaagacuucagcccaugg

SEQ ID NO: 4192242 - RNA, 20 nt, Yersinia pestis KIM
aggcuaauacaugcuggcgg

SEQ ID NO: 4192243 - RNA, 23 nt, Yersinia pestis KIM
aggcuaaugugaugaaacuaaaa

SEQ ID NO: 4192244 - RNA, 20 nt, Yersinia pestis KIM
aggcuaucacgauaaucaau

SEQ ID NO: 4192245 - RNA, 17 nt, Yersinia pestis KIM
aggcucagcauggaaga

SEQ ID NO: 4192246 - RNA, 24 nt, Yersinia pestis KIM
aggcucagcgguacuuuuugugau

SEQ ID NO: 4192247 - RNA, 18 nt, Yersinia pestis KIM
aggcucauuaauccugau

SEQ ID NO: 4192248 - RNA, 18 nt, Yersinia pestis KIM
aggcucccaaggguauaa

SEQ ID NO: 4192249 - RNA, 19 nt, Yersinia pestis KIM
aggcuccuccuuggggccu

SEQ ID NO: 4192250 - RNA, 22 nt, Yersinia pestis KIM
aggcucucauaucccccccaag

SEQ ID NO: 4192251 - RNA, 13 nt, Yersinia pestis KIM
aggcucuguuacc

SEQ ID NO: 4192252 - RNA, 19 nt, Yersinia pestis KIM
aggcugaaggcgcuccccu

SEQ ID NO: 4192253 - RNA, 16 nt, Yersinia pestis KIM
aggcugagguugauga

SEQ ID NO: 4192254 - RNA, 16 nt, Yersinia pestis KIM
aggcugaugccaucaa

SEQ ID NO: 4192255 - RNA, 16 nt, Yersinia pestis KIM
aggcugauuaauauca

SEQ ID NO: 4192256 - RNA, 17 nt, Yersinia pestis KIM
aggcuggccacuuccac

SEQ ID NO: 4192257 - RNA, 19 nt, Yersinia pestis KIM
aggcuggggguucaguaaa

SEQ ID NO: 4192258 - RNA, 13 nt, Yersinia pestis KIM
aggcugucaggaa

SEQ ID NO: 4192259 - RNA, 14 nt, Yersinia pestis KIM
aggcuuagcgacac

SEQ ID NO: 4192260 - RNA, 21 nt, Yersinia pestis KIM
aggcuuauauuuaugcuugau

SEQ ID NO: 4192261 - RNA, 23 nt, Yersinia pestis KIM
aggcuucuuaauucccagccacu

SEQ ID NO: 4192262 - RNA, 17 nt, Yersinia pestis KIM
aggcuugaaguucucau

SEQ ID NO: 4192263 - RNA, 20 nt, Yersinia pestis KIM
aggcuugagguuauugacaa

SEQ ID NO: 4192264 - RNA, 15 nt, Yersinia pestis KIM
aggcuuggcgggcug

SEQ ID NO: 4192265 - RNA, 21 nt, Yersinia pestis KIM
aggcuuggguaucuggagcca

SEQ ID NO: 4192266 - RNA, 14 nt, Yersinia pestis KIM
aggcuuugguuuug

SEQ ID NO: 4192267 - RNA, 21 nt, Yersinia pestis KIM
aggcuuuuguuaauucaccua

SEQ ID NO: 4192268 - RNA, 23 nt, Yersinia pestis KIM
agggaaagguagaucggggacag

SEQ ID NO: 4192269 - RNA, 18 nt, Yersinia pestis KIM
agggaacggauagagggc

SEQ ID NO: 4192270 - RNA, 21 nt, Yersinia pestis KIM
agggaaguuucuuacuaaaau

SEQ ID NO: 4192271 - RNA, 17 nt, Yersinia pestis KIM
agggaaucacgcguuca

SEQ ID NO: 4192272 - RNA, 23 nt, Yersinia pestis KIM
agggacaacaucauauauuaaau

SEQ ID NO: 4192273 - RNA, 23 nt, Yersinia pestis KIM
agggagagucuauuauauucaau

SEQ ID NO: 4192274 - RNA, 19 nt, Yersinia pestis KIM
agggagccaauagaggcuc

SEQ ID NO: 4192275 - RNA, 13 nt, Yersinia pestis KIM
agggagccgcccu

SEQ ID NO: 4192276 - RNA, 12 nt, Yersinia pestis KIM
agggagggcgcg

SEQ ID NO: 4192277 - RNA, 16 nt, Yersinia pestis KIM
agggagucagggagua

SEQ ID NO: 4192278 - RNA, 16 nt, Yersinia pestis KIM
agggagucagggaguc

SEQ ID NO: 4192279 - RNA, 15 nt, Yersinia pestis KIM
agggaugaaaagagc

SEQ ID NO: 4192280 - RNA, 13 nt, Yersinia pestis KIM
agggauucuguca

SEQ ID NO: 4192281 - RNA, 19 nt, Yersinia pestis KIM
agggauucugucagagcua

SEQ ID NO: 4192282 - RNA, 14 nt, Yersinia pestis KIM
agggcaaucaggaa

SEQ ID NO: 4192283 - RNA, 17 nt, Yersinia pestis KIM
agggcagacggggagga

SEQ ID NO: 4192284 - RNA, 16 nt, Yersinia pestis KIM
agggcagcuaaccccu

SEQ ID NO: 4192285 - RNA, 22 nt, Yersinia pestis KIM
agggccacccugccaaaaaaua

SEQ ID NO: 4192286 - RNA, 20 nt, Yersinia pestis KIM
agggccacuucgguggcccu

SEQ ID NO: 4192287 - RNA, 16 nt, Yersinia pestis KIM
agggccuacguucagg

SEQ ID NO: 4192288 - RNA, 23 nt, Yersinia pestis KIM
agggccugcaaacggcucaucac

SEQ ID NO: 4192289 - RNA, 20 nt, Yersinia pestis KIM
agggcgauagcccuacuggc

SEQ ID NO: 4192290 - RNA, 14 nt, Yersinia pestis KIM
agggcgauggcaac

SEQ ID NO: 4192291 - RNA, 13 nt, Yersinia pestis KIM
agggcgcagcccc

SEQ ID NO: 4192292 - RNA, 20 nt, Yersinia pestis KIM
agggcgcauguaaauuaaua

SEQ ID NO: 4192293 - RNA, 21 nt, Yersinia pestis KIM
agggcgcuuguuuuacaauua

SEQ ID NO: 4192294 - RNA, 16 nt, Yersinia pestis KIM
agggcgcuuucugggu

SEQ ID NO: 4192295 - RNA, 17 nt, Yersinia pestis KIM
agggcguuaccgaggcu

SEQ ID NO: 4192296 - RNA, 14 nt, Yersinia pestis KIM
agggcugacagagc

SEQ ID NO: 4192297 - RNA, 22 nt, Yersinia pestis KIM
agggcuguuauccggguggcuu

SEQ ID NO: 4192298 - RNA, 23 nt, Yersinia pestis KIM
aggggaauauaaugauauucaua

SEQ ID NO: 4192299 - RNA, 14 nt, Yersinia pestis KIM
aggggauagggggc

SEQ ID NO: 4192300 - RNA, 19 nt, Yersinia pestis KIM
aggggcaauaauugcaccc

SEQ ID NO: 4192301 - RNA, 20 nt, Yersinia pestis KIM
aggggcacaauucugaaagu

SEQ ID NO: 4192302 - RNA, 17 nt, Yersinia pestis KIM
aggggcuuagaagagau

SEQ ID NO: 4192303 - RNA, 20 nt, Yersinia pestis KIM
aggggcuuagaagagauaga

SEQ ID NO: 4192304 - RNA, 18 nt, Yersinia pestis KIM
agggggaaacgaacaggg

SEQ ID NO: 4192305 - RNA, 19 nt, Yersinia pestis KIM
agggggaaacgaacaggga

SEQ ID NO: 4192306 - RNA, 18 nt, Yersinia pestis KIM
agggggcgauggugacau

SEQ ID NO: 4192307 - RNA, 21 nt, Yersinia pestis KIM
agggggcuguuaagcauugag

SEQ ID NO: 4192308 - RNA, 18 nt, Yersinia pestis KIM
aguacggugccagcagca

SEQ ID NO: 4192309 - RNA, 20 nt, Yersinia pestis KIM
aguacggugccagcagcaag

SEQ ID NO: 4192310 - RNA, 15 nt, Yersinia pestis KIM
aguacguaaauuuau

SEQ ID NO: 4192311 - RNA, 14 nt, Yersinia pestis KIM
aguacuaacgucaa

SEQ ID NO: 4192312 - RNA, 23 nt, Yersinia pestis KIM
aguacugcgcuagaccaguuaau

SEQ ID NO: 4192313 - RNA, 16 nt, Yersinia pestis KIM
aguacuuaccuuccca

SEQ ID NO: 4192314 - RNA, 16 nt, Yersinia pestis KIM
aguacuuagcaauaau

SEQ ID NO: 4192315 - RNA, 18 nt, Yersinia pestis KIM
aguacuuauuugaaacac

SEQ ID NO: 4192316 - RNA, 13 nt, Yersinia pestis KIM
aguacuuccaaua

SEQ ID NO: 4192317 - RNA, 18 nt, Yersinia pestis KIM
aguagaauaccucacugg

SEQ ID NO: 4192318 - RNA, 20 nt, Yersinia pestis KIM
aguagacgacacaaaugcug

SEQ ID NO: 4192319 - RNA, 22 nt, Yersinia pestis KIM
aguagacgacacaaaugcugug

SEQ ID NO: 4192320 - RNA, 13 nt, Yersinia pestis KIM
aguagagcuucca

SEQ ID NO: 4192321 - RNA, 18 nt, Yersinia pestis KIM
aguagcaggcgcacguua

SEQ ID NO: 4192322 - RNA, 23 nt, Yersinia pestis KIM
aguagcagggccgcccagauaaa

SEQ ID NO: 4192323 - RNA, 23 nt, Yersinia pestis KIM
aguagcccagccggaacauguac

SEQ ID NO: 4192324 - RNA, 18 nt, Yersinia pestis KIM
aguagcuaauaaaauggc

SEQ ID NO: 4192325 - RNA, 21 nt, Yersinia pestis KIM
aguaggcaucugccacacuga

SEQ ID NO: 4192326 - RNA, 22 nt, Yersinia pestis KIM
aguaggggccaccaaauaaaac

SEQ ID NO: 4192327 - RNA, 17 nt, Yersinia pestis KIM
aguauacggucaaaagc

SEQ ID NO: 4192328 - RNA, 19 nt, Yersinia pestis KIM
aguauacggucaaaagcug

SEQ ID NO: 4192329 - RNA, 14 nt, Yersinia pestis KIM
aguauacuaaaaca

SEQ ID NO: 4192330 - RNA, 17 nt, Yersinia pestis KIM
aguaucgaagacaaaca

SEQ ID NO: 4192331 - RNA, 18 nt, Yersinia pestis KIM
aguaucugggugagaggu

SEQ ID NO: 4192332 - RNA, 16 nt, Yersinia pestis KIM
aguaucuuuccagcca

SEQ ID NO: 4192333 - RNA, 15 nt, Yersinia pestis KIM
aguaugaaauuuugu

SEQ ID NO: 4192334 - RNA, 15 nt, Yersinia pestis KIM
aguaugcaacaguga

SEQ ID NO: 4192335 - RNA, 19 nt, Yersinia pestis KIM
aguaugcguggguucuuca

SEQ ID NO: 4192336 - RNA, 15 nt, Yersinia pestis KIM
aguaugguuaaucua

SEQ ID NO: 4192337 - RNA, 16 nt, Yersinia pestis KIM
aguaugguuaaucuac

SEQ ID NO: 4192338 - RNA, 15 nt, Yersinia pestis KIM
aguauuaccaauaag

SEQ ID NO: 4192339 - RNA, 15 nt, Yersinia pestis KIM
aguauuaccucauca

SEQ ID NO: 4192340 - RNA, 19 nt, Yersinia pestis KIM
aguauuaccucaucauuau

SEQ ID NO: 4192341 - RNA, 14 nt, Yersinia pestis KIM
aguauuccaauaau

SEQ ID NO: 4192342 - RNA, 13 nt, Yersinia pestis KIM
aguauuccccacu

SEQ ID NO: 4192343 - RNA, 17 nt, Yersinia pestis KIM
aguauuccccacuguaa

SEQ ID NO: 4192344 - RNA, 23 nt, Yersinia pestis KIM
aguauucuuaucaaucaaaaaau

SEQ ID NO: 4192345 - RNA, 13 nt, Yersinia pestis KIM
aguauuugcagug

SEQ ID NO: 4192346 - RNA, 12 nt, Yersinia pestis KIM
agucaaaacaau

SEQ ID NO: 4192347 - RNA, 14 nt, Yersinia pestis KIM
agucaaaacaauau

SEQ ID NO: 4192348 - RNA, 16 nt, Yersinia pestis KIM
agucaaaagaaacugc

SEQ ID NO: 4192349 - RNA, 14 nt, Yersinia pestis KIM
agucaaaaugaaau

SEQ ID NO: 4192350 - RNA, 15 nt, Yersinia pestis KIM
agucaauuucagcuu

SEQ ID NO: 4192351 - RNA, 15 nt, Yersinia pestis KIM
agucaccgcuguaaa

SEQ ID NO: 4192352 - RNA, 21 nt, Yersinia pestis KIM
agucaccuuuuuagcgagugc

SEQ ID NO: 4192353 - RNA, 21 nt, Yersinia pestis KIM
agucacgucguacugccugaa

SEQ ID NO: 4192354 - RNA, 16 nt, Yersinia pestis KIM
agucacgucuucacca

SEQ ID NO: 4192355 - RNA, 17 nt, Yersinia pestis KIM
agucacgucuucaccaa

SEQ ID NO: 4192356 - RNA, 19 nt, Yersinia pestis KIM
agucacgucuucaccaaug

SEQ ID NO: 4192357 - RNA, 20 nt, Yersinia pestis KIM
agucacgucuucaccaauga

SEQ ID NO: 4192358 - RNA, 13 nt, Yersinia pestis KIM
agucacuaaacca

SEQ ID NO: 4192359 - RNA, 15 nt, Yersinia pestis KIM
agucacuaaaccauu

SEQ ID NO: 4192360 - RNA, 20 nt, Yersinia pestis KIM
agucacuaaaccauucagcc

SEQ ID NO: 4192361 - RNA, 14 nt, Yersinia pestis KIM
agucacugcugcac

SEQ ID NO: 4192362 - RNA, 16 nt, Yersinia pestis KIM
agucacuggccgcagg

SEQ ID NO: 4192363 - RNA, 23 nt, Yersinia pestis KIM
agucacuggggugaaucaaaacc

SEQ ID NO: 4192364 - RNA, 14 nt, Yersinia pestis KIM
agucagcaaaucaa

SEQ ID NO: 4192365 - RNA, 15 nt, Yersinia pestis KIM
agucagcaaaucaaa

SEQ ID NO: 4192366 - RNA, 16 nt, Yersinia pestis KIM
agucagcaaaucaaac

SEQ ID NO: 4192367 - RNA, 20 nt, Yersinia pestis KIM
agucagcaaggugagcacuu

SEQ ID NO: 4192368 - RNA, 15 nt, Yersinia pestis KIM
agucagggagucagg

SEQ ID NO: 4192369 - RNA, 16 nt, Yersinia pestis KIM
agucagggaucaccuc

SEQ ID NO: 4192370 - RNA, 20 nt, Yersinia pestis KIM
agucaguaauucacccuuua

SEQ ID NO: 4192371 - RNA, 21 nt, Yersinia pestis KIM
agucauaagguuaaugagcgu

SEQ ID NO: 4192372 - RNA, 15 nt, Yersinia pestis KIM
agucauacaaaauga

SEQ ID NO: 4192373 - RNA, 19 nt, Yersinia pestis KIM
agucauauauuuuucuuuc

SEQ ID NO: 4192374 - RNA, 21 nt, Yersinia pestis KIM
agucauauauuuuucuuucuc

SEQ ID NO: 4192375 - RNA, 24 nt, Yersinia pestis KIM
agucauauauuuuucuuucucgau

SEQ ID NO: 4192376 - RNA, 20 nt, Yersinia pestis KIM
agucaucgcggguuuuuaac

SEQ ID NO: 4192377 - RNA, 22 nt, Yersinia pestis KIM
agucaugguacaacugcggcgu

SEQ ID NO: 4192378 - RNA, 15 nt, Yersinia pestis KIM
agucauucaccugcc

SEQ ID NO: 4192379 - RNA, 20 nt, Yersinia pestis KIM
agucauuggcguuacagcaa

SEQ ID NO: 4192380 - RNA, 16 nt, Yersinia pestis KIM
agucauuuacugauga

SEQ ID NO: 4192381 - RNA, 17 nt, Yersinia pestis KIM
aguccaaaaaacugcgg

SEQ ID NO: 4192382 - RNA, 15 nt, Yersinia pestis KIM
aguccaaaauacggc

SEQ ID NO: 4192383 - RNA, 17 nt, Yersinia pestis KIM
aguccaagaagauaacu

SEQ ID NO: 4192384 - RNA, 17 nt, Yersinia pestis KIM
agucccuaaagagcgau

SEQ ID NO: 4192385 - RNA, 19 nt, Yersinia pestis KIM
aguccgguuguggcugcca

SEQ ID NO: 4192386 - RNA, 22 nt, Yersinia pestis KIM
aguccguuaaaaaauucaucuu

SEQ ID NO: 4192387 - RNA, 18 nt, Yersinia pestis KIM
aguccuccuugagauccu

SEQ ID NO: 4192388 - RNA, 20 nt, Yersinia pestis KIM
aguccuucggacgcuccuca

SEQ ID NO: 4192389 - RNA, 19 nt, Yersinia pestis KIM
agucgacaguguaaaaagc

SEQ ID NO: 4192390 - RNA, 14 nt, Yersinia pestis KIM
agucgauagcuuuc

SEQ ID NO: 4192391 - RNA, 13 nt, Yersinia pestis KIM
agucgcgaaauaa

SEQ ID NO: 4192392 - RNA, 19 nt, Yersinia pestis KIM
agucgcgaaauaagaauaa

SEQ ID NO: 4192393 - RNA, 21 nt, Yersinia pestis KIM
agucgcuuuuuguauuuuugu

SEQ ID NO: 4192394 - RNA, 22 nt, Yersinia pestis KIM
agucuaaacgccgcgucaauaa

SEQ ID NO: 4192395 - RNA, 13 nt, Yersinia pestis KIM
agucuauuauauu

SEQ ID NO: 4192396 - RNA, 16 nt, Yersinia pestis KIM
agucuauugaaaaaau

SEQ ID NO: 4192397 - RNA, 20 nt, Yersinia pestis KIM
agucucacuaaaucaaaagg

SEQ ID NO: 4192398 - RNA, 15 nt, Yersinia pestis KIM
agucucaucaaggaa

SEQ ID NO: 4192399 - RNA, 16 nt, Yersinia pestis KIM
agucuccaaauucauu

SEQ ID NO: 4192400 - RNA, 21 nt, Yersinia pestis KIM
agucucuguggauugccaaau

SEQ ID NO: 4192401 - RNA, 22 nt, Yersinia pestis KIM
agucucuuuacggaauaaccua

SEQ ID NO: 4192402 - RNA, 19 nt, Yersinia pestis KIM
agucugaaaccccuuguuu

SEQ ID NO: 4192403 - RNA, 22 nt, Yersinia pestis KIM
agucugaaacgccagccucugc

SEQ ID NO: 4192404 - RNA, 20 nt, Yersinia pestis KIM
agucugaaggguauugaaga

SEQ ID NO: 4192405 - RNA, 15 nt, Yersinia pestis KIM
agucugagccucaug

SEQ ID NO: 4192406 - RNA, 18 nt, Yersinia pestis KIM
agucugagccucaugaau

SEQ ID NO: 4192407 - RNA, 16 nt, Yersinia pestis KIM
agucugggcaggugcg

SEQ ID NO: 4192408 - RNA, 19 nt, Yersinia pestis KIM
agucugucguacuuuccuu

SEQ ID NO: 4192409 - RNA, 14 nt, Yersinia pestis KIM
agucuuagacguca

SEQ ID NO: 4192410 - RNA, 21 nt, Yersinia pestis KIM
agucuugauauuuaagccaug

SEQ ID NO: 4192411 - RNA, 19 nt, Yersinia pestis KIM
agucuuuuuaauaugugac

SEQ ID NO: 4192412 - RNA, 16 nt, Yersinia pestis KIM
agugaaaacguuaacu

SEQ ID NO: 4192413 - RNA, 18 nt, Yersinia pestis KIM
agugaaaacguuaacugc

SEQ ID NO: 4192414 - RNA, 20 nt, Yersinia pestis KIM
agugaaaacguuaacugcag

SEQ ID NO: 4192415 - RNA, 22 nt, Yersinia pestis KIM
agugaaaacguuaacugcagua

SEQ ID NO: 4192416 - RNA, 21 nt, Yersinia pestis KIM
agugaaacccgcgcagccuaa

SEQ ID NO: 4192417 - RNA, 13 nt, Yersinia pestis KIM
agugaaagggaag

SEQ ID NO: 4192418 - RNA, 18 nt, Yersinia pestis KIM
agugaacauagcuaacac

SEQ ID NO: 4192419 - RNA, 21 nt, Yersinia pestis KIM
agugaacauagcuaacaccgc

SEQ ID NO: 4192420 - RNA, 18 nt, Yersinia pestis KIM
agugaaccgcgcucugcu

SEQ ID NO: 4192421 - RNA, 14 nt, Yersinia pestis KIM
agugaacguagcua

SEQ ID NO: 4192422 - RNA, 22 nt, Yersinia pestis KIM
aguuaauacgccauccgcaccu

SEQ ID NO: 4192423 - RNA, 14 nt, Yersinia pestis KIM
aguuaauuuucacc

SEQ ID NO: 4192424 - RNA, 16 nt, Yersinia pestis KIM
aguuacaauaaaucaa

SEQ ID NO: 4192425 - RNA, 18 nt, Yersinia pestis KIM
aguuacaggucaacaccg

SEQ ID NO: 4192426 - RNA, 21 nt, Yersinia pestis KIM
aguuacauuuuuaacaucugg

SEQ ID NO: 4192427 - RNA, 13 nt, Yersinia pestis KIM
aguuaccauggca

SEQ ID NO: 4192428 - RNA, 16 nt, Yersinia pestis KIM
aguuaccgugagcagc

SEQ ID NO: 4192429 - RNA, 22 nt, Yersinia pestis KIM
aguuaccgugagcagcaauaau

SEQ ID NO: 4192430 - RNA, 19 nt, Yersinia pestis KIM
aguuaccuugugucaccau

SEQ ID NO: 4192431 - RNA, 21 nt, Yersinia pestis KIM
aguuacgucaggaauaaagua

SEQ ID NO: 4192432 - RNA, 21 nt, Yersinia pestis KIM
aguuacuguaagauaauucga

SEQ ID NO: 4192433 - RNA, 21 nt, Yersinia pestis KIM
aguuacuuuuuuauuuuacuu

SEQ ID NO: 4192434 - RNA, 19 nt, Yersinia pestis KIM
aguuagacccaauugcagg

SEQ ID NO: 4192435 - RNA, 15 nt, Yersinia pestis KIM
aguuagcaggcagca

SEQ ID NO: 4192436 - RNA, 16 nt, Yersinia pestis KIM
aguuaguggcuuuaag

SEQ ID NO: 4192437 - RNA, 23 nt, Yersinia pestis KIM
aguuagugguguuauccacuugc

SEQ ID NO: 4192438 - RNA, 13 nt, Yersinia pestis KIM
aguuauaaaaacc

SEQ ID NO: 4192439 - RNA, 23 nt, Yersinia pestis KIM
aguuauaacguuaugugccauaa

SEQ ID NO: 4192440 - RNA, 19 nt, Yersinia pestis KIM
aguuaucauugcuccugua

SEQ ID NO: 4192441 - RNA, 21 nt, Yersinia pestis KIM
aguuaucucccauuaauuaau

SEQ ID NO: 4192442 - RNA, 21 nt, Yersinia pestis KIM
aguuaucuguuucaaauaagu

SEQ ID NO: 4192443 - RNA, 15 nt, Yersinia pestis KIM
aguuauucgccccuu

SEQ ID NO: 4192444 - RNA, 21 nt, Yersinia pestis KIM
aguucaagcagcuuuucacga

SEQ ID NO: 4192445 - RNA, 21 nt, Yersinia pestis KIM
aguucacaccguauagcaucg

SEQ ID NO: 4192446 - RNA, 21 nt, Yersinia pestis KIM
aguucaccagcuugggugaag

SEQ ID NO: 4192447 - RNA, 16 nt, Yersinia pestis KIM
aguucacgaauuugcu

SEQ ID NO: 4192448 - RNA, 17 nt, Yersinia pestis KIM
aguucacgaauuugcug

SEQ ID NO: 4192449 - RNA, 23 nt, Yersinia pestis KIM
aguucacgauggaaaaaauacag

SEQ ID NO: 4192450 - RNA, 16 nt, Yersinia pestis KIM
aguucacucuguuuua

SEQ ID NO: 4192451 - RNA, 20 nt, Yersinia pestis KIM
aguucacugaguugcaggaa

SEQ ID NO: 4192452 - RNA, 21 nt, Yersinia pestis KIM
aguucagauuuagcgauauaa

SEQ ID NO: 4192453 - RNA, 17 nt, Yersinia pestis KIM
aguucagguugaaauaa

SEQ ID NO: 4192454 - RNA, 11 nt, Yersinia pestis KIM
aguucaucaaa

SEQ ID NO: 4192455 - RNA, 14 nt, Yersinia pestis KIM
aguucauggccaug

SEQ ID NO: 4192456 - RNA, 16 nt, Yersinia pestis KIM
aguucauggccaugaa

SEQ ID NO: 4192457 - RNA, 18 nt, Yersinia pestis KIM
aguucauuccccaucgcc

SEQ ID NO: 4192458 - RNA, 11 nt, Yersinia pestis KIM
aguucauucgc

SEQ ID NO: 4192459 - RNA, 19 nt, Yersinia pestis KIM
aguucauuuugaccagcau

SEQ ID NO: 4192460 - RNA, 19 nt, Yersinia pestis KIM
aguuccaauaugcggcaua

SEQ ID NO: 4192461 - RNA, 21 nt, Yersinia pestis KIM
aguucgacaccuucaaucauu

SEQ ID NO: 4192462 - RNA, 19 nt, Yersinia pestis KIM
aguucggucuauaaaaccg

SEQ ID NO: 4192463 - RNA, 19 nt, Yersinia pestis KIM
aguucgucgcgaauagcca

SEQ ID NO: 4192464 - RNA, 14 nt, Yersinia pestis KIM
aguucugcgccccc

SEQ ID NO: 4192465 - RNA, 19 nt, Yersinia pestis KIM
aguucuggaucggcauacu

SEQ ID NO: 4192466 - RNA, 22 nt, Yersinia pestis KIM
aguucuggaucggcauacucca

SEQ ID NO: 4192467 - RNA, 22 nt, Yersinia pestis KIM
aguucugguagcugcucacgau

SEQ ID NO: 4192468 - RNA, 18 nt, Yersinia pestis KIM
aguucuucacgaagaauu

SEQ ID NO: 4192469 - RNA, 18 nt, Yersinia pestis KIM
aguucuucugauaaaaca

SEQ ID NO: 4192470 - RNA, 20 nt, Yersinia pestis KIM
aguucuucugauaaaacagu

SEQ ID NO: 4192471 - RNA, 20 nt, Yersinia pestis KIM
aguugaauuuuuauaauuaa

SEQ ID NO: 4192472 - RNA, 17 nt, Yersinia pestis KIM
aguugagagacaaaaau

SEQ ID NO: 4192473 - RNA, 18 nt, Yersinia pestis KIM
aguugauaaaagucuaua

SEQ ID NO: 4192474 - RNA, 17 nt, Yersinia pestis KIM
aguugauaaacaauaaa

SEQ ID NO: 4192475 - RNA, 20 nt, Yersinia pestis KIM
aguugaucggccaauaugau

SEQ ID NO: 4192476 - RNA, 16 nt, Yersinia pestis KIM
aguugaugcaauggca

SEQ ID NO: 4192477 - RNA, 18 nt, Yersinia pestis KIM
aguugcaguuggaucugc

SEQ ID NO: 4192478 - RNA, 22 nt, Yersinia pestis KIM
aguugccagcaggcugcaccca

SEQ ID NO: 4192479 - RNA, 17 nt, Yersinia pestis KIM
aguugcgggaauucuuu

SEQ ID NO: 4192480 - RNA, 19 nt, Yersinia pestis KIM
aguugcgggaauucuuugg

SEQ ID NO: 4192481 - RNA, 17 nt, Yersinia pestis KIM
aguugcuaucaauaaac

SEQ ID NO: 4192482 - RNA, 16 nt, Yersinia pestis KIM
aguuggaaaugacaaa

SEQ ID NO: 4192483 - RNA, 14 nt, Yersinia pestis KIM
aguuggauauacau

SEQ ID NO: 4192484 - RNA, 16 nt, Yersinia pestis KIM
aguuggcauucuaguu

SEQ ID NO: 4192485 - RNA, 17 nt, Yersinia pestis KIM
aguuggggauaauugac

SEQ ID NO: 4192486 - RNA, 14 nt, Yersinia pestis KIM
aguuguacgugaag

SEQ ID NO: 4192487 - RNA, 20 nt, Yersinia pestis KIM
aguuguauuaccgauaaagg

SEQ ID NO: 4192488 - RNA, 17 nt, Yersinia pestis KIM
aguugucuauuuucauu

SEQ ID NO: 4192489 - RNA, 20 nt, Yersinia pestis KIM
aguugucuauuuucauuauu

SEQ ID NO: 4192490 - RNA, 15 nt, Yersinia pestis KIM
aguuguugccacaga

SEQ ID NO: 4192491 - RNA, 21 nt, Yersinia pestis KIM
aguuuaaugccguuuugcaga

SEQ ID NO: 4192492 - RNA, 21 nt, Yersinia pestis KIM
aguuuacgcacguugagugau

SEQ ID NO: 4192493 - RNA, 23 nt, Yersinia pestis KIM
aguuuagucuagucuagcugcgc

SEQ ID NO: 4192494 - RNA, 13 nt, Yersinia pestis KIM
aguuuauaugcuu

SEQ ID NO: 4192495 - RNA, 14 nt, Yersinia pestis KIM
aguuuauuuaagcu

SEQ ID NO: 4192496 - RNA, 23 nt, Yersinia pestis KIM
aguuuauuuuauuuaaucaucga

SEQ ID NO: 4192497 - RNA, 13 nt, Yersinia pestis KIM
aguuuauuuuccc

SEQ ID NO: 4192498 - RNA, 19 nt, Yersinia pestis KIM
aguuuauuuucccuuucuc

SEQ ID NO: 4192499 - RNA, 21 nt, Yersinia pestis KIM
aguuuauuuucccuuucucag

SEQ ID NO: 4192500 - RNA, 16 nt, Yersinia pestis KIM
aguuucacccucugcg

SEQ ID NO: 4192501 - RNA, 15 nt, Yersinia pestis KIM
aguuucccuuuucca

SEQ ID NO: 4192502 - RNA, 15 nt, Yersinia pestis KIM
aguuugacgcuguau

SEQ ID NO: 4192503 - RNA, 15 nt, Yersinia pestis KIM
aguuugagaaacuga

SEQ ID NO: 4192504 - RNA, 22 nt, Yersinia pestis KIM
aguuugcggucuggcaacugca

SEQ ID NO: 4192505 - RNA, 16 nt, Yersinia pestis KIM
aguuuggcugccaugg

SEQ ID NO: 4192506 - RNA, 20 nt, Yersinia pestis KIM
aguuugguaauacugagacc

SEQ ID NO: 4192507 - RNA, 17 nt, Yersinia pestis KIM
aguuuuccucccugcca

SEQ ID NO: 4192508 - RNA, 18 nt, Yersinia pestis KIM
aguuuucuggcaauuucu

SEQ ID NO: 4192509 - RNA, 13 nt, Yersinia pestis KIM
auaaaaaacccgc

SEQ ID NO: 4192510 - RNA, 14 nt, Yersinia pestis KIM
auaaaaaacugacu

SEQ ID NO: 4192511 - RNA, 23 nt, Yersinia pestis KIM
auaaaaaagcaugcagaauaucu

SEQ ID NO: 4192512 - RNA, 21 nt, Yersinia pestis KIM
auaaaaaagcugucauaaaaa

SEQ ID NO: 4192513 - RNA, 12 nt, Yersinia pestis KIM
auaaaaaauaau

SEQ ID NO: 4192514 - RNA, 11 nt, Yersinia pestis KIM
auaaaaacccc

SEQ ID NO: 4192515 - RNA, 22 nt, Yersinia pestis KIM
auaaaaaccccugucuuauuuu

SEQ ID NO: 4192516 - RNA, 15 nt, Yersinia pestis KIM
auaaaaacuucagag

SEQ ID NO: 4192517 - RNA, 11 nt, Yersinia pestis KIM
auaaaaagcca

SEQ ID NO: 4192518 - RNA, 15 nt, Yersinia pestis KIM
auaaaaauaaucaau

SEQ ID NO: 4192519 - RNA, 17 nt, Yersinia pestis KIM
auaaaaauaaucaauga

SEQ ID NO: 4192520 - RNA, 12 nt, Yersinia pestis KIM
auaaaaauagcu

SEQ ID NO: 4192521 - RNA, 22 nt, Yersinia pestis KIM
auaaaaauauccagcaacgaau

SEQ ID NO: 4192522 - RNA, 19 nt, Yersinia pestis KIM
auaaaaaucccggcauauu

SEQ ID NO: 4192523 - RNA, 18 nt, Yersinia pestis KIM
auaaaacagaacccccgc

SEQ ID NO: 4192524 - RNA, 21 nt, Yersinia pestis KIM
auaaaacagcuugauagggcu

SEQ ID NO: 4192525 - RNA, 18 nt, Yersinia pestis KIM
auaaaaccgcuuaucccu

SEQ ID NO: 4192526 - RNA, 17 nt, Yersinia pestis KIM
auaaaaccuuuacaauu

SEQ ID NO: 4192527 - RNA, 23 nt, Yersinia pestis KIM
auaaaaccuuuacaauuacacac

SEQ ID NO: 4192528 - RNA, 22 nt, Yersinia pestis KIM
auaaaaccuuuauguaacacau

SEQ ID NO: 4192529 - RNA, 21 nt, Yersinia pestis KIM
auaaaacuauucugcuuggac

SEQ ID NO: 4192530 - RNA, 18 nt, Yersinia pestis KIM
auaaaagagauguuauuu

SEQ ID NO: 4192531 - RNA, 21 nt, Yersinia pestis KIM
auaaaagcacagacaaacaac

SEQ ID NO: 4192532 - RNA, 16 nt, Yersinia pestis KIM
auaaaaggauggccca

SEQ ID NO: 4192533 - RNA, 23 nt, Yersinia pestis KIM
auaaaaggauggcccaagccauc

SEQ ID NO: 4192534 - RNA, 13 nt, Yersinia pestis KIM
auaaaaguaauuu

SEQ ID NO: 4192535 - RNA, 21 nt, Yersinia pestis KIM
auaaaaguaauuuaucaguag

SEQ ID NO: 4192536 - RNA, 20 nt, Yersinia pestis KIM
auaaccuacaaaaauaguug

SEQ ID NO: 4192537 - RNA, 14 nt, Yersinia pestis KIM
auaaccucagaggc

SEQ ID NO: 4192538 - RNA, 14 nt, Yersinia pestis KIM
auaaccucagccuc

SEQ ID NO: 4192539 - RNA, 15 nt, Yersinia pestis KIM
auaaccucagccuca

SEQ ID NO: 4192540 - RNA, 16 nt, Yersinia pestis KIM
auaaccucagccucau

SEQ ID NO: 4192541 - RNA, 17 nt, Yersinia pestis KIM
auaaccucagggagcca

SEQ ID NO: 4192542 - RNA, 22 nt, Yersinia pestis KIM
auaaccucagggcgucucuacg

SEQ ID NO: 4192543 - RNA, 16 nt, Yersinia pestis KIM
auaaccucaggggcca

SEQ ID NO: 4192544 - RNA, 20 nt, Yersinia pestis KIM
auaaccugaccguuaucauc

SEQ ID NO: 4192545 - RNA, 18 nt, Yersinia pestis KIM
auaaccugagcaccagaa

SEQ ID NO: 4192546 - RNA, 23 nt, Yersinia pestis KIM
auaacgauuaauuaguuuuaaua

SEQ ID NO: 4192547 - RNA, 16 nt, Yersinia pestis KIM
auaacgcaaaaaucac

SEQ ID NO: 4192548 - RNA, 22 nt, Yersinia pestis KIM
auaacgcacacgaaucaggcgg

SEQ ID NO: 4192549 - RNA, 19 nt, Yersinia pestis KIM
auaacgcaucaugguccag

SEQ ID NO: 4192550 - RNA, 14 nt, Yersinia pestis KIM
auaacgccacaaua

SEQ ID NO: 4192551 - RNA, 18 nt, Yersinia pestis KIM
auaacgcgaucugaagau

SEQ ID NO: 4192552 - RNA, 22 nt, Yersinia pestis KIM
auaacgcuuuuucauugguaau

SEQ ID NO: 4192553 - RNA, 14 nt, Yersinia pestis KIM
auaacggcggcaau

SEQ ID NO: 4192554 - RNA, 20 nt, Yersinia pestis KIM
auaacuaagagucacagcau

SEQ ID NO: 4192555 - RNA, 19 nt, Yersinia pestis KIM
auaacuauuaucuuuuaaa

SEQ ID NO: 4192556 - RNA, 20 nt, Yersinia pestis KIM
auaacuauuaucuuuuaaaa

SEQ ID NO: 4192557 - RNA, 13 nt, Yersinia pestis KIM
auaacucaucagu

SEQ ID NO: 4192558 - RNA, 15 nt, Yersinia pestis KIM
auaacucaucaguaa

SEQ ID NO: 4192559 - RNA, 14 nt, Yersinia pestis KIM
auaacugccagggc

SEQ ID NO: 4192560 - RNA, 15 nt, Yersinia pestis KIM
auaacugguccaacu

SEQ ID NO: 4192561 - RNA, 22 nt, Yersinia pestis KIM
auaacugguccaacuaaacagg

SEQ ID NO: 4192562 - RNA, 18 nt, Yersinia pestis KIM
auaacuuauuacaccuua

SEQ ID NO: 4192563 - RNA, 17 nt, Yersinia pestis KIM
auaagacuaacagaaua

SEQ ID NO: 4192564 - RNA, 21 nt, Yersinia pestis KIM
auaagagcgacucaauaauau

SEQ ID NO: 4192565 - RNA, 17 nt, Yersinia pestis KIM
auaagauccagaacacc

SEQ ID NO: 4192566 - RNA, 22 nt, Yersinia pestis KIM
auaagaugaccaccaauuucau

SEQ ID NO: 4192567 - RNA, 20 nt, Yersinia pestis KIM
auaagauucagcugcccuug

SEQ ID NO: 4192568 - RNA, 18 nt, Yersinia pestis KIM
auaagcacaacgcucuaa

SEQ ID NO: 4192569 - RNA, 20 nt, Yersinia pestis KIM
auaagcacgaauuuuauuca

SEQ ID NO: 4192570 - RNA, 16 nt, Yersinia pestis KIM
auaagcacuccacugg

SEQ ID NO: 4192571 - RNA, 21 nt, Yersinia pestis KIM
auaagcaggcaguaaaauauu

SEQ ID NO: 4192572 - RNA, 19 nt, Yersinia pestis KIM
auaagccauuuuuuauaaa

SEQ ID NO: 4192573 - RNA, 22 nt, Yersinia pestis KIM
auaagccgcaggcaaacaaugu

SEQ ID NO: 4192574 - RNA, 20 nt, Yersinia pestis KIM
auaagcgguuucauggcugg

SEQ ID NO: 4192575 - RNA, 18 nt, Yersinia pestis KIM
auaagcgguuuuaucaau

SEQ ID NO: 4192576 - RNA, 16 nt, Yersinia pestis KIM
auaagcguuauuuuug

SEQ ID NO: 4192577 - RNA, 14 nt, Yersinia pestis KIM
auaaggaauauacu

SEQ ID NO: 4192578 - RNA, 17 nt, Yersinia pestis KIM
auaaggagagauuagag

SEQ ID NO: 4192579 - RNA, 15 nt, Yersinia pestis KIM
auaaggcuaacaccu

SEQ ID NO: 4192580 - RNA, 17 nt, Yersinia pestis KIM
auaaggcuuuauauugc

SEQ ID NO: 4192581 - RNA, 13 nt, Yersinia pestis KIM
auaagggccacca

SEQ ID NO: 4192582 - RNA, 14 nt, Yersinia pestis KIM
auaaguaauaagua

SEQ ID NO: 4192583 - RNA, 20 nt, Yersinia pestis KIM
auaaguaaucgccaaugguc

SEQ ID NO: 4192584 - RNA, 19 nt, Yersinia pestis KIM
auaaguaggcaucugccac

SEQ ID NO: 4192585 - RNA, 19 nt, Yersinia pestis KIM
auaagugaaacaaauacac

SEQ ID NO: 4192586 - RNA, 17 nt, Yersinia pestis KIM
auaagugaucagcuaac

SEQ ID NO: 4192587 - RNA, 23 nt, Yersinia pestis KIM
auaaguguguguauuuaaaagau

SEQ ID NO: 4192588 - RNA, 18 nt, Yersinia pestis KIM
auaaguguuucaaauaag

SEQ ID NO: 4192589 - RNA, 20 nt, Yersinia pestis KIM
auaaguguuucaaauaagua

SEQ ID NO: 4192590 - RNA, 22 nt, Yersinia pestis KIM
auaaguuacgucagaaauaaau

SEQ ID NO: 4192591 - RNA, 13 nt, Yersinia pestis KIM
auaaguugaacca

SEQ ID NO: 4192592 - RNA, 11 nt, Yersinia pestis KIM
auaauaaaaaa

SEQ ID NO: 4192593 - RNA, 12 nt, Yersinia pestis KIM
auaauaaaaaaa

SEQ ID NO: 4192594 - RNA, 15 nt, Yersinia pestis KIM
auaauaaaaaaaaau

SEQ ID NO: 4192595 - RNA, 22 nt, Yersinia pestis KIM
auaauaaaaucugcuucuccug

SEQ ID NO: 4192596 - RNA, 18 nt, Yersinia pestis KIM
auaauaaauuaucugaau

SEQ ID NO: 4192597 - RNA, 20 nt, Yersinia pestis KIM
auaauaacgucgccaguugc

SEQ ID NO: 4192598 - RNA, 14 nt, Yersinia pestis KIM
auaauaacucuaug

SEQ ID NO: 4192599 - RNA, 20 nt, Yersinia pestis KIM
auaauaagggcgcauauccu

SEQ ID NO: 4192600 - RNA, 14 nt, Yersinia pestis KIM
auaauaauauugau

SEQ ID NO: 4192601 - RNA, 13 nt, Yersinia pestis KIM
auaauaauccaua

SEQ ID NO: 4192602 - RNA, 16 nt, Yersinia pestis KIM
auaauaauccauaacu

SEQ ID NO: 4192603 - RNA, 10 nt, Yersinia pestis KIM
auaauaaugg

SEQ ID NO: 4192604 - RNA, 11 nt, Yersinia pestis KIM
auaauaauggc

SEQ ID NO: 4192605 - RNA, 16 nt, Yersinia pestis KIM
auaauacgaucagcgu

SEQ ID NO: 4192606 - RNA, 14 nt, Yersinia pestis KIM
auaauagauaguac

SEQ ID NO: 4192607 - RNA, 15 nt, Yersinia pestis KIM
auaauagauaguacu

SEQ ID NO: 4192608 - RNA, 21 nt, Yersinia pestis KIM
auaauagcuggcggauaaaaa

SEQ ID NO: 4192609 - RNA, 18 nt, Yersinia pestis KIM
auaauaucggcaaauuaa

SEQ ID NO: 4192610 - RNA, 13 nt, Yersinia pestis KIM
auaauauuggccg

SEQ ID NO: 4192611 - RNA, 18 nt, Yersinia pestis KIM
auaaucaacggcaccaca

SEQ ID NO: 4192612 - RNA, 17 nt, Yersinia pestis KIM
auaaucacauaauauuu

SEQ ID NO: 4192613 - RNA, 15 nt, Yersinia pestis KIM
auaaucaccagacaa

SEQ ID NO: 4192614 - RNA, 19 nt, Yersinia pestis KIM
auaaucaccagacaaccaa

SEQ ID NO: 4192615 - RNA, 21 nt, Yersinia pestis KIM
auaaucagaggugaaaaaaua

SEQ ID NO: 4192616 - RNA, 18 nt, Yersinia pestis KIM
auaaucaguacaucaaua

SEQ ID NO: 4192617 - RNA, 22 nt, Yersinia pestis KIM
auaaucaucaguuuauuguuau

SEQ ID NO: 4192618 - RNA, 13 nt, Yersinia pestis KIM
auaaucaucuaca

SEQ ID NO: 4192619 - RNA, 17 nt, Yersinia pestis KIM
auaaucaucuacaacau

SEQ ID NO: 4192620 - RNA, 19 nt, Yersinia pestis KIM
auaaucaucuacaacauca

SEQ ID NO: 4192621 - RNA, 16 nt, Yersinia pestis KIM
auaaucccuugagcau

SEQ ID NO: 4192622 - RNA, 19 nt, Yersinia pestis KIM
auaauccgccaauagcugg

SEQ ID NO: 4192623 - RNA, 13 nt, Yersinia pestis KIM
auaaucucagcau

SEQ ID NO: 4192624 - RNA, 18 nt, Yersinia pestis KIM
auaaucucagcaucggca

SEQ ID NO: 4192625 - RNA, 20 nt, Yersinia pestis KIM
auaaucuggaugaguauuac

SEQ ID NO: 4192626 - RNA, 19 nt, Yersinia pestis KIM
auaaucugggguuccaggc

SEQ ID NO: 4192627 - RNA, 16 nt, Yersinia pestis KIM
auaaucuuaaguaaau

SEQ ID NO: 4192628 - RNA, 14 nt, Yersinia pestis KIM
auaaugagccauaa

SEQ ID NO: 4192629 - RNA, 13 nt, Yersinia pestis KIM
auaaugaugaacu

SEQ ID NO: 4192630 - RNA, 23 nt, Yersinia pestis KIM
auaaugcggcucucuuucuccaa

SEQ ID NO: 4192631 - RNA, 21 nt, Yersinia pestis KIM
auaaugcugaugcaauaacuc

SEQ ID NO: 4192632 - RNA, 14 nt, Yersinia pestis KIM
auaaugcuuuggua

SEQ ID NO: 4192633 - RNA, 18 nt, Yersinia pestis KIM
auaauggaugaauaucca

SEQ ID NO: 4192634 - RNA, 16 nt, Yersinia pestis KIM
auaauggcauuuuucg

SEQ ID NO: 4192635 - RNA, 18 nt, Yersinia pestis KIM
auaaugguauuugaaaua

SEQ ID NO: 4192636 - RNA, 20 nt, Yersinia pestis KIM
auaaugguauuugaaauauu

SEQ ID NO: 4192637 - RNA, 22 nt, Yersinia pestis KIM
auaauggugggccgugcgggau

SEQ ID NO: 4192638 - RNA, 22 nt, Yersinia pestis KIM
auaauggugggucgugcgggau

SEQ ID NO: 4192639 - RNA, 22 nt, Yersinia pestis KIM
auaaugucaccacggcuuucaa

SEQ ID NO: 4192640 - RNA, 17 nt, Yersinia pestis KIM
auaauguccuauuuaau

SEQ ID NO: 4192641 - RNA, 22 nt, Yersinia pestis KIM
auaauguggcauguucagcauu

SEQ ID NO: 4192642 - RNA, 22 nt, Yersinia pestis KIM
auaauguucguuuuuuggguuu

SEQ ID NO: 4192643 - RNA, 16 nt, Yersinia pestis KIM
auaauuaacagcauca

SEQ ID NO: 4192644 - RNA, 12 nt, Yersinia pestis KIM
auaauuaacuau

SEQ ID NO: 4192645 - RNA, 13 nt, Yersinia pestis KIM
auaauuaacuauu

SEQ ID NO: 4192646 - RNA, 14 nt, Yersinia pestis KIM
auaauuaacuauuu

SEQ ID NO: 4192647 - RNA, 22 nt, Yersinia pestis KIM
auaauuaaggggcuuugcgcaa

SEQ ID NO: 4192648 - RNA, 13 nt, Yersinia pestis KIM
auaauuaauuauu

SEQ ID NO: 4192649 - RNA, 22 nt, Yersinia pestis KIM
auaauuaauuucacuggccuau

SEQ ID NO: 4192650 - RNA, 13 nt, Yersinia pestis KIM
auauaauagcugg

SEQ ID NO: 4192651 - RNA, 20 nt, Yersinia pestis KIM
auauaauagcuggcggauaa

SEQ ID NO: 4192652 - RNA, 14 nt, Yersinia pestis KIM
auauaaucauacug

SEQ ID NO: 4192653 - RNA, 17 nt, Yersinia pestis KIM
auauaaugcugaaugaa

SEQ ID NO: 4192654 - RNA, 16 nt, Yersinia pestis KIM
auauaauugaagauuu

SEQ ID NO: 4192655 - RNA, 20 nt, Yersinia pestis KIM
auauaauugaagauuuaaau

SEQ ID NO: 4192656 - RNA, 14 nt, Yersinia pestis KIM
auauacaaggcaca

SEQ ID NO: 4192657 - RNA, 23 nt, Yersinia pestis KIM
auauacagaagaguacgcuuugg

SEQ ID NO: 4192658 - RNA, 18 nt, Yersinia pestis KIM
auauacauauucacuaua

SEQ ID NO: 4192659 - RNA, 14 nt, Yersinia pestis KIM
auauacccaccaga

SEQ ID NO: 4192660 - RNA, 22 nt, Yersinia pestis KIM
auauacccgucauaaauaaaga

SEQ ID NO: 4192661 - RNA, 17 nt, Yersinia pestis KIM
auauacgcauaaugcgc

SEQ ID NO: 4192662 - RNA, 21 nt, Yersinia pestis KIM
auauacggcggcuacugguag

SEQ ID NO: 4192663 - RNA, 14 nt, Yersinia pestis KIM
auauagagaaaucu

SEQ ID NO: 4192664 - RNA, 14 nt, Yersinia pestis KIM
auauagagauaaaa

SEQ ID NO: 4192665 - RNA, 13 nt, Yersinia pestis KIM
auauagagcucag

SEQ ID NO: 4192666 - RNA, 23 nt, Yersinia pestis KIM
auauagagcucagcuucaggcca

SEQ ID NO: 4192667 - RNA, 22 nt, Yersinia pestis KIM
auauaggccccaacccguggcc

SEQ ID NO: 4192668 - RNA, 18 nt, Yersinia pestis KIM
auauagggaaauaacauc

SEQ ID NO: 4192669 - RNA, 13 nt, Yersinia pestis KIM
auauauccaaaau

SEQ ID NO: 4192670 - RNA, 15 nt, Yersinia pestis KIM
auauauccaaaauaa

SEQ ID NO: 4192671 - RNA, 19 nt, Yersinia pestis KIM
auauauuaaaugagaauaa

SEQ ID NO: 4192672 - RNA, 16 nt, Yersinia pestis KIM
auauauuagccaguau

SEQ ID NO: 4192673 - RNA, 14 nt, Yersinia pestis KIM
auauauugcauuua

SEQ ID NO: 4192674 - RNA, 19 nt, Yersinia pestis KIM
auauauuuuuucauauccg

SEQ ID NO: 4192675 - RNA, 17 nt, Yersinia pestis KIM
auaucaaaacugauuaa

SEQ ID NO: 4192676 - RNA, 21 nt, Yersinia pestis KIM
auaucaaaaggauaaccuauu

SEQ ID NO: 4192677 - RNA, 16 nt, Yersinia pestis KIM
auaucaaaauaaaaau

SEQ ID NO: 4192678 - RNA, 16 nt, Yersinia pestis KIM
auaucaacacugccug

SEQ ID NO: 4192679 - RNA, 19 nt, Yersinia pestis KIM
auaucaagucuugaagagu

SEQ ID NO: 4192680 - RNA, 20 nt, Yersinia pestis KIM
auaucaauaagugcaaacuu

SEQ ID NO: 4192681 - RNA, 13 nt, Yersinia pestis KIM
auaucacuucugc

SEQ ID NO: 4192682 - RNA, 17 nt, Yersinia pestis KIM
auaucagaaacaauaaa

SEQ ID NO: 4192683 - RNA, 14 nt, Yersinia pestis KIM
auaucagccagcuc

SEQ ID NO: 4192684 - RNA, 20 nt, Yersinia pestis KIM
auaucagccagcuccugcca

SEQ ID NO: 4192685 - RNA, 15 nt, Yersinia pestis KIM
auaucaggcacugua

SEQ ID NO: 4192686 - RNA, 17 nt, Yersinia pestis KIM
auaucagucgcuuuuua

SEQ ID NO: 4192687 - RNA, 15 nt, Yersinia pestis KIM
auaucaucagcagag

SEQ ID NO: 4192688 - RNA, 18 nt, Yersinia pestis KIM
auaucauuugcucgaaau

SEQ ID NO: 4192689 - RNA, 13 nt, Yersinia pestis KIM
auauccaaaauaa

SEQ ID NO: 4192690 - RNA, 14 nt, Yersinia pestis KIM
auauccaaaauaau

SEQ ID NO: 4192691 - RNA, 13 nt, Yersinia pestis KIM
auauccaccugau

SEQ ID NO: 4192692 - RNA, 18 nt, Yersinia pestis KIM
auaucccgagaaacaaaa

SEQ ID NO: 4192693 - RNA, 20 nt, Yersinia pestis KIM
auaucccgagaaacaaaacc

SEQ ID NO: 4192694 - RNA, 17 nt, Yersinia pestis KIM
auaucccuguuuucuag

SEQ ID NO: 4192695 - RNA, 17 nt, Yersinia pestis KIM
auauccgccaaagauua

SEQ ID NO: 4192696 - RNA, 17 nt, Yersinia pestis KIM
auauccggugucaggau

SEQ ID NO: 4192697 - RNA, 19 nt, Yersinia pestis KIM
auauccucaagaccgauuu

SEQ ID NO: 4192698 - RNA, 13 nt, Yersinia pestis KIM
auauccugauagg

SEQ ID NO: 4192699 - RNA, 17 nt, Yersinia pestis KIM
auauccugcucagcuaa

SEQ ID NO: 4192700 - RNA, 20 nt, Yersinia pestis KIM
auaucgaaggggauaaacca

SEQ ID NO: 4192701 - RNA, 16 nt, Yersinia pestis KIM
auaucgaugacagcau

SEQ ID NO: 4192702 - RNA, 19 nt, Yersinia pestis KIM
auaucgccacggauaaggu

SEQ ID NO: 4192703 - RNA, 15 nt, Yersinia pestis KIM
auaucggaguguaaa

SEQ ID NO: 4192704 - RNA, 15 nt, Yersinia pestis KIM
auaucuaacugaugu

SEQ ID NO: 4192705 - RNA, 21 nt, Yersinia pestis KIM
auaucuaaguccaagacagaa

SEQ ID NO: 4192706 - RNA, 21 nt, Yersinia pestis KIM
auaucuaauuuauaaccuuuu

SEQ ID NO: 4192707 - RNA, 13 nt, Yersinia pestis KIM
auaucuauauagg

SEQ ID NO: 4192708 - RNA, 18 nt, Yersinia pestis KIM
auaucuccguugaaaccu

SEQ ID NO: 4192709 - RNA, 12 nt, Yersinia pestis KIM
auaucucuuuau

SEQ ID NO: 4192710 - RNA, 19 nt, Yersinia pestis KIM
auaucugccaauucaaggc

SEQ ID NO: 4192711 - RNA, 16 nt, Yersinia pestis KIM
auaucugcguuuucug

SEQ ID NO: 4192712 - RNA, 17 nt, Yersinia pestis KIM
auaucugcucauuacca

SEQ ID NO: 4192713 - RNA, 17 nt, Yersinia pestis KIM
auaucuugaaccaauuu

SEQ ID NO: 4192714 - RNA, 23 nt, Yersinia pestis KIM
auaucuugcugaaaacaauauaa

SEQ ID NO: 4192715 - RNA, 19 nt, Yersinia pestis KIM
auaugaaaaaucugacucu

SEQ ID NO: 4192716 - RNA, 16 nt, Yersinia pestis KIM
auaugaagcacaaaaa

SEQ ID NO: 4192717 - RNA, 14 nt, Yersinia pestis KIM
auaugacuaaacug

SEQ ID NO: 4192718 - RNA, 17 nt, Yersinia pestis KIM
auaugauaauaguucau

SEQ ID NO: 4192719 - RNA, 16 nt, Yersinia pestis KIM
auaugaucaguggggu

SEQ ID NO: 4192720 - RNA, 13 nt, Yersinia pestis KIM
auaugauggcauc

SEQ ID NO: 4192721 - RNA, 18 nt, Yersinia pestis KIM
auaugcaaaucaugcuca

SEQ ID NO: 4192722 - RNA, 19 nt, Yersinia pestis KIM
auaugcaguuuuccucccu

SEQ ID NO: 4192723 - RNA, 14 nt, Yersinia pestis KIM
auaugccaggcauc

SEQ ID NO: 4192724 - RNA, 17 nt, Yersinia pestis KIM
auaugcggcauaacuga

SEQ ID NO: 4192725 - RNA, 23 nt, Yersinia pestis KIM
auaugcucugcugggauacuggu

SEQ ID NO: 4192726 - RNA, 13 nt, Yersinia pestis KIM
auaugcuuauaaa

SEQ ID NO: 4192727 - RNA, 16 nt, Yersinia pestis KIM
auaugcuuauaaaccu

SEQ ID NO: 4192728 - RNA, 15 nt, Yersinia pestis KIM
auauggaugaugcac

SEQ ID NO: 4192729 - RNA, 22 nt, Yersinia pestis KIM
auauggaugaugcacagcugga

SEQ ID NO: 4192730 - RNA, 19 nt, Yersinia pestis KIM
auauggcggcaucagcaaa

SEQ ID NO: 4192731 - RNA, 15 nt, Yersinia pestis KIM
auaugggcauccauc

SEQ ID NO: 4192732 - RNA, 15 nt, Yersinia pestis KIM
auauggguuaaaaac

SEQ ID NO: 4192733 - RNA, 20 nt, Yersinia pestis KIM
auauguagggguacagcagg

SEQ ID NO: 4192734 - RNA, 20 nt, Yersinia pestis KIM
auaugucagauagaccaaug

SEQ ID NO: 4192735 - RNA, 20 nt, Yersinia pestis KIM
auauguucgaucaaaacaau

SEQ ID NO: 4192736 - RNA, 16 nt, Yersinia pestis KIM
auauguucuuccugug

SEQ ID NO: 4192737 - RNA, 23 nt, Yersinia pestis KIM
auauguugauuccguauuauuua

SEQ ID NO: 4192738 - RNA, 16 nt, Yersinia pestis KIM
auauuaaaaaagggag

SEQ ID NO: 4192739 - RNA, 22 nt, Yersinia pestis KIM
auauuaaaaaagggagcuuugc

SEQ ID NO: 4192740 - RNA, 12 nt, Yersinia pestis KIM
auauuaaaauag

SEQ ID NO: 4192741 - RNA, 12 nt, Yersinia pestis KIM
auauuaaaugca

SEQ ID NO: 4192742 - RNA, 15 nt, Yersinia pestis KIM
auauuaaaugcauua

SEQ ID NO: 4192743 - RNA, 18 nt, Yersinia pestis KIM
auauuaacauaucaauaa

SEQ ID NO: 4192744 - RNA, 13 nt, Yersinia pestis KIM
auauuaauccaua

SEQ ID NO: 4192745 - RNA, 12 nt, Yersinia pestis KIM
auauuaccgcug

SEQ ID NO: 4192746 - RNA, 14 nt, Yersinia pestis KIM
auauuacgcagcca

SEQ ID NO: 4192747 - RNA, 16 nt, Yersinia pestis KIM
auauuacgcagccaua

SEQ ID NO: 4192748 - RNA, 22 nt, Yersinia pestis KIM
auauuacgcagccauacccaaa

SEQ ID NO: 4192749 - RNA, 21 nt, Yersinia pestis KIM
auauuacggcccuccugacga

SEQ ID NO: 4192750 - RNA, 15 nt, Yersinia pestis KIM
auauuacucucuauu

SEQ ID NO: 4192751 - RNA, 17 nt, Yersinia pestis KIM
auauuacucucuauuga

SEQ ID NO: 4192752 - RNA, 16 nt, Yersinia pestis KIM
auauuagcaauuggcc

SEQ ID NO: 4192753 - RNA, 14 nt, Yersinia pestis KIM
auauuauaaugaaa

SEQ ID NO: 4192754 - RNA, 16 nt, Yersinia pestis KIM
auauuauaaugaaaua

SEQ ID NO: 4192755 - RNA, 16 nt, Yersinia pestis KIM
auauuaucauucaaga

SEQ ID NO: 4192756 - RNA, 15 nt, Yersinia pestis KIM
auauuauuagccaaa

SEQ ID NO: 4192757 - RNA, 21 nt, Yersinia pestis KIM
auauuauucauauugaauuaa

SEQ ID NO: 4192758 - RNA, 13 nt, Yersinia pestis KIM
auauuauuuugca

SEQ ID NO: 4192759 - RNA, 13 nt, Yersinia pestis KIM
auauucaccagac

SEQ ID NO: 4192760 - RNA, 20 nt, Yersinia pestis KIM
auauucaccaucugccugca

SEQ ID NO: 4192761 - RNA, 13 nt, Yersinia pestis KIM
auauucauuaaaa

SEQ ID NO: 4192762 - RNA, 14 nt, Yersinia pestis KIM
auauucauuaaaaa

SEQ ID NO: 4192763 - RNA, 12 nt, Yersinia pestis KIM
auauucauucuu

SEQ ID NO: 4192764 - RNA, 14 nt, Yersinia pestis KIM
auauucauucuuau

SEQ ID NO: 4192765 - RNA, 18 nt, Yersinia pestis KIM
auauucccccugagucaa

SEQ ID NO: 4192766 - RNA, 21 nt, Yersinia pestis KIM
auauucccugcguugcgaaau

SEQ ID NO: 4192767 - RNA, 23 nt, Yersinia pestis KIM
auauucccugcguugcgaaauaa

SEQ ID NO: 4192768 - RNA, 14 nt, Yersinia pestis KIM
auauucgcagccaa

SEQ ID NO: 4192769 - RNA, 21 nt, Yersinia pestis KIM
auauucgccagauugccaauc

SEQ ID NO: 4192770 - RNA, 14 nt, Yersinia pestis KIM
auauucgucucauc

SEQ ID NO: 4192771 - RNA, 13 nt, Yersinia pestis KIM
auauucucaauau

SEQ ID NO: 4192772 - RNA, 15 nt, Yersinia pestis KIM
auauucucauugccc

SEQ ID NO: 4192773 - RNA, 21 nt, Yersinia pestis KIM
auauucugcaugcuuuuuuau

SEQ ID NO: 4192774 - RNA, 16 nt, Yersinia pestis KIM
auauucuuagccagug

SEQ ID NO: 4192775 - RNA, 15 nt, Yersinia pestis KIM
auauugagaaucagu

SEQ ID NO: 4192776 - RNA, 17 nt, Yersinia pestis KIM
auauugauaaaaguaau

SEQ ID NO: 4192777 - RNA, 23 nt, Yersinia pestis KIM
auauugauaaaaguaauuuauca

SEQ ID NO: 4192778 - RNA, 21 nt, Yersinia pestis KIM
auauugauaauggcauuuuca

SEQ ID NO: 4192779 - RNA, 18 nt, Yersinia pestis KIM
auauugauagccacauca

SEQ ID NO: 4192780 - RNA, 14 nt, Yersinia pestis KIM
auauugauauagcg

SEQ ID NO: 4192781 - RNA, 16 nt, Yersinia pestis KIM
auauugaucuuuaaua

SEQ ID NO: 4192782 - RNA, 14 nt, Yersinia pestis KIM
auauugcauuuuac

SEQ ID NO: 4192783 - RNA, 16 nt, Yersinia pestis KIM
auauugccaucgggca

SEQ ID NO: 4192784 - RNA, 15 nt, Yersinia pestis KIM
auauugccaucuugu

SEQ ID NO: 4192785 - RNA, 21 nt, Yersinia pestis KIM
auauugcggaguaacacuuca

SEQ ID NO: 4192786 - RNA, 15 nt, Yersinia pestis KIM
auauuggcaacaaca

SEQ ID NO: 4192787 - RNA, 16 nt, Yersinia pestis KIM
auauuggcaacaacag

SEQ ID NO: 4192788 - RNA, 19 nt, Yersinia pestis KIM
auauuggcaauauucagua

SEQ ID NO: 4192789 - RNA, 19 nt, Yersinia pestis KIM
auauuggccgucagcagau

SEQ ID NO: 4192790 - RNA, 19 nt, Yersinia pestis KIM
auauugggccggagauaga

SEQ ID NO: 4192791 - RNA, 19 nt, Yersinia pestis KIM
auauuggggggcaguuuuu

SEQ ID NO: 4192792 - RNA, 22 nt, Yersinia pestis KIM
auauuggggggcaguuuuuuau

SEQ ID NO: 4192793 - RNA, 17 nt, Yersinia pestis KIM
auauuggucauuuuucc

SEQ ID NO: 4192794 - RNA, 18 nt, Yersinia pestis KIM
auauugucuuaugauaua

SEQ ID NO: 4192795 - RNA, 23 nt, Yersinia pestis KIM
auauuguggggccuuuauucauu

SEQ ID NO: 4192796 - RNA, 22 nt, Yersinia pestis KIM
auauuguguggcacgccaauca

SEQ ID NO: 4192797 - RNA, 13 nt, Yersinia pestis KIM
auauuuacgcaua

SEQ ID NO: 4192798 - RNA, 14 nt, Yersinia pestis KIM
auauuuauaaaaaa

SEQ ID NO: 4192799 - RNA, 17 nt, Yersinia pestis KIM
auauuuauccauuuaau

SEQ ID NO: 4192800 - RNA, 14 nt, Yersinia pestis KIM
auauuucaggcugu

SEQ ID NO: 4192801 - RNA, 22 nt, Yersinia pestis KIM
auauuuccguggguuauagcca

SEQ ID NO: 4192802 - RNA, 20 nt, Yersinia pestis KIM
auauuucgcccugcauauca

SEQ ID NO: 4192803 - RNA, 20 nt, Yersinia pestis KIM
auauuugggucgguaaccug

SEQ ID NO: 4192804 - RNA, 19 nt, Yersinia pestis KIM
auauuuguuugaauuuuag

SEQ ID NO: 4192805 - RNA, 12 nt, Yersinia pestis KIM
auauuuuaaaua

SEQ ID NO: 4192806 - RNA, 13 nt, Yersinia pestis KIM
auauuuuagcaau

SEQ ID NO: 4192807 - RNA, 18 nt, Yersinia pestis KIM
auauuuuagcauuuucca

SEQ ID NO: 4192808 - RNA, 19 nt, Yersinia pestis KIM
auauuuugcuuuaaauuca

SEQ ID NO: 4192809 - RNA, 17 nt, Yersinia pestis KIM
auauuuuuauuaauaua

SEQ ID NO: 4192810 - RNA, 14 nt, Yersinia pestis KIM
auauuuuuuauaua

SEQ ID NO: 4192811 - RNA, 19 nt, Yersinia pestis KIM
aucaaaacugauuaauagu

SEQ ID NO: 4192812 - RNA, 16 nt, Yersinia pestis KIM
aucaaaagcaagaccg

SEQ ID NO: 4192813 - RNA, 21 nt, Yersinia pestis KIM
aucaaaagggaucaccaggcu

SEQ ID NO: 4192814 - RNA, 14 nt, Yersinia pestis KIM
aucaaaauaucggu

SEQ ID NO: 4192815 - RNA, 22 nt, Yersinia pestis KIM
aucaaacaaaucuuaaauugaa

SEQ ID NO: 4192816 - RNA, 18 nt, Yersinia pestis KIM
aucaaacauaaccugcaa

SEQ ID NO: 4192817 - RNA, 16 nt, Yersinia pestis KIM
aucaaacggcuuuuua

SEQ ID NO: 4192818 - RNA, 18 nt, Yersinia pestis KIM
aucaaacggcuuuuuaaa

SEQ ID NO: 4192819 - RNA, 20 nt, Yersinia pestis KIM
aucaaacggcuuuuuaaacu

SEQ ID NO: 4192820 - RNA, 16 nt, Yersinia pestis KIM
aucaaaggagugcccg

SEQ ID NO: 4192821 - RNA, 22 nt, Yersinia pestis KIM
aucaaagugcuuaacccaccaa

SEQ ID NO: 4192822 - RNA, 15 nt, Yersinia pestis KIM
aucaacacauaaaau

SEQ ID NO: 4192823 - RNA, 19 nt, Yersinia pestis KIM
aucaacacugccugaugcu

SEQ ID NO: 4192824 - RNA, 14 nt, Yersinia pestis KIM
aucaacagaacuaa

SEQ ID NO: 4192825 - RNA, 23 nt, Yersinia pestis KIM
aucaacaggccaccuaacacuuu

SEQ ID NO: 4192826 - RNA, 20 nt, Yersinia pestis KIM
aucaacaugguccacaguca

SEQ ID NO: 4192827 - RNA, 18 nt, Yersinia pestis KIM
aucaacauuguccugcaa

SEQ ID NO: 4192828 - RNA, 18 nt, Yersinia pestis KIM
aucaacauuuuuagcuuc

SEQ ID NO: 4192829 - RNA, 15 nt, Yersinia pestis KIM
aucaaccaagacaua

SEQ ID NO: 4192830 - RNA, 22 nt, Yersinia pestis KIM
aucaacccccuguggaaacucu

SEQ ID NO: 4192831 - RNA, 20 nt, Yersinia pestis KIM
aucaaccgggauaucaaauu

SEQ ID NO: 4192832 - RNA, 15 nt, Yersinia pestis KIM
aucaaccucagccuc

SEQ ID NO: 4192833 - RNA, 16 nt, Yersinia pestis KIM
aucaaccucagccuca

SEQ ID NO: 4192834 - RNA, 22 nt, Yersinia pestis KIM
aucaaccucagccucauucaug

SEQ ID NO: 4192835 - RNA, 16 nt, Yersinia pestis KIM
aucaaccugaucauca

SEQ ID NO: 4192836 - RNA, 14 nt, Yersinia pestis KIM
aucaacgcccagcu

SEQ ID NO: 4192837 - RNA, 22 nt, Yersinia pestis KIM
aucaacgccguauuuuauaucu

SEQ ID NO: 4192838 - RNA, 18 nt, Yersinia pestis KIM
aucaacgcgccuuucggc

SEQ ID NO: 4192839 - RNA, 17 nt, Yersinia pestis KIM
aucaacgcucaaucacg

SEQ ID NO: 4192840 - RNA, 13 nt, Yersinia pestis KIM
aucaacugguuga

SEQ ID NO: 4192841 - RNA, 17 nt, Yersinia pestis KIM
aucaacuucugcaaaau

SEQ ID NO: 4192842 - RNA, 23 nt, Yersinia pestis KIM
aucaacuuucaccccuuucuugc

SEQ ID NO: 4192843 - RNA, 19 nt, Yersinia pestis KIM
aucaagaaaacagguaaug

SEQ ID NO: 4192844 - RNA, 13 nt, Yersinia pestis KIM
aucaagaucaaaa

SEQ ID NO: 4192845 - RNA, 21 nt, Yersinia pestis KIM
aucaagcacauucgcccgcgc

SEQ ID NO: 4192846 - RNA, 12 nt, Yersinia pestis KIM
aucaagccgcuu

SEQ ID NO: 4192847 - RNA, 15 nt, Yersinia pestis KIM
aucaaggauaagaau

SEQ ID NO: 4192848 - RNA, 16 nt, Yersinia pestis KIM
aucaagucuugaagag

SEQ ID NO: 4192849 - RNA, 18 nt, Yersinia pestis KIM
aucaaguugaaugaagcg

SEQ ID NO: 4192850 - RNA, 16 nt, Yersinia pestis KIM
aucaauaaagcuggcu

SEQ ID NO: 4192851 - RNA, 19 nt, Yersinia pestis KIM
aucaauacccugccaccuu

SEQ ID NO: 4192852 - RNA, 16 nt, Yersinia pestis KIM
aucaauaccuuacugc

SEQ ID NO: 4192853 - RNA, 18 nt, Yersinia pestis KIM
aucaauaccuuacugcau

SEQ ID NO: 4192854 - RNA, 13 nt, Yersinia pestis KIM
aucaauacugcaa

SEQ ID NO: 4192855 - RNA, 17 nt, Yersinia pestis KIM
aucaauacuguuaucac

SEQ ID NO: 4192856 - RNA, 14 nt, Yersinia pestis KIM
aucaauaggucagu

SEQ ID NO: 4192857 - RNA, 14 nt, Yersinia pestis KIM
aucaauauaacgcc

SEQ ID NO: 4192858 - RNA, 16 nt, Yersinia pestis KIM
aucaauauaagagaaa

SEQ ID NO: 4192859 - RNA, 23 nt, Yersinia pestis KIM
aucaauaucccgagaaacaaaac

SEQ ID NO: 4192860 - RNA, 15 nt, Yersinia pestis KIM
aucaaucaaaaaaua

SEQ ID NO: 4192861 - RNA, 13 nt, Yersinia pestis KIM
aucaaucagcuga

SEQ ID NO: 4192862 - RNA, 19 nt, Yersinia pestis KIM
aucaaucagcugauaugaa

SEQ ID NO: 4192863 - RNA, 22 nt, Yersinia pestis KIM
aucaaucagcugauaugaaaaa

SEQ ID NO: 4192864 - RNA, 16 nt, Yersinia pestis KIM
aucaaucucuucaugg

SEQ ID NO: 4192865 - RNA, 18 nt, Yersinia pestis KIM
aucaaugaaaauauccga

SEQ ID NO: 4192866 - RNA, 19 nt, Yersinia pestis KIM
aucaauggauucuugcugc

SEQ ID NO: 4192867 - RNA, 15 nt, Yersinia pestis KIM
aucaauggccagcgg

SEQ ID NO: 4192868 - RNA, 22 nt, Yersinia pestis KIM
aucaauggccagcgggaaucaa

SEQ ID NO: 4192869 - RNA, 17 nt, Yersinia pestis KIM
aucaauguuaucgccaa

SEQ ID NO: 4192870 - RNA, 23 nt, Yersinia pestis KIM
aucaauguuaucgccaacacuau

SEQ ID NO: 4192871 - RNA, 20 nt, Yersinia pestis KIM
aucaauguuggcccaagaua

SEQ ID NO: 4192872 - RNA, 15 nt, Yersinia pestis KIM
aucaauugcuggcua

SEQ ID NO: 4192873 - RNA, 22 nt, Yersinia pestis KIM
aucaauuuauacccguuauauu

SEQ ID NO: 4192874 - RNA, 17 nt, Yersinia pestis KIM
aucacaaaaccuuuaau

SEQ ID NO: 4192875 - RNA, 18 nt, Yersinia pestis KIM
aucacacccuccugcaca

SEQ ID NO: 4192876 - RNA, 15 nt, Yersinia pestis KIM
aucacauaauauuua

SEQ ID NO: 4192877 - RNA, 16 nt, Yersinia pestis KIM
aucacauaauauuuac

SEQ ID NO: 4192878 - RNA, 22 nt, Yersinia pestis KIM
aucacaucucggcguaaacaau

SEQ ID NO: 4192879 - RNA, 16 nt, Yersinia pestis KIM
aucacaugcggauuga

SEQ ID NO: 4192880 - RNA, 14 nt, Yersinia pestis KIM
aucaucacaaauaa

SEQ ID NO: 4192881 - RNA, 21 nt, Yersinia pestis KIM
aucaucacauucaaacacuua

SEQ ID NO: 4192882 - RNA, 15 nt, Yersinia pestis KIM
aucaucaccauucaa

SEQ ID NO: 4192883 - RNA, 16 nt, Yersinia pestis KIM
aucaucagacagccau

SEQ ID NO: 4192884 - RNA, 12 nt, Yersinia pestis KIM
aucaucaucaau

SEQ ID NO: 4192885 - RNA, 20 nt, Yersinia pestis KIM
aucaucaucgguaccgccag

SEQ ID NO: 4192886 - RNA, 22 nt, Yersinia pestis KIM
aucaucaucgguaccgccagaa

SEQ ID NO: 4192887 - RNA, 19 nt, Yersinia pestis KIM
aucaucaucuuuaauaaua

SEQ ID NO: 4192888 - RNA, 17 nt, Yersinia pestis KIM
aucauccccuauauacc

SEQ ID NO: 4192889 - RNA, 18 nt, Yersinia pestis KIM
aucauccgcucagcaaaa

SEQ ID NO: 4192890 - RNA, 23 nt, Yersinia pestis KIM
aucaucgacuugaugaaguuauu

SEQ ID NO: 4192891 - RNA, 13 nt, Yersinia pestis KIM
aucaucgaugccc

SEQ ID NO: 4192892 - RNA, 18 nt, Yersinia pestis KIM
aucaucgcucaucgccaa

SEQ ID NO: 4192893 - RNA, 16 nt, Yersinia pestis KIM
aucaucgcugacaauu

SEQ ID NO: 4192894 - RNA, 17 nt, Yersinia pestis KIM
aucaucgggcauucacu

SEQ ID NO: 4192895 - RNA, 19 nt, Yersinia pestis KIM
aucaucgggcauucacugc

SEQ ID NO: 4192896 - RNA, 14 nt, Yersinia pestis KIM
aucaucguaguaau

SEQ ID NO: 4192897 - RNA, 14 nt, Yersinia pestis KIM
aucaucuacaacau

SEQ ID NO: 4192898 - RNA, 21 nt, Yersinia pestis KIM
aucaucugguuuuuuuauaaa

SEQ ID NO: 4192899 - RNA, 14 nt, Yersinia pestis KIM
aucaucuucuucau

SEQ ID NO: 4192900 - RNA, 21 nt, Yersinia pestis KIM
aucaugaacggauacccagca

SEQ ID NO: 4192901 - RNA, 22 nt, Yersinia pestis KIM
aucaugaacggauacccagcac

SEQ ID NO: 4192902 - RNA, 16 nt, Yersinia pestis KIM
aucaugcgggauuacu

SEQ ID NO: 4192903 - RNA, 19 nt, Yersinia pestis KIM
aucaugcucaaucugcaau

SEQ ID NO: 4192904 - RNA, 18 nt, Yersinia pestis KIM
aucauggaagaccagaua

SEQ ID NO: 4192905 - RNA, 19 nt, Yersinia pestis KIM
aucauggcucagauugaac

SEQ ID NO: 4192906 - RNA, 14 nt, Yersinia pestis KIM
aucaugggccaauc

SEQ ID NO: 4192907 - RNA, 17 nt, Yersinia pestis KIM
aucaugguucugcucaa

SEQ ID NO: 4192908 - RNA, 15 nt, Yersinia pestis KIM
aucauguaaggcaau

SEQ ID NO: 4192909 - RNA, 15 nt, Yersinia pestis KIM
aucauuaagaugcau

SEQ ID NO: 4192910 - RNA, 15 nt, Yersinia pestis KIM
aucauuacaucaucu

SEQ ID NO: 4192911 - RNA, 15 nt, Yersinia pestis KIM
aucauuauagaauuc

SEQ ID NO: 4192912 - RNA, 20 nt, Yersinia pestis KIM
aucauuauauauuuuuucau

SEQ ID NO: 4192913 - RNA, 21 nt, Yersinia pestis KIM
aucauuauuauguauuuuuau

SEQ ID NO: 4192914 - RNA, 17 nt, Yersinia pestis KIM
aucauucaauuccugau

SEQ ID NO: 4192915 - RNA, 18 nt, Yersinia pestis KIM
aucauucauuuuaaaaaa

SEQ ID NO: 4192916 - RNA, 18 nt, Yersinia pestis KIM
aucauucgguuauuuaga

SEQ ID NO: 4192917 - RNA, 16 nt, Yersinia pestis KIM
aucauucugucaucaa

SEQ ID NO: 4192918 - RNA, 23 nt, Yersinia pestis KIM
aucauugacgugcaggcccagca

SEQ ID NO: 4192919 - RNA, 23 nt, Yersinia pestis KIM
aucauugccacgacgcagcucca

SEQ ID NO: 4192920 - RNA, 13 nt, Yersinia pestis KIM
aucauuggcaacu

SEQ ID NO: 4192921 - RNA, 21 nt, Yersinia pestis KIM
aucauuggcaacuuaagcauu

SEQ ID NO: 4192922 - RNA, 18 nt, Yersinia pestis KIM
aucauuuauuuuuccagg

SEQ ID NO: 4192923 - RNA, 18 nt, Yersinia pestis KIM
aucauuuguuucucaccg

SEQ ID NO: 4192924 - RNA, 16 nt, Yersinia pestis KIM
aucauuuguuuuuaau

SEQ ID NO: 4192925 - RNA, 21 nt, Yersinia pestis KIM
aucauuuucccgccaggaaau

SEQ ID NO: 4192926 - RNA, 17 nt, Yersinia pestis KIM
aucauuuuccugcauau

SEQ ID NO: 4192927 - RNA, 18 nt, Yersinia pestis KIM
aucauuuuccugcauauu

SEQ ID NO: 4192928 - RNA, 15 nt, Yersinia pestis KIM
auccaaaugacacuu

SEQ ID NO: 4192929 - RNA, 21 nt, Yersinia pestis KIM
auccaacguaaacauuggcuu

SEQ ID NO: 4192930 - RNA, 22 nt, Yersinia pestis KIM
auccaagccaccaccacggcca

SEQ ID NO: 4192931 - RNA, 15 nt, Yersinia pestis KIM
auccaaggcagauau

SEQ ID NO: 4192932 - RNA, 19 nt, Yersinia pestis KIM
auccaauaccaccaaugcg

SEQ ID NO: 4192933 - RNA, 22 nt, Yersinia pestis KIM
auccaaucauucugucaucaag

SEQ ID NO: 4192934 - RNA, 13 nt, Yersinia pestis KIM
auccaauucagua

SEQ ID NO: 4192935 - RNA, 14 nt, Yersinia pestis KIM
auccaauucaguac

SEQ ID NO: 4192936 - RNA, 17 nt, Yersinia pestis KIM
auccacaaugaucaaac

SEQ ID NO: 4192937 - RNA, 15 nt, Yersinia pestis KIM
auccacauaaaaaga

SEQ ID NO: 4192938 - RNA, 15 nt, Yersinia pestis KIM
auccaccauuugggg

SEQ ID NO: 4192939 - RNA, 22 nt, Yersinia pestis KIM
auccacgcaggcaaucagaaug

SEQ ID NO: 4192940 - RNA, 18 nt, Yersinia pestis KIM
auccacuuauaucuccac

SEQ ID NO: 4192941 - RNA, 17 nt, Yersinia pestis KIM
auccacuuuucagauag

SEQ ID NO: 4192942 - RNA, 14 nt, Yersinia pestis KIM
auccagaacaccaa

SEQ ID NO: 4192943 - RNA, 23 nt, Yersinia pestis KIM
auccagaacaccaacaccacacu

SEQ ID NO: 4192944 - RNA, 20 nt, Yersinia pestis KIM
auccagaacgucagauaacu

SEQ ID NO: 4192945 - RNA, 15 nt, Yersinia pestis KIM
auccagauauuuuac

SEQ ID NO: 4192946 - RNA, 13 nt, Yersinia pestis KIM
auccagauucaga

SEQ ID NO: 4192947 - RNA, 20 nt, Yersinia pestis KIM
auccagcaccacaauggcag

SEQ ID NO: 4192948 - RNA, 15 nt, Yersinia pestis KIM
auccagcgccaucag

SEQ ID NO: 4192949 - RNA, 21 nt, Yersinia pestis KIM
auccagcgcggcgaaacugac

SEQ ID NO: 4192950 - RNA, 21 nt, Yersinia pestis KIM
auccagcguaaacaguagcag

SEQ ID NO: 4192951 - RNA, 18 nt, Yersinia pestis KIM
auccaggaugguuaucaa

SEQ ID NO: 4192952 - RNA, 19 nt, Yersinia pestis KIM
auccaguauuucaguaacc

SEQ ID NO: 4192953 - RNA, 16 nt, Yersinia pestis KIM
auccaguccggccacg

SEQ ID NO: 4192954 - RNA, 20 nt, Yersinia pestis KIM
auccaguucgaccaauucac

SEQ ID NO: 4192955 - RNA, 23 nt, Yersinia pestis KIM
auccaguugcccggaguuugaga

SEQ ID NO: 4192956 - RNA, 18 nt, Yersinia pestis KIM
auccauacgaauuuuucc

SEQ ID NO: 4192957 - RNA, 21 nt, Yersinia pestis KIM
auccauagugauuauuuaaac

SEQ ID NO: 4192958 - RNA, 21 nt, Yersinia pestis KIM
auccauauuuggcauguucac

SEQ ID NO: 4192959 - RNA, 20 nt, Yersinia pestis KIM
auccaucccaacaauuugcg

SEQ ID NO: 4192960 - RNA, 13 nt, Yersinia pestis KIM
auccaucggaaac

SEQ ID NO: 4192961 - RNA, 16 nt, Yersinia pestis KIM
auccaucugauaaguu

SEQ ID NO: 4192962 - RNA, 22 nt, Yersinia pestis KIM
auccaucugaugaguguuuauu

SEQ ID NO: 4192963 - RNA, 13 nt, Yersinia pestis KIM
auccauguauauu

SEQ ID NO: 4192964 - RNA, 18 nt, Yersinia pestis KIM
auccauucggcuaaauaa

SEQ ID NO: 4192965 - RNA, 18 nt, Yersinia pestis KIM
auccauuguauugcucag

SEQ ID NO: 4192966 - RNA, 18 nt, Yersinia pestis KIM
auccauuucaaucacugc

SEQ ID NO: 4192967 - RNA, 15 nt, Yersinia pestis KIM
auccauuuucugcca

SEQ ID NO: 4192968 - RNA, 16 nt, Yersinia pestis KIM
auccauuuucugccaa

SEQ ID NO: 4192969 - RNA, 12 nt, Yersinia pestis KIM
aucccaauauua

SEQ ID NO: 4192970 - RNA, 12 nt, Yersinia pestis KIM
aucccaauauug

SEQ ID NO: 4192971 - RNA, 20 nt, Yersinia pestis KIM
aucccaauauugacaggauc

SEQ ID NO: 4192972 - RNA, 14 nt, Yersinia pestis KIM
aucccaaucaucau

SEQ ID NO: 4192973 - RNA, 15 nt, Yersinia pestis KIM
aucccaaugaauauu

SEQ ID NO: 4192974 - RNA, 15 nt, Yersinia pestis KIM
aucccacucuguagc

SEQ ID NO: 4192975 - RNA, 12 nt, Yersinia pestis KIM
aucccagcacag

SEQ ID NO: 4192976 - RNA, 23 nt, Yersinia pestis KIM
aucccaguuuuuaauuuaaacuc

SEQ ID NO: 4192977 - RNA, 19 nt, Yersinia pestis KIM
auccccaaacgcugaccau

SEQ ID NO: 4192978 - RNA, 20 nt, Yersinia pestis KIM
auccccacauugaccagauu

SEQ ID NO: 4192979 - RNA, 15 nt, Yersinia pestis KIM
auccccaccaacaca

SEQ ID NO: 4192980 - RNA, 23 nt, Yersinia pestis KIM
auccccacuuguaccugugccag

SEQ ID NO: 4192981 - RNA, 17 nt, Yersinia pestis KIM
auccccauggcuuucag

SEQ ID NO: 4192982 - RNA, 20 nt, Yersinia pestis KIM
auccccuuugacagcaucug

SEQ ID NO: 4192983 - RNA, 23 nt, Yersinia pestis KIM
auccccuuugacagcaucugcaa

SEQ ID NO: 4192984 - RNA, 22 nt, Yersinia pestis KIM
aucccgaaucaagcuacgccaa

SEQ ID NO: 4192985 - RNA, 13 nt, Yersinia pestis KIM
aucccgagacacu

SEQ ID NO: 4192986 - RNA, 13 nt, Yersinia pestis KIM
aucccgauauaaa

SEQ ID NO: 4192987 - RNA, 14 nt, Yersinia pestis KIM
aucccggugaucau

SEQ ID NO: 4192988 - RNA, 14 nt, Yersinia pestis KIM
aucccgugccagau

SEQ ID NO: 4192989 - RNA, 18 nt, Yersinia pestis KIM
aucccgugugauuuccau

SEQ ID NO: 4192990 - RNA, 15 nt, Yersinia pestis KIM
aucccguuccgcuuc

SEQ ID NO: 4192991 - RNA, 17 nt, Yersinia pestis KIM
aucccuaaaaucauuga

SEQ ID NO: 4192992 - RNA, 15 nt, Yersinia pestis KIM
aucccuauuuuuucc

SEQ ID NO: 4192993 - RNA, 22 nt, Yersinia pestis KIM
aucccuggcucaucaaaggagu

SEQ ID NO: 4192994 - RNA, 23 nt, Yersinia pestis KIM
aucguccuguaaggcccgcagua

SEQ ID NO: 4192995 - RNA, 19 nt, Yersinia pestis KIM
aucgugcaguaauggaaau

SEQ ID NO: 4192996 - RNA, 17 nt, Yersinia pestis KIM
aucgugcuccgcuucca

SEQ ID NO: 4192997 - RNA, 19 nt, Yersinia pestis KIM
aucguggcgcgcaucuaac

SEQ ID NO: 4192998 - RNA, 21 nt, Yersinia pestis KIM
aucguggcuguaaauaaauaa

SEQ ID NO: 4192999 - RNA, 15 nt, Yersinia pestis KIM
aucgugggcgcagaa

SEQ ID NO: 4193000 - RNA, 20 nt, Yersinia pestis KIM
aucguuaaaguuaucaccaa

SEQ ID NO: 4193001 - RNA, 20 nt, Yersinia pestis KIM
aucguuggugcgacaaagau

SEQ ID NO: 4193002 - RNA, 21 nt, Yersinia pestis KIM
aucguugugggguuuuuuaau

SEQ ID NO: 4193003 - RNA, 15 nt, Yersinia pestis KIM
aucuaaaaggauagg

SEQ ID NO: 4193004 - RNA, 17 nt, Yersinia pestis KIM
aucuaaacaauugccuu

SEQ ID NO: 4193005 - RNA, 11 nt, Yersinia pestis KIM
aucuaaauauu

SEQ ID NO: 4193006 - RNA, 13 nt, Yersinia pestis KIM
aucuaacucuucc

SEQ ID NO: 4193007 - RNA, 20 nt, Yersinia pestis KIM
aucuaacuggcccucuuuuu

SEQ ID NO: 4193008 - RNA, 14 nt, Yersinia pestis KIM
aucuaaguccaaga

SEQ ID NO: 4193009 - RNA, 16 nt, Yersinia pestis KIM
aucuaauuuauaaccu

SEQ ID NO: 4193010 - RNA, 22 nt, Yersinia pestis KIM
aucuacauaaucuuuacugcau

SEQ ID NO: 4193011 - RNA, 15 nt, Yersinia pestis KIM
aucuacuuuauucaa

SEQ ID NO: 4193012 - RNA, 13 nt, Yersinia pestis KIM
aucuagcagugau

SEQ ID NO: 4193013 - RNA, 18 nt, Yersinia pestis KIM
aucuauauagggaaauaa

SEQ ID NO: 4193014 - RNA, 16 nt, Yersinia pestis KIM
aucuauccaauccuuu

SEQ ID NO: 4193015 - RNA, 19 nt, Yersinia pestis KIM
aucuaucggugcagugcaa

SEQ ID NO: 4193016 - RNA, 16 nt, Yersinia pestis KIM
aucuaugcuauccaga

SEQ ID NO: 4193017 - RNA, 17 nt, Yersinia pestis KIM
aucuauuagaugugaaa

SEQ ID NO: 4193018 - RNA, 17 nt, Yersinia pestis KIM
aucuauugugucaauac

SEQ ID NO: 4193019 - RNA, 16 nt, Yersinia pestis KIM
aucuauuuccaucaaa

SEQ ID NO: 4193020 - RNA, 17 nt, Yersinia pestis KIM
aucuauuuccaucaaag

SEQ ID NO: 4193021 - RNA, 17 nt, Yersinia pestis KIM
aucuauuugaguuuuag

SEQ ID NO: 4193022 - RNA, 21 nt, Yersinia pestis KIM
aucuauuuuuauuucuccuua

SEQ ID NO: 4193023 - RNA, 16 nt, Yersinia pestis KIM
aucucacgcugaauaa

SEQ ID NO: 4193024 - RNA, 18 nt, Yersinia pestis KIM
aucucacgcugaauaaca

SEQ ID NO: 4193025 - RNA, 22 nt, Yersinia pestis KIM
aucucacgguagugacucauca

SEQ ID NO: 4193026 - RNA, 15 nt, Yersinia pestis KIM
aucucagaauuuuuu

SEQ ID NO: 4193027 - RNA, 23 nt, Yersinia pestis KIM
aucucagugagguuuuugauggu

SEQ ID NO: 4193028 - RNA, 11 nt, Yersinia pestis KIM
aucucaucaaa

SEQ ID NO: 4193029 - RNA, 23 nt, Yersinia pestis KIM
aucucaucaaucgucaauccaau

SEQ ID NO: 4193030 - RNA, 16 nt, Yersinia pestis KIM
aucucaucggcauacu

SEQ ID NO: 4193031 - RNA, 13 nt, Yersinia pestis KIM
aucuccagaagca

SEQ ID NO: 4193032 - RNA, 16 nt, Yersinia pestis KIM
aucuccaguaaaucua

SEQ ID NO: 4193033 - RNA, 19 nt, Yersinia pestis KIM
aucuccaguugcacaccau

SEQ ID NO: 4193034 - RNA, 18 nt, Yersinia pestis KIM
aucuccgcucuccuuuuc

SEQ ID NO: 4193035 - RNA, 13 nt, Yersinia pestis KIM
aucuccggacagg

SEQ ID NO: 4193036 - RNA, 16 nt, Yersinia pestis KIM
aucuccugguucacuc

SEQ ID NO: 4193037 - RNA, 21 nt, Yersinia pestis KIM
aucuccuguggcacaucaaua

SEQ ID NO: 4193038 - RNA, 14 nt, Yersinia pestis KIM
aucucgacaaaucc

SEQ ID NO: 4193039 - RNA, 19 nt, Yersinia pestis KIM
aucucgacaaauccuuuua

SEQ ID NO: 4193040 - RNA, 18 nt, Yersinia pestis KIM
aucucgagguguuuuccc

SEQ ID NO: 4193041 - RNA, 18 nt, Yersinia pestis KIM
aucucgauacauaccaua

SEQ ID NO: 4193042 - RNA, 16 nt, Yersinia pestis KIM
aucucggcuuucaggu

SEQ ID NO: 4193043 - RNA, 23 nt, Yersinia pestis KIM
aucucggggccacgguuggccgu

SEQ ID NO: 4193044 - RNA, 15 nt, Yersinia pestis KIM
aucucgguaaugcac

SEQ ID NO: 4193045 - RNA, 20 nt, Yersinia pestis KIM
aucucuaacagggaugaaua

SEQ ID NO: 4193046 - RNA, 20 nt, Yersinia pestis KIM
aucucuaucguuuggcaauu

SEQ ID NO: 4193047 - RNA, 14 nt, Yersinia pestis KIM
aucucuccagccug

SEQ ID NO: 4193048 - RNA, 20 nt, Yersinia pestis KIM
aucucuccagugcaaauuua

SEQ ID NO: 4193049 - RNA, 15 nt, Yersinia pestis KIM
aucucucgaacccgc

SEQ ID NO: 4193050 - RNA, 15 nt, Yersinia pestis KIM
aucucugccgcugaa

SEQ ID NO: 4193051 - RNA, 23 nt, Yersinia pestis KIM
aucucuggccguggucuugguca

SEQ ID NO: 4193052 - RNA, 16 nt, Yersinia pestis KIM
aucucugggugcugcu

SEQ ID NO: 4193053 - RNA, 16 nt, Yersinia pestis KIM
aucucuuaccccuuuc

SEQ ID NO: 4193054 - RNA, 17 nt, Yersinia pestis KIM
aucucuuccgacaggcu

SEQ ID NO: 4193055 - RNA, 18 nt, Yersinia pestis KIM
aucucuucgccuuugaug

SEQ ID NO: 4193056 - RNA, 21 nt, Yersinia pestis KIM
aucucuugauuaccaauaauu

SEQ ID NO: 4193057 - RNA, 20 nt, Yersinia pestis KIM
aucucuuuauauucaauauc

SEQ ID NO: 4193058 - RNA, 18 nt, Yersinia pestis KIM
aucugaaacggugaggau

SEQ ID NO: 4193059 - RNA, 19 nt, Yersinia pestis KIM
aucugaaacggugaggaua

SEQ ID NO: 4193060 - RNA, 21 nt, Yersinia pestis KIM
aucugaaacggugaggauagg

SEQ ID NO: 4193061 - RNA, 19 nt, Yersinia pestis KIM
aucugaauagcgcugcauc

SEQ ID NO: 4193062 - RNA, 17 nt, Yersinia pestis KIM
aucugaaugcugugacu

SEQ ID NO: 4193063 - RNA, 15 nt, Yersinia pestis KIM
aucugaccaaacauu

SEQ ID NO: 4193064 - RNA, 17 nt, Yersinia pestis KIM
aucugaccaaacauugu

SEQ ID NO: 4193065 - RNA, 15 nt, Yersinia pestis KIM
aucugauacugaacg

SEQ ID NO: 4193066 - RNA, 15 nt, Yersinia pestis KIM
aucugauaucucuuu

SEQ ID NO: 4193067 - RNA, 16 nt, Yersinia pestis KIM
aucugauaucucuuua

SEQ ID NO: 4193068 - RNA, 14 nt, Yersinia pestis KIM
aucugauauuauug

SEQ ID NO: 4193069 - RNA, 20 nt, Yersinia pestis KIM
aucugaucaaucucaucaau

SEQ ID NO: 4193070 - RNA, 21 nt, Yersinia pestis KIM
aucugcaacuucagccaccag

SEQ ID NO: 4193071 - RNA, 22 nt, Yersinia pestis KIM
aucugcacuguaauugcgucag

SEQ ID NO: 4193072 - RNA, 15 nt, Yersinia pestis KIM
aucugcauaccugga

SEQ ID NO: 4193073 - RNA, 22 nt, Yersinia pestis KIM
aucugcauaccuggaucacgau

SEQ ID NO: 4193074 - RNA, 15 nt, Yersinia pestis KIM
aucugcauugauuaa

SEQ ID NO: 4193075 - RNA, 19 nt, Yersinia pestis KIM
aucugccaccgcuccuuuc

SEQ ID NO: 4193076 - RNA, 22 nt, Yersinia pestis KIM
aucugcccagccugguuuuuua

SEQ ID NO: 4193077 - RNA, 22 nt, Yersinia pestis KIM
aucugccccaaccgaccacaaa

SEQ ID NO: 4193078 - RNA, 12 nt, Yersinia pestis KIM
aucugccuguuc

SEQ ID NO: 4193079 - RNA, 17 nt, Yersinia pestis KIM
aucugccuguucucucc

SEQ ID NO: 4193080 - RNA, 22 nt, Yersinia pestis KIM
aucugcggauuuacucgccuuu

SEQ ID NO: 4193081 - RNA, 23 nt, Yersinia pestis KIM
aucugcucauuaccaauaccauu

SEQ ID NO: 4193082 - RNA, 19 nt, Yersinia pestis KIM
aucugcuuuacugcuuuuc

SEQ ID NO: 4193083 - RNA, 21 nt, Yersinia pestis KIM
aucugcuuuacugcuuuucua

SEQ ID NO: 4193084 - RNA, 23 nt, Yersinia pestis KIM
aucugcuuuugaaacuguuugca

SEQ ID NO: 4193085 - RNA, 13 nt, Yersinia pestis KIM
aucuggaauuuau

SEQ ID NO: 4193086 - RNA, 15 nt, Yersinia pestis KIM
aucuggauauauuua

SEQ ID NO: 4193087 - RNA, 22 nt, Yersinia pestis KIM
aucuggcucaggaaucuucaau

SEQ ID NO: 4193088 - RNA, 19 nt, Yersinia pestis KIM
aucuggcuuucucaacagc

SEQ ID NO: 4193089 - RNA, 23 nt, Yersinia pestis KIM
aucuggucaucauguagccauug

SEQ ID NO: 4193090 - RNA, 23 nt, Yersinia pestis KIM
aucugguuuuuuuauaaauuacu

SEQ ID NO: 4193091 - RNA, 23 nt, Yersinia pestis KIM
aucugucuaagugccaguuaaua

SEQ ID NO: 4193092 - RNA, 12 nt, Yersinia pestis KIM
aucugugauaac

SEQ ID NO: 4193093 - RNA, 14 nt, Yersinia pestis KIM
aucuguggugacau

SEQ ID NO: 4193094 - RNA, 21 nt, Yersinia pestis KIM
aucugugucaguaccugaugu

SEQ ID NO: 4193095 - RNA, 12 nt, Yersinia pestis KIM
aucuguuauaaa

SEQ ID NO: 4193096 - RNA, 14 nt, Yersinia pestis KIM
aucuguuucaaaua

SEQ ID NO: 4193097 - RNA, 13 nt, Yersinia pestis KIM
aucuuaaaaauaa

SEQ ID NO: 4193098 - RNA, 14 nt, Yersinia pestis KIM
aucuuaaucacgau

SEQ ID NO: 4193099 - RNA, 19 nt, Yersinia pestis KIM
aucuuaccuucaguuuauu

SEQ ID NO: 4193100 - RNA, 17 nt, Yersinia pestis KIM
aucuuacugauacccgc

SEQ ID NO: 4193101 - RNA, 17 nt, Yersinia pestis KIM
aucuuauccacagcaug

SEQ ID NO: 4193102 - RNA, 17 nt, Yersinia pestis KIM
aucuuauuaauugguau

SEQ ID NO: 4193103 - RNA, 22 nt, Yersinia pestis KIM
aucuucagaaacggugaaaaua

SEQ ID NO: 4193104 - RNA, 19 nt, Yersinia pestis KIM
aucuucaguuugcugaaua

SEQ ID NO: 4193105 - RNA, 21 nt, Yersinia pestis KIM
aucuucauauacagaagagua

SEQ ID NO: 4193106 - RNA, 13 nt, Yersinia pestis KIM
aucuuccaaagga

SEQ ID NO: 4193107 - RNA, 16 nt, Yersinia pestis KIM
aucuuccaaaggaagg

SEQ ID NO: 4193108 - RNA, 19 nt, Yersinia pestis KIM
augagggaugaaaagagcu

SEQ ID NO: 4193109 - RNA, 22 nt, Yersinia pestis KIM
augagguaauacucauccagau

SEQ ID NO: 4193110 - RNA, 13 nt, Yersinia pestis KIM
augaguaaacaga

SEQ ID NO: 4193111 - RNA, 14 nt, Yersinia pestis KIM
augaguaaacagag

SEQ ID NO: 4193112 - RNA, 22 nt, Yersinia pestis KIM
augaguaaaccguacauuaaau

SEQ ID NO: 4193113 - RNA, 18 nt, Yersinia pestis KIM
augaguagagcgcaaagu

SEQ ID NO: 4193114 - RNA, 14 nt, Yersinia pestis KIM
augagucgcuggua

SEQ ID NO: 4193115 - RNA, 15 nt, Yersinia pestis KIM
augagucuauuuauu

SEQ ID NO: 4193116 - RNA, 22 nt, Yersinia pestis KIM
augagucuauuuauugcaaggu

SEQ ID NO: 4193117 - RNA, 20 nt, Yersinia pestis KIM
augaguguuuuucucagcau

SEQ ID NO: 4193118 - RNA, 17 nt, Yersinia pestis KIM
augaguuuuguccugag

SEQ ID NO: 4193119 - RNA, 13 nt, Yersinia pestis KIM
augauaaaauccu

SEQ ID NO: 4193120 - RNA, 23 nt, Yersinia pestis KIM
augauaagugaauaaaucaaagc

SEQ ID NO: 4193121 - RNA, 13 nt, Yersinia pestis KIM
augauagacagca

SEQ ID NO: 4193122 - RNA, 18 nt, Yersinia pestis KIM
augauagcgacacccuca

SEQ ID NO: 4193123 - RNA, 19 nt, Yersinia pestis KIM
augauauacccaccagaga

SEQ ID NO: 4193124 - RNA, 15 nt, Yersinia pestis KIM
augauauugaugacg

SEQ ID NO: 4193125 - RNA, 16 nt, Yersinia pestis KIM
augauauuuaucgauu

SEQ ID NO: 4193126 - RNA, 14 nt, Yersinia pestis KIM
augaucaaauuaua

SEQ ID NO: 4193127 - RNA, 23 nt, Yersinia pestis KIM
augaucaaauuauauaagagaug

SEQ ID NO: 4193128 - RNA, 18 nt, Yersinia pestis KIM
augaucaacgccaaaaua

SEQ ID NO: 4193129 - RNA, 20 nt, Yersinia pestis KIM
augaucaacgccaaaauaac

SEQ ID NO: 4193130 - RNA, 16 nt, Yersinia pestis KIM
augaucaucaagccaa

SEQ ID NO: 4193131 - RNA, 20 nt, Yersinia pestis KIM
augaucccugguuugccaua

SEQ ID NO: 4193132 - RNA, 14 nt, Yersinia pestis KIM
augauccggcgaug

SEQ ID NO: 4193133 - RNA, 22 nt, Yersinia pestis KIM
augauccuuuagcgcugcaucu

SEQ ID NO: 4193134 - RNA, 18 nt, Yersinia pestis KIM
augaucugaugaucaucu

SEQ ID NO: 4193135 - RNA, 17 nt, Yersinia pestis KIM
augaucuugauaaacau

SEQ ID NO: 4193136 - RNA, 11 nt, Yersinia pestis KIM
augaugacaau

SEQ ID NO: 4193137 - RNA, 14 nt, Yersinia pestis KIM
augaugaguaacau

SEQ ID NO: 4193138 - RNA, 15 nt, Yersinia pestis KIM
augaugauaucaccu

SEQ ID NO: 4193139 - RNA, 19 nt, Yersinia pestis KIM
augaugcuggguauauaua

SEQ ID NO: 4193140 - RNA, 19 nt, Yersinia pestis KIM
augauggcggugcuguauu

SEQ ID NO: 4193141 - RNA, 16 nt, Yersinia pestis KIM
augauguggcugcugu

SEQ ID NO: 4193142 - RNA, 18 nt, Yersinia pestis KIM
augauuaacggauacccu

SEQ ID NO: 4193143 - RNA, 19 nt, Yersinia pestis KIM
augauuaacggauacccuu

SEQ ID NO: 4193144 - RNA, 17 nt, Yersinia pestis KIM
augauuacaucacuuuu

SEQ ID NO: 4193145 - RNA, 15 nt, Yersinia pestis KIM
augauuauuuuaugg

SEQ ID NO: 4193146 - RNA, 14 nt, Yersinia pestis KIM
augauuauuuugug

SEQ ID NO: 4193147 - RNA, 22 nt, Yersinia pestis KIM
augauucguagaaacaucgcca

SEQ ID NO: 4193148 - RNA, 13 nt, Yersinia pestis KIM
augauucucuauu

SEQ ID NO: 4193149 - RNA, 15 nt, Yersinia pestis KIM
augauucucuauucu

SEQ ID NO: 4193150 - RNA, 13 nt, Yersinia pestis KIM
augauugauuauc

SEQ ID NO: 4193151 - RNA, 12 nt, Yersinia pestis KIM
augauuuuuaac

SEQ ID NO: 4193152 - RNA, 13 nt, Yersinia pestis KIM
augauuuuuuuca

SEQ ID NO: 4193153 - RNA, 14 nt, Yersinia pestis KIM
augauuuuuuucau

SEQ ID NO: 4193154 - RNA, 23 nt, Yersinia pestis KIM
augcaaaauaugguagaauuuac

SEQ ID NO: 4193155 - RNA, 20 nt, Yersinia pestis KIM
augcaaauaauaacgccugc

SEQ ID NO: 4193156 - RNA, 17 nt, Yersinia pestis KIM
augcaacuuggcaccua

SEQ ID NO: 4193157 - RNA, 15 nt, Yersinia pestis KIM
augcaaucuaacuaa

SEQ ID NO: 4193158 - RNA, 20 nt, Yersinia pestis KIM
augcaauuacugcauugcgu

SEQ ID NO: 4193159 - RNA, 19 nt, Yersinia pestis KIM
augcacaguugucugaggc

SEQ ID NO: 4193160 - RNA, 17 nt, Yersinia pestis KIM
augcacccaauggcaac

SEQ ID NO: 4193161 - RNA, 17 nt, Yersinia pestis KIM
augcaccgacaaagaua

SEQ ID NO: 4193162 - RNA, 16 nt, Yersinia pestis KIM
augcaccuacaaauuu

SEQ ID NO: 4193163 - RNA, 14 nt, Yersinia pestis KIM
augcacuccacuau

SEQ ID NO: 4193164 - RNA, 14 nt, Yersinia pestis KIM
augcagagaugcag

SEQ ID NO: 4193165 - RNA, 17 nt, Yersinia pestis KIM
augcagauaaccgugcg

SEQ ID NO: 4193166 - RNA, 19 nt, Yersinia pestis KIM
augcagcaucccaaugaau

SEQ ID NO: 4193167 - RNA, 16 nt, Yersinia pestis KIM
augcagcauuucagga

SEQ ID NO: 4193168 - RNA, 15 nt, Yersinia pestis KIM
augcagcgauuaagg

SEQ ID NO: 4193169 - RNA, 22 nt, Yersinia pestis KIM
augcagcguauucaguaaaaac

SEQ ID NO: 4193170 - RNA, 17 nt, Yersinia pestis KIM
augcagcuaaaagaugc

SEQ ID NO: 4193171 - RNA, 18 nt, Yersinia pestis KIM
augcagggagguuauauu

SEQ ID NO: 4193172 - RNA, 20 nt, Yersinia pestis KIM
augcaggggaaauggugucu

SEQ ID NO: 4193173 - RNA, 12 nt, Yersinia pestis KIM
augcaguaaaua

SEQ ID NO: 4193174 - RNA, 23 nt, Yersinia pestis KIM
augcaguaacgggucucaaugca

SEQ ID NO: 4193175 - RNA, 23 nt, Yersinia pestis KIM
augcaguaacucgacaaccuucu

SEQ ID NO: 4193176 - RNA, 14 nt, Yersinia pestis KIM
augcagucagcacu

SEQ ID NO: 4193177 - RNA, 22 nt, Yersinia pestis KIM
augcaguuaagguuagcuaugc

SEQ ID NO: 4193178 - RNA, 19 nt, Yersinia pestis KIM
augcaguuuuccucccugc

SEQ ID NO: 4193179 - RNA, 23 nt, Yersinia pestis KIM
augcaguuuuccucccugccaag

SEQ ID NO: 4193180 - RNA, 16 nt, Yersinia pestis KIM
augcauaagcacgaau

SEQ ID NO: 4193181 - RNA, 15 nt, Yersinia pestis KIM
augcaucgcaucaga

SEQ ID NO: 4193182 - RNA, 17 nt, Yersinia pestis KIM
augcaugaaaacccugu

SEQ ID NO: 4193183 - RNA, 14 nt, Yersinia pestis KIM
augcauuagugagc

SEQ ID NO: 4193184 - RNA, 13 nt, Yersinia pestis KIM
augcauuauaagg

SEQ ID NO: 4193185 - RNA, 14 nt, Yersinia pestis KIM
augccaaacccauu

SEQ ID NO: 4193186 - RNA, 24 nt, Yersinia pestis KIM
augccaaauaucuuucagcaccau

SEQ ID NO: 4193187 - RNA, 16 nt, Yersinia pestis KIM
augccaacaacugggu

SEQ ID NO: 4193188 - RNA, 22 nt, Yersinia pestis KIM
augccaauugacgccacuuauc

SEQ ID NO: 4193189 - RNA, 14 nt, Yersinia pestis KIM
augccacacucaga

SEQ ID NO: 4193190 - RNA, 19 nt, Yersinia pestis KIM
augccacuucgcuacgccg

SEQ ID NO: 4193191 - RNA, 12 nt, Yersinia pestis KIM
augccagcccca

SEQ ID NO: 4193192 - RNA, 20 nt, Yersinia pestis KIM
augccagcguggcccaggca

SEQ ID NO: 4193193 - RNA, 15 nt, Yersinia pestis KIM
augccauagcugcug

SEQ ID NO: 4193194 - RNA, 14 nt, Yersinia pestis KIM
augccaucccccuu

SEQ ID NO: 4193195 - RNA, 21 nt, Yersinia pestis KIM
augccauuaucuuuaauuuuc

SEQ ID NO: 4193196 - RNA, 15 nt, Yersinia pestis KIM
augccauuuacccug

SEQ ID NO: 4193197 - RNA, 13 nt, Yersinia pestis KIM
augcccauuagua

SEQ ID NO: 4193198 - RNA, 21 nt, Yersinia pestis KIM
augccccucacccguaaacac

SEQ ID NO: 4193199 - RNA, 22 nt, Yersinia pestis KIM
augccccucacccguaaacaca

SEQ ID NO: 4193200 - RNA, 19 nt, Yersinia pestis KIM
augcccugagauuauuggc

SEQ ID NO: 4193201 - RNA, 19 nt, Yersinia pestis KIM
augccgcaggucccucuug

SEQ ID NO: 4193202 - RNA, 16 nt, Yersinia pestis KIM
augccgcuccagcacu

SEQ ID NO: 4193203 - RNA, 14 nt, Yersinia pestis KIM
augccggugagcac

SEQ ID NO: 4193204 - RNA, 20 nt, Yersinia pestis KIM
augccguuaauugugaucag

SEQ ID NO: 4193205 - RNA, 19 nt, Yersinia pestis KIM
augccugagcuauugcaac

SEQ ID NO: 4193206 - RNA, 20 nt, Yersinia pestis KIM
augccugcgaauuaucaucc

SEQ ID NO: 4193207 - RNA, 21 nt, Yersinia pestis KIM
augccuggugcaaccgcugaa

SEQ ID NO: 4193208 - RNA, 18 nt, Yersinia pestis KIM
augccuuggcaaagagac

SEQ ID NO: 4193209 - RNA, 15 nt, Yersinia pestis KIM
augccuuguuucugg

SEQ ID NO: 4193210 - RNA, 21 nt, Yersinia pestis KIM
augccuuuuaaaugaagcagu

SEQ ID NO: 4193211 - RNA, 12 nt, Yersinia pestis KIM
augccuuuucuu

SEQ ID NO: 4193212 - RNA, 13 nt, Yersinia pestis KIM
augccuuuucuuc

SEQ ID NO: 4193213 - RNA, 14 nt, Yersinia pestis KIM
augcgaauacuuug

SEQ ID NO: 4193214 - RNA, 14 nt, Yersinia pestis KIM
augcgagcaaggca

SEQ ID NO: 4193215 - RNA, 22 nt, Yersinia pestis KIM
augcgauacgcccgccccagca

SEQ ID NO: 4193216 - RNA, 16 nt, Yersinia pestis KIM
augcgcgaauagcugg

SEQ ID NO: 4193217 - RNA, 17 nt, Yersinia pestis KIM
augcgcgcgucacuaaa

SEQ ID NO: 4193218 - RNA, 17 nt, Yersinia pestis KIM
augcgcucacuuuuauu

SEQ ID NO: 4193219 - RNA, 14 nt, Yersinia pestis KIM
augcgcuccgccau

SEQ ID NO: 4193220 - RNA, 14 nt, Yersinia pestis KIM
augcggaagaaggc

SEQ ID NO: 4193221 - RNA, 19 nt, Yersinia pestis KIM
augcggguuucauccccac

SEQ ID NO: 4193222 - RNA, 17 nt, Yersinia pestis KIM
augcguugaugcucuuc

SEQ ID NO: 4193223 - RNA, 18 nt, Yersinia pestis KIM
augguugaaugaccaagg

SEQ ID NO: 4193224 - RNA, 14 nt, Yersinia pestis KIM
augguuggcuauca

SEQ ID NO: 4193225 - RNA, 23 nt, Yersinia pestis KIM
augguuuccuucaccaaaaaaac

SEQ ID NO: 4193226 - RNA, 17 nt, Yersinia pestis KIM
augguuuuucaguuggg

SEQ ID NO: 4193227 - RNA, 15 nt, Yersinia pestis KIM
auguaacacacagca

SEQ ID NO: 4193228 - RNA, 17 nt, Yersinia pestis KIM
auguaaggcaauaccaa

SEQ ID NO: 4193229 - RNA, 15 nt, Yersinia pestis KIM
auguaaugccacacu

SEQ ID NO: 4193230 - RNA, 17 nt, Yersinia pestis KIM
auguaaugccacacuca

SEQ ID NO: 4193231 - RNA, 16 nt, Yersinia pestis KIM
auguacacauuauuua

SEQ ID NO: 4193232 - RNA, 21 nt, Yersinia pestis KIM
auguacauuauucaugaugcc

SEQ ID NO: 4193233 - RNA, 21 nt, Yersinia pestis KIM
auguacgcaaguaucuuaccg

SEQ ID NO: 4193234 - RNA, 20 nt, Yersinia pestis KIM
auguagcacacuaccgucuu

SEQ ID NO: 4193235 - RNA, 12 nt, Yersinia pestis KIM
auguagccuaug

SEQ ID NO: 4193236 - RNA, 16 nt, Yersinia pestis KIM
auguaggcaauacacc

SEQ ID NO: 4193237 - RNA, 19 nt, Yersinia pestis KIM
auguaguacuuaccuuccc

SEQ ID NO: 4193238 - RNA, 21 nt, Yersinia pestis KIM
auguaguuaaucuacccgagu

SEQ ID NO: 4193239 - RNA, 22 nt, Yersinia pestis KIM
auguauuagcgcugcucaauca

SEQ ID NO: 4193240 - RNA, 15 nt, Yersinia pestis KIM
auguauucaagcgau

SEQ ID NO: 4193241 - RNA, 20 nt, Yersinia pestis KIM
auguauucccucaauagcua

SEQ ID NO: 4193242 - RNA, 19 nt, Yersinia pestis KIM
auguauuuauucaaaaaau

SEQ ID NO: 4193243 - RNA, 18 nt, Yersinia pestis KIM
augucaccuccacuucaa

SEQ ID NO: 4193244 - RNA, 13 nt, Yersinia pestis KIM
augucacuugccc

SEQ ID NO: 4193245 - RNA, 15 nt, Yersinia pestis KIM
augucagagauaaac

SEQ ID NO: 4193246 - RNA, 13 nt, Yersinia pestis KIM
augucagauuagu

SEQ ID NO: 4193247 - RNA, 13 nt, Yersinia pestis KIM
augucaugauaaa

SEQ ID NO: 4193248 - RNA, 19 nt, Yersinia pestis KIM
augucaugcaauuacugca

SEQ ID NO: 4193249 - RNA, 13 nt, Yersinia pestis KIM
augucccucuguc

SEQ ID NO: 4193250 - RNA, 15 nt, Yersinia pestis KIM
auguccucaccauuu

SEQ ID NO: 4193251 - RNA, 18 nt, Yersinia pestis KIM
augucgcuguagcgccag

SEQ ID NO: 4193252 - RNA, 23 nt, Yersinia pestis KIM
augucgcuguagcgccagguaag

SEQ ID NO: 4193253 - RNA, 18 nt, Yersinia pestis KIM
augucgucaauuaaaauu

SEQ ID NO: 4193254 - RNA, 20 nt, Yersinia pestis KIM
augucucaggauacaaauga

SEQ ID NO: 4193255 - RNA, 14 nt, Yersinia pestis KIM
augucucuauucac

SEQ ID NO: 4193256 - RNA, 19 nt, Yersinia pestis KIM
augucucuauucacuauuu

SEQ ID NO: 4193257 - RNA, 20 nt, Yersinia pestis KIM
augucucuggcgcgaaaugc

SEQ ID NO: 4193258 - RNA, 21 nt, Yersinia pestis KIM
augucuuuacuaaauuagaaa

SEQ ID NO: 4193259 - RNA, 22 nt, Yersinia pestis KIM
augucuuuuucuuuuuaacuua

SEQ ID NO: 4193260 - RNA, 14 nt, Yersinia pestis KIM
augugaaaagcagu

SEQ ID NO: 4193261 - RNA, 13 nt, Yersinia pestis KIM
augugaagagcgg

SEQ ID NO: 4193262 - RNA, 17 nt, Yersinia pestis KIM
augugauaagucgucug

SEQ ID NO: 4193263 - RNA, 22 nt, Yersinia pestis KIM
augugauaagucgucugauauu

SEQ ID NO: 4193264 - RNA, 22 nt, Yersinia pestis KIM
auguggauaauuucagcagcac

SEQ ID NO: 4193265 - RNA, 18 nt, Yersinia pestis KIM
auguggcugcuguugcca

SEQ ID NO: 4193266 - RNA, 13 nt, Yersinia pestis KIM
auguggcuguauu

SEQ ID NO: 4193267 - RNA, 14 nt, Yersinia pestis KIM
augugguguuggcg

SEQ ID NO: 4193268 - RNA, 19 nt, Yersinia pestis KIM
augugguguuggcgauaaa

SEQ ID NO: 4193269 - RNA, 17 nt, Yersinia pestis KIM
auguguaccaaauaaac

SEQ ID NO: 4193270 - RNA, 20 nt, Yersinia pestis KIM
auguguaguugaaguucaca

SEQ ID NO: 4193271 - RNA, 14 nt, Yersinia pestis KIM
auguguugaauauc

SEQ ID NO: 4193272 - RNA, 17 nt, Yersinia pestis KIM
auguuaaaccaaagaua

SEQ ID NO: 4193273 - RNA, 19 nt, Yersinia pestis KIM
auguuaaaccaaagauaau

SEQ ID NO: 4193274 - RNA, 13 nt, Yersinia pestis KIM
auguuaaaucagu

SEQ ID NO: 4193275 - RNA, 17 nt, Yersinia pestis KIM
auguuaacucagccaca

SEQ ID NO: 4193276 - RNA, 16 nt, Yersinia pestis KIM
auguuaucgccaacac

SEQ ID NO: 4193277 - RNA, 20 nt, Yersinia pestis KIM
auguuaucgccaacacuauu

SEQ ID NO: 4193278 - RNA, 16 nt, Yersinia pestis KIM
auguuauggauuuuua

SEQ ID NO: 4193279 - RNA, 14 nt, Yersinia pestis KIM
auguuauuaaugau

SEQ ID NO: 4193280 - RNA, 15 nt, Yersinia pestis KIM
auguuauuugaauaa

SEQ ID NO: 4193281 - RNA, 17 nt, Yersinia pestis KIM
auguucaacaagaaauc

SEQ ID NO: 4193282 - RNA, 18 nt, Yersinia pestis KIM
auguucaacaagaaauca

SEQ ID NO: 4193283 - RNA, 16 nt, Yersinia pestis KIM
auguucacaucgguca

SEQ ID NO: 4193284 - RNA, 17 nt, Yersinia pestis KIM
auguucagcucaagaau

SEQ ID NO: 4193285 - RNA, 19 nt, Yersinia pestis KIM
auguucccccuucagccuu

SEQ ID NO: 4193286 - RNA, 20 nt, Yersinia pestis KIM
auguucgcacugcucugccc

SEQ ID NO: 4193287 - RNA, 20 nt, Yersinia pestis KIM
auguucucuggguaagaaca

SEQ ID NO: 4193288 - RNA, 12 nt, Yersinia pestis KIM
auguucugccaa

SEQ ID NO: 4193289 - RNA, 16 nt, Yersinia pestis KIM
auguucuuccugugcg

SEQ ID NO: 4193290 - RNA, 16 nt, Yersinia pestis KIM
auguugaccaaacaga

SEQ ID NO: 4193291 - RNA, 12 nt, Yersinia pestis KIM
auguugacguuc

SEQ ID NO: 4193292 - RNA, 21 nt, Yersinia pestis KIM
auguugauuccguauuauuua

SEQ ID NO: 4193293 - RNA, 19 nt, Yersinia pestis KIM
auguugcaaacagguaaau

SEQ ID NO: 4193294 - RNA, 14 nt, Yersinia pestis KIM
auguugcaacaugc

SEQ ID NO: 4193295 - RNA, 15 nt, Yersinia pestis KIM
auguugcauucccaa

SEQ ID NO: 4193296 - RNA, 18 nt, Yersinia pestis KIM
auguugccaaugggccaa

SEQ ID NO: 4193297 - RNA, 20 nt, Yersinia pestis KIM
auguugcccuuaguuggcaa

SEQ ID NO: 4193298 - RNA, 22 nt, Yersinia pestis KIM
auguuucuauccgaaaaauauu

SEQ ID NO: 4193299 - RNA, 18 nt, Yersinia pestis KIM
auguuugccgguaugcca

SEQ ID NO: 4193300 - RNA, 17 nt, Yersinia pestis KIM
auguuuguugauguaag

SEQ ID NO: 4193301 - RNA, 14 nt, Yersinia pestis KIM
auuaaaaaauaauu

SEQ ID NO: 4193302 - RNA, 13 nt, Yersinia pestis KIM
auuaaaaauacaa

SEQ ID NO: 4193303 - RNA, 14 nt, Yersinia pestis KIM
auuaaaaauacaac

SEQ ID NO: 4193304 - RNA, 16 nt, Yersinia pestis KIM
auuaaaaccacgcauu

SEQ ID NO: 4193305 - RNA, 17 nt, Yersinia pestis KIM
auuaaaacugaaaaguu

SEQ ID NO: 4193306 - RNA, 21 nt, Yersinia pestis KIM
auuaaaaucacccgcaagaau

SEQ ID NO: 4193307 - RNA, 22 nt, Yersinia pestis KIM
auuaaaaugauaugcuuauaaa

SEQ ID NO: 4193308 - RNA, 11 nt, Yersinia pestis KIM
auuaaacagau

SEQ ID NO: 4193309 - RNA, 12 nt, Yersinia pestis KIM
auuaaaccugac

SEQ ID NO: 4193310 - RNA, 13 nt, Yersinia pestis KIM
auuaaacgcucau

SEQ ID NO: 4193311 - RNA, 14 nt, Yersinia pestis KIM
auuaaagauuucau

SEQ ID NO: 4193312 - RNA, 22 nt, Yersinia pestis KIM
auuaaagauuucaucauucaau

SEQ ID NO: 4193313 - RNA, 18 nt, Yersinia pestis KIM
auuaaagguacguaauuu

SEQ ID NO: 4193314 - RNA, 18 nt, Yersinia pestis KIM
auuaaaguuuagcaaagc

SEQ ID NO: 4193315 - RNA, 20 nt, Yersinia pestis KIM
auuaaaguuuagcaaagcau

SEQ ID NO: 4193316 - RNA, 13 nt, Yersinia pestis KIM
auuaaauuauuua

SEQ ID NO: 4193317 - RNA, 17 nt, Yersinia pestis KIM
auuaaauuuuauauuau

SEQ ID NO: 4193318 - RNA, 20 nt, Yersinia pestis KIM
auuaaauuuuaugacacaua

SEQ ID NO: 4193319 - RNA, 23 nt, Yersinia pestis KIM
auuaacaagcgaccaucaugaau

SEQ ID NO: 4193320 - RNA, 22 nt, Yersinia pestis KIM
auuaacaauuacuuuggcauuu

SEQ ID NO: 4193321 - RNA, 12 nt, Yersinia pestis KIM
auuaacacaucu

SEQ ID NO: 4193322 - RNA, 20 nt, Yersinia pestis KIM
auuaacacauuaauuuaucu

SEQ ID NO: 4193323 - RNA, 22 nt, Yersinia pestis KIM
auuaacacccaauaauaaaaaa

SEQ ID NO: 4193324 - RNA, 19 nt, Yersinia pestis KIM
auuaacaccuuauucccgu

SEQ ID NO: 4193325 - RNA, 12 nt, Yersinia pestis KIM
auuaacauccau

SEQ ID NO: 4193326 - RNA, 13 nt, Yersinia pestis KIM
auuaacauucucu

SEQ ID NO: 4193327 - RNA, 22 nt, Yersinia pestis KIM
auuaaccaagcucgccaucgca

SEQ ID NO: 4193328 - RNA, 14 nt, Yersinia pestis KIM
auuaaccuaaaaac

SEQ ID NO: 4193329 - RNA, 20 nt, Yersinia pestis KIM
auuaaccuaaaaacgucacu

SEQ ID NO: 4193330 - RNA, 19 nt, Yersinia pestis KIM
auuaaccuuaauuugcuuu

SEQ ID NO: 4193331 - RNA, 16 nt, Yersinia pestis KIM
auuaaccuuaucacca

SEQ ID NO: 4193332 - RNA, 13 nt, Yersinia pestis KIM
auuaacgacauuu

SEQ ID NO: 4193333 - RNA, 11 nt, Yersinia pestis KIM
auuaacugcag

SEQ ID NO: 4193334 - RNA, 15 nt, Yersinia pestis KIM
auuaacuucaauuug

SEQ ID NO: 4193335 - RNA, 21 nt, Yersinia pestis KIM
auuaagauaauagcuaaacau

SEQ ID NO: 4193336 - RNA, 15 nt, Yersinia pestis KIM
auuaagauuaagcca

SEQ ID NO: 4193337 - RNA, 12 nt, Yersinia pestis KIM
auuaaggagugc

SEQ ID NO: 4193338 - RNA, 16 nt, Yersinia pestis KIM
auuauuaaacuugcuc

SEQ ID NO: 4193339 - RNA, 14 nt, Yersinia pestis KIM
auuauuacuagaca

SEQ ID NO: 4193340 - RNA, 22 nt, Yersinia pestis KIM
auuauuacucagcacauuuuua

SEQ ID NO: 4193341 - RNA, 21 nt, Yersinia pestis KIM
auuauuauaaauuuucaguuc

SEQ ID NO: 4193342 - RNA, 13 nt, Yersinia pestis KIM
auuauuauuacua

SEQ ID NO: 4193343 - RNA, 15 nt, Yersinia pestis KIM
auuauucaacgugac

SEQ ID NO: 4193344 - RNA, 18 nt, Yersinia pestis KIM
auuauucauauugaauua

SEQ ID NO: 4193345 - RNA, 12 nt, Yersinia pestis KIM
auuauucugcuc

SEQ ID NO: 4193346 - RNA, 19 nt, Yersinia pestis KIM
auuauucuucaccacgauu

SEQ ID NO: 4193347 - RNA, 15 nt, Yersinia pestis KIM
auuauugaccagaua

SEQ ID NO: 4193348 - RNA, 18 nt, Yersinia pestis KIM
auuauugauguuauuaau

SEQ ID NO: 4193349 - RNA, 11 nt, Yersinia pestis KIM
auuauugcugu

SEQ ID NO: 4193350 - RNA, 17 nt, Yersinia pestis KIM
auuauuggcgauuuaau

SEQ ID NO: 4193351 - RNA, 22 nt, Yersinia pestis KIM
auuauuggcuucugcuucuugu

SEQ ID NO: 4193352 - RNA, 16 nt, Yersinia pestis KIM
auuauuuaaacaauga

SEQ ID NO: 4193353 - RNA, 19 nt, Yersinia pestis KIM
auuauuuaaacaaugaaau

SEQ ID NO: 4193354 - RNA, 21 nt, Yersinia pestis KIM
auuauuuaaacaaugaaauug

SEQ ID NO: 4193355 - RNA, 14 nt, Yersinia pestis KIM
auuauuuaucaauc

SEQ ID NO: 4193356 - RNA, 17 nt, Yersinia pestis KIM
auuauuuauuuacagcc

SEQ ID NO: 4193357 - RNA, 16 nt, Yersinia pestis KIM
auuauuucucugauga

SEQ ID NO: 4193358 - RNA, 12 nt, Yersinia pestis KIM
auuauuuuaugg

SEQ ID NO: 4193359 - RNA, 21 nt, Yersinia pestis KIM
auuauuuuguacgaauaacuc

SEQ ID NO: 4193360 - RNA, 21 nt, Yersinia pestis KIM
auuauuuugugcguaaagaaa

SEQ ID NO: 4193361 - RNA, 16 nt, Yersinia pestis KIM
auuauuuuuauacaga

SEQ ID NO: 4193362 - RNA, 14 nt, Yersinia pestis KIM
auuauuuuucacga

SEQ ID NO: 4193363 - RNA, 21 nt, Yersinia pestis KIM
auucaaaaauuucguuaagau

SEQ ID NO: 4193364 - RNA, 15 nt, Yersinia pestis KIM
auucaaaauagaaaa

SEQ ID NO: 4193365 - RNA, 15 nt, Yersinia pestis KIM
auucaaaauagggaa

SEQ ID NO: 4193366 - RNA, 16 nt, Yersinia pestis KIM
auucaaaauagggaag

SEQ ID NO: 4193367 - RNA, 23 nt, Yersinia pestis KIM
auucaaaauguauuauuuuguac

SEQ ID NO: 4193368 - RNA, 16 nt, Yersinia pestis KIM
auucaaacggugugca

SEQ ID NO: 4193369 - RNA, 22 nt, Yersinia pestis KIM
auucaaacggugugcaaugcag

SEQ ID NO: 4193370 - RNA, 19 nt, Yersinia pestis KIM
auucaaccaauuauccauc

SEQ ID NO: 4193371 - RNA, 16 nt, Yersinia pestis KIM
auucaacgccaauacc

SEQ ID NO: 4193372 - RNA, 20 nt, Yersinia pestis KIM
auucaacuugccugaaauug

SEQ ID NO: 4193373 - RNA, 15 nt, Yersinia pestis KIM
auucaagaaaaugau

SEQ ID NO: 4193374 - RNA, 16 nt, Yersinia pestis KIM
auucaagaaaaugauu

SEQ ID NO: 4193375 - RNA, 17 nt, Yersinia pestis KIM
auucaagagagguaaug

SEQ ID NO: 4193376 - RNA, 20 nt, Yersinia pestis KIM
auucaaggccagcacguuuu

SEQ ID NO: 4193377 - RNA, 13 nt, Yersinia pestis KIM
auucaauaucacu

SEQ ID NO: 4193378 - RNA, 16 nt, Yersinia pestis KIM
auucaauaucacugau

SEQ ID NO: 4193379 - RNA, 21 nt, Yersinia pestis KIM
auucaauccauugaucucauu

SEQ ID NO: 4193380 - RNA, 15 nt, Yersinia pestis KIM
auucaaucggcagau

SEQ ID NO: 4193381 - RNA, 22 nt, Yersinia pestis KIM
auucaaugacuccugaaauaaa

SEQ ID NO: 4193382 - RNA, 23 nt, Yersinia pestis KIM
auucaaugacuccugaaauaaag

SEQ ID NO: 4193383 - RNA, 22 nt, Yersinia pestis KIM
auucaaugcggcuuuacuggcu

SEQ ID NO: 4193384 - RNA, 16 nt, Yersinia pestis KIM
auucaauugaaauaag

SEQ ID NO: 4193385 - RNA, 15 nt, Yersinia pestis KIM
auucaauugugcaaa

SEQ ID NO: 4193386 - RNA, 23 nt, Yersinia pestis KIM
auucaauugugcaaaaucagcau

SEQ ID NO: 4193387 - RNA, 22 nt, Yersinia pestis KIM
auucacaacagugcaacauuaa

SEQ ID NO: 4193388 - RNA, 22 nt, Yersinia pestis KIM
auucacaacauagguuuuuuca

SEQ ID NO: 4193389 - RNA, 12 nt, Yersinia pestis KIM
auucacagcaga

SEQ ID NO: 4193390 - RNA, 15 nt, Yersinia pestis KIM
auucaccaccauauu

SEQ ID NO: 4193391 - RNA, 16 nt, Yersinia pestis KIM
auucaccagcaauaaa

SEQ ID NO: 4193392 - RNA, 15 nt, Yersinia pestis KIM
auucacccuuuaaau

SEQ ID NO: 4193393 - RNA, 13 nt, Yersinia pestis KIM
auucaccuucaau

SEQ ID NO: 4193394 - RNA, 15 nt, Yersinia pestis KIM
auucacgcaaggcca

SEQ ID NO: 4193395 - RNA, 18 nt, Yersinia pestis KIM
auucacgcaaggccaggu

SEQ ID NO: 4193396 - RNA, 17 nt, Yersinia pestis KIM
auucacgcccuacugag

SEQ ID NO: 4193397 - RNA, 14 nt, Yersinia pestis KIM
auucacgccuaucu

SEQ ID NO: 4193398 - RNA, 15 nt, Yersinia pestis KIM
auucacguuuuucca

SEQ ID NO: 4193399 - RNA, 16 nt, Yersinia pestis KIM
auucacuauagacuca

SEQ ID NO: 4193400 - RNA, 22 nt, Yersinia pestis KIM
auucacuauuuauuaaucuauu

SEQ ID NO: 4193401 - RNA, 16 nt, Yersinia pestis KIM
auucacugaguugaga

SEQ ID NO: 4193402 - RNA, 12 nt, Yersinia pestis KIM
auucacugcuaa

SEQ ID NO: 4193403 - RNA, 19 nt, Yersinia pestis KIM
auucagacgacgugcagcg

SEQ ID NO: 4193404 - RNA, 23 nt, Yersinia pestis KIM
auucagacgguugcuagagcaug

SEQ ID NO: 4193405 - RNA, 22 nt, Yersinia pestis KIM
auucagagcacugugcgccauu

SEQ ID NO: 4193406 - RNA, 12 nt, Yersinia pestis KIM
auucagcaauau

SEQ ID NO: 4193407 - RNA, 17 nt, Yersinia pestis KIM
auucagcagcauuucuc

SEQ ID NO: 4193408 - RNA, 22 nt, Yersinia pestis KIM
auucagcaucaaauuauuuuuc

SEQ ID NO: 4193409 - RNA, 22 nt, Yersinia pestis KIM
auucagcguuuuauuuggcuca

SEQ ID NO: 4193410 - RNA, 12 nt, Yersinia pestis KIM
auucagcuucag

SEQ ID NO: 4193411 - RNA, 19 nt, Yersinia pestis KIM
auucagcuucagcucuucu

SEQ ID NO: 4193412 - RNA, 17 nt, Yersinia pestis KIM
auucaguacauaaaccg

SEQ ID NO: 4193413 - RNA, 15 nt, Yersinia pestis KIM
auucaguugauugca

SEQ ID NO: 4193414 - RNA, 20 nt, Yersinia pestis KIM
auucauacggcgauauuuau

SEQ ID NO: 4193415 - RNA, 15 nt, Yersinia pestis KIM
auucauagguagaau

SEQ ID NO: 4193416 - RNA, 18 nt, Yersinia pestis KIM
auucauaucgcucaucau

SEQ ID NO: 4193417 - RNA, 17 nt, Yersinia pestis KIM
auucauaugacaaauaa

SEQ ID NO: 4193418 - RNA, 22 nt, Yersinia pestis KIM
auucauauuucacuguuauauu

SEQ ID NO: 4193419 - RNA, 22 nt, Yersinia pestis KIM
auucaucaacugguugagauaa

SEQ ID NO: 4193420 - RNA, 12 nt, Yersinia pestis KIM
auucaucaccag

SEQ ID NO: 4193421 - RNA, 21 nt, Yersinia pestis KIM
auucaucaccuuauccaauag

SEQ ID NO: 4193422 - RNA, 14 nt, Yersinia pestis KIM
auucaucagcaauu

SEQ ID NO: 4193423 - RNA, 20 nt, Yersinia pestis KIM
auucaucagcaauuugcuug

SEQ ID NO: 4193424 - RNA, 14 nt, Yersinia pestis KIM
auucaucagggcag

SEQ ID NO: 4193425 - RNA, 14 nt, Yersinia pestis KIM
auucaucuagcuua

SEQ ID NO: 4193426 - RNA, 13 nt, Yersinia pestis KIM
auucaugaggcuc

SEQ ID NO: 4193427 - RNA, 17 nt, Yersinia pestis KIM
auucaugaggcucagac

SEQ ID NO: 4193428 - RNA, 16 nt, Yersinia pestis KIM
auucaugguuucaaaa

SEQ ID NO: 4193429 - RNA, 17 nt, Yersinia pestis KIM
auucaugguuucaaaau

SEQ ID NO: 4193430 - RNA, 19 nt, Yersinia pestis KIM
auucaugugagauaacaca

SEQ ID NO: 4193431 - RNA, 15 nt, Yersinia pestis KIM
auucauuucuuuggc

SEQ ID NO: 4193432 - RNA, 15 nt, Yersinia pestis KIM
auuccaaaauugcau

SEQ ID NO: 4193433 - RNA, 19 nt, Yersinia pestis KIM
auuccacauaaaauagccc

SEQ ID NO: 4193434 - RNA, 20 nt, Yersinia pestis KIM
auucccaaagcgcagugcuc

SEQ ID NO: 4193435 - RNA, 17 nt, Yersinia pestis KIM
auucccaccacuugcua

SEQ ID NO: 4193436 - RNA, 13 nt, Yersinia pestis KIM
auucccagccacu

SEQ ID NO: 4193437 - RNA, 15 nt, Yersinia pestis KIM
auuccccaccauugc

SEQ ID NO: 4193438 - RNA, 16 nt, Yersinia pestis KIM
auuccccaccauugca

SEQ ID NO: 4193439 - RNA, 13 nt, Yersinia pestis KIM
auuccccagccca

SEQ ID NO: 4193440 - RNA, 16 nt, Yersinia pestis KIM
auucccccaaaaccuc

SEQ ID NO: 4193441 - RNA, 16 nt, Yersinia pestis KIM
auucccccaguagcac

SEQ ID NO: 4193442 - RNA, 18 nt, Yersinia pestis KIM
auuccccccagucacuac

SEQ ID NO: 4193443 - RNA, 19 nt, Yersinia pestis KIM
auucccguuguuuauccgu

SEQ ID NO: 4193444 - RNA, 21 nt, Yersinia pestis KIM
auucccguuuuauuacugaua

SEQ ID NO: 4193445 - RNA, 23 nt, Yersinia pestis KIM
auuccgccaguggcuuugcacca

SEQ ID NO: 4193446 - RNA, 14 nt, Yersinia pestis KIM
auuccgcccugaau

SEQ ID NO: 4193447 - RNA, 17 nt, Yersinia pestis KIM
auuccgccuguuuucag

SEQ ID NO: 4193448 - RNA, 19 nt, Yersinia pestis KIM
auuccgccuguuuucaggc

SEQ ID NO: 4193449 - RNA, 13 nt, Yersinia pestis KIM
auuccgcgccugg

SEQ ID NO: 4193450 - RNA, 22 nt, Yersinia pestis KIM
auuccgucgauaucuaagucca

SEQ ID NO: 4193451 - RNA, 15 nt, Yersinia pestis KIM
auuccguuuaaacuc

SEQ ID NO: 4193452 - RNA, 14 nt, Yersinia pestis KIM
auuccuaagcaaau

SEQ ID NO: 4193453 - RNA, 16 nt, Yersinia pestis KIM
auugcccgguaacaua

SEQ ID NO: 4193454 - RNA, 21 nt, Yersinia pestis KIM
auugcccuacggguaaagcgu

SEQ ID NO: 4193455 - RNA, 20 nt, Yersinia pestis KIM
auugccgcagauaaaucugu

SEQ ID NO: 4193456 - RNA, 23 nt, Yersinia pestis KIM
auugccgcauacaccuucuuaau

SEQ ID NO: 4193457 - RNA, 22 nt, Yersinia pestis KIM
auugccgcgucuguuaucugcu

SEQ ID NO: 4193458 - RNA, 23 nt, Yersinia pestis KIM
auugccgcgucuguuaucugcua

SEQ ID NO: 4193459 - RNA, 10 nt, Yersinia pestis KIM
auugccggua

SEQ ID NO: 4193460 - RNA, 16 nt, Yersinia pestis KIM
auugccugauuuuuau

SEQ ID NO: 4193461 - RNA, 12 nt, Yersinia pestis KIM
auugcgaauauu

SEQ ID NO: 4193462 - RNA, 22 nt, Yersinia pestis KIM
auugcgagucucaucaaggaaa

SEQ ID NO: 4193463 - RNA, 16 nt, Yersinia pestis KIM
auugcgcuaacagcgu

SEQ ID NO: 4193464 - RNA, 14 nt, Yersinia pestis KIM
auugcggaguaaca

SEQ ID NO: 4193465 - RNA, 16 nt, Yersinia pestis KIM
auugcggcuuagccac

SEQ ID NO: 4193466 - RNA, 18 nt, Yersinia pestis KIM
auugcggcuuagccacug

SEQ ID NO: 4193467 - RNA, 19 nt, Yersinia pestis KIM
auugcguuauaucuauauu

SEQ ID NO: 4193468 - RNA, 18 nt, Yersinia pestis KIM
auugcuacguaaugauga

SEQ ID NO: 4193469 - RNA, 20 nt, Yersinia pestis KIM
auugcucacgcguaaaugga

SEQ ID NO: 4193470 - RNA, 15 nt, Yersinia pestis KIM
auugcucagggccac

SEQ ID NO: 4193471 - RNA, 19 nt, Yersinia pestis KIM
auugcuccuuacuauuuuc

SEQ ID NO: 4193472 - RNA, 20 nt, Yersinia pestis KIM
auugcuccuuacuauuuuca

SEQ ID NO: 4193473 - RNA, 16 nt, Yersinia pestis KIM
auugcugaaaaaaaac

SEQ ID NO: 4193474 - RNA, 14 nt, Yersinia pestis KIM
auugcugcuguuau

SEQ ID NO: 4193475 - RNA, 18 nt, Yersinia pestis KIM
auugcugcuguuauuacu

SEQ ID NO: 4193476 - RNA, 22 nt, Yersinia pestis KIM
auugcugcuguuauuacuguca

SEQ ID NO: 4193477 - RNA, 18 nt, Yersinia pestis KIM
auugcuggcuaucauccc

SEQ ID NO: 4193478 - RNA, 18 nt, Yersinia pestis KIM
auugcuguuguuauuacu

SEQ ID NO: 4193479 - RNA, 22 nt, Yersinia pestis KIM
auugcuguuguuauuacuguca

SEQ ID NO: 4193480 - RNA, 22 nt, Yersinia pestis KIM
auugcuugccagcgcuuuaggc

SEQ ID NO: 4193481 - RNA, 23 nt, Yersinia pestis KIM
auuggaaguacuuauuugaaaca

SEQ ID NO: 4193482 - RNA, 14 nt, Yersinia pestis KIM
auuggaaugaaaua

SEQ ID NO: 4193483 - RNA, 23 nt, Yersinia pestis KIM
auuggauaauuugccuggcgaau

SEQ ID NO: 4193484 - RNA, 23 nt, Yersinia pestis KIM
auuggcagcggcaaauagagcac

SEQ ID NO: 4193485 - RNA, 21 nt, Yersinia pestis KIM
auuggcaguauuuuaagaaaa

SEQ ID NO: 4193486 - RNA, 22 nt, Yersinia pestis KIM
auuggccgccaagguugcauug

SEQ ID NO: 4193487 - RNA, 14 nt, Yersinia pestis KIM
auuggcuagaaauc

SEQ ID NO: 4193488 - RNA, 21 nt, Yersinia pestis KIM
auuggcuagaaaucacacugg

SEQ ID NO: 4193489 - RNA, 13 nt, Yersinia pestis KIM
auuggcugcuugc

SEQ ID NO: 4193490 - RNA, 14 nt, Yersinia pestis KIM
auuggcuucaacuu

SEQ ID NO: 4193491 - RNA, 17 nt, Yersinia pestis KIM
auugggcugccugugcg

SEQ ID NO: 4193492 - RNA, 18 nt, Yersinia pestis KIM
auuggguaauaucaccau

SEQ ID NO: 4193493 - RNA, 23 nt, Yersinia pestis KIM
auuggucgcuuuuuacugaccgc

SEQ ID NO: 4193494 - RNA, 17 nt, Yersinia pestis KIM
auuggucuuaucagcgg

SEQ ID NO: 4193495 - RNA, 20 nt, Yersinia pestis KIM
auugguguuacagcaaggca

SEQ ID NO: 4193496 - RNA, 14 nt, Yersinia pestis KIM
auugguuaauuggu

SEQ ID NO: 4193497 - RNA, 17 nt, Yersinia pestis KIM
auugguuacccuaagaa

SEQ ID NO: 4193498 - RNA, 23 nt, Yersinia pestis KIM
auugguuacccuaagaauugguu

SEQ ID NO: 4193499 - RNA, 16 nt, Yersinia pestis KIM
auugguuauccuauuc

SEQ ID NO: 4193500 - RNA, 17 nt, Yersinia pestis KIM
auugguuuauaacaagg

SEQ ID NO: 4193501 - RNA, 22 nt, Yersinia pestis KIM
auugguuugacauacucuucca

SEQ ID NO: 4193502 - RNA, 15 nt, Yersinia pestis KIM
auuguauugcucagg

SEQ ID NO: 4193503 - RNA, 13 nt, Yersinia pestis KIM
auugucaaucacu

SEQ ID NO: 4193504 - RNA, 13 nt, Yersinia pestis KIM
auugucacagacg

SEQ ID NO: 4193505 - RNA, 15 nt, Yersinia pestis KIM
auuguccaaaggaag

SEQ ID NO: 4193506 - RNA, 16 nt, Yersinia pestis KIM
auuguccaaaggaagg

SEQ ID NO: 4193507 - RNA, 18 nt, Yersinia pestis KIM
auugucuggucuuucauu

SEQ ID NO: 4193508 - RNA, 18 nt, Yersinia pestis KIM
auugucuucuuuugggau

SEQ ID NO: 4193509 - RNA, 15 nt, Yersinia pestis KIM
auugucuuuaauaaa

SEQ ID NO: 4193510 - RNA, 15 nt, Yersinia pestis KIM
auugugagcuauucc

SEQ ID NO: 4193511 - RNA, 14 nt, Yersinia pestis KIM
auugugcagcauca

SEQ ID NO: 4193512 - RNA, 17 nt, Yersinia pestis KIM
auuguggcuaaacccaa

SEQ ID NO: 4193513 - RNA, 17 nt, Yersinia pestis KIM
auuguuaccuaaccaaa

SEQ ID NO: 4193514 - RNA, 13 nt, Yersinia pestis KIM
auuguugcaagcu

SEQ ID NO: 4193515 - RNA, 12 nt, Yersinia pestis KIM
auuguugccaaa

SEQ ID NO: 4193516 - RNA, 12 nt, Yersinia pestis KIM
auuguugccaau

SEQ ID NO: 4193517 - RNA, 17 nt, Yersinia pestis KIM
auuguugcucaacauau

SEQ ID NO: 4193518 - RNA, 19 nt, Yersinia pestis KIM
auuguuugcuuucagauaa

SEQ ID NO: 4193519 - RNA, 20 nt, Yersinia pestis KIM
auuguuuucguuuaaaaaau

SEQ ID NO: 4193520 - RNA, 17 nt, Yersinia pestis KIM
auuguuuugacuaaaau

SEQ ID NO: 4193521 - RNA, 13 nt, Yersinia pestis KIM
auuuaaacacuca

SEQ ID NO: 4193522 - RNA, 20 nt, Yersinia pestis KIM
auuuaaacagccguauaucu

SEQ ID NO: 4193523 - RNA, 18 nt, Yersinia pestis KIM
auuuaaauaagauccaga

SEQ ID NO: 4193524 - RNA, 16 nt, Yersinia pestis KIM
auuuaaauacaaaaau

SEQ ID NO: 4193525 - RNA, 20 nt, Yersinia pestis KIM
auuuaagcugaaauuuuuua

SEQ ID NO: 4193526 - RNA, 22 nt, Yersinia pestis KIM
auuuaagcugaaauuuuuuaau

SEQ ID NO: 4193527 - RNA, 18 nt, Yersinia pestis KIM
auuuaauuuauccaacug

SEQ ID NO: 4193528 - RNA, 14 nt, Yersinia pestis KIM
auuuaauuucugga

SEQ ID NO: 4193529 - RNA, 20 nt, Yersinia pestis KIM
auuuacaccgugcaauagcu

SEQ ID NO: 4193530 - RNA, 21 nt, Yersinia pestis KIM
auuuacaccgugcaauagcua

SEQ ID NO: 4193531 - RNA, 22 nt, Yersinia pestis KIM
auuuaccgacagcaucuagcag

SEQ ID NO: 4193532 - RNA, 12 nt, Yersinia pestis KIM
auuuaccugcuc

SEQ ID NO: 4193533 - RNA, 17 nt, Yersinia pestis KIM
auuuaccuguuugcaac

SEQ ID NO: 4193534 - RNA, 19 nt, Yersinia pestis KIM
auuuaccuguuugcaacau

SEQ ID NO: 4193535 - RNA, 21 nt, Yersinia pestis KIM
auuuaccuguuugcaacauua

SEQ ID NO: 4193536 - RNA, 23 nt, Yersinia pestis KIM
auuuaccuguuugcaacauuauc

SEQ ID NO: 4193537 - RNA, 22 nt, Yersinia pestis KIM
auuuacgcuucgcuguguuuug

SEQ ID NO: 4193538 - RNA, 15 nt, Yersinia pestis KIM
auuuacucaucuauu

SEQ ID NO: 4193539 - RNA, 21 nt, Yersinia pestis KIM
auuuacuccccaaagccuacg

SEQ ID NO: 4193540 - RNA, 18 nt, Yersinia pestis KIM
auuuacucguuuuacauu

SEQ ID NO: 4193541 - RNA, 20 nt, Yersinia pestis KIM
auuuacugcauucugagcac

SEQ ID NO: 4193542 - RNA, 13 nt, Yersinia pestis KIM
auuuacuuauaaa

SEQ ID NO: 4193543 - RNA, 15 nt, Yersinia pestis KIM
auuuacuuauaaaca

SEQ ID NO: 4193544 - RNA, 17 nt, Yersinia pestis KIM
auuuacuuauaaacacu

SEQ ID NO: 4193545 - RNA, 15 nt, Yersinia pestis KIM
auuuagacagcuuaa

SEQ ID NO: 4193546 - RNA, 17 nt, Yersinia pestis KIM
auuuagcaaagcgauau

SEQ ID NO: 4193547 - RNA, 23 nt, Yersinia pestis KIM
auuuagcauuauucuucaccacg

SEQ ID NO: 4193548 - RNA, 14 nt, Yersinia pestis KIM
auuuagccgcaacu

SEQ ID NO: 4193549 - RNA, 14 nt, Yersinia pestis KIM
auuuaggcguucuu

SEQ ID NO: 4193550 - RNA, 16 nt, Yersinia pestis KIM
auuuagguaguuuuau

SEQ ID NO: 4193551 - RNA, 17 nt, Yersinia pestis KIM
auuuagguaguuuuauu

SEQ ID NO: 4193552 - RNA, 22 nt, Yersinia pestis KIM
auuuagguaguuuuauucagag

SEQ ID NO: 4193553 - RNA, 23 nt, Yersinia pestis KIM
auuuagguaguuuuauucagagc

SEQ ID NO: 4193554 - RNA, 19 nt, Yersinia pestis KIM
auuuaguaucauugugaua

SEQ ID NO: 4193555 - RNA, 13 nt, Yersinia pestis KIM
auuuauaaaacca

SEQ ID NO: 4193556 - RNA, 14 nt, Yersinia pestis KIM
auuuauaaaaccac

SEQ ID NO: 4193557 - RNA, 12 nt, Yersinia pestis KIM
auuuauaaggaa

SEQ ID NO: 4193558 - RNA, 16 nt, Yersinia pestis KIM
auuuauauaaggucaa

SEQ ID NO: 4193559 - RNA, 19 nt, Yersinia pestis KIM
auuuauauuuacgcauaau

SEQ ID NO: 4193560 - RNA, 14 nt, Yersinia pestis KIM
auuuaucaguagcu

SEQ ID NO: 4193561 - RNA, 16 nt, Yersinia pestis KIM
auuuaucauauuaaca

SEQ ID NO: 4193562 - RNA, 21 nt, Yersinia pestis KIM
auuuaucauauuaacauauca

SEQ ID NO: 4193563 - RNA, 19 nt, Yersinia pestis KIM
auuuauccacuaauucauc

SEQ ID NO: 4193564 - RNA, 17 nt, Yersinia pestis KIM
auuuauccauuuaauaa

SEQ ID NO: 4193565 - RNA, 12 nt, Yersinia pestis KIM
auuuauccuauu

SEQ ID NO: 4193566 - RNA, 19 nt, Yersinia pestis KIM
auuuaucgauuuaguauca

SEQ ID NO: 4193567 - RNA, 14 nt, Yersinia pestis KIM
auuuucccuuucuc

SEQ ID NO: 4193568 - RNA, 20 nt, Yersinia pestis KIM
auuuuccgcagcucaccuag

SEQ ID NO: 4193569 - RNA, 22 nt, Yersinia pestis KIM
auuuuccugcauauuauuuugc

SEQ ID NO: 4193570 - RNA, 23 nt, Yersinia pestis KIM
auuuuccugcauauuauuuugca

SEQ ID NO: 4193571 - RNA, 12 nt, Yersinia pestis KIM
auuuucggguau

SEQ ID NO: 4193572 - RNA, 16 nt, Yersinia pestis KIM
auuuucggguaucugu

SEQ ID NO: 4193573 - RNA, 15 nt, Yersinia pestis KIM
auuuucuaagcugcc

SEQ ID NO: 4193574 - RNA, 16 nt, Yersinia pestis KIM
auuuucuaagcugccu

SEQ ID NO: 4193575 - RNA, 14 nt, Yersinia pestis KIM
auuuucuauaccaa

SEQ ID NO: 4193576 - RNA, 18 nt, Yersinia pestis KIM
auuuucuauaccaauuga

SEQ ID NO: 4193577 - RNA, 19 nt, Yersinia pestis KIM
auuuucugauguguauauu

SEQ ID NO: 4193578 - RNA, 18 nt, Yersinia pestis KIM
auuuucugccaacgagaa

SEQ ID NO: 4193579 - RNA, 19 nt, Yersinia pestis KIM
auuuucuggugagcaucaa

SEQ ID NO: 4193580 - RNA, 21 nt, Yersinia pestis KIM
auuuucuggugagcaucaaca

SEQ ID NO: 4193581 - RNA, 22 nt, Yersinia pestis KIM
auuuugagaugcgagauauaaa

SEQ ID NO: 4193582 - RNA, 15 nt, Yersinia pestis KIM
auuuugcggaucaca

SEQ ID NO: 4193583 - RNA, 13 nt, Yersinia pestis KIM
auuuugcugccag

SEQ ID NO: 4193584 - RNA, 17 nt, Yersinia pestis KIM
auuuugggugaacacag

SEQ ID NO: 4193585 - RNA, 16 nt, Yersinia pestis KIM
auuuuguagcccacug

SEQ ID NO: 4193586 - RNA, 18 nt, Yersinia pestis KIM
auuuugucaugaaaaucu

SEQ ID NO: 4193587 - RNA, 19 nt, Yersinia pestis KIM
auuuugucaugaaaaucuu

SEQ ID NO: 4193588 - RNA, 20 nt, Yersinia pestis KIM
auuuugugggaaugcccuuu

SEQ ID NO: 4193589 - RNA, 15 nt, Yersinia pestis KIM
auuuuguuacccacu

SEQ ID NO: 4193590 - RNA, 20 nt, Yersinia pestis KIM
auuuuguuuguaaauuuuaa

SEQ ID NO: 4193591 - RNA, 18 nt, Yersinia pestis KIM
auuuuuaacgucagauaa

SEQ ID NO: 4193592 - RNA, 18 nt, Yersinia pestis KIM
auuuuuaagucaauuuca

SEQ ID NO: 4193593 - RNA, 14 nt, Yersinia pestis KIM
auuuuuaauaaugu

SEQ ID NO: 4193594 - RNA, 19 nt, Yersinia pestis KIM
auuuuuacgauaucaccag

SEQ ID NO: 4193595 - RNA, 21 nt, Yersinia pestis KIM
auuuuuacgauaucaccaggu

SEQ ID NO: 4193596 - RNA, 14 nt, Yersinia pestis KIM
auuuuuagccgcaa

SEQ ID NO: 4193597 - RNA, 15 nt, Yersinia pestis KIM
auuuuuagccgcaau

SEQ ID NO: 4193598 - RNA, 16 nt, Yersinia pestis KIM
auuuuuaguaguaaua

SEQ ID NO: 4193599 - RNA, 22 nt, Yersinia pestis KIM
auuuuuaguauuggaaaaauca

SEQ ID NO: 4193600 - RNA, 13 nt, Yersinia pestis KIM
auuuuuauaauca

SEQ ID NO: 4193601 - RNA, 14 nt, Yersinia pestis KIM
auuuuuaugccauu

SEQ ID NO: 4193602 - RNA, 15 nt, Yersinia pestis KIM
auuuuucauucuauu

SEQ ID NO: 4193603 - RNA, 13 nt, Yersinia pestis KIM
auuuuucuuucuc

SEQ ID NO: 4193604 - RNA, 19 nt, Yersinia pestis KIM
auuuuugcauauaaaacac

SEQ ID NO: 4193605 - RNA, 20 nt, Yersinia pestis KIM
auuuuugccaaugcugcugu

SEQ ID NO: 4193606 - RNA, 22 nt, Yersinia pestis KIM
auuuuuggucguuuaaauaaaa

SEQ ID NO: 4193607 - RNA, 14 nt, Yersinia pestis KIM
auuuuuguauuuaa

SEQ ID NO: 4193608 - RNA, 17 nt, Yersinia pestis KIM
auuuuuuacuuuuuccu

SEQ ID NO: 4193609 - RNA, 14 nt, Yersinia pestis KIM
auuuuuuauaaaca

SEQ ID NO: 4193610 - RNA, 17 nt, Yersinia pestis KIM
auuuuuuaucuuguaaa

SEQ ID NO: 4193611 - RNA, 17 nt, Yersinia pestis KIM
auuuuuugcguauuauc

SEQ ID NO: 4193612 - RNA, 14 nt, Yersinia pestis KIM
auuuuuuguagguu

SEQ ID NO: 4193613 - RNA, 23 nt, Yersinia pestis KIM
auuuuuugugcccagaaaacccc

SEQ ID NO: 4193614 - RNA, 23 nt, Yersinia pestis KIM
auuuuuuguucuuaauuuuauca

SEQ ID NO: 4193615 - RNA, 17 nt, Yersinia pestis KIM
auuuuuuucacccaugu

SEQ ID NO: 4193616 - RNA, 17 nt, Yersinia pestis KIM
auuuuuuucaugguaaa

SEQ ID NO: 4193617 - RNA, 17 nt, Yersinia pestis KIM
auuuuuuuccaggucaa

SEQ ID NO: 4193618 - RNA, 21 nt, Yersinia pestis KIM
auuuuuuuuccuauaaaccaa

SEQ ID NO: 4193619 - RNA, 22 nt, Yersinia pestis KIM
auuuuuuuuccuauaaaccaac

SEQ ID NO: 4193620 - RNA, 23 nt, Yersinia pestis KIM
caaaaaaaccaccaaaauagcgg

SEQ ID NO: 4193621 - RNA, 13 nt, Yersinia pestis KIM
caaaaaacaaacc

SEQ ID NO: 4193622 - RNA, 15 nt, Yersinia pestis KIM
caaaaaaccggcucc

SEQ ID NO: 4193623 - RNA, 17 nt, Yersinia pestis KIM
caaaaaacugcggcaau

SEQ ID NO: 4193624 - RNA, 12 nt, Yersinia pestis KIM
caaaaaagggca

SEQ ID NO: 4193625 - RNA, 11 nt, Yersinia pestis KIM
caaaaaauaaa

SEQ ID NO: 4193626 - RNA, 12 nt, Yersinia pestis KIM
caaaaaauaagg

SEQ ID NO: 4193627 - RNA, 20 nt, Yersinia pestis KIM
caaaaaauagccguaggcca

SEQ ID NO: 4193628 - RNA, 21 nt, Yersinia pestis KIM
caaaaaauagccguaggccac

SEQ ID NO: 4193629 - RNA, 11 nt, Yersinia pestis KIM
caaaaaauugg

SEQ ID NO: 4193630 - RNA, 19 nt, Yersinia pestis KIM
caaaaacacagguucucca

SEQ ID NO: 4193631 - RNA, 20 nt, Yersinia pestis KIM
caaaaacacagguucuccag

SEQ ID NO: 4193632 - RNA, 19 nt, Yersinia pestis KIM
caaaaacccauuaaaaaca

SEQ ID NO: 4193633 - RNA, 23 nt, Yersinia pestis KIM
caaaaacgcuggccagcauggcg

SEQ ID NO: 4193634 - RNA, 16 nt, Yersinia pestis KIM
caaaaagccagcgaug

SEQ ID NO: 4193635 - RNA, 21 nt, Yersinia pestis KIM
caaaaauaaacgggcuuccau

SEQ ID NO: 4193636 - RNA, 18 nt, Yersinia pestis KIM
caaaaauacaaaaagcga

SEQ ID NO: 4193637 - RNA, 17 nt, Yersinia pestis KIM
caaaaauaguugcuauc

SEQ ID NO: 4193638 - RNA, 19 nt, Yersinia pestis KIM
caaaaaugauauugugaua

SEQ ID NO: 4193639 - RNA, 18 nt, Yersinia pestis KIM
caaaacagccuaaggcca

SEQ ID NO: 4193640 - RNA, 22 nt, Yersinia pestis KIM
caaaaccgaugagugaaaucuc

SEQ ID NO: 4193641 - RNA, 20 nt, Yersinia pestis KIM
caaaaccguacugauaucuu

SEQ ID NO: 4193642 - RNA, 20 nt, Yersinia pestis KIM
caaaaccgugacuaaaacaa

SEQ ID NO: 4193643 - RNA, 14 nt, Yersinia pestis KIM
caaaacgaacaaaa

SEQ ID NO: 4193644 - RNA, 18 nt, Yersinia pestis KIM
caaaacgacgggcugcug

SEQ ID NO: 4193645 - RNA, 13 nt, Yersinia pestis KIM
caaaacgaguaaa

SEQ ID NO: 4193646 - RNA, 14 nt, Yersinia pestis KIM
caaaacgcgcgcca

SEQ ID NO: 4193647 - RNA, 14 nt, Yersinia pestis KIM
caaaacuauuuauu

SEQ ID NO: 4193648 - RNA, 14 nt, Yersinia pestis KIM
caaaacucagguga

SEQ ID NO: 4193649 - RNA, 11 nt, Yersinia pestis KIM
caaaacucaug

SEQ ID NO: 4193650 - RNA, 13 nt, Yersinia pestis KIM
caaaagaaucagu

SEQ ID NO: 4193651 - RNA, 17 nt, Yersinia pestis KIM
caaaagcaaguuaggua

SEQ ID NO: 4193652 - RNA, 20 nt, Yersinia pestis KIM
caaaagccccagugcgcaaa

SEQ ID NO: 4193653 - RNA, 22 nt, Yersinia pestis KIM
caaaagccccagugcgcaaaaa

SEQ ID NO: 4193654 - RNA, 12 nt, Yersinia pestis KIM
caaaagcgauca

SEQ ID NO: 4193655 - RNA, 22 nt, Yersinia pestis KIM
caaaagcgaucagcaauaugcu

SEQ ID NO: 4193656 - RNA, 14 nt, Yersinia pestis KIM
caaaaggauggccc

SEQ ID NO: 4193657 - RNA, 22 nt, Yersinia pestis KIM
caaaaggauggcccaagccauc

SEQ ID NO: 4193658 - RNA, 18 nt, Yersinia pestis KIM
caaaaggugcaagcagcu

SEQ ID NO: 4193659 - RNA, 21 nt, Yersinia pestis KIM
caaaagugacgaaugagcagu

SEQ ID NO: 4193660 - RNA, 23 nt, Yersinia pestis KIM
caaaaguuaggguucaguaaaac

SEQ ID NO: 4193661 - RNA, 19 nt, Yersinia pestis KIM
caaaaguucacaugaugaa

SEQ ID NO: 4193662 - RNA, 13 nt, Yersinia pestis KIM
caaaauaaaaauu

SEQ ID NO: 4193663 - RNA, 20 nt, Yersinia pestis KIM
caaaauaaaaauucacaaca

SEQ ID NO: 4193664 - RNA, 23 nt, Yersinia pestis KIM
caaaauaaauauccuccggcaua

SEQ ID NO: 4193665 - RNA, 23 nt, Yersinia pestis KIM
caaaauaaccaacaccaucgcag

SEQ ID NO: 4193666 - RNA, 14 nt, Yersinia pestis KIM
caaaauaauauaau

SEQ ID NO: 4193667 - RNA, 12 nt, Yersinia pestis KIM
caaaauacccau

SEQ ID NO: 4193668 - RNA, 21 nt, Yersinia pestis KIM
caaaauacuuaacaaucagug

SEQ ID NO: 4193669 - RNA, 15 nt, Yersinia pestis KIM
caaaauagggcgccc

SEQ ID NO: 4193670 - RNA, 21 nt, Yersinia pestis KIM
caaaauaucgcgcuucagguc

SEQ ID NO: 4193671 - RNA, 12 nt, Yersinia pestis KIM
caaaauauguuc

SEQ ID NO: 4193672 - RNA, 22 nt, Yersinia pestis KIM
caaaauauucgcauugugcuuu

SEQ ID NO: 4193673 - RNA, 22 nt, Yersinia pestis KIM
caaaaucaccccacuagaaaua

SEQ ID NO: 4193674 - RNA, 15 nt, Yersinia pestis KIM
caaaauccaccagcg

SEQ ID NO: 4193675 - RNA, 21 nt, Yersinia pestis KIM
caaaauccaccagcgggcggc

SEQ ID NO: 4193676 - RNA, 12 nt, Yersinia pestis KIM
caaaaugacaau

SEQ ID NO: 4193677 - RNA, 16 nt, Yersinia pestis KIM
caaaaugaccuuaucu

SEQ ID NO: 4193678 - RNA, 17 nt, Yersinia pestis KIM
caaaaugaucaucagca

SEQ ID NO: 4193679 - RNA, 23 nt, Yersinia pestis KIM
caaaaugaucaucagcagcagga

SEQ ID NO: 4193680 - RNA, 16 nt, Yersinia pestis KIM
caaaaugccaacaacu

SEQ ID NO: 4193681 - RNA, 14 nt, Yersinia pestis KIM
caaauuaacacauc

SEQ ID NO: 4193682 - RNA, 14 nt, Yersinia pestis KIM
caaauuaaccugcu

SEQ ID NO: 4193683 - RNA, 13 nt, Yersinia pestis KIM
caaauuaauaggu

SEQ ID NO: 4193684 - RNA, 15 nt, Yersinia pestis KIM
caaauuaaucuugua

SEQ ID NO: 4193685 - RNA, 22 nt, Yersinia pestis KIM
caaauuacggcucaguugaugc

SEQ ID NO: 4193686 - RNA, 21 nt, Yersinia pestis KIM
caaauuacgugcccaaaaacg

SEQ ID NO: 4193687 - RNA, 13 nt, Yersinia pestis KIM
caaauuagcaggg

SEQ ID NO: 4193688 - RNA, 17 nt, Yersinia pestis KIM
caaauucagguugauca

SEQ ID NO: 4193689 - RNA, 15 nt, Yersinia pestis KIM
caaauuccgcuucuc

SEQ ID NO: 4193690 - RNA, 23 nt, Yersinia pestis KIM
caaauuccgcuucucagucgcga

SEQ ID NO: 4193691 - RNA, 15 nt, Yersinia pestis KIM
caaauucgugaucaa

SEQ ID NO: 4193692 - RNA, 17 nt, Yersinia pestis KIM
caaauucucaaugauaa

SEQ ID NO: 4193693 - RNA, 18 nt, Yersinia pestis KIM
caaauucucaaugauaaa

SEQ ID NO: 4193694 - RNA, 21 nt, Yersinia pestis KIM
caaauucucaaugauaaaauc

SEQ ID NO: 4193695 - RNA, 18 nt, Yersinia pestis KIM
caaauucuuucaacgcau

SEQ ID NO: 4193696 - RNA, 19 nt, Yersinia pestis KIM
caaauugcugaaaaaaaac

SEQ ID NO: 4193697 - RNA, 15 nt, Yersinia pestis KIM
caaauuugacauuuc

SEQ ID NO: 4193698 - RNA, 20 nt, Yersinia pestis KIM
caaauuugacauuuccuugu

SEQ ID NO: 4193699 - RNA, 23 nt, Yersinia pestis KIM
caacaaaaucgcgaccagcagaa

SEQ ID NO: 4193700 - RNA, 16 nt, Yersinia pestis KIM
caacaaacucugcgua

SEQ ID NO: 4193701 - RNA, 17 nt, Yersinia pestis KIM
caacaaauucaccagca

SEQ ID NO: 4193702 - RNA, 19 nt, Yersinia pestis KIM
caacaacugccaaauuugg

SEQ ID NO: 4193703 - RNA, 22 nt, Yersinia pestis KIM
caacaagaucccaagcaggaaa

SEQ ID NO: 4193704 - RNA, 12 nt, Yersinia pestis KIM
caacaagccucg

SEQ ID NO: 4193705 - RNA, 22 nt, Yersinia pestis KIM
caacaauaccgaugagcugaau

SEQ ID NO: 4193706 - RNA, 13 nt, Yersinia pestis KIM
caacacaccugca

SEQ ID NO: 4193707 - RNA, 15 nt, Yersinia pestis KIM
caacacauaaaauca

SEQ ID NO: 4193708 - RNA, 20 nt, Yersinia pestis KIM
caacacauucccauuauuau

SEQ ID NO: 4193709 - RNA, 13 nt, Yersinia pestis KIM
caacaccacacug

SEQ ID NO: 4193710 - RNA, 15 nt, Yersinia pestis KIM
caacacccaacucaa

SEQ ID NO: 4193711 - RNA, 18 nt, Yersinia pestis KIM
caacacccgaccagacaa

SEQ ID NO: 4193712 - RNA, 13 nt, Yersinia pestis KIM
caacacugccuga

SEQ ID NO: 4193713 - RNA, 20 nt, Yersinia pestis KIM
caacacuuuuaaggaacggg

SEQ ID NO: 4193714 - RNA, 18 nt, Yersinia pestis KIM
caacagaacuaaacgcca

SEQ ID NO: 4193715 - RNA, 22 nt, Yersinia pestis KIM
caacagauaugcauuauugaug

SEQ ID NO: 4193716 - RNA, 15 nt, Yersinia pestis KIM
caacaguaccuucua

SEQ ID NO: 4193717 - RNA, 23 nt, Yersinia pestis KIM
caacaguacugccaaccaccaaa

SEQ ID NO: 4193718 - RNA, 15 nt, Yersinia pestis KIM
caacagugaacgggc

SEQ ID NO: 4193719 - RNA, 14 nt, Yersinia pestis KIM
caacauaaguaaua

SEQ ID NO: 4193720 - RNA, 15 nt, Yersinia pestis KIM
caacauaaucaaucc

SEQ ID NO: 4193721 - RNA, 19 nt, Yersinia pestis KIM
caacauagguuuuuucacu

SEQ ID NO: 4193722 - RNA, 16 nt, Yersinia pestis KIM
caacauaguugaauaa

SEQ ID NO: 4193723 - RNA, 18 nt, Yersinia pestis KIM
caacauaguugaauaacu

SEQ ID NO: 4193724 - RNA, 11 nt, Yersinia pestis KIM
caacaucaucg

SEQ ID NO: 4193725 - RNA, 18 nt, Yersinia pestis KIM
caacauccagauauggca

SEQ ID NO: 4193726 - RNA, 15 nt, Yersinia pestis KIM
caacauccaguucga

SEQ ID NO: 4193727 - RNA, 20 nt, Yersinia pestis KIM
caacauccaguucgaccaau

SEQ ID NO: 4193728 - RNA, 21 nt, Yersinia pestis KIM
caacaucgcuugugcuacauc

SEQ ID NO: 4193729 - RNA, 14 nt, Yersinia pestis KIM
caacaucuccgcca

SEQ ID NO: 4193730 - RNA, 16 nt, Yersinia pestis KIM
caacaugagccacaca

SEQ ID NO: 4193731 - RNA, 22 nt, Yersinia pestis KIM
caacaugagccacacauucagu

SEQ ID NO: 4193732 - RNA, 23 nt, Yersinia pestis KIM
caacaugggcaagcucugggcug

SEQ ID NO: 4193733 - RNA, 14 nt, Yersinia pestis KIM
caacauuaaaaaua

SEQ ID NO: 4193734 - RNA, 15 nt, Yersinia pestis KIM
caacauuaaaaauac

SEQ ID NO: 4193735 - RNA, 17 nt, Yersinia pestis KIM
caacauuaaaaauacaa

SEQ ID NO: 4193736 - RNA, 13 nt, Yersinia pestis KIM
caacauugguuac

SEQ ID NO: 4193737 - RNA, 18 nt, Yersinia pestis KIM
caacauuuauuuaucgcc

SEQ ID NO: 4193738 - RNA, 20 nt, Yersinia pestis KIM
caacauuuggggugcaguuc

SEQ ID NO: 4193739 - RNA, 21 nt, Yersinia pestis KIM
caacauuuggggugcaguuca

SEQ ID NO: 4193740 - RNA, 14 nt, Yersinia pestis KIM
caacauuuuuagcu

SEQ ID NO: 4193741 - RNA, 18 nt, Yersinia pestis KIM
caaccaacaaacaauccu

SEQ ID NO: 4193742 - RNA, 17 nt, Yersinia pestis KIM
caaccaacacuccucuu

SEQ ID NO: 4193743 - RNA, 14 nt, Yersinia pestis KIM
caaccaaccaugcu

SEQ ID NO: 4193744 - RNA, 15 nt, Yersinia pestis KIM
caaccaccaaaaacu

SEQ ID NO: 4193745 - RNA, 19 nt, Yersinia pestis KIM
caaccaccuuuaccaugcu

SEQ ID NO: 4193746 - RNA, 18 nt, Yersinia pestis KIM
caaccacgguaauagcuu

SEQ ID NO: 4193747 - RNA, 17 nt, Yersinia pestis KIM
caaccaguuauagcggu

SEQ ID NO: 4193748 - RNA, 15 nt, Yersinia pestis KIM
caaccauaucgccau

SEQ ID NO: 4193749 - RNA, 19 nt, Yersinia pestis KIM
caaccauccgcccaauacg

SEQ ID NO: 4193750 - RNA, 17 nt, Yersinia pestis KIM
caaccauuguggcuaaa

SEQ ID NO: 4193751 - RNA, 22 nt, Yersinia pestis KIM
caaccauuguggcuaaacccaa

SEQ ID NO: 4193752 - RNA, 12 nt, Yersinia pestis KIM
caaccccagccg

SEQ ID NO: 4193753 - RNA, 23 nt, Yersinia pestis KIM
caaccccuaauccagcagccucu

SEQ ID NO: 4193754 - RNA, 12 nt, Yersinia pestis KIM
caacccuuuggg

SEQ ID NO: 4193755 - RNA, 17 nt, Yersinia pestis KIM
caaccgaccaaaggcca

SEQ ID NO: 4193756 - RNA, 14 nt, Yersinia pestis KIM
caaccgagaagucg

SEQ ID NO: 4193757 - RNA, 17 nt, Yersinia pestis KIM
caaccgaggcgcugaca

SEQ ID NO: 4193758 - RNA, 18 nt, Yersinia pestis KIM
caaccgcuggcaguugcc

SEQ ID NO: 4193759 - RNA, 21 nt, Yersinia pestis KIM
caaccgcuugcauacgcuuaa

SEQ ID NO: 4193760 - RNA, 15 nt, Yersinia pestis KIM
caaccggauuacaua

SEQ ID NO: 4193761 - RNA, 13 nt, Yersinia pestis KIM
caaccggcgcgcu

SEQ ID NO: 4193762 - RNA, 15 nt, Yersinia pestis KIM
caaccguuaacgggc

SEQ ID NO: 4193763 - RNA, 18 nt, Yersinia pestis KIM
caaccuaaaaaaaacaac

SEQ ID NO: 4193764 - RNA, 21 nt, Yersinia pestis KIM
caaccuacgccauuaaaaggu

SEQ ID NO: 4193765 - RNA, 12 nt, Yersinia pestis KIM
caaccucagccu

SEQ ID NO: 4193766 - RNA, 16 nt, Yersinia pestis KIM
caaccucagccucauu

SEQ ID NO: 4193767 - RNA, 20 nt, Yersinia pestis KIM
caaccucggucugaauaaga

SEQ ID NO: 4193768 - RNA, 17 nt, Yersinia pestis KIM
caaccugacugcuggca

SEQ ID NO: 4193769 - RNA, 19 nt, Yersinia pestis KIM
caaccugaucacgcugaau

SEQ ID NO: 4193770 - RNA, 17 nt, Yersinia pestis KIM
caaccugcaaugccuaa

SEQ ID NO: 4193771 - RNA, 17 nt, Yersinia pestis KIM
caaccugcgccacccau

SEQ ID NO: 4193772 - RNA, 18 nt, Yersinia pestis KIM
caaccugguuaucggcca

SEQ ID NO: 4193773 - RNA, 23 nt, Yersinia pestis KIM
caaccuguuguggaauuaccaca

SEQ ID NO: 4193774 - RNA, 21 nt, Yersinia pestis KIM
caaccuuggugaagaucaaug

SEQ ID NO: 4193775 - RNA, 22 nt, Yersinia pestis KIM
caaccuuuuccgccaugagaac

SEQ ID NO: 4193776 - RNA, 21 nt, Yersinia pestis KIM
caacgaaaugucgaaagauag

SEQ ID NO: 4193777 - RNA, 14 nt, Yersinia pestis KIM
caacgacagcaaca

SEQ ID NO: 4193778 - RNA, 14 nt, Yersinia pestis KIM
caacgacagcagca

SEQ ID NO: 4193779 - RNA, 12 nt, Yersinia pestis KIM
caacgaccagua

SEQ ID NO: 4193780 - RNA, 14 nt, Yersinia pestis KIM
caacgacuccauca

SEQ ID NO: 4193781 - RNA, 18 nt, Yersinia pestis KIM
caacgauauagagcucag

SEQ ID NO: 4193782 - RNA, 13 nt, Yersinia pestis KIM
caacgcacacccc

SEQ ID NO: 4193783 - RNA, 12 nt, Yersinia pestis KIM
caacgcacugaa

SEQ ID NO: 4193784 - RNA, 14 nt, Yersinia pestis KIM
caacgccaauaccg

SEQ ID NO: 4193785 - RNA, 15 nt, Yersinia pestis KIM
caacgccagauaacg

SEQ ID NO: 4193786 - RNA, 17 nt, Yersinia pestis KIM
caacgcccagcuuuagc

SEQ ID NO: 4193787 - RNA, 22 nt, Yersinia pestis KIM
caacgcccagcuuuuuacgcaa

SEQ ID NO: 4193788 - RNA, 15 nt, Yersinia pestis KIM
caacgcccugcaucu

SEQ ID NO: 4193789 - RNA, 18 nt, Yersinia pestis KIM
caacgcuaugcagcccag

SEQ ID NO: 4193790 - RNA, 19 nt, Yersinia pestis KIM
caacgcuccgguuuucacc

SEQ ID NO: 4193791 - RNA, 18 nt, Yersinia pestis KIM
caacggagagaacaggca

SEQ ID NO: 4193792 - RNA, 20 nt, Yersinia pestis KIM
caacggagagaacaggcaga

SEQ ID NO: 4193793 - RNA, 21 nt, Yersinia pestis KIM
caacggagcguacacgcagua

SEQ ID NO: 4193794 - RNA, 18 nt, Yersinia pestis KIM
caacggcacaucccaaua

SEQ ID NO: 4193795 - RNA, 17 nt, Yersinia pestis KIM
caacggcccaauauuga

SEQ ID NO: 4193796 - RNA, 12 nt, Yersinia pestis KIM
caaggcggaugu

SEQ ID NO: 4193797 - RNA, 13 nt, Yersinia pestis KIM
caaggcuuucugg

SEQ ID NO: 4193798 - RNA, 20 nt, Yersinia pestis KIM
caaggggcgagccacgauca

SEQ ID NO: 4193799 - RNA, 15 nt, Yersinia pestis KIM
caagguacugauaau

SEQ ID NO: 4193800 - RNA, 14 nt, Yersinia pestis KIM
caagguauguuugc

SEQ ID NO: 4193801 - RNA, 18 nt, Yersinia pestis KIM
caaggucaacgaccagua

SEQ ID NO: 4193802 - RNA, 15 nt, Yersinia pestis KIM
caaggucgcaaccag

SEQ ID NO: 4193803 - RNA, 20 nt, Yersinia pestis KIM
caaggugacuauuuaaauac

SEQ ID NO: 4193804 - RNA, 20 nt, Yersinia pestis KIM
caaggugccauaaauaccaa

SEQ ID NO: 4193805 - RNA, 11 nt, Yersinia pestis KIM
caagguuuccc

SEQ ID NO: 4193806 - RNA, 15 nt, Yersinia pestis KIM
caaguaaaagucagc

SEQ ID NO: 4193807 - RNA, 14 nt, Yersinia pestis KIM
caaguaugcagggu

SEQ ID NO: 4193808 - RNA, 15 nt, Yersinia pestis KIM
caaguauguuuacuu

SEQ ID NO: 4193809 - RNA, 22 nt, Yersinia pestis KIM
caaguauuggcguucagauaag

SEQ ID NO: 4193810 - RNA, 23 nt, Yersinia pestis KIM
caagucaauaaauaaaaacgcag

SEQ ID NO: 4193811 - RNA, 17 nt, Yersinia pestis KIM
caagucagugauucggg

SEQ ID NO: 4193812 - RNA, 15 nt, Yersinia pestis KIM
caagucaugguacaa

SEQ ID NO: 4193813 - RNA, 9 nt, Yersinia pestis KIM
caagucccg

SEQ ID NO: 4193814 - RNA, 16 nt, Yersinia pestis KIM
caagucccgccccggg

SEQ ID NO: 4193815 - RNA, 14 nt, Yersinia pestis KIM
caagugaacgaggc

SEQ ID NO: 4193816 - RNA, 12 nt, Yersinia pestis KIM
caagugcuucaa

SEQ ID NO: 4193817 - RNA, 23 nt, Yersinia pestis KIM
caagugcuucaaauccucggguu

SEQ ID NO: 4193818 - RNA, 19 nt, Yersinia pestis KIM
caaguggguaauguugcaa

SEQ ID NO: 4193819 - RNA, 21 nt, Yersinia pestis KIM
caaguggguaauguugcaaac

SEQ ID NO: 4193820 - RNA, 12 nt, Yersinia pestis KIM
caaguuaaauac

SEQ ID NO: 4193821 - RNA, 23 nt, Yersinia pestis KIM
caaguuaaauacugcacguuuaa

SEQ ID NO: 4193822 - RNA, 13 nt, Yersinia pestis KIM
caaguucaagcag

SEQ ID NO: 4193823 - RNA, 19 nt, Yersinia pestis KIM
caauaaaaccuuuauguaa

SEQ ID NO: 4193824 - RNA, 13 nt, Yersinia pestis KIM
caauaaaacucac

SEQ ID NO: 4193825 - RNA, 21 nt, Yersinia pestis KIM
caauaaaauuacccagcaucu

SEQ ID NO: 4193826 - RNA, 19 nt, Yersinia pestis KIM
caauaaacagacuaaaaac

SEQ ID NO: 4193827 - RNA, 20 nt, Yersinia pestis KIM
caauaaacagacuaaaaacc

SEQ ID NO: 4193828 - RNA, 21 nt, Yersinia pestis KIM
caauaaacagacuaaaaaccg

SEQ ID NO: 4193829 - RNA, 18 nt, Yersinia pestis KIM
caauaaacgcucggcacc

SEQ ID NO: 4193830 - RNA, 19 nt, Yersinia pestis KIM
caauaaagcgauaaauacu

SEQ ID NO: 4193831 - RNA, 18 nt, Yersinia pestis KIM
caauaaaggcaagauuuc

SEQ ID NO: 4193832 - RNA, 15 nt, Yersinia pestis KIM
caauaaauaaaaacg

SEQ ID NO: 4193833 - RNA, 16 nt, Yersinia pestis KIM
caauaaauauccuccg

SEQ ID NO: 4193834 - RNA, 21 nt, Yersinia pestis KIM
caauaaauauccuccggcaua

SEQ ID NO: 4193835 - RNA, 16 nt, Yersinia pestis KIM
caauaacaaacacauc

SEQ ID NO: 4193836 - RNA, 15 nt, Yersinia pestis KIM
caauaacaauauuca

SEQ ID NO: 4193837 - RNA, 20 nt, Yersinia pestis KIM
caauaacaccgucuuugacc

SEQ ID NO: 4193838 - RNA, 17 nt, Yersinia pestis KIM
caauaaccagaauaauc

SEQ ID NO: 4193839 - RNA, 18 nt, Yersinia pestis KIM
caauaaccgcagcaggca

SEQ ID NO: 4193840 - RNA, 15 nt, Yersinia pestis KIM
caauaaccucagccu

SEQ ID NO: 4193841 - RNA, 22 nt, Yersinia pestis KIM
caauaaccucagccucauucau

SEQ ID NO: 4193842 - RNA, 15 nt, Yersinia pestis KIM
caauaaccucagggc

SEQ ID NO: 4193843 - RNA, 22 nt, Yersinia pestis KIM
caauaaccucagggcgucucua

SEQ ID NO: 4193844 - RNA, 20 nt, Yersinia pestis KIM
caauaacggaaaaucaucgc

SEQ ID NO: 4193845 - RNA, 19 nt, Yersinia pestis KIM
caauaacguccugaugaug

SEQ ID NO: 4193846 - RNA, 23 nt, Yersinia pestis KIM
caauaacuuuggguauaugacug

SEQ ID NO: 4193847 - RNA, 22 nt, Yersinia pestis KIM
caauaagccacgcugugucaau

SEQ ID NO: 4193848 - RNA, 14 nt, Yersinia pestis KIM
caauaagcuguaau

SEQ ID NO: 4193849 - RNA, 17 nt, Yersinia pestis KIM
caauaaggugccacaca

SEQ ID NO: 4193850 - RNA, 22 nt, Yersinia pestis KIM
caauaagugcaaacuuaaaaau

SEQ ID NO: 4193851 - RNA, 15 nt, Yersinia pestis KIM
caauaauaaaaucug

SEQ ID NO: 4193852 - RNA, 19 nt, Yersinia pestis KIM
caauaauaacgaauuucau

SEQ ID NO: 4193853 - RNA, 15 nt, Yersinia pestis KIM
caauaauaagccgca

SEQ ID NO: 4193854 - RNA, 19 nt, Yersinia pestis KIM
caauaauauccaaccaacc

SEQ ID NO: 4193855 - RNA, 15 nt, Yersinia pestis KIM
caauaaucucagcau

SEQ ID NO: 4193856 - RNA, 22 nt, Yersinia pestis KIM
caauaauuaggaauaucaacga

SEQ ID NO: 4193857 - RNA, 15 nt, Yersinia pestis KIM
caauaauuucacuau

SEQ ID NO: 4193858 - RNA, 18 nt, Yersinia pestis KIM
caauaauuuuuacgauau

SEQ ID NO: 4193859 - RNA, 14 nt, Yersinia pestis KIM
caauacaauuauuu

SEQ ID NO: 4193860 - RNA, 13 nt, Yersinia pestis KIM
caauacaccuugc

SEQ ID NO: 4193861 - RNA, 15 nt, Yersinia pestis KIM
caauacagcaaauag

SEQ ID NO: 4193862 - RNA, 20 nt, Yersinia pestis KIM
caauacaggcaucgguaaua

SEQ ID NO: 4193863 - RNA, 14 nt, Yersinia pestis KIM
caauacauagaagc

SEQ ID NO: 4193864 - RNA, 15 nt, Yersinia pestis KIM
caauaccaaaaaucu

SEQ ID NO: 4193865 - RNA, 12 nt, Yersinia pestis KIM
caauacccaugg

SEQ ID NO: 4193866 - RNA, 13 nt, Yersinia pestis KIM
caauacccauggu

SEQ ID NO: 4193867 - RNA, 19 nt, Yersinia pestis KIM
caauaccgaugagcugaau

SEQ ID NO: 4193868 - RNA, 15 nt, Yersinia pestis KIM
caauaccgccaauau

SEQ ID NO: 4193869 - RNA, 15 nt, Yersinia pestis KIM
caauaccgccacaca

SEQ ID NO: 4193870 - RNA, 21 nt, Yersinia pestis KIM
caauaccgccacacaauacau

SEQ ID NO: 4193871 - RNA, 15 nt, Yersinia pestis KIM
caauaccuuacugca

SEQ ID NO: 4193872 - RNA, 18 nt, Yersinia pestis KIM
caauacuguuaucacuga

SEQ ID NO: 4193873 - RNA, 18 nt, Yersinia pestis KIM
caauagaaaaacacuggc

SEQ ID NO: 4193874 - RNA, 13 nt, Yersinia pestis KIM
caauagaaaagcg

SEQ ID NO: 4193875 - RNA, 14 nt, Yersinia pestis KIM
caauagaaaggcua

SEQ ID NO: 4193876 - RNA, 13 nt, Yersinia pestis KIM
caauagaggcucc

SEQ ID NO: 4193877 - RNA, 20 nt, Yersinia pestis KIM
caauagccaagaucacauga

SEQ ID NO: 4193878 - RNA, 17 nt, Yersinia pestis KIM
caauagccauggcuuua

SEQ ID NO: 4193879 - RNA, 14 nt, Yersinia pestis KIM
caauagcccaaaua

SEQ ID NO: 4193880 - RNA, 22 nt, Yersinia pestis KIM
caauagcggaauauuuaaccag

SEQ ID NO: 4193881 - RNA, 21 nt, Yersinia pestis KIM
caauagcguuaacgauauaau

SEQ ID NO: 4193882 - RNA, 22 nt, Yersinia pestis KIM
caauagcuaauaauuguucaua

SEQ ID NO: 4193883 - RNA, 17 nt, Yersinia pestis KIM
caauaggucagugguuu

SEQ ID NO: 4193884 - RNA, 23 nt, Yersinia pestis KIM
caauaggucagugguuuuaucaa

SEQ ID NO: 4193885 - RNA, 23 nt, Yersinia pestis KIM
caauagguguugccggcggcgcu

SEQ ID NO: 4193886 - RNA, 20 nt, Yersinia pestis KIM
caauagucuggccuucuggu

SEQ ID NO: 4193887 - RNA, 14 nt, Yersinia pestis KIM
caauaguguugcua

SEQ ID NO: 4193888 - RNA, 23 nt, Yersinia pestis KIM
caauaguguugcuaaggugugau

SEQ ID NO: 4193889 - RNA, 21 nt, Yersinia pestis KIM
caauauaaagccauuggucaa

SEQ ID NO: 4193890 - RNA, 16 nt, Yersinia pestis KIM
caauauaauaaucuau

SEQ ID NO: 4193891 - RNA, 13 nt, Yersinia pestis KIM
caauaucaacgcc

SEQ ID NO: 4193892 - RNA, 17 nt, Yersinia pestis KIM
caauaucugccaauuca

SEQ ID NO: 4193893 - RNA, 20 nt, Yersinia pestis KIM
caauaugaaggccauaaucu

SEQ ID NO: 4193894 - RNA, 20 nt, Yersinia pestis KIM
caauauguuagcagcacaag

SEQ ID NO: 4193895 - RNA, 15 nt, Yersinia pestis KIM
caauauguuuguuga

SEQ ID NO: 4193896 - RNA, 18 nt, Yersinia pestis KIM
caauauucagcguugaca

SEQ ID NO: 4193897 - RNA, 12 nt, Yersinia pestis KIM
caauauuccaaa

SEQ ID NO: 4193898 - RNA, 16 nt, Yersinia pestis KIM
caauauuccaaaaaau

SEQ ID NO: 4193899 - RNA, 16 nt, Yersinia pestis KIM
caauauucgccagauu

SEQ ID NO: 4193900 - RNA, 22 nt, Yersinia pestis KIM
caauauugacaggaucaggcca

SEQ ID NO: 4193901 - RNA, 22 nt, Yersinia pestis KIM
caauauugcauaaaugacgagc

SEQ ID NO: 4193902 - RNA, 22 nt, Yersinia pestis KIM
caauauugccuucacccaggcu

SEQ ID NO: 4193903 - RNA, 19 nt, Yersinia pestis KIM
caauauugcuugccagcgc

SEQ ID NO: 4193904 - RNA, 18 nt, Yersinia pestis KIM
caauauuggauaauaacc

SEQ ID NO: 4193905 - RNA, 19 nt, Yersinia pestis KIM
caauauuuauccauuuaau

SEQ ID NO: 4193906 - RNA, 20 nt, Yersinia pestis KIM
caauauuuuagcauuuucca

SEQ ID NO: 4193907 - RNA, 16 nt, Yersinia pestis KIM
caaucaaaaaauaaau

SEQ ID NO: 4193908 - RNA, 18 nt, Yersinia pestis KIM
caaucaaaaaauaaauua

SEQ ID NO: 4193909 - RNA, 18 nt, Yersinia pestis KIM
caaucaaaagggaucacc

SEQ ID NO: 4193910 - RNA, 20 nt, Yersinia pestis KIM
caaucaaaagggaucaccag

SEQ ID NO: 4193911 - RNA, 13 nt, Yersinia pestis KIM
cacaaccccaccu

SEQ ID NO: 4193912 - RNA, 22 nt, Yersinia pestis KIM
cacaacccccccgacccacgcc

SEQ ID NO: 4193913 - RNA, 19 nt, Yersinia pestis KIM
cacaacgcaucaguaaugu

SEQ ID NO: 4193914 - RNA, 14 nt, Yersinia pestis KIM
cacaacgcauuacc

SEQ ID NO: 4193915 - RNA, 19 nt, Yersinia pestis KIM
cacaacggaaggcccagcc

SEQ ID NO: 4193916 - RNA, 19 nt, Yersinia pestis KIM
cacaacuuuuauuggcauu

SEQ ID NO: 4193917 - RNA, 13 nt, Yersinia pestis KIM
cacaagauaaaua

SEQ ID NO: 4193918 - RNA, 14 nt, Yersinia pestis KIM
cacaauaaaauaag

SEQ ID NO: 4193919 - RNA, 17 nt, Yersinia pestis KIM
cacaauaauuaggaaua

SEQ ID NO: 4193920 - RNA, 21 nt, Yersinia pestis KIM
cacaauaauuaggaauaucaa

SEQ ID NO: 4193921 - RNA, 17 nt, Yersinia pestis KIM
cacaauacauagaagcu

SEQ ID NO: 4193922 - RNA, 19 nt, Yersinia pestis KIM
cacaauagaugcaguaacg

SEQ ID NO: 4193923 - RNA, 22 nt, Yersinia pestis KIM
cacaauagcuaccccuucaguc

SEQ ID NO: 4193924 - RNA, 21 nt, Yersinia pestis KIM
cacaaucagggcacucugcuu

SEQ ID NO: 4193925 - RNA, 18 nt, Yersinia pestis KIM
cacaauccaggcgaccca

SEQ ID NO: 4193926 - RNA, 11 nt, Yersinia pestis KIM
cacaaugaauu

SEQ ID NO: 4193927 - RNA, 18 nt, Yersinia pestis KIM
cacaaugccuaaaauggc

SEQ ID NO: 4193928 - RNA, 22 nt, Yersinia pestis KIM
cacaaugcuguuuugucauaaa

SEQ ID NO: 4193929 - RNA, 16 nt, Yersinia pestis KIM
cacaauuucaccccga

SEQ ID NO: 4193930 - RNA, 12 nt, Yersinia pestis KIM
cacacaauacau

SEQ ID NO: 4193931 - RNA, 12 nt, Yersinia pestis KIM
cacacacuaaua

SEQ ID NO: 4193932 - RNA, 23 nt, Yersinia pestis KIM
cacacacuaauaauaauuaaucu

SEQ ID NO: 4193933 - RNA, 17 nt, Yersinia pestis KIM
cacacagaaucaccaac

SEQ ID NO: 4193934 - RNA, 18 nt, Yersinia pestis KIM
cacacagaaucaccaaca

SEQ ID NO: 4193935 - RNA, 16 nt, Yersinia pestis KIM
cacacagaugcuggcu

SEQ ID NO: 4193936 - RNA, 19 nt, Yersinia pestis KIM
cacacagcguagacaauga

SEQ ID NO: 4193937 - RNA, 15 nt, Yersinia pestis KIM
cacacaguauucugc

SEQ ID NO: 4193938 - RNA, 12 nt, Yersinia pestis KIM
cacaccacacug

SEQ ID NO: 4193939 - RNA, 19 nt, Yersinia pestis KIM
cacaccauuuggacugaau

SEQ ID NO: 4193940 - RNA, 20 nt, Yersinia pestis KIM
cacacccucucuuuccagca

SEQ ID NO: 4193941 - RNA, 20 nt, Yersinia pestis KIM
cacacguguacucauauugu

SEQ ID NO: 4193942 - RNA, 22 nt, Yersinia pestis KIM
cacacguguacucauauugucc

SEQ ID NO: 4193943 - RNA, 22 nt, Yersinia pestis KIM
cacacugacagcaacgacgccc

SEQ ID NO: 4193944 - RNA, 15 nt, Yersinia pestis KIM
cacacugagcaccgc

SEQ ID NO: 4193945 - RNA, 17 nt, Yersinia pestis KIM
cacacugagcaccgcag

SEQ ID NO: 4193946 - RNA, 12 nt, Yersinia pestis KIM
cacacuggaugc

SEQ ID NO: 4193947 - RNA, 19 nt, Yersinia pestis KIM
cacacuggcggacaucuua

SEQ ID NO: 4193948 - RNA, 14 nt, Yersinia pestis KIM
cacacugguugaaa

SEQ ID NO: 4193949 - RNA, 19 nt, Yersinia pestis KIM
cacagaaacgauuacccac

SEQ ID NO: 4193950 - RNA, 13 nt, Yersinia pestis KIM
cacagaaucacca

SEQ ID NO: 4193951 - RNA, 16 nt, Yersinia pestis KIM
cacagaaucaccaaca

SEQ ID NO: 4193952 - RNA, 12 nt, Yersinia pestis KIM
cacagacaaaca

SEQ ID NO: 4193953 - RNA, 18 nt, Yersinia pestis KIM
cacagagcgggaacgcca

SEQ ID NO: 4193954 - RNA, 14 nt, Yersinia pestis KIM
cacagauaaacaag

SEQ ID NO: 4193955 - RNA, 14 nt, Yersinia pestis KIM
cacagauaaauaaa

SEQ ID NO: 4193956 - RNA, 18 nt, Yersinia pestis KIM
cacagauaaauaaaauaa

SEQ ID NO: 4193957 - RNA, 12 nt, Yersinia pestis KIM
cacagcaacagg

SEQ ID NO: 4193958 - RNA, 18 nt, Yersinia pestis KIM
cacagcaaguauuaccaa

SEQ ID NO: 4193959 - RNA, 16 nt, Yersinia pestis KIM
cacagcacucauaaug

SEQ ID NO: 4193960 - RNA, 17 nt, Yersinia pestis KIM
cacagcagaacaaaaca

SEQ ID NO: 4193961 - RNA, 14 nt, Yersinia pestis KIM
cacagcagacagcg

SEQ ID NO: 4193962 - RNA, 16 nt, Yersinia pestis KIM
cacagcccugccuggc

SEQ ID NO: 4193963 - RNA, 20 nt, Yersinia pestis KIM
cacagccugccgggaugacu

SEQ ID NO: 4193964 - RNA, 14 nt, Yersinia pestis KIM
cacagcucucugag

SEQ ID NO: 4193965 - RNA, 13 nt, Yersinia pestis KIM
cacagcuggaugu

SEQ ID NO: 4193966 - RNA, 18 nt, Yersinia pestis KIM
cacaggcaggcuguaugc

SEQ ID NO: 4193967 - RNA, 17 nt, Yersinia pestis KIM
cacaggcuuucaggacu

SEQ ID NO: 4193968 - RNA, 18 nt, Yersinia pestis KIM
cacaggggcgaugucacc

SEQ ID NO: 4193969 - RNA, 20 nt, Yersinia pestis KIM
cacaggggcgaugucaccau

SEQ ID NO: 4193970 - RNA, 14 nt, Yersinia pestis KIM
cacaguacaaaaaa

SEQ ID NO: 4193971 - RNA, 20 nt, Yersinia pestis KIM
cacaguagaagcuaccagca

SEQ ID NO: 4193972 - RNA, 23 nt, Yersinia pestis KIM
cacagucaguucauuacaggccc

SEQ ID NO: 4193973 - RNA, 15 nt, Yersinia pestis KIM
cacagucugucguac

SEQ ID NO: 4193974 - RNA, 19 nt, Yersinia pestis KIM
cacaguuuucuuaaaauac

SEQ ID NO: 4193975 - RNA, 12 nt, Yersinia pestis KIM
cacauaaauaag

SEQ ID NO: 4193976 - RNA, 14 nt, Yersinia pestis KIM
cacauaaccaucaa

SEQ ID NO: 4193977 - RNA, 15 nt, Yersinia pestis KIM
cacauaaccaucaaa

SEQ ID NO: 4193978 - RNA, 18 nt, Yersinia pestis KIM
cacauagccgucaauaaa

SEQ ID NO: 4193979 - RNA, 17 nt, Yersinia pestis KIM
cacauagcgucagguag

SEQ ID NO: 4193980 - RNA, 16 nt, Yersinia pestis KIM
cacauauuucaggcug

SEQ ID NO: 4193981 - RNA, 22 nt, Yersinia pestis KIM
cacauauuucaggcuguugcgu

SEQ ID NO: 4193982 - RNA, 15 nt, Yersinia pestis KIM
cacauauuucauuag

SEQ ID NO: 4193983 - RNA, 20 nt, Yersinia pestis KIM
cacaucaacaguugccgacu

SEQ ID NO: 4193984 - RNA, 14 nt, Yersinia pestis KIM
cacaucaaccugau

SEQ ID NO: 4193985 - RNA, 14 nt, Yersinia pestis KIM
cacaucaauauaaa

SEQ ID NO: 4193986 - RNA, 12 nt, Yersinia pestis KIM
cacaucaggccg

SEQ ID NO: 4193987 - RNA, 15 nt, Yersinia pestis KIM
cacaucauaaucggu

SEQ ID NO: 4193988 - RNA, 15 nt, Yersinia pestis KIM
cacaucauuacccau

SEQ ID NO: 4193989 - RNA, 18 nt, Yersinia pestis KIM
cacaucgcccugcucuuc

SEQ ID NO: 4193990 - RNA, 15 nt, Yersinia pestis KIM
cacaucugggucaug

SEQ ID NO: 4193991 - RNA, 21 nt, Yersinia pestis KIM
cacaucuugcgccgaaauaaa

SEQ ID NO: 4193992 - RNA, 15 nt, Yersinia pestis KIM
cacaugcagcauuuc

SEQ ID NO: 4193993 - RNA, 20 nt, Yersinia pestis KIM
cacaugcagcauuucaggau

SEQ ID NO: 4193994 - RNA, 12 nt, Yersinia pestis KIM
cacaugcucagu

SEQ ID NO: 4193995 - RNA, 19 nt, Yersinia pestis KIM
cacaugguuucaaugagca

SEQ ID NO: 4193996 - RNA, 21 nt, Yersinia pestis KIM
cacaugguuucaaugagcaua

SEQ ID NO: 4193997 - RNA, 19 nt, Yersinia pestis KIM
cacauuaacacauuaauuu

SEQ ID NO: 4193998 - RNA, 19 nt, Yersinia pestis KIM
cacauuaacuucagguuca

SEQ ID NO: 4193999 - RNA, 17 nt, Yersinia pestis KIM
cacauuaauuuaucugc

SEQ ID NO: 4194000 - RNA, 14 nt, Yersinia pestis KIM
cacauucagucacu

SEQ ID NO: 4194001 - RNA, 16 nt, Yersinia pestis KIM
cacauuccaguaaaaa

SEQ ID NO: 4194002 - RNA, 15 nt, Yersinia pestis KIM
cacauugaccagauu

SEQ ID NO: 4194003 - RNA, 17 nt, Yersinia pestis KIM
cacauuucccuuacugu

SEQ ID NO: 4194004 - RNA, 15 nt, Yersinia pestis KIM
cacauuuugugugag

SEQ ID NO: 4194005 - RNA, 21 nt, Yersinia pestis KIM
caccaaaaaacggauuuccau

SEQ ID NO: 4194006 - RNA, 15 nt, Yersinia pestis KIM
caccaaaaugacaau

SEQ ID NO: 4194007 - RNA, 17 nt, Yersinia pestis KIM
caccaaaggaagccgag

SEQ ID NO: 4194008 - RNA, 13 nt, Yersinia pestis KIM
caccaaaucuucc

SEQ ID NO: 4194009 - RNA, 14 nt, Yersinia pestis KIM
caccaaaucuucca

SEQ ID NO: 4194010 - RNA, 16 nt, Yersinia pestis KIM
caccaaaucuuccagc

SEQ ID NO: 4194011 - RNA, 17 nt, Yersinia pestis KIM
caccaaaucuuccagcg

SEQ ID NO: 4194012 - RNA, 14 nt, Yersinia pestis KIM
caccaacaccacac

SEQ ID NO: 4194013 - RNA, 16 nt, Yersinia pestis KIM
caccaacggccccuca

SEQ ID NO: 4194014 - RNA, 14 nt, Yersinia pestis KIM
caccaacuccugcc

SEQ ID NO: 4194015 - RNA, 13 nt, Yersinia pestis KIM
caccaagaccagu

SEQ ID NO: 4194016 - RNA, 15 nt, Yersinia pestis KIM
caccaagacugaagu

SEQ ID NO: 4194017 - RNA, 15 nt, Yersinia pestis KIM
caccaagaggcugcg

SEQ ID NO: 4194018 - RNA, 21 nt, Yersinia pestis KIM
caccaauagcgaucagcaacg

SEQ ID NO: 4194019 - RNA, 16 nt, Yersinia pestis KIM
caccaaugaaugcagg

SEQ ID NO: 4194020 - RNA, 14 nt, Yersinia pestis KIM
caccaaugcaucca

SEQ ID NO: 4194021 - RNA, 13 nt, Yersinia pestis KIM
caccaauggcuaa

SEQ ID NO: 4194022 - RNA, 15 nt, Yersinia pestis KIM
caccacaaaggcaaa

SEQ ID NO: 4194023 - RNA, 19 nt, Yersinia pestis KIM
caccacaaaggcaaaauga

SEQ ID NO: 4194024 - RNA, 15 nt, Yersinia pestis KIM
caccacacuggaugc

SEQ ID NO: 4194025 - RNA, 14 nt, Yersinia pestis KIM
caccaccaacagca

SEQ ID NO: 4194026 - RNA, 22 nt, Yersinia pestis KIM
caccacgaaaaaauggcagccc

SEQ ID NO: 4194027 - RNA, 13 nt, Yersinia pestis KIM
cacgauccgcuuu

SEQ ID NO: 4194028 - RNA, 16 nt, Yersinia pestis KIM
cacgaucgaugugaua

SEQ ID NO: 4194029 - RNA, 13 nt, Yersinia pestis KIM
cacgcaaggccag

SEQ ID NO: 4194030 - RNA, 12 nt, Yersinia pestis KIM
cacgcagcagac

SEQ ID NO: 4194031 - RNA, 17 nt, Yersinia pestis KIM
cacgcauuccaucagcc

SEQ ID NO: 4194032 - RNA, 18 nt, Yersinia pestis KIM
cacgcauuccaucagcca

SEQ ID NO: 4194033 - RNA, 19 nt, Yersinia pestis KIM
cacgcauuccaucagccaa

SEQ ID NO: 4194034 - RNA, 18 nt, Yersinia pestis KIM
cacgccaguaaacagcca

SEQ ID NO: 4194035 - RNA, 16 nt, Yersinia pestis KIM
cacgcccuucacacug

SEQ ID NO: 4194036 - RNA, 13 nt, Yersinia pestis KIM
cacgcgaagcccu

SEQ ID NO: 4194037 - RNA, 13 nt, Yersinia pestis KIM
cacgcguucaauc

SEQ ID NO: 4194038 - RNA, 13 nt, Yersinia pestis KIM
cacgcuaauuauu

SEQ ID NO: 4194039 - RNA, 19 nt, Yersinia pestis KIM
cacgcuauccgcgccgagc

SEQ ID NO: 4194040 - RNA, 21 nt, Yersinia pestis KIM
cacgcucgcccaugaccacuu

SEQ ID NO: 4194041 - RNA, 15 nt, Yersinia pestis KIM
cacgcuggcgauaaa

SEQ ID NO: 4194042 - RNA, 19 nt, Yersinia pestis KIM
cacgcugggcgaucauuuu

SEQ ID NO: 4194043 - RNA, 23 nt, Yersinia pestis KIM
cacgcugggcgaucauuuucugu

SEQ ID NO: 4194044 - RNA, 14 nt, Yersinia pestis KIM
cacgcugugucaau

SEQ ID NO: 4194045 - RNA, 16 nt, Yersinia pestis KIM
cacgcuguucaccgau

SEQ ID NO: 4194046 - RNA, 12 nt, Yersinia pestis KIM
cacggacagcaa

SEQ ID NO: 4194047 - RNA, 14 nt, Yersinia pestis KIM
cacggacagcaacc

SEQ ID NO: 4194048 - RNA, 13 nt, Yersinia pestis KIM
cacggauaucaac

SEQ ID NO: 4194049 - RNA, 20 nt, Yersinia pestis KIM
cacggauaucaauaaccuga

SEQ ID NO: 4194050 - RNA, 18 nt, Yersinia pestis KIM
cacggaucucauucagac

SEQ ID NO: 4194051 - RNA, 13 nt, Yersinia pestis KIM
cacggcaggcggu

SEQ ID NO: 4194052 - RNA, 18 nt, Yersinia pestis KIM
cacggccgggugcagcgc

SEQ ID NO: 4194053 - RNA, 17 nt, Yersinia pestis KIM
cacggccuauugaauaa

SEQ ID NO: 4194054 - RNA, 21 nt, Yersinia pestis KIM
cacggcgagaccuacucgccg

SEQ ID NO: 4194055 - RNA, 15 nt, Yersinia pestis KIM
cacgggaucaacaug

SEQ ID NO: 4194056 - RNA, 19 nt, Yersinia pestis KIM
cacgggcuuccaucaggaa

SEQ ID NO: 4194057 - RNA, 19 nt, Yersinia pestis KIM
cacgguagugacucaucaa

SEQ ID NO: 4194058 - RNA, 17 nt, Yersinia pestis KIM
cacggugaauaaacccu

SEQ ID NO: 4194059 - RNA, 18 nt, Yersinia pestis KIM
cacguaaagaguuaccgu

SEQ ID NO: 4194060 - RNA, 16 nt, Yersinia pestis KIM
cacgucgauaguccuu

SEQ ID NO: 4194061 - RNA, 15 nt, Yersinia pestis KIM
cacgucguacugccu

SEQ ID NO: 4194062 - RNA, 23 nt, Yersinia pestis KIM
cacgucuaauuccgccaguggcu

SEQ ID NO: 4194063 - RNA, 21 nt, Yersinia pestis KIM
cacgucuacgcucuccucucc

SEQ ID NO: 4194064 - RNA, 17 nt, Yersinia pestis KIM
cacgucuucaccaauga

SEQ ID NO: 4194065 - RNA, 18 nt, Yersinia pestis KIM
cacguuaaauuucuucaa

SEQ ID NO: 4194066 - RNA, 18 nt, Yersinia pestis KIM
cacguucaccaaagcaau

SEQ ID NO: 4194067 - RNA, 22 nt, Yersinia pestis KIM
cacguucggcgucgccacccca

SEQ ID NO: 4194068 - RNA, 18 nt, Yersinia pestis KIM
cacguugucaaaaaccca

SEQ ID NO: 4194069 - RNA, 18 nt, Yersinia pestis KIM
cacguuuaauucaaaguu

SEQ ID NO: 4194070 - RNA, 13 nt, Yersinia pestis KIM
cacguuuccaaaa

SEQ ID NO: 4194071 - RNA, 20 nt, Yersinia pestis KIM
cacguuuuucagcuucuucu

SEQ ID NO: 4194072 - RNA, 18 nt, Yersinia pestis KIM
cacuaaaccauucagcca

SEQ ID NO: 4194073 - RNA, 19 nt, Yersinia pestis KIM
cacuaaagcggaauuugcc

SEQ ID NO: 4194074 - RNA, 13 nt, Yersinia pestis KIM
cacuaacgccccu

SEQ ID NO: 4194075 - RNA, 17 nt, Yersinia pestis KIM
cacuaacgcugaggcga

SEQ ID NO: 4194076 - RNA, 12 nt, Yersinia pestis KIM
cacuaauaauaa

SEQ ID NO: 4194077 - RNA, 15 nt, Yersinia pestis KIM
cacuaauaauaauua

SEQ ID NO: 4194078 - RNA, 20 nt, Yersinia pestis KIM
cacuaauacucuguuaccaa

SEQ ID NO: 4194079 - RNA, 14 nt, Yersinia pestis KIM
cacuaauagcauuu

SEQ ID NO: 4194080 - RNA, 17 nt, Yersinia pestis KIM
cacuaauuagugacagu

SEQ ID NO: 4194081 - RNA, 19 nt, Yersinia pestis KIM
cacuaauuagugacaguag

SEQ ID NO: 4194082 - RNA, 15 nt, Yersinia pestis KIM
cacuacauucugaua

SEQ ID NO: 4194083 - RNA, 14 nt, Yersinia pestis KIM
cacuacucaguugc

SEQ ID NO: 4194084 - RNA, 20 nt, Yersinia pestis KIM
cacuagagcguuacacauca

SEQ ID NO: 4194085 - RNA, 22 nt, Yersinia pestis KIM
cacuagagcguuacacaucagg

SEQ ID NO: 4194086 - RNA, 22 nt, Yersinia pestis KIM
cacuagggggcaauugaaaaug

SEQ ID NO: 4194087 - RNA, 19 nt, Yersinia pestis KIM
cacuauaauuauuucucug

SEQ ID NO: 4194088 - RNA, 19 nt, Yersinia pestis KIM
cacuauccccaauucacgc

SEQ ID NO: 4194089 - RNA, 13 nt, Yersinia pestis KIM
cacuauccuuuga

SEQ ID NO: 4194090 - RNA, 18 nt, Yersinia pestis KIM
cacuauccuuugauagaa

SEQ ID NO: 4194091 - RNA, 21 nt, Yersinia pestis KIM
cacuauccuuugauagaaaua

SEQ ID NO: 4194092 - RNA, 14 nt, Yersinia pestis KIM
cacuaugggggauu

SEQ ID NO: 4194093 - RNA, 21 nt, Yersinia pestis KIM
cacuauucuccaacaacugcc

SEQ ID NO: 4194094 - RNA, 12 nt, Yersinia pestis KIM
cacuauuucaga

SEQ ID NO: 4194095 - RNA, 14 nt, Yersinia pestis KIM
cacuauuucagaca

SEQ ID NO: 4194096 - RNA, 14 nt, Yersinia pestis KIM
cacuauuucaggca

SEQ ID NO: 4194097 - RNA, 22 nt, Yersinia pestis KIM
cacuauuucaggcauaucacua

SEQ ID NO: 4194098 - RNA, 22 nt, Yersinia pestis KIM
cacuauuucguguauaucacua

SEQ ID NO: 4194099 - RNA, 19 nt, Yersinia pestis KIM
cacuauuuuaccuauuuau

SEQ ID NO: 4194100 - RNA, 18 nt, Yersinia pestis KIM
cacuauuuucuacugaau

SEQ ID NO: 4194101 - RNA, 22 nt, Yersinia pestis KIM
cacuauuuucuacugaauaaac

SEQ ID NO: 4194102 - RNA, 13 nt, Yersinia pestis KIM
cacucaagccagu

SEQ ID NO: 4194103 - RNA, 15 nt, Yersinia pestis KIM
cacucaauuggacua

SEQ ID NO: 4194104 - RNA, 11 nt, Yersinia pestis KIM
cacucaccgcc

SEQ ID NO: 4194105 - RNA, 14 nt, Yersinia pestis KIM
cacucacucuucgc

SEQ ID NO: 4194106 - RNA, 18 nt, Yersinia pestis KIM
cacucagcgacuccuggc

SEQ ID NO: 4194107 - RNA, 22 nt, Yersinia pestis KIM
cacucaggguuagggaugagug

SEQ ID NO: 4194108 - RNA, 15 nt, Yersinia pestis KIM
cacucauccucuggc

SEQ ID NO: 4194109 - RNA, 15 nt, Yersinia pestis KIM
cacucaugacaaaau

SEQ ID NO: 4194110 - RNA, 15 nt, Yersinia pestis KIM
cacucauugccuggc

SEQ ID NO: 4194111 - RNA, 18 nt, Yersinia pestis KIM
cacuccacuaugcccagu

SEQ ID NO: 4194112 - RNA, 13 nt, Yersinia pestis KIM
cacuccauuaauu

SEQ ID NO: 4194113 - RNA, 13 nt, Yersinia pestis KIM
cacuccggcauca

SEQ ID NO: 4194114 - RNA, 14 nt, Yersinia pestis KIM
cacucgcaucgccu

SEQ ID NO: 4194115 - RNA, 19 nt, Yersinia pestis KIM
cacucgcgacuacagaaaa

SEQ ID NO: 4194116 - RNA, 14 nt, Yersinia pestis KIM
cacucggccagagc

SEQ ID NO: 4194117 - RNA, 15 nt, Yersinia pestis KIM
cacucggccagagcu

SEQ ID NO: 4194118 - RNA, 18 nt, Yersinia pestis KIM
cacucuagcuguguuuua

SEQ ID NO: 4194119 - RNA, 20 nt, Yersinia pestis KIM
cacucuggcguugccgugcu

SEQ ID NO: 4194120 - RNA, 22 nt, Yersinia pestis KIM
cacucuggggcaaucaauguau

SEQ ID NO: 4194121 - RNA, 14 nt, Yersinia pestis KIM
cacucugguuuugu

SEQ ID NO: 4194122 - RNA, 17 nt, Yersinia pestis KIM
cacucuguacguaaaua

SEQ ID NO: 4194123 - RNA, 14 nt, Yersinia pestis KIM
cacucuguuuuaaa

SEQ ID NO: 4194124 - RNA, 14 nt, Yersinia pestis KIM
cacugaauaacuga

SEQ ID NO: 4194125 - RNA, 15 nt, Yersinia pestis KIM
cacugacaaaaacag

SEQ ID NO: 4194126 - RNA, 14 nt, Yersinia pestis KIM
cacugacagcaacg

SEQ ID NO: 4194127 - RNA, 16 nt, Yersinia pestis KIM
cacugaccuauugaua

SEQ ID NO: 4194128 - RNA, 19 nt, Yersinia pestis KIM
cacugaccuauugauaaaa

SEQ ID NO: 4194129 - RNA, 20 nt, Yersinia pestis KIM
cacugacggcagacaaccau

SEQ ID NO: 4194130 - RNA, 15 nt, Yersinia pestis KIM
cacugagaaccgaua

SEQ ID NO: 4194131 - RNA, 14 nt, Yersinia pestis KIM
cacugagcaccgca

SEQ ID NO: 4194132 - RNA, 14 nt, Yersinia pestis KIM
cacugagccgaaga

SEQ ID NO: 4194133 - RNA, 21 nt, Yersinia pestis KIM
cacugagccgaagaacaaauu

SEQ ID NO: 4194134 - RNA, 22 nt, Yersinia pestis KIM
cacugagucgucugucgggaac

SEQ ID NO: 4194135 - RNA, 15 nt, Yersinia pestis KIM
cacugaguucugcug

SEQ ID NO: 4194136 - RNA, 16 nt, Yersinia pestis KIM
cacugaguucugcugc

SEQ ID NO: 4194137 - RNA, 15 nt, Yersinia pestis KIM
cacugaguugcagga

SEQ ID NO: 4194138 - RNA, 17 nt, Yersinia pestis KIM
cacugauagauucauca

SEQ ID NO: 4194139 - RNA, 22 nt, Yersinia pestis KIM
cacugauagauucaucaccagu

SEQ ID NO: 4194140 - RNA, 15 nt, Yersinia pestis KIM
cacugaugagcuggc

SEQ ID NO: 4194141 - RNA, 23 nt, Yersinia pestis KIM
cacugaugagcuggcaaaacuca

SEQ ID NO: 4194142 - RNA, 21 nt, Yersinia pestis KIM
cacugauucucuucaccuuca

SEQ ID NO: 4194143 - RNA, 18 nt, Yersinia pestis KIM
cagaauggugccauacag

SEQ ID NO: 4194144 - RNA, 19 nt, Yersinia pestis KIM
cagaauuagcggcaacgau

SEQ ID NO: 4194145 - RNA, 11 nt, Yersinia pestis KIM
cagacaaacaa

SEQ ID NO: 4194146 - RNA, 16 nt, Yersinia pestis KIM
cagacaaccaauacac

SEQ ID NO: 4194147 - RNA, 21 nt, Yersinia pestis KIM
cagacaaccaauacacagcac

SEQ ID NO: 4194148 - RNA, 15 nt, Yersinia pestis KIM
cagacacaagauaaa

SEQ ID NO: 4194149 - RNA, 14 nt, Yersinia pestis KIM
cagacacaaugcug

SEQ ID NO: 4194150 - RNA, 15 nt, Yersinia pestis KIM
cagacacguaaaaca

SEQ ID NO: 4194151 - RNA, 16 nt, Yersinia pestis KIM
cagacacugacaucau

SEQ ID NO: 4194152 - RNA, 15 nt, Yersinia pestis KIM
cagacauaucugaac

SEQ ID NO: 4194153 - RNA, 21 nt, Yersinia pestis KIM
cagacauauuggucauuuuuc

SEQ ID NO: 4194154 - RNA, 14 nt, Yersinia pestis KIM
cagacauuuuucua

SEQ ID NO: 4194155 - RNA, 20 nt, Yersinia pestis KIM
cagacauuuuucuauuucug

SEQ ID NO: 4194156 - RNA, 20 nt, Yersinia pestis KIM
cagaccaaauagcaagccaa

SEQ ID NO: 4194157 - RNA, 15 nt, Yersinia pestis KIM
cagaccaaauucccc

SEQ ID NO: 4194158 - RNA, 19 nt, Yersinia pestis KIM
cagacccauuucugcuucu

SEQ ID NO: 4194159 - RNA, 14 nt, Yersinia pestis KIM
cagaccccagaaga

SEQ ID NO: 4194160 - RNA, 18 nt, Yersinia pestis KIM
cagaccuuuaggaaagcc

SEQ ID NO: 4194161 - RNA, 16 nt, Yersinia pestis KIM
cagacgaaagauaauu

SEQ ID NO: 4194162 - RNA, 18 nt, Yersinia pestis KIM
cagacgaguauuccccac

SEQ ID NO: 4194163 - RNA, 19 nt, Yersinia pestis KIM
cagacgaguauuccccacu

SEQ ID NO: 4194164 - RNA, 23 nt, Yersinia pestis KIM
cagacgauuauccgcaccauaga

SEQ ID NO: 4194165 - RNA, 23 nt, Yersinia pestis KIM
cagacgcgguuaacgacgcauua

SEQ ID NO: 4194166 - RNA, 21 nt, Yersinia pestis KIM
cagacggcagauccugaacga

SEQ ID NO: 4194167 - RNA, 19 nt, Yersinia pestis KIM
cagacguacauauaucacu

SEQ ID NO: 4194168 - RNA, 20 nt, Yersinia pestis KIM
cagacguacauauaucacua

SEQ ID NO: 4194169 - RNA, 15 nt, Yersinia pestis KIM
cagacguuuaaauaa

SEQ ID NO: 4194170 - RNA, 15 nt, Yersinia pestis KIM
cagacuaaaaaccau

SEQ ID NO: 4194171 - RNA, 17 nt, Yersinia pestis KIM
cagacuaaaaaccgcca

SEQ ID NO: 4194172 - RNA, 12 nt, Yersinia pestis KIM
cagacuaaugac

SEQ ID NO: 4194173 - RNA, 14 nt, Yersinia pestis KIM
cagacuaaugacaa

SEQ ID NO: 4194174 - RNA, 13 nt, Yersinia pestis KIM
cagacuccugccc

SEQ ID NO: 4194175 - RNA, 18 nt, Yersinia pestis KIM
cagacucuuauauaaauc

SEQ ID NO: 4194176 - RNA, 19 nt, Yersinia pestis KIM
cagacucuuauauaaaucc

SEQ ID NO: 4194177 - RNA, 16 nt, Yersinia pestis KIM
cagacugaaaguagaa

SEQ ID NO: 4194178 - RNA, 21 nt, Yersinia pestis KIM
cagacugaaaguagaaauaaa

SEQ ID NO: 4194179 - RNA, 14 nt, Yersinia pestis KIM
cagacugacgcaga

SEQ ID NO: 4194180 - RNA, 20 nt, Yersinia pestis KIM
cagacugacgcagagcuaaa

SEQ ID NO: 4194181 - RNA, 12 nt, Yersinia pestis KIM
cagacugcugac

SEQ ID NO: 4194182 - RNA, 15 nt, Yersinia pestis KIM
cagacugcugacaaa

SEQ ID NO: 4194183 - RNA, 18 nt, Yersinia pestis KIM
cagacugcugacaaaccc

SEQ ID NO: 4194184 - RNA, 17 nt, Yersinia pestis KIM
cagacugcugacaaccc

SEQ ID NO: 4194185 - RNA, 17 nt, Yersinia pestis KIM
cagacuuggguaaccaa

SEQ ID NO: 4194186 - RNA, 18 nt, Yersinia pestis KIM
cagagaccacagauaaau

SEQ ID NO: 4194187 - RNA, 21 nt, Yersinia pestis KIM
cagagaccacagauaaauaaa

SEQ ID NO: 4194188 - RNA, 14 nt, Yersinia pestis KIM
cagagagauaaucu

SEQ ID NO: 4194189 - RNA, 13 nt, Yersinia pestis KIM
cagagagguuuca

SEQ ID NO: 4194190 - RNA, 20 nt, Yersinia pestis KIM
cagagauaaacccuaauccc

SEQ ID NO: 4194191 - RNA, 20 nt, Yersinia pestis KIM
cagagauaauagauaacaaa

SEQ ID NO: 4194192 - RNA, 19 nt, Yersinia pestis KIM
cagagaucauguaguacuu

SEQ ID NO: 4194193 - RNA, 16 nt, Yersinia pestis KIM
cagagcaaaaagccag

SEQ ID NO: 4194194 - RNA, 12 nt, Yersinia pestis KIM
cagagcaaaacu

SEQ ID NO: 4194195 - RNA, 20 nt, Yersinia pestis KIM
cagagcaagggucuccacac

SEQ ID NO: 4194196 - RNA, 14 nt, Yersinia pestis KIM
cagagcagaaagca

SEQ ID NO: 4194197 - RNA, 17 nt, Yersinia pestis KIM
cagagcagaaagcagca

SEQ ID NO: 4194198 - RNA, 15 nt, Yersinia pestis KIM
cagagccaaucccca

SEQ ID NO: 4194199 - RNA, 16 nt, Yersinia pestis KIM
cagagccaauccccag

SEQ ID NO: 4194200 - RNA, 21 nt, Yersinia pestis KIM
cagagccaauccccagaagcg

SEQ ID NO: 4194201 - RNA, 22 nt, Yersinia pestis KIM
cagagccagaauaucguggaga

SEQ ID NO: 4194202 - RNA, 14 nt, Yersinia pestis KIM
cagagcgggaacgc

SEQ ID NO: 4194203 - RNA, 14 nt, Yersinia pestis KIM
cagagcggguuuuu

SEQ ID NO: 4194204 - RNA, 17 nt, Yersinia pestis KIM
cagaguauccagcguca

SEQ ID NO: 4194205 - RNA, 18 nt, Yersinia pestis KIM
cagagucgcaaaaaauau

SEQ ID NO: 4194206 - RNA, 21 nt, Yersinia pestis KIM
cagagugacaacaaaaaauaa

SEQ ID NO: 4194207 - RNA, 14 nt, Yersinia pestis KIM
cagaguucggucau

SEQ ID NO: 4194208 - RNA, 16 nt, Yersinia pestis KIM
cagaguucggucauaa

SEQ ID NO: 4194209 - RNA, 13 nt, Yersinia pestis KIM
cagauaaaaagcc

SEQ ID NO: 4194210 - RNA, 14 nt, Yersinia pestis KIM
cagauaaaaagcca

SEQ ID NO: 4194211 - RNA, 16 nt, Yersinia pestis KIM
cagauaaacaucauga

SEQ ID NO: 4194212 - RNA, 16 nt, Yersinia pestis KIM
cagauaaagaaaaacc

SEQ ID NO: 4194213 - RNA, 17 nt, Yersinia pestis KIM
cagauaaagaaaaaccc

SEQ ID NO: 4194214 - RNA, 20 nt, Yersinia pestis KIM
cagauaaagaaaaacccguu

SEQ ID NO: 4194215 - RNA, 14 nt, Yersinia pestis KIM
cagauaaauaaaau

SEQ ID NO: 4194216 - RNA, 22 nt, Yersinia pestis KIM
cagauaaauaaaauaauaaugg

SEQ ID NO: 4194217 - RNA, 19 nt, Yersinia pestis KIM
cagauaaaucaguggguca

SEQ ID NO: 4194218 - RNA, 13 nt, Yersinia pestis KIM
cagauaacaacaa

SEQ ID NO: 4194219 - RNA, 16 nt, Yersinia pestis KIM
cagauaacucaguacc

SEQ ID NO: 4194220 - RNA, 16 nt, Yersinia pestis KIM
cagauaauccccuugu

SEQ ID NO: 4194221 - RNA, 13 nt, Yersinia pestis KIM
cagauaaucccuu

SEQ ID NO: 4194222 - RNA, 17 nt, Yersinia pestis KIM
cagauacggcuccagaa

SEQ ID NO: 4194223 - RNA, 19 nt, Yersinia pestis KIM
cagauaggcgaaauugacu

SEQ ID NO: 4194224 - RNA, 20 nt, Yersinia pestis KIM
cagauaguuacccacauuca

SEQ ID NO: 4194225 - RNA, 15 nt, Yersinia pestis KIM
cagauaucagcgcac

SEQ ID NO: 4194226 - RNA, 15 nt, Yersinia pestis KIM
cagauaucugcucau

SEQ ID NO: 4194227 - RNA, 13 nt, Yersinia pestis KIM
cagauaugaucaa

SEQ ID NO: 4194228 - RNA, 18 nt, Yersinia pestis KIM
cagauaugccaggcauca

SEQ ID NO: 4194229 - RNA, 21 nt, Yersinia pestis KIM
cagauaugccaggcaucaucu

SEQ ID NO: 4194230 - RNA, 20 nt, Yersinia pestis KIM
cagauauggcauuccugguu

SEQ ID NO: 4194231 - RNA, 16 nt, Yersinia pestis KIM
cagauauuuuaccaau

SEQ ID NO: 4194232 - RNA, 15 nt, Yersinia pestis KIM
cagaucaacagauuu

SEQ ID NO: 4194233 - RNA, 20 nt, Yersinia pestis KIM
cagaucaagaaaacgcacgc

SEQ ID NO: 4194234 - RNA, 17 nt, Yersinia pestis KIM
cagaucaccgaugauaa

SEQ ID NO: 4194235 - RNA, 21 nt, Yersinia pestis KIM
cagaucagcgugacguuaucu

SEQ ID NO: 4194236 - RNA, 17 nt, Yersinia pestis KIM
cagauccagaauuucau

SEQ ID NO: 4194237 - RNA, 23 nt, Yersinia pestis KIM
cagauccguaccaccacgaaaau

SEQ ID NO: 4194238 - RNA, 21 nt, Yersinia pestis KIM
cagauccucaucacugccguc

SEQ ID NO: 4194239 - RNA, 23 nt, Yersinia pestis KIM
cagauccugccgccucugcuccg

SEQ ID NO: 4194240 - RNA, 19 nt, Yersinia pestis KIM
cagaucguaaagacgccgu

SEQ ID NO: 4194241 - RNA, 23 nt, Yersinia pestis KIM
cagaucguuaaaguuaucaccaa

SEQ ID NO: 4194242 - RNA, 16 nt, Yersinia pestis KIM
cagaugaaaaacugug

SEQ ID NO: 4194243 - RNA, 14 nt, Yersinia pestis KIM
cagaugacgggcga

SEQ ID NO: 4194244 - RNA, 17 nt, Yersinia pestis KIM
cagaugacggugcccac

SEQ ID NO: 4194245 - RNA, 13 nt, Yersinia pestis KIM
cagaugagaaucu

SEQ ID NO: 4194246 - RNA, 20 nt, Yersinia pestis KIM
cagaugaucaacgccaaaau

SEQ ID NO: 4194247 - RNA, 22 nt, Yersinia pestis KIM
cagaugaugaugagaaguaaaa

SEQ ID NO: 4194248 - RNA, 19 nt, Yersinia pestis KIM
cagaugccgcuuuaguuuc

SEQ ID NO: 4194249 - RNA, 20 nt, Yersinia pestis KIM
cagauggccagauucaccag

SEQ ID NO: 4194250 - RNA, 17 nt, Yersinia pestis KIM
cagauggccccaauugu

SEQ ID NO: 4194251 - RNA, 14 nt, Yersinia pestis KIM
cagaugggaagaca

SEQ ID NO: 4194252 - RNA, 19 nt, Yersinia pestis KIM
cagauguauuagcgcugcu

SEQ ID NO: 4194253 - RNA, 18 nt, Yersinia pestis KIM
cagauguuaacuggcucc

SEQ ID NO: 4194254 - RNA, 22 nt, Yersinia pestis KIM
cagauguuuaaauugcgcccgg

SEQ ID NO: 4194255 - RNA, 14 nt, Yersinia pestis KIM
cagauuaaucaccu

SEQ ID NO: 4194256 - RNA, 18 nt, Yersinia pestis KIM
cagauuauuguuauccac

SEQ ID NO: 4194257 - RNA, 17 nt, Yersinia pestis KIM
cagauucccgcgccgcg

SEQ ID NO: 4194258 - RNA, 13 nt, Yersinia pestis KIM
cagcccauccugu

SEQ ID NO: 4194259 - RNA, 19 nt, Yersinia pestis KIM
cagccccaaacacuuagca

SEQ ID NO: 4194260 - RNA, 20 nt, Yersinia pestis KIM
cagccccaaucaccggcugg

SEQ ID NO: 4194261 - RNA, 11 nt, Yersinia pestis KIM
cagccccgcca

SEQ ID NO: 4194262 - RNA, 19 nt, Yersinia pestis KIM
cagcccggauagaauugaa

SEQ ID NO: 4194263 - RNA, 14 nt, Yersinia pestis KIM
cagcccuccagccg

SEQ ID NO: 4194264 - RNA, 14 nt, Yersinia pestis KIM
cagcccugccuggc

SEQ ID NO: 4194265 - RNA, 22 nt, Yersinia pestis KIM
cagcccugccuggcaggaagcc

SEQ ID NO: 4194266 - RNA, 19 nt, Yersinia pestis KIM
cagcccuuauucaaagaau

SEQ ID NO: 4194267 - RNA, 19 nt, Yersinia pestis KIM
cagccgggaugaucaacag

SEQ ID NO: 4194268 - RNA, 22 nt, Yersinia pestis KIM
cagccgggaugaucaacaguga

SEQ ID NO: 4194269 - RNA, 13 nt, Yersinia pestis KIM
cagccguuuacga

SEQ ID NO: 4194270 - RNA, 14 nt, Yersinia pestis KIM
cagccuaaaaugaa

SEQ ID NO: 4194271 - RNA, 12 nt, Yersinia pestis KIM
cagccuaaauuc

SEQ ID NO: 4194272 - RNA, 14 nt, Yersinia pestis KIM
cagccuaaccgcug

SEQ ID NO: 4194273 - RNA, 14 nt, Yersinia pestis KIM
cagccuaaggccau

SEQ ID NO: 4194274 - RNA, 17 nt, Yersinia pestis KIM
cagccuauccucaccgu

SEQ ID NO: 4194275 - RNA, 20 nt, Yersinia pestis KIM
cagccucauacaagccguga

SEQ ID NO: 4194276 - RNA, 17 nt, Yersinia pestis KIM
cagccucuaacauacuc

SEQ ID NO: 4194277 - RNA, 15 nt, Yersinia pestis KIM
cagccugguugguaa

SEQ ID NO: 4194278 - RNA, 12 nt, Yersinia pestis KIM
cagccugugccc

SEQ ID NO: 4194279 - RNA, 12 nt, Yersinia pestis KIM
cagccuguuaau

SEQ ID NO: 4194280 - RNA, 18 nt, Yersinia pestis KIM
cagccuguuuaguaaaua

SEQ ID NO: 4194281 - RNA, 20 nt, Yersinia pestis KIM
cagccuguuuaguaaauaua

SEQ ID NO: 4194282 - RNA, 23 nt, Yersinia pestis KIM
cagccuuaauguuuuacgaucaa

SEQ ID NO: 4194283 - RNA, 13 nt, Yersinia pestis KIM
cagccuuuaucca

SEQ ID NO: 4194284 - RNA, 20 nt, Yersinia pestis KIM
cagccuuuauccagccaccu

SEQ ID NO: 4194285 - RNA, 14 nt, Yersinia pestis KIM
cagcgaaauguaag

SEQ ID NO: 4194286 - RNA, 23 nt, Yersinia pestis KIM
cagcgaaauguaagcuacuaaug

SEQ ID NO: 4194287 - RNA, 16 nt, Yersinia pestis KIM
cagcgaauaguaucua

SEQ ID NO: 4194288 - RNA, 14 nt, Yersinia pestis KIM
cagcgagcacugcc

SEQ ID NO: 4194289 - RNA, 16 nt, Yersinia pestis KIM
cagcgagcacugcccc

SEQ ID NO: 4194290 - RNA, 17 nt, Yersinia pestis KIM
cagcgauacaaccggcu

SEQ ID NO: 4194291 - RNA, 23 nt, Yersinia pestis KIM
cagcgcacugaauaacgcggcac

SEQ ID NO: 4194292 - RNA, 15 nt, Yersinia pestis KIM
cagcgccaagcuuuc

SEQ ID NO: 4194293 - RNA, 22 nt, Yersinia pestis KIM
cagcgcccuugccagugcaauc

SEQ ID NO: 4194294 - RNA, 15 nt, Yersinia pestis KIM
cagcgcgcagccaac

SEQ ID NO: 4194295 - RNA, 12 nt, Yersinia pestis KIM
cagcgcuggcuu

SEQ ID NO: 4194296 - RNA, 23 nt, Yersinia pestis KIM
cagcgcuuuaggcaagaguugac

SEQ ID NO: 4194297 - RNA, 18 nt, Yersinia pestis KIM
cagcggagaaucgcuguu

SEQ ID NO: 4194298 - RNA, 17 nt, Yersinia pestis KIM
cagcggcaaauagagca

SEQ ID NO: 4194299 - RNA, 12 nt, Yersinia pestis KIM
cagcggcgauua

SEQ ID NO: 4194300 - RNA, 17 nt, Yersinia pestis KIM
cagcggcguaucaaacg

SEQ ID NO: 4194301 - RNA, 15 nt, Yersinia pestis KIM
cagcggggcauucau

SEQ ID NO: 4194302 - RNA, 21 nt, Yersinia pestis KIM
cagcgguaaauugcucacuca

SEQ ID NO: 4194303 - RNA, 18 nt, Yersinia pestis KIM
cagcgguagagaucucug

SEQ ID NO: 4194304 - RNA, 16 nt, Yersinia pestis KIM
cagcgguaucccacug

SEQ ID NO: 4194305 - RNA, 21 nt, Yersinia pestis KIM
cagcgguaucccacuggacgu

SEQ ID NO: 4194306 - RNA, 23 nt, Yersinia pestis KIM
cagcgguaugaggaucccuucug

SEQ ID NO: 4194307 - RNA, 20 nt, Yersinia pestis KIM
cagcggucgguauucagccg

SEQ ID NO: 4194308 - RNA, 22 nt, Yersinia pestis KIM
cagcggucgguauucagccgcc

SEQ ID NO: 4194309 - RNA, 15 nt, Yersinia pestis KIM
cagcguagacaauga

SEQ ID NO: 4194310 - RNA, 22 nt, Yersinia pestis KIM
cagcguagacaaugacugugcg

SEQ ID NO: 4194311 - RNA, 18 nt, Yersinia pestis KIM
cagcguagauuuucucag

SEQ ID NO: 4194312 - RNA, 23 nt, Yersinia pestis KIM
cagcguagguaacuaagcugccu

SEQ ID NO: 4194313 - RNA, 18 nt, Yersinia pestis KIM
cagcguauagcgccgcca

SEQ ID NO: 4194314 - RNA, 19 nt, Yersinia pestis KIM
cagcgucauggucucacug

SEQ ID NO: 4194315 - RNA, 22 nt, Yersinia pestis KIM
cagcgucgccguaaauugcuca

SEQ ID NO: 4194316 - RNA, 17 nt, Yersinia pestis KIM
cagcgugauuagcagua

SEQ ID NO: 4194317 - RNA, 15 nt, Yersinia pestis KIM
cagcguuacccagau

SEQ ID NO: 4194318 - RNA, 18 nt, Yersinia pestis KIM
cagcguucuucugauuca

SEQ ID NO: 4194319 - RNA, 18 nt, Yersinia pestis KIM
cagcguuucaccaaacag

SEQ ID NO: 4194320 - RNA, 17 nt, Yersinia pestis KIM
cagcguuuuauucguuc

SEQ ID NO: 4194321 - RNA, 15 nt, Yersinia pestis KIM
cagcuaugcgcggca

SEQ ID NO: 4194322 - RNA, 21 nt, Yersinia pestis KIM
cagcucaagaauuucgucuuc

SEQ ID NO: 4194323 - RNA, 14 nt, Yersinia pestis KIM
cagcucaucaccaa

SEQ ID NO: 4194324 - RNA, 16 nt, Yersinia pestis KIM
cagcucaucaccaaaa

SEQ ID NO: 4194325 - RNA, 23 nt, Yersinia pestis KIM
cagcucaucgucgugugucuuaa

SEQ ID NO: 4194326 - RNA, 16 nt, Yersinia pestis KIM
cagcucauuaaacugu

SEQ ID NO: 4194327 - RNA, 15 nt, Yersinia pestis KIM
cagcucuagaccuga

SEQ ID NO: 4194328 - RNA, 13 nt, Yersinia pestis KIM
cagcucucugagc

SEQ ID NO: 4194329 - RNA, 20 nt, Yersinia pestis KIM
cagcucucugagccauccag

SEQ ID NO: 4194330 - RNA, 13 nt, Yersinia pestis KIM
cagcucuucuaac

SEQ ID NO: 4194331 - RNA, 19 nt, Yersinia pestis KIM
cagcucuucuaacacuuca

SEQ ID NO: 4194332 - RNA, 17 nt, Yersinia pestis KIM
cagcugacccccgccgc

SEQ ID NO: 4194333 - RNA, 15 nt, Yersinia pestis KIM
cagcugacgcagcag

SEQ ID NO: 4194334 - RNA, 16 nt, Yersinia pestis KIM
cagcugcuuuaucgua

SEQ ID NO: 4194335 - RNA, 23 nt, Yersinia pestis KIM
cagcugcuuuaucguagccaaua

SEQ ID NO: 4194336 - RNA, 23 nt, Yersinia pestis KIM
cagcuggaugugagucugcggau

SEQ ID NO: 4194337 - RNA, 23 nt, Yersinia pestis KIM
cagcugggauaugccguauacgu

SEQ ID NO: 4194338 - RNA, 21 nt, Yersinia pestis KIM
cagcuuauaggucauugguua

SEQ ID NO: 4194339 - RNA, 17 nt, Yersinia pestis KIM
cagcuucagcucuucua

SEQ ID NO: 4194340 - RNA, 15 nt, Yersinia pestis KIM
cagcuuccagcaccc

SEQ ID NO: 4194341 - RNA, 20 nt, Yersinia pestis KIM
cagcuuccagcaccccuuca

SEQ ID NO: 4194342 - RNA, 19 nt, Yersinia pestis KIM
cagcuuccugugaaauaaa

SEQ ID NO: 4194343 - RNA, 15 nt, Yersinia pestis KIM
cagcuucgccaccag

SEQ ID NO: 4194344 - RNA, 22 nt, Yersinia pestis KIM
cagcuucuucugggucuaucag

SEQ ID NO: 4194345 - RNA, 15 nt, Yersinia pestis KIM
cagcuucuuuuaaag

SEQ ID NO: 4194346 - RNA, 13 nt, Yersinia pestis KIM
cagcuuguugaua

SEQ ID NO: 4194347 - RNA, 21 nt, Yersinia pestis KIM
cagcuuuagcauugcagauuu

SEQ ID NO: 4194348 - RNA, 22 nt, Yersinia pestis KIM
cagcuuugggucaguuauaaaa

SEQ ID NO: 4194349 - RNA, 14 nt, Yersinia pestis KIM
caggaaacuccagu

SEQ ID NO: 4194350 - RNA, 16 nt, Yersinia pestis KIM
caggaagcaagaaacu

SEQ ID NO: 4194351 - RNA, 23 nt, Yersinia pestis KIM
caggaagcccgucagacugcuga

SEQ ID NO: 4194352 - RNA, 21 nt, Yersinia pestis KIM
caggaagcggccagguucaau

SEQ ID NO: 4194353 - RNA, 15 nt, Yersinia pestis KIM
caggagugaauuucu

SEQ ID NO: 4194354 - RNA, 19 nt, Yersinia pestis KIM
caggauaaaccuacagcca

SEQ ID NO: 4194355 - RNA, 21 nt, Yersinia pestis KIM
caggauaauaccugaauagaa

SEQ ID NO: 4194356 - RNA, 20 nt, Yersinia pestis KIM
caggaucaggccagagacac

SEQ ID NO: 4194357 - RNA, 21 nt, Yersinia pestis KIM
caggaucgaucuggauauauu

SEQ ID NO: 4194358 - RNA, 15 nt, Yersinia pestis KIM
caggaucugcuccuc

SEQ ID NO: 4194359 - RNA, 14 nt, Yersinia pestis KIM
caggauuaaauaaa

SEQ ID NO: 4194360 - RNA, 14 nt, Yersinia pestis KIM
caggcaacgacagc

SEQ ID NO: 4194361 - RNA, 20 nt, Yersinia pestis KIM
caggcaacgacagcaacaac

SEQ ID NO: 4194362 - RNA, 17 nt, Yersinia pestis KIM
caggcaaugagugcagc

SEQ ID NO: 4194363 - RNA, 21 nt, Yersinia pestis KIM
caggcacuuugucaacaaccu

SEQ ID NO: 4194364 - RNA, 19 nt, Yersinia pestis KIM
caggcacuuugucaauaac

SEQ ID NO: 4194365 - RNA, 16 nt, Yersinia pestis KIM
caggcagagcaagggu

SEQ ID NO: 4194366 - RNA, 15 nt, Yersinia pestis KIM
caggcagauaaaucc

SEQ ID NO: 4194367 - RNA, 15 nt, Yersinia pestis KIM
caggcaguaaaauau

SEQ ID NO: 4194368 - RNA, 15 nt, Yersinia pestis KIM
caggcauaucacuau

SEQ ID NO: 4194369 - RNA, 20 nt, Yersinia pestis KIM
caggcauaucacuauuucgu

SEQ ID NO: 4194370 - RNA, 13 nt, Yersinia pestis KIM
caggcaucaucug

SEQ ID NO: 4194371 - RNA, 21 nt, Yersinia pestis KIM
caggcaucaucugcgguaacc

SEQ ID NO: 4194372 - RNA, 15 nt, Yersinia pestis KIM
caguaacugaucaau

SEQ ID NO: 4194373 - RNA, 11 nt, Yersinia pestis KIM
caguaagcucu

SEQ ID NO: 4194374 - RNA, 20 nt, Yersinia pestis KIM
caguaagcuguugaccugaa

SEQ ID NO: 4194375 - RNA, 12 nt, Yersinia pestis KIM
caguaaggcagc

SEQ ID NO: 4194376 - RNA, 16 nt, Yersinia pestis KIM
caguaagguauugaca

SEQ ID NO: 4194377 - RNA, 19 nt, Yersinia pestis KIM
caguaagguauugacacaa

SEQ ID NO: 4194378 - RNA, 20 nt, Yersinia pestis KIM
caguaaguuaaaaagaaaaa

SEQ ID NO: 4194379 - RNA, 23 nt, Yersinia pestis KIM
caguaaguugaugacaugcucuu

SEQ ID NO: 4194380 - RNA, 18 nt, Yersinia pestis KIM
caguaaucaaacauaaaa

SEQ ID NO: 4194381 - RNA, 17 nt, Yersinia pestis KIM
caguaauucacugcuua

SEQ ID NO: 4194382 - RNA, 14 nt, Yersinia pestis KIM
caguaccgcuggug

SEQ ID NO: 4194383 - RNA, 16 nt, Yersinia pestis KIM
caguaccgcuggugcu

SEQ ID NO: 4194384 - RNA, 21 nt, Yersinia pestis KIM
caguacgacgacggauauucu

SEQ ID NO: 4194385 - RNA, 13 nt, Yersinia pestis KIM
caguacgcuggcc

SEQ ID NO: 4194386 - RNA, 21 nt, Yersinia pestis KIM
caguagacgacacaaaugcug

SEQ ID NO: 4194387 - RNA, 22 nt, Yersinia pestis KIM
caguagagcgguuuguugcuac

SEQ ID NO: 4194388 - RNA, 15 nt, Yersinia pestis KIM
caguagcaggcgcac

SEQ ID NO: 4194389 - RNA, 17 nt, Yersinia pestis KIM
caguagcagggccgccc

SEQ ID NO: 4194390 - RNA, 20 nt, Yersinia pestis KIM
caguagcagggccgcccaga

SEQ ID NO: 4194391 - RNA, 20 nt, Yersinia pestis KIM
caguagcauucgauguaacg

SEQ ID NO: 4194392 - RNA, 14 nt, Yersinia pestis KIM
caguagcccagccg

SEQ ID NO: 4194393 - RNA, 19 nt, Yersinia pestis KIM
caguagcccagccggaaca

SEQ ID NO: 4194394 - RNA, 16 nt, Yersinia pestis KIM
caguagcgucaguuuc

SEQ ID NO: 4194395 - RNA, 17 nt, Yersinia pestis KIM
caguagcgucaguuuca

SEQ ID NO: 4194396 - RNA, 14 nt, Yersinia pestis KIM
caguagugaagaua

SEQ ID NO: 4194397 - RNA, 13 nt, Yersinia pestis KIM
caguaucaaccac

SEQ ID NO: 4194398 - RNA, 15 nt, Yersinia pestis KIM
caguaucaaccaccg

SEQ ID NO: 4194399 - RNA, 20 nt, Yersinia pestis KIM
caguaucagcgauuuuaaaa

SEQ ID NO: 4194400 - RNA, 21 nt, Yersinia pestis KIM
caguauguuguucgaaaauag

SEQ ID NO: 4194401 - RNA, 21 nt, Yersinia pestis KIM
caguauugcagagcaaaacug

SEQ ID NO: 4194402 - RNA, 22 nt, Yersinia pestis KIM
caguauuuagcgugacacuguc

SEQ ID NO: 4194403 - RNA, 23 nt, Yersinia pestis KIM
caguauuugcaguggaugauaaa

SEQ ID NO: 4194404 - RNA, 15 nt, Yersinia pestis KIM
caguauuuuaagaaa

SEQ ID NO: 4194405 - RNA, 17 nt, Yersinia pestis KIM
caguauuuuaagaaaac

SEQ ID NO: 4194406 - RNA, 22 nt, Yersinia pestis KIM
caguauuuuaagaaaacugugc

SEQ ID NO: 4194407 - RNA, 11 nt, Yersinia pestis KIM
cagucaaaaga

SEQ ID NO: 4194408 - RNA, 13 nt, Yersinia pestis KIM
cagucaaaagaaa

SEQ ID NO: 4194409 - RNA, 12 nt, Yersinia pestis KIM
cagucaauacac

SEQ ID NO: 4194410 - RNA, 18 nt, Yersinia pestis KIM
cagucaccgcuguaaaug

SEQ ID NO: 4194411 - RNA, 16 nt, Yersinia pestis KIM
cagucacuaaaccauu

SEQ ID NO: 4194412 - RNA, 22 nt, Yersinia pestis KIM
cagucacuaccgcucagauaaa

SEQ ID NO: 4194413 - RNA, 11 nt, Yersinia pestis KIM
cagucacugcu

SEQ ID NO: 4194414 - RNA, 17 nt, Yersinia pestis KIM
cagucacugcugcacug

SEQ ID NO: 4194415 - RNA, 20 nt, Yersinia pestis KIM
cagucacuuugggcugauca

SEQ ID NO: 4194416 - RNA, 21 nt, Yersinia pestis KIM
cagucagcacuccguuaccaa

SEQ ID NO: 4194417 - RNA, 13 nt, Yersinia pestis KIM
cagucaguaggcu

SEQ ID NO: 4194418 - RNA, 19 nt, Yersinia pestis KIM
cagucaucgccuucuggca

SEQ ID NO: 4194419 - RNA, 14 nt, Yersinia pestis KIM
cagucauuaacaca

SEQ ID NO: 4194420 - RNA, 22 nt, Yersinia pestis KIM
cagucauucaccugcccgucac

SEQ ID NO: 4194421 - RNA, 19 nt, Yersinia pestis KIM
caguccaaaauacggccag

SEQ ID NO: 4194422 - RNA, 14 nt, Yersinia pestis KIM
caguccagccaccc

SEQ ID NO: 4194423 - RNA, 13 nt, Yersinia pestis KIM
cagucccugugcg

SEQ ID NO: 4194424 - RNA, 13 nt, Yersinia pestis KIM
caguccguaaauc

SEQ ID NO: 4194425 - RNA, 20 nt, Yersinia pestis KIM
cagucgacaguguaaaaagc

SEQ ID NO: 4194426 - RNA, 18 nt, Yersinia pestis KIM
cagucgcgaugcgcugcu

SEQ ID NO: 4194427 - RNA, 16 nt, Yersinia pestis KIM
cagucgcuuuuuaaca

SEQ ID NO: 4194428 - RNA, 18 nt, Yersinia pestis KIM
cagucgcuuuuuaacaaa

SEQ ID NO: 4194429 - RNA, 15 nt, Yersinia pestis KIM
cagucuaaacgccgc

SEQ ID NO: 4194430 - RNA, 17 nt, Yersinia pestis KIM
cagucuagugcgcugug

SEQ ID NO: 4194431 - RNA, 22 nt, Yersinia pestis KIM
cagucugaaacgccagccucug

SEQ ID NO: 4194432 - RNA, 17 nt, Yersinia pestis KIM
cagucugaaaucuccuc

SEQ ID NO: 4194433 - RNA, 15 nt, Yersinia pestis KIM
cagucugaagccuac

SEQ ID NO: 4194434 - RNA, 19 nt, Yersinia pestis KIM
cagucugaaggguauugaa

SEQ ID NO: 4194435 - RNA, 22 nt, Yersinia pestis KIM
cagucugagccucaugaaugag

SEQ ID NO: 4194436 - RNA, 17 nt, Yersinia pestis KIM
cagucugagggccacuu

SEQ ID NO: 4194437 - RNA, 19 nt, Yersinia pestis KIM
cagucugucguacuuuccu

SEQ ID NO: 4194438 - RNA, 14 nt, Yersinia pestis KIM
cagucuuuuuccca

SEQ ID NO: 4194439 - RNA, 16 nt, Yersinia pestis KIM
cagucuuuuucccaau

SEQ ID NO: 4194440 - RNA, 22 nt, Yersinia pestis KIM
cagugaaaagguuaacugcagu

SEQ ID NO: 4194441 - RNA, 13 nt, Yersinia pestis KIM
cagugaacugcuc

SEQ ID NO: 4194442 - RNA, 19 nt, Yersinia pestis KIM
cagugagcauuuuguuacc

SEQ ID NO: 4194443 - RNA, 18 nt, Yersinia pestis KIM
cagugaugcugcacauca

SEQ ID NO: 4194444 - RNA, 21 nt, Yersinia pestis KIM
cagugauuaucucaacguauu

SEQ ID NO: 4194445 - RNA, 21 nt, Yersinia pestis KIM
cagugauucgggugagugagc

SEQ ID NO: 4194446 - RNA, 18 nt, Yersinia pestis KIM
cagugcaaaaugcucuuc

SEQ ID NO: 4194447 - RNA, 14 nt, Yersinia pestis KIM
cagugcacagucac

SEQ ID NO: 4194448 - RNA, 17 nt, Yersinia pestis KIM
cagugcacaucaauacc

SEQ ID NO: 4194449 - RNA, 14 nt, Yersinia pestis KIM
cagugcagccaaga

SEQ ID NO: 4194450 - RNA, 17 nt, Yersinia pestis KIM
cagugcauccccacuga

SEQ ID NO: 4194451 - RNA, 16 nt, Yersinia pestis KIM
cagugccaacagcgag

SEQ ID NO: 4194452 - RNA, 12 nt, Yersinia pestis KIM
cagugccaauaa

SEQ ID NO: 4194453 - RNA, 22 nt, Yersinia pestis KIM
cagugccgcggcggccagcggc

SEQ ID NO: 4194454 - RNA, 16 nt, Yersinia pestis KIM
cagugccguaugcgca

SEQ ID NO: 4194455 - RNA, 19 nt, Yersinia pestis KIM
cagugccugacgcggugac

SEQ ID NO: 4194456 - RNA, 18 nt, Yersinia pestis KIM
cagugccugguuuuacgc

SEQ ID NO: 4194457 - RNA, 23 nt, Yersinia pestis KIM
cagugcgcaaaaauuagaggccu

SEQ ID NO: 4194458 - RNA, 20 nt, Yersinia pestis KIM
cagugcgccguaaaucguca

SEQ ID NO: 4194459 - RNA, 23 nt, Yersinia pestis KIM
cagugcgguuaucgcucuugagg

SEQ ID NO: 4194460 - RNA, 20 nt, Yersinia pestis KIM
cagugcguaaucagccgcgg

SEQ ID NO: 4194461 - RNA, 20 nt, Yersinia pestis KIM
cagugcucccugaacgccuu

SEQ ID NO: 4194462 - RNA, 23 nt, Yersinia pestis KIM
cagugcucccugaacgccuugcc

SEQ ID NO: 4194463 - RNA, 13 nt, Yersinia pestis KIM
caguggcaucaau

SEQ ID NO: 4194464 - RNA, 14 nt, Yersinia pestis KIM
caguggcaucaaua

SEQ ID NO: 4194465 - RNA, 21 nt, Yersinia pestis KIM
caguggcaugaugcgcucacu

SEQ ID NO: 4194466 - RNA, 14 nt, Yersinia pestis KIM
caguggcuggaaag

SEQ ID NO: 4194467 - RNA, 19 nt, Yersinia pestis KIM
caguguacgaauauguucu

SEQ ID NO: 4194468 - RNA, 18 nt, Yersinia pestis KIM
caguguauuaccugcgac

SEQ ID NO: 4194469 - RNA, 15 nt, Yersinia pestis KIM
caguguauuuaucaa

SEQ ID NO: 4194470 - RNA, 16 nt, Yersinia pestis KIM
cagugucaguaugaaa

SEQ ID NO: 4194471 - RNA, 22 nt, Yersinia pestis KIM
cagugucaguucgacaccuuca

SEQ ID NO: 4194472 - RNA, 20 nt, Yersinia pestis KIM
caguguccagccugguuggu

SEQ ID NO: 4194473 - RNA, 18 nt, Yersinia pestis KIM
cagugugcgcaucagcca

SEQ ID NO: 4194474 - RNA, 13 nt, Yersinia pestis KIM
caguguugccaug

SEQ ID NO: 4194475 - RNA, 22 nt, Yersinia pestis KIM
caguuaaggcuggcugugugag

SEQ ID NO: 4194476 - RNA, 14 nt, Yersinia pestis KIM
caguuacaggucaa

SEQ ID NO: 4194477 - RNA, 22 nt, Yersinia pestis KIM
caguuacgguguugguuguuuu

SEQ ID NO: 4194478 - RNA, 19 nt, Yersinia pestis KIM
caguuacgucaggaauaaa

SEQ ID NO: 4194479 - RNA, 17 nt, Yersinia pestis KIM
caguuauaaaaaccccu

SEQ ID NO: 4194480 - RNA, 22 nt, Yersinia pestis KIM
caguuauaaaaaccccuuuuga

SEQ ID NO: 4194481 - RNA, 23 nt, Yersinia pestis KIM
caguuauuauuuuuaaugauuga

SEQ ID NO: 4194482 - RNA, 14 nt, Yersinia pestis KIM
caguucagcccccu

SEQ ID NO: 4194483 - RNA, 20 nt, Yersinia pestis KIM
caguucagcccccucaauac

SEQ ID NO: 4194484 - RNA, 21 nt, Yersinia pestis KIM
caguucagcccccucaauacc

SEQ ID NO: 4194485 - RNA, 16 nt, Yersinia pestis KIM
caguucaucagcccag

SEQ ID NO: 4194486 - RNA, 14 nt, Yersinia pestis KIM
cauauccaguugcc

SEQ ID NO: 4194487 - RNA, 16 nt, Yersinia pestis KIM
cauauccgaugauaua

SEQ ID NO: 4194488 - RNA, 16 nt, Yersinia pestis KIM
cauauccgguuguuca

SEQ ID NO: 4194489 - RNA, 17 nt, Yersinia pestis KIM
cauauccucgagaugua

SEQ ID NO: 4194490 - RNA, 16 nt, Yersinia pestis KIM
cauauccugugccaac

SEQ ID NO: 4194491 - RNA, 17 nt, Yersinia pestis KIM
cauaucgcucaucaugg

SEQ ID NO: 4194492 - RNA, 13 nt, Yersinia pestis KIM
cauaucggccaag

SEQ ID NO: 4194493 - RNA, 13 nt, Yersinia pestis KIM
cauaucguccaaa

SEQ ID NO: 4194494 - RNA, 15 nt, Yersinia pestis KIM
cauaucguccaaagg

SEQ ID NO: 4194495 - RNA, 20 nt, Yersinia pestis KIM
cauaucuugaaccaauuuuu

SEQ ID NO: 4194496 - RNA, 22 nt, Yersinia pestis KIM
cauaucuugaaccaauuuuucu

SEQ ID NO: 4194497 - RNA, 23 nt, Yersinia pestis KIM
cauaucuuuauuaucaauggcgc

SEQ ID NO: 4194498 - RNA, 13 nt, Yersinia pestis KIM
cauaugaaacacc

SEQ ID NO: 4194499 - RNA, 11 nt, Yersinia pestis KIM
cauaugacaaa

SEQ ID NO: 4194500 - RNA, 15 nt, Yersinia pestis KIM
cauaugacaaauaag

SEQ ID NO: 4194501 - RNA, 16 nt, Yersinia pestis KIM
cauaugaguuucaaau

SEQ ID NO: 4194502 - RNA, 14 nt, Yersinia pestis KIM
cauauggaugaugc

SEQ ID NO: 4194503 - RNA, 21 nt, Yersinia pestis KIM
cauauguucgaucaaaacaau

SEQ ID NO: 4194504 - RNA, 13 nt, Yersinia pestis KIM
cauauguugaguc

SEQ ID NO: 4194505 - RNA, 21 nt, Yersinia pestis KIM
cauauuaacauaucaauaagu

SEQ ID NO: 4194506 - RNA, 16 nt, Yersinia pestis KIM
cauauuacucucuauu

SEQ ID NO: 4194507 - RNA, 16 nt, Yersinia pestis KIM
cauauuauaaugaaau

SEQ ID NO: 4194508 - RNA, 11 nt, Yersinia pestis KIM
cauauuauuug

SEQ ID NO: 4194509 - RNA, 23 nt, Yersinia pestis KIM
cauauucaaugcggcuuuacugg

SEQ ID NO: 4194510 - RNA, 12 nt, Yersinia pestis KIM
cauauucaccag

SEQ ID NO: 4194511 - RNA, 17 nt, Yersinia pestis KIM
cauauucacuauagacu

SEQ ID NO: 4194512 - RNA, 19 nt, Yersinia pestis KIM
cauauucaugguuucaaaa

SEQ ID NO: 4194513 - RNA, 19 nt, Yersinia pestis KIM
cauauugaauuaaauuuua

SEQ ID NO: 4194514 - RNA, 21 nt, Yersinia pestis KIM
cauauugaauuaaauuuuaua

SEQ ID NO: 4194515 - RNA, 17 nt, Yersinia pestis KIM
cauauuggccaguugcc

SEQ ID NO: 4194516 - RNA, 15 nt, Yersinia pestis KIM
cauauuguccaaagg

SEQ ID NO: 4194517 - RNA, 17 nt, Yersinia pestis KIM
cauauuguccaaaggaa

SEQ ID NO: 4194518 - RNA, 18 nt, Yersinia pestis KIM
cauauuguccaaaggaag

SEQ ID NO: 4194519 - RNA, 19 nt, Yersinia pestis KIM
cauauuguccaaaggaagg

SEQ ID NO: 4194520 - RNA, 20 nt, Yersinia pestis KIM
cauauuguccaaaggaaggg

SEQ ID NO: 4194521 - RNA, 17 nt, Yersinia pestis KIM
cauauuuaucuuaucca

SEQ ID NO: 4194522 - RNA, 13 nt, Yersinia pestis KIM
cauauuuuaaaua

SEQ ID NO: 4194523 - RNA, 14 nt, Yersinia pestis KIM
cauauuuuucaaua

SEQ ID NO: 4194524 - RNA, 17 nt, Yersinia pestis KIM
cauauuuuuuagaucuc

SEQ ID NO: 4194525 - RNA, 14 nt, Yersinia pestis KIM
caucaaaauugaug

SEQ ID NO: 4194526 - RNA, 13 nt, Yersinia pestis KIM
caucaaaccggcu

SEQ ID NO: 4194527 - RNA, 18 nt, Yersinia pestis KIM
caucaaaucagaggcuuc

SEQ ID NO: 4194528 - RNA, 21 nt, Yersinia pestis KIM
caucaaaugaauaaccuugcu

SEQ ID NO: 4194529 - RNA, 16 nt, Yersinia pestis KIM
caucaacauuguccug

SEQ ID NO: 4194530 - RNA, 12 nt, Yersinia pestis KIM
caucaaccugau

SEQ ID NO: 4194531 - RNA, 16 nt, Yersinia pestis KIM
caucaacgacagcagc

SEQ ID NO: 4194532 - RNA, 21 nt, Yersinia pestis KIM
caucaacguuaaucgccaccc

SEQ ID NO: 4194533 - RNA, 15 nt, Yersinia pestis KIM
caucaacugacagcg

SEQ ID NO: 4194534 - RNA, 13 nt, Yersinia pestis KIM
caucaacuucacu

SEQ ID NO: 4194535 - RNA, 16 nt, Yersinia pestis KIM
caucaacuucugcaaa

SEQ ID NO: 4194536 - RNA, 16 nt, Yersinia pestis KIM
caucaagccaccgcug

SEQ ID NO: 4194537 - RNA, 19 nt, Yersinia pestis KIM
caucaauaaaauuacccag

SEQ ID NO: 4194538 - RNA, 22 nt, Yersinia pestis KIM
caucaauaaaauuacccagcau

SEQ ID NO: 4194539 - RNA, 13 nt, Yersinia pestis KIM
caucaauaacggu

SEQ ID NO: 4194540 - RNA, 22 nt, Yersinia pestis KIM
caucaauagugcgaucaaaaac

SEQ ID NO: 4194541 - RNA, 19 nt, Yersinia pestis KIM
caucaauguuggcccaaga

SEQ ID NO: 4194542 - RNA, 23 nt, Yersinia pestis KIM
caucaauguuggcccaagauacu

SEQ ID NO: 4194543 - RNA, 22 nt, Yersinia pestis KIM
caucaauuggcagcggcaaaua

SEQ ID NO: 4194544 - RNA, 13 nt, Yersinia pestis KIM
caucaauuuggca

SEQ ID NO: 4194545 - RNA, 23 nt, Yersinia pestis KIM
caucacaaauauuggcccacugg

SEQ ID NO: 4194546 - RNA, 14 nt, Yersinia pestis KIM
caucacaccgcgau

SEQ ID NO: 4194547 - RNA, 16 nt, Yersinia pestis KIM
caucacaucggcgacu

SEQ ID NO: 4194548 - RNA, 19 nt, Yersinia pestis KIM
caucaccaaagauauguuc

SEQ ID NO: 4194549 - RNA, 20 nt, Yersinia pestis KIM
caucaccaaagauauguucu

SEQ ID NO: 4194550 - RNA, 12 nt, Yersinia pestis KIM
caucaccacccu

SEQ ID NO: 4194551 - RNA, 16 nt, Yersinia pestis KIM
caucaccauugaccag

SEQ ID NO: 4194552 - RNA, 20 nt, Yersinia pestis KIM
caucacccagcaaaauagca

SEQ ID NO: 4194553 - RNA, 20 nt, Yersinia pestis KIM
caucacccgcagugccuuau

SEQ ID NO: 4194554 - RNA, 16 nt, Yersinia pestis KIM
caucaccgcuaucacu

SEQ ID NO: 4194555 - RNA, 18 nt, Yersinia pestis KIM
caucaccgcuaucacuga

SEQ ID NO: 4194556 - RNA, 13 nt, Yersinia pestis KIM
caucacgcagcag

SEQ ID NO: 4194557 - RNA, 20 nt, Yersinia pestis KIM
caucacggcggcccggugca

SEQ ID NO: 4194558 - RNA, 20 nt, Yersinia pestis KIM
caucagacaggauaaucauc

SEQ ID NO: 4194559 - RNA, 13 nt, Yersinia pestis KIM
caucagacauauu

SEQ ID NO: 4194560 - RNA, 14 nt, Yersinia pestis KIM
caucagacugcucu

SEQ ID NO: 4194561 - RNA, 18 nt, Yersinia pestis KIM
caucagacugcucuuucc

SEQ ID NO: 4194562 - RNA, 16 nt, Yersinia pestis KIM
caucagaggcucaucc

SEQ ID NO: 4194563 - RNA, 18 nt, Yersinia pestis KIM
caucagaguccaauagcu

SEQ ID NO: 4194564 - RNA, 12 nt, Yersinia pestis KIM
caucagauagau

SEQ ID NO: 4194565 - RNA, 18 nt, Yersinia pestis KIM
caucagcaaaguauuuau

SEQ ID NO: 4194566 - RNA, 12 nt, Yersinia pestis KIM
caucagcaauuu

SEQ ID NO: 4194567 - RNA, 21 nt, Yersinia pestis KIM
caucagcagagagcgacucac

SEQ ID NO: 4194568 - RNA, 15 nt, Yersinia pestis KIM
caucagcagcaggaa

SEQ ID NO: 4194569 - RNA, 19 nt, Yersinia pestis KIM
caucagcagcaggaauacc

SEQ ID NO: 4194570 - RNA, 21 nt, Yersinia pestis KIM
caucagcagugacgucaucgu

SEQ ID NO: 4194571 - RNA, 19 nt, Yersinia pestis KIM
caucagcauauuacccagu

SEQ ID NO: 4194572 - RNA, 21 nt, Yersinia pestis KIM
caucagccagccacugggcua

SEQ ID NO: 4194573 - RNA, 15 nt, Yersinia pestis KIM
caucagccucuaaca

SEQ ID NO: 4194574 - RNA, 21 nt, Yersinia pestis KIM
caucagcgauucauugagcaa

SEQ ID NO: 4194575 - RNA, 16 nt, Yersinia pestis KIM
caucagcgcacugcau

SEQ ID NO: 4194576 - RNA, 15 nt, Yersinia pestis KIM
caucagcgcccagcu

SEQ ID NO: 4194577 - RNA, 18 nt, Yersinia pestis KIM
caucagcgcccuugccag

SEQ ID NO: 4194578 - RNA, 19 nt, Yersinia pestis KIM
caucagcgccuuugccccg

SEQ ID NO: 4194579 - RNA, 14 nt, Yersinia pestis KIM
caucagcgcuggcu

SEQ ID NO: 4194580 - RNA, 15 nt, Yersinia pestis KIM
caucagcgcuggcuu

SEQ ID NO: 4194581 - RNA, 21 nt, Yersinia pestis KIM
caucagcguagccguuaaaua

SEQ ID NO: 4194582 - RNA, 18 nt, Yersinia pestis KIM
caucaggcgcuuuucuau

SEQ ID NO: 4194583 - RNA, 16 nt, Yersinia pestis KIM
caucaggcuuauauuu

SEQ ID NO: 4194584 - RNA, 18 nt, Yersinia pestis KIM
caucagguuguauuuugc

SEQ ID NO: 4194585 - RNA, 14 nt, Yersinia pestis KIM
caucaguaauguga

SEQ ID NO: 4194586 - RNA, 17 nt, Yersinia pestis KIM
caucagucacuaaacca

SEQ ID NO: 4194587 - RNA, 16 nt, Yersinia pestis KIM
caucauaaaaauacau

SEQ ID NO: 4194588 - RNA, 22 nt, Yersinia pestis KIM
caucauaaaaauacauaucaac

SEQ ID NO: 4194589 - RNA, 14 nt, Yersinia pestis KIM
caucauaacgaaug

SEQ ID NO: 4194590 - RNA, 12 nt, Yersinia pestis KIM
caucauacugac

SEQ ID NO: 4194591 - RNA, 23 nt, Yersinia pestis KIM
caucauaguggccuaauguacua

SEQ ID NO: 4194592 - RNA, 14 nt, Yersinia pestis KIM
caucauauauuaaa

SEQ ID NO: 4194593 - RNA, 13 nt, Yersinia pestis KIM
caucauaucgaug

SEQ ID NO: 4194594 - RNA, 18 nt, Yersinia pestis KIM
caucauaucgaugacagc

SEQ ID NO: 4194595 - RNA, 12 nt, Yersinia pestis KIM
caucaucaaaac

SEQ ID NO: 4194596 - RNA, 17 nt, Yersinia pestis KIM
caucaucaaaaccgaug

SEQ ID NO: 4194597 - RNA, 22 nt, Yersinia pestis KIM
caucaucaaaaccgaugaguga

SEQ ID NO: 4194598 - RNA, 13 nt, Yersinia pestis KIM
caucaucaauaaa

SEQ ID NO: 4194599 - RNA, 20 nt, Yersinia pestis KIM
caucaucaauggauucuugc

SEQ ID NO: 4194600 - RNA, 20 nt, Yersinia pestis KIM
caucaucacaaauaacccgc

SEQ ID NO: 4194601 - RNA, 20 nt, Yersinia pestis KIM
caucuugcgccgaaauaaaa

SEQ ID NO: 4194602 - RNA, 23 nt, Yersinia pestis KIM
caucuugcgccgaaauaaaacca

SEQ ID NO: 4194603 - RNA, 19 nt, Yersinia pestis KIM
caucuugggccgacucugc

SEQ ID NO: 4194604 - RNA, 12 nt, Yersinia pestis KIM
caucuuuaacaa

SEQ ID NO: 4194605 - RNA, 22 nt, Yersinia pestis KIM
caucuuuaauaaauuuucuaag

SEQ ID NO: 4194606 - RNA, 16 nt, Yersinia pestis KIM
caucuuuaccccauug

SEQ ID NO: 4194607 - RNA, 12 nt, Yersinia pestis KIM
caucuuuugcua

SEQ ID NO: 4194608 - RNA, 19 nt, Yersinia pestis KIM
caucuuuuucugccugagu

SEQ ID NO: 4194609 - RNA, 20 nt, Yersinia pestis KIM
caucuuuuuuuuuauuauca

SEQ ID NO: 4194610 - RNA, 22 nt, Yersinia pestis KIM
caucuuuuuuuuuauuaucauc

SEQ ID NO: 4194611 - RNA, 17 nt, Yersinia pestis KIM
caugaaaucagagaguu

SEQ ID NO: 4194612 - RNA, 16 nt, Yersinia pestis KIM
caugaaguugauaaaa

SEQ ID NO: 4194613 - RNA, 15 nt, Yersinia pestis KIM
caugaauauucacca

SEQ ID NO: 4194614 - RNA, 13 nt, Yersinia pestis KIM
caugaauggcuuu

SEQ ID NO: 4194615 - RNA, 13 nt, Yersinia pestis KIM
caugacaaaauac

SEQ ID NO: 4194616 - RNA, 15 nt, Yersinia pestis KIM
caugacaaauugcaa

SEQ ID NO: 4194617 - RNA, 23 nt, Yersinia pestis KIM
caugacagguugauaaguugaga

SEQ ID NO: 4194618 - RNA, 14 nt, Yersinia pestis KIM
caugacaucccagc

SEQ ID NO: 4194619 - RNA, 20 nt, Yersinia pestis KIM
caugacgguggcacgagggu

SEQ ID NO: 4194620 - RNA, 20 nt, Yersinia pestis KIM
caugacuagugccacaacaa

SEQ ID NO: 4194621 - RNA, 13 nt, Yersinia pestis KIM
caugagaaccagu

SEQ ID NO: 4194622 - RNA, 20 nt, Yersinia pestis KIM
caugagaaccaguucuggua

SEQ ID NO: 4194623 - RNA, 20 nt, Yersinia pestis KIM
caugagaauacuucaggcca

SEQ ID NO: 4194624 - RNA, 23 nt, Yersinia pestis KIM
caugagaauacuucaggccaaua

SEQ ID NO: 4194625 - RNA, 19 nt, Yersinia pestis KIM
caugaguguuggccucaga

SEQ ID NO: 4194626 - RNA, 21 nt, Yersinia pestis KIM
caugauaaaacuauucugcuu

SEQ ID NO: 4194627 - RNA, 21 nt, Yersinia pestis KIM
caugauagcuugggcgauagu

SEQ ID NO: 4194628 - RNA, 20 nt, Yersinia pestis KIM
caugaugaauacgauaaaga

SEQ ID NO: 4194629 - RNA, 16 nt, Yersinia pestis KIM
caugaugacaaugcgu

SEQ ID NO: 4194630 - RNA, 16 nt, Yersinia pestis KIM
caugaugauaucaccu

SEQ ID NO: 4194631 - RNA, 14 nt, Yersinia pestis KIM
caugaugccgagug

SEQ ID NO: 4194632 - RNA, 18 nt, Yersinia pestis KIM
caugauucguagaaacau

SEQ ID NO: 4194633 - RNA, 12 nt, Yersinia pestis KIM
caugauucucua

SEQ ID NO: 4194634 - RNA, 15 nt, Yersinia pestis KIM
caugauucucuauuc

SEQ ID NO: 4194635 - RNA, 15 nt, Yersinia pestis KIM
caugauuuguugaug

SEQ ID NO: 4194636 - RNA, 11 nt, Yersinia pestis KIM
caugcaacaga

SEQ ID NO: 4194637 - RNA, 12 nt, Yersinia pestis KIM
caugcacaguug

SEQ ID NO: 4194638 - RNA, 21 nt, Yersinia pestis KIM
caugcagcauuuucagcaacu

SEQ ID NO: 4194639 - RNA, 23 nt, Yersinia pestis KIM
caugcauuaaggcgcgacugauu

SEQ ID NO: 4194640 - RNA, 17 nt, Yersinia pestis KIM
caugcauuggaaaaaau

SEQ ID NO: 4194641 - RNA, 12 nt, Yersinia pestis KIM
caugccauggcg

SEQ ID NO: 4194642 - RNA, 17 nt, Yersinia pestis KIM
caugcccauacacaguc

SEQ ID NO: 4194643 - RNA, 15 nt, Yersinia pestis KIM
caugcgaauacuuug

SEQ ID NO: 4194644 - RNA, 12 nt, Yersinia pestis KIM
caugcgagcagu

SEQ ID NO: 4194645 - RNA, 14 nt, Yersinia pestis KIM
caugcgauacgccc

SEQ ID NO: 4194646 - RNA, 16 nt, Yersinia pestis KIM
caugcggauugaacug

SEQ ID NO: 4194647 - RNA, 16 nt, Yersinia pestis KIM
caugcguaaaugaaau

SEQ ID NO: 4194648 - RNA, 22 nt, Yersinia pestis KIM
caugcguugaugcucuucuuca

SEQ ID NO: 4194649 - RNA, 16 nt, Yersinia pestis KIM
caugcucaaucugcaa

SEQ ID NO: 4194650 - RNA, 19 nt, Yersinia pestis KIM
caugcucaaucugcaaugc

SEQ ID NO: 4194651 - RNA, 14 nt, Yersinia pestis KIM
caugcucaccaugu

SEQ ID NO: 4194652 - RNA, 15 nt, Yersinia pestis KIM
caugcucccuccugc

SEQ ID NO: 4194653 - RNA, 22 nt, Yersinia pestis KIM
caugcucccuccugcccaugcu

SEQ ID NO: 4194654 - RNA, 19 nt, Yersinia pestis KIM
caugcucugcuaauacgcu

SEQ ID NO: 4194655 - RNA, 13 nt, Yersinia pestis KIM
caugcugauagca

SEQ ID NO: 4194656 - RNA, 19 nt, Yersinia pestis KIM
caugcugcccgcacacuga

SEQ ID NO: 4194657 - RNA, 23 nt, Yersinia pestis KIM
cauggaaaauauucuaaguaaaa

SEQ ID NO: 4194658 - RNA, 15 nt, Yersinia pestis KIM
cauggacggcauaua

SEQ ID NO: 4194659 - RNA, 17 nt, Yersinia pestis KIM
cauggagagcagggccc

SEQ ID NO: 4194660 - RNA, 16 nt, Yersinia pestis KIM
cauggaucacccguug

SEQ ID NO: 4194661 - RNA, 22 nt, Yersinia pestis KIM
cauggcaaccccuaauccagca

SEQ ID NO: 4194662 - RNA, 17 nt, Yersinia pestis KIM
cauggcagcuugaagua

SEQ ID NO: 4194663 - RNA, 19 nt, Yersinia pestis KIM
cauggcaggucucgcaaug

SEQ ID NO: 4194664 - RNA, 18 nt, Yersinia pestis KIM
cauggcauauucaccaga

SEQ ID NO: 4194665 - RNA, 23 nt, Yersinia pestis KIM
cauggcauauucaccagacaccu

SEQ ID NO: 4194666 - RNA, 18 nt, Yersinia pestis KIM
cauggccaugaaucaaau

SEQ ID NO: 4194667 - RNA, 19 nt, Yersinia pestis KIM
cauggccaugaaucaaauu

SEQ ID NO: 4194668 - RNA, 16 nt, Yersinia pestis KIM
cauggcgaaaauccuu

SEQ ID NO: 4194669 - RNA, 21 nt, Yersinia pestis KIM
cauggcggcagcacagagcac

SEQ ID NO: 4194670 - RNA, 15 nt, Yersinia pestis KIM
cauggcggcucgccu

SEQ ID NO: 4194671 - RNA, 21 nt, Yersinia pestis KIM
cauggcggcucgccugauagc

SEQ ID NO: 4194672 - RNA, 15 nt, Yersinia pestis KIM
cauggcguaaccgcc

SEQ ID NO: 4194673 - RNA, 16 nt, Yersinia pestis KIM
cauggcguaaccgccg

SEQ ID NO: 4194674 - RNA, 16 nt, Yersinia pestis KIM
cauggcucucuuuuuu

SEQ ID NO: 4194675 - RNA, 14 nt, Yersinia pestis KIM
cauggcugggaagg

SEQ ID NO: 4194676 - RNA, 16 nt, Yersinia pestis KIM
cauggcuugugcagca

SEQ ID NO: 4194677 - RNA, 17 nt, Yersinia pestis KIM
cauggcuuuaugaccaa

SEQ ID NO: 4194678 - RNA, 13 nt, Yersinia pestis KIM
cauggcuuucagg

SEQ ID NO: 4194679 - RNA, 15 nt, Yersinia pestis KIM
cauggcuuucaggau

SEQ ID NO: 4194680 - RNA, 15 nt, Yersinia pestis KIM
cauggcuuuuugccc

SEQ ID NO: 4194681 - RNA, 20 nt, Yersinia pestis KIM
cauggcuuuuugcccgcgcu

SEQ ID NO: 4194682 - RNA, 14 nt, Yersinia pestis KIM
caugggaaacaagg

SEQ ID NO: 4194683 - RNA, 13 nt, Yersinia pestis KIM
caugggaaaucaa

SEQ ID NO: 4194684 - RNA, 22 nt, Yersinia pestis KIM
caugggcaagcucugggcugau

SEQ ID NO: 4194685 - RNA, 22 nt, Yersinia pestis KIM
caugggcuugcauaucagcaau

SEQ ID NO: 4194686 - RNA, 22 nt, Yersinia pestis KIM
caugggguuuauugguuauuuu

SEQ ID NO: 4194687 - RNA, 14 nt, Yersinia pestis KIM
caugguacaacugc

SEQ ID NO: 4194688 - RNA, 19 nt, Yersinia pestis KIM
caugguagccugcacggcu

SEQ ID NO: 4194689 - RNA, 19 nt, Yersinia pestis KIM
cauggugaugaucaugcuc

SEQ ID NO: 4194690 - RNA, 17 nt, Yersinia pestis KIM
caugguugcuagcccaa

SEQ ID NO: 4194691 - RNA, 13 nt, Yersinia pestis KIM
caugguuucgcag

SEQ ID NO: 4194692 - RNA, 17 nt, Yersinia pestis KIM
cauguaacacacagcag

SEQ ID NO: 4194693 - RNA, 22 nt, Yersinia pestis KIM
cauguaacacacagcagacagc

SEQ ID NO: 4194694 - RNA, 15 nt, Yersinia pestis KIM
cauguacuagaucac

SEQ ID NO: 4194695 - RNA, 19 nt, Yersinia pestis KIM
cauguaucccgcuugggua

SEQ ID NO: 4194696 - RNA, 23 nt, Yersinia pestis KIM
caugucagacagcacgggcuauc

SEQ ID NO: 4194697 - RNA, 15 nt, Yersinia pestis KIM
caugugcauugacua

SEQ ID NO: 4194698 - RNA, 19 nt, Yersinia pestis KIM
cauguggugacuacggcua

SEQ ID NO: 4194699 - RNA, 15 nt, Yersinia pestis KIM
caugugguuaccauc

SEQ ID NO: 4194700 - RNA, 14 nt, Yersinia pestis KIM
cauguguguucuug

SEQ ID NO: 4194701 - RNA, 19 nt, Yersinia pestis KIM
cauguucacaucggucaau

SEQ ID NO: 4194702 - RNA, 16 nt, Yersinia pestis KIM
cauguugaguuuacgc

SEQ ID NO: 4194703 - RNA, 12 nt, Yersinia pestis KIM
cauuaaaaacaa

SEQ ID NO: 4194704 - RNA, 14 nt, Yersinia pestis KIM
cauuaaaaauacaa

SEQ ID NO: 4194705 - RNA, 11 nt, Yersinia pestis KIM
cauuaaacaga

SEQ ID NO: 4194706 - RNA, 18 nt, Yersinia pestis KIM
cauuaaagguacguaauu

SEQ ID NO: 4194707 - RNA, 17 nt, Yersinia pestis KIM
cauuaaauccaauauuc

SEQ ID NO: 4194708 - RNA, 16 nt, Yersinia pestis KIM
cauuaacaauuacuuu

SEQ ID NO: 4194709 - RNA, 16 nt, Yersinia pestis KIM
cauuaacacauuaauu

SEQ ID NO: 4194710 - RNA, 16 nt, Yersinia pestis KIM
cauuaaccuaaaaacg

SEQ ID NO: 4194711 - RNA, 20 nt, Yersinia pestis KIM
cauuaacgacauuucguuua

SEQ ID NO: 4194712 - RNA, 22 nt, Yersinia pestis KIM
cauuaagauaauagcuaaacau

SEQ ID NO: 4194713 - RNA, 14 nt, Yersinia pestis KIM
cauuaaggagugcc

SEQ ID NO: 4194714 - RNA, 17 nt, Yersinia pestis KIM
cauuaauaccguuuucu

SEQ ID NO: 4194715 - RNA, 22 nt, Yersinia pestis KIM
cauuaauaccguuuucuuucaa

SEQ ID NO: 4194716 - RNA, 19 nt, Yersinia pestis KIM
cauuucaauucguucaaau

SEQ ID NO: 4194717 - RNA, 15 nt, Yersinia pestis KIM
cauuucacggugcuc

SEQ ID NO: 4194718 - RNA, 22 nt, Yersinia pestis KIM
cauuucaggacugucuucaacu

SEQ ID NO: 4194719 - RNA, 15 nt, Yersinia pestis KIM
cauuucccccaccug

SEQ ID NO: 4194720 - RNA, 17 nt, Yersinia pestis KIM
cauuucguuuaaagccu

SEQ ID NO: 4194721 - RNA, 22 nt, Yersinia pestis KIM
cauuucugccacaccgucaucu

SEQ ID NO: 4194722 - RNA, 23 nt, Yersinia pestis KIM
cauuucugguugugcuucagaca

SEQ ID NO: 4194723 - RNA, 21 nt, Yersinia pestis KIM
cauuucuugcucgaucagcgu

SEQ ID NO: 4194724 - RNA, 23 nt, Yersinia pestis KIM
cauuugaccuccguaggccaacc

SEQ ID NO: 4194725 - RNA, 15 nt, Yersinia pestis KIM
cauuugagcuguuau

SEQ ID NO: 4194726 - RNA, 15 nt, Yersinia pestis KIM
cauuugcaacuuccu

SEQ ID NO: 4194727 - RNA, 13 nt, Yersinia pestis KIM
cauuugcaucuau

SEQ ID NO: 4194728 - RNA, 18 nt, Yersinia pestis KIM
cauuugcaucuauggauu

SEQ ID NO: 4194729 - RNA, 19 nt, Yersinia pestis KIM
cauuugucguuauaaacca

SEQ ID NO: 4194730 - RNA, 15 nt, Yersinia pestis KIM
cauuuuaaaaaaauu

SEQ ID NO: 4194731 - RNA, 18 nt, Yersinia pestis KIM
cauuuuaaucucuccaug

SEQ ID NO: 4194732 - RNA, 23 nt, Yersinia pestis KIM
cauuuuaaucucuccaugauaua

SEQ ID NO: 4194733 - RNA, 19 nt, Yersinia pestis KIM
cauuuuacaggauuaaaua

SEQ ID NO: 4194734 - RNA, 15 nt, Yersinia pestis KIM
cauuuuacucccuga

SEQ ID NO: 4194735 - RNA, 17 nt, Yersinia pestis KIM
cauuuuacucccugacu

SEQ ID NO: 4194736 - RNA, 14 nt, Yersinia pestis KIM
cauuuuauccucuu

SEQ ID NO: 4194737 - RNA, 15 nt, Yersinia pestis KIM
cauuuuauccucuuc

SEQ ID NO: 4194738 - RNA, 16 nt, Yersinia pestis KIM
cauuuuauccucuucc

SEQ ID NO: 4194739 - RNA, 14 nt, Yersinia pestis KIM
cauuuucaauacca

SEQ ID NO: 4194740 - RNA, 21 nt, Yersinia pestis KIM
cauuuuccugcauauuauuuu

SEQ ID NO: 4194741 - RNA, 14 nt, Yersinia pestis KIM
cauuuucuaagcug

SEQ ID NO: 4194742 - RNA, 16 nt, Yersinia pestis KIM
cauuuucuaagcugcc

SEQ ID NO: 4194743 - RNA, 18 nt, Yersinia pestis KIM
cauuuucuaagcugccug

SEQ ID NO: 4194744 - RNA, 21 nt, Yersinia pestis KIM
cauuuucuggugagcaucaac

SEQ ID NO: 4194745 - RNA, 12 nt, Yersinia pestis KIM
cauuuugaccag

SEQ ID NO: 4194746 - RNA, 24 nt, Yersinia pestis KIM
cauuuugaccagcauacgugccaa

SEQ ID NO: 4194747 - RNA, 17 nt, Yersinia pestis KIM
cauuuuggccgcuuugg

SEQ ID NO: 4194748 - RNA, 21 nt, Yersinia pestis KIM
cauuuuguauuuuguuuuuuu

SEQ ID NO: 4194749 - RNA, 16 nt, Yersinia pestis KIM
cauuuuguuacccacu

SEQ ID NO: 4194750 - RNA, 19 nt, Yersinia pestis KIM
cauuuuuaaguggcaucag

SEQ ID NO: 4194751 - RNA, 15 nt, Yersinia pestis KIM
cauuuuuuauaaaca

SEQ ID NO: 4194752 - RNA, 19 nt, Yersinia pestis KIM
cauuuuuuaucuuguaaau

SEQ ID NO: 4194753 - RNA, 13 nt, Yersinia pestis KIM
cauuuuuugggau

SEQ ID NO: 4194754 - RNA, 12 nt, Yersinia pestis KIM
ccaaaaaucuug

SEQ ID NO: 4194755 - RNA, 15 nt, Yersinia pestis KIM
ccaaaacaucggcca

SEQ ID NO: 4194756 - RNA, 22 nt, Yersinia pestis KIM
ccaaaaccgugacuaaaacaag

SEQ ID NO: 4194757 - RNA, 16 nt, Yersinia pestis KIM
ccaaaacguugaggca

SEQ ID NO: 4194758 - RNA, 15 nt, Yersinia pestis KIM
ccaaaacucaugucc

SEQ ID NO: 4194759 - RNA, 18 nt, Yersinia pestis KIM
ccaaaacucccuguuacg

SEQ ID NO: 4194760 - RNA, 19 nt, Yersinia pestis KIM
ccaaaauaaauauccuccg

SEQ ID NO: 4194761 - RNA, 11 nt, Yersinia pestis KIM
ccaaaauaacc

SEQ ID NO: 4194762 - RNA, 24 nt, Yersinia pestis KIM
ccaaaauaauucgaguagauucau

SEQ ID NO: 4194763 - RNA, 16 nt, Yersinia pestis KIM
ccaaaauccaccagcg

SEQ ID NO: 4194764 - RNA, 17 nt, Yersinia pestis KIM
ccaaaauuuagaagccc

SEQ ID NO: 4194765 - RNA, 20 nt, Yersinia pestis KIM
ccaaacaaaugaacccuuuc

SEQ ID NO: 4194766 - RNA, 21 nt, Yersinia pestis KIM
ccaaacauacauccacccauc

SEQ ID NO: 4194767 - RNA, 18 nt, Yersinia pestis KIM
ccaaacauugucaccuga

SEQ ID NO: 4194768 - RNA, 22 nt, Yersinia pestis KIM
ccaaaccauugguuaaguuuca

SEQ ID NO: 4194769 - RNA, 14 nt, Yersinia pestis KIM
ccaaacgugcuacu

SEQ ID NO: 4194770 - RNA, 18 nt, Yersinia pestis KIM
ccaaacugcucauaaagc

SEQ ID NO: 4194771 - RNA, 16 nt, Yersinia pestis KIM
ccaaagauaauacaua

SEQ ID NO: 4194772 - RNA, 19 nt, Yersinia pestis KIM
ccaaagccgucaguuccug

SEQ ID NO: 4194773 - RNA, 13 nt, Yersinia pestis KIM
ccaaagcugcgcc

SEQ ID NO: 4194774 - RNA, 18 nt, Yersinia pestis KIM
ccaaaggggagccaaugu

SEQ ID NO: 4194775 - RNA, 18 nt, Yersinia pestis KIM
ccaaauaaauauccuccg

SEQ ID NO: 4194776 - RNA, 23 nt, Yersinia pestis KIM
ccaaauaaauauccuccggcaua

SEQ ID NO: 4194777 - RNA, 20 nt, Yersinia pestis KIM
ccaaauaaccucuaauaaac

SEQ ID NO: 4194778 - RNA, 22 nt, Yersinia pestis KIM
ccaaauacauauaaccaucaaa

SEQ ID NO: 4194779 - RNA, 23 nt, Yersinia pestis KIM
ccaaauagcaagccaaaacagcc

SEQ ID NO: 4194780 - RNA, 19 nt, Yersinia pestis KIM
ccaaauccgacugauagca

SEQ ID NO: 4194781 - RNA, 15 nt, Yersinia pestis KIM
ccaaaucuuccagcg

SEQ ID NO: 4194782 - RNA, 13 nt, Yersinia pestis KIM
ccaaaugagaugg

SEQ ID NO: 4194783 - RNA, 16 nt, Yersinia pestis KIM
ccaaaugagaugggcc

SEQ ID NO: 4194784 - RNA, 16 nt, Yersinia pestis KIM
ccaaaugccgaaggcu

SEQ ID NO: 4194785 - RNA, 18 nt, Yersinia pestis KIM
ccaaauggacgaacagcc

SEQ ID NO: 4194786 - RNA, 21 nt, Yersinia pestis KIM
ccaaauguuggauaacccccu

SEQ ID NO: 4194787 - RNA, 23 nt, Yersinia pestis KIM
ccaaauguuggauaacccccuga

SEQ ID NO: 4194788 - RNA, 20 nt, Yersinia pestis KIM
ccaacaacuggguggccagu

SEQ ID NO: 4194789 - RNA, 14 nt, Yersinia pestis KIM
ccaacaacuuaauu

SEQ ID NO: 4194790 - RNA, 13 nt, Yersinia pestis KIM
ccaacaauuugcg

SEQ ID NO: 4194791 - RNA, 16 nt, Yersinia pestis KIM
ccaacaauuugcgccc

SEQ ID NO: 4194792 - RNA, 18 nt, Yersinia pestis KIM
ccaacaauuugcgcccgc

SEQ ID NO: 4194793 - RNA, 13 nt, Yersinia pestis KIM
ccaacaccaccau

SEQ ID NO: 4194794 - RNA, 14 nt, Yersinia pestis KIM
ccaacaccaccauc

SEQ ID NO: 4194795 - RNA, 21 nt, Yersinia pestis KIM
ccaacacucaugacaaaaugc

SEQ ID NO: 4194796 - RNA, 16 nt, Yersinia pestis KIM
ccaacagacucacucu

SEQ ID NO: 4194797 - RNA, 20 nt, Yersinia pestis KIM
ccaacaggcggguucuucag

SEQ ID NO: 4194798 - RNA, 16 nt, Yersinia pestis KIM
ccaacaucuccgccaa

SEQ ID NO: 4194799 - RNA, 16 nt, Yersinia pestis KIM
ccaacaucuuccaaug

SEQ ID NO: 4194800 - RNA, 18 nt, Yersinia pestis KIM
ccaacaugagccacacau

SEQ ID NO: 4194801 - RNA, 14 nt, Yersinia pestis KIM
ccaaccaaccaugc

SEQ ID NO: 4194802 - RNA, 14 nt, Yersinia pestis KIM
ccaaccaggccgcc

SEQ ID NO: 4194803 - RNA, 21 nt, Yersinia pestis KIM
ccaaccaggccgccaucauca

SEQ ID NO: 4194804 - RNA, 12 nt, Yersinia pestis KIM
ccaaccaugcug

SEQ ID NO: 4194805 - RNA, 16 nt, Yersinia pestis KIM
ccaaccccaucagcau

SEQ ID NO: 4194806 - RNA, 20 nt, Yersinia pestis KIM
ccaacccccauuagcaguaa

SEQ ID NO: 4194807 - RNA, 14 nt, Yersinia pestis KIM
ccaacccuuuuuga

SEQ ID NO: 4194808 - RNA, 20 nt, Yersinia pestis KIM
ccaaccggauaaaacaauag

SEQ ID NO: 4194809 - RNA, 16 nt, Yersinia pestis KIM
ccaacgcccugcaucu

SEQ ID NO: 4194810 - RNA, 19 nt, Yersinia pestis KIM
ccaacgcccugcaucuuga

SEQ ID NO: 4194811 - RNA, 16 nt, Yersinia pestis KIM
ccaacgcggcccccgc

SEQ ID NO: 4194812 - RNA, 22 nt, Yersinia pestis KIM
ccaacgcggcccccgcaggggu

SEQ ID NO: 4194813 - RNA, 15 nt, Yersinia pestis KIM
ccaacggacacauaa

SEQ ID NO: 4194814 - RNA, 17 nt, Yersinia pestis KIM
ccaacggccccucaggc

SEQ ID NO: 4194815 - RNA, 22 nt, Yersinia pestis KIM
ccaacgucauuuccguuaaccc

SEQ ID NO: 4194816 - RNA, 22 nt, Yersinia pestis KIM
ccaacuaaacagggcagaaaau

SEQ ID NO: 4194817 - RNA, 21 nt, Yersinia pestis KIM
ccaacucgccugugaaucaag

SEQ ID NO: 4194818 - RNA, 15 nt, Yersinia pestis KIM
ccaacugaaacugga

SEQ ID NO: 4194819 - RNA, 15 nt, Yersinia pestis KIM
ccaacugacugaagu

SEQ ID NO: 4194820 - RNA, 14 nt, Yersinia pestis KIM
ccaacugaggcaga

SEQ ID NO: 4194821 - RNA, 17 nt, Yersinia pestis KIM
ccaacugaucucaucau

SEQ ID NO: 4194822 - RNA, 20 nt, Yersinia pestis KIM
ccaacugaucucaucauuga

SEQ ID NO: 4194823 - RNA, 19 nt, Yersinia pestis KIM
ccaacuuaccuugauccgc

SEQ ID NO: 4194824 - RNA, 21 nt, Yersinia pestis KIM
ccaacuuaccuugauccgcca

SEQ ID NO: 4194825 - RNA, 14 nt, Yersinia pestis KIM
ccaacuugccgcgg

SEQ ID NO: 4194826 - RNA, 14 nt, Yersinia pestis KIM
ccaacuugcuggca

SEQ ID NO: 4194827 - RNA, 19 nt, Yersinia pestis KIM
ccaacuugcuggcaggaaa

SEQ ID NO: 4194828 - RNA, 18 nt, Yersinia pestis KIM
ccaagaaaagcaccgcag

SEQ ID NO: 4194829 - RNA, 17 nt, Yersinia pestis KIM
ccaagaacccuuuaucu

SEQ ID NO: 4194830 - RNA, 16 nt, Yersinia pestis KIM
ccacuaaggucaucaa

SEQ ID NO: 4194831 - RNA, 17 nt, Yersinia pestis KIM
ccacuacacgcuuuacu

SEQ ID NO: 4194832 - RNA, 14 nt, Yersinia pestis KIM
ccacuagaaauacu

SEQ ID NO: 4194833 - RNA, 17 nt, Yersinia pestis KIM
ccacuagguccauaaug

SEQ ID NO: 4194834 - RNA, 16 nt, Yersinia pestis KIM
ccacuaguuaaaacca

SEQ ID NO: 4194835 - RNA, 18 nt, Yersinia pestis KIM
ccacucaccucagucauc

SEQ ID NO: 4194836 - RNA, 15 nt, Yersinia pestis KIM
ccacucaguguggaa

SEQ ID NO: 4194837 - RNA, 16 nt, Yersinia pestis KIM
ccacucgccccacaau

SEQ ID NO: 4194838 - RNA, 21 nt, Yersinia pestis KIM
ccacucggccagagcuugcug

SEQ ID NO: 4194839 - RNA, 23 nt, Yersinia pestis KIM
ccacucggguucuaaauccugca

SEQ ID NO: 4194840 - RNA, 16 nt, Yersinia pestis KIM
ccacucguucucaacc

SEQ ID NO: 4194841 - RNA, 14 nt, Yersinia pestis KIM
ccacucucccucag

SEQ ID NO: 4194842 - RNA, 20 nt, Yersinia pestis KIM
ccacugacaaaaacagcacu

SEQ ID NO: 4194843 - RNA, 14 nt, Yersinia pestis KIM
ccacugaccgggaa

SEQ ID NO: 4194844 - RNA, 23 nt, Yersinia pestis KIM
ccacugaccgggaacaacgaaac

SEQ ID NO: 4194845 - RNA, 21 nt, Yersinia pestis KIM
ccacugaccuauugauaaaac

SEQ ID NO: 4194846 - RNA, 23 nt, Yersinia pestis KIM
ccacugaccuauugauaaaaccg

SEQ ID NO: 4194847 - RNA, 17 nt, Yersinia pestis KIM
ccacugagcaaacagug

SEQ ID NO: 4194848 - RNA, 10 nt, Yersinia pestis KIM
ccacugaggg

SEQ ID NO: 4194849 - RNA, 14 nt, Yersinia pestis KIM
ccacugauacccag

SEQ ID NO: 4194850 - RNA, 21 nt, Yersinia pestis KIM
ccacugcuuuaggauuuauuu

SEQ ID NO: 4194851 - RNA, 19 nt, Yersinia pestis KIM
ccacuggccugagaaccca

SEQ ID NO: 4194852 - RNA, 14 nt, Yersinia pestis KIM
ccacuguuuuucca

SEQ ID NO: 4194853 - RNA, 21 nt, Yersinia pestis KIM
ccacuuaacacgaaccuucuc

SEQ ID NO: 4194854 - RNA, 12 nt, Yersinia pestis KIM
ccacuuauaucu

SEQ ID NO: 4194855 - RNA, 12 nt, Yersinia pestis KIM
ccacuucaucau

SEQ ID NO: 4194856 - RNA, 18 nt, Yersinia pestis KIM
ccacuucaucaucaacaa

SEQ ID NO: 4194857 - RNA, 10 nt, Yersinia pestis KIM
ccacuucuuc

SEQ ID NO: 4194858 - RNA, 18 nt, Yersinia pestis KIM
ccacuucuuucacuaaug

SEQ ID NO: 4194859 - RNA, 19 nt, Yersinia pestis KIM
ccacuugcuuggauuccgu

SEQ ID NO: 4194860 - RNA, 17 nt, Yersinia pestis KIM
ccacuuggcccacuguu

SEQ ID NO: 4194861 - RNA, 18 nt, Yersinia pestis KIM
ccacuuuauuuuuuucca

SEQ ID NO: 4194862 - RNA, 13 nt, Yersinia pestis KIM
ccacuuuccaggu

SEQ ID NO: 4194863 - RNA, 20 nt, Yersinia pestis KIM
ccacuuuuaccgcaaccacc

SEQ ID NO: 4194864 - RNA, 13 nt, Yersinia pestis KIM
ccagaacaccaac

SEQ ID NO: 4194865 - RNA, 16 nt, Yersinia pestis KIM
ccagaaccucaacauu

SEQ ID NO: 4194866 - RNA, 16 nt, Yersinia pestis KIM
ccagaagaacagcccu

SEQ ID NO: 4194867 - RNA, 17 nt, Yersinia pestis KIM
ccagaagcauauggaug

SEQ ID NO: 4194868 - RNA, 15 nt, Yersinia pestis KIM
ccagaauaauaagcc

SEQ ID NO: 4194869 - RNA, 19 nt, Yersinia pestis KIM
ccagaaucacugucaaaaa

SEQ ID NO: 4194870 - RNA, 14 nt, Yersinia pestis KIM
ccagacaaccaaua

SEQ ID NO: 4194871 - RNA, 16 nt, Yersinia pestis KIM
ccagacaaccaauaca

SEQ ID NO: 4194872 - RNA, 20 nt, Yersinia pestis KIM
ccagacaaccaauacacagc

SEQ ID NO: 4194873 - RNA, 18 nt, Yersinia pestis KIM
ccagacaccugauaggca

SEQ ID NO: 4194874 - RNA, 18 nt, Yersinia pestis KIM
ccagaccgcguaagccgu

SEQ ID NO: 4194875 - RNA, 21 nt, Yersinia pestis KIM
ccagacgauuauccgcaccau

SEQ ID NO: 4194876 - RNA, 14 nt, Yersinia pestis KIM
ccagacucaaaaua

SEQ ID NO: 4194877 - RNA, 23 nt, Yersinia pestis KIM
ccagacucugcuaccaggaagcg

SEQ ID NO: 4194878 - RNA, 20 nt, Yersinia pestis KIM
ccagacuguucacaagccaa

SEQ ID NO: 4194879 - RNA, 18 nt, Yersinia pestis KIM
ccagagcggagccucagu

SEQ ID NO: 4194880 - RNA, 15 nt, Yersinia pestis KIM
ccagaggauaaucac

SEQ ID NO: 4194881 - RNA, 16 nt, Yersinia pestis KIM
ccagagugacaacaaa

SEQ ID NO: 4194882 - RNA, 15 nt, Yersinia pestis KIM
ccagauaacaacaaa

SEQ ID NO: 4194883 - RNA, 21 nt, Yersinia pestis KIM
ccagauaaucgccaauaaccg

SEQ ID NO: 4194884 - RNA, 12 nt, Yersinia pestis KIM
ccagauagucau

SEQ ID NO: 4194885 - RNA, 18 nt, Yersinia pestis KIM
ccagauaugaucaaaaau

SEQ ID NO: 4194886 - RNA, 20 nt, Yersinia pestis KIM
ccagauggccagauucacca

SEQ ID NO: 4194887 - RNA, 15 nt, Yersinia pestis KIM
ccagauggucacccu

SEQ ID NO: 4194888 - RNA, 20 nt, Yersinia pestis KIM
ccagauucaccaguagccca

SEQ ID NO: 4194889 - RNA, 20 nt, Yersinia pestis KIM
ccagauugugcuccagcacu

SEQ ID NO: 4194890 - RNA, 12 nt, Yersinia pestis KIM
ccagcaaaucau

SEQ ID NO: 4194891 - RNA, 20 nt, Yersinia pestis KIM
ccagcaacgaauaaaaaagc

SEQ ID NO: 4194892 - RNA, 20 nt, Yersinia pestis KIM
ccagcaacguaacaugcagc

SEQ ID NO: 4194893 - RNA, 18 nt, Yersinia pestis KIM
ccagcaacucaagccacu

SEQ ID NO: 4194894 - RNA, 22 nt, Yersinia pestis KIM
ccagcaagagcagccaacacac

SEQ ID NO: 4194895 - RNA, 17 nt, Yersinia pestis KIM
ccagcacacagaugcug

SEQ ID NO: 4194896 - RNA, 22 nt, Yersinia pestis KIM
ccagcacguuuuaaugccaauu

SEQ ID NO: 4194897 - RNA, 9 nt, Yersinia pestis KIM
ccagcagca

SEQ ID NO: 4194898 - RNA, 21 nt, Yersinia pestis KIM
ccagcagcauaaccagugccg

SEQ ID NO: 4194899 - RNA, 13 nt, Yersinia pestis KIM
ccagcagugcugc

SEQ ID NO: 4194900 - RNA, 20 nt, Yersinia pestis KIM
ccagcagugcugcgcccagu

SEQ ID NO: 4194901 - RNA, 23 nt, Yersinia pestis KIM
ccagcaugugguuaccaucaacc

SEQ ID NO: 4194902 - RNA, 16 nt, Yersinia pestis KIM
ccagccaacuccuuga

SEQ ID NO: 4194903 - RNA, 12 nt, Yersinia pestis KIM
ccagccaacugg

SEQ ID NO: 4194904 - RNA, 15 nt, Yersinia pestis KIM
ccagccaacuggcgc

SEQ ID NO: 4194905 - RNA, 13 nt, Yersinia pestis KIM
ccagccaccgcac

SEQ ID NO: 4194906 - RNA, 20 nt, Yersinia pestis KIM
ccagccaugcgacaccaaga

SEQ ID NO: 4194907 - RNA, 16 nt, Yersinia pestis KIM
ccagccauucugaauc

SEQ ID NO: 4194908 - RNA, 14 nt, Yersinia pestis KIM
ccagcccaucacca

SEQ ID NO: 4194909 - RNA, 18 nt, Yersinia pestis KIM
ccagcccauccuguucaa

SEQ ID NO: 4194910 - RNA, 18 nt, Yersinia pestis KIM
ccagccccaaacacuuag

SEQ ID NO: 4194911 - RNA, 19 nt, Yersinia pestis KIM
ccagccccaaucaccggcu

SEQ ID NO: 4194912 - RNA, 17 nt, Yersinia pestis KIM
ccagccccaauccgccu

SEQ ID NO: 4194913 - RNA, 17 nt, Yersinia pestis KIM
ccagccccuaacagcag

SEQ ID NO: 4194914 - RNA, 20 nt, Yersinia pestis KIM
ccagccuguuaauaauucag

SEQ ID NO: 4194915 - RNA, 21 nt, Yersinia pestis KIM
ccagccuguuaauaauucagg

SEQ ID NO: 4194916 - RNA, 18 nt, Yersinia pestis KIM
ccagcgaagugccgccau

SEQ ID NO: 4194917 - RNA, 13 nt, Yersinia pestis KIM
ccagcgccccauc

SEQ ID NO: 4194918 - RNA, 21 nt, Yersinia pestis KIM
ccagcgccgauauacacccca

SEQ ID NO: 4194919 - RNA, 23 nt, Yersinia pestis KIM
ccagcggcaaauagagcaccaaa

SEQ ID NO: 4194920 - RNA, 15 nt, Yersinia pestis KIM
ccagcggcuuauucc

SEQ ID NO: 4194921 - RNA, 15 nt, Yersinia pestis KIM
ccagcgggcgcagcc

SEQ ID NO: 4194922 - RNA, 21 nt, Yersinia pestis KIM
ccagcgguaaauugcucacuc

SEQ ID NO: 4194923 - RNA, 19 nt, Yersinia pestis KIM
ccagcguaaacaguagcag

SEQ ID NO: 4194924 - RNA, 21 nt, Yersinia pestis KIM
ccagcguccugugcaaagugc

SEQ ID NO: 4194925 - RNA, 23 nt, Yersinia pestis KIM
ccagcguccugugcaaagugcug

SEQ ID NO: 4194926 - RNA, 20 nt, Yersinia pestis KIM
ccagcgucgccguaaauugc

SEQ ID NO: 4194927 - RNA, 18 nt, Yersinia pestis KIM
ccagcuauugcuuuuauu

SEQ ID NO: 4194928 - RNA, 13 nt, Yersinia pestis KIM
ccagcuccugcca

SEQ ID NO: 4194929 - RNA, 23 nt, Yersinia pestis KIM
ccagcuccugccacagacuuucu

SEQ ID NO: 4194930 - RNA, 13 nt, Yersinia pestis KIM
ccagcugcaauug

SEQ ID NO: 4194931 - RNA, 16 nt, Yersinia pestis KIM
ccagcuucuuuuaaag

SEQ ID NO: 4194932 - RNA, 19 nt, Yersinia pestis KIM
ccagcuuuagcauugcaga

SEQ ID NO: 4194933 - RNA, 19 nt, Yersinia pestis KIM
ccagcuuuuuacgcaacaa

SEQ ID NO: 4194934 - RNA, 15 nt, Yersinia pestis KIM
ccaggaagcggccag

SEQ ID NO: 4194935 - RNA, 18 nt, Yersinia pestis KIM
ccaggaauuaacaauucu

SEQ ID NO: 4194936 - RNA, 20 nt, Yersinia pestis KIM
ccaggacgacauccacauug

SEQ ID NO: 4194937 - RNA, 19 nt, Yersinia pestis KIM
ccaggcaacgacagcaaca

SEQ ID NO: 4194938 - RNA, 17 nt, Yersinia pestis KIM
ccaggcagcuaucacgu

SEQ ID NO: 4194939 - RNA, 16 nt, Yersinia pestis KIM
ccaggccacggccgcc

SEQ ID NO: 4194940 - RNA, 18 nt, Yersinia pestis KIM
ccaggccuagcccaguac

SEQ ID NO: 4194941 - RNA, 18 nt, Yersinia pestis KIM
ccaggcuggccacuucca

SEQ ID NO: 4194942 - RNA, 23 nt, Yersinia pestis KIM
ccaggcuuuuguuaauucaccua

SEQ ID NO: 4194943 - RNA, 21 nt, Yersinia pestis KIM
ccagggaaauuagcgccuccg

SEQ ID NO: 4194944 - RNA, 22 nt, Yersinia pestis KIM
ccaugucggcagguaaugcauu

SEQ ID NO: 4194945 - RNA, 13 nt, Yersinia pestis KIM
ccauguucuucaa

SEQ ID NO: 4194946 - RNA, 16 nt, Yersinia pestis KIM
ccauguugugugugaa

SEQ ID NO: 4194947 - RNA, 21 nt, Yersinia pestis KIM
ccauuaaaaggugcccgcuug

SEQ ID NO: 4194948 - RNA, 13 nt, Yersinia pestis KIM
ccauuaauaauau

SEQ ID NO: 4194949 - RNA, 14 nt, Yersinia pestis KIM
ccauuaauuggccg

SEQ ID NO: 4194950 - RNA, 13 nt, Yersinia pestis KIM
ccauuaccguaac

SEQ ID NO: 4194951 - RNA, 23 nt, Yersinia pestis KIM
ccauuacgcaacguaauaucugc

SEQ ID NO: 4194952 - RNA, 16 nt, Yersinia pestis KIM
ccauuaucguuagcau

SEQ ID NO: 4194953 - RNA, 19 nt, Yersinia pestis KIM
ccauuaucuuuaauuuucu

SEQ ID NO: 4194954 - RNA, 22 nt, Yersinia pestis KIM
ccauuauuggcuggcaaaguua

SEQ ID NO: 4194955 - RNA, 12 nt, Yersinia pestis KIM
ccauucagccac

SEQ ID NO: 4194956 - RNA, 17 nt, Yersinia pestis KIM
ccauuccguuauuaaac

SEQ ID NO: 4194957 - RNA, 22 nt, Yersinia pestis KIM
ccauucgcaggccagacccauu

SEQ ID NO: 4194958 - RNA, 15 nt, Yersinia pestis KIM
ccauucugaaucgcu

SEQ ID NO: 4194959 - RNA, 17 nt, Yersinia pestis KIM
ccauucugaaucgcugc

SEQ ID NO: 4194960 - RNA, 22 nt, Yersinia pestis KIM
ccauugauggccuugaaucaaa

SEQ ID NO: 4194961 - RNA, 19 nt, Yersinia pestis KIM
ccauugauuggcuccuaua

SEQ ID NO: 4194962 - RNA, 16 nt, Yersinia pestis KIM
ccauugcauauugcuc

SEQ ID NO: 4194963 - RNA, 22 nt, Yersinia pestis KIM
ccauugcucaaacucagcauca

SEQ ID NO: 4194964 - RNA, 16 nt, Yersinia pestis KIM
ccauuggcaaaggcca

SEQ ID NO: 4194965 - RNA, 17 nt, Yersinia pestis KIM
ccauugguaauaaugcc

SEQ ID NO: 4194966 - RNA, 21 nt, Yersinia pestis KIM
ccauugguuuuuagcuuaaca

SEQ ID NO: 4194967 - RNA, 17 nt, Yersinia pestis KIM
ccauuguauugcucagg

SEQ ID NO: 4194968 - RNA, 16 nt, Yersinia pestis KIM
ccauuguggcuaaacc

SEQ ID NO: 4194969 - RNA, 21 nt, Yersinia pestis KIM
ccauuuaucgccaagccagua

SEQ ID NO: 4194970 - RNA, 13 nt, Yersinia pestis KIM
ccauuuccuuaua

SEQ ID NO: 4194971 - RNA, 19 nt, Yersinia pestis KIM
ccauuucucugaugguauc

SEQ ID NO: 4194972 - RNA, 21 nt, Yersinia pestis KIM
ccauuucugguugugcuucag

SEQ ID NO: 4194973 - RNA, 14 nt, Yersinia pestis KIM
ccauuugcucuggc

SEQ ID NO: 4194974 - RNA, 23 nt, Yersinia pestis KIM
ccauuuggugauaagcugcguga

SEQ ID NO: 4194975 - RNA, 17 nt, Yersinia pestis KIM
ccauuuuaauauuaugg

SEQ ID NO: 4194976 - RNA, 12 nt, Yersinia pestis KIM
ccauuuuauccu

SEQ ID NO: 4194977 - RNA, 17 nt, Yersinia pestis KIM
ccauuuuauccucuucc

SEQ ID NO: 4194978 - RNA, 19 nt, Yersinia pestis KIM
ccauuuuauuuaacguguu

SEQ ID NO: 4194979 - RNA, 18 nt, Yersinia pestis KIM
ccauuuucaauaccauau

SEQ ID NO: 4194980 - RNA, 20 nt, Yersinia pestis KIM
ccauuuuuauaucagauuca

SEQ ID NO: 4194981 - RNA, 17 nt, Yersinia pestis KIM
ccauuuuuaugccauua

SEQ ID NO: 4194982 - RNA, 17 nt, Yersinia pestis KIM
ccauuuuuuauaaacac

SEQ ID NO: 4194983 - RNA, 21 nt, Yersinia pestis KIM
cccaaaauaauguuugcgaca

SEQ ID NO: 4194984 - RNA, 21 nt, Yersinia pestis KIM
cccaaagcgcagugcucauua

SEQ ID NO: 4194985 - RNA, 20 nt, Yersinia pestis KIM
cccaaaggggagccaaugua

SEQ ID NO: 4194986 - RNA, 17 nt, Yersinia pestis KIM
cccaaaugagcagcaau

SEQ ID NO: 4194987 - RNA, 21 nt, Yersinia pestis KIM
cccaacaacgcuccagguuca

SEQ ID NO: 4194988 - RNA, 20 nt, Yersinia pestis KIM
cccaaccgaccaaaggccaa

SEQ ID NO: 4194989 - RNA, 13 nt, Yersinia pestis KIM
cccaacugacuga

SEQ ID NO: 4194990 - RNA, 12 nt, Yersinia pestis KIM
cccaagcaggaa

SEQ ID NO: 4194991 - RNA, 14 nt, Yersinia pestis KIM
cccaagccauccuu

SEQ ID NO: 4194992 - RNA, 17 nt, Yersinia pestis KIM
cccaagggcuauugcug

SEQ ID NO: 4194993 - RNA, 22 nt, Yersinia pestis KIM
cccaaggguauaacucaucagu

SEQ ID NO: 4194994 - RNA, 23 nt, Yersinia pestis KIM
cccaaggguauaacucaucagua

SEQ ID NO: 4194995 - RNA, 13 nt, Yersinia pestis KIM
cccaaguaaaaaa

SEQ ID NO: 4194996 - RNA, 20 nt, Yersinia pestis KIM
cccaauaauaaaaaaaaaua

SEQ ID NO: 4194997 - RNA, 13 nt, Yersinia pestis KIM
cccaauauugauc

SEQ ID NO: 4194998 - RNA, 17 nt, Yersinia pestis KIM
cccaauggcaacaaaau

SEQ ID NO: 4194999 - RNA, 14 nt, Yersinia pestis KIM
cccaaugucaggaa

SEQ ID NO: 4195000 - RNA, 14 nt, Yersinia pestis KIM
cccacaucaggccg

SEQ ID NO: 4195001 - RNA, 17 nt, Yersinia pestis KIM
cccacauuaaaggccgc

SEQ ID NO: 4195002 - RNA, 15 nt, Yersinia pestis KIM
cccacauucaggccg

SEQ ID NO: 4195003 - RNA, 18 nt, Yersinia pestis KIM
cccacggcgacguucagc

SEQ ID NO: 4195004 - RNA, 15 nt, Yersinia pestis KIM
cccacuaauauuccu

SEQ ID NO: 4195005 - RNA, 16 nt, Yersinia pestis KIM
cccacugacacugaua

SEQ ID NO: 4195006 - RNA, 19 nt, Yersinia pestis KIM
cccacuggccccgaucauc

SEQ ID NO: 4195007 - RNA, 21 nt, Yersinia pestis KIM
cccacuuguaccugugccagu

SEQ ID NO: 4195008 - RNA, 20 nt, Yersinia pestis KIM
cccacuuuauuuuuuuccag

SEQ ID NO: 4195009 - RNA, 16 nt, Yersinia pestis KIM
cccagaaaggcaaaaa

SEQ ID NO: 4195010 - RNA, 22 nt, Yersinia pestis KIM
cccagaagaucgguucaucgga

SEQ ID NO: 4195011 - RNA, 20 nt, Yersinia pestis KIM
cccagauaguaguguuugau

SEQ ID NO: 4195012 - RNA, 17 nt, Yersinia pestis KIM
cccagcacaaugcauuc

SEQ ID NO: 4195013 - RNA, 20 nt, Yersinia pestis KIM
cccagcaggcugugaucugc

SEQ ID NO: 4195014 - RNA, 23 nt, Yersinia pestis KIM
cccagcaggcugugaucugccag

SEQ ID NO: 4195015 - RNA, 19 nt, Yersinia pestis KIM
cccagcagugcugcgccca

SEQ ID NO: 4195016 - RNA, 19 nt, Yersinia pestis KIM
cccagcauucagguguuca

SEQ ID NO: 4195017 - RNA, 21 nt, Yersinia pestis KIM
cccagccauuugaacaaaccc

SEQ ID NO: 4195018 - RNA, 21 nt, Yersinia pestis KIM
cccagccgggguaucauagaa

SEQ ID NO: 4195019 - RNA, 14 nt, Yersinia pestis KIM
cccaggcaaucucu

SEQ ID NO: 4195020 - RNA, 22 nt, Yersinia pestis KIM
cccaggcaaucucuccccaagc

SEQ ID NO: 4195021 - RNA, 13 nt, Yersinia pestis KIM
cccaggccuccgc

SEQ ID NO: 4195022 - RNA, 14 nt, Yersinia pestis KIM
cccaguaccgcugg

SEQ ID NO: 4195023 - RNA, 16 nt, Yersinia pestis KIM
cccaguaccgcuggug

SEQ ID NO: 4195024 - RNA, 15 nt, Yersinia pestis KIM
cccaguagcacaaug

SEQ ID NO: 4195025 - RNA, 19 nt, Yersinia pestis KIM
cccagucacuacagcauuu

SEQ ID NO: 4195026 - RNA, 20 nt, Yersinia pestis KIM
cccagucgucuucagcuucc

SEQ ID NO: 4195027 - RNA, 18 nt, Yersinia pestis KIM
cccagugcguacgccaac

SEQ ID NO: 4195028 - RNA, 14 nt, Yersinia pestis KIM
cccaguuacuaccu

SEQ ID NO: 4195029 - RNA, 16 nt, Yersinia pestis KIM
cccaguuacuaccuuu

SEQ ID NO: 4195030 - RNA, 20 nt, Yersinia pestis KIM
cccaguuacuaccuuuugca

SEQ ID NO: 4195031 - RNA, 21 nt, Yersinia pestis KIM
cccaguuuuuaauuuaaacuc

SEQ ID NO: 4195032 - RNA, 11 nt, Yersinia pestis KIM
cccauaacaau

SEQ ID NO: 4195033 - RNA, 16 nt, Yersinia pestis KIM
cccauaaccauugaaa

SEQ ID NO: 4195034 - RNA, 21 nt, Yersinia pestis KIM
cccauagaugggccaggcaau

SEQ ID NO: 4195035 - RNA, 20 nt, Yersinia pestis KIM
cccauauaaaaaacuaaugu

SEQ ID NO: 4195036 - RNA, 17 nt, Yersinia pestis KIM
cccaucaauuuccccaa

SEQ ID NO: 4195037 - RNA, 12 nt, Yersinia pestis KIM
cccaucaccauu

SEQ ID NO: 4195038 - RNA, 11 nt, Yersinia pestis KIM
cccaucagacg

SEQ ID NO: 4195039 - RNA, 15 nt, Yersinia pestis KIM
cccaucagcaucaau

SEQ ID NO: 4195040 - RNA, 14 nt, Yersinia pestis KIM
cccaucccuuugau

SEQ ID NO: 4195041 - RNA, 21 nt, Yersinia pestis KIM
cccaucgccaauacaaucguc

SEQ ID NO: 4195042 - RNA, 10 nt, Yersinia pestis KIM
cccaucuuuc

SEQ ID NO: 4195043 - RNA, 12 nt, Yersinia pestis KIM
cccaugcgagca

SEQ ID NO: 4195044 - RNA, 18 nt, Yersinia pestis KIM
cccaugcucccuccugcc

SEQ ID NO: 4195045 - RNA, 18 nt, Yersinia pestis KIM
cccauggcguaaccgccg

SEQ ID NO: 4195046 - RNA, 14 nt, Yersinia pestis KIM
cccauggggccacc

SEQ ID NO: 4195047 - RNA, 12 nt, Yersinia pestis KIM
cccauuauuaua

SEQ ID NO: 4195048 - RNA, 22 nt, Yersinia pestis KIM
cccauucaucaaacucugcauc

SEQ ID NO: 4195049 - RNA, 18 nt, Yersinia pestis KIM
cccauuccguuuaaacuc

SEQ ID NO: 4195050 - RNA, 14 nt, Yersinia pestis KIM
cccauugcaccaau

SEQ ID NO: 4195051 - RNA, 13 nt, Yersinia pestis KIM
cccauuuuauccu

SEQ ID NO: 4195052 - RNA, 22 nt, Yersinia pestis KIM
ccccaaccgaccacaaaaucau

SEQ ID NO: 4195053 - RNA, 15 nt, Yersinia pestis KIM
ccccaacucaucggc

SEQ ID NO: 4195054 - RNA, 18 nt, Yersinia pestis KIM
ccccaauaagggccaccc

SEQ ID NO: 4195055 - RNA, 22 nt, Yersinia pestis KIM
ccccaaugaguagcuguagcca

SEQ ID NO: 4195056 - RNA, 21 nt, Yersinia pestis KIM
ccccaauucacgcaaggccag

SEQ ID NO: 4195057 - RNA, 21 nt, Yersinia pestis KIM
ccccacaaccugcgccaccca

SEQ ID NO: 4195058 - RNA, 15 nt, Yersinia pestis KIM
ccccacaucaggccg

SEQ ID NO: 4195059 - RNA, 20 nt, Yersinia pestis KIM
cccugaguuaucuguuucaa

SEQ ID NO: 4195060 - RNA, 19 nt, Yersinia pestis KIM
cccugauagucaauaaauc

SEQ ID NO: 4195061 - RNA, 16 nt, Yersinia pestis KIM
cccugauccacuacuu

SEQ ID NO: 4195062 - RNA, 22 nt, Yersinia pestis KIM
cccugccagaaucagccccaag

SEQ ID NO: 4195063 - RNA, 16 nt, Yersinia pestis KIM
cccugcggccauccag

SEQ ID NO: 4195064 - RNA, 20 nt, Yersinia pestis KIM
cccugcggguagaaacguuc

SEQ ID NO: 4195065 - RNA, 21 nt, Yersinia pestis KIM
cccugcgguauccuuagccaa

SEQ ID NO: 4195066 - RNA, 20 nt, Yersinia pestis KIM
cccugcguuuguaggggagg

SEQ ID NO: 4195067 - RNA, 13 nt, Yersinia pestis KIM
cccugcucuucug

SEQ ID NO: 4195068 - RNA, 18 nt, Yersinia pestis KIM
cccugcugauaauuuauu

SEQ ID NO: 4195069 - RNA, 23 nt, Yersinia pestis KIM
cccugcuggccggcuacugguca

SEQ ID NO: 4195070 - RNA, 16 nt, Yersinia pestis KIM
cccugcuuguuacgua

SEQ ID NO: 4195071 - RNA, 16 nt, Yersinia pestis KIM
cccuggagcaagauuu

SEQ ID NO: 4195072 - RNA, 18 nt, Yersinia pestis KIM
cccuggcucaucaaagga

SEQ ID NO: 4195073 - RNA, 17 nt, Yersinia pestis KIM
cccuggcucuggccagc

SEQ ID NO: 4195074 - RNA, 11 nt, Yersinia pestis KIM
cccuguaaccg

SEQ ID NO: 4195075 - RNA, 12 nt, Yersinia pestis KIM
cccuguccagcc

SEQ ID NO: 4195076 - RNA, 20 nt, Yersinia pestis KIM
cccugucuccuaucugaggu

SEQ ID NO: 4195077 - RNA, 15 nt, Yersinia pestis KIM
cccuguugaucugag

SEQ ID NO: 4195078 - RNA, 17 nt, Yersinia pestis KIM
cccuguugaucugaguu

SEQ ID NO: 4195079 - RNA, 23 nt, Yersinia pestis KIM
cccuguugcccagcaaggcgggc

SEQ ID NO: 4195080 - RNA, 12 nt, Yersinia pestis KIM
cccuuacgauca

SEQ ID NO: 4195081 - RNA, 17 nt, Yersinia pestis KIM
cccuuacgaucacuuac

SEQ ID NO: 4195082 - RNA, 14 nt, Yersinia pestis KIM
cccuuaucuacugg

SEQ ID NO: 4195083 - RNA, 20 nt, Yersinia pestis KIM
cccuuaugaguacuauuuuu

SEQ ID NO: 4195084 - RNA, 20 nt, Yersinia pestis KIM
cccuucaaagccgcuuuaau

SEQ ID NO: 4195085 - RNA, 17 nt, Yersinia pestis KIM
cccuucaacucuacauu

SEQ ID NO: 4195086 - RNA, 14 nt, Yersinia pestis KIM
cccuucaagcaccc

SEQ ID NO: 4195087 - RNA, 22 nt, Yersinia pestis KIM
cccuucagaugaauccagccau

SEQ ID NO: 4195088 - RNA, 11 nt, Yersinia pestis KIM
cccuucaguca

SEQ ID NO: 4195089 - RNA, 13 nt, Yersinia pestis KIM
cccuucagucagu

SEQ ID NO: 4195090 - RNA, 17 nt, Yersinia pestis KIM
cccuucagucaguaggc

SEQ ID NO: 4195091 - RNA, 19 nt, Yersinia pestis KIM
cccuucgauauuacaguuu

SEQ ID NO: 4195092 - RNA, 20 nt, Yersinia pestis KIM
cccuucgcccuguaaagcca

SEQ ID NO: 4195093 - RNA, 16 nt, Yersinia pestis KIM
cccuugaccucauuau

SEQ ID NO: 4195094 - RNA, 14 nt, Yersinia pestis KIM
cccuugacugacca

SEQ ID NO: 4195095 - RNA, 17 nt, Yersinia pestis KIM
cccuugaguauccaaua

SEQ ID NO: 4195096 - RNA, 22 nt, Yersinia pestis KIM
cccuuuaaaucuagcccuucag

SEQ ID NO: 4195097 - RNA, 13 nt, Yersinia pestis KIM
cccuuuacuauca

SEQ ID NO: 4195098 - RNA, 14 nt, Yersinia pestis KIM
cccuuugacagcau

SEQ ID NO: 4195099 - RNA, 23 nt, Yersinia pestis KIM
cccuuuugauuuguuaaaacagu

SEQ ID NO: 4195100 - RNA, 19 nt, Yersinia pestis KIM
cccuuuuugguuuucuauu

SEQ ID NO: 4195101 - RNA, 16 nt, Yersinia pestis KIM
ccgaaauaaaaccauc

SEQ ID NO: 4195102 - RNA, 18 nt, Yersinia pestis KIM
ccgaaauggaaaggcggg

SEQ ID NO: 4195103 - RNA, 14 nt, Yersinia pestis KIM
ccgaaccaaggccc

SEQ ID NO: 4195104 - RNA, 11 nt, Yersinia pestis KIM
ccgaagcccca

SEQ ID NO: 4195105 - RNA, 19 nt, Yersinia pestis KIM
ccgaagcugauggcgauca

SEQ ID NO: 4195106 - RNA, 17 nt, Yersinia pestis KIM
ccgaauuaauaaaaccu

SEQ ID NO: 4195107 - RNA, 16 nt, Yersinia pestis KIM
ccgacaccaauaccga

SEQ ID NO: 4195108 - RNA, 13 nt, Yersinia pestis KIM
ccgacacccagcc

SEQ ID NO: 4195109 - RNA, 15 nt, Yersinia pestis KIM
ccgacacccagccag

SEQ ID NO: 4195110 - RNA, 16 nt, Yersinia pestis KIM
ccgacacccagccaga

SEQ ID NO: 4195111 - RNA, 14 nt, Yersinia pestis KIM
ccgaccaaaggcca

SEQ ID NO: 4195112 - RNA, 14 nt, Yersinia pestis KIM
ccgacccacgcccc

SEQ ID NO: 4195113 - RNA, 12 nt, Yersinia pestis KIM
ccgagaggcuga

SEQ ID NO: 4195114 - RNA, 14 nt, Yersinia pestis KIM
ccgagcaaucaaaa

SEQ ID NO: 4195115 - RNA, 16 nt, Yersinia pestis KIM
ccgagcaaucaaaagg

SEQ ID NO: 4195116 - RNA, 15 nt, Yersinia pestis KIM
ccgagccgcaccauc

SEQ ID NO: 4195117 - RNA, 16 nt, Yersinia pestis KIM
ccgagcgucaagccaa

SEQ ID NO: 4195118 - RNA, 19 nt, Yersinia pestis KIM
ccgaggaauaugcccuuuu

SEQ ID NO: 4195119 - RNA, 15 nt, Yersinia pestis KIM
ccgagggcgugcucu

SEQ ID NO: 4195120 - RNA, 17 nt, Yersinia pestis KIM
ccgagguauuguugcca

SEQ ID NO: 4195121 - RNA, 18 nt, Yersinia pestis KIM
ccgagguuaucagccucu

SEQ ID NO: 4195122 - RNA, 13 nt, Yersinia pestis KIM
ccgaguguaaaaa

SEQ ID NO: 4195123 - RNA, 19 nt, Yersinia pestis KIM
ccgauaaaaaccauuuuua

SEQ ID NO: 4195124 - RNA, 12 nt, Yersinia pestis KIM
ccgauaagcccu

SEQ ID NO: 4195125 - RNA, 14 nt, Yersinia pestis KIM
ccgauaaucaauuu

SEQ ID NO: 4195126 - RNA, 20 nt, Yersinia pestis KIM
ccgauaaucccugccagaau

SEQ ID NO: 4195127 - RNA, 18 nt, Yersinia pestis KIM
ccgauacaggcucugaaa

SEQ ID NO: 4195128 - RNA, 11 nt, Yersinia pestis KIM
ccgauauaaau

SEQ ID NO: 4195129 - RNA, 12 nt, Yersinia pestis KIM
ccgauaugcccu

SEQ ID NO: 4195130 - RNA, 20 nt, Yersinia pestis KIM
ccgauauugauagccacauc

SEQ ID NO: 4195131 - RNA, 14 nt, Yersinia pestis KIM
ccgaucaccaucau

SEQ ID NO: 4195132 - RNA, 20 nt, Yersinia pestis KIM
ccgaugacgcgaucuugaac

SEQ ID NO: 4195133 - RNA, 15 nt, Yersinia pestis KIM
ccgaugacuaaccaa

SEQ ID NO: 4195134 - RNA, 12 nt, Yersinia pestis KIM
ccgaugcaauaa

SEQ ID NO: 4195135 - RNA, 19 nt, Yersinia pestis KIM
ccgaugcaauaaaccauac

SEQ ID NO: 4195136 - RNA, 15 nt, Yersinia pestis KIM
ccgauuccaucagcg

SEQ ID NO: 4195137 - RNA, 15 nt, Yersinia pestis KIM
ccgauucgauggcau

SEQ ID NO: 4195138 - RNA, 16 nt, Yersinia pestis KIM
ccgauuuaaacccucu

SEQ ID NO: 4195139 - RNA, 11 nt, Yersinia pestis KIM
ccgcaaaacug

SEQ ID NO: 4195140 - RNA, 20 nt, Yersinia pestis KIM
ccgcaaccgggccggguuga

SEQ ID NO: 4195141 - RNA, 16 nt, Yersinia pestis KIM
ccgcaaccugacugcu

SEQ ID NO: 4195142 - RNA, 12 nt, Yersinia pestis KIM
ccgcaaggccau

SEQ ID NO: 4195143 - RNA, 23 nt, Yersinia pestis KIM
ccgcaaggcuucgacucugggcc

SEQ ID NO: 4195144 - RNA, 13 nt, Yersinia pestis KIM
ccgcaccaaacag

SEQ ID NO: 4195145 - RNA, 20 nt, Yersinia pestis KIM
ccgcaccacaaaggcaaaau

SEQ ID NO: 4195146 - RNA, 18 nt, Yersinia pestis KIM
ccgcagcaggcagagcaa

SEQ ID NO: 4195147 - RNA, 21 nt, Yersinia pestis KIM
ccgcagccuucagaugaauga

SEQ ID NO: 4195148 - RNA, 19 nt, Yersinia pestis KIM
ccgcagcggcuagcagcag

SEQ ID NO: 4195149 - RNA, 15 nt, Yersinia pestis KIM
ccgcagcucaccuag

SEQ ID NO: 4195150 - RNA, 13 nt, Yersinia pestis KIM
ccgcaggaagcaa

SEQ ID NO: 4195151 - RNA, 18 nt, Yersinia pestis KIM
ccgcagggguaucagugu

SEQ ID NO: 4195152 - RNA, 11 nt, Yersinia pestis KIM
ccgcaguccaa

SEQ ID NO: 4195153 - RNA, 23 nt, Yersinia pestis KIM
ccgcaguuugagaaacugaugcc

SEQ ID NO: 4195154 - RNA, 20 nt, Yersinia pestis KIM
ccgcauauucucgccccgug

SEQ ID NO: 4195155 - RNA, 18 nt, Yersinia pestis KIM
ccgcaucaccgcccauau

SEQ ID NO: 4195156 - RNA, 13 nt, Yersinia pestis KIM
ccgcauccggcgg

SEQ ID NO: 4195157 - RNA, 13 nt, Yersinia pestis KIM
ccgcauuccagcg

SEQ ID NO: 4195158 - RNA, 14 nt, Yersinia pestis KIM
ccgccacugauacc

SEQ ID NO: 4195159 - RNA, 19 nt, Yersinia pestis KIM
ccgccagcaauaagccacg

SEQ ID NO: 4195160 - RNA, 22 nt, Yersinia pestis KIM
ccgccagcaauaagccacgcug

SEQ ID NO: 4195161 - RNA, 11 nt, Yersinia pestis KIM
ccgccagcaga

SEQ ID NO: 4195162 - RNA, 15 nt, Yersinia pestis KIM
ccgccagcagaacca

SEQ ID NO: 4195163 - RNA, 19 nt, Yersinia pestis KIM
ccgccagguuuacuggcgg

SEQ ID NO: 4195164 - RNA, 21 nt, Yersinia pestis KIM
ccgccagguuuacuggcgggc

SEQ ID NO: 4195165 - RNA, 17 nt, Yersinia pestis KIM
ccgccaguaaaccuggc

SEQ ID NO: 4195166 - RNA, 14 nt, Yersinia pestis KIM
ccgccaguugcuca

SEQ ID NO: 4195167 - RNA, 14 nt, Yersinia pestis KIM
ccgccauccuucaa

SEQ ID NO: 4195168 - RNA, 17 nt, Yersinia pestis KIM
ccgccaugagaaccagu

SEQ ID NO: 4195169 - RNA, 22 nt, Yersinia pestis KIM
ccgccaugagaaccaguucugg

SEQ ID NO: 4195170 - RNA, 15 nt, Yersinia pestis KIM
ccgccauugccagaa

SEQ ID NO: 4195171 - RNA, 21 nt, Yersinia pestis KIM
ccgcccccaauaagggccacc

SEQ ID NO: 4195172 - RNA, 14 nt, Yersinia pestis KIM
ccgccccccauccc

SEQ ID NO: 4195173 - RNA, 14 nt, Yersinia pestis KIM
ccgcccucuugaac

SEQ ID NO: 4195174 - RNA, 13 nt, Yersinia pestis KIM
ccgccgccagccc

SEQ ID NO: 4195175 - RNA, 22 nt, Yersinia pestis KIM
ccguggcauaaucaacgcucaa

SEQ ID NO: 4195176 - RNA, 22 nt, Yersinia pestis KIM
ccguggcgcggaugcuuuauuc

SEQ ID NO: 4195177 - RNA, 16 nt, Yersinia pestis KIM
ccgugguuauuggccg

SEQ ID NO: 4195178 - RNA, 14 nt, Yersinia pestis KIM
ccguguucauggug

SEQ ID NO: 4195179 - RNA, 17 nt, Yersinia pestis KIM
ccguuaacccaaagcca

SEQ ID NO: 4195180 - RNA, 17 nt, Yersinia pestis KIM
ccguuaacccaaagccc

SEQ ID NO: 4195181 - RNA, 14 nt, Yersinia pestis KIM
ccguuacugcaucu

SEQ ID NO: 4195182 - RNA, 16 nt, Yersinia pestis KIM
ccguuagccaugcauu

SEQ ID NO: 4195183 - RNA, 21 nt, Yersinia pestis KIM
ccguuauagaucuccugcaac

SEQ ID NO: 4195184 - RNA, 14 nt, Yersinia pestis KIM
ccguucaauaauag

SEQ ID NO: 4195185 - RNA, 13 nt, Yersinia pestis KIM
ccguuccaaccgg

SEQ ID NO: 4195186 - RNA, 17 nt, Yersinia pestis KIM
ccguucccacuuccauc

SEQ ID NO: 4195187 - RNA, 17 nt, Yersinia pestis KIM
ccguucggucacacugg

SEQ ID NO: 4195188 - RNA, 18 nt, Yersinia pestis KIM
ccguugcauuuuucuguu

SEQ ID NO: 4195189 - RNA, 19 nt, Yersinia pestis KIM
ccguuggccggccaacauc

SEQ ID NO: 4195190 - RNA, 14 nt, Yersinia pestis KIM
ccguuugcagcuca

SEQ ID NO: 4195191 - RNA, 21 nt, Yersinia pestis KIM
ccguuuuaacgcugcccaaua

SEQ ID NO: 4195192 - RNA, 18 nt, Yersinia pestis KIM
ccguuuucuuucaacugc

SEQ ID NO: 4195193 - RNA, 22 nt, Yersinia pestis KIM
ccuaaacagcaacacaaaagcg

SEQ ID NO: 4195194 - RNA, 16 nt, Yersinia pestis KIM
ccuaaaccccacagcg

SEQ ID NO: 4195195 - RNA, 21 nt, Yersinia pestis KIM
ccuaaagauaauuaauucaau

SEQ ID NO: 4195196 - RNA, 15 nt, Yersinia pestis KIM
ccuaaauaauuccag

SEQ ID NO: 4195197 - RNA, 13 nt, Yersinia pestis KIM
ccuaaauccugca

SEQ ID NO: 4195198 - RNA, 18 nt, Yersinia pestis KIM
ccuaacaacugccgccau

SEQ ID NO: 4195199 - RNA, 20 nt, Yersinia pestis KIM
ccuaacacguuaaauuucuu

SEQ ID NO: 4195200 - RNA, 16 nt, Yersinia pestis KIM
ccuaaccaaacauugu

SEQ ID NO: 4195201 - RNA, 18 nt, Yersinia pestis KIM
ccuaacgccaaaauguag

SEQ ID NO: 4195202 - RNA, 20 nt, Yersinia pestis KIM
ccuaacgccaaaauguagua

SEQ ID NO: 4195203 - RNA, 23 nt, Yersinia pestis KIM
ccuaacgccguggugaaaaauga

SEQ ID NO: 4195204 - RNA, 20 nt, Yersinia pestis KIM
ccuaauaaccgacagugcau

SEQ ID NO: 4195205 - RNA, 17 nt, Yersinia pestis KIM
ccuaauacagcaccacc

SEQ ID NO: 4195206 - RNA, 22 nt, Yersinia pestis KIM
ccuaaucccuuguucaggcaga

SEQ ID NO: 4195207 - RNA, 18 nt, Yersinia pestis KIM
ccuaaugaacacuuaauu

SEQ ID NO: 4195208 - RNA, 16 nt, Yersinia pestis KIM
ccuaauguacuaccaa

SEQ ID NO: 4195209 - RNA, 15 nt, Yersinia pestis KIM
ccuacagaaaaauaa

SEQ ID NO: 4195210 - RNA, 23 nt, Yersinia pestis KIM
ccuacauaaaaauagcuucccug

SEQ ID NO: 4195211 - RNA, 19 nt, Yersinia pestis KIM
ccuacccuuugagaaagga

SEQ ID NO: 4195212 - RNA, 14 nt, Yersinia pestis KIM
ccuaccgcaccaau

SEQ ID NO: 4195213 - RNA, 17 nt, Yersinia pestis KIM
ccuacgccauuaaaagg

SEQ ID NO: 4195214 - RNA, 18 nt, Yersinia pestis KIM
ccuacgccuaaaaaugau

SEQ ID NO: 4195215 - RNA, 20 nt, Yersinia pestis KIM
ccuacggaggucaaaugagu

SEQ ID NO: 4195216 - RNA, 12 nt, Yersinia pestis KIM
ccuacuaccaaa

SEQ ID NO: 4195217 - RNA, 15 nt, Yersinia pestis KIM
ccuagccagccaccg

SEQ ID NO: 4195218 - RNA, 14 nt, Yersinia pestis KIM
ccuagcggauacca

SEQ ID NO: 4195219 - RNA, 22 nt, Yersinia pestis KIM
ccuaggcggugagggagucagg

SEQ ID NO: 4195220 - RNA, 19 nt, Yersinia pestis KIM
ccuaggcuaaugugaugaa

SEQ ID NO: 4195221 - RNA, 23 nt, Yersinia pestis KIM
ccuagucucacuaaaucaaaagg

SEQ ID NO: 4195222 - RNA, 21 nt, Yersinia pestis KIM
ccuauagcaauauaauaaucu

SEQ ID NO: 4195223 - RNA, 19 nt, Yersinia pestis KIM
ccuauagcucagaaaauaa

SEQ ID NO: 4195224 - RNA, 13 nt, Yersinia pestis KIM
ccuaucauggcug

SEQ ID NO: 4195225 - RNA, 14 nt, Yersinia pestis KIM
ccuauccucaccgu

SEQ ID NO: 4195226 - RNA, 15 nt, Yersinia pestis KIM
ccuauccucaccguu

SEQ ID NO: 4195227 - RNA, 14 nt, Yersinia pestis KIM
ccuauccugacacc

SEQ ID NO: 4195228 - RNA, 13 nt, Yersinia pestis KIM
ccuaucgccgccg

SEQ ID NO: 4195229 - RNA, 22 nt, Yersinia pestis KIM
ccuaucuauuuuuauuucuccu

SEQ ID NO: 4195230 - RNA, 14 nt, Yersinia pestis KIM
ccuaucugaaugcu

SEQ ID NO: 4195231 - RNA, 18 nt, Yersinia pestis KIM
ccuauggcgguuccaaag

SEQ ID NO: 4195232 - RNA, 20 nt, Yersinia pestis KIM
ccuauuaucccaguuuuuaa

SEQ ID NO: 4195233 - RNA, 19 nt, Yersinia pestis KIM
ccuauucagcagcauuucu

SEQ ID NO: 4195234 - RNA, 23 nt, Yersinia pestis KIM
ccuauuucagggcguauaaacag

SEQ ID NO: 4195235 - RNA, 23 nt, Yersinia pestis KIM
ccuauuuucgcccuuaucuacug

SEQ ID NO: 4195236 - RNA, 11 nt, Yersinia pestis KIM
ccuauuuuuac

SEQ ID NO: 4195237 - RNA, 23 nt, Yersinia pestis KIM
ccucaaaaggauggcccaagcca

SEQ ID NO: 4195238 - RNA, 21 nt, Yersinia pestis KIM
ccucaaaauucgugcucauca

SEQ ID NO: 4195239 - RNA, 22 nt, Yersinia pestis KIM
ccucaaaauucgugcucaucaa

SEQ ID NO: 4195240 - RNA, 21 nt, Yersinia pestis KIM
ccucaaaucgauacuuuuuau

SEQ ID NO: 4195241 - RNA, 14 nt, Yersinia pestis KIM
ccucaacaguacug

SEQ ID NO: 4195242 - RNA, 18 nt, Yersinia pestis KIM
ccucaacgcaccccacaa

SEQ ID NO: 4195243 - RNA, 23 nt, Yersinia pestis KIM
ccucaacgcgaauaucaggcacu

SEQ ID NO: 4195244 - RNA, 11 nt, Yersinia pestis KIM
ccucaagaccg

SEQ ID NO: 4195245 - RNA, 17 nt, Yersinia pestis KIM
ccucaaggaugaggcuc

SEQ ID NO: 4195246 - RNA, 12 nt, Yersinia pestis KIM
ccucaauugugc

SEQ ID NO: 4195247 - RNA, 16 nt, Yersinia pestis KIM
ccucaccagcaucuug

SEQ ID NO: 4195248 - RNA, 12 nt, Yersinia pestis KIM
ccucaccauuua

SEQ ID NO: 4195249 - RNA, 23 nt, Yersinia pestis KIM
ccucaccguucaagagugaguca

SEQ ID NO: 4195250 - RNA, 23 nt, Yersinia pestis KIM
ccucacgcagcguagguaacuaa

SEQ ID NO: 4195251 - RNA, 17 nt, Yersinia pestis KIM
ccucacguacugcaugu

SEQ ID NO: 4195252 - RNA, 14 nt, Yersinia pestis KIM
ccucacucagcgac

SEQ ID NO: 4195253 - RNA, 14 nt, Yersinia pestis KIM
ccucacugucuuug

SEQ ID NO: 4195254 - RNA, 15 nt, Yersinia pestis KIM
ccucagacuaaugac

SEQ ID NO: 4195255 - RNA, 19 nt, Yersinia pestis KIM
ccucagacugcugacaaac

SEQ ID NO: 4195256 - RNA, 16 nt, Yersinia pestis KIM
ccucagagacaucuuu

SEQ ID NO: 4195257 - RNA, 21 nt, Yersinia pestis KIM
ccucagagacaucuuuaccag

SEQ ID NO: 4195258 - RNA, 20 nt, Yersinia pestis KIM
ccucagccucauucaugagg

SEQ ID NO: 4195259 - RNA, 22 nt, Yersinia pestis KIM
ccucagccuuuuuugcuuaaaa

SEQ ID NO: 4195260 - RNA, 15 nt, Yersinia pestis KIM
ccucaggcccgcuau

SEQ ID NO: 4195261 - RNA, 21 nt, Yersinia pestis KIM
ccucaggcccgcuaucacuag

SEQ ID NO: 4195262 - RNA, 18 nt, Yersinia pestis KIM
ccucagggcgucucuacg

SEQ ID NO: 4195263 - RNA, 22 nt, Yersinia pestis KIM
ccucaggugcauccacauauau

SEQ ID NO: 4195264 - RNA, 16 nt, Yersinia pestis KIM
ccucauccguaaaaaa

SEQ ID NO: 4195265 - RNA, 10 nt, Yersinia pestis KIM
ccucaugaau

SEQ ID NO: 4195266 - RNA, 21 nt, Yersinia pestis KIM
ccucaugaaugaggcugaggu

SEQ ID NO: 4195267 - RNA, 17 nt, Yersinia pestis KIM
ccucauuauuaaacuga

SEQ ID NO: 4195268 - RNA, 18 nt, Yersinia pestis KIM
ccucauucaugaggcuuc

SEQ ID NO: 4195269 - RNA, 16 nt, Yersinia pestis KIM
ccuccauucugcagau

SEQ ID NO: 4195270 - RNA, 19 nt, Yersinia pestis KIM
ccuccgauucauaguccaa

SEQ ID NO: 4195271 - RNA, 20 nt, Yersinia pestis KIM
ccuccggaaucagcguuuua

SEQ ID NO: 4195272 - RNA, 16 nt, Yersinia pestis KIM
ccuccggcgcccuucc

SEQ ID NO: 4195273 - RNA, 14 nt, Yersinia pestis KIM
ccuccguaggccaa

SEQ ID NO: 4195274 - RNA, 18 nt, Yersinia pestis KIM
ccuccugacgaugauaaa

SEQ ID NO: 4195275 - RNA, 18 nt, Yersinia pestis KIM
ccuccugcggcggagcaa

SEQ ID NO: 4195276 - RNA, 18 nt, Yersinia pestis KIM
ccuccuugagauccucca

SEQ ID NO: 4195277 - RNA, 18 nt, Yersinia pestis KIM
ccuccuuggggccucacu

SEQ ID NO: 4195278 - RNA, 20 nt, Yersinia pestis KIM
ccuccuuggggccucacucu

SEQ ID NO: 4195279 - RNA, 20 nt, Yersinia pestis KIM
ccucgaaaucauccgcggca

SEQ ID NO: 4195280 - RNA, 20 nt, Yersinia pestis KIM
ccucgacaccaaaacucccu

SEQ ID NO: 4195281 - RNA, 21 nt, Yersinia pestis KIM
ccucgcgccacucuagcugug

SEQ ID NO: 4195282 - RNA, 20 nt, Yersinia pestis KIM
ccucggucacugccugcaca

SEQ ID NO: 4195283 - RNA, 19 nt, Yersinia pestis KIM
ccucggucggcaagaccuu

SEQ ID NO: 4195284 - RNA, 18 nt, Yersinia pestis KIM
ccucggugauaaguuuua

SEQ ID NO: 4195285 - RNA, 22 nt, Yersinia pestis KIM
ccucggugucaguacgcuggcc

SEQ ID NO: 4195286 - RNA, 18 nt, Yersinia pestis KIM
ccucguuuaacucaaaua

SEQ ID NO: 4195287 - RNA, 16 nt, Yersinia pestis KIM
ccucuaacacucuuuc

SEQ ID NO: 4195288 - RNA, 13 nt, Yersinia pestis KIM
ccucuauuaucuu

SEQ ID NO: 4195289 - RNA, 15 nt, Yersinia pestis KIM
ccuguuucgauccag

SEQ ID NO: 4195290 - RNA, 14 nt, Yersinia pestis KIM
ccuguuuggccccc

SEQ ID NO: 4195291 - RNA, 21 nt, Yersinia pestis KIM
ccuuaaccaacaugagccaca

SEQ ID NO: 4195292 - RNA, 19 nt, Yersinia pestis KIM
ccuuaauguuuuacgauca

SEQ ID NO: 4195293 - RNA, 21 nt, Yersinia pestis KIM
ccuuaauuaacucuucuguug

SEQ ID NO: 4195294 - RNA, 14 nt, Yersinia pestis KIM
ccuuacuaucuuua

SEQ ID NO: 4195295 - RNA, 16 nt, Yersinia pestis KIM
ccuuacuaucuuuauu

SEQ ID NO: 4195296 - RNA, 20 nt, Yersinia pestis KIM
ccuuacuaucuuuauugcuc

SEQ ID NO: 4195297 - RNA, 14 nt, Yersinia pestis KIM
ccuuacuauuuuuc

SEQ ID NO: 4195298 - RNA, 17 nt, Yersinia pestis KIM
ccuuacuuuuuugccug

SEQ ID NO: 4195299 - RNA, 22 nt, Yersinia pestis KIM
ccuuagcacguuuuucagcuuc

SEQ ID NO: 4195300 - RNA, 21 nt, Yersinia pestis KIM
ccuuagcgccaucgcuaauca

SEQ ID NO: 4195301 - RNA, 21 nt, Yersinia pestis KIM
ccuuauaaauccgcuaguuaa

SEQ ID NO: 4195302 - RNA, 23 nt, Yersinia pestis KIM
ccuuauccaauagaaaagcgccu

SEQ ID NO: 4195303 - RNA, 14 nt, Yersinia pestis KIM
ccuuauucuuauuu

SEQ ID NO: 4195304 - RNA, 16 nt, Yersinia pestis KIM
ccuucaaagccgcuuu

SEQ ID NO: 4195305 - RNA, 18 nt, Yersinia pestis KIM
ccuucaacuguggauuau

SEQ ID NO: 4195306 - RNA, 13 nt, Yersinia pestis KIM
ccuucaaucagca

SEQ ID NO: 4195307 - RNA, 13 nt, Yersinia pestis KIM
ccuucaccaauac

SEQ ID NO: 4195308 - RNA, 14 nt, Yersinia pestis KIM
ccuucaccaauaca

SEQ ID NO: 4195309 - RNA, 11 nt, Yersinia pestis KIM
ccuucacccag

SEQ ID NO: 4195310 - RNA, 20 nt, Yersinia pestis KIM
ccuucacgcaucacaucuug

SEQ ID NO: 4195311 - RNA, 20 nt, Yersinia pestis KIM
ccuucagacugcugacaaac

SEQ ID NO: 4195312 - RNA, 16 nt, Yersinia pestis KIM
ccuucagccaccagau

SEQ ID NO: 4195313 - RNA, 16 nt, Yersinia pestis KIM
ccuucagcgauacaac

SEQ ID NO: 4195314 - RNA, 17 nt, Yersinia pestis KIM
ccuucaggaauaaacag

SEQ ID NO: 4195315 - RNA, 19 nt, Yersinia pestis KIM
ccuucaggccuuuacuguu

SEQ ID NO: 4195316 - RNA, 20 nt, Yersinia pestis KIM
ccuucaggccuuuacuguua

SEQ ID NO: 4195317 - RNA, 21 nt, Yersinia pestis KIM
ccuucaguuuauuuaagcuga

SEQ ID NO: 4195318 - RNA, 18 nt, Yersinia pestis KIM
ccuucaucgacaauggcu

SEQ ID NO: 4195319 - RNA, 18 nt, Yersinia pestis KIM
ccuucauuugacuuuguc

SEQ ID NO: 4195320 - RNA, 20 nt, Yersinia pestis KIM
ccuucccccaaguaaaaaaa

SEQ ID NO: 4195321 - RNA, 20 nt, Yersinia pestis KIM
ccuucccuacagaaaaauaa

SEQ ID NO: 4195322 - RNA, 19 nt, Yersinia pestis KIM
ccuucccuauucaaaauag

SEQ ID NO: 4195323 - RNA, 11 nt, Yersinia pestis KIM
ccuucccuggg

SEQ ID NO: 4195324 - RNA, 14 nt, Yersinia pestis KIM
ccuucgcccuguaa

SEQ ID NO: 4195325 - RNA, 17 nt, Yersinia pestis KIM
ccuucggacgcuccuca

SEQ ID NO: 4195326 - RNA, 20 nt, Yersinia pestis KIM
ccuucuccgcgcaaccuggc

SEQ ID NO: 4195327 - RNA, 19 nt, Yersinia pestis KIM
ccuucucuuuaucaauuua

SEQ ID NO: 4195328 - RNA, 20 nt, Yersinia pestis KIM
ccuucuggcaaaccggacau

SEQ ID NO: 4195329 - RNA, 15 nt, Yersinia pestis KIM
ccuucuggugguguc

SEQ ID NO: 4195330 - RNA, 11 nt, Yersinia pestis KIM
ccuucuucacc

SEQ ID NO: 4195331 - RNA, 15 nt, Yersinia pestis KIM
ccuucuuccauugau

SEQ ID NO: 4195332 - RNA, 18 nt, Yersinia pestis KIM
ccuucuuucaaagugaca

SEQ ID NO: 4195333 - RNA, 15 nt, Yersinia pestis KIM
ccuugaacugagcca

SEQ ID NO: 4195334 - RNA, 23 nt, Yersinia pestis KIM
ccuugacgccgaugaauauaaac

SEQ ID NO: 4195335 - RNA, 17 nt, Yersinia pestis KIM
ccuugagggucgcccgg

SEQ ID NO: 4195336 - RNA, 20 nt, Yersinia pestis KIM
ccuugagguuauugacaaag

SEQ ID NO: 4195337 - RNA, 14 nt, Yersinia pestis KIM
ccuugaguauccaa

SEQ ID NO: 4195338 - RNA, 20 nt, Yersinia pestis KIM
ccuugauggaaauacgcuua

SEQ ID NO: 4195339 - RNA, 14 nt, Yersinia pestis KIM
ccuugccagugcaa

SEQ ID NO: 4195340 - RNA, 22 nt, Yersinia pestis KIM
ccuuggcauugucugcuggccu

SEQ ID NO: 4195341 - RNA, 20 nt, Yersinia pestis KIM
ccuuggcugccagugccgcc

SEQ ID NO: 4195342 - RNA, 15 nt, Yersinia pestis KIM
ccuuggggccucacu

SEQ ID NO: 4195343 - RNA, 23 nt, Yersinia pestis KIM
ccuuguaagaccaauugguaaga

SEQ ID NO: 4195344 - RNA, 20 nt, Yersinia pestis KIM
ccuugugucaccaugauuuc

SEQ ID NO: 4195345 - RNA, 19 nt, Yersinia pestis KIM
ccuuguucaggcagauaaa

SEQ ID NO: 4195346 - RNA, 11 nt, Yersinia pestis KIM
ccuuguuucug

SEQ ID NO: 4195347 - RNA, 12 nt, Yersinia pestis KIM
ccuuuaaaacug

SEQ ID NO: 4195348 - RNA, 14 nt, Yersinia pestis KIM
ccuuuaaaacuggu

SEQ ID NO: 4195349 - RNA, 20 nt, Yersinia pestis KIM
ccuuuaaaacuggucagccc

SEQ ID NO: 4195350 - RNA, 20 nt, Yersinia pestis KIM
ccuuuaaacgcacaucaauc

SEQ ID NO: 4195351 - RNA, 14 nt, Yersinia pestis KIM
ccuuuaccaugcuc

SEQ ID NO: 4195352 - RNA, 17 nt, Yersinia pestis KIM
ccuuuaccuacaaccug

SEQ ID NO: 4195353 - RNA, 16 nt, Yersinia pestis KIM
ccuuuacuaucacuau

SEQ ID NO: 4195354 - RNA, 20 nt, Yersinia pestis KIM
ccuuuacuaucacuauccuu

SEQ ID NO: 4195355 - RNA, 17 nt, Yersinia pestis KIM
ccuuuagcgcugcaucu

SEQ ID NO: 4195356 - RNA, 16 nt, Yersinia pestis KIM
ccuuuaggaaagccca

SEQ ID NO: 4195357 - RNA, 21 nt, Yersinia pestis KIM
ccuuuaucgcggacaccaacu

SEQ ID NO: 4195358 - RNA, 17 nt, Yersinia pestis KIM
ccuuuauguaguucagu

SEQ ID NO: 4195359 - RNA, 16 nt, Yersinia pestis KIM
ccuuuauucauucaga

SEQ ID NO: 4195360 - RNA, 12 nt, Yersinia pestis KIM
ccuuucaaaauu

SEQ ID NO: 4195361 - RNA, 22 nt, Yersinia pestis KIM
ccuuucaacaaauucaccagca

SEQ ID NO: 4195362 - RNA, 15 nt, Yersinia pestis KIM
ccuuucuaauuauua

SEQ ID NO: 4195363 - RNA, 17 nt, Yersinia pestis KIM
ccuuucucggugugcuc

SEQ ID NO: 4195364 - RNA, 23 nt, Yersinia pestis KIM
ccuuucuggugguaccugcauca

SEQ ID NO: 4195365 - RNA, 13 nt, Yersinia pestis KIM
ccuuugacagcau

SEQ ID NO: 4195366 - RNA, 19 nt, Yersinia pestis KIM
ccuuugacagcaucugcaa

SEQ ID NO: 4195367 - RNA, 16 nt, Yersinia pestis KIM
ccuuugcuuucaggau

SEQ ID NO: 4195368 - RNA, 18 nt, Yersinia pestis KIM
ccuuugcuuuucugccua

SEQ ID NO: 4195369 - RNA, 22 nt, Yersinia pestis KIM
ccuuuuagccuucguuugucaa

SEQ ID NO: 4195370 - RNA, 19 nt, Yersinia pestis KIM
ccuuuuccgucagcccaac

SEQ ID NO: 4195371 - RNA, 15 nt, Yersinia pestis KIM
ccuuuugaauucacc

SEQ ID NO: 4195372 - RNA, 20 nt, Yersinia pestis KIM
ccuuuuugguuuucuauuuc

SEQ ID NO: 4195373 - RNA, 23 nt, Yersinia pestis KIM
ccuuuuuugaacgauauuuuuau

SEQ ID NO: 4195374 - RNA, 18 nt, Yersinia pestis KIM
cgaaaaaacagcgaucua

SEQ ID NO: 4195375 - RNA, 22 nt, Yersinia pestis KIM
cgaaaaauuucacuggcaccgc

SEQ ID NO: 4195376 - RNA, 18 nt, Yersinia pestis KIM
cgaaaaccuaauacuuuc

SEQ ID NO: 4195377 - RNA, 12 nt, Yersinia pestis KIM
cgaaaagcagca

SEQ ID NO: 4195378 - RNA, 22 nt, Yersinia pestis KIM
cgaaacaccacgcccaauucca

SEQ ID NO: 4195379 - RNA, 11 nt, Yersinia pestis KIM
cgaaacucuuc

SEQ ID NO: 4195380 - RNA, 14 nt, Yersinia pestis KIM
cgaaagaaauaaaa

SEQ ID NO: 4195381 - RNA, 22 nt, Yersinia pestis KIM
cgaaagauaauuuagcaaagcg

SEQ ID NO: 4195382 - RNA, 15 nt, Yersinia pestis KIM
cgaaagauagcaaaa

SEQ ID NO: 4195383 - RNA, 18 nt, Yersinia pestis KIM
cgaaagauagcaaaagaa

SEQ ID NO: 4195384 - RNA, 15 nt, Yersinia pestis KIM
cgaaaggcuggagca

SEQ ID NO: 4195385 - RNA, 23 nt, Yersinia pestis KIM
cgaaaguuaaacaauguuaaacu

SEQ ID NO: 4195386 - RNA, 15 nt, Yersinia pestis KIM
cgaaauaaaaccauc

SEQ ID NO: 4195387 - RNA, 23 nt, Yersinia pestis KIM
cgaaauaaauauccuccggcaua

SEQ ID NO: 4195388 - RNA, 14 nt, Yersinia pestis KIM
cgaaauagcgccug

SEQ ID NO: 4195389 - RNA, 21 nt, Yersinia pestis KIM
cgaaauauucgucucaucaau

SEQ ID NO: 4195390 - RNA, 16 nt, Yersinia pestis KIM
cgaaaucacccggcca

SEQ ID NO: 4195391 - RNA, 17 nt, Yersinia pestis KIM
cgaaaucacccggccau

SEQ ID NO: 4195392 - RNA, 14 nt, Yersinia pestis KIM
cgaaaugaucuuca

SEQ ID NO: 4195393 - RNA, 15 nt, Yersinia pestis KIM
cgaaauuaaggaaaa

SEQ ID NO: 4195394 - RNA, 18 nt, Yersinia pestis KIM
cgaaauuuaagaaaucua

SEQ ID NO: 4195395 - RNA, 16 nt, Yersinia pestis KIM
cgaacaaaaugccgua

SEQ ID NO: 4195396 - RNA, 13 nt, Yersinia pestis KIM
cgaacagccccgc

SEQ ID NO: 4195397 - RNA, 21 nt, Yersinia pestis KIM
cgaacagugccaacagcgaga

SEQ ID NO: 4195398 - RNA, 14 nt, Yersinia pestis KIM
cgaacaugccgaca

SEQ ID NO: 4195399 - RNA, 14 nt, Yersinia pestis KIM
cgaaccaaggcccu

SEQ ID NO: 4195400 - RNA, 14 nt, Yersinia pestis KIM
cgaacccuucagca

SEQ ID NO: 4195401 - RNA, 10 nt, Yersinia pestis KIM
cgaacgcccg

SEQ ID NO: 4195402 - RNA, 23 nt, Yersinia pestis KIM
cgaacggauagcgcuucagugau

SEQ ID NO: 4195403 - RNA, 21 nt, Yersinia pestis KIM
cgaacguaaaaaguagauccc

SEQ ID NO: 4195404 - RNA, 13 nt, Yersinia pestis KIM
cgauaacauuuuu

SEQ ID NO: 4195405 - RNA, 15 nt, Yersinia pestis KIM
cgauaacauuuuuuc

SEQ ID NO: 4195406 - RNA, 14 nt, Yersinia pestis KIM
cgauaaccaaauca

SEQ ID NO: 4195407 - RNA, 16 nt, Yersinia pestis KIM
cgauaaccaaaucacc

SEQ ID NO: 4195408 - RNA, 16 nt, Yersinia pestis KIM
cgauaacccacguuca

SEQ ID NO: 4195409 - RNA, 15 nt, Yersinia pestis KIM
cgauaacgccccggc

SEQ ID NO: 4195410 - RNA, 21 nt, Yersinia pestis KIM
cgauaagaaugaauauuuuca

SEQ ID NO: 4195411 - RNA, 23 nt, Yersinia pestis KIM
cgauaaucccugccagaaucagc

SEQ ID NO: 4195412 - RNA, 22 nt, Yersinia pestis KIM
cgauaauggaugaauauccacc

SEQ ID NO: 4195413 - RNA, 21 nt, Yersinia pestis KIM
cgauacaccauuuccaggcua

SEQ ID NO: 4195414 - RNA, 14 nt, Yersinia pestis KIM
cgauacaguggcua

SEQ ID NO: 4195415 - RNA, 18 nt, Yersinia pestis KIM
cgauacccauuuuaaucu

SEQ ID NO: 4195416 - RNA, 16 nt, Yersinia pestis KIM
cgauacgacuucuuau

SEQ ID NO: 4195417 - RNA, 18 nt, Yersinia pestis KIM
cgauacguugcaggucaa

SEQ ID NO: 4195418 - RNA, 18 nt, Yersinia pestis KIM
cgauacucgauaccagcg

SEQ ID NO: 4195419 - RNA, 21 nt, Yersinia pestis KIM
cgauagaaacaucagauagau

SEQ ID NO: 4195420 - RNA, 15 nt, Yersinia pestis KIM
cgauagagauagcca

SEQ ID NO: 4195421 - RNA, 22 nt, Yersinia pestis KIM
cgauaguaauuuuuagccgcaa

SEQ ID NO: 4195422 - RNA, 22 nt, Yersinia pestis KIM
cgauagugcuuccaacucaccu

SEQ ID NO: 4195423 - RNA, 14 nt, Yersinia pestis KIM
cgauauacaucacg

SEQ ID NO: 4195424 - RNA, 23 nt, Yersinia pestis KIM
cgauauauuucaacccgaucacc

SEQ ID NO: 4195425 - RNA, 22 nt, Yersinia pestis KIM
cgauaucugcguuuucugcaua

SEQ ID NO: 4195426 - RNA, 16 nt, Yersinia pestis KIM
cgauaugaucagauuu

SEQ ID NO: 4195427 - RNA, 11 nt, Yersinia pestis KIM
cgauauugaua

SEQ ID NO: 4195428 - RNA, 19 nt, Yersinia pestis KIM
cgaucaaaaacguccaggc

SEQ ID NO: 4195429 - RNA, 22 nt, Yersinia pestis KIM
cgaucaacaggccaccuaacac

SEQ ID NO: 4195430 - RNA, 12 nt, Yersinia pestis KIM
cgaucaacagug

SEQ ID NO: 4195431 - RNA, 18 nt, Yersinia pestis KIM
cgaucacuuucccgcguc

SEQ ID NO: 4195432 - RNA, 17 nt, Yersinia pestis KIM
cgaucagaacuaacacu

SEQ ID NO: 4195433 - RNA, 16 nt, Yersinia pestis KIM
cgaucagcaauaugcu

SEQ ID NO: 4195434 - RNA, 18 nt, Yersinia pestis KIM
cgaucagcguauaaaacu

SEQ ID NO: 4195435 - RNA, 16 nt, Yersinia pestis KIM
cgaucauaaaucacaa

SEQ ID NO: 4195436 - RNA, 16 nt, Yersinia pestis KIM
cgaucaucaucgguac

SEQ ID NO: 4195437 - RNA, 12 nt, Yersinia pestis KIM
cgaucauuuucu

SEQ ID NO: 4195438 - RNA, 21 nt, Yersinia pestis KIM
cgauccgggaaaaaauacgcu

SEQ ID NO: 4195439 - RNA, 23 nt, Yersinia pestis KIM
cgaucuauucucuguaauggcgc

SEQ ID NO: 4195440 - RNA, 16 nt, Yersinia pestis KIM
cgaucugaaacgguga

SEQ ID NO: 4195441 - RNA, 17 nt, Yersinia pestis KIM
cgaucugaagaugcuga

SEQ ID NO: 4195442 - RNA, 18 nt, Yersinia pestis KIM
cgaucugauaucucuuua

SEQ ID NO: 4195443 - RNA, 15 nt, Yersinia pestis KIM
cgaucuguugauaaa

SEQ ID NO: 4195444 - RNA, 17 nt, Yersinia pestis KIM
cgaucuugaacggugag

SEQ ID NO: 4195445 - RNA, 23 nt, Yersinia pestis KIM
cgaugaacugacacacaccagug

SEQ ID NO: 4195446 - RNA, 14 nt, Yersinia pestis KIM
cgaugaccuggaag

SEQ ID NO: 4195447 - RNA, 20 nt, Yersinia pestis KIM
cgaugauauacccaccagag

SEQ ID NO: 4195448 - RNA, 21 nt, Yersinia pestis KIM
cgaugcagcguauucaguaaa

SEQ ID NO: 4195449 - RNA, 13 nt, Yersinia pestis KIM
cgauggaaaaaau

SEQ ID NO: 4195450 - RNA, 23 nt, Yersinia pestis KIM
cgauggaacaggauuuucaaacu

SEQ ID NO: 4195451 - RNA, 14 nt, Yersinia pestis KIM
cgauggaaccacau

SEQ ID NO: 4195452 - RNA, 22 nt, Yersinia pestis KIM
cgauggauaaauucagccgcuc

SEQ ID NO: 4195453 - RNA, 13 nt, Yersinia pestis KIM
cgaugucaauaaa

SEQ ID NO: 4195454 - RNA, 15 nt, Yersinia pestis KIM
cgauguccagccagu

SEQ ID NO: 4195455 - RNA, 16 nt, Yersinia pestis KIM
cgauguuuacggcauu

SEQ ID NO: 4195456 - RNA, 22 nt, Yersinia pestis KIM
cgauuaaacgucucuuuuucau

SEQ ID NO: 4195457 - RNA, 18 nt, Yersinia pestis KIM
cgauuaauuaguuuuaau

SEQ ID NO: 4195458 - RNA, 16 nt, Yersinia pestis KIM
cgauuacccaccaccu

SEQ ID NO: 4195459 - RNA, 20 nt, Yersinia pestis KIM
cgauuccgcgagcaauacca

SEQ ID NO: 4195460 - RNA, 19 nt, Yersinia pestis KIM
cgauugaaucaaggcuuua

SEQ ID NO: 4195461 - RNA, 14 nt, Yersinia pestis KIM
cgauugaucagcca

SEQ ID NO: 4195462 - RNA, 14 nt, Yersinia pestis KIM
cgauuucagcugcu

SEQ ID NO: 4195463 - RNA, 17 nt, Yersinia pestis KIM
cgauuucaucagcguua

SEQ ID NO: 4195464 - RNA, 12 nt, Yersinia pestis KIM
cgauuucugcau

SEQ ID NO: 4195465 - RNA, 11 nt, Yersinia pestis KIM
cgauuuuagcu

SEQ ID NO: 4195466 - RNA, 13 nt, Yersinia pestis KIM
cgauuuuuaaguc

SEQ ID NO: 4195467 - RNA, 10 nt, Yersinia pestis KIM
cgcaaaacuu

SEQ ID NO: 4195468 - RNA, 13 nt, Yersinia pestis KIM
cgcaaaaucagua

SEQ ID NO: 4195469 - RNA, 19 nt, Yersinia pestis KIM
cgcaaacggguggccgccg

SEQ ID NO: 4195470 - RNA, 23 nt, Yersinia pestis KIM
cgcaaagagaacgggcaaccugu

SEQ ID NO: 4195471 - RNA, 20 nt, Yersinia pestis KIM
cgcaaagcgggccagcaacc

SEQ ID NO: 4195472 - RNA, 14 nt, Yersinia pestis KIM
cgcaacagcgccuc

SEQ ID NO: 4195473 - RNA, 19 nt, Yersinia pestis KIM
cgcaaccauccgcccaaua

SEQ ID NO: 4195474 - RNA, 18 nt, Yersinia pestis KIM
cgcaagaaagaaaaauag

SEQ ID NO: 4195475 - RNA, 19 nt, Yersinia pestis KIM
cgcaaggauaccaaucccu

SEQ ID NO: 4195476 - RNA, 16 nt, Yersinia pestis KIM
cgcaaggccagguuag

SEQ ID NO: 4195477 - RNA, 23 nt, Yersinia pestis KIM
cgcaauaaaauaaauauccuccg

SEQ ID NO: 4195478 - RNA, 23 nt, Yersinia pestis KIM
cgcaauaggcgguugguaauacg

SEQ ID NO: 4195479 - RNA, 20 nt, Yersinia pestis KIM
cgcaaucaggauaaugagug

SEQ ID NO: 4195480 - RNA, 19 nt, Yersinia pestis KIM
cgcaaucucuugacgccga

SEQ ID NO: 4195481 - RNA, 18 nt, Yersinia pestis KIM
cgcaaugauuacaucacu

SEQ ID NO: 4195482 - RNA, 20 nt, Yersinia pestis KIM
cgcaauggaagaaucaccga

SEQ ID NO: 4195483 - RNA, 22 nt, Yersinia pestis KIM
cgcaauucgucuaaagaaucag

SEQ ID NO: 4195484 - RNA, 21 nt, Yersinia pestis KIM
cgcacaaacauggcugucccg

SEQ ID NO: 4195485 - RNA, 14 nt, Yersinia pestis KIM
cgcacacagcccug

SEQ ID NO: 4195486 - RNA, 23 nt, Yersinia pestis KIM
cgcacacagcccugccuggcagg

SEQ ID NO: 4195487 - RNA, 22 nt, Yersinia pestis KIM
cgcacaugccgucaccucauca

SEQ ID NO: 4195488 - RNA, 16 nt, Yersinia pestis KIM
cgcacauuacaagugc

SEQ ID NO: 4195489 - RNA, 21 nt, Yersinia pestis KIM
cgcaccaaugccgguccagac

SEQ ID NO: 4195490 - RNA, 18 nt, Yersinia pestis KIM
cgcaccauaaccaaucca

SEQ ID NO: 4195491 - RNA, 20 nt, Yersinia pestis KIM
cgcaccauccagcaaaucau

SEQ ID NO: 4195492 - RNA, 23 nt, Yersinia pestis KIM
cgcaccggcuaaccacagcaaug

SEQ ID NO: 4195493 - RNA, 13 nt, Yersinia pestis KIM
cgcacggcuacug

SEQ ID NO: 4195494 - RNA, 17 nt, Yersinia pestis KIM
cgcacgggcuuuaauga

SEQ ID NO: 4195495 - RNA, 16 nt, Yersinia pestis KIM
cgcacgggucauuaac

SEQ ID NO: 4195496 - RNA, 17 nt, Yersinia pestis KIM
cgcacguucccaggcca

SEQ ID NO: 4195497 - RNA, 19 nt, Yersinia pestis KIM
cgcacucuguaacugccag

SEQ ID NO: 4195498 - RNA, 21 nt, Yersinia pestis KIM
cgcacugagagcauaacccca

SEQ ID NO: 4195499 - RNA, 15 nt, Yersinia pestis KIM
cgcacugauagccaa

SEQ ID NO: 4195500 - RNA, 18 nt, Yersinia pestis KIM
cgcacugggaucugauca

SEQ ID NO: 4195501 - RNA, 22 nt, Yersinia pestis KIM
cgcacugggucaucacccagca

SEQ ID NO: 4195502 - RNA, 16 nt, Yersinia pestis KIM
cgcacugucugagcaa

SEQ ID NO: 4195503 - RNA, 15 nt, Yersinia pestis KIM
cgcacugugagcggc

SEQ ID NO: 4195504 - RNA, 20 nt, Yersinia pestis KIM
cgcacugugagcggcaucca

SEQ ID NO: 4195505 - RNA, 21 nt, Yersinia pestis KIM
cgcacuuaaugccgcugauca

SEQ ID NO: 4195506 - RNA, 16 nt, Yersinia pestis KIM
cgcacuuggccccauc

SEQ ID NO: 4195507 - RNA, 18 nt, Yersinia pestis KIM
cgcagaauaacggcagua

SEQ ID NO: 4195508 - RNA, 19 nt, Yersinia pestis KIM
cgcagaauuaaccguuaac

SEQ ID NO: 4195509 - RNA, 20 nt, Yersinia pestis KIM
cgcagacggcguaagccuuc

SEQ ID NO: 4195510 - RNA, 20 nt, Yersinia pestis KIM
cgcagacugcugacaaaccc

SEQ ID NO: 4195511 - RNA, 21 nt, Yersinia pestis KIM
cgcagaguccucucaccaaga

SEQ ID NO: 4195512 - RNA, 19 nt, Yersinia pestis KIM
cgcagagucucaccgcugg

SEQ ID NO: 4195513 - RNA, 17 nt, Yersinia pestis KIM
cgcagauccagaauuuc

SEQ ID NO: 4195514 - RNA, 17 nt, Yersinia pestis KIM
cgcagcaaauaaacaaa

SEQ ID NO: 4195515 - RNA, 12 nt, Yersinia pestis KIM
cgcagcagggcu

SEQ ID NO: 4195516 - RNA, 15 nt, Yersinia pestis KIM
cgcagcggcuagcag

SEQ ID NO: 4195517 - RNA, 11 nt, Yersinia pestis KIM
cgcagcuucca

SEQ ID NO: 4195518 - RNA, 19 nt, Yersinia pestis KIM
cgcgacggagagaacaggc

SEQ ID NO: 4195519 - RNA, 14 nt, Yersinia pestis KIM
cgcgagacggcgca

SEQ ID NO: 4195520 - RNA, 17 nt, Yersinia pestis KIM
cgcgaguaacgcacuga

SEQ ID NO: 4195521 - RNA, 22 nt, Yersinia pestis KIM
cgcgagugaaccgcgcucugcu

SEQ ID NO: 4195522 - RNA, 20 nt, Yersinia pestis KIM
cgcgauaacgguaucaguca

SEQ ID NO: 4195523 - RNA, 17 nt, Yersinia pestis KIM
cgcgaucuugaacggug

SEQ ID NO: 4195524 - RNA, 18 nt, Yersinia pestis KIM
cgcgaugacacaauuccc

SEQ ID NO: 4195525 - RNA, 14 nt, Yersinia pestis KIM
cgcgcagcaagcug

SEQ ID NO: 4195526 - RNA, 16 nt, Yersinia pestis KIM
cgcgcagccaacggag

SEQ ID NO: 4195527 - RNA, 15 nt, Yersinia pestis KIM
cgcgccacuucuuuc

SEQ ID NO: 4195528 - RNA, 20 nt, Yersinia pestis KIM
cgcgccauaaaagauaacga

SEQ ID NO: 4195529 - RNA, 21 nt, Yersinia pestis KIM
cgcgcccauccgcaggaagca

SEQ ID NO: 4195530 - RNA, 13 nt, Yersinia pestis KIM
cgcgccugcucac

SEQ ID NO: 4195531 - RNA, 13 nt, Yersinia pestis KIM
cgcgcuuccaggc

SEQ ID NO: 4195532 - RNA, 15 nt, Yersinia pestis KIM
cgcgcuucgagcccc

SEQ ID NO: 4195533 - RNA, 17 nt, Yersinia pestis KIM
cgcgcuucgagccccca

SEQ ID NO: 4195534 - RNA, 15 nt, Yersinia pestis KIM
cgcgcuuggaagggu

SEQ ID NO: 4195535 - RNA, 20 nt, Yersinia pestis KIM
cgcggacaccaacuggcggc

SEQ ID NO: 4195536 - RNA, 21 nt, Yersinia pestis KIM
cgcggacgcuuuacuccucug

SEQ ID NO: 4195537 - RNA, 21 nt, Yersinia pestis KIM
cgcggaggguaaaacugccau

SEQ ID NO: 4195538 - RNA, 14 nt, Yersinia pestis KIM
cgcggaugauacga

SEQ ID NO: 4195539 - RNA, 17 nt, Yersinia pestis KIM
cgcggaugcgcgcguca

SEQ ID NO: 4195540 - RNA, 23 nt, Yersinia pestis KIM
cgcggaugguacggaucagugug

SEQ ID NO: 4195541 - RNA, 15 nt, Yersinia pestis KIM
cgcggcaaagucugg

SEQ ID NO: 4195542 - RNA, 12 nt, Yersinia pestis KIM
cgcggccugcug

SEQ ID NO: 4195543 - RNA, 23 nt, Yersinia pestis KIM
cgcggguaaugcuguuguagcgc

SEQ ID NO: 4195544 - RNA, 23 nt, Yersinia pestis KIM
cgcgggucaugucgcuguagcgc

SEQ ID NO: 4195545 - RNA, 17 nt, Yersinia pestis KIM
cgcggguuuugccgggc

SEQ ID NO: 4195546 - RNA, 20 nt, Yersinia pestis KIM
cgcgguaacuaacaucagcg

SEQ ID NO: 4195547 - RNA, 22 nt, Yersinia pestis KIM
cgcgguuggguucaauucccaa

SEQ ID NO: 4195548 - RNA, 17 nt, Yersinia pestis KIM
cgcgguuuuuccgccgu

SEQ ID NO: 4195549 - RNA, 22 nt, Yersinia pestis KIM
cgcgucaauaacauuaccaccg

SEQ ID NO: 4195550 - RNA, 22 nt, Yersinia pestis KIM
cgcgucugagguggcacccagu

SEQ ID NO: 4195551 - RNA, 16 nt, Yersinia pestis KIM
cgcgugcgcaucaaug

SEQ ID NO: 4195552 - RNA, 18 nt, Yersinia pestis KIM
cgcguuaaugcuaaugcc

SEQ ID NO: 4195553 - RNA, 16 nt, Yersinia pestis KIM
cgcguucaaaucugcu

SEQ ID NO: 4195554 - RNA, 20 nt, Yersinia pestis KIM
cgcguugucagccaugccug

SEQ ID NO: 4195555 - RNA, 21 nt, Yersinia pestis KIM
cgcuaaccaacgcggcccccg

SEQ ID NO: 4195556 - RNA, 16 nt, Yersinia pestis KIM
cgcuaaccaccgucac

SEQ ID NO: 4195557 - RNA, 22 nt, Yersinia pestis KIM
cgcuaaccgccaguucuggauc

SEQ ID NO: 4195558 - RNA, 13 nt, Yersinia pestis KIM
cgcuaaccuuaac

SEQ ID NO: 4195559 - RNA, 13 nt, Yersinia pestis KIM
cgcuaagccauua

SEQ ID NO: 4195560 - RNA, 18 nt, Yersinia pestis KIM
cgcuaagcugcgcugacc

SEQ ID NO: 4195561 - RNA, 20 nt, Yersinia pestis KIM
cgcuaauauuuucagcccua

SEQ ID NO: 4195562 - RNA, 18 nt, Yersinia pestis KIM
cgcuaaucauauccauaa

SEQ ID NO: 4195563 - RNA, 22 nt, Yersinia pestis KIM
cgcuaauggauuccgaugcuug

SEQ ID NO: 4195564 - RNA, 14 nt, Yersinia pestis KIM
cgcuaaugggugau

SEQ ID NO: 4195565 - RNA, 13 nt, Yersinia pestis KIM
cgcuaccaugagu

SEQ ID NO: 4195566 - RNA, 14 nt, Yersinia pestis KIM
cgcuagauuuucuu

SEQ ID NO: 4195567 - RNA, 12 nt, Yersinia pestis KIM
cgcuagcacuga

SEQ ID NO: 4195568 - RNA, 18 nt, Yersinia pestis KIM
cgcuauaucaucagcaga

SEQ ID NO: 4195569 - RNA, 16 nt, Yersinia pestis KIM
cgcuaugcagcccaga

SEQ ID NO: 4195570 - RNA, 17 nt, Yersinia pestis KIM
cgcucaauggcgggggc

SEQ ID NO: 4195571 - RNA, 21 nt, Yersinia pestis KIM
cgcucacuuuuauauccgcca

SEQ ID NO: 4195572 - RNA, 14 nt, Yersinia pestis KIM
cgcucacuuuuauu

SEQ ID NO: 4195573 - RNA, 18 nt, Yersinia pestis KIM
cgcucaguauucgccaga

SEQ ID NO: 4195574 - RNA, 13 nt, Yersinia pestis KIM
cgcucaucgccaa

SEQ ID NO: 4195575 - RNA, 17 nt, Yersinia pestis KIM
cgcuccaccagcccauc

SEQ ID NO: 4195576 - RNA, 12 nt, Yersinia pestis KIM
cgcuccagcacu

SEQ ID NO: 4195577 - RNA, 22 nt, Yersinia pestis KIM
cgcuccaggcuggccacuucca

SEQ ID NO: 4195578 - RNA, 14 nt, Yersinia pestis KIM
cgcuccgagcgugc

SEQ ID NO: 4195579 - RNA, 22 nt, Yersinia pestis KIM
cgcucggcaccgauuugcccca

SEQ ID NO: 4195580 - RNA, 21 nt, Yersinia pestis KIM
cgcucuaacgucagauaaaaa

SEQ ID NO: 4195581 - RNA, 23 nt, Yersinia pestis KIM
cgcugacaauuuacacccaguua

SEQ ID NO: 4195582 - RNA, 14 nt, Yersinia pestis KIM
cgcugacagaguac

SEQ ID NO: 4195583 - RNA, 11 nt, Yersinia pestis KIM
cgcugagcggg

SEQ ID NO: 4195584 - RNA, 23 nt, Yersinia pestis KIM
cgcugagguucuccaacaaccgu

SEQ ID NO: 4195585 - RNA, 14 nt, Yersinia pestis KIM
cgcugauaaccagc

SEQ ID NO: 4195586 - RNA, 18 nt, Yersinia pestis KIM
cgcugauaacuuccuuug

SEQ ID NO: 4195587 - RNA, 17 nt, Yersinia pestis KIM
cgcugaucaucaucaau

SEQ ID NO: 4195588 - RNA, 20 nt, Yersinia pestis KIM
cgcugauguaggcaauacac

SEQ ID NO: 4195589 - RNA, 23 nt, Yersinia pestis KIM
cgcugauguaggcaauacaccgc

SEQ ID NO: 4195590 - RNA, 22 nt, Yersinia pestis KIM
cgcugauugugccuuacuuuuu

SEQ ID NO: 4195591 - RNA, 13 nt, Yersinia pestis KIM
cgcugcaauaaag

SEQ ID NO: 4195592 - RNA, 16 nt, Yersinia pestis KIM
cgcugcaauuauaagc

SEQ ID NO: 4195593 - RNA, 14 nt, Yersinia pestis KIM
cgcugcagcuuuag

SEQ ID NO: 4195594 - RNA, 17 nt, Yersinia pestis KIM
cgcugcucaaucaccga

SEQ ID NO: 4195595 - RNA, 21 nt, Yersinia pestis KIM
cgcugcuuuuacgcaaguaaa

SEQ ID NO: 4195596 - RNA, 21 nt, Yersinia pestis KIM
cgcuguacaacaagaucccaa

SEQ ID NO: 4195597 - RNA, 16 nt, Yersinia pestis KIM
cgcugucugaauagug

SEQ ID NO: 4195598 - RNA, 22 nt, Yersinia pestis KIM
cgcuguguuuugcuaaccgccu

SEQ ID NO: 4195599 - RNA, 20 nt, Yersinia pestis KIM
cgcuguuacucaguucagcc

SEQ ID NO: 4195600 - RNA, 19 nt, Yersinia pestis KIM
cgcuguuucucuucaucgc

SEQ ID NO: 4195601 - RNA, 19 nt, Yersinia pestis KIM
cgcuguuugauuaaaaccc

SEQ ID NO: 4195602 - RNA, 18 nt, Yersinia pestis KIM
cgcuuaaauaaaacaccc

SEQ ID NO: 4195603 - RNA, 14 nt, Yersinia pestis KIM
cgcuuaaggcauca

SEQ ID NO: 4195604 - RNA, 20 nt, Yersinia pestis KIM
cgcuuagcaauaccagccga

SEQ ID NO: 4195605 - RNA, 15 nt, Yersinia pestis KIM
cgcuuaucccuccau

SEQ ID NO: 4195606 - RNA, 22 nt, Yersinia pestis KIM
cgcuuccagcgcuuccacugcg

SEQ ID NO: 4195607 - RNA, 12 nt, Yersinia pestis KIM
cgcuucgcugug

SEQ ID NO: 4195608 - RNA, 15 nt, Yersinia pestis KIM
cgcuucguccagaug

SEQ ID NO: 4195609 - RNA, 17 nt, Yersinia pestis KIM
cgcuugugcucacguca

SEQ ID NO: 4195610 - RNA, 17 nt, Yersinia pestis KIM
cgcuuuaaccuuucuaa

SEQ ID NO: 4195611 - RNA, 22 nt, Yersinia pestis KIM
cgcuuuaaccuuucuaauuauu

SEQ ID NO: 4195612 - RNA, 22 nt, Yersinia pestis KIM
cgcuuuagugacuaauuguuug

SEQ ID NO: 4195613 - RNA, 12 nt, Yersinia pestis KIM
cgcuuuaucgcc

SEQ ID NO: 4195614 - RNA, 20 nt, Yersinia pestis KIM
cgcuuucagcacgcuuucca

SEQ ID NO: 4195615 - RNA, 14 nt, Yersinia pestis KIM
cgcuuuucuuuuuu

SEQ ID NO: 4195616 - RNA, 15 nt, Yersinia pestis KIM
cggaaacguccaggg

SEQ ID NO: 4195617 - RNA, 15 nt, Yersinia pestis KIM
cggaaauaaggcgca

SEQ ID NO: 4195618 - RNA, 15 nt, Yersinia pestis KIM
cggaaaucagcuuca

SEQ ID NO: 4195619 - RNA, 13 nt, Yersinia pestis KIM
cggaacagcagcg

SEQ ID NO: 4195620 - RNA, 19 nt, Yersinia pestis KIM
cggaagacuuccagcacca

SEQ ID NO: 4195621 - RNA, 15 nt, Yersinia pestis KIM
cggaagcaaucagga

SEQ ID NO: 4195622 - RNA, 14 nt, Yersinia pestis KIM
cggaauaaaugaga

SEQ ID NO: 4195623 - RNA, 21 nt, Yersinia pestis KIM
cggaauaugcugugguucaau

SEQ ID NO: 4195624 - RNA, 19 nt, Yersinia pestis KIM
cggaaucaccuuucuccau

SEQ ID NO: 4195625 - RNA, 14 nt, Yersinia pestis KIM
cggacagcaaccac

SEQ ID NO: 4195626 - RNA, 14 nt, Yersinia pestis KIM
cggacagcgcgcag

SEQ ID NO: 4195627 - RNA, 19 nt, Yersinia pestis KIM
cggacagcgcgcagccaac

SEQ ID NO: 4195628 - RNA, 21 nt, Yersinia pestis KIM
cggacauaagaugaccaccaa

SEQ ID NO: 4195629 - RNA, 14 nt, Yersinia pestis KIM
cggacaucuuacug

SEQ ID NO: 4195630 - RNA, 20 nt, Yersinia pestis KIM
cggacaucuuacugauaccc

SEQ ID NO: 4195631 - RNA, 23 nt, Yersinia pestis KIM
cggacauuuuacucccugacucc

SEQ ID NO: 4195632 - RNA, 15 nt, Yersinia pestis KIM
cggcuguaaccgccu

SEQ ID NO: 4195633 - RNA, 22 nt, Yersinia pestis KIM
cggcuuaaccaacaacuccacu

SEQ ID NO: 4195634 - RNA, 12 nt, Yersinia pestis KIM
cggcuucaucag

SEQ ID NO: 4195635 - RNA, 18 nt, Yersinia pestis KIM
cggcuugcuuggugcccg

SEQ ID NO: 4195636 - RNA, 22 nt, Yersinia pestis KIM
cggcuuuaauccauucacgccc

SEQ ID NO: 4195637 - RNA, 16 nt, Yersinia pestis KIM
cggcuuuauaguccuu

SEQ ID NO: 4195638 - RNA, 14 nt, Yersinia pestis KIM
cggcuuucaauaaa

SEQ ID NO: 4195639 - RNA, 17 nt, Yersinia pestis KIM
cggcuuucucuugccau

SEQ ID NO: 4195640 - RNA, 21 nt, Yersinia pestis KIM
cggcuuugcugugcgauuuca

SEQ ID NO: 4195641 - RNA, 16 nt, Yersinia pestis KIM
cggcuuuuaucuucca

SEQ ID NO: 4195642 - RNA, 23 nt, Yersinia pestis KIM
cgggaacaggaucugcuccucuu

SEQ ID NO: 4195643 - RNA, 14 nt, Yersinia pestis KIM
cgggaacgccaagu

SEQ ID NO: 4195644 - RNA, 21 nt, Yersinia pestis KIM
cgggaaucaauuugaacaaca

SEQ ID NO: 4195645 - RNA, 14 nt, Yersinia pestis KIM
cgggaaucuugauu

SEQ ID NO: 4195646 - RNA, 18 nt, Yersinia pestis KIM
cgggaaucuugauuagcu

SEQ ID NO: 4195647 - RNA, 17 nt, Yersinia pestis KIM
cgggagauaguuaucuc

SEQ ID NO: 4195648 - RNA, 23 nt, Yersinia pestis KIM
cgggagauuaauacaucaucaaa

SEQ ID NO: 4195649 - RNA, 22 nt, Yersinia pestis KIM
cgggaggaaggcuugaacguga

SEQ ID NO: 4195650 - RNA, 15 nt, Yersinia pestis KIM
cgggaucaccgcuuu

SEQ ID NO: 4195651 - RNA, 18 nt, Yersinia pestis KIM
cgggauccaucugauaag

SEQ ID NO: 4195652 - RNA, 22 nt, Yersinia pestis KIM
cgggcaaacgccagugcaaaau

SEQ ID NO: 4195653 - RNA, 14 nt, Yersinia pestis KIM
cgggcaacagagaa

SEQ ID NO: 4195654 - RNA, 15 nt, Yersinia pestis KIM
cgggcaacagagaaa

SEQ ID NO: 4195655 - RNA, 11 nt, Yersinia pestis KIM
cgggcaaccug

SEQ ID NO: 4195656 - RNA, 13 nt, Yersinia pestis KIM
cgggcaccaugcc

SEQ ID NO: 4195657 - RNA, 22 nt, Yersinia pestis KIM
cgggcacccgauaugcccguua

SEQ ID NO: 4195658 - RNA, 21 nt, Yersinia pestis KIM
cgggcaccugacgcagaagua

SEQ ID NO: 4195659 - RNA, 16 nt, Yersinia pestis KIM
cgggcaugaacguguu

SEQ ID NO: 4195660 - RNA, 22 nt, Yersinia pestis KIM
cgggccagcaaccacgguauca

SEQ ID NO: 4195661 - RNA, 17 nt, Yersinia pestis KIM
cgggccgcauucaccac

SEQ ID NO: 4195662 - RNA, 17 nt, Yersinia pestis KIM
cgggcgaacagaaauca

SEQ ID NO: 4195663 - RNA, 16 nt, Yersinia pestis KIM
cgggcgcaauggaaga

SEQ ID NO: 4195664 - RNA, 20 nt, Yersinia pestis KIM
cgggcgcugagcgggcggca

SEQ ID NO: 4195665 - RNA, 19 nt, Yersinia pestis KIM
cgggcgcuuaaauaaaaca

SEQ ID NO: 4195666 - RNA, 19 nt, Yersinia pestis KIM
cgggcggaaauaaggcgca

SEQ ID NO: 4195667 - RNA, 23 nt, Yersinia pestis KIM
cgggcggcauaauccucaaccug

SEQ ID NO: 4195668 - RNA, 15 nt, Yersinia pestis KIM
cgggcggccucugcu

SEQ ID NO: 4195669 - RNA, 21 nt, Yersinia pestis KIM
cgggcuaucaucaaaggcaau

SEQ ID NO: 4195670 - RNA, 22 nt, Yersinia pestis KIM
cgggcuaucaucaaaggcaaua

SEQ ID NO: 4195671 - RNA, 18 nt, Yersinia pestis KIM
cgggcugucuugcguucu

SEQ ID NO: 4195672 - RNA, 15 nt, Yersinia pestis KIM
cgggcuucaccaucu

SEQ ID NO: 4195673 - RNA, 21 nt, Yersinia pestis KIM
cgggcuucuaggugcucugcc

SEQ ID NO: 4195674 - RNA, 17 nt, Yersinia pestis KIM
cggggauccauaggauc

SEQ ID NO: 4195675 - RNA, 16 nt, Yersinia pestis KIM
cggggccaucaucuuc

SEQ ID NO: 4195676 - RNA, 18 nt, Yersinia pestis KIM
cggggguggcugccugga

SEQ ID NO: 4195677 - RNA, 19 nt, Yersinia pestis KIM
cggggucuuuucgguaaua

SEQ ID NO: 4195678 - RNA, 20 nt, Yersinia pestis KIM
cggguaacaacucaccgccg

SEQ ID NO: 4195679 - RNA, 18 nt, Yersinia pestis KIM
cggguagaaacguucaau

SEQ ID NO: 4195680 - RNA, 14 nt, Yersinia pestis KIM
cggguauauugccc

SEQ ID NO: 4195681 - RNA, 17 nt, Yersinia pestis KIM
cggguauuacgggcgau

SEQ ID NO: 4195682 - RNA, 16 nt, Yersinia pestis KIM
cggguauuugucgucc

SEQ ID NO: 4195683 - RNA, 15 nt, Yersinia pestis KIM
cgggucagcucacca

SEQ ID NO: 4195684 - RNA, 14 nt, Yersinia pestis KIM
cgggucagcugacg

SEQ ID NO: 4195685 - RNA, 19 nt, Yersinia pestis KIM
cgggucucucaccgcugcu

SEQ ID NO: 4195686 - RNA, 16 nt, Yersinia pestis KIM
cggguggugaaaucgg

SEQ ID NO: 4195687 - RNA, 16 nt, Yersinia pestis KIM
cggguuaacuuuuucu

SEQ ID NO: 4195688 - RNA, 21 nt, Yersinia pestis KIM
cggguuaauagcaagcacggc

SEQ ID NO: 4195689 - RNA, 13 nt, Yersinia pestis KIM
cggguucuaaauc

SEQ ID NO: 4195690 - RNA, 23 nt, Yersinia pestis KIM
cggguugcccaucagcaucaaua

SEQ ID NO: 4195691 - RNA, 19 nt, Yersinia pestis KIM
cggguuuaauucaggccaa

SEQ ID NO: 4195692 - RNA, 15 nt, Yersinia pestis KIM
cggguuuugcaucaa

SEQ ID NO: 4195693 - RNA, 17 nt, Yersinia pestis KIM
cggguuuugcaucaagc

SEQ ID NO: 4195694 - RNA, 16 nt, Yersinia pestis KIM
cggguuuugucggcgg

SEQ ID NO: 4195695 - RNA, 23 nt, Yersinia pestis KIM
cggguuuuuaacuuuaucagucu

SEQ ID NO: 4195696 - RNA, 17 nt, Yersinia pestis KIM
cggguuuuuuuacauau

SEQ ID NO: 4195697 - RNA, 21 nt, Yersinia pestis KIM
cgguaaauggcgugcacugac

SEQ ID NO: 4195698 - RNA, 23 nt, Yersinia pestis KIM
cgguaacauauaaaccagccagu

SEQ ID NO: 4195699 - RNA, 14 nt, Yersinia pestis KIM
cgguaaccagcauc

SEQ ID NO: 4195700 - RNA, 16 nt, Yersinia pestis KIM
cgguaacgcagauaaa

SEQ ID NO: 4195701 - RNA, 18 nt, Yersinia pestis KIM
cgguaacgcagauaaauc

SEQ ID NO: 4195702 - RNA, 20 nt, Yersinia pestis KIM
cgguaacuuacaggcugccu

SEQ ID NO: 4195703 - RNA, 20 nt, Yersinia pestis KIM
cgguaaguuggcaucagcuc

SEQ ID NO: 4195704 - RNA, 20 nt, Yersinia pestis KIM
cgguaauaaacggcguugau

SEQ ID NO: 4195705 - RNA, 15 nt, Yersinia pestis KIM
cgguaauaaaucaug

SEQ ID NO: 4195706 - RNA, 23 nt, Yersinia pestis KIM
cgguaaucccgauauaaauaaaa

SEQ ID NO: 4195707 - RNA, 22 nt, Yersinia pestis KIM
cgguaaugagccgcauugaucc

SEQ ID NO: 4195708 - RNA, 17 nt, Yersinia pestis KIM
cgguaauggccaauuuu

SEQ ID NO: 4195709 - RNA, 16 nt, Yersinia pestis KIM
cgguacaggcaaagug

SEQ ID NO: 4195710 - RNA, 15 nt, Yersinia pestis KIM
cgguacgcaggccuu

SEQ ID NO: 4195711 - RNA, 15 nt, Yersinia pestis KIM
cgguacugaaaucca

SEQ ID NO: 4195712 - RNA, 14 nt, Yersinia pestis KIM
cgguagaccaccaa

SEQ ID NO: 4195713 - RNA, 15 nt, Yersinia pestis KIM
cgguagaccaccaac

SEQ ID NO: 4195714 - RNA, 18 nt, Yersinia pestis KIM
cgguagugacucaucaaa

SEQ ID NO: 4195715 - RNA, 24 nt, Yersinia pestis KIM
cgguaucaacaauuuccauaucaa

SEQ ID NO: 4195716 - RNA, 19 nt, Yersinia pestis KIM
cgguaucacuugggcauga

SEQ ID NO: 4195717 - RNA, 18 nt, Yersinia pestis KIM
cgguauccaucccaacaa

SEQ ID NO: 4195718 - RNA, 18 nt, Yersinia pestis KIM
cgguaucggccaauucag

SEQ ID NO: 4195719 - RNA, 21 nt, Yersinia pestis KIM
cggucaauaccauauccacgg

SEQ ID NO: 4195720 - RNA, 21 nt, Yersinia pestis KIM
cggucaauugagucucuggcc

SEQ ID NO: 4195721 - RNA, 18 nt, Yersinia pestis KIM
cggucacaccagacagaa

SEQ ID NO: 4195722 - RNA, 12 nt, Yersinia pestis KIM
cggucagggaaa

SEQ ID NO: 4195723 - RNA, 21 nt, Yersinia pestis KIM
cggucagguggugcccgacca

SEQ ID NO: 4195724 - RNA, 20 nt, Yersinia pestis KIM
cggucauuguagauggccau

SEQ ID NO: 4195725 - RNA, 23 nt, Yersinia pestis KIM
cggucgcccgcuaccacuccuua

SEQ ID NO: 4195726 - RNA, 14 nt, Yersinia pestis KIM
cggucucuggaugc

SEQ ID NO: 4195727 - RNA, 20 nt, Yersinia pestis KIM
cggucuggcaacugcaaaug

SEQ ID NO: 4195728 - RNA, 23 nt, Yersinia pestis KIM
cggucugggacuuuaucugccaa

SEQ ID NO: 4195729 - RNA, 13 nt, Yersinia pestis KIM
cggucuguuaauc

SEQ ID NO: 4195730 - RNA, 18 nt, Yersinia pestis KIM
cggucuuuuuacaagcac

SEQ ID NO: 4195731 - RNA, 17 nt, Yersinia pestis KIM
cggugagcacgauuacc

SEQ ID NO: 4195732 - RNA, 11 nt, Yersinia pestis KIM
cggugaggaua

SEQ ID NO: 4195733 - RNA, 19 nt, Yersinia pestis KIM
cggugagggagucagggag

SEQ ID NO: 4195734 - RNA, 22 nt, Yersinia pestis KIM
cggugcaaaaccccaauacacu

SEQ ID NO: 4195735 - RNA, 23 nt, Yersinia pestis KIM
cggugccgcaucaccgcccauau

SEQ ID NO: 4195736 - RNA, 20 nt, Yersinia pestis KIM
cgguguaaagcgcccgccag

SEQ ID NO: 4195737 - RNA, 20 nt, Yersinia pestis KIM
cgguguaauaagacguucac

SEQ ID NO: 4195738 - RNA, 15 nt, Yersinia pestis KIM
cgguguaguuaaggu

SEQ ID NO: 4195739 - RNA, 15 nt, Yersinia pestis KIM
cggugugcaaugcag

SEQ ID NO: 4195740 - RNA, 22 nt, Yersinia pestis KIM
cgguguuagaucggccaaugcu

SEQ ID NO: 4195741 - RNA, 21 nt, Yersinia pestis KIM
cgguguuccacaauguugaua

SEQ ID NO: 4195742 - RNA, 13 nt, Yersinia pestis KIM
cgguuaaauacag

SEQ ID NO: 4195743 - RNA, 22 nt, Yersinia pestis KIM
cgguuaacgacgcauuaauccg

SEQ ID NO: 4195744 - RNA, 14 nt, Yersinia pestis KIM
cgguuaaugccagc

SEQ ID NO: 4195745 - RNA, 22 nt, Yersinia pestis KIM
cgguuaauucaugugagauaac

SEQ ID NO: 4195746 - RNA, 22 nt, Yersinia pestis KIM
cguccaggcuuucacggugcgu

SEQ ID NO: 4195747 - RNA, 19 nt, Yersinia pestis KIM
cguccagggcgcccuaaua

SEQ ID NO: 4195748 - RNA, 14 nt, Yersinia pestis KIM
cgucccuaaagcca

SEQ ID NO: 4195749 - RNA, 19 nt, Yersinia pestis KIM
cgucccuaaagccaucgcc

SEQ ID NO: 4195750 - RNA, 18 nt, Yersinia pestis KIM
cguccgcuuagcaggccc

SEQ ID NO: 4195751 - RNA, 12 nt, Yersinia pestis KIM
cguccggcggcu

SEQ ID NO: 4195752 - RNA, 16 nt, Yersinia pestis KIM
cguccggcggcuagca

SEQ ID NO: 4195753 - RNA, 12 nt, Yersinia pestis KIM
cgucgcaagaga

SEQ ID NO: 4195754 - RNA, 21 nt, Yersinia pestis KIM
cgucgcaagagagccaaaaug

SEQ ID NO: 4195755 - RNA, 13 nt, Yersinia pestis KIM
cgucgcuguuacc

SEQ ID NO: 4195756 - RNA, 20 nt, Yersinia pestis KIM
cgucgugugucuuaagccug

SEQ ID NO: 4195757 - RNA, 14 nt, Yersinia pestis KIM
cgucguuugcucca

SEQ ID NO: 4195758 - RNA, 20 nt, Yersinia pestis KIM
cgucguuugcuccauuuuuu

SEQ ID NO: 4195759 - RNA, 21 nt, Yersinia pestis KIM
cgucuccggggauaaccgccg

SEQ ID NO: 4195760 - RNA, 18 nt, Yersinia pestis KIM
cgucucuaacccauuggu

SEQ ID NO: 4195761 - RNA, 21 nt, Yersinia pestis KIM
cgucugacggguauaucacuu

SEQ ID NO: 4195762 - RNA, 21 nt, Yersinia pestis KIM
cgucugagguggcacccagug

SEQ ID NO: 4195763 - RNA, 16 nt, Yersinia pestis KIM
cgucugcaauagcuca

SEQ ID NO: 4195764 - RNA, 14 nt, Yersinia pestis KIM
cgucugccauugcu

SEQ ID NO: 4195765 - RNA, 20 nt, Yersinia pestis KIM
cgucuuccgcccguucauca

SEQ ID NO: 4195766 - RNA, 17 nt, Yersinia pestis KIM
cgucuuggauauuugaa

SEQ ID NO: 4195767 - RNA, 23 nt, Yersinia pestis KIM
cgucuuguuggucaccacuugca

SEQ ID NO: 4195768 - RNA, 15 nt, Yersinia pestis KIM
cgucuuuacgaucug

SEQ ID NO: 4195769 - RNA, 20 nt, Yersinia pestis KIM
cgucuuuacgaucugccugu

SEQ ID NO: 4195770 - RNA, 23 nt, Yersinia pestis KIM
cgucuuuacgaucugccuguucu

SEQ ID NO: 4195771 - RNA, 17 nt, Yersinia pestis KIM
cgucuuuagauuucacc

SEQ ID NO: 4195772 - RNA, 21 nt, Yersinia pestis KIM
cgucuuuaucgccagcugcaa

SEQ ID NO: 4195773 - RNA, 21 nt, Yersinia pestis KIM
cgucuuugaccgaaccaccgc

SEQ ID NO: 4195774 - RNA, 20 nt, Yersinia pestis KIM
cgugaacauugcaguauuuu

SEQ ID NO: 4195775 - RNA, 15 nt, Yersinia pestis KIM
cgugaagugagcuga

SEQ ID NO: 4195776 - RNA, 14 nt, Yersinia pestis KIM
cgugaccaccgcag

SEQ ID NO: 4195777 - RNA, 17 nt, Yersinia pestis KIM
cgugaccaccgcagcaa

SEQ ID NO: 4195778 - RNA, 17 nt, Yersinia pestis KIM
cgugacgcucgcugcug

SEQ ID NO: 4195779 - RNA, 13 nt, Yersinia pestis KIM
cgugacggcagcg

SEQ ID NO: 4195780 - RNA, 16 nt, Yersinia pestis KIM
cgugacggcagcgagc

SEQ ID NO: 4195781 - RNA, 21 nt, Yersinia pestis KIM
cgugacggcagcgagcacugc

SEQ ID NO: 4195782 - RNA, 21 nt, Yersinia pestis KIM
cgugacggcggcgagcacugc

SEQ ID NO: 4195783 - RNA, 23 nt, Yersinia pestis KIM
cgugacggcggcgagcacugccc

SEQ ID NO: 4195784 - RNA, 18 nt, Yersinia pestis KIM
cgugagcaaucuggcggc

SEQ ID NO: 4195785 - RNA, 16 nt, Yersinia pestis KIM
cgugagcagcaccggu

SEQ ID NO: 4195786 - RNA, 18 nt, Yersinia pestis KIM
cgugaguaucgauaagaa

SEQ ID NO: 4195787 - RNA, 13 nt, Yersinia pestis KIM
cgugaucgccgua

SEQ ID NO: 4195788 - RNA, 17 nt, Yersinia pestis KIM
cgugauugagcguugau

SEQ ID NO: 4195789 - RNA, 17 nt, Yersinia pestis KIM
cgugauuuuuauauuuu

SEQ ID NO: 4195790 - RNA, 21 nt, Yersinia pestis KIM
cgugauuuuuauauuuugaga

SEQ ID NO: 4195791 - RNA, 22 nt, Yersinia pestis KIM
cgugcaauaaagcgauaaauac

SEQ ID NO: 4195792 - RNA, 14 nt, Yersinia pestis KIM
cgugcagcgcgcag

SEQ ID NO: 4195793 - RNA, 15 nt, Yersinia pestis KIM
cgugcagcgcgcagc

SEQ ID NO: 4195794 - RNA, 19 nt, Yersinia pestis KIM
cgugcagcgcgcagccaac

SEQ ID NO: 4195795 - RNA, 22 nt, Yersinia pestis KIM
cgugccaaaaugccuaccguua

SEQ ID NO: 4195796 - RNA, 18 nt, Yersinia pestis KIM
cgugcccaaaaacgcugg

SEQ ID NO: 4195797 - RNA, 19 nt, Yersinia pestis KIM
cgugccgaagugcauauua

SEQ ID NO: 4195798 - RNA, 18 nt, Yersinia pestis KIM
cgugccugcuggcaaacu

SEQ ID NO: 4195799 - RNA, 21 nt, Yersinia pestis KIM
cgugcguuuuugaaauaccac

SEQ ID NO: 4195800 - RNA, 20 nt, Yersinia pestis KIM
cgugcucaucaaccucagcc

SEQ ID NO: 4195801 - RNA, 23 nt, Yersinia pestis KIM
cgugcucaucaaccucagccuca

SEQ ID NO: 4195802 - RNA, 21 nt, Yersinia pestis KIM
cgugcucgucuucgacagcag

SEQ ID NO: 4195803 - RNA, 16 nt, Yersinia pestis KIM
cgugcugcuuccugcu

SEQ ID NO: 4195804 - RNA, 22 nt, Yersinia pestis KIM
cguggcacaccgcuacaggcgc

SEQ ID NO: 4195805 - RNA, 17 nt, Yersinia pestis KIM
cguggcauaaucaacgc

SEQ ID NO: 4195806 - RNA, 20 nt, Yersinia pestis KIM
cguggccgugaccaccgcag

SEQ ID NO: 4195807 - RNA, 21 nt, Yersinia pestis KIM
cguggcgcggaugcuuuauuc

SEQ ID NO: 4195808 - RNA, 16 nt, Yersinia pestis KIM
cguggcguucccgcag

SEQ ID NO: 4195809 - RNA, 14 nt, Yersinia pestis KIM
cgugggcauuuuuu

SEQ ID NO: 4195810 - RNA, 21 nt, Yersinia pestis KIM
cguggugggcgguaguauuug

SEQ ID NO: 4195811 - RNA, 20 nt, Yersinia pestis KIM
cgugguugcggcaccugccc

SEQ ID NO: 4195812 - RNA, 16 nt, Yersinia pestis KIM
cguguaagaacuggcu

SEQ ID NO: 4195813 - RNA, 17 nt, Yersinia pestis KIM
cguguacuuucccugcu

SEQ ID NO: 4195814 - RNA, 19 nt, Yersinia pestis KIM
cguguauaucacuauuuca

SEQ ID NO: 4195815 - RNA, 23 nt, Yersinia pestis KIM
cguguauaucacuauuucagaca

SEQ ID NO: 4195816 - RNA, 17 nt, Yersinia pestis KIM
cgugucaaaccaauuuc

SEQ ID NO: 4195817 - RNA, 21 nt, Yersinia pestis KIM
cgugucaauauucuguuaguc

SEQ ID NO: 4195818 - RNA, 18 nt, Yersinia pestis KIM
cgugugcuguaagaaaaa

SEQ ID NO: 4195819 - RNA, 20 nt, Yersinia pestis KIM
cguguuuuucaucugugccu

SEQ ID NO: 4195820 - RNA, 17 nt, Yersinia pestis KIM
cguuaaacccugucguu

SEQ ID NO: 4195821 - RNA, 16 nt, Yersinia pestis KIM
cguuaaauuucuucaa

SEQ ID NO: 4195822 - RNA, 20 nt, Yersinia pestis KIM
cguuaaauuucuucaauaau

SEQ ID NO: 4195823 - RNA, 15 nt, Yersinia pestis KIM
cguuaaccaguagcg

SEQ ID NO: 4195824 - RNA, 14 nt, Yersinia pestis KIM
cguuaagaacgcuu

SEQ ID NO: 4195825 - RNA, 16 nt, Yersinia pestis KIM
cguuaauuauagugaa

SEQ ID NO: 4195826 - RNA, 18 nt, Yersinia pestis KIM
cguuacacaaucaguaaa

SEQ ID NO: 4195827 - RNA, 16 nt, Yersinia pestis KIM
cguuacacaucaggcu

SEQ ID NO: 4195828 - RNA, 21 nt, Yersinia pestis KIM
cguuacacaucaggcuguuga

SEQ ID NO: 4195829 - RNA, 17 nt, Yersinia pestis KIM
cguuacagaugggaaga

SEQ ID NO: 4195830 - RNA, 17 nt, Yersinia pestis KIM
cguuacagggggcacuu

SEQ ID NO: 4195831 - RNA, 18 nt, Yersinia pestis KIM
cguuacaguaaggcagca

SEQ ID NO: 4195832 - RNA, 16 nt, Yersinia pestis KIM
cguuacccacauuaaa

SEQ ID NO: 4195833 - RNA, 22 nt, Yersinia pestis KIM
cguuacccccuucaccaauaca

SEQ ID NO: 4195834 - RNA, 13 nt, Yersinia pestis KIM
cguuacugcaucu

SEQ ID NO: 4195835 - RNA, 13 nt, Yersinia pestis KIM
cguuagguucaau

SEQ ID NO: 4195836 - RNA, 13 nt, Yersinia pestis KIM
cguuauauaaaug

SEQ ID NO: 4195837 - RNA, 22 nt, Yersinia pestis KIM
cguuaucaaauacgaccgucac

SEQ ID NO: 4195838 - RNA, 18 nt, Yersinia pestis KIM
cguuaucggcgcaggcag

SEQ ID NO: 4195839 - RNA, 15 nt, Yersinia pestis KIM
cguuaugccaaccgg

SEQ ID NO: 4195840 - RNA, 15 nt, Yersinia pestis KIM
cguuauuaaacaguc

SEQ ID NO: 4195841 - RNA, 20 nt, Yersinia pestis KIM
cguuauuuuuguaacucaau

SEQ ID NO: 4195842 - RNA, 17 nt, Yersinia pestis KIM
cguucaagagugaguca

SEQ ID NO: 4195843 - RNA, 23 nt, Yersinia pestis KIM
cguucaaucgugcacccccuucg

SEQ ID NO: 4195844 - RNA, 19 nt, Yersinia pestis KIM
cguucacacgauuccucug

SEQ ID NO: 4195845 - RNA, 18 nt, Yersinia pestis KIM
cguucaccccccacccug

SEQ ID NO: 4195846 - RNA, 15 nt, Yersinia pestis KIM
cguucagcaauauga

SEQ ID NO: 4195847 - RNA, 21 nt, Yersinia pestis KIM
cguucagugcgauguuuucca

SEQ ID NO: 4195848 - RNA, 16 nt, Yersinia pestis KIM
cguuccaaucugcgcc

SEQ ID NO: 4195849 - RNA, 13 nt, Yersinia pestis KIM
cguuccagugguc

SEQ ID NO: 4195850 - RNA, 14 nt, Yersinia pestis KIM
cguucccacuucca

SEQ ID NO: 4195851 - RNA, 23 nt, Yersinia pestis KIM
cguucccgcaggcggccaaugac

SEQ ID NO: 4195852 - RNA, 12 nt, Yersinia pestis KIM
cguucccuguau

SEQ ID NO: 4195853 - RNA, 15 nt, Yersinia pestis KIM
cguuccuuggcugcc

SEQ ID NO: 4195854 - RNA, 21 nt, Yersinia pestis KIM
cguucguagccacgaucgaug

SEQ ID NO: 4195855 - RNA, 17 nt, Yersinia pestis KIM
cguucuaucaaugccuu

SEQ ID NO: 4195856 - RNA, 20 nt, Yersinia pestis KIM
cguucuaucaaugccuuggc

SEQ ID NO: 4195857 - RNA, 15 nt, Yersinia pestis KIM
cguucuccaguugcc

SEQ ID NO: 4195858 - RNA, 11 nt, Yersinia pestis KIM
cguucucuggc

SEQ ID NO: 4195859 - RNA, 15 nt, Yersinia pestis KIM
cguugaugcucuucu

SEQ ID NO: 4195860 - RNA, 13 nt, Yersinia pestis KIM
cuacacacagcaa

SEQ ID NO: 4195861 - RNA, 14 nt, Yersinia pestis KIM
cuacacacagcaau

SEQ ID NO: 4195862 - RNA, 14 nt, Yersinia pestis KIM
cuacagaaaaauaa

SEQ ID NO: 4195863 - RNA, 19 nt, Yersinia pestis KIM
cuacagcaaacaucgguaa

SEQ ID NO: 4195864 - RNA, 21 nt, Yersinia pestis KIM
cuacaggcgcaacugccaugg

SEQ ID NO: 4195865 - RNA, 18 nt, Yersinia pestis KIM
cuacauuuugggcaauuu

SEQ ID NO: 4195866 - RNA, 13 nt, Yersinia pestis KIM
cuaccaggaagcg

SEQ ID NO: 4195867 - RNA, 19 nt, Yersinia pestis KIM
cuaccaugagugaaaauau

SEQ ID NO: 4195868 - RNA, 21 nt, Yersinia pestis KIM
cuaccgacgauaaucaggcua

SEQ ID NO: 4195869 - RNA, 20 nt, Yersinia pestis KIM
cuaccggcauuggcugguaa

SEQ ID NO: 4195870 - RNA, 22 nt, Yersinia pestis KIM
cuaccggccauugauaccuuca

SEQ ID NO: 4195871 - RNA, 17 nt, Yersinia pestis KIM
cuaccguaucagccccu

SEQ ID NO: 4195872 - RNA, 12 nt, Yersinia pestis KIM
cuaccugaaugc

SEQ ID NO: 4195873 - RNA, 21 nt, Yersinia pestis KIM
cuaccugaaugcgccgcggcc

SEQ ID NO: 4195874 - RNA, 18 nt, Yersinia pestis KIM
cuaccuguaacauuacuu

SEQ ID NO: 4195875 - RNA, 19 nt, Yersinia pestis KIM
cuaccuugcuccgcaauuu

SEQ ID NO: 4195876 - RNA, 17 nt, Yersinia pestis KIM
cuaccuuuugcauauuu

SEQ ID NO: 4195877 - RNA, 19 nt, Yersinia pestis KIM
cuaccuuuugcauauuucu

SEQ ID NO: 4195878 - RNA, 17 nt, Yersinia pestis KIM
cuacgccgucaucaucu

SEQ ID NO: 4195879 - RNA, 23 nt, Yersinia pestis KIM
cuacgccgucaucaucuucuuca

SEQ ID NO: 4195880 - RNA, 22 nt, Yersinia pestis KIM
cuacgcuuucaggagugaauuu

SEQ ID NO: 4195881 - RNA, 18 nt, Yersinia pestis KIM
cuacggccuguaccacca

SEQ ID NO: 4195882 - RNA, 17 nt, Yersinia pestis KIM
cuacggcugaucugccc

SEQ ID NO: 4195883 - RNA, 18 nt, Yersinia pestis KIM
cuacggcugaucugcccc

SEQ ID NO: 4195884 - RNA, 21 nt, Yersinia pestis KIM
cuacggcugaucugccccugg

SEQ ID NO: 4195885 - RNA, 16 nt, Yersinia pestis KIM
cuacgggcaaacuccu

SEQ ID NO: 4195886 - RNA, 16 nt, Yersinia pestis KIM
cuacgguaauaaacag

SEQ ID NO: 4195887 - RNA, 13 nt, Yersinia pestis KIM
cuacguucgcuuu

SEQ ID NO: 4195888 - RNA, 23 nt, Yersinia pestis KIM
cuacguuguuaucaucaccaccc

SEQ ID NO: 4195889 - RNA, 16 nt, Yersinia pestis KIM
cuacucguaacgacga

SEQ ID NO: 4195890 - RNA, 23 nt, Yersinia pestis KIM
cuacugaaaagaguacgaacagu

SEQ ID NO: 4195891 - RNA, 22 nt, Yersinia pestis KIM
cuacugcaagccguaauucaga

SEQ ID NO: 4195892 - RNA, 19 nt, Yersinia pestis KIM
cuacugcguccuuugccca

SEQ ID NO: 4195893 - RNA, 20 nt, Yersinia pestis KIM
cuacuggcccgcccauaaau

SEQ ID NO: 4195894 - RNA, 21 nt, Yersinia pestis KIM
cuacuggcccgcccauaaauu

SEQ ID NO: 4195895 - RNA, 23 nt, Yersinia pestis KIM
cuacugggcuacccgacaccggc

SEQ ID NO: 4195896 - RNA, 14 nt, Yersinia pestis KIM
cuacugguagcagc

SEQ ID NO: 4195897 - RNA, 12 nt, Yersinia pestis KIM
cuacuuauuucc

SEQ ID NO: 4195898 - RNA, 14 nt, Yersinia pestis KIM
cuacuuauuuccgc

SEQ ID NO: 4195899 - RNA, 16 nt, Yersinia pestis KIM
cuacuuuggguauccu

SEQ ID NO: 4195900 - RNA, 22 nt, Yersinia pestis KIM
cuagaaauaaguugaaccauaa

SEQ ID NO: 4195901 - RNA, 16 nt, Yersinia pestis KIM
cuagaaauacuguugg

SEQ ID NO: 4195902 - RNA, 11 nt, Yersinia pestis KIM
cuagaaaucac

SEQ ID NO: 4195903 - RNA, 17 nt, Yersinia pestis KIM
cuagaacuauuggucaa

SEQ ID NO: 4195904 - RNA, 20 nt, Yersinia pestis KIM
cuagaauuugaucagccaga

SEQ ID NO: 4195905 - RNA, 18 nt, Yersinia pestis KIM
cuagacaguaaccgggcu

SEQ ID NO: 4195906 - RNA, 22 nt, Yersinia pestis KIM
cuagagcaugauggucaucaua

SEQ ID NO: 4195907 - RNA, 16 nt, Yersinia pestis KIM
cuagauagccauaaua

SEQ ID NO: 4195908 - RNA, 17 nt, Yersinia pestis KIM
cuagauauaaugguggg

SEQ ID NO: 4195909 - RNA, 12 nt, Yersinia pestis KIM
cuagcaaauucc

SEQ ID NO: 4195910 - RNA, 22 nt, Yersinia pestis KIM
cuagcaacaugguuaagagauc

SEQ ID NO: 4195911 - RNA, 17 nt, Yersinia pestis KIM
cuagccaccucacucag

SEQ ID NO: 4195912 - RNA, 18 nt, Yersinia pestis KIM
cuagccaccucacucagc

SEQ ID NO: 4195913 - RNA, 18 nt, Yersinia pestis KIM
cuagcucaagggcacagu

SEQ ID NO: 4195914 - RNA, 14 nt, Yersinia pestis KIM
cuagcucacggaag

SEQ ID NO: 4195915 - RNA, 17 nt, Yersinia pestis KIM
cuagggauuuuaagcag

SEQ ID NO: 4195916 - RNA, 17 nt, Yersinia pestis KIM
cuagggcuacugaccug

SEQ ID NO: 4195917 - RNA, 14 nt, Yersinia pestis KIM
cuaguagauaauca

SEQ ID NO: 4195918 - RNA, 18 nt, Yersinia pestis KIM
cuagucucacuaaaucaa

SEQ ID NO: 4195919 - RNA, 14 nt, Yersinia pestis KIM
cuagugccacaaca

SEQ ID NO: 4195920 - RNA, 20 nt, Yersinia pestis KIM
cuagugcgcugugcccuacu

SEQ ID NO: 4195921 - RNA, 20 nt, Yersinia pestis KIM
cuaguuaacccuaccuaggc

SEQ ID NO: 4195922 - RNA, 11 nt, Yersinia pestis KIM
cuauaaaaccg

SEQ ID NO: 4195923 - RNA, 20 nt, Yersinia pestis KIM
cuauaaacauuuacuuauaa

SEQ ID NO: 4195924 - RNA, 13 nt, Yersinia pestis KIM
cuauaaauuuuaa

SEQ ID NO: 4195925 - RNA, 17 nt, Yersinia pestis KIM
cuauaagcgcucaaaua

SEQ ID NO: 4195926 - RNA, 15 nt, Yersinia pestis KIM
cuauaaggcucuguu

SEQ ID NO: 4195927 - RNA, 16 nt, Yersinia pestis KIM
cuauaauuauuucucu

SEQ ID NO: 4195928 - RNA, 20 nt, Yersinia pestis KIM
cuauaauuucucucaauaua

SEQ ID NO: 4195929 - RNA, 14 nt, Yersinia pestis KIM
cuauagacaauacu

SEQ ID NO: 4195930 - RNA, 19 nt, Yersinia pestis KIM
cuauagacucaucuaauuu

SEQ ID NO: 4195931 - RNA, 22 nt, Yersinia pestis KIM
cuauauacccgucauaaauaaa

SEQ ID NO: 4195932 - RNA, 13 nt, Yersinia pestis KIM
cuauauauggaua

SEQ ID NO: 4195933 - RNA, 13 nt, Yersinia pestis KIM
cuauaugguaacg

SEQ ID NO: 4195934 - RNA, 15 nt, Yersinia pestis KIM
cuaucaacuuucacc

SEQ ID NO: 4195935 - RNA, 20 nt, Yersinia pestis KIM
cuaucaauugcuggcuauca

SEQ ID NO: 4195936 - RNA, 21 nt, Yersinia pestis KIM
cuaucaccccguuacggcugg

SEQ ID NO: 4195937 - RNA, 15 nt, Yersinia pestis KIM
cuaucacuagcgggc

SEQ ID NO: 4195938 - RNA, 16 nt, Yersinia pestis KIM
cuaucacuagcgggcc

SEQ ID NO: 4195939 - RNA, 17 nt, Yersinia pestis KIM
cuaucaggucaaucuua

SEQ ID NO: 4195940 - RNA, 13 nt, Yersinia pestis KIM
cuaucaucaccau

SEQ ID NO: 4195941 - RNA, 17 nt, Yersinia pestis KIM
cuaucaucaccauucaa

SEQ ID NO: 4195942 - RNA, 14 nt, Yersinia pestis KIM
cuaucauuaaaugg

SEQ ID NO: 4195943 - RNA, 16 nt, Yersinia pestis KIM
cuaucccuccccacug

SEQ ID NO: 4195944 - RNA, 19 nt, Yersinia pestis KIM
cuauccgaaaaauauucuc

SEQ ID NO: 4195945 - RNA, 22 nt, Yersinia pestis KIM
cuauccgaaaaauauucucaau

SEQ ID NO: 4195946 - RNA, 12 nt, Yersinia pestis KIM
cuauccgccccg

SEQ ID NO: 4195947 - RNA, 20 nt, Yersinia pestis KIM
cuauccucuuaaugucuuua

SEQ ID NO: 4195948 - RNA, 12 nt, Yersinia pestis KIM
cuauccuuugau

SEQ ID NO: 4195949 - RNA, 17 nt, Yersinia pestis KIM
cuaucgaacuauugaug

SEQ ID NO: 4195950 - RNA, 24 nt, Yersinia pestis KIM
cuaucgaguugauauaccgauuac

SEQ ID NO: 4195951 - RNA, 20 nt, Yersinia pestis KIM
cuaucgaugguuggcuauca

SEQ ID NO: 4195952 - RNA, 15 nt, Yersinia pestis KIM
cuaucgcacguugca

SEQ ID NO: 4195953 - RNA, 16 nt, Yersinia pestis KIM
cuaucggguaacggcu

SEQ ID NO: 4195954 - RNA, 18 nt, Yersinia pestis KIM
cuaucgguaucucccgca

SEQ ID NO: 4195955 - RNA, 21 nt, Yersinia pestis KIM
cuaucuauuuuuauuucuccu

SEQ ID NO: 4195956 - RNA, 17 nt, Yersinia pestis KIM
cuaucugguuuaaauuc

SEQ ID NO: 4195957 - RNA, 14 nt, Yersinia pestis KIM
cuaucuguucaccg

SEQ ID NO: 4195958 - RNA, 16 nt, Yersinia pestis KIM
cuaucuuaaaaauaac

SEQ ID NO: 4195959 - RNA, 18 nt, Yersinia pestis KIM
cuaucuuuucgauagcca

SEQ ID NO: 4195960 - RNA, 18 nt, Yersinia pestis KIM
cuaugcacccauagcuca

SEQ ID NO: 4195961 - RNA, 22 nt, Yersinia pestis KIM
cuaugcccaguuuaccauccac

SEQ ID NO: 4195962 - RNA, 13 nt, Yersinia pestis KIM
cuaugcuaacucg

SEQ ID NO: 4195963 - RNA, 13 nt, Yersinia pestis KIM
cuauggauaaauc

SEQ ID NO: 4195964 - RNA, 19 nt, Yersinia pestis KIM
cuauggauuacuuacggcc

SEQ ID NO: 4195965 - RNA, 18 nt, Yersinia pestis KIM
cuauggcgguuccaaagc

SEQ ID NO: 4195966 - RNA, 23 nt, Yersinia pestis KIM
cuauggcgguuccaaagcaccaa

SEQ ID NO: 4195967 - RNA, 15 nt, Yersinia pestis KIM
cuaugggauaaacuu

SEQ ID NO: 4195968 - RNA, 22 nt, Yersinia pestis KIM
cuaugugaaugcagucagcacu

SEQ ID NO: 4195969 - RNA, 21 nt, Yersinia pestis KIM
cuauuaauauaccaacucuga

SEQ ID NO: 4195970 - RNA, 11 nt, Yersinia pestis KIM
cuauuaauauc

SEQ ID NO: 4195971 - RNA, 23 nt, Yersinia pestis KIM
cuauuagccagaaauagcaccau

SEQ ID NO: 4195972 - RNA, 16 nt, Yersinia pestis KIM
cuauuaucuuuuaaaa

SEQ ID NO: 4195973 - RNA, 19 nt, Yersinia pestis KIM
cuauucaaugacuccugaa

SEQ ID NO: 4195974 - RNA, 18 nt, Yersinia pestis KIM
cuauucacuauuuauuaa

SEQ ID NO: 4195975 - RNA, 13 nt, Yersinia pestis KIM
cucaggcucauca

SEQ ID NO: 4195976 - RNA, 15 nt, Yersinia pestis KIM
cucaggcucaucacc

SEQ ID NO: 4195977 - RNA, 19 nt, Yersinia pestis KIM
cucagggcgcuuaugcccu

SEQ ID NO: 4195978 - RNA, 22 nt, Yersinia pestis KIM
cucaguaaaagcggguuaccag

SEQ ID NO: 4195979 - RNA, 17 nt, Yersinia pestis KIM
cucaguaccugaagcua

SEQ ID NO: 4195980 - RNA, 15 nt, Yersinia pestis KIM
cucaguaucuuucca

SEQ ID NO: 4195981 - RNA, 16 nt, Yersinia pestis KIM
cucaguaucuuuccag

SEQ ID NO: 4195982 - RNA, 21 nt, Yersinia pestis KIM
cucaguaucuuuccagccaau

SEQ ID NO: 4195983 - RNA, 17 nt, Yersinia pestis KIM
cucagucaucgcuaacc

SEQ ID NO: 4195984 - RNA, 21 nt, Yersinia pestis KIM
cucaguuaaacgguaaccauc

SEQ ID NO: 4195985 - RNA, 17 nt, Yersinia pestis KIM
cucaguuaucagggccu

SEQ ID NO: 4195986 - RNA, 15 nt, Yersinia pestis KIM
cucaguucagccccc

SEQ ID NO: 4195987 - RNA, 13 nt, Yersinia pestis KIM
cucaguugaaacc

SEQ ID NO: 4195988 - RNA, 15 nt, Yersinia pestis KIM
cucaguugaugcaaa

SEQ ID NO: 4195989 - RNA, 13 nt, Yersinia pestis KIM
cucauauaaucau

SEQ ID NO: 4195990 - RNA, 17 nt, Yersinia pestis KIM
cucauaugcagcaucca

SEQ ID NO: 4195991 - RNA, 20 nt, Yersinia pestis KIM
cucauauucaaaaucugaua

SEQ ID NO: 4195992 - RNA, 16 nt, Yersinia pestis KIM
cucauauuguccaaag

SEQ ID NO: 4195993 - RNA, 17 nt, Yersinia pestis KIM
cucauauuguccaaagg

SEQ ID NO: 4195994 - RNA, 22 nt, Yersinia pestis KIM
cucauauuguccaaaggaaggg

SEQ ID NO: 4195995 - RNA, 14 nt, Yersinia pestis KIM
cucaucaaaacaau

SEQ ID NO: 4195996 - RNA, 14 nt, Yersinia pestis KIM
cucaucaaccucag

SEQ ID NO: 4195997 - RNA, 16 nt, Yersinia pestis KIM
cucaucaaccucagcc

SEQ ID NO: 4195998 - RNA, 16 nt, Yersinia pestis KIM
cucaucaacuucugca

SEQ ID NO: 4195999 - RNA, 18 nt, Yersinia pestis KIM
cucaucaccaaaaugaca

SEQ ID NO: 4196000 - RNA, 15 nt, Yersinia pestis KIM
cucaucaccuuccaa

SEQ ID NO: 4196001 - RNA, 22 nt, Yersinia pestis KIM
cucaucaguaacgccugauuca

SEQ ID NO: 4196002 - RNA, 18 nt, Yersinia pestis KIM
cucaucaguuggucuuua

SEQ ID NO: 4196003 - RNA, 16 nt, Yersinia pestis KIM
cucauccgccaagauu

SEQ ID NO: 4196004 - RNA, 15 nt, Yersinia pestis KIM
cucauccguaaaaaa

SEQ ID NO: 4196005 - RNA, 20 nt, Yersinia pestis KIM
cucauccguuuuaacgcugc

SEQ ID NO: 4196006 - RNA, 23 nt, Yersinia pestis KIM
cucaucgaaauucccguuuuauu

SEQ ID NO: 4196007 - RNA, 12 nt, Yersinia pestis KIM
cucaucgccaaa

SEQ ID NO: 4196008 - RNA, 14 nt, Yersinia pestis KIM
cucaucggcguuac

SEQ ID NO: 4196009 - RNA, 20 nt, Yersinia pestis KIM
cucaucggcguuacaguaag

SEQ ID NO: 4196010 - RNA, 18 nt, Yersinia pestis KIM
cucaucggguaaaaucau

SEQ ID NO: 4196011 - RNA, 22 nt, Yersinia pestis KIM
cucaucgguaacuuacaggcug

SEQ ID NO: 4196012 - RNA, 20 nt, Yersinia pestis KIM
cucaucuggcguucuacugc

SEQ ID NO: 4196013 - RNA, 14 nt, Yersinia pestis KIM
cucaugaaugaggc

SEQ ID NO: 4196014 - RNA, 16 nt, Yersinia pestis KIM
cucaugaaugaggcug

SEQ ID NO: 4196015 - RNA, 17 nt, Yersinia pestis KIM
cucaugaaugaggcuga

SEQ ID NO: 4196016 - RNA, 20 nt, Yersinia pestis KIM
cucaugaaugaggcugaggu

SEQ ID NO: 4196017 - RNA, 12 nt, Yersinia pestis KIM
cucaugacaaaa

SEQ ID NO: 4196018 - RNA, 13 nt, Yersinia pestis KIM
cucaugccccaau

SEQ ID NO: 4196019 - RNA, 14 nt, Yersinia pestis KIM
cucauuaauaauga

SEQ ID NO: 4196020 - RNA, 20 nt, Yersinia pestis KIM
cucauuaaucagcauuaacc

SEQ ID NO: 4196021 - RNA, 13 nt, Yersinia pestis KIM
cucauucaugagg

SEQ ID NO: 4196022 - RNA, 14 nt, Yersinia pestis KIM
cucauucaugaggc

SEQ ID NO: 4196023 - RNA, 16 nt, Yersinia pestis KIM
cucauucaugaggcuc

SEQ ID NO: 4196024 - RNA, 17 nt, Yersinia pestis KIM
cucauucaugaggcuca

SEQ ID NO: 4196025 - RNA, 16 nt, Yersinia pestis KIM
cucauucaugaggcuu

SEQ ID NO: 4196026 - RNA, 18 nt, Yersinia pestis KIM
cucauucaugaggcuucu

SEQ ID NO: 4196027 - RNA, 19 nt, Yersinia pestis KIM
cucauugccuggcccaucu

SEQ ID NO: 4196028 - RNA, 16 nt, Yersinia pestis KIM
cucauugguucacuga

SEQ ID NO: 4196029 - RNA, 14 nt, Yersinia pestis KIM
cucauuuaaaauac

SEQ ID NO: 4196030 - RNA, 20 nt, Yersinia pestis KIM
cucauuuaaaauacucauuu

SEQ ID NO: 4196031 - RNA, 15 nt, Yersinia pestis KIM
cucauuuaucuaaaa

SEQ ID NO: 4196032 - RNA, 22 nt, Yersinia pestis KIM
cucauuugaccuccguaggcca

SEQ ID NO: 4196033 - RNA, 13 nt, Yersinia pestis KIM
cucauuuuuugcg

SEQ ID NO: 4196034 - RNA, 20 nt, Yersinia pestis KIM
cuccaagcacacugguugaa

SEQ ID NO: 4196035 - RNA, 18 nt, Yersinia pestis KIM
cuccacaccuccgcccuc

SEQ ID NO: 4196036 - RNA, 20 nt, Yersinia pestis KIM
cuccacacguguacucauau

SEQ ID NO: 4196037 - RNA, 21 nt, Yersinia pestis KIM
cuccaccaacggcccaauauu

SEQ ID NO: 4196038 - RNA, 12 nt, Yersinia pestis KIM
cuccagaagcau

SEQ ID NO: 4196039 - RNA, 14 nt, Yersinia pestis KIM
cuccagaagcauau

SEQ ID NO: 4196040 - RNA, 13 nt, Yersinia pestis KIM
cuccaggcauuaa

SEQ ID NO: 4196041 - RNA, 18 nt, Yersinia pestis KIM
cuccaggcauuaaaauca

SEQ ID NO: 4196042 - RNA, 20 nt, Yersinia pestis KIM
cuccaggcauuaaaaucacc

SEQ ID NO: 4196043 - RNA, 21 nt, Yersinia pestis KIM
cuccaguaagccugaugccuu

SEQ ID NO: 4196044 - RNA, 13 nt, Yersinia pestis KIM
cuccaguucgacu

SEQ ID NO: 4196045 - RNA, 17 nt, Yersinia pestis KIM
cuccaguugauacagga

SEQ ID NO: 4196046 - RNA, 22 nt, Yersinia pestis KIM
cuccaguugcacaccaucagua

SEQ ID NO: 4196047 - RNA, 15 nt, Yersinia pestis KIM
cuccaguugccagca

SEQ ID NO: 4196048 - RNA, 18 nt, Yersinia pestis KIM
cuccaguugccagcaggc

SEQ ID NO: 4196049 - RNA, 17 nt, Yersinia pestis KIM
cuccaucgccacuucua

SEQ ID NO: 4196050 - RNA, 17 nt, Yersinia pestis KIM
cuccauuuuuuugaugc

SEQ ID NO: 4196051 - RNA, 13 nt, Yersinia pestis KIM
cucccauuaauua

SEQ ID NO: 4196052 - RNA, 14 nt, Yersinia pestis KIM
cucccauuuauuac

SEQ ID NO: 4196053 - RNA, 17 nt, Yersinia pestis KIM
cucccccacucgcccca

SEQ ID NO: 4196054 - RNA, 12 nt, Yersinia pestis KIM
cuccccuguaac

SEQ ID NO: 4196055 - RNA, 14 nt, Yersinia pestis KIM
cucccgcuaacgca

SEQ ID NO: 4196056 - RNA, 15 nt, Yersinia pestis KIM
cucccgcuaacgcac

SEQ ID NO: 4196057 - RNA, 15 nt, Yersinia pestis KIM
cucccucauuuauau

SEQ ID NO: 4196058 - RNA, 14 nt, Yersinia pestis KIM
cucccugacucccu

SEQ ID NO: 4196059 - RNA, 16 nt, Yersinia pestis KIM
cucccugacucccuga

SEQ ID NO: 4196060 - RNA, 20 nt, Yersinia pestis KIM
cucccugacucccugacucc

SEQ ID NO: 4196061 - RNA, 20 nt, Yersinia pestis KIM
cucccuguuacgguauuuga

SEQ ID NO: 4196062 - RNA, 16 nt, Yersinia pestis KIM
cuccgcacuuggcccc

SEQ ID NO: 4196063 - RNA, 15 nt, Yersinia pestis KIM
cuccgcggugcuuuu

SEQ ID NO: 4196064 - RNA, 23 nt, Yersinia pestis KIM
cuccggcgacuaagacuguuuua

SEQ ID NO: 4196065 - RNA, 21 nt, Yersinia pestis KIM
cuccggcgcccuucccauuua

SEQ ID NO: 4196066 - RNA, 17 nt, Yersinia pestis KIM
cuccggcggcuucauca

SEQ ID NO: 4196067 - RNA, 22 nt, Yersinia pestis KIM
cuccgguaauccuuguaagacc

SEQ ID NO: 4196068 - RNA, 22 nt, Yersinia pestis KIM
cuccggugguuucgccgccaau

SEQ ID NO: 4196069 - RNA, 16 nt, Yersinia pestis KIM
cuccguugcaggcacu

SEQ ID NO: 4196070 - RNA, 17 nt, Yersinia pestis KIM
cuccguugcaggcacuu

SEQ ID NO: 4196071 - RNA, 17 nt, Yersinia pestis KIM
cuccucagccuuuuuug

SEQ ID NO: 4196072 - RNA, 18 nt, Yersinia pestis KIM
cuccucucucuggggagg

SEQ ID NO: 4196073 - RNA, 23 nt, Yersinia pestis KIM
cuccucuuuauacauauguugag

SEQ ID NO: 4196074 - RNA, 13 nt, Yersinia pestis KIM
cuccugaggguga

SEQ ID NO: 4196075 - RNA, 18 nt, Yersinia pestis KIM
cuccugagggugaugaca

SEQ ID NO: 4196076 - RNA, 18 nt, Yersinia pestis KIM
cuccugaucuucauugcc

SEQ ID NO: 4196077 - RNA, 22 nt, Yersinia pestis KIM
cuccugaucuucauugccuucu

SEQ ID NO: 4196078 - RNA, 17 nt, Yersinia pestis KIM
cuccugaugacucaucu

SEQ ID NO: 4196079 - RNA, 13 nt, Yersinia pestis KIM
cuccugauuuaac

SEQ ID NO: 4196080 - RNA, 22 nt, Yersinia pestis KIM
cuccugccacagacuuucuuua

SEQ ID NO: 4196081 - RNA, 18 nt, Yersinia pestis KIM
cuccugccuacgcuggcg

SEQ ID NO: 4196082 - RNA, 18 nt, Yersinia pestis KIM
cuccuuauacuaaagaaa

SEQ ID NO: 4196083 - RNA, 14 nt, Yersinia pestis KIM
cuccuugaaguguu

SEQ ID NO: 4196084 - RNA, 20 nt, Yersinia pestis KIM
cuccuuuaccuacaaccugg

SEQ ID NO: 4196085 - RNA, 13 nt, Yersinia pestis KIM
cuccuuugauuug

SEQ ID NO: 4196086 - RNA, 14 nt, Yersinia pestis KIM
cucgaacaaccggu

SEQ ID NO: 4196087 - RNA, 18 nt, Yersinia pestis KIM
cucgaacgcuuguggaaa

SEQ ID NO: 4196088 - RNA, 21 nt, Yersinia pestis KIM
cucgaauaaacggauuugucu

SEQ ID NO: 4196089 - RNA, 16 nt, Yersinia pestis KIM
cucgacuaaacgccca

SEQ ID NO: 4196090 - RNA, 18 nt, Yersinia pestis KIM
cugaacccugacggccag

SEQ ID NO: 4196091 - RNA, 15 nt, Yersinia pestis KIM
cugaacgaccagaau

SEQ ID NO: 4196092 - RNA, 18 nt, Yersinia pestis KIM
cugaacgaggacuuccug

SEQ ID NO: 4196093 - RNA, 23 nt, Yersinia pestis KIM
cugaacguaaaacaaucaccacc

SEQ ID NO: 4196094 - RNA, 15 nt, Yersinia pestis KIM
cugaacguauauugg

SEQ ID NO: 4196095 - RNA, 18 nt, Yersinia pestis KIM
cugaacguauauuggccu

SEQ ID NO: 4196096 - RNA, 19 nt, Yersinia pestis KIM
cugaacugcacauacucac

SEQ ID NO: 4196097 - RNA, 19 nt, Yersinia pestis KIM
cugaacuucugggaucauc

SEQ ID NO: 4196098 - RNA, 22 nt, Yersinia pestis KIM
cugaacuucugggaucaucgcu

SEQ ID NO: 4196099 - RNA, 14 nt, Yersinia pestis KIM
cugaagacccaagg

SEQ ID NO: 4196100 - RNA, 20 nt, Yersinia pestis KIM
cugaagagaaauaacccaua

SEQ ID NO: 4196101 - RNA, 20 nt, Yersinia pestis KIM
cugaagaugccaaucaaaaa

SEQ ID NO: 4196102 - RNA, 13 nt, Yersinia pestis KIM
cugaagccagcac

SEQ ID NO: 4196103 - RNA, 16 nt, Yersinia pestis KIM
cugaagccagcaccgg

SEQ ID NO: 4196104 - RNA, 19 nt, Yersinia pestis KIM
cugaagcgacacuuauugg

SEQ ID NO: 4196105 - RNA, 21 nt, Yersinia pestis KIM
cugaaggguauugaagauacc

SEQ ID NO: 4196106 - RNA, 13 nt, Yersinia pestis KIM
cugaaguuaaaaa

SEQ ID NO: 4196107 - RNA, 19 nt, Yersinia pestis KIM
cugaauaaaaaauuauuaa

SEQ ID NO: 4196108 - RNA, 22 nt, Yersinia pestis KIM
cugaauaaaaaauuauuaaaua

SEQ ID NO: 4196109 - RNA, 23 nt, Yersinia pestis KIM
cugaauaaaaaauuauuaaauaa

SEQ ID NO: 4196110 - RNA, 12 nt, Yersinia pestis KIM
cugaauaaacac

SEQ ID NO: 4196111 - RNA, 21 nt, Yersinia pestis KIM
cugaauaaacggcaagcggug

SEQ ID NO: 4196112 - RNA, 21 nt, Yersinia pestis KIM
cugaauaacguggaaaaaacg

SEQ ID NO: 4196113 - RNA, 15 nt, Yersinia pestis KIM
cugaauaauacuguc

SEQ ID NO: 4196114 - RNA, 11 nt, Yersinia pestis KIM
cugaauaccau

SEQ ID NO: 4196115 - RNA, 18 nt, Yersinia pestis KIM
cugaauaccggccugauu

SEQ ID NO: 4196116 - RNA, 19 nt, Yersinia pestis KIM
cugaauaucaucuuuuucu

SEQ ID NO: 4196117 - RNA, 20 nt, Yersinia pestis KIM
cugaauaucaucuuuuucug

SEQ ID NO: 4196118 - RNA, 20 nt, Yersinia pestis KIM
cugaaucacaggccacugca

SEQ ID NO: 4196119 - RNA, 16 nt, Yersinia pestis KIM
cugaauccccucaaaa

SEQ ID NO: 4196120 - RNA, 17 nt, Yersinia pestis KIM
cugaaucguacuucuua

SEQ ID NO: 4196121 - RNA, 18 nt, Yersinia pestis KIM
cugaaucuguaagucauu

SEQ ID NO: 4196122 - RNA, 15 nt, Yersinia pestis KIM
cugaaugccauucaa

SEQ ID NO: 4196123 - RNA, 16 nt, Yersinia pestis KIM
cugaauggaucacauc

SEQ ID NO: 4196124 - RNA, 19 nt, Yersinia pestis KIM
cugaauggaucacaucaca

SEQ ID NO: 4196125 - RNA, 22 nt, Yersinia pestis KIM
cugaauggaucacaucacagug

SEQ ID NO: 4196126 - RNA, 18 nt, Yersinia pestis KIM
cugaauggcuauuuacuc

SEQ ID NO: 4196127 - RNA, 23 nt, Yersinia pestis KIM
cugaaugguuuuagucauuugcu

SEQ ID NO: 4196128 - RNA, 15 nt, Yersinia pestis KIM
cugaaugugaagagc

SEQ ID NO: 4196129 - RNA, 16 nt, Yersinia pestis KIM
cugaauugauuuauuc

SEQ ID NO: 4196130 - RNA, 18 nt, Yersinia pestis KIM
cugaauugauuuauuccu

SEQ ID NO: 4196131 - RNA, 20 nt, Yersinia pestis KIM
cugaauugcuuauccagccg

SEQ ID NO: 4196132 - RNA, 21 nt, Yersinia pestis KIM
cugaauugcuuauccagccgc

SEQ ID NO: 4196133 - RNA, 16 nt, Yersinia pestis KIM
cugaauuggaagagcc

SEQ ID NO: 4196134 - RNA, 12 nt, Yersinia pestis KIM
cugaauuucaau

SEQ ID NO: 4196135 - RNA, 21 nt, Yersinia pestis KIM
cugaauuugugcuacggcaaa

SEQ ID NO: 4196136 - RNA, 16 nt, Yersinia pestis KIM
cugacaaaaugccaga

SEQ ID NO: 4196137 - RNA, 12 nt, Yersinia pestis KIM
cugacaaacccc

SEQ ID NO: 4196138 - RNA, 20 nt, Yersinia pestis KIM
cugacacaacacauuacugc

SEQ ID NO: 4196139 - RNA, 16 nt, Yersinia pestis KIM
cugacacacaccagug

SEQ ID NO: 4196140 - RNA, 17 nt, Yersinia pestis KIM
cugacaccggauaugcc

SEQ ID NO: 4196141 - RNA, 21 nt, Yersinia pestis KIM
cugacaccggggauccauagg

SEQ ID NO: 4196142 - RNA, 20 nt, Yersinia pestis KIM
cugacacuggcguuuucugc

SEQ ID NO: 4196143 - RNA, 17 nt, Yersinia pestis KIM
cugacagccugugccca

SEQ ID NO: 4196144 - RNA, 18 nt, Yersinia pestis KIM
cugacagcggucgguauu

SEQ ID NO: 4196145 - RNA, 19 nt, Yersinia pestis KIM
cugacauaagguuucauuu

SEQ ID NO: 4196146 - RNA, 23 nt, Yersinia pestis KIM
cugacauuugcaucuauggauua

SEQ ID NO: 4196147 - RNA, 13 nt, Yersinia pestis KIM
cugaccaaacauu

SEQ ID NO: 4196148 - RNA, 20 nt, Yersinia pestis KIM
cugaccaaacauugucaccu

SEQ ID NO: 4196149 - RNA, 14 nt, Yersinia pestis KIM
cugaccacaaaaac

SEQ ID NO: 4196150 - RNA, 17 nt, Yersinia pestis KIM
cugaccacaaaaacagu

SEQ ID NO: 4196151 - RNA, 19 nt, Yersinia pestis KIM
cugaccauuacguaauagu

SEQ ID NO: 4196152 - RNA, 14 nt, Yersinia pestis KIM
cugaccguuaucau

SEQ ID NO: 4196153 - RNA, 14 nt, Yersinia pestis KIM
cugaccuaaaccgc

SEQ ID NO: 4196154 - RNA, 21 nt, Yersinia pestis KIM
cugaccuguuguaacacuuga

SEQ ID NO: 4196155 - RNA, 13 nt, Yersinia pestis KIM
cugacgaaaugcc

SEQ ID NO: 4196156 - RNA, 15 nt, Yersinia pestis KIM
cugacgaaaugccgc

SEQ ID NO: 4196157 - RNA, 13 nt, Yersinia pestis KIM
cugacgcagcagg

SEQ ID NO: 4196158 - RNA, 18 nt, Yersinia pestis KIM
cugacgccaugcucagaa

SEQ ID NO: 4196159 - RNA, 22 nt, Yersinia pestis KIM
cugacggauacgcaaaccaugg

SEQ ID NO: 4196160 - RNA, 16 nt, Yersinia pestis KIM
cugacggguauaucac

SEQ ID NO: 4196161 - RNA, 16 nt, Yersinia pestis KIM
cugacgguuucaacau

SEQ ID NO: 4196162 - RNA, 17 nt, Yersinia pestis KIM
cugacguaguguauuca

SEQ ID NO: 4196163 - RNA, 21 nt, Yersinia pestis KIM
cugacuaacucuucuggcaaa

SEQ ID NO: 4196164 - RNA, 18 nt, Yersinia pestis KIM
cugacucacguauuuuca

SEQ ID NO: 4196165 - RNA, 15 nt, Yersinia pestis KIM
cugacucccucaccg

SEQ ID NO: 4196166 - RNA, 14 nt, Yersinia pestis KIM
cugacucccugacu

SEQ ID NO: 4196167 - RNA, 16 nt, Yersinia pestis KIM
cugacucccugacucc

SEQ ID NO: 4196168 - RNA, 20 nt, Yersinia pestis KIM
cugacucccugacucccuga

SEQ ID NO: 4196169 - RNA, 21 nt, Yersinia pestis KIM
cugacugagugccagcaaaga

SEQ ID NO: 4196170 - RNA, 15 nt, Yersinia pestis KIM
cugacugcuuuuaau

SEQ ID NO: 4196171 - RNA, 19 nt, Yersinia pestis KIM
cugacugguucacaccaaa

SEQ ID NO: 4196172 - RNA, 14 nt, Yersinia pestis KIM
cugacuguuuugcu

SEQ ID NO: 4196173 - RNA, 15 nt, Yersinia pestis KIM
cugacuguuuugcua

SEQ ID NO: 4196174 - RNA, 12 nt, Yersinia pestis KIM
cugacuugcagg

SEQ ID NO: 4196175 - RNA, 12 nt, Yersinia pestis KIM
cugagaacccau

SEQ ID NO: 4196176 - RNA, 14 nt, Yersinia pestis KIM
cugagaaucaaaaa

SEQ ID NO: 4196177 - RNA, 22 nt, Yersinia pestis KIM
cugagauagauaagggcgcaga

SEQ ID NO: 4196178 - RNA, 20 nt, Yersinia pestis KIM
cugagaucaucgggcauuca

SEQ ID NO: 4196179 - RNA, 21 nt, Yersinia pestis KIM
cugagauuauugggcugccug

SEQ ID NO: 4196180 - RNA, 12 nt, Yersinia pestis KIM
cugagcaccaga

SEQ ID NO: 4196181 - RNA, 17 nt, Yersinia pestis KIM
cugagcaccgcaggaac

SEQ ID NO: 4196182 - RNA, 20 nt, Yersinia pestis KIM
cugagcagcaaacgccucgu

SEQ ID NO: 4196183 - RNA, 22 nt, Yersinia pestis KIM
cugagccucaugaaugaggcug

SEQ ID NO: 4196184 - RNA, 15 nt, Yersinia pestis KIM
cugagcgaacugaau

SEQ ID NO: 4196185 - RNA, 19 nt, Yersinia pestis KIM
cugagcgaacugaaugcgu

SEQ ID NO: 4196186 - RNA, 18 nt, Yersinia pestis KIM
cugagcgcuuuaaccaaa

SEQ ID NO: 4196187 - RNA, 22 nt, Yersinia pestis KIM
cugagcguccgucauccaauga

SEQ ID NO: 4196188 - RNA, 21 nt, Yersinia pestis KIM
cugagcuguaaauauaaaaua

SEQ ID NO: 4196189 - RNA, 22 nt, Yersinia pestis KIM
cugagcuuauagaacggcagug

SEQ ID NO: 4196190 - RNA, 22 nt, Yersinia pestis KIM
cugaggacggaugguaaagcag

SEQ ID NO: 4196191 - RNA, 15 nt, Yersinia pestis KIM
cugaggauaaaaacu

SEQ ID NO: 4196192 - RNA, 19 nt, Yersinia pestis KIM
cugaggcagaauggugcca

SEQ ID NO: 4196193 - RNA, 23 nt, Yersinia pestis KIM
cugaggccaacacucaugacaaa

SEQ ID NO: 4196194 - RNA, 15 nt, Yersinia pestis KIM
cugaggcguggcaca

SEQ ID NO: 4196195 - RNA, 13 nt, Yersinia pestis KIM
cugagggccacuu

SEQ ID NO: 4196196 - RNA, 21 nt, Yersinia pestis KIM
cugaggguuagcgaugacuga

SEQ ID NO: 4196197 - RNA, 18 nt, Yersinia pestis KIM
cugagguggcacccagug

SEQ ID NO: 4196198 - RNA, 23 nt, Yersinia pestis KIM
cugagguucccaacggcagaagu

SEQ ID NO: 4196199 - RNA, 16 nt, Yersinia pestis KIM
cugagguugcucagcg

SEQ ID NO: 4196200 - RNA, 18 nt, Yersinia pestis KIM
cugaguaaagcccagcag

SEQ ID NO: 4196201 - RNA, 22 nt, Yersinia pestis KIM
cugaguaaagcccagcaggcug

SEQ ID NO: 4196202 - RNA, 17 nt, Yersinia pestis KIM
cugagucaguaauucac

SEQ ID NO: 4196203 - RNA, 14 nt, Yersinia pestis KIM
cugagucagucagg

SEQ ID NO: 4196204 - RNA, 20 nt, Yersinia pestis KIM
cugccgucuaucugccagau

SEQ ID NO: 4196205 - RNA, 22 nt, Yersinia pestis KIM
cugccguuucaguaaaaccagc

SEQ ID NO: 4196206 - RNA, 14 nt, Yersinia pestis KIM
cugccuaccugcaa

SEQ ID NO: 4196207 - RNA, 12 nt, Yersinia pestis KIM
cugccuauccuc

SEQ ID NO: 4196208 - RNA, 13 nt, Yersinia pestis KIM
cugccuauccuca

SEQ ID NO: 4196209 - RNA, 15 nt, Yersinia pestis KIM
cugccuauccucacc

SEQ ID NO: 4196210 - RNA, 17 nt, Yersinia pestis KIM
cugccuauccucaccgu

SEQ ID NO: 4196211 - RNA, 14 nt, Yersinia pestis KIM
cugccuauuuaucg

SEQ ID NO: 4196212 - RNA, 14 nt, Yersinia pestis KIM
cugccugagguucc

SEQ ID NO: 4196213 - RNA, 19 nt, Yersinia pestis KIM
cugccugcaccagugccaa

SEQ ID NO: 4196214 - RNA, 11 nt, Yersinia pestis KIM
cugccugugcg

SEQ ID NO: 4196215 - RNA, 15 nt, Yersinia pestis KIM
cugccugugcggcag

SEQ ID NO: 4196216 - RNA, 16 nt, Yersinia pestis KIM
cugccugugcggcagu

SEQ ID NO: 4196217 - RNA, 15 nt, Yersinia pestis KIM
cugccuguucucucc

SEQ ID NO: 4196218 - RNA, 19 nt, Yersinia pestis KIM
cugccuuuuuugauaauca

SEQ ID NO: 4196219 - RNA, 15 nt, Yersinia pestis KIM
cugcgaccaaggcuc

SEQ ID NO: 4196220 - RNA, 15 nt, Yersinia pestis KIM
cugcgaggccgcugc

SEQ ID NO: 4196221 - RNA, 20 nt, Yersinia pestis KIM
cugcgauuuaugaaccguca

SEQ ID NO: 4196222 - RNA, 14 nt, Yersinia pestis KIM
cugcgccagcagca

SEQ ID NO: 4196223 - RNA, 18 nt, Yersinia pestis KIM
cugcgccauaugccauga

SEQ ID NO: 4196224 - RNA, 23 nt, Yersinia pestis KIM
cugcgcccaaaucugcccccagc

SEQ ID NO: 4196225 - RNA, 22 nt, Yersinia pestis KIM
cugcgcccuuaucuaucucagg

SEQ ID NO: 4196226 - RNA, 13 nt, Yersinia pestis KIM
cugcgccugcgcu

SEQ ID NO: 4196227 - RNA, 23 nt, Yersinia pestis KIM
cugcgcgacaaaaccgauggcuu

SEQ ID NO: 4196228 - RNA, 19 nt, Yersinia pestis KIM
cugcgcggaaaaaaggauu

SEQ ID NO: 4196229 - RNA, 19 nt, Yersinia pestis KIM
cugcgcuaaacggcccugu

SEQ ID NO: 4196230 - RNA, 20 nt, Yersinia pestis KIM
cugcggauaaacacuguuua

SEQ ID NO: 4196231 - RNA, 17 nt, Yersinia pestis KIM
cugcggcgucugauaac

SEQ ID NO: 4196232 - RNA, 12 nt, Yersinia pestis KIM
cugcgggcacua

SEQ ID NO: 4196233 - RNA, 20 nt, Yersinia pestis KIM
cugcgguuuguuugcaucug

SEQ ID NO: 4196234 - RNA, 22 nt, Yersinia pestis KIM
cugcgugaaacgauaugcucca

SEQ ID NO: 4196235 - RNA, 14 nt, Yersinia pestis KIM
cugcguucuucuug

SEQ ID NO: 4196236 - RNA, 22 nt, Yersinia pestis KIM
cugcguuuuucccuguagaaca

SEQ ID NO: 4196237 - RNA, 18 nt, Yersinia pestis KIM
cugcuaacacgaccuuca

SEQ ID NO: 4196238 - RNA, 12 nt, Yersinia pestis KIM
cugcuaauuaaa

SEQ ID NO: 4196239 - RNA, 15 nt, Yersinia pestis KIM
cugcuaauuaaaccu

SEQ ID NO: 4196240 - RNA, 19 nt, Yersinia pestis KIM
cugcuaauuaaaccugacu

SEQ ID NO: 4196241 - RNA, 21 nt, Yersinia pestis KIM
cugcuagcaaauuccgcuucu

SEQ ID NO: 4196242 - RNA, 16 nt, Yersinia pestis KIM
cugcuaucaugauaaa

SEQ ID NO: 4196243 - RNA, 14 nt, Yersinia pestis KIM
cugcucaacugcuc

SEQ ID NO: 4196244 - RNA, 16 nt, Yersinia pestis KIM
cugcucaacugcucaa

SEQ ID NO: 4196245 - RNA, 17 nt, Yersinia pestis KIM
cugcucaacugcucaac

SEQ ID NO: 4196246 - RNA, 20 nt, Yersinia pestis KIM
cugcucaacugcucaacgcc

SEQ ID NO: 4196247 - RNA, 13 nt, Yersinia pestis KIM
cugcucacgcaaa

SEQ ID NO: 4196248 - RNA, 16 nt, Yersinia pestis KIM
cugcucacgcaaauaa

SEQ ID NO: 4196249 - RNA, 14 nt, Yersinia pestis KIM
cugcucauaaagca

SEQ ID NO: 4196250 - RNA, 15 nt, Yersinia pestis KIM
cugcucauaaagcau

SEQ ID NO: 4196251 - RNA, 17 nt, Yersinia pestis KIM
cugcuccaaagcuucca

SEQ ID NO: 4196252 - RNA, 12 nt, Yersinia pestis KIM
cugcuccagcca

SEQ ID NO: 4196253 - RNA, 13 nt, Yersinia pestis KIM
cugcuccagccaa

SEQ ID NO: 4196254 - RNA, 23 nt, Yersinia pestis KIM
cugcucccguaaacguucugcca

SEQ ID NO: 4196255 - RNA, 21 nt, Yersinia pestis KIM
cugcuccgcccuaaagcuguc

SEQ ID NO: 4196256 - RNA, 14 nt, Yersinia pestis KIM
cugcucgagccaau

SEQ ID NO: 4196257 - RNA, 15 nt, Yersinia pestis KIM
cugcucgagccaauu

SEQ ID NO: 4196258 - RNA, 14 nt, Yersinia pestis KIM
cugcucuaucucuu

SEQ ID NO: 4196259 - RNA, 15 nt, Yersinia pestis KIM
cugcucuaucucuuc

SEQ ID NO: 4196260 - RNA, 12 nt, Yersinia pestis KIM
cugcucugcccc

SEQ ID NO: 4196261 - RNA, 15 nt, Yersinia pestis KIM
cugcucuuucccuuc

SEQ ID NO: 4196262 - RNA, 20 nt, Yersinia pestis KIM
cugcugaaaaaugagucauu

SEQ ID NO: 4196263 - RNA, 13 nt, Yersinia pestis KIM
cugcugcuuuaau

SEQ ID NO: 4196264 - RNA, 17 nt, Yersinia pestis KIM
cugcuggaaguuggcuu

SEQ ID NO: 4196265 - RNA, 15 nt, Yersinia pestis KIM
cugcuggaaugcagu

SEQ ID NO: 4196266 - RNA, 24 nt, Yersinia pestis KIM
cugcuggaaugcagugccacggau

SEQ ID NO: 4196267 - RNA, 17 nt, Yersinia pestis KIM
cugcuguggguucauca

SEQ ID NO: 4196268 - RNA, 19 nt, Yersinia pestis KIM
cugcuguucuggcaggccg

SEQ ID NO: 4196269 - RNA, 16 nt, Yersinia pestis KIM
cugcuuaccuuguuug

SEQ ID NO: 4196270 - RNA, 23 nt, Yersinia pestis KIM
cugcuuaccuuguuuguuacugc

SEQ ID NO: 4196271 - RNA, 20 nt, Yersinia pestis KIM
cugcuuauacgcuuccugcg

SEQ ID NO: 4196272 - RNA, 17 nt, Yersinia pestis KIM
cugcuuauuuuuucaau

SEQ ID NO: 4196273 - RNA, 19 nt, Yersinia pestis KIM
cugcuugcgcgccuguuua

SEQ ID NO: 4196274 - RNA, 13 nt, Yersinia pestis KIM
cugcuugcgcguu

SEQ ID NO: 4196275 - RNA, 23 nt, Yersinia pestis KIM
cugcuuuaggauuuauuucucug

SEQ ID NO: 4196276 - RNA, 23 nt, Yersinia pestis KIM
cugcuuuaggugguucaucaauc

SEQ ID NO: 4196277 - RNA, 15 nt, Yersinia pestis KIM
cugcuuuuaccgcag

SEQ ID NO: 4196278 - RNA, 16 nt, Yersinia pestis KIM
cugcuuuucuaccuga

SEQ ID NO: 4196279 - RNA, 22 nt, Yersinia pestis KIM
cugcuuuuuauugucucuacuc

SEQ ID NO: 4196280 - RNA, 12 nt, Yersinia pestis KIM
cuggaaacaaaa

SEQ ID NO: 4196281 - RNA, 20 nt, Yersinia pestis KIM
cuggaaauauuggcaacaac

SEQ ID NO: 4196282 - RNA, 20 nt, Yersinia pestis KIM
cuggaacguugcacccugcu

SEQ ID NO: 4196283 - RNA, 19 nt, Yersinia pestis KIM
cuggaaggcggcccgcaga

SEQ ID NO: 4196284 - RNA, 22 nt, Yersinia pestis KIM
cuggaauggcgcaauagcaucu

SEQ ID NO: 4196285 - RNA, 16 nt, Yersinia pestis KIM
cuggacguuugcugcu

SEQ ID NO: 4196286 - RNA, 16 nt, Yersinia pestis KIM
cuggagcuauggaaga

SEQ ID NO: 4196287 - RNA, 14 nt, Yersinia pestis KIM
cuggagcuucuggc

SEQ ID NO: 4196288 - RNA, 17 nt, Yersinia pestis KIM
cuggauauauuuacaaa

SEQ ID NO: 4196289 - RNA, 13 nt, Yersinia pestis KIM
cuggauauuuucc

SEQ ID NO: 4196290 - RNA, 20 nt, Yersinia pestis KIM
cuggaucggcauacuccauu

SEQ ID NO: 4196291 - RNA, 19 nt, Yersinia pestis KIM
cuggaugcucauugguuca

SEQ ID NO: 4196292 - RNA, 14 nt, Yersinia pestis KIM
cuggauggccaucu

SEQ ID NO: 4196293 - RNA, 15 nt, Yersinia pestis KIM
cuggauggccaucuc

SEQ ID NO: 4196294 - RNA, 14 nt, Yersinia pestis KIM
cuggauuugagaau

SEQ ID NO: 4196295 - RNA, 16 nt, Yersinia pestis KIM
cuggcaaacgcugggc

SEQ ID NO: 4196296 - RNA, 23 nt, Yersinia pestis KIM
cuggcaaaguuauugaccaauau

SEQ ID NO: 4196297 - RNA, 14 nt, Yersinia pestis KIM
cuggcaacugcaaa

SEQ ID NO: 4196298 - RNA, 14 nt, Yersinia pestis KIM
cuggcaagcagacg

SEQ ID NO: 4196299 - RNA, 22 nt, Yersinia pestis KIM
cuggcaauuucuguuaccagaa

SEQ ID NO: 4196300 - RNA, 12 nt, Yersinia pestis KIM
cuggcaggaaau

SEQ ID NO: 4196301 - RNA, 16 nt, Yersinia pestis KIM
cuggcauacaguuuug

SEQ ID NO: 4196302 - RNA, 18 nt, Yersinia pestis KIM
cuggcaugcauuggaaaa

SEQ ID NO: 4196303 - RNA, 19 nt, Yersinia pestis KIM
cuggcaugcauuggaaaaa

SEQ ID NO: 4196304 - RNA, 12 nt, Yersinia pestis KIM
cuggcauuuuuu

SEQ ID NO: 4196305 - RNA, 19 nt, Yersinia pestis KIM
cuggccagaugauaccgcg

SEQ ID NO: 4196306 - RNA, 17 nt, Yersinia pestis KIM
cuggcccccaaugacac

SEQ ID NO: 4196307 - RNA, 13 nt, Yersinia pestis KIM
cuggcccgccagc

SEQ ID NO: 4196308 - RNA, 20 nt, Yersinia pestis KIM
cuggccgauaucauggccau

SEQ ID NO: 4196309 - RNA, 13 nt, Yersinia pestis KIM
cuggccgcaggcg

SEQ ID NO: 4196310 - RNA, 17 nt, Yersinia pestis KIM
cuggccgggauucaaac

SEQ ID NO: 4196311 - RNA, 21 nt, Yersinia pestis KIM
cuggccguguuuuucccuacc

SEQ ID NO: 4196312 - RNA, 14 nt, Yersinia pestis KIM
cuggccuauuaaga

SEQ ID NO: 4196313 - RNA, 19 nt, Yersinia pestis KIM
cuggccuauuaagauaauu

SEQ ID NO: 4196314 - RNA, 22 nt, Yersinia pestis KIM
cuggccucuuuacgcucugccu

SEQ ID NO: 4196315 - RNA, 23 nt, Yersinia pestis KIM
cuggccucuuuacgcucugccug

SEQ ID NO: 4196316 - RNA, 17 nt, Yersinia pestis KIM
cuggccugagaacccau

SEQ ID NO: 4196317 - RNA, 14 nt, Yersinia pestis KIM
cuggcgaccgcuga

SEQ ID NO: 4196318 - RNA, 17 nt, Yersinia pestis KIM
cuggcgcaacagcgccu

SEQ ID NO: 4196319 - RNA, 18 nt, Yersinia pestis KIM
cugugcggcagugaacuu

SEQ ID NO: 4196320 - RNA, 15 nt, Yersinia pestis KIM
cugugcuaaauccca

SEQ ID NO: 4196321 - RNA, 19 nt, Yersinia pestis KIM
cugugcuaaaucccaggcg

SEQ ID NO: 4196322 - RNA, 18 nt, Yersinia pestis KIM
cugugcuuugccauucug

SEQ ID NO: 4196323 - RNA, 19 nt, Yersinia pestis KIM
cuguggagguggugguaau

SEQ ID NO: 4196324 - RNA, 23 nt, Yersinia pestis KIM
cuguggcggcaagaacaccguca

SEQ ID NO: 4196325 - RNA, 15 nt, Yersinia pestis KIM
cuguggucaacagug

SEQ ID NO: 4196326 - RNA, 14 nt, Yersinia pestis KIM
cugugguggcgguc

SEQ ID NO: 4196327 - RNA, 15 nt, Yersinia pestis KIM
cuguguaacugccac

SEQ ID NO: 4196328 - RNA, 17 nt, Yersinia pestis KIM
cuguguuuauaccaaag

SEQ ID NO: 4196329 - RNA, 21 nt, Yersinia pestis KIM
cuguguuugauuaaugccucu

SEQ ID NO: 4196330 - RNA, 16 nt, Yersinia pestis KIM
cuguguuuugagcauc

SEQ ID NO: 4196331 - RNA, 22 nt, Yersinia pestis KIM
cuguuaaaagaccgcuuuugcg

SEQ ID NO: 4196332 - RNA, 13 nt, Yersinia pestis KIM
cuguuaacucaug

SEQ ID NO: 4196333 - RNA, 19 nt, Yersinia pestis KIM
cuguuaauccguaugucac

SEQ ID NO: 4196334 - RNA, 20 nt, Yersinia pestis KIM
cuguuaauccuaaugaacac

SEQ ID NO: 4196335 - RNA, 18 nt, Yersinia pestis KIM
cuguuacaucagagcuca

SEQ ID NO: 4196336 - RNA, 19 nt, Yersinia pestis KIM
cuguuacaucagagcucaa

SEQ ID NO: 4196337 - RNA, 15 nt, Yersinia pestis KIM
cuguuaccagaaaac

SEQ ID NO: 4196338 - RNA, 20 nt, Yersinia pestis KIM
cuguuaccgcgcuugcauca

SEQ ID NO: 4196339 - RNA, 22 nt, Yersinia pestis KIM
cuguuaguaacuguaaggccaa

SEQ ID NO: 4196340 - RNA, 14 nt, Yersinia pestis KIM
cuguuauaaaaaag

SEQ ID NO: 4196341 - RNA, 20 nt, Yersinia pestis KIM
cuguuauaaggcuaacaccu

SEQ ID NO: 4196342 - RNA, 14 nt, Yersinia pestis KIM
cuguuauauaaaug

SEQ ID NO: 4196343 - RNA, 21 nt, Yersinia pestis KIM
cuguuaucugguuauauugac

SEQ ID NO: 4196344 - RNA, 16 nt, Yersinia pestis KIM
cuguuauuacugucau

SEQ ID NO: 4196345 - RNA, 19 nt, Yersinia pestis KIM
cuguuauuggggacaggcu

SEQ ID NO: 4196346 - RNA, 12 nt, Yersinia pestis KIM
cuguucaaaaug

SEQ ID NO: 4196347 - RNA, 22 nt, Yersinia pestis KIM
cuguucagauuuaccaugucca

SEQ ID NO: 4196348 - RNA, 22 nt, Yersinia pestis KIM
cuguucaucaauagguguugcc

SEQ ID NO: 4196349 - RNA, 11 nt, Yersinia pestis KIM
cuguucaucag

SEQ ID NO: 4196350 - RNA, 13 nt, Yersinia pestis KIM
cuguuccaaccaa

SEQ ID NO: 4196351 - RNA, 17 nt, Yersinia pestis KIM
cuguugaccgacucauu

SEQ ID NO: 4196352 - RNA, 20 nt, Yersinia pestis KIM
cuguugaccgacucauuaaa

SEQ ID NO: 4196353 - RNA, 16 nt, Yersinia pestis KIM
cuguugaugaguaaac

SEQ ID NO: 4196354 - RNA, 18 nt, Yersinia pestis KIM
cuguugcaugaaaucagu

SEQ ID NO: 4196355 - RNA, 15 nt, Yersinia pestis KIM
cuguugccacagacg

SEQ ID NO: 4196356 - RNA, 12 nt, Yersinia pestis KIM
cuguugccaugc

SEQ ID NO: 4196357 - RNA, 17 nt, Yersinia pestis KIM
cuguugccaugccaugg

SEQ ID NO: 4196358 - RNA, 20 nt, Yersinia pestis KIM
cuguugcccccugcuccaaa

SEQ ID NO: 4196359 - RNA, 20 nt, Yersinia pestis KIM
cuguugcuaggcgcagcagg

SEQ ID NO: 4196360 - RNA, 15 nt, Yersinia pestis KIM
cuguuggcaauuuca

SEQ ID NO: 4196361 - RNA, 19 nt, Yersinia pestis KIM
cuguuggcgggauccaucu

SEQ ID NO: 4196362 - RNA, 15 nt, Yersinia pestis KIM
cuguuggcuccugag

SEQ ID NO: 4196363 - RNA, 15 nt, Yersinia pestis KIM
cuguugguaaauaac

SEQ ID NO: 4196364 - RNA, 19 nt, Yersinia pestis KIM
cuguugguagcguuuuuuc

SEQ ID NO: 4196365 - RNA, 19 nt, Yersinia pestis KIM
cuguuguaacacuugacca

SEQ ID NO: 4196366 - RNA, 21 nt, Yersinia pestis KIM
cuguuguaguuagaugacauc

SEQ ID NO: 4196367 - RNA, 17 nt, Yersinia pestis KIM
cuguuguggcagcguuu

SEQ ID NO: 4196368 - RNA, 14 nt, Yersinia pestis KIM
cuguuuaguucacg

SEQ ID NO: 4196369 - RNA, 12 nt, Yersinia pestis KIM
cuguuucaacau

SEQ ID NO: 4196370 - RNA, 18 nt, Yersinia pestis KIM
cuguuugcaacauuaucc

SEQ ID NO: 4196371 - RNA, 18 nt, Yersinia pestis KIM
cuguuuucauuauuuuca

SEQ ID NO: 4196372 - RNA, 17 nt, Yersinia pestis KIM
cuguuuugguuuccgcu

SEQ ID NO: 4196373 - RNA, 13 nt, Yersinia pestis KIM
cuguuuugucaua

SEQ ID NO: 4196374 - RNA, 18 nt, Yersinia pestis KIM
cuguuuuuuaaagaaaaa

SEQ ID NO: 4196375 - RNA, 14 nt, Yersinia pestis KIM
cuguuuuuuauccc

SEQ ID NO: 4196376 - RNA, 13 nt, Yersinia pestis KIM
cuuaaaaaucaaa

SEQ ID NO: 4196377 - RNA, 17 nt, Yersinia pestis KIM
cuuaaaaucuguaauua

SEQ ID NO: 4196378 - RNA, 18 nt, Yersinia pestis KIM
cuuaaaaucuguaauuaa

SEQ ID NO: 4196379 - RNA, 16 nt, Yersinia pestis KIM
cuuaaagaaauaaaua

SEQ ID NO: 4196380 - RNA, 23 nt, Yersinia pestis KIM
cuuaaagaaauaaauauccuccg

SEQ ID NO: 4196381 - RNA, 11 nt, Yersinia pestis KIM
cuuaaauaaaa

SEQ ID NO: 4196382 - RNA, 11 nt, Yersinia pestis KIM
cuuaaauaacu

SEQ ID NO: 4196383 - RNA, 22 nt, Yersinia pestis KIM
cuuaaauauaccgccaagcgcc

SEQ ID NO: 4196384 - RNA, 21 nt, Yersinia pestis KIM
cuuaacaaucagugcaauaaa

SEQ ID NO: 4196385 - RNA, 22 nt, Yersinia pestis KIM
cuuaacgauauuuacucaucua

SEQ ID NO: 4196386 - RNA, 18 nt, Yersinia pestis KIM
cuuaacgguaugacgggu

SEQ ID NO: 4196387 - RNA, 18 nt, Yersinia pestis KIM
cuuaacguugcaaaugcu

SEQ ID NO: 4196388 - RNA, 18 nt, Yersinia pestis KIM
cuuaacucgccacucaca

SEQ ID NO: 4196389 - RNA, 15 nt, Yersinia pestis KIM
cuuaacugcauagcu

SEQ ID NO: 4196390 - RNA, 16 nt, Yersinia pestis KIM
cuuaacugcauagcua

SEQ ID NO: 4196391 - RNA, 14 nt, Yersinia pestis KIM
cuuaagcaauauuu

SEQ ID NO: 4196392 - RNA, 17 nt, Yersinia pestis KIM
cuuaagcccaucuuauu

SEQ ID NO: 4196393 - RNA, 23 nt, Yersinia pestis KIM
cuuaaguugaguugaauuuuuau

SEQ ID NO: 4196394 - RNA, 10 nt, Yersinia pestis KIM
cuuaauaaua

SEQ ID NO: 4196395 - RNA, 21 nt, Yersinia pestis KIM
cuuaaucaucaucacaaauaa

SEQ ID NO: 4196396 - RNA, 15 nt, Yersinia pestis KIM
cuuaaucgccagcaa

SEQ ID NO: 4196397 - RNA, 15 nt, Yersinia pestis KIM
cuuaaugcgaacagc

SEQ ID NO: 4196398 - RNA, 17 nt, Yersinia pestis KIM
cuuaaugucuuuacuaa

SEQ ID NO: 4196399 - RNA, 14 nt, Yersinia pestis KIM
cuuaauuaacucuu

SEQ ID NO: 4196400 - RNA, 15 nt, Yersinia pestis KIM
cuuaauuaacucuuc

SEQ ID NO: 4196401 - RNA, 15 nt, Yersinia pestis KIM
cuuaauucccagcca

SEQ ID NO: 4196402 - RNA, 22 nt, Yersinia pestis KIM
cuuaauuggcggaagacuucca

SEQ ID NO: 4196403 - RNA, 23 nt, Yersinia pestis KIM
cuuaauuggcggaagacuuccag

SEQ ID NO: 4196404 - RNA, 18 nt, Yersinia pestis KIM
cuuaauuuggcuauugag

SEQ ID NO: 4196405 - RNA, 13 nt, Yersinia pestis KIM
cuuaauuuuauca

SEQ ID NO: 4196406 - RNA, 16 nt, Yersinia pestis KIM
cuuacaaagcauuuca

SEQ ID NO: 4196407 - RNA, 20 nt, Yersinia pestis KIM
cuuacagugaucaugggaaa

SEQ ID NO: 4196408 - RNA, 14 nt, Yersinia pestis KIM
cuuacauaaguaag

SEQ ID NO: 4196409 - RNA, 22 nt, Yersinia pestis KIM
cuuacauucgagcaacuuuuac

SEQ ID NO: 4196410 - RNA, 16 nt, Yersinia pestis KIM
cuuacauuucaucuug

SEQ ID NO: 4196411 - RNA, 14 nt, Yersinia pestis KIM
cuuaccccuuucaa

SEQ ID NO: 4196412 - RNA, 15 nt, Yersinia pestis KIM
cuuacccuacccauu

SEQ ID NO: 4196413 - RNA, 19 nt, Yersinia pestis KIM
cuuaccggccucuuucccc

SEQ ID NO: 4196414 - RNA, 21 nt, Yersinia pestis KIM
cuuaccuuguuuguuacugcu

SEQ ID NO: 4196415 - RNA, 23 nt, Yersinia pestis KIM
cuuacgcuguaugccgcucaagg

SEQ ID NO: 4196416 - RNA, 18 nt, Yersinia pestis KIM
cuuacggugauacaucuc

SEQ ID NO: 4196417 - RNA, 14 nt, Yersinia pestis KIM
cuuacgucuuuaaa

SEQ ID NO: 4196418 - RNA, 23 nt, Yersinia pestis KIM
cuuacguuuugagguuuuaccaa

SEQ ID NO: 4196419 - RNA, 16 nt, Yersinia pestis KIM
cuuacuaaaauaucac

SEQ ID NO: 4196420 - RNA, 18 nt, Yersinia pestis KIM
cuuacuauuuuucucaau

SEQ ID NO: 4196421 - RNA, 16 nt, Yersinia pestis KIM
cuuacugcaucaauaa

SEQ ID NO: 4196422 - RNA, 20 nt, Yersinia pestis KIM
cuuacugguaccaaucucca

SEQ ID NO: 4196423 - RNA, 16 nt, Yersinia pestis KIM
cuuacuguaucaauac

SEQ ID NO: 4196424 - RNA, 22 nt, Yersinia pestis KIM
cuuacuguuuucauuauuuuca

SEQ ID NO: 4196425 - RNA, 15 nt, Yersinia pestis KIM
cuuacuuuuuacggc

SEQ ID NO: 4196426 - RNA, 15 nt, Yersinia pestis KIM
cuuacuuuuuugccu

SEQ ID NO: 4196427 - RNA, 22 nt, Yersinia pestis KIM
cuuagcgcacacccgauggaac

SEQ ID NO: 4196428 - RNA, 18 nt, Yersinia pestis KIM
cuuagcgcacggggaaac

SEQ ID NO: 4196429 - RNA, 18 nt, Yersinia pestis KIM
cuuagcucaguugguuag

SEQ ID NO: 4196430 - RNA, 15 nt, Yersinia pestis KIM
cuuagucauuaagaa

SEQ ID NO: 4196431 - RNA, 15 nt, Yersinia pestis KIM
cuuaguuggugcuuu

SEQ ID NO: 4196432 - RNA, 22 nt, Yersinia pestis KIM
cuuauaucaauagugauuguuu

SEQ ID NO: 4196433 - RNA, 16 nt, Yersinia pestis KIM
cuuauauuauucauau

SEQ ID NO: 4196434 - RNA, 13 nt, Yersinia pestis KIM
cuucguagccauu

SEQ ID NO: 4196435 - RNA, 22 nt, Yersinia pestis KIM
cuucguugccccaucagcacuc

SEQ ID NO: 4196436 - RNA, 18 nt, Yersinia pestis KIM
cuucuaaaaucgcacuga

SEQ ID NO: 4196437 - RNA, 13 nt, Yersinia pestis KIM
cuucuaacaauaa

SEQ ID NO: 4196438 - RNA, 18 nt, Yersinia pestis KIM
cuucuaggugcucugccu

SEQ ID NO: 4196439 - RNA, 21 nt, Yersinia pestis KIM
cuucuaggugcucugccuuau

SEQ ID NO: 4196440 - RNA, 20 nt, Yersinia pestis KIM
cuucuccgcgcaaccuggcc

SEQ ID NO: 4196441 - RNA, 15 nt, Yersinia pestis KIM
cuucuccuguauuug

SEQ ID NO: 4196442 - RNA, 16 nt, Yersinia pestis KIM
cuucugauucaauuuc

SEQ ID NO: 4196443 - RNA, 18 nt, Yersinia pestis KIM
cuucugauuuuuuguucu

SEQ ID NO: 4196444 - RNA, 16 nt, Yersinia pestis KIM
cuucugcccauccuca

SEQ ID NO: 4196445 - RNA, 20 nt, Yersinia pestis KIM
cuucugcccauccucaccgu

SEQ ID NO: 4196446 - RNA, 19 nt, Yersinia pestis KIM
cuucugccuauccucaccg

SEQ ID NO: 4196447 - RNA, 20 nt, Yersinia pestis KIM
cuucugccuauccucaccgu

SEQ ID NO: 4196448 - RNA, 16 nt, Yersinia pestis KIM
cuucuggcgcuaauga

SEQ ID NO: 4196449 - RNA, 15 nt, Yersinia pestis KIM
cuucuggcgugucau

SEQ ID NO: 4196450 - RNA, 23 nt, Yersinia pestis KIM
cuucugggaucaucgcuugauca

SEQ ID NO: 4196451 - RNA, 15 nt, Yersinia pestis KIM
cuucuggugguguca

SEQ ID NO: 4196452 - RNA, 19 nt, Yersinia pestis KIM
cuucugguggugucacauu

SEQ ID NO: 4196453 - RNA, 23 nt, Yersinia pestis KIM
cuucuguugcuucacggacagca

SEQ ID NO: 4196454 - RNA, 13 nt, Yersinia pestis KIM
cuucuucaaaagc

SEQ ID NO: 4196455 - RNA, 13 nt, Yersinia pestis KIM
cuucuucauccca

SEQ ID NO: 4196456 - RNA, 14 nt, Yersinia pestis KIM
cuucuuccauugau

SEQ ID NO: 4196457 - RNA, 20 nt, Yersinia pestis KIM
cuucuucgauuuuagcuuug

SEQ ID NO: 4196458 - RNA, 22 nt, Yersinia pestis KIM
cuucuucgcuaucgagauuacg

SEQ ID NO: 4196459 - RNA, 18 nt, Yersinia pestis KIM
cuucuuggguggcaauuu

SEQ ID NO: 4196460 - RNA, 17 nt, Yersinia pestis KIM
cuucuuugacauguccc

SEQ ID NO: 4196461 - RNA, 13 nt, Yersinia pestis KIM
cuucuuuuaaaga

SEQ ID NO: 4196462 - RNA, 18 nt, Yersinia pestis KIM
cuucuuuuaaagaagaau

SEQ ID NO: 4196463 - RNA, 19 nt, Yersinia pestis KIM
cuugaaaccgguaauguuc

SEQ ID NO: 4196464 - RNA, 20 nt, Yersinia pestis KIM
cuugaaccaauuuuucugua

SEQ ID NO: 4196465 - RNA, 17 nt, Yersinia pestis KIM
cuugaacggugaggaua

SEQ ID NO: 4196466 - RNA, 11 nt, Yersinia pestis KIM
cuugaagagug

SEQ ID NO: 4196467 - RNA, 19 nt, Yersinia pestis KIM
cuugaaggacgacggguau

SEQ ID NO: 4196468 - RNA, 21 nt, Yersinia pestis KIM
cuugaaguacggugccagcag

SEQ ID NO: 4196469 - RNA, 21 nt, Yersinia pestis KIM
cuugaauaauaggcugaucaa

SEQ ID NO: 4196470 - RNA, 16 nt, Yersinia pestis KIM
cuugaauaauauucaa

SEQ ID NO: 4196471 - RNA, 15 nt, Yersinia pestis KIM
cuugaaucaaaauac

SEQ ID NO: 4196472 - RNA, 17 nt, Yersinia pestis KIM
cuugaaucaaaauaccc

SEQ ID NO: 4196473 - RNA, 18 nt, Yersinia pestis KIM
cuugaccuugccuugcau

SEQ ID NO: 4196474 - RNA, 21 nt, Yersinia pestis KIM
cuugacgacaauauaauaaug

SEQ ID NO: 4196475 - RNA, 19 nt, Yersinia pestis KIM
cuugacucuucagcgggaa

SEQ ID NO: 4196476 - RNA, 21 nt, Yersinia pestis KIM
cuugagggugaccaucuggcg

SEQ ID NO: 4196477 - RNA, 19 nt, Yersinia pestis KIM
cuugaggugcuugaacaac

SEQ ID NO: 4196478 - RNA, 18 nt, Yersinia pestis KIM
cuugaguauccaauaagc

SEQ ID NO: 4196479 - RNA, 20 nt, Yersinia pestis KIM
cuugauagcgggcagacguu

SEQ ID NO: 4196480 - RNA, 22 nt, Yersinia pestis KIM
cuugauagggcugaagacccaa

SEQ ID NO: 4196481 - RNA, 22 nt, Yersinia pestis KIM
cuugauaucuucggcggcuaaa

SEQ ID NO: 4196482 - RNA, 19 nt, Yersinia pestis KIM
cuugaucgccaaauaaaca

SEQ ID NO: 4196483 - RNA, 22 nt, Yersinia pestis KIM
cuugaugaaguuauuuuuauua

SEQ ID NO: 4196484 - RNA, 23 nt, Yersinia pestis KIM
cuugauggcuaauuaauuuaaac

SEQ ID NO: 4196485 - RNA, 12 nt, Yersinia pestis KIM
cuugauuaaaug

SEQ ID NO: 4196486 - RNA, 16 nt, Yersinia pestis KIM
cuugauuagcuggcug

SEQ ID NO: 4196487 - RNA, 13 nt, Yersinia pestis KIM
cuugauucaccag

SEQ ID NO: 4196488 - RNA, 15 nt, Yersinia pestis KIM
cuugauucucaaagg

SEQ ID NO: 4196489 - RNA, 13 nt, Yersinia pestis KIM
cuugauuugcccg

SEQ ID NO: 4196490 - RNA, 15 nt, Yersinia pestis KIM
cuugauuugcccgau

SEQ ID NO: 4196491 - RNA, 21 nt, Yersinia pestis KIM
cuugcaacaacgccucaucuu

SEQ ID NO: 4196492 - RNA, 22 nt, Yersinia pestis KIM
cuugcaacaacucgaacaaccg

SEQ ID NO: 4196493 - RNA, 13 nt, Yersinia pestis KIM
cuugcagcaacag

SEQ ID NO: 4196494 - RNA, 14 nt, Yersinia pestis KIM
cuugcagcaacagg

SEQ ID NO: 4196495 - RNA, 11 nt, Yersinia pestis KIM
cuugcagcaca

SEQ ID NO: 4196496 - RNA, 22 nt, Yersinia pestis KIM
cuugcagcacaccggccaaaau

SEQ ID NO: 4196497 - RNA, 19 nt, Yersinia pestis KIM
cuugcagugcuucaucacu

SEQ ID NO: 4196498 - RNA, 15 nt, Yersinia pestis KIM
cuugcauaucagcaa

SEQ ID NO: 4196499 - RNA, 13 nt, Yersinia pestis KIM
cuugcaucaacuu

SEQ ID NO: 4196500 - RNA, 12 nt, Yersinia pestis KIM
cuugcaucccca

SEQ ID NO: 4196501 - RNA, 19 nt, Yersinia pestis KIM
cuugccacucugcuccgca

SEQ ID NO: 4196502 - RNA, 18 nt, Yersinia pestis KIM
cuugcccuuugcuauuca

SEQ ID NO: 4196503 - RNA, 21 nt, Yersinia pestis KIM
cuugcgcguuaaucugcugcu

SEQ ID NO: 4196504 - RNA, 21 nt, Yersinia pestis KIM
cuugcuaccaagacuucauga

SEQ ID NO: 4196505 - RNA, 15 nt, Yersinia pestis KIM
cuugcucucuucaua

SEQ ID NO: 4196506 - RNA, 19 nt, Yersinia pestis KIM
cuugcucucuucauagcua

SEQ ID NO: 4196507 - RNA, 14 nt, Yersinia pestis KIM
cuugcugaugccca

SEQ ID NO: 4196508 - RNA, 21 nt, Yersinia pestis KIM
cuugcugguauucaucagcaa

SEQ ID NO: 4196509 - RNA, 15 nt, Yersinia pestis KIM
cuuggaaaacagcaa

SEQ ID NO: 4196510 - RNA, 18 nt, Yersinia pestis KIM
cuuggaacuuacucccuu

SEQ ID NO: 4196511 - RNA, 17 nt, Yersinia pestis KIM
cuuggacaucugcuuua

SEQ ID NO: 4196512 - RNA, 16 nt, Yersinia pestis KIM
cuuggagccagccauu

SEQ ID NO: 4196513 - RNA, 23 nt, Yersinia pestis KIM
cuuggagccagccauucugaauc

SEQ ID NO: 4196514 - RNA, 18 nt, Yersinia pestis KIM
cuuggcaccuaauaagcu

SEQ ID NO: 4196515 - RNA, 17 nt, Yersinia pestis KIM
cuuggcauguucagggu

SEQ ID NO: 4196516 - RNA, 22 nt, Yersinia pestis KIM
cuuggccgauaugaagcacaaa

SEQ ID NO: 4196517 - RNA, 21 nt, Yersinia pestis KIM
cuuggcgcggacgcuuuacuc

SEQ ID NO: 4196518 - RNA, 20 nt, Yersinia pestis KIM
cuugggagucagaugccgcu

SEQ ID NO: 4196519 - RNA, 14 nt, Yersinia pestis KIM
cuugggcagcgaca

SEQ ID NO: 4196520 - RNA, 22 nt, Yersinia pestis KIM
cuuggggcuuauugugccccaa

SEQ ID NO: 4196521 - RNA, 19 nt, Yersinia pestis KIM
cuugguccgggauggaaau

SEQ ID NO: 4196522 - RNA, 21 nt, Yersinia pestis KIM
cuuggugcccgguugccugac

SEQ ID NO: 4196523 - RNA, 12 nt, Yersinia pestis KIM
cuugguuguuuc

SEQ ID NO: 4196524 - RNA, 22 nt, Yersinia pestis KIM
cuuguaagaccaauugguaaga

SEQ ID NO: 4196525 - RNA, 16 nt, Yersinia pestis KIM
cuuguaagcaaacgau

SEQ ID NO: 4196526 - RNA, 16 nt, Yersinia pestis KIM
cuuguauauaaaaaau

SEQ ID NO: 4196527 - RNA, 11 nt, Yersinia pestis KIM
cuuguauuuaa

SEQ ID NO: 4196528 - RNA, 23 nt, Yersinia pestis KIM
cuugucaccguaaccauuggcac

SEQ ID NO: 4196529 - RNA, 17 nt, Yersinia pestis KIM
cuugucaccugaguaau

SEQ ID NO: 4196530 - RNA, 19 nt, Yersinia pestis KIM
cuuguccauagcuaaaaua

SEQ ID NO: 4196531 - RNA, 20 nt, Yersinia pestis KIM
cuugugaugaaauuaaaaug

SEQ ID NO: 4196532 - RNA, 19 nt, Yersinia pestis KIM
cuugugggcaucugucuaa

SEQ ID NO: 4196533 - RNA, 15 nt, Yersinia pestis KIM
cuuguuaauuuaaac

SEQ ID NO: 4196534 - RNA, 16 nt, Yersinia pestis KIM
cuuguuaauuuaaaca

SEQ ID NO: 4196535 - RNA, 13 nt, Yersinia pestis KIM
cuuguuaggagaa

SEQ ID NO: 4196536 - RNA, 16 nt, Yersinia pestis KIM
cuuguuggucaccacu

SEQ ID NO: 4196537 - RNA, 23 nt, Yersinia pestis KIM
cuuguuuaguaauuuccuuggca

SEQ ID NO: 4196538 - RNA, 19 nt, Yersinia pestis KIM
cuuguuuaucggucacuuu

SEQ ID NO: 4196539 - RNA, 23 nt, Yersinia pestis KIM
cuuguuugcgccguaaacugccg

SEQ ID NO: 4196540 - RNA, 23 nt, Yersinia pestis KIM
cuuuaaaaaaauuaucaucaaua

SEQ ID NO: 4196541 - RNA, 22 nt, Yersinia pestis KIM
cuuuaaauacccagcuucuuuu

SEQ ID NO: 4196542 - RNA, 16 nt, Yersinia pestis KIM
cuuuaaaucuagcccu

SEQ ID NO: 4196543 - RNA, 15 nt, Yersinia pestis KIM
cuuuaacaauuuauc

SEQ ID NO: 4196544 - RNA, 14 nt, Yersinia pestis KIM
cuuuaaccaaagaa

SEQ ID NO: 4196545 - RNA, 22 nt, Yersinia pestis KIM
cuuuaaccaaagaacggccugc

SEQ ID NO: 4196546 - RNA, 17 nt, Yersinia pestis KIM
cuuuaaccgcauucaca

SEQ ID NO: 4196547 - RNA, 23 nt, Yersinia pestis KIM
cuuuaagauccaguucaguccag

SEQ ID NO: 4196548 - RNA, 18 nt, Yersinia pestis KIM
cuuuugcauauuucucuu

SEQ ID NO: 4196549 - RNA, 20 nt, Yersinia pestis KIM
cuuuugcauauuucucuuug

SEQ ID NO: 4196550 - RNA, 14 nt, Yersinia pestis KIM
cuuuugccacauuu

SEQ ID NO: 4196551 - RNA, 16 nt, Yersinia pestis KIM
cuuuugccacauuucc

SEQ ID NO: 4196552 - RNA, 15 nt, Yersinia pestis KIM
cuuuuggcagcacca

SEQ ID NO: 4196553 - RNA, 19 nt, Yersinia pestis KIM
cuuuuuaacuuacugcucu

SEQ ID NO: 4196554 - RNA, 19 nt, Yersinia pestis KIM
cuuuuuacgccuauccuca

SEQ ID NO: 4196555 - RNA, 22 nt, Yersinia pestis KIM
cuuuuuacgccuauccucauga

SEQ ID NO: 4196556 - RNA, 17 nt, Yersinia pestis KIM
cuuuuuacguauuaucc

SEQ ID NO: 4196557 - RNA, 14 nt, Yersinia pestis KIM
cuuuuuacuuuuua

SEQ ID NO: 4196558 - RNA, 20 nt, Yersinia pestis KIM
cuuuuuauaagcguuauuuu

SEQ ID NO: 4196559 - RNA, 23 nt, Yersinia pestis KIM
cuuuuuauaagcguuauuuuugu

SEQ ID NO: 4196560 - RNA, 19 nt, Yersinia pestis KIM
cuuuuuauguaacaacuga

SEQ ID NO: 4196561 - RNA, 19 nt, Yersinia pestis KIM
cuuuuuauuucuuuuaaau

SEQ ID NO: 4196562 - RNA, 20 nt, Yersinia pestis KIM
cuuuuucacacgcccaggcc

SEQ ID NO: 4196563 - RNA, 17 nt, Yersinia pestis KIM
cuuuuucgugucguaac

SEQ ID NO: 4196564 - RNA, 15 nt, Yersinia pestis KIM
cuuuuucuuuuuaac

SEQ ID NO: 4196565 - RNA, 17 nt, Yersinia pestis KIM
cuuuuugcccgcgcuuc

SEQ ID NO: 4196566 - RNA, 15 nt, Yersinia pestis KIM
cuuuuuguauuuuug

SEQ ID NO: 4196567 - RNA, 15 nt, Yersinia pestis KIM
cuuuuuuaauaaaaa

SEQ ID NO: 4196568 - RNA, 16 nt, Yersinia pestis KIM
cuuuuuuaauaaaaaa

SEQ ID NO: 4196569 - RNA, 17 nt, Yersinia pestis KIM
cuuuuuuaauaaaaaac

SEQ ID NO: 4196570 - RNA, 20 nt, Yersinia pestis KIM
cuuuuuugccugcucagcuc

SEQ ID NO: 4196571 - RNA, 15 nt, Yersinia pestis KIM
gaaaaaaacagacua

SEQ ID NO: 4196572 - RNA, 22 nt, Yersinia pestis KIM
gaaaaaauacgcuuucccccau

SEQ ID NO: 4196573 - RNA, 16 nt, Yersinia pestis KIM
gaaaaacacuggcagc

SEQ ID NO: 4196574 - RNA, 17 nt, Yersinia pestis KIM
gaaaaacacuggcagcc

SEQ ID NO: 4196575 - RNA, 19 nt, Yersinia pestis KIM
gaaaaaggcaccagcgcac

SEQ ID NO: 4196576 - RNA, 23 nt, Yersinia pestis KIM
gaaaaaugagccgaccgucguaa

SEQ ID NO: 4196577 - RNA, 15 nt, Yersinia pestis KIM
gaaaacaaguuucac

SEQ ID NO: 4196578 - RNA, 21 nt, Yersinia pestis KIM
gaaaacaauauaauaacucua

SEQ ID NO: 4196579 - RNA, 17 nt, Yersinia pestis KIM
gaaaacagccaccagcc

SEQ ID NO: 4196580 - RNA, 21 nt, Yersinia pestis KIM
gaaaacagccaccagccaacu

SEQ ID NO: 4196581 - RNA, 18 nt, Yersinia pestis KIM
gaaaacccauaccacuga

SEQ ID NO: 4196582 - RNA, 21 nt, Yersinia pestis KIM
gaaaacccccagcuaggcugg

SEQ ID NO: 4196583 - RNA, 17 nt, Yersinia pestis KIM
gaaaacguuaacugcag

SEQ ID NO: 4196584 - RNA, 20 nt, Yersinia pestis KIM
gaaaacugugcgaauggaaa

SEQ ID NO: 4196585 - RNA, 20 nt, Yersinia pestis KIM
gaaaagaggggcaguuguug

SEQ ID NO: 4196586 - RNA, 19 nt, Yersinia pestis KIM
gaaaagagucgcuuuggga

SEQ ID NO: 4196587 - RNA, 13 nt, Yersinia pestis KIM
gaaaagcaccgca

SEQ ID NO: 4196588 - RNA, 17 nt, Yersinia pestis KIM
gaaaaguggcuaucuga

SEQ ID NO: 4196589 - RNA, 19 nt, Yersinia pestis KIM
gaaaauaccgcgaucaaca

SEQ ID NO: 4196590 - RNA, 21 nt, Yersinia pestis KIM
gaaaaucuuuuuguaauguuu

SEQ ID NO: 4196591 - RNA, 19 nt, Yersinia pestis KIM
gaaaaugaucaucaagcca

SEQ ID NO: 4196592 - RNA, 14 nt, Yersinia pestis KIM
gaaaaugauuuaau

SEQ ID NO: 4196593 - RNA, 18 nt, Yersinia pestis KIM
gaaaaugcgccagccaau

SEQ ID NO: 4196594 - RNA, 20 nt, Yersinia pestis KIM
gaaaaugcggcggcugacca

SEQ ID NO: 4196595 - RNA, 20 nt, Yersinia pestis KIM
gaaaaugguuagauuacagc

SEQ ID NO: 4196596 - RNA, 16 nt, Yersinia pestis KIM
gaaaauguccauaaua

SEQ ID NO: 4196597 - RNA, 15 nt, Yersinia pestis KIM
gaaacaaaaccaacc

SEQ ID NO: 4196598 - RNA, 20 nt, Yersinia pestis KIM
gaaacaaaaccaaccccacg

SEQ ID NO: 4196599 - RNA, 14 nt, Yersinia pestis KIM
gaaacaaaaccuaa

SEQ ID NO: 4196600 - RNA, 19 nt, Yersinia pestis KIM
gaaacaaaaccuaacgcca

SEQ ID NO: 4196601 - RNA, 11 nt, Yersinia pestis KIM
gaaacaaauac

SEQ ID NO: 4196602 - RNA, 23 nt, Yersinia pestis KIM
gaaacacacuucgccgggucagg

SEQ ID NO: 4196603 - RNA, 17 nt, Yersinia pestis KIM
gaaacaccguguuccag

SEQ ID NO: 4196604 - RNA, 18 nt, Yersinia pestis KIM
gaaacagguaguggaaau

SEQ ID NO: 4196605 - RNA, 21 nt, Yersinia pestis KIM
gaaacagguaguggaaauagg

SEQ ID NO: 4196606 - RNA, 15 nt, Yersinia pestis KIM
gaaaccaaaucugac

SEQ ID NO: 4196607 - RNA, 21 nt, Yersinia pestis KIM
gaaaccacggcguuacuggcg

SEQ ID NO: 4196608 - RNA, 15 nt, Yersinia pestis KIM
gaaaccagcggcagc

SEQ ID NO: 4196609 - RNA, 19 nt, Yersinia pestis KIM
gaaaccauugguaauaaug

SEQ ID NO: 4196610 - RNA, 17 nt, Yersinia pestis KIM
gaaacccacauaucucc

SEQ ID NO: 4196611 - RNA, 17 nt, Yersinia pestis KIM
gaaacgauaugcuccag

SEQ ID NO: 4196612 - RNA, 20 nt, Yersinia pestis KIM
gaaacgauuacccaccaccu

SEQ ID NO: 4196613 - RNA, 13 nt, Yersinia pestis KIM
gaaacgcaauuuu

SEQ ID NO: 4196614 - RNA, 20 nt, Yersinia pestis KIM
gaaacgccagccucugcgcu

SEQ ID NO: 4196615 - RNA, 20 nt, Yersinia pestis KIM
gaaacgcccaaaucugccug

SEQ ID NO: 4196616 - RNA, 19 nt, Yersinia pestis KIM
gaaacgccccgauaaacca

SEQ ID NO: 4196617 - RNA, 16 nt, Yersinia pestis KIM
gaaacggcuauuuuuu

SEQ ID NO: 4196618 - RNA, 21 nt, Yersinia pestis KIM
gaaacugccgccaccauauca

SEQ ID NO: 4196619 - RNA, 15 nt, Yersinia pestis KIM
gaaacugucagucaa

SEQ ID NO: 4196620 - RNA, 15 nt, Yersinia pestis KIM
gaaacuucaaaauca

SEQ ID NO: 4196621 - RNA, 15 nt, Yersinia pestis KIM
gaaacuucauuucag

SEQ ID NO: 4196622 - RNA, 14 nt, Yersinia pestis KIM
gaaagaaauaaaag

SEQ ID NO: 4196623 - RNA, 16 nt, Yersinia pestis KIM
gaaagaaauaaaagaa

SEQ ID NO: 4196624 - RNA, 19 nt, Yersinia pestis KIM
gaaagaaauaaaagaaaac

SEQ ID NO: 4196625 - RNA, 14 nt, Yersinia pestis KIM
gaaagacguggcac

SEQ ID NO: 4196626 - RNA, 14 nt, Yersinia pestis KIM
gaaagagccagcac

SEQ ID NO: 4196627 - RNA, 23 nt, Yersinia pestis KIM
gaaagcaauuagcacauaugcag

SEQ ID NO: 4196628 - RNA, 18 nt, Yersinia pestis KIM
gaaagcaggucgccaaac

SEQ ID NO: 4196629 - RNA, 19 nt, Yersinia pestis KIM
gaaagcauggcagguauca

SEQ ID NO: 4196630 - RNA, 21 nt, Yersinia pestis KIM
gaaagcgccugugggcggcuu

SEQ ID NO: 4196631 - RNA, 17 nt, Yersinia pestis KIM
gaaagcguauuaucugc

SEQ ID NO: 4196632 - RNA, 23 nt, Yersinia pestis KIM
gaaagcuucaacuuccagugcca

SEQ ID NO: 4196633 - RNA, 21 nt, Yersinia pestis KIM
gaaaggccggauguaaaacac

SEQ ID NO: 4196634 - RNA, 17 nt, Yersinia pestis KIM
gaaagggaaguuucuua

SEQ ID NO: 4196635 - RNA, 23 nt, Yersinia pestis KIM
gaaagguagaucggggacaggcu

SEQ ID NO: 4196636 - RNA, 17 nt, Yersinia pestis KIM
gaaagguaugugccaaa

SEQ ID NO: 4196637 - RNA, 19 nt, Yersinia pestis KIM
gaaagugacccaagaugac

SEQ ID NO: 4196638 - RNA, 13 nt, Yersinia pestis KIM
gaaaguggccacu

SEQ ID NO: 4196639 - RNA, 14 nt, Yersinia pestis KIM
gaaaguguauuucu

SEQ ID NO: 4196640 - RNA, 21 nt, Yersinia pestis KIM
gaaaguugagcagcaauaacu

SEQ ID NO: 4196641 - RNA, 15 nt, Yersinia pestis KIM
gaaaguuguucauua

SEQ ID NO: 4196642 - RNA, 22 nt, Yersinia pestis KIM
gaaauaaauauccuccggcaua

SEQ ID NO: 4196643 - RNA, 19 nt, Yersinia pestis KIM
gaaauaaaugacuaucccu

SEQ ID NO: 4196644 - RNA, 17 nt, Yersinia pestis KIM
gaaauacagaaaaauag

SEQ ID NO: 4196645 - RNA, 14 nt, Yersinia pestis KIM
gaaauaccccucac

SEQ ID NO: 4196646 - RNA, 20 nt, Yersinia pestis KIM
gaaauacuuauuugaaacag

SEQ ID NO: 4196647 - RNA, 15 nt, Yersinia pestis KIM
gaaauagcaacuaaa

SEQ ID NO: 4196648 - RNA, 20 nt, Yersinia pestis KIM
gaaauaguaauuaauuauga

SEQ ID NO: 4196649 - RNA, 14 nt, Yersinia pestis KIM
gaaauauaaaacag

SEQ ID NO: 4196650 - RNA, 16 nt, Yersinia pestis KIM
gaaauaucaggaugaa

SEQ ID NO: 4196651 - RNA, 17 nt, Yersinia pestis KIM
gaaauauggugauaacu

SEQ ID NO: 4196652 - RNA, 19 nt, Yersinia pestis KIM
gaaauauggugauaacugc

SEQ ID NO: 4196653 - RNA, 15 nt, Yersinia pestis KIM
gaaaucagaucaaca

SEQ ID NO: 4196654 - RNA, 16 nt, Yersinia pestis KIM
gaaaucagcuucauua

SEQ ID NO: 4196655 - RNA, 15 nt, Yersinia pestis KIM
gaaaucaggcuguuc

SEQ ID NO: 4196656 - RNA, 17 nt, Yersinia pestis KIM
gaaaucaggcuguucuu

SEQ ID NO: 4196657 - RNA, 13 nt, Yersinia pestis KIM
gaaauccaaaucu

SEQ ID NO: 4196658 - RNA, 15 nt, Yersinia pestis KIM
gaaaucgaucauaau

SEQ ID NO: 4196659 - RNA, 18 nt, Yersinia pestis KIM
gaaaucgauggccgcccu

SEQ ID NO: 4196660 - RNA, 18 nt, Yersinia pestis KIM
gaaaucgcggcgaaggcu

SEQ ID NO: 4196661 - RNA, 16 nt, Yersinia pestis KIM
gaaaucuaaguucagc

SEQ ID NO: 4196662 - RNA, 20 nt, Yersinia pestis KIM
gaagcugauaacgcacggcc

SEQ ID NO: 4196663 - RNA, 15 nt, Yersinia pestis KIM
gaagcuguuuccuga

SEQ ID NO: 4196664 - RNA, 18 nt, Yersinia pestis KIM
gaaggacuuggcguaacu

SEQ ID NO: 4196665 - RNA, 21 nt, Yersinia pestis KIM
gaaggcucauagucggcagcu

SEQ ID NO: 4196666 - RNA, 15 nt, Yersinia pestis KIM
gaaggcugauuaaua

SEQ ID NO: 4196667 - RNA, 21 nt, Yersinia pestis KIM
gaagggaguuacucagcaucc

SEQ ID NO: 4196668 - RNA, 13 nt, Yersinia pestis KIM
gaagggcgcagcc

SEQ ID NO: 4196669 - RNA, 16 nt, Yersinia pestis KIM
gaagggcggccagcaa

SEQ ID NO: 4196670 - RNA, 22 nt, Yersinia pestis KIM
gaagggcggccagcaagagcag

SEQ ID NO: 4196671 - RNA, 14 nt, Yersinia pestis KIM
gaagggggcuuauu

SEQ ID NO: 4196672 - RNA, 16 nt, Yersinia pestis KIM
gaagggguucuuccaa

SEQ ID NO: 4196673 - RNA, 15 nt, Yersinia pestis KIM
gaaggguauugaaga

SEQ ID NO: 4196674 - RNA, 16 nt, Yersinia pestis KIM
gaagguaacuuaaaau

SEQ ID NO: 4196675 - RNA, 17 nt, Yersinia pestis KIM
gaagguaaucagacugc

SEQ ID NO: 4196676 - RNA, 18 nt, Yersinia pestis KIM
gaagguaaucagacugcu

SEQ ID NO: 4196677 - RNA, 19 nt, Yersinia pestis KIM
gaagguaaucagacugcug

SEQ ID NO: 4196678 - RNA, 12 nt, Yersinia pestis KIM
gaagguaaugcg

SEQ ID NO: 4196679 - RNA, 18 nt, Yersinia pestis KIM
gaaguacaguaccugcua

SEQ ID NO: 4196680 - RNA, 13 nt, Yersinia pestis KIM
gaaguacuuauuu

SEQ ID NO: 4196681 - RNA, 19 nt, Yersinia pestis KIM
gaaguacuuauuugaaaca

SEQ ID NO: 4196682 - RNA, 17 nt, Yersinia pestis KIM
gaaguguuuaccacggc

SEQ ID NO: 4196683 - RNA, 22 nt, Yersinia pestis KIM
gaaguuauugacaggugguucu

SEQ ID NO: 4196684 - RNA, 18 nt, Yersinia pestis KIM
gaaguuuaccgcaugaau

SEQ ID NO: 4196685 - RNA, 20 nt, Yersinia pestis KIM
gaauaaaaaagcccggucac

SEQ ID NO: 4196686 - RNA, 23 nt, Yersinia pestis KIM
gaauaaaaccuugcgccaagucc

SEQ ID NO: 4196687 - RNA, 12 nt, Yersinia pestis KIM
gaauaaaagaga

SEQ ID NO: 4196688 - RNA, 13 nt, Yersinia pestis KIM
gaauaaaauccac

SEQ ID NO: 4196689 - RNA, 16 nt, Yersinia pestis KIM
gaauaaccuacuccaa

SEQ ID NO: 4196690 - RNA, 17 nt, Yersinia pestis KIM
gaauaacucucaucuau

SEQ ID NO: 4196691 - RNA, 21 nt, Yersinia pestis KIM
gaauaacuucgcgaacacaau

SEQ ID NO: 4196692 - RNA, 20 nt, Yersinia pestis KIM
gaauaagagagacgggauaa

SEQ ID NO: 4196693 - RNA, 12 nt, Yersinia pestis KIM
gaauaaggguag

SEQ ID NO: 4196694 - RNA, 23 nt, Yersinia pestis KIM
gaauaauccccacggccagagcc

SEQ ID NO: 4196695 - RNA, 15 nt, Yersinia pestis KIM
gaauacacagcgaga

SEQ ID NO: 4196696 - RNA, 17 nt, Yersinia pestis KIM
gaauacagguacuucaa

SEQ ID NO: 4196697 - RNA, 18 nt, Yersinia pestis KIM
gaauaccauaacgcugcu

SEQ ID NO: 4196698 - RNA, 18 nt, Yersinia pestis KIM
gaauacccaaaauuugcu

SEQ ID NO: 4196699 - RNA, 19 nt, Yersinia pestis KIM
gaauacguagcccuuugcu

SEQ ID NO: 4196700 - RNA, 16 nt, Yersinia pestis KIM
gaauacuucaggccaa

SEQ ID NO: 4196701 - RNA, 19 nt, Yersinia pestis KIM
gaauagaccugaugacccg

SEQ ID NO: 4196702 - RNA, 22 nt, Yersinia pestis KIM
gaauagagacggaaagagccag

SEQ ID NO: 4196703 - RNA, 19 nt, Yersinia pestis KIM
gaauagaucccauacccac

SEQ ID NO: 4196704 - RNA, 15 nt, Yersinia pestis KIM
gaauagcaucagggg

SEQ ID NO: 4196705 - RNA, 15 nt, Yersinia pestis KIM
gaauagccaagccuu

SEQ ID NO: 4196706 - RNA, 19 nt, Yersinia pestis KIM
gaauagccaagccuuguaa

SEQ ID NO: 4196707 - RNA, 20 nt, Yersinia pestis KIM
gaauagccaagccuuguaac

SEQ ID NO: 4196708 - RNA, 16 nt, Yersinia pestis KIM
gaauagcgcugcauca

SEQ ID NO: 4196709 - RNA, 20 nt, Yersinia pestis KIM
gaauagcgcugcaucagcag

SEQ ID NO: 4196710 - RNA, 16 nt, Yersinia pestis KIM
gaauagcuguaaaaua

SEQ ID NO: 4196711 - RNA, 14 nt, Yersinia pestis KIM
gaauaggcagggga

SEQ ID NO: 4196712 - RNA, 20 nt, Yersinia pestis KIM
gaauagucacgcggcggcgu

SEQ ID NO: 4196713 - RNA, 21 nt, Yersinia pestis KIM
gaauauaaaagcacagacaaa

SEQ ID NO: 4196714 - RNA, 15 nt, Yersinia pestis KIM
gaauauaauuucaag

SEQ ID NO: 4196715 - RNA, 13 nt, Yersinia pestis KIM
gaauaucaggcac

SEQ ID NO: 4196716 - RNA, 16 nt, Yersinia pestis KIM
gaauaucuagcaacac

SEQ ID NO: 4196717 - RNA, 20 nt, Yersinia pestis KIM
gaauaucugugauaaccagc

SEQ ID NO: 4196718 - RNA, 13 nt, Yersinia pestis KIM
gaauauguucuuc

SEQ ID NO: 4196719 - RNA, 12 nt, Yersinia pestis KIM
gaauauuauuca

SEQ ID NO: 4196720 - RNA, 19 nt, Yersinia pestis KIM
gaauauuuacggugagaau

SEQ ID NO: 4196721 - RNA, 20 nt, Yersinia pestis KIM
gaaucaccgaaagaagacau

SEQ ID NO: 4196722 - RNA, 21 nt, Yersinia pestis KIM
gaaucacugucaaaaagcacc

SEQ ID NO: 4196723 - RNA, 14 nt, Yersinia pestis KIM
gaaucacuuacugg

SEQ ID NO: 4196724 - RNA, 14 nt, Yersinia pestis KIM
gaaucacuuuauuu

SEQ ID NO: 4196725 - RNA, 14 nt, Yersinia pestis KIM
gaaucagcggcggc

SEQ ID NO: 4196726 - RNA, 20 nt, Yersinia pestis KIM
gaaucauaaugguaccggca

SEQ ID NO: 4196727 - RNA, 14 nt, Yersinia pestis KIM
gaauccagccaugc

SEQ ID NO: 4196728 - RNA, 14 nt, Yersinia pestis KIM
gaaucccaucaaac

SEQ ID NO: 4196729 - RNA, 23 nt, Yersinia pestis KIM
gaaucccaucaaacgugaaauug

SEQ ID NO: 4196730 - RNA, 17 nt, Yersinia pestis KIM
gaaucccuaacgagaaa

SEQ ID NO: 4196731 - RNA, 17 nt, Yersinia pestis KIM
gaauccggauccagcgc

SEQ ID NO: 4196732 - RNA, 15 nt, Yersinia pestis KIM
gaaucucccuuguuu

SEQ ID NO: 4196733 - RNA, 22 nt, Yersinia pestis KIM
gaaucucuccagugcaaauuua

SEQ ID NO: 4196734 - RNA, 18 nt, Yersinia pestis KIM
gaaugaaguucaccagcu

SEQ ID NO: 4196735 - RNA, 21 nt, Yersinia pestis KIM
gaaugaaguucaccagcuugg

SEQ ID NO: 4196736 - RNA, 20 nt, Yersinia pestis KIM
gaaugacgcggguuuugccg

SEQ ID NO: 4196737 - RNA, 12 nt, Yersinia pestis KIM
gaaugagaugaa

SEQ ID NO: 4196738 - RNA, 15 nt, Yersinia pestis KIM
gaaugagaugaacac

SEQ ID NO: 4196739 - RNA, 16 nt, Yersinia pestis KIM
gaaugaggcugagguu

SEQ ID NO: 4196740 - RNA, 19 nt, Yersinia pestis KIM
gaaugaguuuuguccugag

SEQ ID NO: 4196741 - RNA, 22 nt, Yersinia pestis KIM
gaaugaugguauuaaucaacag

SEQ ID NO: 4196742 - RNA, 15 nt, Yersinia pestis KIM
gaaugauucauugag

SEQ ID NO: 4196743 - RNA, 19 nt, Yersinia pestis KIM
gaaugcacccaauggcaac

SEQ ID NO: 4196744 - RNA, 14 nt, Yersinia pestis KIM
gaaugcagauauca

SEQ ID NO: 4196745 - RNA, 20 nt, Yersinia pestis KIM
gaaugcagggagguuauauu

SEQ ID NO: 4196746 - RNA, 16 nt, Yersinia pestis KIM
gaaugcagucagcacu

SEQ ID NO: 4196747 - RNA, 16 nt, Yersinia pestis KIM
gaaugcaucgcaucag

SEQ ID NO: 4196748 - RNA, 22 nt, Yersinia pestis KIM
gaaugcgccgcggcccugaggu

SEQ ID NO: 4196749 - RNA, 22 nt, Yersinia pestis KIM
gaaugcguugccgaaagccaag

SEQ ID NO: 4196750 - RNA, 22 nt, Yersinia pestis KIM
gaauggagccgcuagcgcaggu

SEQ ID NO: 4196751 - RNA, 15 nt, Yersinia pestis KIM
gaauggaucacauca

SEQ ID NO: 4196752 - RNA, 17 nt, Yersinia pestis KIM
gaauggcaaagcacagu

SEQ ID NO: 4196753 - RNA, 17 nt, Yersinia pestis KIM
gaauggcaacguauaau

SEQ ID NO: 4196754 - RNA, 16 nt, Yersinia pestis KIM
gaauggcgcaauagca

SEQ ID NO: 4196755 - RNA, 19 nt, Yersinia pestis KIM
gaauggggggcaaccuggu

SEQ ID NO: 4196756 - RNA, 21 nt, Yersinia pestis KIM
gaaugucaugguuaaacugac

SEQ ID NO: 4196757 - RNA, 15 nt, Yersinia pestis KIM
gaaugugaagagcgg

SEQ ID NO: 4196758 - RNA, 16 nt, Yersinia pestis KIM
gaauguuaaacccccu

SEQ ID NO: 4196759 - RNA, 13 nt, Yersinia pestis KIM
gaauguucauuca

SEQ ID NO: 4196760 - RNA, 19 nt, Yersinia pestis KIM
gaauguuggugaucagcag

SEQ ID NO: 4196761 - RNA, 13 nt, Yersinia pestis KIM
gaauuaaauuuua

SEQ ID NO: 4196762 - RNA, 14 nt, Yersinia pestis KIM
gaauuaacauacaa

SEQ ID NO: 4196763 - RNA, 17 nt, Yersinia pestis KIM
gaauuaagaagccucau

SEQ ID NO: 4196764 - RNA, 20 nt, Yersinia pestis KIM
gaauuaagaagccucaugaa

SEQ ID NO: 4196765 - RNA, 21 nt, Yersinia pestis KIM
gaauuaagaagccucaugaau

SEQ ID NO: 4196766 - RNA, 10 nt, Yersinia pestis KIM
gaauuaauaa

SEQ ID NO: 4196767 - RNA, 14 nt, Yersinia pestis KIM
gaauuaauaacagu

SEQ ID NO: 4196768 - RNA, 14 nt, Yersinia pestis KIM
gaauucaccaaauu

SEQ ID NO: 4196769 - RNA, 17 nt, Yersinia pestis KIM
gaauucaccaaauugca

SEQ ID NO: 4196770 - RNA, 19 nt, Yersinia pestis KIM
gaauuuaagauaccagcga

SEQ ID NO: 4196771 - RNA, 16 nt, Yersinia pestis KIM
gaauuugauacaguga

SEQ ID NO: 4196772 - RNA, 12 nt, Yersinia pestis KIM
gaauuugcuagc

SEQ ID NO: 4196773 - RNA, 12 nt, Yersinia pestis KIM
gaauuugcugcu

SEQ ID NO: 4196774 - RNA, 13 nt, Yersinia pestis KIM
gaauuuuagucaa

SEQ ID NO: 4196775 - RNA, 16 nt, Yersinia pestis KIM
gaauuuuucccugcug

SEQ ID NO: 4196776 - RNA, 23 nt, Yersinia pestis KIM
gacaaaaaauaguuguuagccac

SEQ ID NO: 4196777 - RNA, 15 nt, Yersinia pestis KIM
gagacaggauaagca

SEQ ID NO: 4196778 - RNA, 20 nt, Yersinia pestis KIM
gagaccagguauuucuccau

SEQ ID NO: 4196779 - RNA, 15 nt, Yersinia pestis KIM
gagacccguuacugc

SEQ ID NO: 4196780 - RNA, 20 nt, Yersinia pestis KIM
gagacggaaagagccagcac

SEQ ID NO: 4196781 - RNA, 17 nt, Yersinia pestis KIM
gagacgugcguuuuuga

SEQ ID NO: 4196782 - RNA, 16 nt, Yersinia pestis KIM
gagagaggccagacac

SEQ ID NO: 4196783 - RNA, 12 nt, Yersinia pestis KIM
gagagcagggcc

SEQ ID NO: 4196784 - RNA, 16 nt, Yersinia pestis KIM
gagagcgcagcaguga

SEQ ID NO: 4196785 - RNA, 20 nt, Yersinia pestis KIM
gagaguaaggccaauuggcu

SEQ ID NO: 4196786 - RNA, 13 nt, Yersinia pestis KIM
gagagucagcaag

SEQ ID NO: 4196787 - RNA, 17 nt, Yersinia pestis KIM
gagagugauuauucugc

SEQ ID NO: 4196788 - RNA, 21 nt, Yersinia pestis KIM
gagauaaaaaggggcuacuga

SEQ ID NO: 4196789 - RNA, 20 nt, Yersinia pestis KIM
gagauaaucguggcuguaaa

SEQ ID NO: 4196790 - RNA, 16 nt, Yersinia pestis KIM
gagaucagugccagua

SEQ ID NO: 4196791 - RNA, 12 nt, Yersinia pestis KIM
gagaucaguuca

SEQ ID NO: 4196792 - RNA, 17 nt, Yersinia pestis KIM
gagaucaguucaguauu

SEQ ID NO: 4196793 - RNA, 24 nt, Yersinia pestis KIM
gagaucaucgggcauucacugcua

SEQ ID NO: 4196794 - RNA, 17 nt, Yersinia pestis KIM
gagauccuccauauccu

SEQ ID NO: 4196795 - RNA, 22 nt, Yersinia pestis KIM
gagaucguaggcuugagguuau

SEQ ID NO: 4196796 - RNA, 15 nt, Yersinia pestis KIM
gagaugcaaucuaac

SEQ ID NO: 4196797 - RNA, 20 nt, Yersinia pestis KIM
gagauuauugggcugccugu

SEQ ID NO: 4196798 - RNA, 22 nt, Yersinia pestis KIM
gagauuauugggcugccugugc

SEQ ID NO: 4196799 - RNA, 12 nt, Yersinia pestis KIM
gagauucugggg

SEQ ID NO: 4196800 - RNA, 13 nt, Yersinia pestis KIM
gagauugcuacug

SEQ ID NO: 4196801 - RNA, 17 nt, Yersinia pestis KIM
gagauuucagacugcug

SEQ ID NO: 4196802 - RNA, 15 nt, Yersinia pestis KIM
gagcaaaaagccagc

SEQ ID NO: 4196803 - RNA, 18 nt, Yersinia pestis KIM
gagcaaaacugggcuuga

SEQ ID NO: 4196804 - RNA, 17 nt, Yersinia pestis KIM
gagcaagggcagcuaac

SEQ ID NO: 4196805 - RNA, 13 nt, Yersinia pestis KIM
gagcaaucaaaag

SEQ ID NO: 4196806 - RNA, 18 nt, Yersinia pestis KIM
gagcaaucuggcggccgc

SEQ ID NO: 4196807 - RNA, 13 nt, Yersinia pestis KIM
gagcaccaaaucu

SEQ ID NO: 4196808 - RNA, 18 nt, Yersinia pestis KIM
gagcaccaaaucuuccag

SEQ ID NO: 4196809 - RNA, 15 nt, Yersinia pestis KIM
gagcaccgcaggaac

SEQ ID NO: 4196810 - RNA, 21 nt, Yersinia pestis KIM
gagcacugccccgaagcucaa

SEQ ID NO: 4196811 - RNA, 22 nt, Yersinia pestis KIM
gagcagaaagcagcagcuuuug

SEQ ID NO: 4196812 - RNA, 12 nt, Yersinia pestis KIM
gagcagaccgac

SEQ ID NO: 4196813 - RNA, 22 nt, Yersinia pestis KIM
gagcagcaauaauuacgcguuc

SEQ ID NO: 4196814 - RNA, 19 nt, Yersinia pestis KIM
gagcagccaacacaccugc

SEQ ID NO: 4196815 - RNA, 22 nt, Yersinia pestis KIM
gagcaggcuuugugccaaauag

SEQ ID NO: 4196816 - RNA, 18 nt, Yersinia pestis KIM
gagcaguaaguuaaaaag

SEQ ID NO: 4196817 - RNA, 20 nt, Yersinia pestis KIM
gagcaguaauagcaaaaaaa

SEQ ID NO: 4196818 - RNA, 21 nt, Yersinia pestis KIM
gagcauaacugguggcaggcc

SEQ ID NO: 4196819 - RNA, 20 nt, Yersinia pestis KIM
gagcauaccaauaccggcga

SEQ ID NO: 4196820 - RNA, 22 nt, Yersinia pestis KIM
gagcauaccgguuugggcauca

SEQ ID NO: 4196821 - RNA, 22 nt, Yersinia pestis KIM
gagcauacuguuggcaauuuca

SEQ ID NO: 4196822 - RNA, 18 nt, Yersinia pestis KIM
gagccaauuaagaaaucu

SEQ ID NO: 4196823 - RNA, 22 nt, Yersinia pestis KIM
gagccaauuaagaaaucugcag

SEQ ID NO: 4196824 - RNA, 19 nt, Yersinia pestis KIM
gagccacaacgcacugaag

SEQ ID NO: 4196825 - RNA, 15 nt, Yersinia pestis KIM
gagccauccaggcaa

SEQ ID NO: 4196826 - RNA, 16 nt, Yersinia pestis KIM
gagccauccaggcaag

SEQ ID NO: 4196827 - RNA, 14 nt, Yersinia pestis KIM
gagcccccagggaa

SEQ ID NO: 4196828 - RNA, 19 nt, Yersinia pestis KIM
gagccgcccuuuagccagc

SEQ ID NO: 4196829 - RNA, 15 nt, Yersinia pestis KIM
gagccgcgcccuccc

SEQ ID NO: 4196830 - RNA, 18 nt, Yersinia pestis KIM
gagccuacuacauggaug

SEQ ID NO: 4196831 - RNA, 16 nt, Yersinia pestis KIM
gagccucaugaaugag

SEQ ID NO: 4196832 - RNA, 21 nt, Yersinia pestis KIM
gagccucaugaaugaggcuga

SEQ ID NO: 4196833 - RNA, 20 nt, Yersinia pestis KIM
gagcgauaacauuuuuucuu

SEQ ID NO: 4196834 - RNA, 18 nt, Yersinia pestis KIM
gagcggaucgacgugaag

SEQ ID NO: 4196835 - RNA, 13 nt, Yersinia pestis KIM
gagcggcaacugu

SEQ ID NO: 4196836 - RNA, 13 nt, Yersinia pestis KIM
gagcgguaagcug

SEQ ID NO: 4196837 - RNA, 12 nt, Yersinia pestis KIM
gagcguaaucug

SEQ ID NO: 4196838 - RNA, 21 nt, Yersinia pestis KIM
gagcguauagguuauaagcca

SEQ ID NO: 4196839 - RNA, 20 nt, Yersinia pestis KIM
gagcgucaagccaaccccca

SEQ ID NO: 4196840 - RNA, 12 nt, Yersinia pestis KIM
gagcuaaugcuc

SEQ ID NO: 4196841 - RNA, 17 nt, Yersinia pestis KIM
gagcuauggaagaacug

SEQ ID NO: 4196842 - RNA, 22 nt, Yersinia pestis KIM
gagcucagccaggcagcuauca

SEQ ID NO: 4196843 - RNA, 17 nt, Yersinia pestis KIM
gagcugaacugagguga

SEQ ID NO: 4196844 - RNA, 17 nt, Yersinia pestis KIM
gagcugaucugccagua

SEQ ID NO: 4196845 - RNA, 16 nt, Yersinia pestis KIM
gagcugcgauaaucug

SEQ ID NO: 4196846 - RNA, 21 nt, Yersinia pestis KIM
gagcuuccagugcauuaucuu

SEQ ID NO: 4196847 - RNA, 17 nt, Yersinia pestis KIM
gagcuucuucaaaagca

SEQ ID NO: 4196848 - RNA, 11 nt, Yersinia pestis KIM
gagcuugcugc

SEQ ID NO: 4196849 - RNA, 13 nt, Yersinia pestis KIM
gagcuugcugcug

SEQ ID NO: 4196850 - RNA, 21 nt, Yersinia pestis KIM
gaggaagagauaaacgaccau

SEQ ID NO: 4196851 - RNA, 21 nt, Yersinia pestis KIM
gaggaaggcgguuaucuggaa

SEQ ID NO: 4196852 - RNA, 14 nt, Yersinia pestis KIM
gaggacggcggccu

SEQ ID NO: 4196853 - RNA, 14 nt, Yersinia pestis KIM
gaggacuauucaau

SEQ ID NO: 4196854 - RNA, 19 nt, Yersinia pestis KIM
gaggacuuccugcccagcg

SEQ ID NO: 4196855 - RNA, 21 nt, Yersinia pestis KIM
gaggacuuccugcccagcggc

SEQ ID NO: 4196856 - RNA, 16 nt, Yersinia pestis KIM
gaggagauuucagacu

SEQ ID NO: 4196857 - RNA, 14 nt, Yersinia pestis KIM
gaggauaggcagag

SEQ ID NO: 4196858 - RNA, 19 nt, Yersinia pestis KIM
gaggauauuagggcugaca

SEQ ID NO: 4196859 - RNA, 14 nt, Yersinia pestis KIM
gaggauucaagaac

SEQ ID NO: 4196860 - RNA, 18 nt, Yersinia pestis KIM
gaggauuuuccgcagcuc

SEQ ID NO: 4196861 - RNA, 22 nt, Yersinia pestis KIM
gaggcaucaagggcggggucaa

SEQ ID NO: 4196862 - RNA, 13 nt, Yersinia pestis KIM
gaggccaaaugaa

SEQ ID NO: 4196863 - RNA, 14 nt, Yersinia pestis KIM
gaggccagcggcau

SEQ ID NO: 4196864 - RNA, 18 nt, Yersinia pestis KIM
gaggccuuauucgccagg

SEQ ID NO: 4196865 - RNA, 22 nt, Yersinia pestis KIM
gaggcugcguguucuucucacc

SEQ ID NO: 4196866 - RNA, 13 nt, Yersinia pestis KIM
gagggagucaggg

SEQ ID NO: 4196867 - RNA, 16 nt, Yersinia pestis KIM
gagggagucagggagu

SEQ ID NO: 4196868 - RNA, 17 nt, Yersinia pestis KIM
gagggcgguuaaauaca

SEQ ID NO: 4196869 - RNA, 18 nt, Yersinia pestis KIM
gagggcguucucaggaac

SEQ ID NO: 4196870 - RNA, 17 nt, Yersinia pestis KIM
gagggcucaaucucugc

SEQ ID NO: 4196871 - RNA, 13 nt, Yersinia pestis KIM
gagggcuucuggc

SEQ ID NO: 4196872 - RNA, 15 nt, Yersinia pestis KIM
gagguggcacccagu

SEQ ID NO: 4196873 - RNA, 21 nt, Yersinia pestis KIM
gagguggccgagaggcugaag

SEQ ID NO: 4196874 - RNA, 14 nt, Yersinia pestis KIM
gagguuaucagccu

SEQ ID NO: 4196875 - RNA, 21 nt, Yersinia pestis KIM
gagguuauugacaaagagccc

SEQ ID NO: 4196876 - RNA, 12 nt, Yersinia pestis KIM
gagguugaugag

SEQ ID NO: 4196877 - RNA, 13 nt, Yersinia pestis KIM
gaguaaaacugau

SEQ ID NO: 4196878 - RNA, 18 nt, Yersinia pestis KIM
gaguaaagcccagcaggc

SEQ ID NO: 4196879 - RNA, 20 nt, Yersinia pestis KIM
gaguaaauagcaaaacugag

SEQ ID NO: 4196880 - RNA, 21 nt, Yersinia pestis KIM
gaguaacaaauggucaggaac

SEQ ID NO: 4196881 - RNA, 20 nt, Yersinia pestis KIM
gaguaacacuucagacugaa

SEQ ID NO: 4196882 - RNA, 22 nt, Yersinia pestis KIM
gaguaacacuucagacugaaag

SEQ ID NO: 4196883 - RNA, 19 nt, Yersinia pestis KIM
gaguaagugauucggguga

SEQ ID NO: 4196884 - RNA, 21 nt, Yersinia pestis KIM
gaguacuaacgucaacagaac

SEQ ID NO: 4196885 - RNA, 23 nt, Yersinia pestis KIM
gaguacugcgcuagaccaguuaa

SEQ ID NO: 4196886 - RNA, 13 nt, Yersinia pestis KIM
gaguaguugucaa

SEQ ID NO: 4196887 - RNA, 13 nt, Yersinia pestis KIM
gagucacagcauu

SEQ ID NO: 4196888 - RNA, 16 nt, Yersinia pestis KIM
gagucagggagucagg

SEQ ID NO: 4196889 - RNA, 21 nt, Yersinia pestis KIM
gagucagggagucagggaguc

SEQ ID NO: 4196890 - RNA, 13 nt, Yersinia pestis KIM
gagucagucaggg

SEQ ID NO: 4196891 - RNA, 16 nt, Yersinia pestis KIM
gagucagucaggguga

SEQ ID NO: 4196892 - RNA, 20 nt, Yersinia pestis KIM
gagucccguccgcaccgcca

SEQ ID NO: 4196893 - RNA, 20 nt, Yersinia pestis KIM
gagucgauagcuuucuccuu

SEQ ID NO: 4196894 - RNA, 16 nt, Yersinia pestis KIM
gagucgcuccucagcc

SEQ ID NO: 4196895 - RNA, 22 nt, Yersinia pestis KIM
gagucguaaaauuuuggcaacc

SEQ ID NO: 4196896 - RNA, 21 nt, Yersinia pestis KIM
gagucucaucaaggaaaaugg

SEQ ID NO: 4196897 - RNA, 17 nt, Yersinia pestis KIM
gagugaagacaucgcca

SEQ ID NO: 4196898 - RNA, 14 nt, Yersinia pestis KIM
gagugaaggguuga

SEQ ID NO: 4196899 - RNA, 16 nt, Yersinia pestis KIM
gagugaauuucuuccc

SEQ ID NO: 4196900 - RNA, 17 nt, Yersinia pestis KIM
gagugagucaucggggu

SEQ ID NO: 4196901 - RNA, 23 nt, Yersinia pestis KIM
gagugcauccagcguaaacagua

SEQ ID NO: 4196902 - RNA, 20 nt, Yersinia pestis KIM
gagugccagcaaagacaaua

SEQ ID NO: 4196903 - RNA, 13 nt, Yersinia pestis KIM
gagugcuggcaag

SEQ ID NO: 4196904 - RNA, 18 nt, Yersinia pestis KIM
gaguguaaaaagcagugc

SEQ ID NO: 4196905 - RNA, 19 nt, Yersinia pestis KIM
gaguguucauaaauuaaaa

SEQ ID NO: 4196906 - RNA, 23 nt, Yersinia pestis KIM
gaguguucggggguugucagcag

SEQ ID NO: 4196907 - RNA, 22 nt, Yersinia pestis KIM
gaguguuggccucagacuaaug

SEQ ID NO: 4196908 - RNA, 14 nt, Yersinia pestis KIM
gaguuaaacugggu

SEQ ID NO: 4196909 - RNA, 20 nt, Yersinia pestis KIM
gaguuaccuugugucaccau

SEQ ID NO: 4196910 - RNA, 19 nt, Yersinia pestis KIM
gaguuaucuguuucaaaua

SEQ ID NO: 4196911 - RNA, 21 nt, Yersinia pestis KIM
gaguuaucuguuucaaauaag

SEQ ID NO: 4196912 - RNA, 22 nt, Yersinia pestis KIM
gaguugauaaacaauaaacaga

SEQ ID NO: 4196913 - RNA, 17 nt, Yersinia pestis KIM
gaguugaugcaauggca

SEQ ID NO: 4196914 - RNA, 12 nt, Yersinia pestis KIM
gaguuucaaguc

SEQ ID NO: 4196915 - RNA, 14 nt, Yersinia pestis KIM
gaguuuuagcccaa

SEQ ID NO: 4196916 - RNA, 21 nt, Yersinia pestis KIM
gaguuuucccugcgccagcag

SEQ ID NO: 4196917 - RNA, 17 nt, Yersinia pestis KIM
gauaaaaacauuuaaau

SEQ ID NO: 4196918 - RNA, 14 nt, Yersinia pestis KIM
gauaaaaagccagu

SEQ ID NO: 4196919 - RNA, 20 nt, Yersinia pestis KIM
gauaaaaauaaucaaugacc

SEQ ID NO: 4196920 - RNA, 12 nt, Yersinia pestis KIM
gauaaaaaugca

SEQ ID NO: 4196921 - RNA, 13 nt, Yersinia pestis KIM
gauaaaacaauag

SEQ ID NO: 4196922 - RNA, 15 nt, Yersinia pestis KIM
gauaaaacaauagcu

SEQ ID NO: 4196923 - RNA, 11 nt, Yersinia pestis KIM
gauaaaaccac

SEQ ID NO: 4196924 - RNA, 16 nt, Yersinia pestis KIM
gauaaaaccacugacc

SEQ ID NO: 4196925 - RNA, 23 nt, Yersinia pestis KIM
gauaaaagaaagggcaacgacau

SEQ ID NO: 4196926 - RNA, 18 nt, Yersinia pestis KIM
gauaaaaggcuauuuaaa

SEQ ID NO: 4196927 - RNA, 19 nt, Yersinia pestis KIM
gauaaaaggcuauuuaaau

SEQ ID NO: 4196928 - RNA, 20 nt, Yersinia pestis KIM
gauaaaaggcuauuuaaauu

SEQ ID NO: 4196929 - RNA, 13 nt, Yersinia pestis KIM
gauaaaauacuuc

SEQ ID NO: 4196930 - RNA, 15 nt, Yersinia pestis KIM
gauaaacaaauauga

SEQ ID NO: 4196931 - RNA, 19 nt, Yersinia pestis KIM
gauaaacacccaagaauau

SEQ ID NO: 4196932 - RNA, 21 nt, Yersinia pestis KIM
gauaaacacccaagaauauaa

SEQ ID NO: 4196933 - RNA, 12 nt, Yersinia pestis KIM
gauaaacuguuu

SEQ ID NO: 4196934 - RNA, 15 nt, Yersinia pestis KIM
gauaaagagugaaau

SEQ ID NO: 4196935 - RNA, 22 nt, Yersinia pestis KIM
gauaaaggcggugauaaacccu

SEQ ID NO: 4196936 - RNA, 14 nt, Yersinia pestis KIM
gauaaagucugaaa

SEQ ID NO: 4196937 - RNA, 18 nt, Yersinia pestis KIM
gauaaauaauuacuuaua

SEQ ID NO: 4196938 - RNA, 16 nt, Yersinia pestis KIM
gauaaauacaggcucu

SEQ ID NO: 4196939 - RNA, 20 nt, Yersinia pestis KIM
gauaaauaccgccaaauaca

SEQ ID NO: 4196940 - RNA, 21 nt, Yersinia pestis KIM
gauaaauagucguuauauaaa

SEQ ID NO: 4196941 - RNA, 14 nt, Yersinia pestis KIM
gauaaauucaaaua

SEQ ID NO: 4196942 - RNA, 16 nt, Yersinia pestis KIM
gauaacacauauauua

SEQ ID NO: 4196943 - RNA, 23 nt, Yersinia pestis KIM
gauaacaccggcuucuccugcgg

SEQ ID NO: 4196944 - RNA, 13 nt, Yersinia pestis KIM
gauaaccagcagc

SEQ ID NO: 4196945 - RNA, 16 nt, Yersinia pestis KIM
gauaacccuaucguca

SEQ ID NO: 4196946 - RNA, 19 nt, Yersinia pestis KIM
gauaaccguuuuuucaacu

SEQ ID NO: 4196947 - RNA, 17 nt, Yersinia pestis KIM
gauaacgggcagguuuu

SEQ ID NO: 4196948 - RNA, 17 nt, Yersinia pestis KIM
gauaacgguaucaguca

SEQ ID NO: 4196949 - RNA, 16 nt, Yersinia pestis KIM
gauaacgugcgacuuu

SEQ ID NO: 4196950 - RNA, 21 nt, Yersinia pestis KIM
gauaacguuguuucugaaggg

SEQ ID NO: 4196951 - RNA, 16 nt, Yersinia pestis KIM
gauaacuccaggguaa

SEQ ID NO: 4196952 - RNA, 18 nt, Yersinia pestis KIM
gauaacuccaggguaaua

SEQ ID NO: 4196953 - RNA, 18 nt, Yersinia pestis KIM
gauaacugaccugcgcuu

SEQ ID NO: 4196954 - RNA, 18 nt, Yersinia pestis KIM
gauaacuuuuuauuucuu

SEQ ID NO: 4196955 - RNA, 22 nt, Yersinia pestis KIM
gauaacuuuuuauuucuuuuaa

SEQ ID NO: 4196956 - RNA, 16 nt, Yersinia pestis KIM
gauaagaaugaauauu

SEQ ID NO: 4196957 - RNA, 20 nt, Yersinia pestis KIM
gauaagagcgacucaauaau

SEQ ID NO: 4196958 - RNA, 15 nt, Yersinia pestis KIM
gauaagaucucagca

SEQ ID NO: 4196959 - RNA, 13 nt, Yersinia pestis KIM
gauaagccucggu

SEQ ID NO: 4196960 - RNA, 20 nt, Yersinia pestis KIM
gauaagcgguuuuaucaaua

SEQ ID NO: 4196961 - RNA, 21 nt, Yersinia pestis KIM
gauaauaaaacggcucaucgc

SEQ ID NO: 4196962 - RNA, 19 nt, Yersinia pestis KIM
gauaauaaauauccuccgg

SEQ ID NO: 4196963 - RNA, 13 nt, Yersinia pestis KIM
gauaauaaauugc

SEQ ID NO: 4196964 - RNA, 17 nt, Yersinia pestis KIM
gauaauaaccugauauu

SEQ ID NO: 4196965 - RNA, 20 nt, Yersinia pestis KIM
gauaauaguucauuuuguau

SEQ ID NO: 4196966 - RNA, 21 nt, Yersinia pestis KIM
gauaaucagaggugaaaaaau

SEQ ID NO: 4196967 - RNA, 18 nt, Yersinia pestis KIM
gauaaucguggcuguaaa

SEQ ID NO: 4196968 - RNA, 21 nt, Yersinia pestis KIM
gauaaugcugaugcaauaacu

SEQ ID NO: 4196969 - RNA, 20 nt, Yersinia pestis KIM
gauaauggaugaauauccac

SEQ ID NO: 4196970 - RNA, 18 nt, Yersinia pestis KIM
gauaauuauccauuuucu

SEQ ID NO: 4196971 - RNA, 21 nt, Yersinia pestis KIM
gauaauuauccauuuucugcc

SEQ ID NO: 4196972 - RNA, 18 nt, Yersinia pestis KIM
gauaauuggcaauaaugu

SEQ ID NO: 4196973 - RNA, 16 nt, Yersinia pestis KIM
gauaauuuaauuaguu

SEQ ID NO: 4196974 - RNA, 16 nt, Yersinia pestis KIM
gauaauuucagcagca

SEQ ID NO: 4196975 - RNA, 23 nt, Yersinia pestis KIM
gauaauuucuacgccgucaucau

SEQ ID NO: 4196976 - RNA, 19 nt, Yersinia pestis KIM
gauaauuugccuggcgaau

SEQ ID NO: 4196977 - RNA, 22 nt, Yersinia pestis KIM
gauacaaaugagagcgcagcag

SEQ ID NO: 4196978 - RNA, 22 nt, Yersinia pestis KIM
gauacaauagauaacugaaaga

SEQ ID NO: 4196979 - RNA, 15 nt, Yersinia pestis KIM
gauacacaugguugc

SEQ ID NO: 4196980 - RNA, 19 nt, Yersinia pestis KIM
gauacaccguaucugccaa

SEQ ID NO: 4196981 - RNA, 16 nt, Yersinia pestis KIM
gauacagcccaagaga

SEQ ID NO: 4196982 - RNA, 14 nt, Yersinia pestis KIM
gauacaucaaauca

SEQ ID NO: 4196983 - RNA, 15 nt, Yersinia pestis KIM
gauacaucucggcuu

SEQ ID NO: 4196984 - RNA, 16 nt, Yersinia pestis KIM
gauaccacaauccggu

SEQ ID NO: 4196985 - RNA, 18 nt, Yersinia pestis KIM
gauaccacaucaaaccgg

SEQ ID NO: 4196986 - RNA, 18 nt, Yersinia pestis KIM
gauaccacccguugcauu

SEQ ID NO: 4196987 - RNA, 19 nt, Yersinia pestis KIM
gauaccagcgaagugccgc

SEQ ID NO: 4196988 - RNA, 13 nt, Yersinia pestis KIM
gauacccgccagu

SEQ ID NO: 4196989 - RNA, 21 nt, Yersinia pestis KIM
gauacccgccauaaauaaaga

SEQ ID NO: 4196990 - RNA, 22 nt, Yersinia pestis KIM
gauaccgauaauaaauauccuc

SEQ ID NO: 4196991 - RNA, 17 nt, Yersinia pestis KIM
gauaccgccaaucucuc

SEQ ID NO: 4196992 - RNA, 18 nt, Yersinia pestis KIM
gauacgcaaaccauggcg

SEQ ID NO: 4196993 - RNA, 15 nt, Yersinia pestis KIM
gauacggcuccagaa

SEQ ID NO: 4196994 - RNA, 14 nt, Yersinia pestis KIM
gauacgguccagca

SEQ ID NO: 4196995 - RNA, 17 nt, Yersinia pestis KIM
gauacguugcaggucaa

SEQ ID NO: 4196996 - RNA, 22 nt, Yersinia pestis KIM
gauacguuuggugccgcuggca

SEQ ID NO: 4196997 - RNA, 14 nt, Yersinia pestis KIM
gauacuaauuucua

SEQ ID NO: 4196998 - RNA, 17 nt, Yersinia pestis KIM
gauacuacaaucaucgg

SEQ ID NO: 4196999 - RNA, 18 nt, Yersinia pestis KIM
gauacuacaaucaucggc

SEQ ID NO: 4197000 - RNA, 17 nt, Yersinia pestis KIM
gauacuuuuuauuuuuu

SEQ ID NO: 4197001 - RNA, 19 nt, Yersinia pestis KIM
gauacuuuuuauuuuuuaa

SEQ ID NO: 4197002 - RNA, 21 nt, Yersinia pestis KIM
gauagaaaguugagcagcaau

SEQ ID NO: 4197003 - RNA, 14 nt, Yersinia pestis KIM
gauagacagcaaac

SEQ ID NO: 4197004 - RNA, 19 nt, Yersinia pestis KIM
gauagagauaaaaaaaccg

SEQ ID NO: 4197005 - RNA, 19 nt, Yersinia pestis KIM
gauagaguacucggcuacg

SEQ ID NO: 4197006 - RNA, 20 nt, Yersinia pestis KIM
gaucccucggugauaaguuu

SEQ ID NO: 4197007 - RNA, 16 nt, Yersinia pestis KIM
gauccguuuaaucagu

SEQ ID NO: 4197008 - RNA, 20 nt, Yersinia pestis KIM
gauccguuuaaucagugaca

SEQ ID NO: 4197009 - RNA, 18 nt, Yersinia pestis KIM
gauccuaggcggugaggg

SEQ ID NO: 4197010 - RNA, 23 nt, Yersinia pestis KIM
gauccucguuagucacucaagcc

SEQ ID NO: 4197011 - RNA, 23 nt, Yersinia pestis KIM
gauccugaacgaggacuuccugc

SEQ ID NO: 4197012 - RNA, 20 nt, Yersinia pestis KIM
gauccugccgccucugcucc

SEQ ID NO: 4197013 - RNA, 18 nt, Yersinia pestis KIM
gauccuggcccgccagca

SEQ ID NO: 4197014 - RNA, 19 nt, Yersinia pestis KIM
gauccuggguuuuauugca

SEQ ID NO: 4197015 - RNA, 21 nt, Yersinia pestis KIM
gaucgacgugaagugagcuga

SEQ ID NO: 4197016 - RNA, 13 nt, Yersinia pestis KIM
gaucgccaaauaa

SEQ ID NO: 4197017 - RNA, 17 nt, Yersinia pestis KIM
gaucgcgacgaaaaccu

SEQ ID NO: 4197018 - RNA, 20 nt, Yersinia pestis KIM
gaucgcgcccauccgcagga

SEQ ID NO: 4197019 - RNA, 18 nt, Yersinia pestis KIM
gaucgcggcgguaacccc

SEQ ID NO: 4197020 - RNA, 18 nt, Yersinia pestis KIM
gaucgcucucacccugcg

SEQ ID NO: 4197021 - RNA, 15 nt, Yersinia pestis KIM
gaucgcuucacggca

SEQ ID NO: 4197022 - RNA, 18 nt, Yersinia pestis KIM
gaucggguggaccuccau

SEQ ID NO: 4197023 - RNA, 19 nt, Yersinia pestis KIM
gaucuaacguccccugagc

SEQ ID NO: 4197024 - RNA, 20 nt, Yersinia pestis KIM
gaucucaucauugacgugca

SEQ ID NO: 4197025 - RNA, 18 nt, Yersinia pestis KIM
gaucucuaucgcgguuuu

SEQ ID NO: 4197026 - RNA, 21 nt, Yersinia pestis KIM
gaucucuaucgcgguuuuaaa

SEQ ID NO: 4197027 - RNA, 13 nt, Yersinia pestis KIM
gaucucugcgaca

SEQ ID NO: 4197028 - RNA, 19 nt, Yersinia pestis KIM
gaucugaaacggugaggau

SEQ ID NO: 4197029 - RNA, 22 nt, Yersinia pestis KIM
gaucugauaucucuuuaucauu

SEQ ID NO: 4197030 - RNA, 20 nt, Yersinia pestis KIM
gaucugcacaccacacugga

SEQ ID NO: 4197031 - RNA, 23 nt, Yersinia pestis KIM
gaucugccccuggcucaguagca

SEQ ID NO: 4197032 - RNA, 16 nt, Yersinia pestis KIM
gaucugccuguucucu

SEQ ID NO: 4197033 - RNA, 22 nt, Yersinia pestis KIM
gaucuuauuaauugguauuuua

SEQ ID NO: 4197034 - RNA, 14 nt, Yersinia pestis KIM
gaucuuuuucauuc

SEQ ID NO: 4197035 - RNA, 22 nt, Yersinia pestis KIM
gaugaaaaacugugcaaauggc

SEQ ID NO: 4197036 - RNA, 11 nt, Yersinia pestis KIM
gaugaaaaaua

SEQ ID NO: 4197037 - RNA, 20 nt, Yersinia pestis KIM
gaugaaaaauacaaauauaa

SEQ ID NO: 4197038 - RNA, 17 nt, Yersinia pestis KIM
gaugaaaauugcaggug

SEQ ID NO: 4197039 - RNA, 13 nt, Yersinia pestis KIM
gaugaaacacaac

SEQ ID NO: 4197040 - RNA, 16 nt, Yersinia pestis KIM
gaugaaacacaacaac

SEQ ID NO: 4197041 - RNA, 13 nt, Yersinia pestis KIM
gaugaaacccaga

SEQ ID NO: 4197042 - RNA, 22 nt, Yersinia pestis KIM
gaugaaacuaaaauaaucuugu

SEQ ID NO: 4197043 - RNA, 20 nt, Yersinia pestis KIM
gaugaaauccagaucagcgc

SEQ ID NO: 4197044 - RNA, 15 nt, Yersinia pestis KIM
gaugaaauuaaaaug

SEQ ID NO: 4197045 - RNA, 12 nt, Yersinia pestis KIM
gaugaaauuuua

SEQ ID NO: 4197046 - RNA, 14 nt, Yersinia pestis KIM
gaugaacacagaaa

SEQ ID NO: 4197047 - RNA, 14 nt, Yersinia pestis KIM
gaugaacggcuggu

SEQ ID NO: 4197048 - RNA, 16 nt, Yersinia pestis KIM
gaugaacuacaggggg

SEQ ID NO: 4197049 - RNA, 17 nt, Yersinia pestis KIM
gaugaacugacacacac

SEQ ID NO: 4197050 - RNA, 20 nt, Yersinia pestis KIM
gaugaagguaaugcgaaaaa

SEQ ID NO: 4197051 - RNA, 16 nt, Yersinia pestis KIM
gaugaaucaaugaaau

SEQ ID NO: 4197052 - RNA, 13 nt, Yersinia pestis KIM
gaugaauccagcc

SEQ ID NO: 4197053 - RNA, 23 nt, Yersinia pestis KIM
gaugaaugacuggcuauuagaau

SEQ ID NO: 4197054 - RNA, 22 nt, Yersinia pestis KIM
gaugacaacaccguaacgcccu

SEQ ID NO: 4197055 - RNA, 16 nt, Yersinia pestis KIM
gaugacaaugcguuau

SEQ ID NO: 4197056 - RNA, 22 nt, Yersinia pestis KIM
gaugacaaugcguuauaaccau

SEQ ID NO: 4197057 - RNA, 15 nt, Yersinia pestis KIM
gaugacacaauuccc

SEQ ID NO: 4197058 - RNA, 20 nt, Yersinia pestis KIM
gaugaccgugacauuuucac

SEQ ID NO: 4197059 - RNA, 20 nt, Yersinia pestis KIM
gaugacgccguacaaauaua

SEQ ID NO: 4197060 - RNA, 16 nt, Yersinia pestis KIM
gaugacguaauuuuaa

SEQ ID NO: 4197061 - RNA, 23 nt, Yersinia pestis KIM
gaugagaaugugacucagcgaau

SEQ ID NO: 4197062 - RNA, 13 nt, Yersinia pestis KIM
gaugagcugguga

SEQ ID NO: 4197063 - RNA, 21 nt, Yersinia pestis KIM
gaugagcuggugagaaaggcg

SEQ ID NO: 4197064 - RNA, 21 nt, Yersinia pestis KIM
gaugaguauuaccucaucauu

SEQ ID NO: 4197065 - RNA, 16 nt, Yersinia pestis KIM
gaugagucgcugguau

SEQ ID NO: 4197066 - RNA, 14 nt, Yersinia pestis KIM
gaugauauacccac

SEQ ID NO: 4197067 - RNA, 20 nt, Yersinia pestis KIM
gaugauauacccaccagaga

SEQ ID NO: 4197068 - RNA, 14 nt, Yersinia pestis KIM
gaugauauuuaucg

SEQ ID NO: 4197069 - RNA, 19 nt, Yersinia pestis KIM
gaugaucaccgccugcgua

SEQ ID NO: 4197070 - RNA, 14 nt, Yersinia pestis KIM
gaugaucucuggcc

SEQ ID NO: 4197071 - RNA, 19 nt, Yersinia pestis KIM
gaugaugaguaugcaacag

SEQ ID NO: 4197072 - RNA, 18 nt, Yersinia pestis KIM
gaugauugaggcguacca

SEQ ID NO: 4197073 - RNA, 16 nt, Yersinia pestis KIM
gaugauugcaucauca

SEQ ID NO: 4197074 - RNA, 21 nt, Yersinia pestis KIM
gaugauuguuuuauggcgaug

SEQ ID NO: 4197075 - RNA, 18 nt, Yersinia pestis KIM
gaugcacaguaggcugaa

SEQ ID NO: 4197076 - RNA, 21 nt, Yersinia pestis KIM
gaugcacaguaggcugaaggc

SEQ ID NO: 4197077 - RNA, 19 nt, Yersinia pestis KIM
gaugcaguaaauagucuug

SEQ ID NO: 4197078 - RNA, 17 nt, Yersinia pestis KIM
gaugcauauuauaauga

SEQ ID NO: 4197079 - RNA, 20 nt, Yersinia pestis KIM
gaugcauauuugcagaaagu

SEQ ID NO: 4197080 - RNA, 18 nt, Yersinia pestis KIM
gaugcauccuugaucgcc

SEQ ID NO: 4197081 - RNA, 20 nt, Yersinia pestis KIM
gaugccaaucaaaaaaccgg

SEQ ID NO: 4197082 - RNA, 13 nt, Yersinia pestis KIM
gaugccacuguuc

SEQ ID NO: 4197083 - RNA, 13 nt, Yersinia pestis KIM
gaugcccgcauua

SEQ ID NO: 4197084 - RNA, 13 nt, Yersinia pestis KIM
gaugccgcuuuag

SEQ ID NO: 4197085 - RNA, 13 nt, Yersinia pestis KIM
gaugccuauuugc

SEQ ID NO: 4197086 - RNA, 18 nt, Yersinia pestis KIM
gaugccuauuugcagaaa

SEQ ID NO: 4197087 - RNA, 20 nt, Yersinia pestis KIM
gaugccuauuugcagaaagu

SEQ ID NO: 4197088 - RNA, 15 nt, Yersinia pestis KIM
gaugcgacaauuucc

SEQ ID NO: 4197089 - RNA, 23 nt, Yersinia pestis KIM
gaugcgaucuauccaauccuuug

SEQ ID NO: 4197090 - RNA, 18 nt, Yersinia pestis KIM
gaugcgcgcgucacuaaa

SEQ ID NO: 4197091 - RNA, 21 nt, Yersinia pestis KIM
gaugcgggauaaaccagugua

SEQ ID NO: 4197092 - RNA, 23 nt, Yersinia pestis KIM
gaugcggguuuuuuuacauauaa

SEQ ID NO: 4197093 - RNA, 13 nt, Yersinia pestis KIM
gaugcguguaaug

SEQ ID NO: 4197094 - RNA, 13 nt, Yersinia pestis KIM
gaugcuaaagcgu

SEQ ID NO: 4197095 - RNA, 22 nt, Yersinia pestis KIM
gaugcuaaagcguaagugcaau

SEQ ID NO: 4197096 - RNA, 21 nt, Yersinia pestis KIM
gaugcuaaccgaauaaaaccu

SEQ ID NO: 4197097 - RNA, 17 nt, Yersinia pestis KIM
gaugcucuucuucacug

SEQ ID NO: 4197098 - RNA, 21 nt, Yersinia pestis KIM
gaugcugacagaacgcaauca

SEQ ID NO: 4197099 - RNA, 13 nt, Yersinia pestis KIM
gaugcugaggaua

SEQ ID NO: 4197100 - RNA, 12 nt, Yersinia pestis KIM
gaugcugccucu

SEQ ID NO: 4197101 - RNA, 14 nt, Yersinia pestis KIM
gaugcuuggcccga

SEQ ID NO: 4197102 - RNA, 15 nt, Yersinia pestis KIM
gauggaguaaucauu

SEQ ID NO: 4197103 - RNA, 19 nt, Yersinia pestis KIM
gauggaguaaucauugcca

SEQ ID NO: 4197104 - RNA, 18 nt, Yersinia pestis KIM
gauggauaaauucagccg

SEQ ID NO: 4197105 - RNA, 14 nt, Yersinia pestis KIM
gauggcccaagcca

SEQ ID NO: 4197106 - RNA, 16 nt, Yersinia pestis KIM
gauggcgauagugacu

SEQ ID NO: 4197107 - RNA, 18 nt, Yersinia pestis KIM
gauggcgaucaagguuuc

SEQ ID NO: 4197108 - RNA, 22 nt, Yersinia pestis KIM
gauggcggcuggaaaaccaauu

SEQ ID NO: 4197109 - RNA, 21 nt, Yersinia pestis KIM
gauggcuaauuaauuuaaaca

SEQ ID NO: 4197110 - RNA, 14 nt, Yersinia pestis KIM
gauggcuguuuuuc

SEQ ID NO: 4197111 - RNA, 16 nt, Yersinia pestis KIM
gaugggaggaaacugc

SEQ ID NO: 4197112 - RNA, 22 nt, Yersinia pestis KIM
gaugggcaggguauuuucuccu

SEQ ID NO: 4197113 - RNA, 12 nt, Yersinia pestis KIM
gaugggccaaac

SEQ ID NO: 4197114 - RNA, 21 nt, Yersinia pestis KIM
gaugguggcucugccaauaaa

SEQ ID NO: 4197115 - RNA, 17 nt, Yersinia pestis KIM
gaugguuaauccaccug

SEQ ID NO: 4197116 - RNA, 12 nt, Yersinia pestis KIM
gauguaacagcg

SEQ ID NO: 4197117 - RNA, 15 nt, Yersinia pestis KIM
gaugucaucuuccgu

SEQ ID NO: 4197118 - RNA, 17 nt, Yersinia pestis KIM
gaugucuucaacuugug

SEQ ID NO: 4197119 - RNA, 20 nt, Yersinia pestis KIM
gaugugauccacacagcauu

SEQ ID NO: 4197120 - RNA, 22 nt, Yersinia pestis KIM
gcaaauaauaacgccugcaauu

SEQ ID NO: 4197121 - RNA, 17 nt, Yersinia pestis KIM
gcaaauagagcaccaaa

SEQ ID NO: 4197122 - RNA, 22 nt, Yersinia pestis KIM
gcaaauagccguuucagauaaa

SEQ ID NO: 4197123 - RNA, 18 nt, Yersinia pestis KIM
gcaaauggcuuauuucac

SEQ ID NO: 4197124 - RNA, 19 nt, Yersinia pestis KIM
gcaaauuaacacaucaaaa

SEQ ID NO: 4197125 - RNA, 21 nt, Yersinia pestis KIM
gcaaauugcgagcugagcuua

SEQ ID NO: 4197126 - RNA, 12 nt, Yersinia pestis KIM
gcaaauuuaucc

SEQ ID NO: 4197127 - RNA, 23 nt, Yersinia pestis KIM
gcaaauuuaugcgcuuucucgac

SEQ ID NO: 4197128 - RNA, 23 nt, Yersinia pestis KIM
gcaacaaaaucgcgaccagcaga

SEQ ID NO: 4197129 - RNA, 17 nt, Yersinia pestis KIM
gcaacacaucuuccagu

SEQ ID NO: 4197130 - RNA, 15 nt, Yersinia pestis KIM
gcaacacccaacuca

SEQ ID NO: 4197131 - RNA, 12 nt, Yersinia pestis KIM
gcaacagauaau

SEQ ID NO: 4197132 - RNA, 22 nt, Yersinia pestis KIM
gcaacaucaggccuucuuuucu

SEQ ID NO: 4197133 - RNA, 23 nt, Yersinia pestis KIM
gcaacauuacccacuugcaacau

SEQ ID NO: 4197134 - RNA, 20 nt, Yersinia pestis KIM
gcaacauuauccguuugcaa

SEQ ID NO: 4197135 - RNA, 22 nt, Yersinia pestis KIM
gcaacauuauccguuugcaaca

SEQ ID NO: 4197136 - RNA, 23 nt, Yersinia pestis KIM
gcaacauuauccguuugcaacau

SEQ ID NO: 4197137 - RNA, 21 nt, Yersinia pestis KIM
gcaaccaaucguugcugguua

SEQ ID NO: 4197138 - RNA, 22 nt, Yersinia pestis KIM
gcaaccaccuuuaccaugcuca

SEQ ID NO: 4197139 - RNA, 16 nt, Yersinia pestis KIM
gcaaccacgguaucaa

SEQ ID NO: 4197140 - RNA, 21 nt, Yersinia pestis KIM
gcaaccaguuauagcgguggc

SEQ ID NO: 4197141 - RNA, 18 nt, Yersinia pestis KIM
gcaaccccuaauccagca

SEQ ID NO: 4197142 - RNA, 20 nt, Yersinia pestis KIM
gcaaccgagaagucggcuuu

SEQ ID NO: 4197143 - RNA, 21 nt, Yersinia pestis KIM
gcaaccuggccaauaaacgcu

SEQ ID NO: 4197144 - RNA, 14 nt, Yersinia pestis KIM
gcaaccuuguuuua

SEQ ID NO: 4197145 - RNA, 15 nt, Yersinia pestis KIM
gcaacgacagcaaca

SEQ ID NO: 4197146 - RNA, 15 nt, Yersinia pestis KIM
gcaacgccagugacu

SEQ ID NO: 4197147 - RNA, 17 nt, Yersinia pestis KIM
gcaacgccgaugaaggu

SEQ ID NO: 4197148 - RNA, 20 nt, Yersinia pestis KIM
gcaacgcggaauagccggcg

SEQ ID NO: 4197149 - RNA, 20 nt, Yersinia pestis KIM
gcaacgguuucaacuucaac

SEQ ID NO: 4197150 - RNA, 18 nt, Yersinia pestis KIM
gcaacguuaaagaugaag

SEQ ID NO: 4197151 - RNA, 16 nt, Yersinia pestis KIM
gcaacguuuuaccugc

SEQ ID NO: 4197152 - RNA, 21 nt, Yersinia pestis KIM
gcaacucgguuuuaaucgcag

SEQ ID NO: 4197153 - RNA, 16 nt, Yersinia pestis KIM
gcaacucuagcgccag

SEQ ID NO: 4197154 - RNA, 19 nt, Yersinia pestis KIM
gcaacuguaaugccccacu

SEQ ID NO: 4197155 - RNA, 20 nt, Yersinia pestis KIM
gcaagaaacuucauuucagg

SEQ ID NO: 4197156 - RNA, 15 nt, Yersinia pestis KIM
gcaagaaagaaaaau

SEQ ID NO: 4197157 - RNA, 21 nt, Yersinia pestis KIM
gcaagaaagaaaaauagacuc

SEQ ID NO: 4197158 - RNA, 14 nt, Yersinia pestis KIM
gcaagaauaacugg

SEQ ID NO: 4197159 - RNA, 16 nt, Yersinia pestis KIM
gcaagauuuuguagcc

SEQ ID NO: 4197160 - RNA, 14 nt, Yersinia pestis KIM
gcaagcaaacugau

SEQ ID NO: 4197161 - RNA, 17 nt, Yersinia pestis KIM
gcaagccaaaacagccu

SEQ ID NO: 4197162 - RNA, 15 nt, Yersinia pestis KIM
gcaagccgcguucaa

SEQ ID NO: 4197163 - RNA, 16 nt, Yersinia pestis KIM
gcaagcgcguuagccu

SEQ ID NO: 4197164 - RNA, 21 nt, Yersinia pestis KIM
gcaagcgggauagcccggugc

SEQ ID NO: 4197165 - RNA, 20 nt, Yersinia pestis KIM
gcaagcguuuuacugcuucu

SEQ ID NO: 4197166 - RNA, 21 nt, Yersinia pestis KIM
gcaagcugagauaagccucgg

SEQ ID NO: 4197167 - RNA, 16 nt, Yersinia pestis KIM
gcaaggcggcaagcaa

SEQ ID NO: 4197168 - RNA, 16 nt, Yersinia pestis KIM
gcaaggucgccucugg

SEQ ID NO: 4197169 - RNA, 23 nt, Yersinia pestis KIM
gcaaguaaaagucagcaaaucaa

SEQ ID NO: 4197170 - RNA, 13 nt, Yersinia pestis KIM
gcaaguuagguac

SEQ ID NO: 4197171 - RNA, 15 nt, Yersinia pestis KIM
gcaauaaaccacugg

SEQ ID NO: 4197172 - RNA, 14 nt, Yersinia pestis KIM
gcaauaaauucaaa

SEQ ID NO: 4197173 - RNA, 15 nt, Yersinia pestis KIM
gcaauaacaccagca

SEQ ID NO: 4197174 - RNA, 17 nt, Yersinia pestis KIM
gcaauaacaccagcagg

SEQ ID NO: 4197175 - RNA, 20 nt, Yersinia pestis KIM
gcaauaaggugccacacaga

SEQ ID NO: 4197176 - RNA, 16 nt, Yersinia pestis KIM
gcaauaauagccaccg

SEQ ID NO: 4197177 - RNA, 16 nt, Yersinia pestis KIM
gcaauagcaucuggcc

SEQ ID NO: 4197178 - RNA, 17 nt, Yersinia pestis KIM
gcaauauugcuugccag

SEQ ID NO: 4197179 - RNA, 13 nt, Yersinia pestis KIM
gcaaucaauaagc

SEQ ID NO: 4197180 - RNA, 14 nt, Yersinia pestis KIM
gcaaucaauaagcu

SEQ ID NO: 4197181 - RNA, 19 nt, Yersinia pestis KIM
gcaaucaauguauugcucc

SEQ ID NO: 4197182 - RNA, 22 nt, Yersinia pestis KIM
gcaaucaauguauugcuccaga

SEQ ID NO: 4197183 - RNA, 15 nt, Yersinia pestis KIM
gcaaucacaaccccc

SEQ ID NO: 4197184 - RNA, 16 nt, Yersinia pestis KIM
gcaaucagaggccauc

SEQ ID NO: 4197185 - RNA, 20 nt, Yersinia pestis KIM
gcaaucaggauaaugagugu

SEQ ID NO: 4197186 - RNA, 22 nt, Yersinia pestis KIM
gcaaucaugggccaauccaaua

SEQ ID NO: 4197187 - RNA, 19 nt, Yersinia pestis KIM
gcaauccgcugacauugcc

SEQ ID NO: 4197188 - RNA, 18 nt, Yersinia pestis KIM
gcaaucuccaguaaaucu

SEQ ID NO: 4197189 - RNA, 16 nt, Yersinia pestis KIM
gcaaucuguuauaaaa

SEQ ID NO: 4197190 - RNA, 14 nt, Yersinia pestis KIM
gcaaugaaggcuca

SEQ ID NO: 4197191 - RNA, 17 nt, Yersinia pestis KIM
gcaaugcagauaaccgu

SEQ ID NO: 4197192 - RNA, 21 nt, Yersinia pestis KIM
gcaaugcuaccuguaacauua

SEQ ID NO: 4197193 - RNA, 17 nt, Yersinia pestis KIM
gcaaugcuuauuucaca

SEQ ID NO: 4197194 - RNA, 19 nt, Yersinia pestis KIM
gcaauggaagaaucaccga

SEQ ID NO: 4197195 - RNA, 16 nt, Yersinia pestis KIM
gcaauggcgauugugc

SEQ ID NO: 4197196 - RNA, 17 nt, Yersinia pestis KIM
gcaauggcguuccaaua

SEQ ID NO: 4197197 - RNA, 20 nt, Yersinia pestis KIM
gcaauggcucaggcucauca

SEQ ID NO: 4197198 - RNA, 23 nt, Yersinia pestis KIM
gcaaugggucauugcgugcaaua

SEQ ID NO: 4197199 - RNA, 21 nt, Yersinia pestis KIM
gcaaugucaccugaaccugac

SEQ ID NO: 4197200 - RNA, 14 nt, Yersinia pestis KIM
gcaauucgcuuaug

SEQ ID NO: 4197201 - RNA, 23 nt, Yersinia pestis KIM
gcaauucggcuaaugagcucacu

SEQ ID NO: 4197202 - RNA, 21 nt, Yersinia pestis KIM
gcaauuggccuuccaucguca

SEQ ID NO: 4197203 - RNA, 23 nt, Yersinia pestis KIM
gcaauuucuguuaccagaaaacc

SEQ ID NO: 4197204 - RNA, 19 nt, Yersinia pestis KIM
gcaauuugcccaucuuuua

SEQ ID NO: 4197205 - RNA, 23 nt, Yersinia pestis KIM
gcacaaacauggcggcagcacag

SEQ ID NO: 4197206 - RNA, 23 nt, Yersinia pestis KIM
gcacaacggaaggcccagccggg

SEQ ID NO: 4197207 - RNA, 23 nt, Yersinia pestis KIM
gcacaaugacuuaacugaaagcc

SEQ ID NO: 4197208 - RNA, 13 nt, Yersinia pestis KIM
gcacaaugguuga

SEQ ID NO: 4197209 - RNA, 19 nt, Yersinia pestis KIM
gcacacaguuauuaggcau

SEQ ID NO: 4197210 - RNA, 21 nt, Yersinia pestis KIM
gcacacccgauggaacuguaa

SEQ ID NO: 4197211 - RNA, 22 nt, Yersinia pestis KIM
gcacacucagaugaaaaacugu

SEQ ID NO: 4197212 - RNA, 17 nt, Yersinia pestis KIM
gcacacugacagcaacg

SEQ ID NO: 4197213 - RNA, 21 nt, Yersinia pestis KIM
gcacacuuuucacuccggcau

SEQ ID NO: 4197214 - RNA, 16 nt, Yersinia pestis KIM
gcacagaaaaugucca

SEQ ID NO: 4197215 - RNA, 21 nt, Yersinia pestis KIM
gcacagagcgggaacgccaag

SEQ ID NO: 4197216 - RNA, 13 nt, Yersinia pestis KIM
gcacagccugccg

SEQ ID NO: 4197217 - RNA, 17 nt, Yersinia pestis KIM
gcacagcgagauaaacu

SEQ ID NO: 4197218 - RNA, 22 nt, Yersinia pestis KIM
gcacaguagaagcuaccagcac

SEQ ID NO: 4197219 - RNA, 14 nt, Yersinia pestis KIM
gcacauaaagcgca

SEQ ID NO: 4197220 - RNA, 23 nt, Yersinia pestis KIM
gcacauaccccauuuaucgccaa

SEQ ID NO: 4197221 - RNA, 19 nt, Yersinia pestis KIM
gcacauacucaccucccug

SEQ ID NO: 4197222 - RNA, 24 nt, Yersinia pestis KIM
gcacaucaauauaaaacaucucuu

SEQ ID NO: 4197223 - RNA, 21 nt, Yersinia pestis KIM
gcacaucauuuauuuccaagc

SEQ ID NO: 4197224 - RNA, 13 nt, Yersinia pestis KIM
gcacaucccaaua

SEQ ID NO: 4197225 - RNA, 18 nt, Yersinia pestis KIM
gcacaucgccauuagacg

SEQ ID NO: 4197226 - RNA, 17 nt, Yersinia pestis KIM
gcaccaaacagacccca

SEQ ID NO: 4197227 - RNA, 23 nt, Yersinia pestis KIM
gcaccaaacagaccccagaagau

SEQ ID NO: 4197228 - RNA, 14 nt, Yersinia pestis KIM
gcaccaaaucuucc

SEQ ID NO: 4197229 - RNA, 18 nt, Yersinia pestis KIM
gcaccaaaucuuccagcg

SEQ ID NO: 4197230 - RNA, 20 nt, Yersinia pestis KIM
gcaccaaaucuuccagcggc

SEQ ID NO: 4197231 - RNA, 21 nt, Yersinia pestis KIM
gcaccaaaucuuccagcggca

SEQ ID NO: 4197232 - RNA, 17 nt, Yersinia pestis KIM
gcaccaaccauugacua

SEQ ID NO: 4197233 - RNA, 19 nt, Yersinia pestis KIM
gcagccuuuauccagccac

SEQ ID NO: 4197234 - RNA, 21 nt, Yersinia pestis KIM
gcagccuuuauccagccaccu

SEQ ID NO: 4197235 - RNA, 16 nt, Yersinia pestis KIM
gcagcgacaaccugua

SEQ ID NO: 4197236 - RNA, 16 nt, Yersinia pestis KIM
gcagcgagcacugccc

SEQ ID NO: 4197237 - RNA, 14 nt, Yersinia pestis KIM
gcagcgcgcagcca

SEQ ID NO: 4197238 - RNA, 16 nt, Yersinia pestis KIM
gcagcggcaaauagag

SEQ ID NO: 4197239 - RNA, 18 nt, Yersinia pestis KIM
gcagcggcuagcagcagg

SEQ ID NO: 4197240 - RNA, 21 nt, Yersinia pestis KIM
gcagcguaggcaacuaagcug

SEQ ID NO: 4197241 - RNA, 17 nt, Yersinia pestis KIM
gcagcguagguaacuaa

SEQ ID NO: 4197242 - RNA, 18 nt, Yersinia pestis KIM
gcagcguagguaacuaag

SEQ ID NO: 4197243 - RNA, 21 nt, Yersinia pestis KIM
gcagcguagguaacuaagcug

SEQ ID NO: 4197244 - RNA, 14 nt, Yersinia pestis KIM
gcagcgucaagguc

SEQ ID NO: 4197245 - RNA, 15 nt, Yersinia pestis KIM
gcagcuaaagcaaag

SEQ ID NO: 4197246 - RNA, 19 nt, Yersinia pestis KIM
gcagcucaaaaucuucggc

SEQ ID NO: 4197247 - RNA, 14 nt, Yersinia pestis KIM
gcaggaaacaugcu

SEQ ID NO: 4197248 - RNA, 22 nt, Yersinia pestis KIM
gcaggaacgaaguuagacccaa

SEQ ID NO: 4197249 - RNA, 11 nt, Yersinia pestis KIM
gcaggaagcaa

SEQ ID NO: 4197250 - RNA, 14 nt, Yersinia pestis KIM
gcaggaagcaauga

SEQ ID NO: 4197251 - RNA, 16 nt, Yersinia pestis KIM
gcaggaagcaaugaaa

SEQ ID NO: 4197252 - RNA, 14 nt, Yersinia pestis KIM
gcaggaauccaagu

SEQ ID NO: 4197253 - RNA, 17 nt, Yersinia pestis KIM
gcaggaauccaaguuca

SEQ ID NO: 4197254 - RNA, 22 nt, Yersinia pestis KIM
gcaggagucugaaaccccuugu

SEQ ID NO: 4197255 - RNA, 16 nt, Yersinia pestis KIM
gcaggauaaagcugaa

SEQ ID NO: 4197256 - RNA, 13 nt, Yersinia pestis KIM
gcaggauuucccg

SEQ ID NO: 4197257 - RNA, 23 nt, Yersinia pestis KIM
gcaggccauuggcaaaggccagc

SEQ ID NO: 4197258 - RNA, 17 nt, Yersinia pestis KIM
gcaggccccaucauaaa

SEQ ID NO: 4197259 - RNA, 19 nt, Yersinia pestis KIM
gcaggcccuuucaccgcug

SEQ ID NO: 4197260 - RNA, 15 nt, Yersinia pestis KIM
gcaggccuucuucaa

SEQ ID NO: 4197261 - RNA, 14 nt, Yersinia pestis KIM
gcaggcggccaaug

SEQ ID NO: 4197262 - RNA, 16 nt, Yersinia pestis KIM
gcaggcugucaggaac

SEQ ID NO: 4197263 - RNA, 15 nt, Yersinia pestis KIM
gcaggcuucaacuac

SEQ ID NO: 4197264 - RNA, 15 nt, Yersinia pestis KIM
gcagggcauucgccu

SEQ ID NO: 4197265 - RNA, 18 nt, Yersinia pestis KIM
gcagggccgauaaaaaac

SEQ ID NO: 4197266 - RNA, 14 nt, Yersinia pestis KIM
gcagggcgaucagg

SEQ ID NO: 4197267 - RNA, 21 nt, Yersinia pestis KIM
gcaggggaggcgguccuccug

SEQ ID NO: 4197268 - RNA, 19 nt, Yersinia pestis KIM
gcaggggguuagcugcaag

SEQ ID NO: 4197269 - RNA, 15 nt, Yersinia pestis KIM
gcagguaaugcauuc

SEQ ID NO: 4197270 - RNA, 19 nt, Yersinia pestis KIM
gcagguaaugucacugcca

SEQ ID NO: 4197271 - RNA, 23 nt, Yersinia pestis KIM
gcagguaucaauacagacgccga

SEQ ID NO: 4197272 - RNA, 21 nt, Yersinia pestis KIM
gcaggucaaagaagcgcagga

SEQ ID NO: 4197273 - RNA, 14 nt, Yersinia pestis KIM
gcaggucagaauga

SEQ ID NO: 4197274 - RNA, 16 nt, Yersinia pestis KIM
gcaggugcguuaucuu

SEQ ID NO: 4197275 - RNA, 19 nt, Yersinia pestis KIM
gcaggugcguuaucuucac

SEQ ID NO: 4197276 - RNA, 20 nt, Yersinia pestis KIM
gcagguucggcgcaaucaua

SEQ ID NO: 4197277 - RNA, 20 nt, Yersinia pestis KIM
gcaguaacggaauucagaac

SEQ ID NO: 4197278 - RNA, 16 nt, Yersinia pestis KIM
gcaguaacguccaacu

SEQ ID NO: 4197279 - RNA, 22 nt, Yersinia pestis KIM
gcaguaaguuaaaaagaaaaag

SEQ ID NO: 4197280 - RNA, 20 nt, Yersinia pestis KIM
gcagucaccuuuuuagcgag

SEQ ID NO: 4197281 - RNA, 19 nt, Yersinia pestis KIM
gcagucagccacaaaaguu

SEQ ID NO: 4197282 - RNA, 13 nt, Yersinia pestis KIM
gcaguccaaaaaa

SEQ ID NO: 4197283 - RNA, 12 nt, Yersinia pestis KIM
gcagucugaggc

SEQ ID NO: 4197284 - RNA, 18 nt, Yersinia pestis KIM
gcagucugaggcccgcua

SEQ ID NO: 4197285 - RNA, 20 nt, Yersinia pestis KIM
gcagucugagggccacuucg

SEQ ID NO: 4197286 - RNA, 21 nt, Yersinia pestis KIM
gcagugaaaagguuaacugca

SEQ ID NO: 4197287 - RNA, 16 nt, Yersinia pestis KIM
gcagugaggcaaugaa

SEQ ID NO: 4197288 - RNA, 19 nt, Yersinia pestis KIM
gcagugccaucgccaacag

SEQ ID NO: 4197289 - RNA, 12 nt, Yersinia pestis KIM
gcagugccuuau

SEQ ID NO: 4197290 - RNA, 15 nt, Yersinia pestis KIM
gcagugcuucaucac

SEQ ID NO: 4197291 - RNA, 19 nt, Yersinia pestis KIM
gcaguguaaaaccugacug

SEQ ID NO: 4197292 - RNA, 20 nt, Yersinia pestis KIM
gcaguuaacgacgccccacu

SEQ ID NO: 4197293 - RNA, 20 nt, Yersinia pestis KIM
gcaguucaaaggggcugauc

SEQ ID NO: 4197294 - RNA, 18 nt, Yersinia pestis KIM
gcaguuugagaaacugau

SEQ ID NO: 4197295 - RNA, 13 nt, Yersinia pestis KIM
gcauaaaaauaca

SEQ ID NO: 4197296 - RNA, 14 nt, Yersinia pestis KIM
gcauaaaacgauuu

SEQ ID NO: 4197297 - RNA, 12 nt, Yersinia pestis KIM
gcauaaacugaa

SEQ ID NO: 4197298 - RNA, 18 nt, Yersinia pestis KIM
gcauaaacugaaguuaaa

SEQ ID NO: 4197299 - RNA, 20 nt, Yersinia pestis KIM
gcauaaacugaaguuaaaaa

SEQ ID NO: 4197300 - RNA, 21 nt, Yersinia pestis KIM
gcauaaauacgguucaaauca

SEQ ID NO: 4197301 - RNA, 20 nt, Yersinia pestis KIM
gcauaacaacgacuccauca

SEQ ID NO: 4197302 - RNA, 21 nt, Yersinia pestis KIM
gcauaacuggcgguuucaccu

SEQ ID NO: 4197303 - RNA, 17 nt, Yersinia pestis KIM
gcauaagcgguuucaug

SEQ ID NO: 4197304 - RNA, 16 nt, Yersinia pestis KIM
gcauacaccuucuuaa

SEQ ID NO: 4197305 - RNA, 18 nt, Yersinia pestis KIM
gcauaccggucauauuua

SEQ ID NO: 4197306 - RNA, 14 nt, Yersinia pestis KIM
gcauaccuggauca

SEQ ID NO: 4197307 - RNA, 16 nt, Yersinia pestis KIM
gcauacguugccagcc

SEQ ID NO: 4197308 - RNA, 11 nt, Yersinia pestis KIM
gcauacucagg

SEQ ID NO: 4197309 - RNA, 17 nt, Yersinia pestis KIM
gcauagacgaaggcacg

SEQ ID NO: 4197310 - RNA, 19 nt, Yersinia pestis KIM
gcauagccggagguuuuuc

SEQ ID NO: 4197311 - RNA, 16 nt, Yersinia pestis KIM
gcauagcuaaccuuaa

SEQ ID NO: 4197312 - RNA, 13 nt, Yersinia pestis KIM
gcauauaaaacac

SEQ ID NO: 4197313 - RNA, 21 nt, Yersinia pestis KIM
gcauauacagcccgguaucac

SEQ ID NO: 4197314 - RNA, 15 nt, Yersinia pestis KIM
gcauauaucccaaua

SEQ ID NO: 4197315 - RNA, 12 nt, Yersinia pestis KIM
gcauaucagcaa

SEQ ID NO: 4197316 - RNA, 18 nt, Yersinia pestis KIM
gcauaugaguuucaaaua

SEQ ID NO: 4197317 - RNA, 13 nt, Yersinia pestis KIM
gcauauuacccag

SEQ ID NO: 4197318 - RNA, 17 nt, Yersinia pestis KIM
gcauauuacccaguacu

SEQ ID NO: 4197319 - RNA, 19 nt, Yersinia pestis KIM
gcauauuacccaguacugu

SEQ ID NO: 4197320 - RNA, 17 nt, Yersinia pestis KIM
gcauauuauaaugaaau

SEQ ID NO: 4197321 - RNA, 17 nt, Yersinia pestis KIM
gcauauuauuuugcaca

SEQ ID NO: 4197322 - RNA, 18 nt, Yersinia pestis KIM
gcauauugagcauacugu

SEQ ID NO: 4197323 - RNA, 18 nt, Yersinia pestis KIM
gcauauuguaaacuucca

SEQ ID NO: 4197324 - RNA, 13 nt, Yersinia pestis KIM
gcauauuucucuu

SEQ ID NO: 4197325 - RNA, 13 nt, Yersinia pestis KIM
gcaucaacaugga

SEQ ID NO: 4197326 - RNA, 18 nt, Yersinia pestis KIM
gcaucaacauggaugucu

SEQ ID NO: 4197327 - RNA, 16 nt, Yersinia pestis KIM
gcaucaaccaagacau

SEQ ID NO: 4197328 - RNA, 14 nt, Yersinia pestis KIM
gcaucaauaaaauu

SEQ ID NO: 4197329 - RNA, 15 nt, Yersinia pestis KIM
gcaucaauaauaacg

SEQ ID NO: 4197330 - RNA, 16 nt, Yersinia pestis KIM
gcaucaccaaacagug

SEQ ID NO: 4197331 - RNA, 13 nt, Yersinia pestis KIM
gcaucaccaucau

SEQ ID NO: 4197332 - RNA, 20 nt, Yersinia pestis KIM
gcaucaccggcgaacguuug

SEQ ID NO: 4197333 - RNA, 20 nt, Yersinia pestis KIM
gcaucaccgguuuacccugc

SEQ ID NO: 4197334 - RNA, 16 nt, Yersinia pestis KIM
gcaucacgauagccag

SEQ ID NO: 4197335 - RNA, 21 nt, Yersinia pestis KIM
gcaucacgauagccagugaca

SEQ ID NO: 4197336 - RNA, 16 nt, Yersinia pestis KIM
gcaucacuucauacac

SEQ ID NO: 4197337 - RNA, 11 nt, Yersinia pestis KIM
gcaucagccag

SEQ ID NO: 4197338 - RNA, 15 nt, Yersinia pestis KIM
gcaucagccagccac

SEQ ID NO: 4197339 - RNA, 13 nt, Yersinia pestis KIM
gcaucagcccauu

SEQ ID NO: 4197340 - RNA, 12 nt, Yersinia pestis KIM
gcaucauacuga

SEQ ID NO: 4197341 - RNA, 16 nt, Yersinia pestis KIM
gcaucauacugacggg

SEQ ID NO: 4197342 - RNA, 13 nt, Yersinia pestis KIM
gcaucauccagcu

SEQ ID NO: 4197343 - RNA, 22 nt, Yersinia pestis KIM
gcaucauccagcucaacgaccc

SEQ ID NO: 4197344 - RNA, 18 nt, Yersinia pestis KIM
gcaucaucgcuuugcggg

SEQ ID NO: 4197345 - RNA, 19 nt, Yersinia pestis KIM
gcauccaagccaucauuag

SEQ ID NO: 4197346 - RNA, 16 nt, Yersinia pestis KIM
gcauccacugcggcca

SEQ ID NO: 4197347 - RNA, 14 nt, Yersinia pestis KIM
gcauccccaucgcc

SEQ ID NO: 4197348 - RNA, 14 nt, Yersinia pestis KIM
gcauccccggcacc

SEQ ID NO: 4197349 - RNA, 22 nt, Yersinia pestis KIM
gccacgaguuuucccugcgcca

SEQ ID NO: 4197350 - RNA, 15 nt, Yersinia pestis KIM
gccacgaugugaagc

SEQ ID NO: 4197351 - RNA, 19 nt, Yersinia pestis KIM
gccacgccaguaaacagcc

SEQ ID NO: 4197352 - RNA, 16 nt, Yersinia pestis KIM
gccacgcuauucacuc

SEQ ID NO: 4197353 - RNA, 16 nt, Yersinia pestis KIM
gccacggcauuagaag

SEQ ID NO: 4197354 - RNA, 20 nt, Yersinia pestis KIM
gccacggccgccuucaacug

SEQ ID NO: 4197355 - RNA, 19 nt, Yersinia pestis KIM
gccacgggcaccugacgca

SEQ ID NO: 4197356 - RNA, 20 nt, Yersinia pestis KIM
gccacgucugcggaucagag

SEQ ID NO: 4197357 - RNA, 14 nt, Yersinia pestis KIM
gccacuagccauua

SEQ ID NO: 4197358 - RNA, 23 nt, Yersinia pestis KIM
gccacucuagcuguguuuuaucu

SEQ ID NO: 4197359 - RNA, 16 nt, Yersinia pestis KIM
gccacugauaccgaua

SEQ ID NO: 4197360 - RNA, 16 nt, Yersinia pestis KIM
gccacugggcuacccg

SEQ ID NO: 4197361 - RNA, 15 nt, Yersinia pestis KIM
gccacuucgcuacgc

SEQ ID NO: 4197362 - RNA, 15 nt, Yersinia pestis KIM
gccacuucgguggcc

SEQ ID NO: 4197363 - RNA, 17 nt, Yersinia pestis KIM
gccacuucgguggcccu

SEQ ID NO: 4197364 - RNA, 18 nt, Yersinia pestis KIM
gccacuucgguggcccug

SEQ ID NO: 4197365 - RNA, 14 nt, Yersinia pestis KIM
gccacuucuaacaa

SEQ ID NO: 4197366 - RNA, 14 nt, Yersinia pestis KIM
gccagaaagcagcc

SEQ ID NO: 4197367 - RNA, 15 nt, Yersinia pestis KIM
gccagaaucaaccac

SEQ ID NO: 4197368 - RNA, 16 nt, Yersinia pestis KIM
gccagaaucaaccacg

SEQ ID NO: 4197369 - RNA, 23 nt, Yersinia pestis KIM
gccagaaucacugucaaaaagca

SEQ ID NO: 4197370 - RNA, 16 nt, Yersinia pestis KIM
gccagaaucagcccca

SEQ ID NO: 4197371 - RNA, 20 nt, Yersinia pestis KIM
gccagacacugacaucauca

SEQ ID NO: 4197372 - RNA, 19 nt, Yersinia pestis KIM
gccagacccggcaaauaaa

SEQ ID NO: 4197373 - RNA, 20 nt, Yersinia pestis KIM
gccagacccggcaaauaaau

SEQ ID NO: 4197374 - RNA, 22 nt, Yersinia pestis KIM
gccagacgaguauuccccacug

SEQ ID NO: 4197375 - RNA, 13 nt, Yersinia pestis KIM
gccagacuggccg

SEQ ID NO: 4197376 - RNA, 20 nt, Yersinia pestis KIM
gccagagacauaaagcccgc

SEQ ID NO: 4197377 - RNA, 23 nt, Yersinia pestis KIM
gccagagacauaaagcccgcuuc

SEQ ID NO: 4197378 - RNA, 11 nt, Yersinia pestis KIM
gccagauaaaa

SEQ ID NO: 4197379 - RNA, 21 nt, Yersinia pestis KIM
gccagauaacgauaacuccag

SEQ ID NO: 4197380 - RNA, 17 nt, Yersinia pestis KIM
gccagauagagguggcc

SEQ ID NO: 4197381 - RNA, 19 nt, Yersinia pestis KIM
gccagauagcaucauccag

SEQ ID NO: 4197382 - RNA, 19 nt, Yersinia pestis KIM
gccagauaugaucaaaaau

SEQ ID NO: 4197383 - RNA, 17 nt, Yersinia pestis KIM
gccagaucaaugugguu

SEQ ID NO: 4197384 - RNA, 16 nt, Yersinia pestis KIM
gccagauuauccagcc

SEQ ID NO: 4197385 - RNA, 21 nt, Yersinia pestis KIM
gccagauucgcaaagcgggcc

SEQ ID NO: 4197386 - RNA, 18 nt, Yersinia pestis KIM
gccagauugugcuccagc

SEQ ID NO: 4197387 - RNA, 19 nt, Yersinia pestis KIM
gccagauugugcuccagca

SEQ ID NO: 4197388 - RNA, 21 nt, Yersinia pestis KIM
gccagauugugcuccagcacu

SEQ ID NO: 4197389 - RNA, 15 nt, Yersinia pestis KIM
gccagauuuaaauca

SEQ ID NO: 4197390 - RNA, 13 nt, Yersinia pestis KIM
gccagcaaagaca

SEQ ID NO: 4197391 - RNA, 18 nt, Yersinia pestis KIM
gccagcaauuggccuucc

SEQ ID NO: 4197392 - RNA, 20 nt, Yersinia pestis KIM
gccagcaauuggccuuccau

SEQ ID NO: 4197393 - RNA, 22 nt, Yersinia pestis KIM
gccagcacguuuuaaugccaau

SEQ ID NO: 4197394 - RNA, 18 nt, Yersinia pestis KIM
gccagcagaguaaagcag

SEQ ID NO: 4197395 - RNA, 20 nt, Yersinia pestis KIM
gccagcaucgucauugccag

SEQ ID NO: 4197396 - RNA, 13 nt, Yersinia pestis KIM
gccagccauuaaa

SEQ ID NO: 4197397 - RNA, 21 nt, Yersinia pestis KIM
gccagccccaaucaccggcug

SEQ ID NO: 4197398 - RNA, 22 nt, Yersinia pestis KIM
gccagccccaaucaccggcugg

SEQ ID NO: 4197399 - RNA, 18 nt, Yersinia pestis KIM
gccagccccaauccgccu

SEQ ID NO: 4197400 - RNA, 13 nt, Yersinia pestis KIM
gccagcugcaauu

SEQ ID NO: 4197401 - RNA, 18 nt, Yersinia pestis KIM
gccagcugcaauugccgc

SEQ ID NO: 4197402 - RNA, 16 nt, Yersinia pestis KIM
gccaggaaauuugcac

SEQ ID NO: 4197403 - RNA, 16 nt, Yersinia pestis KIM
gccaggcucccaaggg

SEQ ID NO: 4197404 - RNA, 21 nt, Yersinia pestis KIM
gccagggcguuuaccauccag

SEQ ID NO: 4197405 - RNA, 17 nt, Yersinia pestis KIM
gccagggguaagaucca

SEQ ID NO: 4197406 - RNA, 15 nt, Yersinia pestis KIM
gccagguaagaaaga

SEQ ID NO: 4197407 - RNA, 21 nt, Yersinia pestis KIM
gccaguaaaaacucacuguuc

SEQ ID NO: 4197408 - RNA, 21 nt, Yersinia pestis KIM
gccaguaaacagccagcauca

SEQ ID NO: 4197409 - RNA, 15 nt, Yersinia pestis KIM
gccaguaaaccuggc

SEQ ID NO: 4197410 - RNA, 14 nt, Yersinia pestis KIM
gccaguaaacgcag

SEQ ID NO: 4197411 - RNA, 15 nt, Yersinia pestis KIM
gccaguaaucaaaca

SEQ ID NO: 4197412 - RNA, 18 nt, Yersinia pestis KIM
gccaguauccagaugauu

SEQ ID NO: 4197413 - RNA, 22 nt, Yersinia pestis KIM
gccagugaaucagccagagaau

SEQ ID NO: 4197414 - RNA, 22 nt, Yersinia pestis KIM
gccagugccaccguaaaaaacc

SEQ ID NO: 4197415 - RNA, 16 nt, Yersinia pestis KIM
gccaguggcuuugcac

SEQ ID NO: 4197416 - RNA, 18 nt, Yersinia pestis KIM
gccagugugugguauuca

SEQ ID NO: 4197417 - RNA, 17 nt, Yersinia pestis KIM
gccaguguuuucuccac

SEQ ID NO: 4197418 - RNA, 12 nt, Yersinia pestis KIM
gccaguucauca

SEQ ID NO: 4197419 - RNA, 13 nt, Yersinia pestis KIM
gccaguugcucac

SEQ ID NO: 4197420 - RNA, 20 nt, Yersinia pestis KIM
gccaguugggaaucgguuuc

SEQ ID NO: 4197421 - RNA, 16 nt, Yersinia pestis KIM
gccauaaauaccaauu

SEQ ID NO: 4197422 - RNA, 14 nt, Yersinia pestis KIM
gccauaacaucguu

SEQ ID NO: 4197423 - RNA, 14 nt, Yersinia pestis KIM
gccauaaccagagc

SEQ ID NO: 4197424 - RNA, 17 nt, Yersinia pestis KIM
gccauaaccgcaaucag

SEQ ID NO: 4197425 - RNA, 21 nt, Yersinia pestis KIM
gccauaaccugagcaccagaa

SEQ ID NO: 4197426 - RNA, 20 nt, Yersinia pestis KIM
gccauaagcgacgacauuaa

SEQ ID NO: 4197427 - RNA, 17 nt, Yersinia pestis KIM
gccauacccugguagca

SEQ ID NO: 4197428 - RNA, 14 nt, Yersinia pestis KIM
gccauagaauaccc

SEQ ID NO: 4197429 - RNA, 13 nt, Yersinia pestis KIM
gccauagcaaucc

SEQ ID NO: 4197430 - RNA, 17 nt, Yersinia pestis KIM
gccauagcccaugauug

SEQ ID NO: 4197431 - RNA, 13 nt, Yersinia pestis KIM
gccauagcugcug

SEQ ID NO: 4197432 - RNA, 18 nt, Yersinia pestis KIM
gccauagguacuuuguca

SEQ ID NO: 4197433 - RNA, 21 nt, Yersinia pestis KIM
gccauagguuagugguucacc

SEQ ID NO: 4197434 - RNA, 14 nt, Yersinia pestis KIM
gccaucaauaaagc

SEQ ID NO: 4197435 - RNA, 23 nt, Yersinia pestis KIM
gccaucagcgccgccucuucugu

SEQ ID NO: 4197436 - RNA, 15 nt, Yersinia pestis KIM
gccaucaggcaaaag

SEQ ID NO: 4197437 - RNA, 20 nt, Yersinia pestis KIM
gccaucaucuucaaccugga

SEQ ID NO: 4197438 - RNA, 22 nt, Yersinia pestis KIM
gccauccuucaagaugcagggc

SEQ ID NO: 4197439 - RNA, 20 nt, Yersinia pestis KIM
gccaucgccgacaaaauccc

SEQ ID NO: 4197440 - RNA, 21 nt, Yersinia pestis KIM
gccaucgcuaaucauauccau

SEQ ID NO: 4197441 - RNA, 11 nt, Yersinia pestis KIM
gccaucuucag

SEQ ID NO: 4197442 - RNA, 12 nt, Yersinia pestis KIM
gccaugagaacc

SEQ ID NO: 4197443 - RNA, 20 nt, Yersinia pestis KIM
gccaugagaaccaguucugg

SEQ ID NO: 4197444 - RNA, 18 nt, Yersinia pestis KIM
gccaugcauuaaggcgcg

SEQ ID NO: 4197445 - RNA, 15 nt, Yersinia pestis KIM
gccaugcuggaugaa

SEQ ID NO: 4197446 - RNA, 20 nt, Yersinia pestis KIM
gccauggaauuuaugcacca

SEQ ID NO: 4197447 - RNA, 14 nt, Yersinia pestis KIM
gccaugggaaauca

SEQ ID NO: 4197448 - RNA, 15 nt, Yersinia pestis KIM
gccaugggucauuaa

SEQ ID NO: 4197449 - RNA, 16 nt, Yersinia pestis KIM
gccaugggucauuaau

SEQ ID NO: 4197450 - RNA, 14 nt, Yersinia pestis KIM
gccaugucacuguu

SEQ ID NO: 4197451 - RNA, 21 nt, Yersinia pestis KIM
gccauguguuuguuuggauaa

SEQ ID NO: 4197452 - RNA, 19 nt, Yersinia pestis KIM
gccauguuggucaagcggg

SEQ ID NO: 4197453 - RNA, 16 nt, Yersinia pestis KIM
gccauuaccacuguua

SEQ ID NO: 4197454 - RNA, 23 nt, Yersinia pestis KIM
gccauucagcguuuuauuuggcu

SEQ ID NO: 4197455 - RNA, 21 nt, Yersinia pestis KIM
gccauugaguaaguucgucag

SEQ ID NO: 4197456 - RNA, 20 nt, Yersinia pestis KIM
gccauugccgaaccugcaug

SEQ ID NO: 4197457 - RNA, 21 nt, Yersinia pestis KIM
gccauugccgaaccugcaugu

SEQ ID NO: 4197458 - RNA, 18 nt, Yersinia pestis KIM
gccauuggcaaaggccag

SEQ ID NO: 4197459 - RNA, 19 nt, Yersinia pestis KIM
gccauuggguauggucagc

SEQ ID NO: 4197460 - RNA, 22 nt, Yersinia pestis KIM
gccauuuauugcggcuuagcca

SEQ ID NO: 4197461 - RNA, 21 nt, Yersinia pestis KIM
gccauuugaacaaaccccacu

SEQ ID NO: 4197462 - RNA, 20 nt, Yersinia pestis KIM
gccauuuguuaaucgcugaa

SEQ ID NO: 4197463 - RNA, 18 nt, Yersinia pestis KIM
gcccuuuuugguuuucua

SEQ ID NO: 4197464 - RNA, 19 nt, Yersinia pestis KIM
gcccuuuuugguuuucuau

SEQ ID NO: 4197465 - RNA, 17 nt, Yersinia pestis KIM
gcccuuuuuuauugcgu

SEQ ID NO: 4197466 - RNA, 20 nt, Yersinia pestis KIM
gccgaaagccaagcaagcgg

SEQ ID NO: 4197467 - RNA, 16 nt, Yersinia pestis KIM
gccgaaccccuagcca

SEQ ID NO: 4197468 - RNA, 17 nt, Yersinia pestis KIM
gccgaaccccuagccag

SEQ ID NO: 4197469 - RNA, 19 nt, Yersinia pestis KIM
gccgaaccccuagccagcc

SEQ ID NO: 4197470 - RNA, 18 nt, Yersinia pestis KIM
gccgaaugauucauugag

SEQ ID NO: 4197471 - RNA, 19 nt, Yersinia pestis KIM
gccgacaaaaucccccacc

SEQ ID NO: 4197472 - RNA, 22 nt, Yersinia pestis KIM
gccgacaauaccgccacacaau

SEQ ID NO: 4197473 - RNA, 23 nt, Yersinia pestis KIM
gccgaccugcaacgccagugacu

SEQ ID NO: 4197474 - RNA, 23 nt, Yersinia pestis KIM
gccgacugauuaaccaagcucgc

SEQ ID NO: 4197475 - RNA, 12 nt, Yersinia pestis KIM
gccgacugcuga

SEQ ID NO: 4197476 - RNA, 17 nt, Yersinia pestis KIM
gccgaggugaagacacc

SEQ ID NO: 4197477 - RNA, 15 nt, Yersinia pestis KIM
gccgauaaucccugc

SEQ ID NO: 4197478 - RNA, 21 nt, Yersinia pestis KIM
gccgauaaucccugccagaau

SEQ ID NO: 4197479 - RNA, 19 nt, Yersinia pestis KIM
gccgauacgcgccgcagca

SEQ ID NO: 4197480 - RNA, 16 nt, Yersinia pestis KIM
gccgauacuuuugcua

SEQ ID NO: 4197481 - RNA, 17 nt, Yersinia pestis KIM
gccgaucaacaggccac

SEQ ID NO: 4197482 - RNA, 15 nt, Yersinia pestis KIM
gccgaucauaaauca

SEQ ID NO: 4197483 - RNA, 23 nt, Yersinia pestis KIM
gccgaucauaaaucacaauuuca

SEQ ID NO: 4197484 - RNA, 19 nt, Yersinia pestis KIM
gccgauccgggaaaaaaua

SEQ ID NO: 4197485 - RNA, 20 nt, Yersinia pestis KIM
gccgaugaucucuggccgug

SEQ ID NO: 4197486 - RNA, 18 nt, Yersinia pestis KIM
gccgcaaggccauagaau

SEQ ID NO: 4197487 - RNA, 15 nt, Yersinia pestis KIM
gccgcacacagcccu

SEQ ID NO: 4197488 - RNA, 12 nt, Yersinia pestis KIM
gccgcaccaucu

SEQ ID NO: 4197489 - RNA, 13 nt, Yersinia pestis KIM
gccgcagauaaac

SEQ ID NO: 4197490 - RNA, 18 nt, Yersinia pestis KIM
gccgcagaugccagacuu

SEQ ID NO: 4197491 - RNA, 19 nt, Yersinia pestis KIM
gccgcaggcgaugcaagga

SEQ ID NO: 4197492 - RNA, 17 nt, Yersinia pestis KIM
gccgcauucaccaccau

SEQ ID NO: 4197493 - RNA, 18 nt, Yersinia pestis KIM
gccgcauugauccucguu

SEQ ID NO: 4197494 - RNA, 22 nt, Yersinia pestis KIM
gccgccagucauucaccugccc

SEQ ID NO: 4197495 - RNA, 20 nt, Yersinia pestis KIM
gccgcccccuuucuuaucga

SEQ ID NO: 4197496 - RNA, 17 nt, Yersinia pestis KIM
gccgcccuuuagccagc

SEQ ID NO: 4197497 - RNA, 20 nt, Yersinia pestis KIM
gccgcccuuuagccagcggc

SEQ ID NO: 4197498 - RNA, 19 nt, Yersinia pestis KIM
gccgccgauaacauuauug

SEQ ID NO: 4197499 - RNA, 13 nt, Yersinia pestis KIM
gccgccgccagcc

SEQ ID NO: 4197500 - RNA, 17 nt, Yersinia pestis KIM
gccgccgccagccccgc

SEQ ID NO: 4197501 - RNA, 14 nt, Yersinia pestis KIM
gccgccucugcucc

SEQ ID NO: 4197502 - RNA, 18 nt, Yersinia pestis KIM
gccgccuucaacugugga

SEQ ID NO: 4197503 - RNA, 17 nt, Yersinia pestis KIM
gccgcgaaaaaccauga

SEQ ID NO: 4197504 - RNA, 15 nt, Yersinia pestis KIM
gccgcgaauaacaga

SEQ ID NO: 4197505 - RNA, 16 nt, Yersinia pestis KIM
gccgcgccauccuugg

SEQ ID NO: 4197506 - RNA, 17 nt, Yersinia pestis KIM
gccgcgcccuaacaggc

SEQ ID NO: 4197507 - RNA, 14 nt, Yersinia pestis KIM
gccgcggcggccag

SEQ ID NO: 4197508 - RNA, 17 nt, Yersinia pestis KIM
gccgcggugaagaacag

SEQ ID NO: 4197509 - RNA, 22 nt, Yersinia pestis KIM
gccgcgugauagggaguuguuu

SEQ ID NO: 4197510 - RNA, 18 nt, Yersinia pestis KIM
gccgcuaauuuucccugu

SEQ ID NO: 4197511 - RNA, 16 nt, Yersinia pestis KIM
gccgcuaguuugacgc

SEQ ID NO: 4197512 - RNA, 17 nt, Yersinia pestis KIM
gccgcuaguuugacgcu

SEQ ID NO: 4197513 - RNA, 15 nt, Yersinia pestis KIM
gccgcuauauuuuua

SEQ ID NO: 4197514 - RNA, 21 nt, Yersinia pestis KIM
gccgcuauuggcgagcaugac

SEQ ID NO: 4197515 - RNA, 15 nt, Yersinia pestis KIM
gccgcucaugcccca

SEQ ID NO: 4197516 - RNA, 14 nt, Yersinia pestis KIM
gccgcuccagcacu

SEQ ID NO: 4197517 - RNA, 17 nt, Yersinia pestis KIM
gccgcucgguagcaaaa

SEQ ID NO: 4197518 - RNA, 22 nt, Yersinia pestis KIM
gccgcuucgcugacauuuucua

SEQ ID NO: 4197519 - RNA, 22 nt, Yersinia pestis KIM
gccgcuuugguugccagauaau

SEQ ID NO: 4197520 - RNA, 18 nt, Yersinia pestis KIM
gccggaaaagagauagca

SEQ ID NO: 4197521 - RNA, 15 nt, Yersinia pestis KIM
gccggaacggucagg

SEQ ID NO: 4197522 - RNA, 15 nt, Yersinia pestis KIM
gccggaaucagccag

SEQ ID NO: 4197523 - RNA, 16 nt, Yersinia pestis KIM
gccggauguaaaacac

SEQ ID NO: 4197524 - RNA, 20 nt, Yersinia pestis KIM
gccggauuauuauucauagu

SEQ ID NO: 4197525 - RNA, 13 nt, Yersinia pestis KIM
gccggcaacagcg

SEQ ID NO: 4197526 - RNA, 13 nt, Yersinia pestis KIM
gccggccaacauc

SEQ ID NO: 4197527 - RNA, 10 nt, Yersinia pestis KIM
gccggcggcc

SEQ ID NO: 4197528 - RNA, 14 nt, Yersinia pestis KIM
gccggcggcccaua

SEQ ID NO: 4197529 - RNA, 20 nt, Yersinia pestis KIM
gccggcguuaaugccacccc

SEQ ID NO: 4197530 - RNA, 14 nt, Yersinia pestis KIM
gccgggaugaucaa

SEQ ID NO: 4197531 - RNA, 13 nt, Yersinia pestis KIM
gccgggucaggaa

SEQ ID NO: 4197532 - RNA, 14 nt, Yersinia pestis KIM
gccgggucaggaag

SEQ ID NO: 4197533 - RNA, 24 nt, Yersinia pestis KIM
gccggguggcccaauaaaagguag

SEQ ID NO: 4197534 - RNA, 20 nt, Yersinia pestis KIM
gccggguuauaaaucagggc

SEQ ID NO: 4197535 - RNA, 21 nt, Yersinia pestis KIM
gccggguuauaaaucagggca

SEQ ID NO: 4197536 - RNA, 16 nt, Yersinia pestis KIM
gccggguuuugcauca

SEQ ID NO: 4197537 - RNA, 13 nt, Yersinia pestis KIM
gccgguggcaaaa

SEQ ID NO: 4197538 - RNA, 16 nt, Yersinia pestis KIM
gccguacaacaauaau

SEQ ID NO: 4197539 - RNA, 18 nt, Yersinia pestis KIM
gccguaucuuguaguaac

SEQ ID NO: 4197540 - RNA, 16 nt, Yersinia pestis KIM
gccgucagcucuuguu

SEQ ID NO: 4197541 - RNA, 13 nt, Yersinia pestis KIM
gccgucaucaucu

SEQ ID NO: 4197542 - RNA, 21 nt, Yersinia pestis KIM
gccgugaccaccgcagcaacc

SEQ ID NO: 4197543 - RNA, 14 nt, Yersinia pestis KIM
gccgugacuacggu

SEQ ID NO: 4197544 - RNA, 23 nt, Yersinia pestis KIM
gccgugcaaucuguuauaaaaaa

SEQ ID NO: 4197545 - RNA, 15 nt, Yersinia pestis KIM
gccgugcugcaacuc

SEQ ID NO: 4197546 - RNA, 18 nt, Yersinia pestis KIM
gccgugcugucagccagc

SEQ ID NO: 4197547 - RNA, 12 nt, Yersinia pestis KIM
gccguggcgaag

SEQ ID NO: 4197548 - RNA, 18 nt, Yersinia pestis KIM
gccguggcgaagcccaua

SEQ ID NO: 4197549 - RNA, 20 nt, Yersinia pestis KIM
gccguuacccccgacgacuu

SEQ ID NO: 4197550 - RNA, 18 nt, Yersinia pestis KIM
gccguuacccccuucacc

SEQ ID NO: 4197551 - RNA, 19 nt, Yersinia pestis KIM
gccguuauagaucuccugc

SEQ ID NO: 4197552 - RNA, 17 nt, Yersinia pestis KIM
gccguuuaccuugugcg

SEQ ID NO: 4197553 - RNA, 20 nt, Yersinia pestis KIM
gccguuucagauaaaaagcc

SEQ ID NO: 4197554 - RNA, 20 nt, Yersinia pestis KIM
gccguuucaggguauaugga

SEQ ID NO: 4197555 - RNA, 20 nt, Yersinia pestis KIM
gccuaaaaugaauaacgccg

SEQ ID NO: 4197556 - RNA, 16 nt, Yersinia pestis KIM
gccuaauguacuacca

SEQ ID NO: 4197557 - RNA, 23 nt, Yersinia pestis KIM
gccuaauuugguacgacgccaga

SEQ ID NO: 4197558 - RNA, 16 nt, Yersinia pestis KIM
gccuacguucaggccc

SEQ ID NO: 4197559 - RNA, 20 nt, Yersinia pestis KIM
gccuaggaucgaaugaucag

SEQ ID NO: 4197560 - RNA, 22 nt, Yersinia pestis KIM
gccuaguuaaacucaccgagca

SEQ ID NO: 4197561 - RNA, 23 nt, Yersinia pestis KIM
gccuauaaggcucuguuaccagc

SEQ ID NO: 4197562 - RNA, 14 nt, Yersinia pestis KIM
gccuauccucaccg

SEQ ID NO: 4197563 - RNA, 19 nt, Yersinia pestis KIM
gccuauggcggccauguug

SEQ ID NO: 4197564 - RNA, 19 nt, Yersinia pestis KIM
gccuauugaauaacagcua

SEQ ID NO: 4197565 - RNA, 22 nt, Yersinia pestis KIM
gccuauuguuuaugaguucugc

SEQ ID NO: 4197566 - RNA, 15 nt, Yersinia pestis KIM
gccuauuucagggcg

SEQ ID NO: 4197567 - RNA, 19 nt, Yersinia pestis KIM
gccuauuugcagaaaguaa

SEQ ID NO: 4197568 - RNA, 21 nt, Yersinia pestis KIM
gccucacaacuuucccaguca

SEQ ID NO: 4197569 - RNA, 15 nt, Yersinia pestis KIM
gccucagacuaauga

SEQ ID NO: 4197570 - RNA, 20 nt, Yersinia pestis KIM
gccucaguaucuuuccagcc

SEQ ID NO: 4197571 - RNA, 23 nt, Yersinia pestis KIM
gccucaucagaggcucauccugc

SEQ ID NO: 4197572 - RNA, 20 nt, Yersinia pestis KIM
gccuccaacuuaucacugga

SEQ ID NO: 4197573 - RNA, 13 nt, Yersinia pestis KIM
gccuccagugaua

SEQ ID NO: 4197574 - RNA, 14 nt, Yersinia pestis KIM
gccuccaguugagu

SEQ ID NO: 4197575 - RNA, 16 nt, Yersinia pestis KIM
gccuccaguugaguau

SEQ ID NO: 4197576 - RNA, 17 nt, Yersinia pestis KIM
gccucgaugcucaggcc

SEQ ID NO: 4197577 - RNA, 21 nt, Yersinia pestis KIM
gcgcagaguccucucaccaag

SEQ ID NO: 4197578 - RNA, 13 nt, Yersinia pestis KIM
gcgcagccacaug

SEQ ID NO: 4197579 - RNA, 15 nt, Yersinia pestis KIM
gcgcagguucaucag

SEQ ID NO: 4197580 - RNA, 23 nt, Yersinia pestis KIM
gcgcagugcucgggugccucacg

SEQ ID NO: 4197581 - RNA, 16 nt, Yersinia pestis KIM
gcgcaucagccagcca

SEQ ID NO: 4197582 - RNA, 17 nt, Yersinia pestis KIM
gcgcauccccaucgcca

SEQ ID NO: 4197583 - RNA, 20 nt, Yersinia pestis KIM
gcgccaaaacgcgcgccagu

SEQ ID NO: 4197584 - RNA, 21 nt, Yersinia pestis KIM
gcgccaaaauuaugccagucu

SEQ ID NO: 4197585 - RNA, 17 nt, Yersinia pestis KIM
gcgccaaccgcuugcau

SEQ ID NO: 4197586 - RNA, 14 nt, Yersinia pestis KIM
gcgccaaucgccac

SEQ ID NO: 4197587 - RNA, 18 nt, Yersinia pestis KIM
gcgccaaugacaaagggu

SEQ ID NO: 4197588 - RNA, 12 nt, Yersinia pestis KIM
gcgccacaaccc

SEQ ID NO: 4197589 - RNA, 16 nt, Yersinia pestis KIM
gcgccacgcuccacac

SEQ ID NO: 4197590 - RNA, 21 nt, Yersinia pestis KIM
gcgccagcaauuggccuucca

SEQ ID NO: 4197591 - RNA, 23 nt, Yersinia pestis KIM
gcgccagcggaauaugacgauga

SEQ ID NO: 4197592 - RNA, 17 nt, Yersinia pestis KIM
gcgccagggagggcgcg

SEQ ID NO: 4197593 - RNA, 22 nt, Yersinia pestis KIM
gcgccagguaagaaagagauga

SEQ ID NO: 4197594 - RNA, 18 nt, Yersinia pestis KIM
gcgccaguggcaucaaua

SEQ ID NO: 4197595 - RNA, 13 nt, Yersinia pestis KIM
gcgccauaaaaga

SEQ ID NO: 4197596 - RNA, 23 nt, Yersinia pestis KIM
gcgcccaaaugccgaaggcugac

SEQ ID NO: 4197597 - RNA, 14 nt, Yersinia pestis KIM
gcgcccaguggagc

SEQ ID NO: 4197598 - RNA, 14 nt, Yersinia pestis KIM
gcgcccauccgcag

SEQ ID NO: 4197599 - RNA, 16 nt, Yersinia pestis KIM
gcgcccauccgcagga

SEQ ID NO: 4197600 - RNA, 16 nt, Yersinia pestis KIM
gcgcccuucccauuua

SEQ ID NO: 4197601 - RNA, 14 nt, Yersinia pestis KIM
gcgccgacugcuga

SEQ ID NO: 4197602 - RNA, 17 nt, Yersinia pestis KIM
gcgccgcggcccugagg

SEQ ID NO: 4197603 - RNA, 23 nt, Yersinia pestis KIM
gcgccgcuucggucucuggaugc

SEQ ID NO: 4197604 - RNA, 15 nt, Yersinia pestis KIM
gcgccgugcccgguu

SEQ ID NO: 4197605 - RNA, 22 nt, Yersinia pestis KIM
gcgccuccaguuuuccagagcc

SEQ ID NO: 4197606 - RNA, 23 nt, Yersinia pestis KIM
gcgccuuuuauucuuuggugagc

SEQ ID NO: 4197607 - RNA, 21 nt, Yersinia pestis KIM
gcgcgaaauauugcccuacgg

SEQ ID NO: 4197608 - RNA, 19 nt, Yersinia pestis KIM
gcgcgcccagacgccggcc

SEQ ID NO: 4197609 - RNA, 14 nt, Yersinia pestis KIM
gcgcgcugcugcuc

SEQ ID NO: 4197610 - RNA, 21 nt, Yersinia pestis KIM
gcgcgggaaaagguaaacaga

SEQ ID NO: 4197611 - RNA, 17 nt, Yersinia pestis KIM
gcgcggguaauggcggu

SEQ ID NO: 4197612 - RNA, 19 nt, Yersinia pestis KIM
gcgcgucgccauaaccaga

SEQ ID NO: 4197613 - RNA, 16 nt, Yersinia pestis KIM
gcgcguuaaucugcug

SEQ ID NO: 4197614 - RNA, 20 nt, Yersinia pestis KIM
gcgcuauguuggcaaauaau

SEQ ID NO: 4197615 - RNA, 15 nt, Yersinia pestis KIM
gcgcucauacucagu

SEQ ID NO: 4197616 - RNA, 17 nt, Yersinia pestis KIM
gcgcuccacgccccaac

SEQ ID NO: 4197617 - RNA, 21 nt, Yersinia pestis KIM
gcgcucgccguuuuuacccgu

SEQ ID NO: 4197618 - RNA, 21 nt, Yersinia pestis KIM
gcgcugaauuuuugugcuagc

SEQ ID NO: 4197619 - RNA, 12 nt, Yersinia pestis KIM
gcgcugaccuaa

SEQ ID NO: 4197620 - RNA, 11 nt, Yersinia pestis KIM
gcgcugacggu

SEQ ID NO: 4197621 - RNA, 15 nt, Yersinia pestis KIM
gcgcugauugugccu

SEQ ID NO: 4197622 - RNA, 13 nt, Yersinia pestis KIM
gcgcugcaaagcc

SEQ ID NO: 4197623 - RNA, 13 nt, Yersinia pestis KIM
gcgcugcagcgau

SEQ ID NO: 4197624 - RNA, 21 nt, Yersinia pestis KIM
gcgcugcaucuggucaucaug

SEQ ID NO: 4197625 - RNA, 22 nt, Yersinia pestis KIM
gcgcugcugguuuuacugaaac

SEQ ID NO: 4197626 - RNA, 17 nt, Yersinia pestis KIM
gcgcuggcguaaaauau

SEQ ID NO: 4197627 - RNA, 13 nt, Yersinia pestis KIM
gcgcuuaaauaaa

SEQ ID NO: 4197628 - RNA, 16 nt, Yersinia pestis KIM
gcgcuuaauucuggcc

SEQ ID NO: 4197629 - RNA, 16 nt, Yersinia pestis KIM
gcgcuuccagcucugg

SEQ ID NO: 4197630 - RNA, 21 nt, Yersinia pestis KIM
gcgcuucgagcccccagggaa

SEQ ID NO: 4197631 - RNA, 16 nt, Yersinia pestis KIM
gcgcuugccacgccag

SEQ ID NO: 4197632 - RNA, 19 nt, Yersinia pestis KIM
gcgcuugccacgccaguaa

SEQ ID NO: 4197633 - RNA, 20 nt, Yersinia pestis KIM
gcgcuuuaaccaaagaacgg

SEQ ID NO: 4197634 - RNA, 20 nt, Yersinia pestis KIM
gcgcuuuuuaggauguuaug

SEQ ID NO: 4197635 - RNA, 22 nt, Yersinia pestis KIM
gcggaauauuuaaccagagauu

SEQ ID NO: 4197636 - RNA, 14 nt, Yersinia pestis KIM
gcggaauggcaacg

SEQ ID NO: 4197637 - RNA, 13 nt, Yersinia pestis KIM
gcggacaccaacu

SEQ ID NO: 4197638 - RNA, 18 nt, Yersinia pestis KIM
gcggacagcgcgcagcca

SEQ ID NO: 4197639 - RNA, 15 nt, Yersinia pestis KIM
gcggacauggcaaca

SEQ ID NO: 4197640 - RNA, 18 nt, Yersinia pestis KIM
gcggacgcuuuacuccuc

SEQ ID NO: 4197641 - RNA, 20 nt, Yersinia pestis KIM
gcggacgcuuuacucuucug

SEQ ID NO: 4197642 - RNA, 16 nt, Yersinia pestis KIM
gcggauaacggcggca

SEQ ID NO: 4197643 - RNA, 20 nt, Yersinia pestis KIM
gcggauucacccauuaauag

SEQ ID NO: 4197644 - RNA, 23 nt, Yersinia pestis KIM
gcggcaaaaagcgccagaugggc

SEQ ID NO: 4197645 - RNA, 23 nt, Yersinia pestis KIM
gcggcaagaacaccgucaguaug

SEQ ID NO: 4197646 - RNA, 20 nt, Yersinia pestis KIM
gcggcaccgccgucaaacca

SEQ ID NO: 4197647 - RNA, 14 nt, Yersinia pestis KIM
gcggcacucgcuca

SEQ ID NO: 4197648 - RNA, 13 nt, Yersinia pestis KIM
gcggcagagccaa

SEQ ID NO: 4197649 - RNA, 21 nt, Yersinia pestis KIM
gcggcauaaauucuagcaaca

SEQ ID NO: 4197650 - RNA, 13 nt, Yersinia pestis KIM
gcggcaucaccaa

SEQ ID NO: 4197651 - RNA, 14 nt, Yersinia pestis KIM
gcggcaucaccaaa

SEQ ID NO: 4197652 - RNA, 20 nt, Yersinia pestis KIM
gcggcaucuaugcuauccag

SEQ ID NO: 4197653 - RNA, 16 nt, Yersinia pestis KIM
gcggccagccuugagc

SEQ ID NO: 4197654 - RNA, 18 nt, Yersinia pestis KIM
gcggccagcggcaccgcc

SEQ ID NO: 4197655 - RNA, 22 nt, Yersinia pestis KIM
gcggccaucaauuuggcaugug

SEQ ID NO: 4197656 - RNA, 21 nt, Yersinia pestis KIM
gcggccauguuggucaagcgg

SEQ ID NO: 4197657 - RNA, 17 nt, Yersinia pestis KIM
gcggcccgcagauaauc

SEQ ID NO: 4197658 - RNA, 19 nt, Yersinia pestis KIM
gcggccgaucccccgccgu

SEQ ID NO: 4197659 - RNA, 21 nt, Yersinia pestis KIM
gcggccuuaauggccgccauu

SEQ ID NO: 4197660 - RNA, 14 nt, Yersinia pestis KIM
gcggcgaaacugac

SEQ ID NO: 4197661 - RNA, 21 nt, Yersinia pestis KIM
gcggcuguucauggucaccac

SEQ ID NO: 4197662 - RNA, 20 nt, Yersinia pestis KIM
gcgggaaaagguaaacagac

SEQ ID NO: 4197663 - RNA, 22 nt, Yersinia pestis KIM
gcgggaaucuugauuagcuggc

SEQ ID NO: 4197664 - RNA, 18 nt, Yersinia pestis KIM
gcgggaauucuuuggcaa

SEQ ID NO: 4197665 - RNA, 18 nt, Yersinia pestis KIM
gcgggaauugaaccugac

SEQ ID NO: 4197666 - RNA, 12 nt, Yersinia pestis KIM
gcgggagucagu

SEQ ID NO: 4197667 - RNA, 15 nt, Yersinia pestis KIM
gcgggcaacagagaa

SEQ ID NO: 4197668 - RNA, 15 nt, Yersinia pestis KIM
gcgggccagcaacca

SEQ ID NO: 4197669 - RNA, 12 nt, Yersinia pestis KIM
gcgggcgcgcug

SEQ ID NO: 4197670 - RNA, 14 nt, Yersinia pestis KIM
gcgggcgcgcugcu

SEQ ID NO: 4197671 - RNA, 16 nt, Yersinia pestis KIM
gcgggcuaaaacuggc

SEQ ID NO: 4197672 - RNA, 14 nt, Yersinia pestis KIM
gcgggcuggccaca

SEQ ID NO: 4197673 - RNA, 19 nt, Yersinia pestis KIM
gcgggggaacguggguggu

SEQ ID NO: 4197674 - RNA, 20 nt, Yersinia pestis KIM
gcgggugucuuuaaaaucuu

SEQ ID NO: 4197675 - RNA, 20 nt, Yersinia pestis KIM
gcggguuaucacauaaauaa

SEQ ID NO: 4197676 - RNA, 17 nt, Yersinia pestis KIM
gcgguaaacaccguauc

SEQ ID NO: 4197677 - RNA, 21 nt, Yersinia pestis KIM
gcgguaaccagcaucaguagc

SEQ ID NO: 4197678 - RNA, 17 nt, Yersinia pestis KIM
gcgguacuuuuugugau

SEQ ID NO: 4197679 - RNA, 19 nt, Yersinia pestis KIM
gcgguaguauuuguaguga

SEQ ID NO: 4197680 - RNA, 14 nt, Yersinia pestis KIM
gcgguagugaugca

SEQ ID NO: 4197681 - RNA, 21 nt, Yersinia pestis KIM
gcgguaugaaacaaccguguu

SEQ ID NO: 4197682 - RNA, 16 nt, Yersinia pestis KIM
gcgguccuacccuuug

SEQ ID NO: 4197683 - RNA, 12 nt, Yersinia pestis KIM
gcggugaacagu

SEQ ID NO: 4197684 - RNA, 22 nt, Yersinia pestis KIM
gcgguggccagagcauagacga

SEQ ID NO: 4197685 - RNA, 14 nt, Yersinia pestis KIM
gcgguggccgccuu

SEQ ID NO: 4197686 - RNA, 15 nt, Yersinia pestis KIM
gcgguuaucuggaau

SEQ ID NO: 4197687 - RNA, 13 nt, Yersinia pestis KIM
gcgguuauuuuua

SEQ ID NO: 4197688 - RNA, 17 nt, Yersinia pestis KIM
gcgguugggaaaagugg

SEQ ID NO: 4197689 - RNA, 22 nt, Yersinia pestis KIM
gcgguuuuuccgccgucuggug

SEQ ID NO: 4197690 - RNA, 19 nt, Yersinia pestis KIM
gcgguuuuuucuuucuuca

SEQ ID NO: 4197691 - RNA, 18 nt, Yersinia pestis KIM
gcuacugguaauaaugcu

SEQ ID NO: 4197692 - RNA, 21 nt, Yersinia pestis KIM
gcuacuuaacgauaaaaucaa

SEQ ID NO: 4197693 - RNA, 14 nt, Yersinia pestis KIM
gcuagaaaucacac

SEQ ID NO: 4197694 - RNA, 14 nt, Yersinia pestis KIM
gcuagccccaauca

SEQ ID NO: 4197695 - RNA, 17 nt, Yersinia pestis KIM
gcuaggaggccaggacu

SEQ ID NO: 4197696 - RNA, 17 nt, Yersinia pestis KIM
gcuagugauagcgggcc

SEQ ID NO: 4197697 - RNA, 15 nt, Yersinia pestis KIM
gcuaguuugacgcug

SEQ ID NO: 4197698 - RNA, 19 nt, Yersinia pestis KIM
gcuauauacccgucauaaa

SEQ ID NO: 4197699 - RNA, 15 nt, Yersinia pestis KIM
gcuauaucaucagca

SEQ ID NO: 4197700 - RNA, 23 nt, Yersinia pestis KIM
gcuauauugcgcugcgccaauac

SEQ ID NO: 4197701 - RNA, 17 nt, Yersinia pestis KIM
gcuaucacgauaaucaa

SEQ ID NO: 4197702 - RNA, 22 nt, Yersinia pestis KIM
gcuaucacgauaaucaaugcca

SEQ ID NO: 4197703 - RNA, 20 nt, Yersinia pestis KIM
gcuaucaucaaaggcaauac

SEQ ID NO: 4197704 - RNA, 14 nt, Yersinia pestis KIM
gcuauccaccaucg

SEQ ID NO: 4197705 - RNA, 17 nt, Yersinia pestis KIM
gcuauccgcgccgagcg

SEQ ID NO: 4197706 - RNA, 22 nt, Yersinia pestis KIM
gcuaucgaugguuggcuaucaa

SEQ ID NO: 4197707 - RNA, 22 nt, Yersinia pestis KIM
gcuaucgcgaaacucuuccuug

SEQ ID NO: 4197708 - RNA, 11 nt, Yersinia pestis KIM
gcuaucugcug

SEQ ID NO: 4197709 - RNA, 16 nt, Yersinia pestis KIM
gcuaucugugucagua

SEQ ID NO: 4197710 - RNA, 11 nt, Yersinia pestis KIM
gcuaucuguua

SEQ ID NO: 4197711 - RNA, 19 nt, Yersinia pestis KIM
gcuaucuguuaucugguua

SEQ ID NO: 4197712 - RNA, 13 nt, Yersinia pestis KIM
gcuaugcgcaauc

SEQ ID NO: 4197713 - RNA, 15 nt, Yersinia pestis KIM
gcuauggauaaaucc

SEQ ID NO: 4197714 - RNA, 22 nt, Yersinia pestis KIM
gcuauggauaaauccugaacau

SEQ ID NO: 4197715 - RNA, 17 nt, Yersinia pestis KIM
gcuauuaaacauuuaug

SEQ ID NO: 4197716 - RNA, 19 nt, Yersinia pestis KIM
gcuauuaacccgcugcgua

SEQ ID NO: 4197717 - RNA, 20 nt, Yersinia pestis KIM
gcuauuagccagaaauagca

SEQ ID NO: 4197718 - RNA, 21 nt, Yersinia pestis KIM
gcuauucagacgguugcuaga

SEQ ID NO: 4197719 - RNA, 17 nt, Yersinia pestis KIM
gcuauugaacauucauc

SEQ ID NO: 4197720 - RNA, 13 nt, Yersinia pestis KIM
gcuauugacaaag

SEQ ID NO: 4197721 - RNA, 20 nt, Yersinia pestis KIM
gcuauugaugucuaaugaca

SEQ ID NO: 4197722 - RNA, 16 nt, Yersinia pestis KIM
gcuauugcaacgcuug

SEQ ID NO: 4197723 - RNA, 22 nt, Yersinia pestis KIM
gcuauugcuuuuauugccuaca

SEQ ID NO: 4197724 - RNA, 19 nt, Yersinia pestis KIM
gcuauuggcugauucaaca

SEQ ID NO: 4197725 - RNA, 11 nt, Yersinia pestis KIM
gcuauuuaucg

SEQ ID NO: 4197726 - RNA, 16 nt, Yersinia pestis KIM
gcuauuucucucuacu

SEQ ID NO: 4197727 - RNA, 10 nt, Yersinia pestis KIM
gcucaacaug

SEQ ID NO: 4197728 - RNA, 15 nt, Yersinia pestis KIM
gcucaacugcucaac

SEQ ID NO: 4197729 - RNA, 16 nt, Yersinia pestis KIM
gcucaacugcucaacu

SEQ ID NO: 4197730 - RNA, 18 nt, Yersinia pestis KIM
gcucaacugcucaacugc

SEQ ID NO: 4197731 - RNA, 12 nt, Yersinia pestis KIM
gcucaagcuggc

SEQ ID NO: 4197732 - RNA, 14 nt, Yersinia pestis KIM
gcucaagcuggcca

SEQ ID NO: 4197733 - RNA, 12 nt, Yersinia pestis KIM
gcucaagcuggu

SEQ ID NO: 4197734 - RNA, 19 nt, Yersinia pestis KIM
gcucaaucucugccuguga

SEQ ID NO: 4197735 - RNA, 17 nt, Yersinia pestis KIM
gcucaauggcgggggcg

SEQ ID NO: 4197736 - RNA, 15 nt, Yersinia pestis KIM
gcucaauuaaccuga

SEQ ID NO: 4197737 - RNA, 12 nt, Yersinia pestis KIM
gcucaccacuga

SEQ ID NO: 4197738 - RNA, 21 nt, Yersinia pestis KIM
gcucacccauuuuauccucuu

SEQ ID NO: 4197739 - RNA, 16 nt, Yersinia pestis KIM
gcucaccuuucaacaa

SEQ ID NO: 4197740 - RNA, 22 nt, Yersinia pestis KIM
gcucacgcaaagggcaacaaua

SEQ ID NO: 4197741 - RNA, 16 nt, Yersinia pestis KIM
gcucacucaccgccag

SEQ ID NO: 4197742 - RNA, 23 nt, Yersinia pestis KIM
gcucacucaccgccagcaauaag

SEQ ID NO: 4197743 - RNA, 18 nt, Yersinia pestis KIM
gcucacucgguaaugagc

SEQ ID NO: 4197744 - RNA, 20 nt, Yersinia pestis KIM
gcucacucgguacaaucucu

SEQ ID NO: 4197745 - RNA, 21 nt, Yersinia pestis KIM
gcucacugauuuuuuaccuga

SEQ ID NO: 4197746 - RNA, 22 nt, Yersinia pestis KIM
gcucacuggaguuaaaucccug

SEQ ID NO: 4197747 - RNA, 18 nt, Yersinia pestis KIM
gcucacuuuuauauccgc

SEQ ID NO: 4197748 - RNA, 20 nt, Yersinia pestis KIM
gcucacuuuuauauccgcca

SEQ ID NO: 4197749 - RNA, 17 nt, Yersinia pestis KIM
gcucacuuuuauccagc

SEQ ID NO: 4197750 - RNA, 20 nt, Yersinia pestis KIM
gcucacuuuuauccagccau

SEQ ID NO: 4197751 - RNA, 23 nt, Yersinia pestis KIM
gcucagaaaauaaagggggcacc

SEQ ID NO: 4197752 - RNA, 17 nt, Yersinia pestis KIM
gcucagauacaucaaug

SEQ ID NO: 4197753 - RNA, 15 nt, Yersinia pestis KIM
gcucagccaggcagc

SEQ ID NO: 4197754 - RNA, 14 nt, Yersinia pestis KIM
gcucaggaaucuuc

SEQ ID NO: 4197755 - RNA, 14 nt, Yersinia pestis KIM
gcucaggccuugcg

SEQ ID NO: 4197756 - RNA, 18 nt, Yersinia pestis KIM
gcucaggcucaucaccuu

SEQ ID NO: 4197757 - RNA, 20 nt, Yersinia pestis KIM
gcucaggcucaucaccuucc

SEQ ID NO: 4197758 - RNA, 22 nt, Yersinia pestis KIM
gcucagggccacuucgguggcc

SEQ ID NO: 4197759 - RNA, 16 nt, Yersinia pestis KIM
gcucaguauucgccag

SEQ ID NO: 4197760 - RNA, 15 nt, Yersinia pestis KIM
gcucaguugaugcaa

SEQ ID NO: 4197761 - RNA, 16 nt, Yersinia pestis KIM
gcucauaaagcaucag

SEQ ID NO: 4197762 - RNA, 13 nt, Yersinia pestis KIM
gcucauagcccug

SEQ ID NO: 4197763 - RNA, 13 nt, Yersinia pestis KIM
gcucaucacggcg

SEQ ID NO: 4197764 - RNA, 15 nt, Yersinia pestis KIM
gcucaucauaaaaau

SEQ ID NO: 4197765 - RNA, 20 nt, Yersinia pestis KIM
gcucauccaucauugcuaaa

SEQ ID NO: 4197766 - RNA, 17 nt, Yersinia pestis KIM
gcucauguucauguuca

SEQ ID NO: 4197767 - RNA, 15 nt, Yersinia pestis KIM
gcucauuaccaauac

SEQ ID NO: 4197768 - RNA, 19 nt, Yersinia pestis KIM
gcuccaaagcuuccaauau

SEQ ID NO: 4197769 - RNA, 19 nt, Yersinia pestis KIM
gcuccaccguucagguuua

SEQ ID NO: 4197770 - RNA, 19 nt, Yersinia pestis KIM
gcuccagugcaucgcugag

SEQ ID NO: 4197771 - RNA, 15 nt, Yersinia pestis KIM
gcuccaucagguuua

SEQ ID NO: 4197772 - RNA, 21 nt, Yersinia pestis KIM
gcuccaucuuuuacaaauuug

SEQ ID NO: 4197773 - RNA, 21 nt, Yersinia pestis KIM
gcuccauuucugguugugcuu

SEQ ID NO: 4197774 - RNA, 22 nt, Yersinia pestis KIM
gcucccaaggguauaacucauc

SEQ ID NO: 4197775 - RNA, 20 nt, Yersinia pestis KIM
gcuccccccgugauaugcaa

SEQ ID NO: 4197776 - RNA, 20 nt, Yersinia pestis KIM
gcucccccuugauucacuga

SEQ ID NO: 4197777 - RNA, 18 nt, Yersinia pestis KIM
gcuccgcccuaaagcugu

SEQ ID NO: 4197778 - RNA, 22 nt, Yersinia pestis KIM
gcuccuauagcucagaaaauaa

SEQ ID NO: 4197779 - RNA, 23 nt, Yersinia pestis KIM
gcuccuauagcucagaaaauaaa

SEQ ID NO: 4197780 - RNA, 14 nt, Yersinia pestis KIM
gcuccucagccuuu

SEQ ID NO: 4197781 - RNA, 20 nt, Yersinia pestis KIM
gcucgaaccugaacgcagga

SEQ ID NO: 4197782 - RNA, 13 nt, Yersinia pestis KIM
gcucgaagcgcgc

SEQ ID NO: 4197783 - RNA, 14 nt, Yersinia pestis KIM
gcucgacggccaau

SEQ ID NO: 4197784 - RNA, 17 nt, Yersinia pestis KIM
gcucgagccgcgccauc

SEQ ID NO: 4197785 - RNA, 18 nt, Yersinia pestis KIM
gcucgcucaacaugccag

SEQ ID NO: 4197786 - RNA, 16 nt, Yersinia pestis KIM
gcucggcucgaaccug

SEQ ID NO: 4197787 - RNA, 15 nt, Yersinia pestis KIM
gcucgugaucagcag

SEQ ID NO: 4197788 - RNA, 19 nt, Yersinia pestis KIM
gcucgugaucagcagacuc

SEQ ID NO: 4197789 - RNA, 18 nt, Yersinia pestis KIM
gcucuaacgucagauaaa

SEQ ID NO: 4197790 - RNA, 21 nt, Yersinia pestis KIM
gcucuacacaggcguaauaug

SEQ ID NO: 4197791 - RNA, 14 nt, Yersinia pestis KIM
gcucuaucgauaaa

SEQ ID NO: 4197792 - RNA, 20 nt, Yersinia pestis KIM
gcucuaugccaguuauuauu

SEQ ID NO: 4197793 - RNA, 22 nt, Yersinia pestis KIM
gcucuauuucaugauucucuau

SEQ ID NO: 4197794 - RNA, 15 nt, Yersinia pestis KIM
gcucucacugcucca

SEQ ID NO: 4197795 - RNA, 18 nt, Yersinia pestis KIM
gcucucauauccccccca

SEQ ID NO: 4197796 - RNA, 22 nt, Yersinia pestis KIM
gcucuccacucggucaaccguu

SEQ ID NO: 4197797 - RNA, 13 nt, Yersinia pestis KIM
gcucucugagcca

SEQ ID NO: 4197798 - RNA, 17 nt, Yersinia pestis KIM
gcucucuuuuuucucuu

SEQ ID NO: 4197799 - RNA, 12 nt, Yersinia pestis KIM
gcucugauagua

SEQ ID NO: 4197800 - RNA, 14 nt, Yersinia pestis KIM
gcucugccaauaaa

SEQ ID NO: 4197801 - RNA, 14 nt, Yersinia pestis KIM
gcucugccuguucu

SEQ ID NO: 4197802 - RNA, 19 nt, Yersinia pestis KIM
gcucugccuuaugaauaua

SEQ ID NO: 4197803 - RNA, 17 nt, Yersinia pestis KIM
gcucugcguuuuucccu

SEQ ID NO: 4197804 - RNA, 15 nt, Yersinia pestis KIM
gcucuggcguacugu

SEQ ID NO: 4197805 - RNA, 14 nt, Yersinia pestis KIM
gcucuggucacuaa

SEQ ID NO: 4197806 - RNA, 21 nt, Yersinia pestis KIM
gcugugccaugucggcaggua

SEQ ID NO: 4197807 - RNA, 13 nt, Yersinia pestis KIM
gcugugugggcgg

SEQ ID NO: 4197808 - RNA, 16 nt, Yersinia pestis KIM
gcuguuaccaaacauu

SEQ ID NO: 4197809 - RNA, 14 nt, Yersinia pestis KIM
gcuguuauauaaau

SEQ ID NO: 4197810 - RNA, 13 nt, Yersinia pestis KIM
gcuguuauuacug

SEQ ID NO: 4197811 - RNA, 12 nt, Yersinia pestis KIM
gcuguucaaaau

SEQ ID NO: 4197812 - RNA, 14 nt, Yersinia pestis KIM
gcuguucaugguca

SEQ ID NO: 4197813 - RNA, 19 nt, Yersinia pestis KIM
gcuguucauggucaccaca

SEQ ID NO: 4197814 - RNA, 19 nt, Yersinia pestis KIM
gcuguuccaaccaaccuug

SEQ ID NO: 4197815 - RNA, 15 nt, Yersinia pestis KIM
gcuguugcguaccau

SEQ ID NO: 4197816 - RNA, 16 nt, Yersinia pestis KIM
gcuguuguuguugauu

SEQ ID NO: 4197817 - RNA, 16 nt, Yersinia pestis KIM
gcuuaaauaaaacacc

SEQ ID NO: 4197818 - RNA, 22 nt, Yersinia pestis KIM
gcuuaacauccgaauuuuuacu

SEQ ID NO: 4197819 - RNA, 22 nt, Yersinia pestis KIM
gcuuaacgcccugccgggcaau

SEQ ID NO: 4197820 - RNA, 18 nt, Yersinia pestis KIM
gcuuaacucgccacucac

SEQ ID NO: 4197821 - RNA, 22 nt, Yersinia pestis KIM
gcuuaaucaucaucacaaauaa

SEQ ID NO: 4197822 - RNA, 13 nt, Yersinia pestis KIM
gcuuaaucgccag

SEQ ID NO: 4197823 - RNA, 20 nt, Yersinia pestis KIM
gcuuaaucgccagcaaauca

SEQ ID NO: 4197824 - RNA, 13 nt, Yersinia pestis KIM
gcuuaaucuuuuu

SEQ ID NO: 4197825 - RNA, 19 nt, Yersinia pestis KIM
gcuuaaucuuuuuaaccac

SEQ ID NO: 4197826 - RNA, 19 nt, Yersinia pestis KIM
gcuuacaccauguucuuca

SEQ ID NO: 4197827 - RNA, 23 nt, Yersinia pestis KIM
gcuuagcaggcccuuucaccgcu

SEQ ID NO: 4197828 - RNA, 17 nt, Yersinia pestis KIM
gcuuaucaaagugcuua

SEQ ID NO: 4197829 - RNA, 20 nt, Yersinia pestis KIM
gcuuauccccugagaaacau

SEQ ID NO: 4197830 - RNA, 23 nt, Yersinia pestis KIM
gcuuaucucggggccacgguugg

SEQ ID NO: 4197831 - RNA, 12 nt, Yersinia pestis KIM
gcuuauggccuu

SEQ ID NO: 4197832 - RNA, 12 nt, Yersinia pestis KIM
gcuuauucgagu

SEQ ID NO: 4197833 - RNA, 21 nt, Yersinia pestis KIM
gcuuauugugccccaacauug

SEQ ID NO: 4197834 - RNA, 19 nt, Yersinia pestis KIM
gcuucaccgcuuuucuggu

SEQ ID NO: 4197835 - RNA, 20 nt, Yersinia pestis KIM
gcuucacggacagcaaccac

SEQ ID NO: 4197836 - RNA, 17 nt, Yersinia pestis KIM
gcuucagcucuucuaac

SEQ ID NO: 4197837 - RNA, 19 nt, Yersinia pestis KIM
gcuucaguuuugcggguga

SEQ ID NO: 4197838 - RNA, 16 nt, Yersinia pestis KIM
gcuucaucagcgccca

SEQ ID NO: 4197839 - RNA, 18 nt, Yersinia pestis KIM
gcuucaucaguaaaauac

SEQ ID NO: 4197840 - RNA, 18 nt, Yersinia pestis KIM
gcuucaucauggauaaag

SEQ ID NO: 4197841 - RNA, 16 nt, Yersinia pestis KIM
gcuucauccaacuuac

SEQ ID NO: 4197842 - RNA, 15 nt, Yersinia pestis KIM
gcuuccaucacaaau

SEQ ID NO: 4197843 - RNA, 16 nt, Yersinia pestis KIM
gcuuccaucaggaagc

SEQ ID NO: 4197844 - RNA, 16 nt, Yersinia pestis KIM
gcuuccaucaggaagu

SEQ ID NO: 4197845 - RNA, 16 nt, Yersinia pestis KIM
gcuuccgguaaagaag

SEQ ID NO: 4197846 - RNA, 15 nt, Yersinia pestis KIM
gcuucgagcccccag

SEQ ID NO: 4197847 - RNA, 14 nt, Yersinia pestis KIM
gcuucgccacggca

SEQ ID NO: 4197848 - RNA, 17 nt, Yersinia pestis KIM
gcuucguagccauuggg

SEQ ID NO: 4197849 - RNA, 14 nt, Yersinia pestis KIM
gcuucuaacaauaa

SEQ ID NO: 4197850 - RNA, 15 nt, Yersinia pestis KIM
gcuucugccaugguu

SEQ ID NO: 4197851 - RNA, 22 nt, Yersinia pestis KIM
gcuucugcgaggccgcugcaag

SEQ ID NO: 4197852 - RNA, 18 nt, Yersinia pestis KIM
gcuucuggcgugucaucu

SEQ ID NO: 4197853 - RNA, 15 nt, Yersinia pestis KIM
gcuucugggccaaag

SEQ ID NO: 4197854 - RNA, 17 nt, Yersinia pestis KIM
gcuucugggccaaagcg

SEQ ID NO: 4197855 - RNA, 13 nt, Yersinia pestis KIM
gcuucuuuuaaag

SEQ ID NO: 4197856 - RNA, 14 nt, Yersinia pestis KIM
gcuugaucacaauc

SEQ ID NO: 4197857 - RNA, 19 nt, Yersinia pestis KIM
gcuugccgguucccgccgu

SEQ ID NO: 4197858 - RNA, 22 nt, Yersinia pestis KIM
gcuugccugacagccugugccc

SEQ ID NO: 4197859 - RNA, 16 nt, Yersinia pestis KIM
gcuugcgcgccuguuu

SEQ ID NO: 4197860 - RNA, 19 nt, Yersinia pestis KIM
gcuugcgcguuaaucugcu

SEQ ID NO: 4197861 - RNA, 15 nt, Yersinia pestis KIM
gcuugcggaucagcg

SEQ ID NO: 4197862 - RNA, 15 nt, Yersinia pestis KIM
gcuugcuggcggcgg

SEQ ID NO: 4197863 - RNA, 22 nt, Yersinia pestis KIM
gcuugcugguauucaucagcaa

SEQ ID NO: 4197864 - RNA, 17 nt, Yersinia pestis KIM
gcuugcuuugcuucauc

SEQ ID NO: 4197865 - RNA, 19 nt, Yersinia pestis KIM
gcuugcuuugcuucaucca

SEQ ID NO: 4197866 - RNA, 19 nt, Yersinia pestis KIM
gcuuggauuccgucgccaa

SEQ ID NO: 4197867 - RNA, 17 nt, Yersinia pestis KIM
gcuuggguaucuggagc

SEQ ID NO: 4197868 - RNA, 16 nt, Yersinia pestis KIM
gcuuguggaaauagaa

SEQ ID NO: 4197869 - RNA, 13 nt, Yersinia pestis KIM
gcuuguucuuccg

SEQ ID NO: 4197870 - RNA, 17 nt, Yersinia pestis KIM
gcuuuaaauaacgcaaa

SEQ ID NO: 4197871 - RNA, 20 nt, Yersinia pestis KIM
gcuuuaagauccaguucagu

SEQ ID NO: 4197872 - RNA, 19 nt, Yersinia pestis KIM
gcuuuaagauccauguaua

SEQ ID NO: 4197873 - RNA, 17 nt, Yersinia pestis KIM
gcuuuaagcuaauucug

SEQ ID NO: 4197874 - RNA, 13 nt, Yersinia pestis KIM
gcuuuaauccauu

SEQ ID NO: 4197875 - RNA, 12 nt, Yersinia pestis KIM
gcuuuaaugagu

SEQ ID NO: 4197876 - RNA, 13 nt, Yersinia pestis KIM
gcuuuaaugaguu

SEQ ID NO: 4197877 - RNA, 13 nt, Yersinia pestis KIM
gcuuuacuccucu

SEQ ID NO: 4197878 - RNA, 14 nt, Yersinia pestis KIM
gcuuuacuccucug

SEQ ID NO: 4197879 - RNA, 16 nt, Yersinia pestis KIM
gcuuuacuccucugcc

SEQ ID NO: 4197880 - RNA, 20 nt, Yersinia pestis KIM
gcuuuacuccucugccuauc

SEQ ID NO: 4197881 - RNA, 17 nt, Yersinia pestis KIM
gcuuuacucuucagccu

SEQ ID NO: 4197882 - RNA, 16 nt, Yersinia pestis KIM
gcuuuacugcuuuucu

SEQ ID NO: 4197883 - RNA, 18 nt, Yersinia pestis KIM
gcuuuacugcuuuucuac

SEQ ID NO: 4197884 - RNA, 14 nt, Yersinia pestis KIM
gcuuuagcauugca

SEQ ID NO: 4197885 - RNA, 20 nt, Yersinia pestis KIM
gcuuuagcggcgauuucauc

SEQ ID NO: 4197886 - RNA, 19 nt, Yersinia pestis KIM
gcuuuagugggugagcaga

SEQ ID NO: 4197887 - RNA, 16 nt, Yersinia pestis KIM
gcuuuaucgccaacac

SEQ ID NO: 4197888 - RNA, 15 nt, Yersinia pestis KIM
gcuuuaucguagcca

SEQ ID NO: 4197889 - RNA, 14 nt, Yersinia pestis KIM
gcuuuauuauauga

SEQ ID NO: 4197890 - RNA, 14 nt, Yersinia pestis KIM
gcuuucaauaaaac

SEQ ID NO: 4197891 - RNA, 22 nt, Yersinia pestis KIM
gcuuucagcacgcuuuccagcu

SEQ ID NO: 4197892 - RNA, 21 nt, Yersinia pestis KIM
gcuuucaggagugaauuucuu

SEQ ID NO: 4197893 - RNA, 14 nt, Yersinia pestis KIM
gcuuucaucgauug

SEQ ID NO: 4197894 - RNA, 15 nt, Yersinia pestis KIM
gcuuucaucuucuuc

SEQ ID NO: 4197895 - RNA, 19 nt, Yersinia pestis KIM
gcuuuccagcucuggccag

SEQ ID NO: 4197896 - RNA, 13 nt, Yersinia pestis KIM
gcuuucgaucauc

SEQ ID NO: 4197897 - RNA, 18 nt, Yersinia pestis KIM
gcuuucggauuaaaaccu

SEQ ID NO: 4197898 - RNA, 23 nt, Yersinia pestis KIM
gcuuucugugguuggcagcucag

SEQ ID NO: 4197899 - RNA, 16 nt, Yersinia pestis KIM
gcuuugacuaauacug

SEQ ID NO: 4197900 - RNA, 12 nt, Yersinia pestis KIM
gcuuugcaccau

SEQ ID NO: 4197901 - RNA, 11 nt, Yersinia pestis KIM
gcuuugcuucu

SEQ ID NO: 4197902 - RNA, 23 nt, Yersinia pestis KIM
gcuuuuagggauauuucucccca

SEQ ID NO: 4197903 - RNA, 18 nt, Yersinia pestis KIM
gcuuuucgaacugacgau

SEQ ID NO: 4197904 - RNA, 18 nt, Yersinia pestis KIM
gcuuuugauuuucuuacc

SEQ ID NO: 4197905 - RNA, 19 nt, Yersinia pestis KIM
gcuuuugccucacugucuu

SEQ ID NO: 4197906 - RNA, 17 nt, Yersinia pestis KIM
gcuuuugcugcaaacug

SEQ ID NO: 4197907 - RNA, 15 nt, Yersinia pestis KIM
gcuuuuuaucauuua

SEQ ID NO: 4197908 - RNA, 19 nt, Yersinia pestis KIM
gcuuuuuauugucucuacu

SEQ ID NO: 4197909 - RNA, 11 nt, Yersinia pestis KIM
gcuuuuugcug

SEQ ID NO: 4197910 - RNA, 15 nt, Yersinia pestis KIM
gcuuuuuguauuuuu

SEQ ID NO: 4197911 - RNA, 23 nt, Yersinia pestis KIM
gcuuuuuuaauaaaaaacugacu

SEQ ID NO: 4197912 - RNA, 21 nt, Yersinia pestis KIM
gcuuuuuuacgcgccugcuca

SEQ ID NO: 4197913 - RNA, 16 nt, Yersinia pestis KIM
gcuuuuuucuagcugu

SEQ ID NO: 4197914 - RNA, 13 nt, Yersinia pestis KIM
gcuuuuuuguuuu

SEQ ID NO: 4197915 - RNA, 19 nt, Yersinia pestis KIM
ggaaaaacgugaauauccu

SEQ ID NO: 4197916 - RNA, 14 nt, Yersinia pestis KIM
ggaaaacgccagca

SEQ ID NO: 4197917 - RNA, 18 nt, Yersinia pestis KIM
ggaaaauuaacuuauuga

SEQ ID NO: 4197918 - RNA, 16 nt, Yersinia pestis KIM
ggaaaguagccauuuu

SEQ ID NO: 4197919 - RNA, 17 nt, Yersinia pestis KIM
ggaaaucaccaaaucca

SEQ ID NO: 4197920 - RNA, 18 nt, Yersinia pestis KIM
ggaaaugccgauaaaaac

SEQ ID NO: 4197921 - RNA, 11 nt, Yersinia pestis KIM
ggcaaaaaaau

SEQ ID NO: 4197922 - RNA, 16 nt, Yersinia pestis KIM
ggcaaaaauaaucaac

SEQ ID NO: 4197923 - RNA, 19 nt, Yersinia pestis KIM
ggcaaaacucaggugagua

SEQ ID NO: 4197924 - RNA, 16 nt, Yersinia pestis KIM
ggcaaaagcaucacca

SEQ ID NO: 4197925 - RNA, 17 nt, Yersinia pestis KIM
ggcaaaauaaucggcaa

SEQ ID NO: 4197926 - RNA, 19 nt, Yersinia pestis KIM
ggcaaacucagccaucagu

SEQ ID NO: 4197927 - RNA, 12 nt, Yersinia pestis KIM
ggcaaagaagaa

SEQ ID NO: 4197928 - RNA, 22 nt, Yersinia pestis KIM
ggcaaagaauugagguaaacca

SEQ ID NO: 4197929 - RNA, 17 nt, Yersinia pestis KIM
ggcaaagucugguggug

SEQ ID NO: 4197930 - RNA, 23 nt, Yersinia pestis KIM
ggcaaaguuauugaccaauauaa

SEQ ID NO: 4197931 - RNA, 19 nt, Yersinia pestis KIM
ggcaaauagaggggcgcug

SEQ ID NO: 4197932 - RNA, 16 nt, Yersinia pestis KIM
ggcaaauaggccgcau

SEQ ID NO: 4197933 - RNA, 15 nt, Yersinia pestis KIM
ggcaaauuuagccgc

SEQ ID NO: 4197934 - RNA, 24 nt, Yersinia pestis KIM
ggcaacaaaaucgcgaccagcaga

SEQ ID NO: 4197935 - RNA, 21 nt, Yersinia pestis KIM
ggcaacagcauggaaacggug

SEQ ID NO: 4197936 - RNA, 20 nt, Yersinia pestis KIM
ggcaacgaaggcaacaacac

SEQ ID NO: 4197937 - RNA, 15 nt, Yersinia pestis KIM
ggcaacgacauguug

SEQ ID NO: 4197938 - RNA, 21 nt, Yersinia pestis KIM
ggcaacucuagcgccagcaau

SEQ ID NO: 4197939 - RNA, 20 nt, Yersinia pestis KIM
ggcaacuuaagcauuggcaa

SEQ ID NO: 4197940 - RNA, 13 nt, Yersinia pestis KIM
ggcaagaaacuuc

SEQ ID NO: 4197941 - RNA, 21 nt, Yersinia pestis KIM
ggcaagaaacuucauuucagg

SEQ ID NO: 4197942 - RNA, 22 nt, Yersinia pestis KIM
ggcaagaacaccgucaguaugg

SEQ ID NO: 4197943 - RNA, 18 nt, Yersinia pestis KIM
ggcaagacgguaucuagg

SEQ ID NO: 4197944 - RNA, 14 nt, Yersinia pestis KIM
ggcaagauuucucu

SEQ ID NO: 4197945 - RNA, 23 nt, Yersinia pestis KIM
ggcaagcagacgcacccggcugg

SEQ ID NO: 4197946 - RNA, 14 nt, Yersinia pestis KIM
ggcaagcucugggc

SEQ ID NO: 4197947 - RNA, 12 nt, Yersinia pestis KIM
ggcaaggcacga

SEQ ID NO: 4197948 - RNA, 15 nt, Yersinia pestis KIM
ggcaaggcacgagcg

SEQ ID NO: 4197949 - RNA, 14 nt, Yersinia pestis KIM
ggcaaguuaaucau

SEQ ID NO: 4197950 - RNA, 19 nt, Yersinia pestis KIM
ggcaauaaaaaaggcagcg

SEQ ID NO: 4197951 - RNA, 23 nt, Yersinia pestis KIM
ggcaauaacacggccuauugaau

SEQ ID NO: 4197952 - RNA, 13 nt, Yersinia pestis KIM
ggcaauaauucag

SEQ ID NO: 4197953 - RNA, 15 nt, Yersinia pestis KIM
ggcaauacaccgcca

SEQ ID NO: 4197954 - RNA, 14 nt, Yersinia pestis KIM
ggcaaucacaaccc

SEQ ID NO: 4197955 - RNA, 20 nt, Yersinia pestis KIM
ggcaaucucuccccaagcgg

SEQ ID NO: 4197956 - RNA, 19 nt, Yersinia pestis KIM
ggcaauggcucaggcucau

SEQ ID NO: 4197957 - RNA, 22 nt, Yersinia pestis KIM
ggcaauggcucaggcucaucac

SEQ ID NO: 4197958 - RNA, 17 nt, Yersinia pestis KIM
ggcacaccgcuacaggc

SEQ ID NO: 4197959 - RNA, 17 nt, Yersinia pestis KIM
ggcacagcgagauaaac

SEQ ID NO: 4197960 - RNA, 16 nt, Yersinia pestis KIM
ggcacauacuaauaga

SEQ ID NO: 4197961 - RNA, 21 nt, Yersinia pestis KIM
ggcacaucuccagaauauaaa

SEQ ID NO: 4197962 - RNA, 17 nt, Yersinia pestis KIM
ggcaccacggucagaga

SEQ ID NO: 4197963 - RNA, 17 nt, Yersinia pestis KIM
ggcaccagcgcacugaa

SEQ ID NO: 4197964 - RNA, 13 nt, Yersinia pestis KIM
ggcaccaugccca

SEQ ID NO: 4197965 - RNA, 17 nt, Yersinia pestis KIM
ggcaccaugcccauaca

SEQ ID NO: 4197966 - RNA, 14 nt, Yersinia pestis KIM
ggcaccguggauaa

SEQ ID NO: 4197967 - RNA, 19 nt, Yersinia pestis KIM
ggcaccgugggcaaagaau

SEQ ID NO: 4197968 - RNA, 21 nt, Yersinia pestis KIM
ggcacgccaaucaauuccaua

SEQ ID NO: 4197969 - RNA, 23 nt, Yersinia pestis KIM
ggcacgcuuaaucuuuuuaacca

SEQ ID NO: 4197970 - RNA, 15 nt, Yersinia pestis KIM
ggcacgggcgaucac

SEQ ID NO: 4197971 - RNA, 16 nt, Yersinia pestis KIM
ggcacugcagaaaaug

SEQ ID NO: 4197972 - RNA, 12 nt, Yersinia pestis KIM
ggcacuggaugu

SEQ ID NO: 4197973 - RNA, 23 nt, Yersinia pestis KIM
ggcagaaaagcaaaggcccgcua

SEQ ID NO: 4197974 - RNA, 16 nt, Yersinia pestis KIM
ggcagaaacggcuauu

SEQ ID NO: 4197975 - RNA, 18 nt, Yersinia pestis KIM
ggcagaaauaauaucaag

SEQ ID NO: 4197976 - RNA, 16 nt, Yersinia pestis KIM
ggcagacucgacagca

SEQ ID NO: 4197977 - RNA, 19 nt, Yersinia pestis KIM
ggcagauaugccaggcauc

SEQ ID NO: 4197978 - RNA, 17 nt, Yersinia pestis KIM
ggcagauuucaccccuu

SEQ ID NO: 4197979 - RNA, 12 nt, Yersinia pestis KIM
ggcagcaagcaa

SEQ ID NO: 4197980 - RNA, 16 nt, Yersinia pestis KIM
ggcagcacagagcaca

SEQ ID NO: 4197981 - RNA, 17 nt, Yersinia pestis KIM
ggcagccugcggcggcu

SEQ ID NO: 4197982 - RNA, 15 nt, Yersinia pestis KIM
ggcagccuuuaucca

SEQ ID NO: 4197983 - RNA, 14 nt, Yersinia pestis KIM
ggcagcgagcacug

SEQ ID NO: 4197984 - RNA, 14 nt, Yersinia pestis KIM
ggcagcguaggcaa

SEQ ID NO: 4197985 - RNA, 16 nt, Yersinia pestis KIM
ggcagcuuggggaugg

SEQ ID NO: 4197986 - RNA, 18 nt, Yersinia pestis KIM
ggcaggcccgcuucccua

SEQ ID NO: 4197987 - RNA, 21 nt, Yersinia pestis KIM
ggcagggcgcuuucuggguga

SEQ ID NO: 4197988 - RNA, 18 nt, Yersinia pestis KIM
ggcaggguauuuucuccu

SEQ ID NO: 4197989 - RNA, 15 nt, Yersinia pestis KIM
ggcagguaaauccuu

SEQ ID NO: 4197990 - RNA, 16 nt, Yersinia pestis KIM
ggcaguaacgccauaa

SEQ ID NO: 4197991 - RNA, 14 nt, Yersinia pestis KIM
ggcagucacugcug

SEQ ID NO: 4197992 - RNA, 18 nt, Yersinia pestis KIM
ggcagugacaguagugag

SEQ ID NO: 4197993 - RNA, 22 nt, Yersinia pestis KIM
ggcauaaaaagcgacacuuauu

SEQ ID NO: 4197994 - RNA, 18 nt, Yersinia pestis KIM
ggcauaacugaauacuuu

SEQ ID NO: 4197995 - RNA, 21 nt, Yersinia pestis KIM
ggcauaaucaacgcucaauca

SEQ ID NO: 4197996 - RNA, 12 nt, Yersinia pestis KIM
ggcauacugaca

SEQ ID NO: 4197997 - RNA, 19 nt, Yersinia pestis KIM
ggcauauaaccaugcgaua

SEQ ID NO: 4197998 - RNA, 14 nt, Yersinia pestis KIM
ggcauauacaaccu

SEQ ID NO: 4197999 - RNA, 20 nt, Yersinia pestis KIM
ggcauaucgagcaucugguc

SEQ ID NO: 4198000 - RNA, 16 nt, Yersinia pestis KIM
ggcaucaaucagcggg

SEQ ID NO: 4198001 - RNA, 12 nt, Yersinia pestis KIM
ggcaucaccaaa

SEQ ID NO: 4198002 - RNA, 23 nt, Yersinia pestis KIM
ggcaucaccgcuaucacugauau

SEQ ID NO: 4198003 - RNA, 20 nt, Yersinia pestis KIM
ggcaucaucugcgguaacca

SEQ ID NO: 4198004 - RNA, 17 nt, Yersinia pestis KIM
ggcaugaccaaaggcua

SEQ ID NO: 4198005 - RNA, 12 nt, Yersinia pestis KIM
ggcaugcaacuu

SEQ ID NO: 4198006 - RNA, 16 nt, Yersinia pestis KIM
ggcaugcauuggaaaa

SEQ ID NO: 4198007 - RNA, 21 nt, Yersinia pestis KIM
ggcaugcucccuccugcggca

SEQ ID NO: 4198008 - RNA, 16 nt, Yersinia pestis KIM
ggcauggacgagcaca

SEQ ID NO: 4198009 - RNA, 20 nt, Yersinia pestis KIM
ggcauggauggucauaaaau

SEQ ID NO: 4198010 - RNA, 15 nt, Yersinia pestis KIM
ggcaugugggcaggg

SEQ ID NO: 4198011 - RNA, 20 nt, Yersinia pestis KIM
ggcauguucacaucggucaa

SEQ ID NO: 4198012 - RNA, 23 nt, Yersinia pestis KIM
ggcauuaaaaaucugcaauauca

SEQ ID NO: 4198013 - RNA, 14 nt, Yersinia pestis KIM
ggcauuaaacugaa

SEQ ID NO: 4198014 - RNA, 17 nt, Yersinia pestis KIM
ggcauuagagguuuaca

SEQ ID NO: 4198015 - RNA, 22 nt, Yersinia pestis KIM
ggcauuggauaauuugccuggc

SEQ ID NO: 4198016 - RNA, 22 nt, Yersinia pestis KIM
ggcauuuuuuauguuuauauuc

SEQ ID NO: 4198017 - RNA, 13 nt, Yersinia pestis KIM
ggcauuuuuugcc

SEQ ID NO: 4198018 - RNA, 23 nt, Yersinia pestis KIM
ggcauuuuuugccagauaaaaau

SEQ ID NO: 4198019 - RNA, 14 nt, Yersinia pestis KIM
ggccaacaggcccc

SEQ ID NO: 4198020 - RNA, 15 nt, Yersinia pestis KIM
ggccaacaggccccu

SEQ ID NO: 4198021 - RNA, 14 nt, Yersinia pestis KIM
ggccaauaggcccc

SEQ ID NO: 4198022 - RNA, 15 nt, Yersinia pestis KIM
ggccaauaggccccu

SEQ ID NO: 4198023 - RNA, 16 nt, Yersinia pestis KIM
ggccaauuuggccaau

SEQ ID NO: 4198024 - RNA, 19 nt, Yersinia pestis KIM
ggccaauuuggccaauaau

SEQ ID NO: 4198025 - RNA, 21 nt, Yersinia pestis KIM
ggccaccaaauugcggccagu

SEQ ID NO: 4198026 - RNA, 14 nt, Yersinia pestis KIM
ggccaccacgaaaa

SEQ ID NO: 4198027 - RNA, 17 nt, Yersinia pestis KIM
ggccaccacgaaaaaau

SEQ ID NO: 4198028 - RNA, 21 nt, Yersinia pestis KIM
ggccacggcucacacacuaau

SEQ ID NO: 4198029 - RNA, 14 nt, Yersinia pestis KIM
ggccacucaccuca

SEQ ID NO: 4198030 - RNA, 15 nt, Yersinia pestis KIM
ggccacucaccucag

SEQ ID NO: 4198031 - RNA, 17 nt, Yersinia pestis KIM
ggccacucgcaucgccu

SEQ ID NO: 4198032 - RNA, 18 nt, Yersinia pestis KIM
ggccacuucgguggcccu

SEQ ID NO: 4198033 - RNA, 22 nt, Yersinia pestis KIM
ggccacuucgguggcccuuauu

SEQ ID NO: 4198034 - RNA, 15 nt, Yersinia pestis KIM
ggccagcagaacuaa

SEQ ID NO: 4198035 - RNA, 15 nt, Yersinia pestis KIM
ggccagcauucaggc

SEQ ID NO: 4198036 - RNA, 18 nt, Yersinia pestis KIM
ggcucccccuugauucac

SEQ ID NO: 4198037 - RNA, 20 nt, Yersinia pestis KIM
ggcucccguuugcagcucaa

SEQ ID NO: 4198038 - RNA, 16 nt, Yersinia pestis KIM
ggcuccuauagcucag

SEQ ID NO: 4198039 - RNA, 12 nt, Yersinia pestis KIM
ggcucgaaccug

SEQ ID NO: 4198040 - RNA, 14 nt, Yersinia pestis KIM
ggcucgaaccugaa

SEQ ID NO: 4198041 - RNA, 14 nt, Yersinia pestis KIM
ggcucgagccgcgc

SEQ ID NO: 4198042 - RNA, 18 nt, Yersinia pestis KIM
ggcucgcccacggcacau

SEQ ID NO: 4198043 - RNA, 22 nt, Yersinia pestis KIM
ggcucgugaucagcagacucaa

SEQ ID NO: 4198044 - RNA, 17 nt, Yersinia pestis KIM
ggcucucuucagcgcuu

SEQ ID NO: 4198045 - RNA, 18 nt, Yersinia pestis KIM
ggcucucuuuuuucucuu

SEQ ID NO: 4198046 - RNA, 12 nt, Yersinia pestis KIM
ggcucugauucu

SEQ ID NO: 4198047 - RNA, 23 nt, Yersinia pestis KIM
ggcucugcgaccaaggcucuggc

SEQ ID NO: 4198048 - RNA, 20 nt, Yersinia pestis KIM
ggcucuggcaauggcuagcu

SEQ ID NO: 4198049 - RNA, 14 nt, Yersinia pestis KIM
ggcugaagacccaa

SEQ ID NO: 4198050 - RNA, 21 nt, Yersinia pestis KIM
ggcugacggugccagauagac

SEQ ID NO: 4198051 - RNA, 16 nt, Yersinia pestis KIM
ggcugaggccagcggc

SEQ ID NO: 4198052 - RNA, 12 nt, Yersinia pestis KIM
ggcugauacagc

SEQ ID NO: 4198053 - RNA, 17 nt, Yersinia pestis KIM
ggcugauguucugccaa

SEQ ID NO: 4198054 - RNA, 14 nt, Yersinia pestis KIM
ggcugauuaauauc

SEQ ID NO: 4198055 - RNA, 13 nt, Yersinia pestis KIM
ggcugccugccug

SEQ ID NO: 4198056 - RNA, 11 nt, Yersinia pestis KIM
ggcugcgacgc

SEQ ID NO: 4198057 - RNA, 20 nt, Yersinia pestis KIM
ggcugcguucuuugauuuga

SEQ ID NO: 4198058 - RNA, 16 nt, Yersinia pestis KIM
ggcugcugcagccggg

SEQ ID NO: 4198059 - RNA, 17 nt, Yersinia pestis KIM
ggcugcugcagccggga

SEQ ID NO: 4198060 - RNA, 22 nt, Yersinia pestis KIM
ggcuggaaaaaauaauggccaa

SEQ ID NO: 4198061 - RNA, 16 nt, Yersinia pestis KIM
ggcuggcaccaagcag

SEQ ID NO: 4198062 - RNA, 18 nt, Yersinia pestis KIM
ggcuggcauuuuuuaugu

SEQ ID NO: 4198063 - RNA, 20 nt, Yersinia pestis KIM
ggcuggggguucaguaaagc

SEQ ID NO: 4198064 - RNA, 14 nt, Yersinia pestis KIM
ggcuguaaauaaau

SEQ ID NO: 4198065 - RNA, 16 nt, Yersinia pestis KIM
ggcuguauucacguau

SEQ ID NO: 4198066 - RNA, 17 nt, Yersinia pestis KIM
ggcugucccgaugauug

SEQ ID NO: 4198067 - RNA, 18 nt, Yersinia pestis KIM
ggcugucggcgaugaaaa

SEQ ID NO: 4198068 - RNA, 23 nt, Yersinia pestis KIM
ggcugugaucugccagugccuca

SEQ ID NO: 4198069 - RNA, 14 nt, Yersinia pestis KIM
ggcuguugacauaa

SEQ ID NO: 4198070 - RNA, 21 nt, Yersinia pestis KIM
ggcuguuguaguuagaugaca

SEQ ID NO: 4198071 - RNA, 19 nt, Yersinia pestis KIM
ggcuuaacucgccacucac

SEQ ID NO: 4198072 - RNA, 15 nt, Yersinia pestis KIM
ggcuuagucauuaag

SEQ ID NO: 4198073 - RNA, 19 nt, Yersinia pestis KIM
ggcuucaaaaucaccuggc

SEQ ID NO: 4198074 - RNA, 20 nt, Yersinia pestis KIM
ggcuucacccuggcucuggc

SEQ ID NO: 4198075 - RNA, 23 nt, Yersinia pestis KIM
ggcuucaucaguaaaauaccccg

SEQ ID NO: 4198076 - RNA, 15 nt, Yersinia pestis KIM
ggcuucgcuguagga

SEQ ID NO: 4198077 - RNA, 18 nt, Yersinia pestis KIM
ggcuucuccugcgguggc

SEQ ID NO: 4198078 - RNA, 15 nt, Yersinia pestis KIM
ggcuucuuaauuccc

SEQ ID NO: 4198079 - RNA, 23 nt, Yersinia pestis KIM
ggcuugagcgacaaaagugucau

SEQ ID NO: 4198080 - RNA, 22 nt, Yersinia pestis KIM
ggcuugcaaucagaggccauca

SEQ ID NO: 4198081 - RNA, 16 nt, Yersinia pestis KIM
ggcuuggcaugacauc

SEQ ID NO: 4198082 - RNA, 15 nt, Yersinia pestis KIM
ggcuugggagucaga

SEQ ID NO: 4198083 - RNA, 19 nt, Yersinia pestis KIM
ggcuuuaacccggcgacga

SEQ ID NO: 4198084 - RNA, 17 nt, Yersinia pestis KIM
ggcuuuaagauccaguu

SEQ ID NO: 4198085 - RNA, 12 nt, Yersinia pestis KIM
ggcuuuaauauc

SEQ ID NO: 4198086 - RNA, 16 nt, Yersinia pestis KIM
ggcuuucaauaaaacu

SEQ ID NO: 4198087 - RNA, 13 nt, Yersinia pestis KIM
ggcuuucagcaua

SEQ ID NO: 4198088 - RNA, 17 nt, Yersinia pestis KIM
ggcuuucaggugacuga

SEQ ID NO: 4198089 - RNA, 15 nt, Yersinia pestis KIM
ggcuuucucuugcca

SEQ ID NO: 4198090 - RNA, 18 nt, Yersinia pestis KIM
ggcuuugcgcaaaauuaa

SEQ ID NO: 4198091 - RNA, 14 nt, Yersinia pestis KIM
ggcuuuuggggcgc

SEQ ID NO: 4198092 - RNA, 20 nt, Yersinia pestis KIM
ggcuuuuguuaauucaccua

SEQ ID NO: 4198093 - RNA, 21 nt, Yersinia pestis KIM
ggcuuuuucacacgcccaggc

SEQ ID NO: 4198094 - RNA, 16 nt, Yersinia pestis KIM
ggcuuuuuuaauaaaa

SEQ ID NO: 4198095 - RNA, 19 nt, Yersinia pestis KIM
ggcuuuuuuacgcgccugc

SEQ ID NO: 4198096 - RNA, 23 nt, Yersinia pestis KIM
gggaaaaguggcuaucugaaacu

SEQ ID NO: 4198097 - RNA, 15 nt, Yersinia pestis KIM
gggaaacaguaaauu

SEQ ID NO: 4198098 - RNA, 21 nt, Yersinia pestis KIM
gggaaccccucugcagcguca

SEQ ID NO: 4198099 - RNA, 19 nt, Yersinia pestis KIM
gggaaccccuucaggccau

SEQ ID NO: 4198100 - RNA, 14 nt, Yersinia pestis KIM
gggaauaaugguau

SEQ ID NO: 4198101 - RNA, 12 nt, Yersinia pestis KIM
gggaaugcaccc

SEQ ID NO: 4198102 - RNA, 18 nt, Yersinia pestis KIM
gggaauucuuuggcaaau

SEQ ID NO: 4198103 - RNA, 17 nt, Yersinia pestis KIM
gggacagagagauaauc

SEQ ID NO: 4198104 - RNA, 20 nt, Yersinia pestis KIM
gggacugccagaucaaagau

SEQ ID NO: 4198105 - RNA, 21 nt, Yersinia pestis KIM
gggaguauacggucaaaagcu

SEQ ID NO: 4198106 - RNA, 14 nt, Yersinia pestis KIM
gggaguuacucagc

SEQ ID NO: 4198107 - RNA, 14 nt, Yersinia pestis KIM
gggaguucaucaaa

SEQ ID NO: 4198108 - RNA, 15 nt, Yersinia pestis KIM
gggauaaaccagugu

SEQ ID NO: 4198109 - RNA, 12 nt, Yersinia pestis KIM
gggauaucucac

SEQ ID NO: 4198110 - RNA, 16 nt, Yersinia pestis KIM
gggauauuaauuccac

SEQ ID NO: 4198111 - RNA, 17 nt, Yersinia pestis KIM
gggaucaccucuucagg

SEQ ID NO: 4198112 - RNA, 22 nt, Yersinia pestis KIM
gggaucuccggacaggcuugau

SEQ ID NO: 4198113 - RNA, 10 nt, Yersinia pestis KIM
gggauggaaa

SEQ ID NO: 4198114 - RNA, 22 nt, Yersinia pestis KIM
gggauucaauaaguugcagagg

SEQ ID NO: 4198115 - RNA, 12 nt, Yersinia pestis KIM
gggcaaaaaaau

SEQ ID NO: 4198116 - RNA, 17 nt, Yersinia pestis KIM
gggcaaaccgcuaagcu

SEQ ID NO: 4198117 - RNA, 21 nt, Yersinia pestis KIM
gggcaauaacaaacacaucca

SEQ ID NO: 4198118 - RNA, 18 nt, Yersinia pestis KIM
gggcaaucaggaaaggcc

SEQ ID NO: 4198119 - RNA, 12 nt, Yersinia pestis KIM
gggcacuuucau

SEQ ID NO: 4198120 - RNA, 16 nt, Yersinia pestis KIM
gggcagcgacaaccug

SEQ ID NO: 4198121 - RNA, 14 nt, Yersinia pestis KIM
gggcaggagucuga

SEQ ID NO: 4198122 - RNA, 16 nt, Yersinia pestis KIM
gggcauuuaauucagu

SEQ ID NO: 4198123 - RNA, 14 nt, Yersinia pestis KIM
gggccaaggucagg

SEQ ID NO: 4198124 - RNA, 19 nt, Yersinia pestis KIM
gggccaauccaauaggaua

SEQ ID NO: 4198125 - RNA, 20 nt, Yersinia pestis KIM
gggccgaugccaggcaccag

SEQ ID NO: 4198126 - RNA, 13 nt, Yersinia pestis KIM
gggccgugcggga

SEQ ID NO: 4198127 - RNA, 17 nt, Yersinia pestis KIM
gggccuguuugcagcga

SEQ ID NO: 4198128 - RNA, 22 nt, Yersinia pestis KIM
gggccuuaaaaaacgauuagcu

SEQ ID NO: 4198129 - RNA, 18 nt, Yersinia pestis KIM
gggccuuuauucauucag

SEQ ID NO: 4198130 - RNA, 20 nt, Yersinia pestis KIM
gggcgauggggaguauucgu

SEQ ID NO: 4198131 - RNA, 10 nt, Yersinia pestis KIM
gggcgccccg

SEQ ID NO: 4198132 - RNA, 19 nt, Yersinia pestis KIM
gggcgcggguaauggcggu

SEQ ID NO: 4198133 - RNA, 14 nt, Yersinia pestis KIM
gggcgcuuuucuuu

SEQ ID NO: 4198134 - RNA, 14 nt, Yersinia pestis KIM
gggcggcggcuacg

SEQ ID NO: 4198135 - RNA, 16 nt, Yersinia pestis KIM
gggcgguaguauuugu

SEQ ID NO: 4198136 - RNA, 13 nt, Yersinia pestis KIM
gggcguucuguca

SEQ ID NO: 4198137 - RNA, 22 nt, Yersinia pestis KIM
gggcuaucaucaaaggcaauac

SEQ ID NO: 4198138 - RNA, 23 nt, Yersinia pestis KIM
gggcuauuuauuuagagcguccu

SEQ ID NO: 4198139 - RNA, 17 nt, Yersinia pestis KIM
gggcugacagagcgggu

SEQ ID NO: 4198140 - RNA, 20 nt, Yersinia pestis KIM
gggcugaguaaagcccagca

SEQ ID NO: 4198141 - RNA, 11 nt, Yersinia pestis KIM
gggcugaucau

SEQ ID NO: 4198142 - RNA, 15 nt, Yersinia pestis KIM
gggcugccaguaaaa

SEQ ID NO: 4198143 - RNA, 14 nt, Yersinia pestis KIM
gggcuggcaagcag

SEQ ID NO: 4198144 - RNA, 15 nt, Yersinia pestis KIM
gggcuuccaauauug

SEQ ID NO: 4198145 - RNA, 16 nt, Yersinia pestis KIM
gggcuuccaucaggaa

SEQ ID NO: 4198146 - RNA, 16 nt, Yersinia pestis KIM
gggcuucggucaggug

SEQ ID NO: 4198147 - RNA, 19 nt, Yersinia pestis KIM
gggcuucggucagguggug

SEQ ID NO: 4198148 - RNA, 21 nt, Yersinia pestis KIM
gggcuugcauaucagcaauga

SEQ ID NO: 4198149 - RNA, 15 nt, Yersinia pestis KIM
gggcuuuaauacaau

SEQ ID NO: 4198150 - RNA, 13 nt, Yersinia pestis KIM
gggcuuuugcugu

SEQ ID NO: 4198151 - RNA, 18 nt, Yersinia pestis KIM
ggucgcacugugagcggc

SEQ ID NO: 4198152 - RNA, 18 nt, Yersinia pestis KIM
ggucgccgugcugcucgg

SEQ ID NO: 4198153 - RNA, 21 nt, Yersinia pestis KIM
ggucgcuugagguuauugaca

SEQ ID NO: 4198154 - RNA, 18 nt, Yersinia pestis KIM
ggucgggcgcugagcggg

SEQ ID NO: 4198155 - RNA, 19 nt, Yersinia pestis KIM
ggucgggcgcugagcgggc

SEQ ID NO: 4198156 - RNA, 12 nt, Yersinia pestis KIM
ggucguauucag

SEQ ID NO: 4198157 - RNA, 16 nt, Yersinia pestis KIM
ggucgugaaagcagaa

SEQ ID NO: 4198158 - RNA, 18 nt, Yersinia pestis KIM
ggucugcaacucagugaa

SEQ ID NO: 4198159 - RNA, 17 nt, Yersinia pestis KIM
ggucuuaucagcgguau

SEQ ID NO: 4198160 - RNA, 13 nt, Yersinia pestis KIM
ggugaaaaaauau

SEQ ID NO: 4198161 - RNA, 19 nt, Yersinia pestis KIM
ggugaaccaucaacaauuc

SEQ ID NO: 4198162 - RNA, 15 nt, Yersinia pestis KIM
ggugaagaaaccuaa

SEQ ID NO: 4198163 - RNA, 19 nt, Yersinia pestis KIM
ggugacauccgcuugcagc

SEQ ID NO: 4198164 - RNA, 18 nt, Yersinia pestis KIM
ggugacauguuccagugc

SEQ ID NO: 4198165 - RNA, 14 nt, Yersinia pestis KIM
ggugacuauuuaaa

SEQ ID NO: 4198166 - RNA, 23 nt, Yersinia pestis KIM
ggugacuauuuaaauacaaaaau

SEQ ID NO: 4198167 - RNA, 19 nt, Yersinia pestis KIM
ggugacuuacgucuuuaaa

SEQ ID NO: 4198168 - RNA, 16 nt, Yersinia pestis KIM
ggugagugagcgcagg

SEQ ID NO: 4198169 - RNA, 15 nt, Yersinia pestis KIM
ggugagugagcgcgg

SEQ ID NO: 4198170 - RNA, 15 nt, Yersinia pestis KIM
ggugauauaugccau

SEQ ID NO: 4198171 - RNA, 20 nt, Yersinia pestis KIM
ggugaucgguuagcuacuga

SEQ ID NO: 4198172 - RNA, 22 nt, Yersinia pestis KIM
ggugaugaauuugauacaguga

SEQ ID NO: 4198173 - RNA, 19 nt, Yersinia pestis KIM
ggugcaguuucacccucug

SEQ ID NO: 4198174 - RNA, 12 nt, Yersinia pestis KIM
ggugccacacag

SEQ ID NO: 4198175 - RNA, 13 nt, Yersinia pestis KIM
ggugccagcagca

SEQ ID NO: 4198176 - RNA, 22 nt, Yersinia pestis KIM
ggugcgccacuguucuuaucac

SEQ ID NO: 4198177 - RNA, 15 nt, Yersinia pestis KIM
ggugcgccaguggca

SEQ ID NO: 4198178 - RNA, 13 nt, Yersinia pestis KIM
ggugcuauuucug

SEQ ID NO: 4198179 - RNA, 16 nt, Yersinia pestis KIM
ggugcuucaagcccga

SEQ ID NO: 4198180 - RNA, 14 nt, Yersinia pestis KIM
gguggccaguaacg

SEQ ID NO: 4198181 - RNA, 18 nt, Yersinia pestis KIM
ggugguuuuggccgggau

SEQ ID NO: 4198182 - RNA, 23 nt, Yersinia pestis KIM
gguguaccgcuucgcgcccgccc

SEQ ID NO: 4198183 - RNA, 20 nt, Yersinia pestis KIM
ggugucaguacgcuggccag

SEQ ID NO: 4198184 - RNA, 18 nt, Yersinia pestis KIM
gguguguuguuggcuaau

SEQ ID NO: 4198185 - RNA, 12 nt, Yersinia pestis KIM
gguguuuaaaau

SEQ ID NO: 4198186 - RNA, 14 nt, Yersinia pestis KIM
gguguuuggugaag

SEQ ID NO: 4198187 - RNA, 12 nt, Yersinia pestis KIM
gguuaaaacaga

SEQ ID NO: 4198188 - RNA, 13 nt, Yersinia pestis KIM
gguuaaaacagau

SEQ ID NO: 4198189 - RNA, 22 nt, Yersinia pestis KIM
gguuaaaacagauaaaaaauaa

SEQ ID NO: 4198190 - RNA, 22 nt, Yersinia pestis KIM
gguuaacggucucuuucgggca

SEQ ID NO: 4198191 - RNA, 17 nt, Yersinia pestis KIM
gguuaacuuuuucuauc

SEQ ID NO: 4198192 - RNA, 23 nt, Yersinia pestis KIM
gguuacgauacguugcaggucaa

SEQ ID NO: 4198193 - RNA, 16 nt, Yersinia pestis KIM
gguuacgucauauccc

SEQ ID NO: 4198194 - RNA, 17 nt, Yersinia pestis KIM
gguuagauuacagccua

SEQ ID NO: 4198195 - RNA, 12 nt, Yersinia pestis KIM
gguuagcgccuu

SEQ ID NO: 4198196 - RNA, 15 nt, Yersinia pestis KIM
gguuagggcaauaaa

SEQ ID NO: 4198197 - RNA, 14 nt, Yersinia pestis KIM
gguuaucacagcaa

SEQ ID NO: 4198198 - RNA, 17 nt, Yersinia pestis KIM
gguuaucacauaaauaa

SEQ ID NO: 4198199 - RNA, 13 nt, Yersinia pestis KIM
gguuaucccuacc

SEQ ID NO: 4198200 - RNA, 15 nt, Yersinia pestis KIM
gguuaucuggaauuu

SEQ ID NO: 4198201 - RNA, 16 nt, Yersinia pestis KIM
gguuauuauguaaaua

SEQ ID NO: 4198202 - RNA, 22 nt, Yersinia pestis KIM
gguuauuggccgcgcacagcac

SEQ ID NO: 4198203 - RNA, 13 nt, Yersinia pestis KIM
gguucaaaucagu

SEQ ID NO: 4198204 - RNA, 18 nt, Yersinia pestis KIM
gguucaaggaaaccaaug

SEQ ID NO: 4198205 - RNA, 18 nt, Yersinia pestis KIM
gguucaaguccaguaggg

SEQ ID NO: 4198206 - RNA, 14 nt, Yersinia pestis KIM
gguucaccccucac

SEQ ID NO: 4198207 - RNA, 20 nt, Yersinia pestis KIM
gguucaccuuucgguugcau

SEQ ID NO: 4198208 - RNA, 11 nt, Yersinia pestis KIM
gguucacggaa

SEQ ID NO: 4198209 - RNA, 15 nt, Yersinia pestis KIM
gguucauauuggcca

SEQ ID NO: 4198210 - RNA, 15 nt, Yersinia pestis KIM
gguuccaaagcacca

SEQ ID NO: 4198211 - RNA, 18 nt, Yersinia pestis KIM
gguucgagacaacguuuc

SEQ ID NO: 4198212 - RNA, 15 nt, Yersinia pestis KIM
gguucuccaacaacc

SEQ ID NO: 4198213 - RNA, 21 nt, Yersinia pestis KIM
gguucuuucauucauuucaac

SEQ ID NO: 4198214 - RNA, 15 nt, Yersinia pestis KIM
gguugaaauaaauaa

SEQ ID NO: 4198215 - RNA, 20 nt, Yersinia pestis KIM
gguugagcaucugaaagcuu

SEQ ID NO: 4198216 - RNA, 21 nt, Yersinia pestis KIM
gguugcaggcugucaggaacu

SEQ ID NO: 4198217 - RNA, 18 nt, Yersinia pestis KIM
gguugcauuugggcagau

SEQ ID NO: 4198218 - RNA, 23 nt, Yersinia pestis KIM
gguugccauuaauuggccgggac

SEQ ID NO: 4198219 - RNA, 20 nt, Yersinia pestis KIM
gguugccgguuuauuauuca

SEQ ID NO: 4198220 - RNA, 13 nt, Yersinia pestis KIM
gguugcuguaaug

SEQ ID NO: 4198221 - RNA, 14 nt, Yersinia pestis KIM
gguugcuguaaugc

SEQ ID NO: 4198222 - RNA, 14 nt, Yersinia pestis KIM
gguuggcagcucag

SEQ ID NO: 4198223 - RNA, 16 nt, Yersinia pestis KIM
gguuggcaucaaauuu

SEQ ID NO: 4198224 - RNA, 23 nt, Yersinia pestis KIM
gguugggaaaaguggcuaucuga

SEQ ID NO: 4198225 - RNA, 21 nt, Yersinia pestis KIM
gguugucuauguuugaugguu

SEQ ID NO: 4198226 - RNA, 17 nt, Yersinia pestis KIM
gguuuaacaauguggua

SEQ ID NO: 4198227 - RNA, 15 nt, Yersinia pestis KIM
gguuuaggccuauaa

SEQ ID NO: 4198228 - RNA, 15 nt, Yersinia pestis KIM
gguuugacggcggcg

SEQ ID NO: 4198229 - RNA, 17 nt, Yersinia pestis KIM
gguuuuaccaucaccau

SEQ ID NO: 4198230 - RNA, 14 nt, Yersinia pestis KIM
gguuuuaucaauag

SEQ ID NO: 4198231 - RNA, 14 nt, Yersinia pestis KIM
gguuuuggccggga

SEQ ID NO: 4198232 - RNA, 15 nt, Yersinia pestis KIM
gguuuuuaacagcuu

SEQ ID NO: 4198233 - RNA, 19 nt, Yersinia pestis KIM
gguuuuuugcgggacagaa

SEQ ID NO: 4198234 - RNA, 13 nt, Yersinia pestis KIM
guaaaaaaaaccu

SEQ ID NO: 4198235 - RNA, 23 nt, Yersinia pestis KIM
guaaaaaaaccccguacaugaau

SEQ ID NO: 4198236 - RNA, 12 nt, Yersinia pestis KIM
guaaaaaaauag

SEQ ID NO: 4198237 - RNA, 19 nt, Yersinia pestis KIM
guaaaaaaccuuauuuuug

SEQ ID NO: 4198238 - RNA, 18 nt, Yersinia pestis KIM
guaaaaauucaagagagg

SEQ ID NO: 4198239 - RNA, 17 nt, Yersinia pestis KIM
guaaaacacgcaacacu

SEQ ID NO: 4198240 - RNA, 19 nt, Yersinia pestis KIM
guaaaacagggagccgccc

SEQ ID NO: 4198241 - RNA, 14 nt, Yersinia pestis KIM
guaaaacauuucau

SEQ ID NO: 4198242 - RNA, 13 nt, Yersinia pestis KIM
guaaaaccagcag

SEQ ID NO: 4198243 - RNA, 20 nt, Yersinia pestis KIM
guaaaagaauaaaugucacu

SEQ ID NO: 4198244 - RNA, 16 nt, Yersinia pestis KIM
guaaaagauucauaaa

SEQ ID NO: 4198245 - RNA, 15 nt, Yersinia pestis KIM
guaaaaggcccgcua

SEQ ID NO: 4198246 - RNA, 12 nt, Yersinia pestis KIM
guaaaauaccaa

SEQ ID NO: 4198247 - RNA, 19 nt, Yersinia pestis KIM
guaaaauuauugccgcaga

SEQ ID NO: 4198248 - RNA, 20 nt, Yersinia pestis KIM
guaaacaacacauucccauu

SEQ ID NO: 4198249 - RNA, 16 nt, Yersinia pestis KIM
guaaacacaaaauaga

SEQ ID NO: 4198250 - RNA, 16 nt, Yersinia pestis KIM
guaaacaccggcaaua

SEQ ID NO: 4198251 - RNA, 16 nt, Yersinia pestis KIM
guaaacagacacagca

SEQ ID NO: 4198252 - RNA, 19 nt, Yersinia pestis KIM
guaaacagacacagcaaca

SEQ ID NO: 4198253 - RNA, 21 nt, Yersinia pestis KIM
guaaaccuaacacguuaaauu

SEQ ID NO: 4198254 - RNA, 23 nt, Yersinia pestis KIM
guaaacguggcccuuucgcagcc

SEQ ID NO: 4198255 - RNA, 23 nt, Yersinia pestis KIM
guaaacuucggauuaccggcacu

SEQ ID NO: 4198256 - RNA, 18 nt, Yersinia pestis KIM
guaaagaaauacccccca

SEQ ID NO: 4198257 - RNA, 20 nt, Yersinia pestis KIM
guaaagacgccguaaauaca

SEQ ID NO: 4198258 - RNA, 19 nt, Yersinia pestis KIM
guaaagacgcuaauuaaag

SEQ ID NO: 4198259 - RNA, 16 nt, Yersinia pestis KIM
guaaagguuucugccu

SEQ ID NO: 4198260 - RNA, 20 nt, Yersinia pestis KIM
guaaauaaauaaucauuugu

SEQ ID NO: 4198261 - RNA, 18 nt, Yersinia pestis KIM
guaaauagucauauauuu

SEQ ID NO: 4198262 - RNA, 13 nt, Yersinia pestis KIM
guaaauauaaaau

SEQ ID NO: 4198263 - RNA, 13 nt, Yersinia pestis KIM
guaaauaucauau

SEQ ID NO: 4198264 - RNA, 15 nt, Yersinia pestis KIM
guaaaucaggccggu

SEQ ID NO: 4198265 - RNA, 12 nt, Yersinia pestis KIM
guaaauccugau

SEQ ID NO: 4198266 - RNA, 22 nt, Yersinia pestis KIM
guacgugacggcagcgagcacu

SEQ ID NO: 4198267 - RNA, 22 nt, Yersinia pestis KIM
guacgugacggcggcgagcacu

SEQ ID NO: 4198268 - RNA, 15 nt, Yersinia pestis KIM
guacuaccaaaacgu

SEQ ID NO: 4198269 - RNA, 17 nt, Yersinia pestis KIM
guacuccccggcccaga

SEQ ID NO: 4198270 - RNA, 23 nt, Yersinia pestis KIM
guacugauuauuuggugaguaaa

SEQ ID NO: 4198271 - RNA, 14 nt, Yersinia pestis KIM
guacugcauguacg

SEQ ID NO: 4198272 - RNA, 20 nt, Yersinia pestis KIM
guacuggcgcgcuuuggauc

SEQ ID NO: 4198273 - RNA, 18 nt, Yersinia pestis KIM
guacugggaugaagaaau

SEQ ID NO: 4198274 - RNA, 13 nt, Yersinia pestis KIM
guacuuagcaaua

SEQ ID NO: 4198275 - RNA, 18 nt, Yersinia pestis KIM
guacuucagguaauaacg

SEQ ID NO: 4198276 - RNA, 22 nt, Yersinia pestis KIM
guacuuccaauaagugauucga

SEQ ID NO: 4198277 - RNA, 13 nt, Yersinia pestis KIM
guacuucucuggc

SEQ ID NO: 4198278 - RNA, 16 nt, Yersinia pestis KIM
guacuugacgcugcag

SEQ ID NO: 4198279 - RNA, 13 nt, Yersinia pestis KIM
guacuuggucacu

SEQ ID NO: 4198280 - RNA, 14 nt, Yersinia pestis KIM
guagaccaccaacu

SEQ ID NO: 4198281 - RNA, 16 nt, Yersinia pestis KIM
guagacgucauaaaaa

SEQ ID NO: 4198282 - RNA, 19 nt, Yersinia pestis KIM
guagacuuuguacuucgaa

SEQ ID NO: 4198283 - RNA, 20 nt, Yersinia pestis KIM
guagaucaaacauaaccugc

SEQ ID NO: 4198284 - RNA, 18 nt, Yersinia pestis KIM
guagcagcccaacacuuu

SEQ ID NO: 4198285 - RNA, 18 nt, Yersinia pestis KIM
guagcagccuguaggcca

SEQ ID NO: 4198286 - RNA, 17 nt, Yersinia pestis KIM
guagccaauagacaaaa

SEQ ID NO: 4198287 - RNA, 20 nt, Yersinia pestis KIM
guagccacaauaauuaggaa

SEQ ID NO: 4198288 - RNA, 23 nt, Yersinia pestis KIM
guagccauauaauaugccagcgc

SEQ ID NO: 4198289 - RNA, 16 nt, Yersinia pestis KIM
guagccugcacggcuc

SEQ ID NO: 4198290 - RNA, 14 nt, Yersinia pestis KIM
guagcgucaaguuc

SEQ ID NO: 4198291 - RNA, 22 nt, Yersinia pestis KIM
guagcucgccuucauuaucaug

SEQ ID NO: 4198292 - RNA, 20 nt, Yersinia pestis KIM
guagcucggccccuaacuga

SEQ ID NO: 4198293 - RNA, 13 nt, Yersinia pestis KIM
guagcuuaucccc

SEQ ID NO: 4198294 - RNA, 19 nt, Yersinia pestis KIM
guagcuuuuuaaauaccag

SEQ ID NO: 4198295 - RNA, 21 nt, Yersinia pestis KIM
guaggcaacuaagcugccuca

SEQ ID NO: 4198296 - RNA, 13 nt, Yersinia pestis KIM
guaggcaucugcc

SEQ ID NO: 4198297 - RNA, 20 nt, Yersinia pestis KIM
guaggccacccccauaacca

SEQ ID NO: 4198298 - RNA, 13 nt, Yersinia pestis KIM
guagggauaaauc

SEQ ID NO: 4198299 - RNA, 11 nt, Yersinia pestis KIM
guaggggaggu

SEQ ID NO: 4198300 - RNA, 18 nt, Yersinia pestis KIM
guaguaagcaugccaucc

SEQ ID NO: 4198301 - RNA, 20 nt, Yersinia pestis KIM
guaguauuaacgaaauacuc

SEQ ID NO: 4198302 - RNA, 21 nt, Yersinia pestis KIM
guagucauacaaaaugagccu

SEQ ID NO: 4198303 - RNA, 22 nt, Yersinia pestis KIM
guagugacguaaaaaggcagug

SEQ ID NO: 4198304 - RNA, 13 nt, Yersinia pestis KIM
guagugccgccag

SEQ ID NO: 4198305 - RNA, 21 nt, Yersinia pestis KIM
guagugccgccagugcuuccg

SEQ ID NO: 4198306 - RNA, 19 nt, Yersinia pestis KIM
guaguguguuuucuuguau

SEQ ID NO: 4198307 - RNA, 18 nt, Yersinia pestis KIM
guaguuagaugacaucga

SEQ ID NO: 4198308 - RNA, 22 nt, Yersinia pestis KIM
guaguucagucgcgauaaaauu

SEQ ID NO: 4198309 - RNA, 12 nt, Yersinia pestis KIM
guauaaaaauag

SEQ ID NO: 4198310 - RNA, 16 nt, Yersinia pestis KIM
guauaaaaauagccuu

SEQ ID NO: 4198311 - RNA, 19 nt, Yersinia pestis KIM
guauacaauugccugauuu

SEQ ID NO: 4198312 - RNA, 20 nt, Yersinia pestis KIM
guauaccccugcucacgcaa

SEQ ID NO: 4198313 - RNA, 16 nt, Yersinia pestis KIM
guauacggucaaaagc

SEQ ID NO: 4198314 - RNA, 16 nt, Yersinia pestis KIM
guauacgugucacauu

SEQ ID NO: 4198315 - RNA, 23 nt, Yersinia pestis KIM
guauacuaaaacagcucacucgg

SEQ ID NO: 4198316 - RNA, 18 nt, Yersinia pestis KIM
guauacuaugggauaaac

SEQ ID NO: 4198317 - RNA, 12 nt, Yersinia pestis KIM
guauauaaaaaa

SEQ ID NO: 4198318 - RNA, 17 nt, Yersinia pestis KIM
guauauacccuaaauaa

SEQ ID NO: 4198319 - RNA, 20 nt, Yersinia pestis KIM
guauauacccuaaauaauuc

SEQ ID NO: 4198320 - RNA, 23 nt, Yersinia pestis KIM
guauauuaucauucaagaaaaug

SEQ ID NO: 4198321 - RNA, 23 nt, Yersinia pestis KIM
guauauugcucuggauucggcuu

SEQ ID NO: 4198322 - RNA, 11 nt, Yersinia pestis KIM
guauauuuaug

SEQ ID NO: 4198323 - RNA, 17 nt, Yersinia pestis KIM
guaucaacaauuuccau

SEQ ID NO: 4198324 - RNA, 22 nt, Yersinia pestis KIM
guaucaauaccuuacugcauca

SEQ ID NO: 4198325 - RNA, 23 nt, Yersinia pestis KIM
guaucagccccuaaauccugcaa

SEQ ID NO: 4198326 - RNA, 13 nt, Yersinia pestis KIM
guaucagcggcgu

SEQ ID NO: 4198327 - RNA, 22 nt, Yersinia pestis KIM
guaucauauguucgaucaaaac

SEQ ID NO: 4198328 - RNA, 14 nt, Yersinia pestis KIM
guaucauggaagac

SEQ ID NO: 4198329 - RNA, 20 nt, Yersinia pestis KIM
guaucauuuuccugcauauu

SEQ ID NO: 4198330 - RNA, 14 nt, Yersinia pestis KIM
guauccaucugaug

SEQ ID NO: 4198331 - RNA, 15 nt, Yersinia pestis KIM
guauccguuaucauc

SEQ ID NO: 4198332 - RNA, 23 nt, Yersinia pestis KIM
guauccuggccguguuuuucccu

SEQ ID NO: 4198333 - RNA, 22 nt, Yersinia pestis KIM
guaucgaauugaucugauauua

SEQ ID NO: 4198334 - RNA, 21 nt, Yersinia pestis KIM
guaucgcccuggcuaauuuua

SEQ ID NO: 4198335 - RNA, 16 nt, Yersinia pestis KIM
guaucgggggguuuuc

SEQ ID NO: 4198336 - RNA, 16 nt, Yersinia pestis KIM
guaucggguagcaucc

SEQ ID NO: 4198337 - RNA, 18 nt, Yersinia pestis KIM
guaucuguuuuugccacc

SEQ ID NO: 4198338 - RNA, 15 nt, Yersinia pestis KIM
guaucuuuccagcca

SEQ ID NO: 4198339 - RNA, 22 nt, Yersinia pestis KIM
guaugaccgguuuauacacaaa

SEQ ID NO: 4198340 - RNA, 19 nt, Yersinia pestis KIM
guaugauauugaugacgcu

SEQ ID NO: 4198341 - RNA, 21 nt, Yersinia pestis KIM
guaugcgcaccgaaauagucg

SEQ ID NO: 4198342 - RNA, 12 nt, Yersinia pestis KIM
guaugggggaug

SEQ ID NO: 4198343 - RNA, 21 nt, Yersinia pestis KIM
guauguuguucgaaaauagac

SEQ ID NO: 4198344 - RNA, 23 nt, Yersinia pestis KIM
guauuaaucaacagauaugcauu

SEQ ID NO: 4198345 - RNA, 22 nt, Yersinia pestis KIM
guauuaccgauaaaggccgcag

SEQ ID NO: 4198346 - RNA, 21 nt, Yersinia pestis KIM
guauuauaaaauucgcuauga

SEQ ID NO: 4198347 - RNA, 13 nt, Yersinia pestis KIM
guauuaucaucac

SEQ ID NO: 4198348 - RNA, 13 nt, Yersinia pestis KIM
guauuauuuacaa

SEQ ID NO: 4198349 - RNA, 21 nt, Yersinia pestis KIM
guauucaaaauagaaaagcgc

SEQ ID NO: 4198350 - RNA, 15 nt, Yersinia pestis KIM
guauucacugucaau

SEQ ID NO: 4198351 - RNA, 19 nt, Yersinia pestis KIM
guauucacugucaaucgau

SEQ ID NO: 4198352 - RNA, 19 nt, Yersinia pestis KIM
guauucauaucgcuaaaac

SEQ ID NO: 4198353 - RNA, 13 nt, Yersinia pestis KIM
guauucccgcuac

SEQ ID NO: 4198354 - RNA, 15 nt, Yersinia pestis KIM
guauucccgcuaccg

SEQ ID NO: 4198355 - RNA, 20 nt, Yersinia pestis KIM
guauuccgagcaaucaaaag

SEQ ID NO: 4198356 - RNA, 14 nt, Yersinia pestis KIM
guauuccugccugg

SEQ ID NO: 4198357 - RNA, 14 nt, Yersinia pestis KIM
guauugaagauacc

SEQ ID NO: 4198358 - RNA, 19 nt, Yersinia pestis KIM
guauugaccagauaggcuu

SEQ ID NO: 4198359 - RNA, 17 nt, Yersinia pestis KIM
guauugauaaaaauauc

SEQ ID NO: 4198360 - RNA, 13 nt, Yersinia pestis KIM
guauugaugcaug

SEQ ID NO: 4198361 - RNA, 12 nt, Yersinia pestis KIM
guauugcucagg

SEQ ID NO: 4198362 - RNA, 20 nt, Yersinia pestis KIM
guauuggcuaacuggcgcug

SEQ ID NO: 4198363 - RNA, 22 nt, Yersinia pestis KIM
guauugguaacgcagaaauauu

SEQ ID NO: 4198364 - RNA, 17 nt, Yersinia pestis KIM
guauuuauucaaaaaau

SEQ ID NO: 4198365 - RNA, 23 nt, Yersinia pestis KIM
guauuugcaaugcggagccgaua

SEQ ID NO: 4198366 - RNA, 20 nt, Yersinia pestis KIM
guauuuguagugaaugacag

SEQ ID NO: 4198367 - RNA, 18 nt, Yersinia pestis KIM
guauuuuaagaaaacugu

SEQ ID NO: 4198368 - RNA, 16 nt, Yersinia pestis KIM
guauuuugucaugaaa

SEQ ID NO: 4198369 - RNA, 18 nt, Yersinia pestis KIM
guauuuuuguauuuaaau

SEQ ID NO: 4198370 - RNA, 13 nt, Yersinia pestis KIM
gucaaaagaaacu

SEQ ID NO: 4198371 - RNA, 13 nt, Yersinia pestis KIM
gucaaaauccgga

SEQ ID NO: 4198372 - RNA, 17 nt, Yersinia pestis KIM
gucaaaccaauuucucg

SEQ ID NO: 4198373 - RNA, 21 nt, Yersinia pestis KIM
gucaaacucagcgaauaaaua

SEQ ID NO: 4198374 - RNA, 21 nt, Yersinia pestis KIM
gucaacagaacuaauaucaac

SEQ ID NO: 4198375 - RNA, 18 nt, Yersinia pestis KIM
gucaaccugcguaaacaa

SEQ ID NO: 4198376 - RNA, 14 nt, Yersinia pestis KIM
gucaacgauuguua

SEQ ID NO: 4198377 - RNA, 17 nt, Yersinia pestis KIM
gucaaggugauuucaaa

SEQ ID NO: 4198378 - RNA, 23 nt, Yersinia pestis KIM
gucaaguucuaaggaaaauaccc

SEQ ID NO: 4198379 - RNA, 23 nt, Yersinia pestis KIM
gucaaguucuaagggaaauaccc

SEQ ID NO: 4198380 - RNA, 21 nt, Yersinia pestis KIM
guccaggcuuucacggugcgu

SEQ ID NO: 4198381 - RNA, 12 nt, Yersinia pestis KIM
guccauaauucu

SEQ ID NO: 4198382 - RNA, 16 nt, Yersinia pestis KIM
guccauaauucugugu

SEQ ID NO: 4198383 - RNA, 17 nt, Yersinia pestis KIM
guccauagcuaaaauaa

SEQ ID NO: 4198384 - RNA, 18 nt, Yersinia pestis KIM
gucccaagaaaagcaccg

SEQ ID NO: 4198385 - RNA, 21 nt, Yersinia pestis KIM
guccccgagaggcuauuuauc

SEQ ID NO: 4198386 - RNA, 18 nt, Yersinia pestis KIM
gucccgacgguuucuguc

SEQ ID NO: 4198387 - RNA, 14 nt, Yersinia pestis KIM
gucccugauggggc

SEQ ID NO: 4198388 - RNA, 23 nt, Yersinia pestis KIM
guccugauucgcgaccagcagaa

SEQ ID NO: 4198389 - RNA, 12 nt, Yersinia pestis KIM
gucgaaagcuca

SEQ ID NO: 4198390 - RNA, 18 nt, Yersinia pestis KIM
gucgaucccaauauuaaa

SEQ ID NO: 4198391 - RNA, 20 nt, Yersinia pestis KIM
gucgauggucauuuguugcu

SEQ ID NO: 4198392 - RNA, 13 nt, Yersinia pestis KIM
gucgccaccccau

SEQ ID NO: 4198393 - RNA, 17 nt, Yersinia pestis KIM
gucgccauaauuaaggu

SEQ ID NO: 4198394 - RNA, 17 nt, Yersinia pestis KIM
gucgcgaauagccaagc

SEQ ID NO: 4198395 - RNA, 19 nt, Yersinia pestis KIM
gucgcgggcacuuugucaa

SEQ ID NO: 4198396 - RNA, 20 nt, Yersinia pestis KIM
gucgcgggcacuuugucaau

SEQ ID NO: 4198397 - RNA, 16 nt, Yersinia pestis KIM
gucgcguuggcuaaaa

SEQ ID NO: 4198398 - RNA, 21 nt, Yersinia pestis KIM
gucgcucuuugauuccucugu

SEQ ID NO: 4198399 - RNA, 15 nt, Yersinia pestis KIM
gucgcugaaaugcua

SEQ ID NO: 4198400 - RNA, 22 nt, Yersinia pestis KIM
gucgcugaaaugcuauggguaa

SEQ ID NO: 4198401 - RNA, 19 nt, Yersinia pestis KIM
gucgcuguagcgccaggua

SEQ ID NO: 4198402 - RNA, 19 nt, Yersinia pestis KIM
gucggcauuaaaagcaugc

SEQ ID NO: 4198403 - RNA, 22 nt, Yersinia pestis KIM
gucgggcgcugagcgggcggca

SEQ ID NO: 4198404 - RNA, 14 nt, Yersinia pestis KIM
gucgguaaccugaa

SEQ ID NO: 4198405 - RNA, 22 nt, Yersinia pestis KIM
gucgguaaccugaaagucagga

SEQ ID NO: 4198406 - RNA, 21 nt, Yersinia pestis KIM
gucgguuuuuguauuccacuu

SEQ ID NO: 4198407 - RNA, 17 nt, Yersinia pestis KIM
gucguauagaaaauuuc

SEQ ID NO: 4198408 - RNA, 13 nt, Yersinia pestis KIM
gucgucagcgaca

SEQ ID NO: 4198409 - RNA, 19 nt, Yersinia pestis KIM
gucgucugauauuaaaaaa

SEQ ID NO: 4198410 - RNA, 20 nt, Yersinia pestis KIM
gucguggaguagagcuucca

SEQ ID NO: 4198411 - RNA, 13 nt, Yersinia pestis KIM
gucguuauauaaa

SEQ ID NO: 4198412 - RNA, 17 nt, Yersinia pestis KIM
gucguuuaaauaaaaaa

SEQ ID NO: 4198413 - RNA, 15 nt, Yersinia pestis KIM
gucuaaagaaucagc

SEQ ID NO: 4198414 - RNA, 22 nt, Yersinia pestis KIM
gucuaacaguuguuucaauaaa

SEQ ID NO: 4198415 - RNA, 18 nt, Yersinia pestis KIM
gucuaagugccaguuaau

SEQ ID NO: 4198416 - RNA, 12 nt, Yersinia pestis KIM
gucuacgcucuc

SEQ ID NO: 4198417 - RNA, 15 nt, Yersinia pestis KIM
gucuaggauugccgg

SEQ ID NO: 4198418 - RNA, 14 nt, Yersinia pestis KIM
gucuauaaaaccgu

SEQ ID NO: 4198419 - RNA, 16 nt, Yersinia pestis KIM
gucuauuauauucaau

SEQ ID NO: 4198420 - RNA, 17 nt, Yersinia pestis KIM
gucuauugaaaaaauaa

SEQ ID NO: 4198421 - RNA, 22 nt, Yersinia pestis KIM
gucuauugaaaaaauaaugucc

SEQ ID NO: 4198422 - RNA, 13 nt, Yersinia pestis KIM
gucuauuuucauu

SEQ ID NO: 4198423 - RNA, 21 nt, Yersinia pestis KIM
gucuauuuucauuauuuucaa

SEQ ID NO: 4198424 - RNA, 22 nt, Yersinia pestis KIM
gucuauuuuuauaaucaucuac

SEQ ID NO: 4198425 - RNA, 14 nt, Yersinia pestis KIM
gucucaaugcagua

SEQ ID NO: 4198426 - RNA, 22 nt, Yersinia pestis KIM
gucucacuaaaucaaaaggaac

SEQ ID NO: 4198427 - RNA, 17 nt, Yersinia pestis KIM
gucucaggauacaaaug

SEQ ID NO: 4198428 - RNA, 20 nt, Yersinia pestis KIM
gucucaggauacaaaugaga

SEQ ID NO: 4198429 - RNA, 14 nt, Yersinia pestis KIM
gucucgcaaugaaa

SEQ ID NO: 4198430 - RNA, 18 nt, Yersinia pestis KIM
gucucgccgacaacuuca

SEQ ID NO: 4198431 - RNA, 17 nt, Yersinia pestis KIM
gucucuguggauugcca

SEQ ID NO: 4198432 - RNA, 18 nt, Yersinia pestis KIM
gucucuuucgggcaaaaa

SEQ ID NO: 4198433 - RNA, 21 nt, Yersinia pestis KIM
gucucuuucgggcaaaaaaau

SEQ ID NO: 4198434 - RNA, 13 nt, Yersinia pestis KIM
gucugacagauac

SEQ ID NO: 4198435 - RNA, 15 nt, Yersinia pestis KIM
gucugagccucauga

SEQ ID NO: 4198436 - RNA, 16 nt, Yersinia pestis KIM
gucugagccucaugaa

SEQ ID NO: 4198437 - RNA, 13 nt, Yersinia pestis KIM
gucugagggccac

SEQ ID NO: 4198438 - RNA, 14 nt, Yersinia pestis KIM
gucugagguggcac

SEQ ID NO: 4198439 - RNA, 13 nt, Yersinia pestis KIM
gucugauaaccgu

SEQ ID NO: 4198440 - RNA, 21 nt, Yersinia pestis KIM
gucugauaaccguuuuuucaa

SEQ ID NO: 4198441 - RNA, 14 nt, Yersinia pestis KIM
gucugauauuaaaa

SEQ ID NO: 4198442 - RNA, 20 nt, Yersinia pestis KIM
gucugauauuaaaaaaggga

SEQ ID NO: 4198443 - RNA, 16 nt, Yersinia pestis KIM
gucugggccaucaagc

SEQ ID NO: 4198444 - RNA, 15 nt, Yersinia pestis KIM
gucuggucuuucauu

SEQ ID NO: 4198445 - RNA, 22 nt, Yersinia pestis KIM
gucuguuuccacucggccagag

SEQ ID NO: 4198446 - RNA, 15 nt, Yersinia pestis KIM
gucuuaaucuuuaau

SEQ ID NO: 4198447 - RNA, 19 nt, Yersinia pestis KIM
gucuuacuauguccgcaua

SEQ ID NO: 4198448 - RNA, 15 nt, Yersinia pestis KIM
gucuuauuacucauu

SEQ ID NO: 4198449 - RNA, 15 nt, Yersinia pestis KIM
gucuucagcuuccgc

SEQ ID NO: 4198450 - RNA, 18 nt, Yersinia pestis KIM
gucuucgcccagaucauc

SEQ ID NO: 4198451 - RNA, 19 nt, Yersinia pestis KIM
gucuucuuuugggauaaaa

SEQ ID NO: 4198452 - RNA, 21 nt, Yersinia pestis KIM
gucuucuuuugggauaaaaua

SEQ ID NO: 4198453 - RNA, 16 nt, Yersinia pestis KIM
gucuugaucaacucac

SEQ ID NO: 4198454 - RNA, 21 nt, Yersinia pestis KIM
gucuuggucauaccggcggca

SEQ ID NO: 4198455 - RNA, 17 nt, Yersinia pestis KIM
gucuuuaaaaucuugug

SEQ ID NO: 4198456 - RNA, 17 nt, Yersinia pestis KIM
gucuuuaccuccauaua

SEQ ID NO: 4198457 - RNA, 19 nt, Yersinia pestis KIM
gucuuuacgaucugccugu

SEQ ID NO: 4198458 - RNA, 17 nt, Yersinia pestis KIM
gucuuuuuaauauguga

SEQ ID NO: 4198459 - RNA, 14 nt, Yersinia pestis KIM
gugaaacaaauaca

SEQ ID NO: 4198460 - RNA, 21 nt, Yersinia pestis KIM
gugaaaccauugguaauaaug

SEQ ID NO: 4198461 - RNA, 22 nt, Yersinia pestis KIM
gugaaacccgcgcagccuaaaa

SEQ ID NO: 4198462 - RNA, 20 nt, Yersinia pestis KIM
gugaaacgauaugcuccaga

SEQ ID NO: 4198463 - RNA, 20 nt, Yersinia pestis KIM
gugaaagcaucccuucgcaa

SEQ ID NO: 4198464 - RNA, 17 nt, Yersinia pestis KIM
gugaaagggaaguuucu

SEQ ID NO: 4198465 - RNA, 16 nt, Yersinia pestis KIM
gugaaaucgguagaca

SEQ ID NO: 4198466 - RNA, 16 nt, Yersinia pestis KIM
gugaaauugcccgccg

SEQ ID NO: 4198467 - RNA, 14 nt, Yersinia pestis KIM
gugaacaugaugaa

SEQ ID NO: 4198468 - RNA, 13 nt, Yersinia pestis KIM
gugaacauuuauc

SEQ ID NO: 4198469 - RNA, 15 nt, Yersinia pestis KIM
gugaaccagauaaca

SEQ ID NO: 4198470 - RNA, 21 nt, Yersinia pestis KIM
gugaaccgcgcucugcuggga

SEQ ID NO: 4198471 - RNA, 19 nt, Yersinia pestis KIM
gugaacggccaucaauaaa

SEQ ID NO: 4198472 - RNA, 21 nt, Yersinia pestis KIM
gugaacugaacugaacugaau

SEQ ID NO: 4198473 - RNA, 19 nt, Yersinia pestis KIM
gugaacuuagcgccauaac

SEQ ID NO: 4198474 - RNA, 12 nt, Yersinia pestis KIM
gugaagaacagc

SEQ ID NO: 4198475 - RNA, 14 nt, Yersinia pestis KIM
gugaauaaaucaaa

SEQ ID NO: 4198476 - RNA, 19 nt, Yersinia pestis KIM
gugaauaacugguccaacu

SEQ ID NO: 4198477 - RNA, 15 nt, Yersinia pestis KIM
gugaauaccauuuca

SEQ ID NO: 4198478 - RNA, 16 nt, Yersinia pestis KIM
gugaauaccauuucac

SEQ ID NO: 4198479 - RNA, 13 nt, Yersinia pestis KIM
gugaauuagguaa

SEQ ID NO: 4198480 - RNA, 13 nt, Yersinia pestis KIM
gugacaaacgcuu

SEQ ID NO: 4198481 - RNA, 15 nt, Yersinia pestis KIM
gugacaggcaaagac

SEQ ID NO: 4198482 - RNA, 20 nt, Yersinia pestis KIM
gugacauccgcuugcagcaa

SEQ ID NO: 4198483 - RNA, 17 nt, Yersinia pestis KIM
gugacauguuccagugc

SEQ ID NO: 4198484 - RNA, 13 nt, Yersinia pestis KIM
gugacauuuucac

SEQ ID NO: 4198485 - RNA, 16 nt, Yersinia pestis KIM
gugacauuuucaccga

SEQ ID NO: 4198486 - RNA, 18 nt, Yersinia pestis KIM
gugaccaaagcaguaaac

SEQ ID NO: 4198487 - RNA, 20 nt, Yersinia pestis KIM
gugaccgcagauauccuuuu

SEQ ID NO: 4198488 - RNA, 18 nt, Yersinia pestis KIM
gugacgucguagaggcga

SEQ ID NO: 4198489 - RNA, 15 nt, Yersinia pestis KIM
gugacuaaaacaagc

SEQ ID NO: 4198490 - RNA, 23 nt, Yersinia pestis KIM
gugacuauucugccuauccucac

SEQ ID NO: 4198491 - RNA, 17 nt, Yersinia pestis KIM
gugacugguaugcggga

SEQ ID NO: 4198492 - RNA, 17 nt, Yersinia pestis KIM
gugacuugcaguggccu

SEQ ID NO: 4198493 - RNA, 12 nt, Yersinia pestis KIM
gugagcauuuug

SEQ ID NO: 4198494 - RNA, 11 nt, Yersinia pestis KIM
gugagccagag

SEQ ID NO: 4198495 - RNA, 12 nt, Yersinia pestis KIM
gugggcauuuuu

SEQ ID NO: 4198496 - RNA, 23 nt, Yersinia pestis KIM
gugggcgguaguauuuguaguga

SEQ ID NO: 4198497 - RNA, 15 nt, Yersinia pestis KIM
gugggugagcagaga

SEQ ID NO: 4198498 - RNA, 15 nt, Yersinia pestis KIM
gugguaccuacuuua

SEQ ID NO: 4198499 - RNA, 22 nt, Yersinia pestis KIM
gugguauucacguuuuucauca

SEQ ID NO: 4198500 - RNA, 14 nt, Yersinia pestis KIM
gugguccccagagc

SEQ ID NO: 4198501 - RNA, 18 nt, Yersinia pestis KIM
gugguccccagagcgcaa

SEQ ID NO: 4198502 - RNA, 14 nt, Yersinia pestis KIM
guggugaugaugac

SEQ ID NO: 4198503 - RNA, 14 nt, Yersinia pestis KIM
gugguggcagagaa

SEQ ID NO: 4198504 - RNA, 17 nt, Yersinia pestis KIM
gugguguuggcuguggu

SEQ ID NO: 4198505 - RNA, 12 nt, Yersinia pestis KIM
gugguuaccauc

SEQ ID NO: 4198506 - RNA, 20 nt, Yersinia pestis KIM
gugguuagcagauaauaaau

SEQ ID NO: 4198507 - RNA, 15 nt, Yersinia pestis KIM
gugguucaaccaccg

SEQ ID NO: 4198508 - RNA, 18 nt, Yersinia pestis KIM
gugguucaccacuuucca

SEQ ID NO: 4198509 - RNA, 10 nt, Yersinia pestis KIM
gugguuuggu

SEQ ID NO: 4198510 - RNA, 14 nt, Yersinia pestis KIM
gugguuuggugguu

SEQ ID NO: 4198511 - RNA, 17 nt, Yersinia pestis KIM
guguaaaccgcaccaca

SEQ ID NO: 4198512 - RNA, 20 nt, Yersinia pestis KIM
guguaggcgaauuggcaagu

SEQ ID NO: 4198513 - RNA, 22 nt, Yersinia pestis KIM
guguaucccccucacugccagc

SEQ ID NO: 4198514 - RNA, 17 nt, Yersinia pestis KIM
guguaugggcugcuaca

SEQ ID NO: 4198515 - RNA, 18 nt, Yersinia pestis KIM
gugucacaguaaaucagg

SEQ ID NO: 4198516 - RNA, 15 nt, Yersinia pestis KIM
gugucagaccaaaua

SEQ ID NO: 4198517 - RNA, 18 nt, Yersinia pestis KIM
gugucagaccaaauagca

SEQ ID NO: 4198518 - RNA, 13 nt, Yersinia pestis KIM
gugucagcaaacu

SEQ ID NO: 4198519 - RNA, 17 nt, Yersinia pestis KIM
gugucaguaugaaauuu

SEQ ID NO: 4198520 - RNA, 18 nt, Yersinia pestis KIM
gugucucuggagcuucug

SEQ ID NO: 4198521 - RNA, 17 nt, Yersinia pestis KIM
gugugcagcaagaacaa

SEQ ID NO: 4198522 - RNA, 17 nt, Yersinia pestis KIM
gugugcgcaucagccag

SEQ ID NO: 4198523 - RNA, 15 nt, Yersinia pestis KIM
gugugcguacaggua

SEQ ID NO: 4198524 - RNA, 17 nt, Yersinia pestis KIM
gugugcuguaagaaaaa

SEQ ID NO: 4198525 - RNA, 19 nt, Yersinia pestis KIM
guguguggcaauaaaggca

SEQ ID NO: 4198526 - RNA, 20 nt, Yersinia pestis KIM
guguguuuucuuguauauaa

SEQ ID NO: 4198527 - RNA, 21 nt, Yersinia pestis KIM
guguucauaaauuaaaacuga

SEQ ID NO: 4198528 - RNA, 22 nt, Yersinia pestis KIM
guguucauaaauuaaaacugaa

SEQ ID NO: 4198529 - RNA, 15 nt, Yersinia pestis KIM
guguucgguaaauaa

SEQ ID NO: 4198530 - RNA, 15 nt, Yersinia pestis KIM
guguugacgccauuc

SEQ ID NO: 4198531 - RNA, 19 nt, Yersinia pestis KIM
guguuggauaaaccggcug

SEQ ID NO: 4198532 - RNA, 16 nt, Yersinia pestis KIM
guguuuauaccaaagg

SEQ ID NO: 4198533 - RNA, 14 nt, Yersinia pestis KIM
guguuucaaauaag

SEQ ID NO: 4198534 - RNA, 15 nt, Yersinia pestis KIM
guguuuugcuaaccg

SEQ ID NO: 4198535 - RNA, 15 nt, Yersinia pestis KIM
guuaaaaaauucauc

SEQ ID NO: 4198536 - RNA, 22 nt, Yersinia pestis KIM
guuaaaaaauucaucuuuaaca

SEQ ID NO: 4198537 - RNA, 15 nt, Yersinia pestis KIM
guuaaaaagaaaaag

SEQ ID NO: 4198538 - RNA, 12 nt, Yersinia pestis KIM
guuaaacagcgc

SEQ ID NO: 4198539 - RNA, 17 nt, Yersinia pestis KIM
guuaaacgguaaccauc

SEQ ID NO: 4198540 - RNA, 23 nt, Yersinia pestis KIM
guuaaagguaaaaggcccgcuag

SEQ ID NO: 4198541 - RNA, 19 nt, Yersinia pestis KIM
guuaaauagugggcuaaaa

SEQ ID NO: 4198542 - RNA, 20 nt, Yersinia pestis KIM
guuaacaccaucaacauggg

SEQ ID NO: 4198543 - RNA, 14 nt, Yersinia pestis KIM
guuaacccaaagcc

SEQ ID NO: 4198544 - RNA, 20 nt, Yersinia pestis KIM
guuaacucagccacaagaua

SEQ ID NO: 4198545 - RNA, 16 nt, Yersinia pestis KIM
guuaacucauuuaucu

SEQ ID NO: 4198546 - RNA, 23 nt, Yersinia pestis KIM
guuaacugccguuucaguaaaac

SEQ ID NO: 4198547 - RNA, 16 nt, Yersinia pestis KIM
guuaacuuauagcuca

SEQ ID NO: 4198548 - RNA, 13 nt, Yersinia pestis KIM
guuaacuuuuucu

SEQ ID NO: 4198549 - RNA, 19 nt, Yersinia pestis KIM
guuaagagaucccgugcca

SEQ ID NO: 4198550 - RNA, 15 nt, Yersinia pestis KIM
guuaagaugacuacu

SEQ ID NO: 4198551 - RNA, 23 nt, Yersinia pestis KIM
guuaauaccagaugcauauacug

SEQ ID NO: 4198552 - RNA, 16 nt, Yersinia pestis KIM
guuaauaccugcacca

SEQ ID NO: 4198553 - RNA, 13 nt, Yersinia pestis KIM
guuaaucgcagca

SEQ ID NO: 4198554 - RNA, 16 nt, Yersinia pestis KIM
guuaaugagcguuauu

SEQ ID NO: 4198555 - RNA, 23 nt, Yersinia pestis KIM
guuaauucaugugagauaacaca

SEQ ID NO: 4198556 - RNA, 15 nt, Yersinia pestis KIM
guuaauugaauugcc

SEQ ID NO: 4198557 - RNA, 14 nt, Yersinia pestis KIM
guuaauuuaaacag

SEQ ID NO: 4198558 - RNA, 17 nt, Yersinia pestis KIM
guuacagcaaggcagca

SEQ ID NO: 4198559 - RNA, 20 nt, Yersinia pestis KIM
guuacagcaaggcagcaagu

SEQ ID NO: 4198560 - RNA, 20 nt, Yersinia pestis KIM
guuacaguaaggcagcaagu

SEQ ID NO: 4198561 - RNA, 20 nt, Yersinia pestis KIM
guuacaucaugaguaaaaga

SEQ ID NO: 4198562 - RNA, 16 nt, Yersinia pestis KIM
guuaccagaaaaccuu

SEQ ID NO: 4198563 - RNA, 17 nt, Yersinia pestis KIM
guuaccagaaaaccuuc

SEQ ID NO: 4198564 - RNA, 21 nt, Yersinia pestis KIM
guuaccauggcaggucucgca

SEQ ID NO: 4198565 - RNA, 22 nt, Yersinia pestis KIM
guuaccccccaagcuuuugcca

SEQ ID NO: 4198566 - RNA, 16 nt, Yersinia pestis KIM
guuaccuaaccaaaca

SEQ ID NO: 4198567 - RNA, 18 nt, Yersinia pestis KIM
guuaccuaaccaaacauu

SEQ ID NO: 4198568 - RNA, 17 nt, Yersinia pestis KIM
guuaccuugugucacca

SEQ ID NO: 4198569 - RNA, 15 nt, Yersinia pestis KIM
guuacgucaaaacua

SEQ ID NO: 4198570 - RNA, 14 nt, Yersinia pestis KIM
guuacucagcaucc

SEQ ID NO: 4198571 - RNA, 20 nt, Yersinia pestis KIM
guuacugcgcaaauccugaa

SEQ ID NO: 4198572 - RNA, 19 nt, Yersinia pestis KIM
guuacuguaagauaauucg

SEQ ID NO: 4198573 - RNA, 14 nt, Yersinia pestis KIM
guuacuuuccugcu

SEQ ID NO: 4198574 - RNA, 16 nt, Yersinia pestis KIM
guuagcagauaauaaa

SEQ ID NO: 4198575 - RNA, 14 nt, Yersinia pestis KIM
guuagcucuucacg

SEQ ID NO: 4198576 - RNA, 22 nt, Yersinia pestis KIM
guuaguaacuguaaggccaaac

SEQ ID NO: 4198577 - RNA, 17 nt, Yersinia pestis KIM
guuagucacucaagcca

SEQ ID NO: 4198578 - RNA, 15 nt, Yersinia pestis KIM
guuagugccuaucug

SEQ ID NO: 4198579 - RNA, 17 nt, Yersinia pestis KIM
guuagugguucaccacu

SEQ ID NO: 4198580 - RNA, 22 nt, Yersinia pestis KIM
guuagugguucaccacuuucca

SEQ ID NO: 4198581 - RNA, 14 nt, Yersinia pestis KIM
guuaguucagacgu

SEQ ID NO: 4198582 - RNA, 13 nt, Yersinia pestis KIM
guuauaaaaaccc

SEQ ID NO: 4198583 - RNA, 18 nt, Yersinia pestis KIM
guuauaaaucagggcaga

SEQ ID NO: 4198584 - RNA, 23 nt, Yersinia pestis KIM
guuauaacuauauucucauugcc

SEQ ID NO: 4198585 - RNA, 19 nt, Yersinia pestis KIM
guuauaaggcuaacaccuu

SEQ ID NO: 4198586 - RNA, 14 nt, Yersinia pestis KIM
guuauacacuugcu

SEQ ID NO: 4198587 - RNA, 20 nt, Yersinia pestis KIM
guuauagaucuccugcaacg

SEQ ID NO: 4198588 - RNA, 23 nt, Yersinia pestis KIM
guuaucaagaucaaaagcagaga

SEQ ID NO: 4198589 - RNA, 18 nt, Yersinia pestis KIM
guuaucaauacugcaaau

SEQ ID NO: 4198590 - RNA, 18 nt, Yersinia pestis KIM
guuaucaauuaacuacac

SEQ ID NO: 4198591 - RNA, 21 nt, Yersinia pestis KIM
guuaucacauaaauaaguuca

SEQ ID NO: 4198592 - RNA, 20 nt, Yersinia pestis KIM
guuaucaucccuugacugac

SEQ ID NO: 4198593 - RNA, 15 nt, Yersinia pestis KIM
guuaucauugcuccu

SEQ ID NO: 4198594 - RNA, 16 nt, Yersinia pestis KIM
guuaucgugcgucaau

SEQ ID NO: 4198595 - RNA, 13 nt, Yersinia pestis KIM
guuaucugcuauu

SEQ ID NO: 4198596 - RNA, 15 nt, Yersinia pestis KIM
guuaucuggaauuua

SEQ ID NO: 4198597 - RNA, 17 nt, Yersinia pestis KIM
guuaucuuuuauuuaug

SEQ ID NO: 4198598 - RNA, 11 nt, Yersinia pestis KIM
guuaugacacc

SEQ ID NO: 4198599 - RNA, 18 nt, Yersinia pestis KIM
guuaugaggggaggcugu

SEQ ID NO: 4198600 - RNA, 20 nt, Yersinia pestis KIM
guuaugaugaguaacauaau

SEQ ID NO: 4198601 - RNA, 18 nt, Yersinia pestis KIM
guuauugaccaauauaaa

SEQ ID NO: 4198602 - RNA, 23 nt, Yersinia pestis KIM
guuauugaccaauauaaaagcca

SEQ ID NO: 4198603 - RNA, 14 nt, Yersinia pestis KIM
guuauuggcuaaag

SEQ ID NO: 4198604 - RNA, 17 nt, Yersinia pestis KIM
guuauuucugguagccu

SEQ ID NO: 4198605 - RNA, 15 nt, Yersinia pestis KIM
guuauuucuguucca

SEQ ID NO: 4198606 - RNA, 17 nt, Yersinia pestis KIM
guuauuugaauaaaaga

SEQ ID NO: 4198607 - RNA, 14 nt, Yersinia pestis KIM
guuauuugaauaag

SEQ ID NO: 4198608 - RNA, 13 nt, Yersinia pestis KIM
guuauuuucuaua

SEQ ID NO: 4198609 - RNA, 19 nt, Yersinia pestis KIM
guuauuuuggcuuucagug

SEQ ID NO: 4198610 - RNA, 19 nt, Yersinia pestis KIM
guuuaaagccuguaaaaua

SEQ ID NO: 4198611 - RNA, 12 nt, Yersinia pestis KIM
guuuaaauaaaa

SEQ ID NO: 4198612 - RNA, 16 nt, Yersinia pestis KIM
guuuaacaauguggua

SEQ ID NO: 4198613 - RNA, 14 nt, Yersinia pestis KIM
guuuaacucaaaua

SEQ ID NO: 4198614 - RNA, 16 nt, Yersinia pestis KIM
guuuaacucaaauaaa

SEQ ID NO: 4198615 - RNA, 21 nt, Yersinia pestis KIM
guuuaauuucacuuccauucc

SEQ ID NO: 4198616 - RNA, 13 nt, Yersinia pestis KIM
guuuaccuauugc

SEQ ID NO: 4198617 - RNA, 20 nt, Yersinia pestis KIM
guuuaccuggaguaaugagg

SEQ ID NO: 4198618 - RNA, 18 nt, Yersinia pestis KIM
guuuacgacaauccuauc

SEQ ID NO: 4198619 - RNA, 20 nt, Yersinia pestis KIM
guuuacgcacguugagugau

SEQ ID NO: 4198620 - RNA, 20 nt, Yersinia pestis KIM
guuuacugaucucaucaaac

SEQ ID NO: 4198621 - RNA, 20 nt, Yersinia pestis KIM
guuuacuggcgggcauuuuc

SEQ ID NO: 4198622 - RNA, 13 nt, Yersinia pestis KIM
guuuacuuuaaau

SEQ ID NO: 4198623 - RNA, 17 nt, Yersinia pestis KIM
guuuacuuuaccgcuua

SEQ ID NO: 4198624 - RNA, 15 nt, Yersinia pestis KIM
guuuauaaauuaaaa

SEQ ID NO: 4198625 - RNA, 16 nt, Yersinia pestis KIM
guuuauacuauuuaug

SEQ ID NO: 4198626 - RNA, 15 nt, Yersinia pestis KIM
guuuaucaaacagca

SEQ ID NO: 4198627 - RNA, 22 nt, Yersinia pestis KIM
guuuaucaaacagcacaucgcc

SEQ ID NO: 4198628 - RNA, 17 nt, Yersinia pestis KIM
guuuaucacccgccauc

SEQ ID NO: 4198629 - RNA, 21 nt, Yersinia pestis KIM
guuuauccuuuuuauuuaagc

SEQ ID NO: 4198630 - RNA, 22 nt, Yersinia pestis KIM
guuuauccuuuuuauuuaagca

SEQ ID NO: 4198631 - RNA, 20 nt, Yersinia pestis KIM
guuuaugcagggaaccuggg

SEQ ID NO: 4198632 - RNA, 14 nt, Yersinia pestis KIM
guuuauuacgaucg

SEQ ID NO: 4198633 - RNA, 12 nt, Yersinia pestis KIM
guuuauuauuca

SEQ ID NO: 4198634 - RNA, 17 nt, Yersinia pestis KIM
guuucaaauaaguacuu

SEQ ID NO: 4198635 - RNA, 17 nt, Yersinia pestis KIM
guuucaaauaaguauuu

SEQ ID NO: 4198636 - RNA, 18 nt, Yersinia pestis KIM
guuucaacauccaguucg

SEQ ID NO: 4198637 - RNA, 13 nt, Yersinia pestis KIM
guuucacccucug

SEQ ID NO: 4198638 - RNA, 15 nt, Yersinia pestis KIM
guuucagacuccugc

SEQ ID NO: 4198639 - RNA, 19 nt, Yersinia pestis KIM
guuucagcuccgauuaagu

SEQ ID NO: 4198640 - RNA, 17 nt, Yersinia pestis KIM
guuucagcuugcaacaa

SEQ ID NO: 4198641 - RNA, 12 nt, Yersinia pestis KIM
guuucagggugg

SEQ ID NO: 4198642 - RNA, 19 nt, Yersinia pestis KIM
guuucauccccaccaggua

SEQ ID NO: 4198643 - RNA, 18 nt, Yersinia pestis KIM
guuucaucgacucuuuuu

SEQ ID NO: 4198644 - RNA, 21 nt, Yersinia pestis KIM
guuuccaaaacucauguccag

SEQ ID NO: 4198645 - RNA, 17 nt, Yersinia pestis KIM
guuuccacgaaggcacc

SEQ ID NO: 4198646 - RNA, 19 nt, Yersinia pestis KIM
guuuccacgaaggcaccca

SEQ ID NO: 4198647 - RNA, 14 nt, Yersinia pestis KIM
guuuccuucaccaa

SEQ ID NO: 4198648 - RNA, 20 nt, Yersinia pestis KIM
guuucgcaucaggcuuauau

SEQ ID NO: 4198649 - RNA, 22 nt, Yersinia pestis KIM
guuucuauccgaaaaauauucu

SEQ ID NO: 4198650 - RNA, 14 nt, Yersinia pestis KIM
guuucugucuuacu

SEQ ID NO: 4198651 - RNA, 15 nt, Yersinia pestis KIM
guuucuuacuaaaau

SEQ ID NO: 4198652 - RNA, 14 nt, Yersinia pestis KIM
guuucuucuggaau

SEQ ID NO: 4198653 - RNA, 15 nt, Yersinia pestis KIM
guuucuuuagcuaca

SEQ ID NO: 4198654 - RNA, 14 nt, Yersinia pestis KIM
guuugacggcggcg

SEQ ID NO: 4198655 - RNA, 17 nt, Yersinia pestis KIM
guuugagaaacugaugc

SEQ ID NO: 4198656 - RNA, 14 nt, Yersinia pestis KIM
guuugagaccccca

SEQ ID NO: 4198657 - RNA, 13 nt, Yersinia pestis KIM
guuugauaggcuu

SEQ ID NO: 4198658 - RNA, 13 nt, Yersinia pestis KIM
guuugaugguuau

SEQ ID NO: 4198659 - RNA, 12 nt, Yersinia pestis KIM
guuugcagcacu

SEQ ID NO: 4198660 - RNA, 20 nt, Yersinia pestis KIM
guuugccguuuccagugcgg

SEQ ID NO: 4198661 - RNA, 16 nt, Yersinia pestis KIM
guuugcgccguaaacu

SEQ ID NO: 4198662 - RNA, 18 nt, Yersinia pestis KIM
guuugcgccguaaacugc

SEQ ID NO: 4198663 - RNA, 22 nt, Yersinia pestis KIM
guuugcucuucccugcgcugag

SEQ ID NO: 4198664 - RNA, 13 nt, Yersinia pestis KIM
guuuggcugccau

SEQ ID NO: 4198665 - RNA, 12 nt, Yersinia pestis KIM
guuuggugguuu

SEQ ID NO: 4198666 - RNA, 20 nt, Yersinia pestis KIM
guuugucagcagucugacac

SEQ ID NO: 4198667 - RNA, 17 nt, Yersinia pestis KIM
guuuguuacgggcacug

SEQ ID NO: 4198668 - RNA, 19 nt, Yersinia pestis KIM
guuuguuucucugccgcca

SEQ ID NO: 4198669 - RNA, 13 nt, Yersinia pestis KIM
guuuuaauaacca

SEQ ID NO: 4198670 - RNA, 18 nt, Yersinia pestis KIM
guuuuaccaucaccauau

SEQ ID NO: 4198671 - RNA, 22 nt, Yersinia pestis KIM
guuuuacgcgaccauucauccc

SEQ ID NO: 4198672 - RNA, 23 nt, Yersinia pestis KIM
guuuuaggcaauccaaacauaca

SEQ ID NO: 4198673 - RNA, 15 nt, Yersinia pestis KIM
guuuuaucaauaggu

SEQ ID NO: 4198674 - RNA, 18 nt, Yersinia pestis KIM
guuuuaucaauaggucag

SEQ ID NO: 4198675 - RNA, 17 nt, Yersinia pestis KIM
guuuuauugcaacuggg

SEQ ID NO: 4198676 - RNA, 16 nt, Yersinia pestis KIM
guuuucaaauccaguc

SEQ ID NO: 4198677 - RNA, 19 nt, Yersinia pestis KIM
guuuucacccaaccgggau

SEQ ID NO: 4198678 - RNA, 17 nt, Yersinia pestis KIM
guuuucauuauuuucac

SEQ ID NO: 4198679 - RNA, 21 nt, Yersinia pestis KIM
guuuucccugcgccagcagca

SEQ ID NO: 4198680 - RNA, 16 nt, Yersinia pestis KIM
guuuucguuuaaaaaa

SEQ ID NO: 4198681 - RNA, 15 nt, Yersinia pestis KIM
guuuucuauuuccac

SEQ ID NO: 4198682 - RNA, 18 nt, Yersinia pestis KIM
guuuucuccacaccaacg

SEQ ID NO: 4198683 - RNA, 18 nt, Yersinia pestis KIM
guuuucuggcaauuucug

SEQ ID NO: 4198684 - RNA, 20 nt, Yersinia pestis KIM
guuuucuuucaacugcucau

SEQ ID NO: 4198685 - RNA, 14 nt, Yersinia pestis KIM
guuuugacuaaaau

SEQ ID NO: 4198686 - RNA, 15 nt, Yersinia pestis KIM
guuuugacuaaaauu

SEQ ID NO: 4198687 - RNA, 13 nt, Yersinia pestis KIM
guuuugcucugca

SEQ ID NO: 4198688 - RNA, 20 nt, Yersinia pestis KIM
guuuuggcgagauggucaug

SEQ ID NO: 4198689 - RNA, 12 nt, Yersinia pestis KIM
guuuuuaaggac

SEQ ID NO: 4198690 - RNA, 23 nt, Yersinia pestis KIM
guuuuuauauuuaccugcucaac

SEQ ID NO: 4198691 - RNA, 14 nt, Yersinia pestis KIM
guuuuuaucccccu

SEQ ID NO: 4198692 - RNA, 16 nt, Yersinia pestis KIM
guuuuuauuacagagu

SEQ ID NO: 4198693 - RNA, 18 nt, Yersinia pestis KIM
guuuuucaaucuauucuu

SEQ ID NO: 4198694 - RNA, 20 nt, Yersinia pestis KIM
guuuuucccguaggcugacc

SEQ ID NO: 4198695 - RNA, 16 nt, Yersinia pestis KIM
guuuuugaaauaccac

SEQ ID NO: 4198696 - RNA, 19 nt, Yersinia pestis KIM
guuuuugaggaaauuucag

SEQ ID NO: 4198697 - RNA, 13 nt, Yersinia pestis KIM
guuuuuuaaaaaa

SEQ ID NO: 4198698 - RNA, 13 nt, Yersinia pestis KIM
guuuuuucuuucu

SEQ ID NO: 4198699 - RNA, 12 nt, Yersinia pestis KIM
guuuuuuuaaau

SEQ ID NO: 4198700 - RNA, 17 nt, Yersinia pestis KIM
guuuuuuuuaucagccc

SEQ ID NO: 4198701 - RNA, 15 nt, Yersinia pestis KIM
uaaaaaaaaagaaaa

SEQ ID NO: 4198702 - RNA, 10 nt, Yersinia pestis KIM
uaaaaaaagc

SEQ ID NO: 4198703 - RNA, 19 nt, Yersinia pestis KIM
uaaaaaaauuaaaauaaug

SEQ ID NO: 4198704 - RNA, 13 nt, Yersinia pestis KIM
uaaaaaaauucau

SEQ ID NO: 4198705 - RNA, 21 nt, Yersinia pestis KIM
uaaaaaagcugucauaaaaaa

SEQ ID NO: 4198706 - RNA, 16 nt, Yersinia pestis KIM
uaaaaaaggguaauca

SEQ ID NO: 4198707 - RNA, 22 nt, Yersinia pestis KIM
uaaaaaaugauuuuauucacuu

SEQ ID NO: 4198708 - RNA, 13 nt, Yersinia pestis KIM
uaaaaaauuauua

SEQ ID NO: 4198709 - RNA, 22 nt, Yersinia pestis KIM
uaaaaaauuauuaaauaagaag

SEQ ID NO: 4198710 - RNA, 12 nt, Yersinia pestis KIM
uaaaaacauuga

SEQ ID NO: 4198711 - RNA, 21 nt, Yersinia pestis KIM
uaaaaacauuuaaauaugaau

SEQ ID NO: 4198712 - RNA, 23 nt, Yersinia pestis KIM
uaaaaacauuuaaauaugaauga

SEQ ID NO: 4198713 - RNA, 21 nt, Yersinia pestis KIM
uaaaaaccaucugaugcaggu

SEQ ID NO: 4198714 - RNA, 11 nt, Yersinia pestis KIM
uaaaaaccccu

SEQ ID NO: 4198715 - RNA, 18 nt, Yersinia pestis KIM
uaaaaacccucuucaauc

SEQ ID NO: 4198716 - RNA, 23 nt, Yersinia pestis KIM
uaaaaacccucuucaaucggaua

SEQ ID NO: 4198717 - RNA, 12 nt, Yersinia pestis KIM
uaaaaaccgccc

SEQ ID NO: 4198718 - RNA, 19 nt, Yersinia pestis KIM
uaaaaacgccuccagugau

SEQ ID NO: 4198719 - RNA, 12 nt, Yersinia pestis KIM
uaaaaacugugc

SEQ ID NO: 4198720 - RNA, 21 nt, Yersinia pestis KIM
uaaaaacuuaucuaaaaaacc

SEQ ID NO: 4198721 - RNA, 20 nt, Yersinia pestis KIM
uaaaaagaucugcauugauu

SEQ ID NO: 4198722 - RNA, 18 nt, Yersinia pestis KIM
uaaaaagcagcaaacgaa

SEQ ID NO: 4198723 - RNA, 19 nt, Yersinia pestis KIM
uaaaaagccugaauucugu

SEQ ID NO: 4198724 - RNA, 19 nt, Yersinia pestis KIM
uaaaaagcgacacuuauug

SEQ ID NO: 4198725 - RNA, 22 nt, Yersinia pestis KIM
uaaacgccgaucauaaaucaca

SEQ ID NO: 4198726 - RNA, 21 nt, Yersinia pestis KIM
uaaacgccgcgucaauaacau

SEQ ID NO: 4198727 - RNA, 20 nt, Yersinia pestis KIM
uaaacgccugggauccauag

SEQ ID NO: 4198728 - RNA, 20 nt, Yersinia pestis KIM
uaaacgcgaguuaggaaaaa

SEQ ID NO: 4198729 - RNA, 18 nt, Yersinia pestis KIM
uaaacggcgguuaaucgg

SEQ ID NO: 4198730 - RNA, 14 nt, Yersinia pestis KIM
uaaacgggcuucca

SEQ ID NO: 4198731 - RNA, 18 nt, Yersinia pestis KIM
uaaacgggcuuccaucag

SEQ ID NO: 4198732 - RNA, 18 nt, Yersinia pestis KIM
uaaacgucucuuuuucau

SEQ ID NO: 4198733 - RNA, 14 nt, Yersinia pestis KIM
uaaacguucugcca

SEQ ID NO: 4198734 - RNA, 12 nt, Yersinia pestis KIM
uaaacuaauauc

SEQ ID NO: 4198735 - RNA, 14 nt, Yersinia pestis KIM
uaaacuaauaucuu

SEQ ID NO: 4198736 - RNA, 19 nt, Yersinia pestis KIM
uaaacuaauaucuuucaua

SEQ ID NO: 4198737 - RNA, 15 nt, Yersinia pestis KIM
uaaacucuuuaaguu

SEQ ID NO: 4198738 - RNA, 23 nt, Yersinia pestis KIM
uaaacugaauaucccccuccgga

SEQ ID NO: 4198739 - RNA, 19 nt, Yersinia pestis KIM
uaaacugauuuaaccgaug

SEQ ID NO: 4198740 - RNA, 18 nt, Yersinia pestis KIM
uaaacugugcccuugagc

SEQ ID NO: 4198741 - RNA, 16 nt, Yersinia pestis KIM
uaaacuguuggcguga

SEQ ID NO: 4198742 - RNA, 16 nt, Yersinia pestis KIM
uaaacuuccagcguau

SEQ ID NO: 4198743 - RNA, 16 nt, Yersinia pestis KIM
uaaacuuuuaugcauc

SEQ ID NO: 4198744 - RNA, 12 nt, Yersinia pestis KIM
uaaagaaaaaac

SEQ ID NO: 4198745 - RNA, 23 nt, Yersinia pestis KIM
uaaagaaaaacccguugaagccu

SEQ ID NO: 4198746 - RNA, 13 nt, Yersinia pestis KIM
uaaagaaaagagg

SEQ ID NO: 4198747 - RNA, 20 nt, Yersinia pestis KIM
uaaagaaauaaucauaucaa

SEQ ID NO: 4198748 - RNA, 15 nt, Yersinia pestis KIM
uaaagaauaaugggu

SEQ ID NO: 4198749 - RNA, 21 nt, Yersinia pestis KIM
uaaagaaucagcgguugaaaa

SEQ ID NO: 4198750 - RNA, 16 nt, Yersinia pestis KIM
uaaagaccucgcgcca

SEQ ID NO: 4198751 - RNA, 16 nt, Yersinia pestis KIM
uaaagacgcaugagcu

SEQ ID NO: 4198752 - RNA, 17 nt, Yersinia pestis KIM
uaaagacgccguaaaua

SEQ ID NO: 4198753 - RNA, 19 nt, Yersinia pestis KIM
uaaagacgccguaaauaca

SEQ ID NO: 4198754 - RNA, 21 nt, Yersinia pestis KIM
uaaagacgccguaaauacauc

SEQ ID NO: 4198755 - RNA, 23 nt, Yersinia pestis KIM
uaaagacgccguaaauacaucca

SEQ ID NO: 4198756 - RNA, 18 nt, Yersinia pestis KIM
uaaagacgcuaauuaaag

SEQ ID NO: 4198757 - RNA, 15 nt, Yersinia pestis KIM
uaaagagugaaauau

SEQ ID NO: 4198758 - RNA, 16 nt, Yersinia pestis KIM
uaaagauaauuaauuc

SEQ ID NO: 4198759 - RNA, 19 nt, Yersinia pestis KIM
uaaagauaauuaauucaau

SEQ ID NO: 4198760 - RNA, 14 nt, Yersinia pestis KIM
uaaagauacccgcc

SEQ ID NO: 4198761 - RNA, 17 nt, Yersinia pestis KIM
uaaagauagccacuaac

SEQ ID NO: 4198762 - RNA, 21 nt, Yersinia pestis KIM
uaaagauccccacaaaaucaa

SEQ ID NO: 4198763 - RNA, 17 nt, Yersinia pestis KIM
uaaagauuuuaagcacu

SEQ ID NO: 4198764 - RNA, 12 nt, Yersinia pestis KIM
uaaagccagaca

SEQ ID NO: 4198765 - RNA, 20 nt, Yersinia pestis KIM
uaaagccaguaaacgcagag

SEQ ID NO: 4198766 - RNA, 13 nt, Yersinia pestis KIM
uaaagcccagcag

SEQ ID NO: 4198767 - RNA, 14 nt, Yersinia pestis KIM
uaaagcccgcuuca

SEQ ID NO: 4198768 - RNA, 20 nt, Yersinia pestis KIM
uaaagccgacauccaccauu

SEQ ID NO: 4198769 - RNA, 14 nt, Yersinia pestis KIM
uaaagccuuucagc

SEQ ID NO: 4198770 - RNA, 17 nt, Yersinia pestis KIM
uaaagccuuucagcgcu

SEQ ID NO: 4198771 - RNA, 23 nt, Yersinia pestis KIM
uaaagcgauaaauacucccgcca

SEQ ID NO: 4198772 - RNA, 16 nt, Yersinia pestis KIM
uaaagcgaugcucaau

SEQ ID NO: 4198773 - RNA, 15 nt, Yersinia pestis KIM
uaaagcgccuuccuu

SEQ ID NO: 4198774 - RNA, 21 nt, Yersinia pestis KIM
uaaagcugucaguccaaaaua

SEQ ID NO: 4198775 - RNA, 13 nt, Yersinia pestis KIM
uaaaggcaaagaa

SEQ ID NO: 4198776 - RNA, 22 nt, Yersinia pestis KIM
uaaaggcaacgaaggcaacaac

SEQ ID NO: 4198777 - RNA, 19 nt, Yersinia pestis KIM
uaaaggcccaaucuugcaa

SEQ ID NO: 4198778 - RNA, 22 nt, Yersinia pestis KIM
uaaaggggggaaacgguuuuaa

SEQ ID NO: 4198779 - RNA, 19 nt, Yersinia pestis KIM
uaaagguaaaaggcccgcu

SEQ ID NO: 4198780 - RNA, 18 nt, Yersinia pestis KIM
uaaagguauagcgauaga

SEQ ID NO: 4198781 - RNA, 14 nt, Yersinia pestis KIM
uaaaggugauauca

SEQ ID NO: 4198782 - RNA, 20 nt, Yersinia pestis KIM
uaaaguaaaagccagucagg

SEQ ID NO: 4198783 - RNA, 15 nt, Yersinia pestis KIM
uaaagugcguaggca

SEQ ID NO: 4198784 - RNA, 15 nt, Yersinia pestis KIM
uaaaguuaucaccaa

SEQ ID NO: 4198785 - RNA, 15 nt, Yersinia pestis KIM
uaaaguugaaccaau

SEQ ID NO: 4198786 - RNA, 12 nt, Yersinia pestis KIM
uaaaguuuuucc

SEQ ID NO: 4198787 - RNA, 14 nt, Yersinia pestis KIM
uaaauaaaaaagcu

SEQ ID NO: 4198788 - RNA, 14 nt, Yersinia pestis KIM
uaaauaaaaacgca

SEQ ID NO: 4198789 - RNA, 20 nt, Yersinia pestis KIM
uaaauaaaaagcguuucaga

SEQ ID NO: 4198790 - RNA, 13 nt, Yersinia pestis KIM
uaaauaaaauaau

SEQ ID NO: 4198791 - RNA, 15 nt, Yersinia pestis KIM
uaaauaaaauaauaa

SEQ ID NO: 4198792 - RNA, 16 nt, Yersinia pestis KIM
uaaauaaaauaauaau

SEQ ID NO: 4198793 - RNA, 19 nt, Yersinia pestis KIM
uaaauaaagugcuucucug

SEQ ID NO: 4198794 - RNA, 23 nt, Yersinia pestis KIM
uaaauaaauuuaucuaauguauu

SEQ ID NO: 4198795 - RNA, 20 nt, Yersinia pestis KIM
uaaauaacgcaaaaaucacu

SEQ ID NO: 4198796 - RNA, 12 nt, Yersinia pestis KIM
uaaauaagaagu

SEQ ID NO: 4198797 - RNA, 14 nt, Yersinia pestis KIM
uaaauaaguaggca

SEQ ID NO: 4198798 - RNA, 14 nt, Yersinia pestis KIM
uaaauaauaaauua

SEQ ID NO: 4198799 - RNA, 16 nt, Yersinia pestis KIM
uaaauaauaucaauga

SEQ ID NO: 4198800 - RNA, 19 nt, Yersinia pestis KIM
uaaauaaugucgucaauua

SEQ ID NO: 4198801 - RNA, 22 nt, Yersinia pestis KIM
uaaauaaugucgucaauuaaaa

SEQ ID NO: 4198802 - RNA, 23 nt, Yersinia pestis KIM
uaaauaaugucgucaauuaaaau

SEQ ID NO: 4198803 - RNA, 13 nt, Yersinia pestis KIM
uaaauaauuaaug

SEQ ID NO: 4198804 - RNA, 13 nt, Yersinia pestis KIM
uaaauaauuacuu

SEQ ID NO: 4198805 - RNA, 14 nt, Yersinia pestis KIM
uaaauaauuacuua

SEQ ID NO: 4198806 - RNA, 17 nt, Yersinia pestis KIM
uaaauaauuacuuauaa

SEQ ID NO: 4198807 - RNA, 19 nt, Yersinia pestis KIM
uaaauaauuacuuauaaac

SEQ ID NO: 4198808 - RNA, 13 nt, Yersinia pestis KIM
uaaauacagauca

SEQ ID NO: 4198809 - RNA, 15 nt, Yersinia pestis KIM
uaaauaccagagacg

SEQ ID NO: 4198810 - RNA, 19 nt, Yersinia pestis KIM
uaaauaccgccaaauacaa

SEQ ID NO: 4198811 - RNA, 20 nt, Yersinia pestis KIM
uaaauacgguucaaaucagu

SEQ ID NO: 4198812 - RNA, 13 nt, Yersinia pestis KIM
uaaauacugcugg

SEQ ID NO: 4198813 - RNA, 23 nt, Yersinia pestis KIM
uaaauagagugaaguaucaccac

SEQ ID NO: 4198814 - RNA, 17 nt, Yersinia pestis KIM
uaaauagauaaaaacau

SEQ ID NO: 4198815 - RNA, 18 nt, Yersinia pestis KIM
uaaauagauaaaaacauu

SEQ ID NO: 4198816 - RNA, 18 nt, Yersinia pestis KIM
uaaauagcaaaacugagg

SEQ ID NO: 4198817 - RNA, 20 nt, Yersinia pestis KIM
uaaauagucguuauauaaau

SEQ ID NO: 4198818 - RNA, 13 nt, Yersinia pestis KIM
uaaauagugggcu

SEQ ID NO: 4198819 - RNA, 18 nt, Yersinia pestis KIM
uaaauagugggcuaaaac

SEQ ID NO: 4198820 - RNA, 20 nt, Yersinia pestis KIM
uaaauaguuacuauauaaau

SEQ ID NO: 4198821 - RNA, 22 nt, Yersinia pestis KIM
uaaauaguuacuauauaaauga

SEQ ID NO: 4198822 - RNA, 13 nt, Yersinia pestis KIM
uaaauauaaaaua

SEQ ID NO: 4198823 - RNA, 20 nt, Yersinia pestis KIM
uaaauauccugcucagcuaa

SEQ ID NO: 4198824 - RNA, 13 nt, Yersinia pestis KIM
uaaauauucauua

SEQ ID NO: 4198825 - RNA, 16 nt, Yersinia pestis KIM
uaaauauucauuaaaa

SEQ ID NO: 4198826 - RNA, 13 nt, Yersinia pestis KIM
uaaauauugggca

SEQ ID NO: 4198827 - RNA, 21 nt, Yersinia pestis KIM
uaaauauugguacauaggucu

SEQ ID NO: 4198828 - RNA, 21 nt, Yersinia pestis KIM
uaaaucaauucuaucgcugua

SEQ ID NO: 4198829 - RNA, 17 nt, Yersinia pestis KIM
uaaaucacaauuucacc

SEQ ID NO: 4198830 - RNA, 19 nt, Yersinia pestis KIM
uaaaucacgcagcaggcca

SEQ ID NO: 4198831 - RNA, 19 nt, Yersinia pestis KIM
uaaaucagaccauggccuu

SEQ ID NO: 4198832 - RNA, 12 nt, Yersinia pestis KIM
uaaaucagugua

SEQ ID NO: 4198833 - RNA, 13 nt, Yersinia pestis KIM
uaaaucaucaaau

SEQ ID NO: 4198834 - RNA, 14 nt, Yersinia pestis KIM
uaaaucaucaaauu

SEQ ID NO: 4198835 - RNA, 16 nt, Yersinia pestis KIM
uaaaucaucaaauuca

SEQ ID NO: 4198836 - RNA, 20 nt, Yersinia pestis KIM
uaaaucaugucccuauuaga

SEQ ID NO: 4198837 - RNA, 12 nt, Yersinia pestis KIM
uaaauccaaaug

SEQ ID NO: 4198838 - RNA, 15 nt, Yersinia pestis KIM
uaaauccaaaugccc

SEQ ID NO: 4198839 - RNA, 16 nt, Yersinia pestis KIM
uaaauccaaaugccca

SEQ ID NO: 4198840 - RNA, 18 nt, Yersinia pestis KIM
uaaccagugccgcccagc

SEQ ID NO: 4198841 - RNA, 19 nt, Yersinia pestis KIM
uaaccagugccgcccagcg

SEQ ID NO: 4198842 - RNA, 16 nt, Yersinia pestis KIM
uaaccaguuaucgaua

SEQ ID NO: 4198843 - RNA, 16 nt, Yersinia pestis KIM
uaaccaugaugacaau

SEQ ID NO: 4198844 - RNA, 20 nt, Yersinia pestis KIM
uaaccaugaugacaaugcgu

SEQ ID NO: 4198845 - RNA, 16 nt, Yersinia pestis KIM
uaaccauuaauugguu

SEQ ID NO: 4198846 - RNA, 21 nt, Yersinia pestis KIM
uaaccauuuuaauauuauggu

SEQ ID NO: 4198847 - RNA, 13 nt, Yersinia pestis KIM
uaacccaaagccc

SEQ ID NO: 4198848 - RNA, 21 nt, Yersinia pestis KIM
uaacccauugguuuuuagcuu

SEQ ID NO: 4198849 - RNA, 13 nt, Yersinia pestis KIM
uaaccccauaucc

SEQ ID NO: 4198850 - RNA, 22 nt, Yersinia pestis KIM
uaacccccaaauagcuggcauc

SEQ ID NO: 4198851 - RNA, 15 nt, Yersinia pestis KIM
uaaccccguagcaca

SEQ ID NO: 4198852 - RNA, 17 nt, Yersinia pestis KIM
uaacccgcaagcaaacu

SEQ ID NO: 4198853 - RNA, 17 nt, Yersinia pestis KIM
uaaccgaagauaaccgg

SEQ ID NO: 4198854 - RNA, 14 nt, Yersinia pestis KIM
uaaccgaauaaaac

SEQ ID NO: 4198855 - RNA, 20 nt, Yersinia pestis KIM
uaaccgaguuuuuugcgcca

SEQ ID NO: 4198856 - RNA, 13 nt, Yersinia pestis KIM
uaaccgcauaauc

SEQ ID NO: 4198857 - RNA, 14 nt, Yersinia pestis KIM
uaaccgcauucaca

SEQ ID NO: 4198858 - RNA, 22 nt, Yersinia pestis KIM
uaaccgccaaaauaucgcgcuu

SEQ ID NO: 4198859 - RNA, 15 nt, Yersinia pestis KIM
uaaccgccgcaggcc

SEQ ID NO: 4198860 - RNA, 20 nt, Yersinia pestis KIM
uaaccgccgcaggccauuac

SEQ ID NO: 4198861 - RNA, 20 nt, Yersinia pestis KIM
uaaccgccugugacgcuuga

SEQ ID NO: 4198862 - RNA, 17 nt, Yersinia pestis KIM
uaaccgguauauuggcc

SEQ ID NO: 4198863 - RNA, 22 nt, Yersinia pestis KIM
uaaccguuuuuucaacuggcug

SEQ ID NO: 4198864 - RNA, 13 nt, Yersinia pestis KIM
uaaccuacuccaa

SEQ ID NO: 4198865 - RNA, 15 nt, Yersinia pestis KIM
uaaccucaaaaggau

SEQ ID NO: 4198866 - RNA, 17 nt, Yersinia pestis KIM
uaaccucacgccaccuu

SEQ ID NO: 4198867 - RNA, 22 nt, Yersinia pestis KIM
uaaccucacgggcuuccaucag

SEQ ID NO: 4198868 - RNA, 13 nt, Yersinia pestis KIM
uaaccucagccuc

SEQ ID NO: 4198869 - RNA, 16 nt, Yersinia pestis KIM
uaaccucagccucauu

SEQ ID NO: 4198870 - RNA, 21 nt, Yersinia pestis KIM
uaaccucaggcccgcuaucac

SEQ ID NO: 4198871 - RNA, 19 nt, Yersinia pestis KIM
uaaccucagggagccaaua

SEQ ID NO: 4198872 - RNA, 23 nt, Yersinia pestis KIM
uaaccugcuggcgcaacuguagu

SEQ ID NO: 4198873 - RNA, 23 nt, Yersinia pestis KIM
uaacgaacagguagaucaaacau

SEQ ID NO: 4198874 - RNA, 16 nt, Yersinia pestis KIM
uaacgaagguaacuua

SEQ ID NO: 4198875 - RNA, 21 nt, Yersinia pestis KIM
uaacgaauuucauuuuaaaau

SEQ ID NO: 4198876 - RNA, 16 nt, Yersinia pestis KIM
uaacgacgauaagaau

SEQ ID NO: 4198877 - RNA, 17 nt, Yersinia pestis KIM
uaacgacgcauuaaucc

SEQ ID NO: 4198878 - RNA, 21 nt, Yersinia pestis KIM
uaacgauaaccaaaucaccug

SEQ ID NO: 4198879 - RNA, 18 nt, Yersinia pestis KIM
uaacgauauaauagcugg

SEQ ID NO: 4198880 - RNA, 15 nt, Yersinia pestis KIM
uaacgcagauaaauc

SEQ ID NO: 4198881 - RNA, 17 nt, Yersinia pestis KIM
uaacgccaccaaugcau

SEQ ID NO: 4198882 - RNA, 19 nt, Yersinia pestis KIM
uaacgcccggcaauaauag

SEQ ID NO: 4198883 - RNA, 19 nt, Yersinia pestis KIM
uaacgccggauaaauuaau

SEQ ID NO: 4198884 - RNA, 21 nt, Yersinia pestis KIM
uaacgcuaauaacauggggua

SEQ ID NO: 4198885 - RNA, 14 nt, Yersinia pestis KIM
uaacgcucuuguag

SEQ ID NO: 4198886 - RNA, 20 nt, Yersinia pestis KIM
uaacgcuggauaagugaaua

SEQ ID NO: 4198887 - RNA, 15 nt, Yersinia pestis KIM
uaacgcuucaucaug

SEQ ID NO: 4198888 - RNA, 12 nt, Yersinia pestis KIM
uaacgggagauu

SEQ ID NO: 4198889 - RNA, 20 nt, Yersinia pestis KIM
uaacgguuaagaagcgauua

SEQ ID NO: 4198890 - RNA, 14 nt, Yersinia pestis KIM
uaacguagagagac

SEQ ID NO: 4198891 - RNA, 15 nt, Yersinia pestis KIM
uaacgucaacagaac

SEQ ID NO: 4198892 - RNA, 16 nt, Yersinia pestis KIM
uaacgucaacagaacu

SEQ ID NO: 4198893 - RNA, 19 nt, Yersinia pestis KIM
uaacgucgcugaaaugcua

SEQ ID NO: 4198894 - RNA, 17 nt, Yersinia pestis KIM
uaacguugcaaaugcua

SEQ ID NO: 4198895 - RNA, 15 nt, Yersinia pestis KIM
uaacguuucagggug

SEQ ID NO: 4198896 - RNA, 15 nt, Yersinia pestis KIM
uaacuaacagauugu

SEQ ID NO: 4198897 - RNA, 15 nt, Yersinia pestis KIM
uaacuaacaucagcg

SEQ ID NO: 4198898 - RNA, 18 nt, Yersinia pestis KIM
uaacuaagagucacagca

SEQ ID NO: 4198899 - RNA, 18 nt, Yersinia pestis KIM
uaacucaaccccagccgg

SEQ ID NO: 4198900 - RNA, 15 nt, Yersinia pestis KIM
uaacucaagcguuau

SEQ ID NO: 4198901 - RNA, 16 nt, Yersinia pestis KIM
uaacucaaguaugcag

SEQ ID NO: 4198902 - RNA, 15 nt, Yersinia pestis KIM
uaacucaauaauauu

SEQ ID NO: 4198903 - RNA, 13 nt, Yersinia pestis KIM
uaacucaugugua

SEQ ID NO: 4198904 - RNA, 20 nt, Yersinia pestis KIM
uaacucauuuaucuaaaacu

SEQ ID NO: 4198905 - RNA, 16 nt, Yersinia pestis KIM
uaacuccaucaggcua

SEQ ID NO: 4198906 - RNA, 16 nt, Yersinia pestis KIM
uaacucgccacucaca

SEQ ID NO: 4198907 - RNA, 16 nt, Yersinia pestis KIM
uaacucgcgauaacgg

SEQ ID NO: 4198908 - RNA, 16 nt, Yersinia pestis KIM
uaacucgcgcuuuauu

SEQ ID NO: 4198909 - RNA, 14 nt, Yersinia pestis KIM
uaacugaucaauau

SEQ ID NO: 4198910 - RNA, 17 nt, Yersinia pestis KIM
uaacugcagugaaaagg

SEQ ID NO: 4198911 - RNA, 23 nt, Yersinia pestis KIM
uaacugccgauaucuuuaucauu

SEQ ID NO: 4198912 - RNA, 18 nt, Yersinia pestis KIM
uaacuggcuggcuuugga

SEQ ID NO: 4198913 - RNA, 15 nt, Yersinia pestis KIM
uaacuguaaggccaa

SEQ ID NO: 4198914 - RNA, 16 nt, Yersinia pestis KIM
uaacugugcaguaucu

SEQ ID NO: 4198915 - RNA, 17 nt, Yersinia pestis KIM
uaacuuaaaauauggca

SEQ ID NO: 4198916 - RNA, 21 nt, Yersinia pestis KIM
uaacuuaaaauauggcaggua

SEQ ID NO: 4198917 - RNA, 17 nt, Yersinia pestis KIM
uaacuuaaauaauuuuc

SEQ ID NO: 4198918 - RNA, 21 nt, Yersinia pestis KIM
uaacuuacugcucuaucucuu

SEQ ID NO: 4198919 - RNA, 20 nt, Yersinia pestis KIM
uaacuuagauugcaaaucac

SEQ ID NO: 4198920 - RNA, 21 nt, Yersinia pestis KIM
uaacuuaucgaccaacuggca

SEQ ID NO: 4198921 - RNA, 22 nt, Yersinia pestis KIM
uaacuuaucgaccaacuggcaa

SEQ ID NO: 4198922 - RNA, 19 nt, Yersinia pestis KIM
uaacuuauugauuauaugc

SEQ ID NO: 4198923 - RNA, 15 nt, Yersinia pestis KIM
uaacuucuauuuuuc

SEQ ID NO: 4198924 - RNA, 16 nt, Yersinia pestis KIM
uaacuuuaucagucug

SEQ ID NO: 4198925 - RNA, 13 nt, Yersinia pestis KIM
uaacuuuauugac

SEQ ID NO: 4198926 - RNA, 21 nt, Yersinia pestis KIM
uaacuuuggguuaucccuacc

SEQ ID NO: 4198927 - RNA, 13 nt, Yersinia pestis KIM
uaacuuuucuuca

SEQ ID NO: 4198928 - RNA, 15 nt, Yersinia pestis KIM
uaacuuuucuucauu

SEQ ID NO: 4198929 - RNA, 16 nt, Yersinia pestis KIM
uaacuuuucuucauug

SEQ ID NO: 4198930 - RNA, 15 nt, Yersinia pestis KIM
uaacuuuuggcagca

SEQ ID NO: 4198931 - RNA, 16 nt, Yersinia pestis KIM
uaacuuuuuauuucuu

SEQ ID NO: 4198932 - RNA, 14 nt, Yersinia pestis KIM
uaagaacaacgcug

SEQ ID NO: 4198933 - RNA, 16 nt, Yersinia pestis KIM
uaagaacaacgcugca

SEQ ID NO: 4198934 - RNA, 17 nt, Yersinia pestis KIM
uaagaacaacgcugcaa

SEQ ID NO: 4198935 - RNA, 19 nt, Yersinia pestis KIM
uaagaacgcuugcgccaaa

SEQ ID NO: 4198936 - RNA, 15 nt, Yersinia pestis KIM
uaagaagccucauga

SEQ ID NO: 4198937 - RNA, 17 nt, Yersinia pestis KIM
uaagaagccucaugaau

SEQ ID NO: 4198938 - RNA, 17 nt, Yersinia pestis KIM
uaagaaguagaaugaga

SEQ ID NO: 4198939 - RNA, 14 nt, Yersinia pestis KIM
uaagaauaaauaau

SEQ ID NO: 4198940 - RNA, 19 nt, Yersinia pestis KIM
uaagagcgacucaauaaua

SEQ ID NO: 4198941 - RNA, 13 nt, Yersinia pestis KIM
uaagagugcuggc

SEQ ID NO: 4198942 - RNA, 18 nt, Yersinia pestis KIM
uaagauaauuauccauuu

SEQ ID NO: 4198943 - RNA, 16 nt, Yersinia pestis KIM
uaagaucaauauguuu

SEQ ID NO: 4198944 - RNA, 20 nt, Yersinia pestis KIM
uaagauccagaacaccaaca

SEQ ID NO: 4198945 - RNA, 15 nt, Yersinia pestis KIM
uaagaugacuacugu

SEQ ID NO: 4198946 - RNA, 19 nt, Yersinia pestis KIM
uaagauucgccgcaaggca

SEQ ID NO: 4198947 - RNA, 15 nt, Yersinia pestis KIM
uaagauucucggcau

SEQ ID NO: 4198948 - RNA, 14 nt, Yersinia pestis KIM
uaagcacaacgcuc

SEQ ID NO: 4198949 - RNA, 16 nt, Yersinia pestis KIM
uaagcacgaauuuuau

SEQ ID NO: 4198950 - RNA, 13 nt, Yersinia pestis KIM
uaagcagagaauu

SEQ ID NO: 4198951 - RNA, 22 nt, Yersinia pestis KIM
uaagcagagaauuucaagcugu

SEQ ID NO: 4198952 - RNA, 12 nt, Yersinia pestis KIM
uaagcagccgcc

SEQ ID NO: 4198953 - RNA, 16 nt, Yersinia pestis KIM
uaagcaucggcaacgu

SEQ ID NO: 4198954 - RNA, 17 nt, Yersinia pestis KIM
uaagcaugccgccagau

SEQ ID NO: 4198955 - RNA, 17 nt, Yersinia pestis KIM
uaaucacgauacgacuu

SEQ ID NO: 4198956 - RNA, 23 nt, Yersinia pestis KIM
uaaucacgauacgacuucuuauu

SEQ ID NO: 4198957 - RNA, 22 nt, Yersinia pestis KIM
uaaucagaggugaaaaaauauc

SEQ ID NO: 4198958 - RNA, 16 nt, Yersinia pestis KIM
uaaucagccuucaggg

SEQ ID NO: 4198959 - RNA, 20 nt, Yersinia pestis KIM
uaaucaggcauuacagacug

SEQ ID NO: 4198960 - RNA, 21 nt, Yersinia pestis KIM
uaaucauauccauaaccgaug

SEQ ID NO: 4198961 - RNA, 23 nt, Yersinia pestis KIM
uaauccaaaauaauauaauucaa

SEQ ID NO: 4198962 - RNA, 22 nt, Yersinia pestis KIM
uaauccaagccaugguaaccac

SEQ ID NO: 4198963 - RNA, 11 nt, Yersinia pestis KIM
uaauccaaggc

SEQ ID NO: 4198964 - RNA, 12 nt, Yersinia pestis KIM
uaauccauacag

SEQ ID NO: 4198965 - RNA, 19 nt, Yersinia pestis KIM
uaauccauucacgcccuac

SEQ ID NO: 4198966 - RNA, 20 nt, Yersinia pestis KIM
uaauccccggucacuuaaau

SEQ ID NO: 4198967 - RNA, 19 nt, Yersinia pestis KIM
uaauccgaccaccacugca

SEQ ID NO: 4198968 - RNA, 20 nt, Yersinia pestis KIM
uaauccgaccaccacugcau

SEQ ID NO: 4198969 - RNA, 22 nt, Yersinia pestis KIM
uaauccgccugagauuaaccgc

SEQ ID NO: 4198970 - RNA, 15 nt, Yersinia pestis KIM
uaaucgcagcagaga

SEQ ID NO: 4198971 - RNA, 17 nt, Yersinia pestis KIM
uaaucgccaauaaccgc

SEQ ID NO: 4198972 - RNA, 21 nt, Yersinia pestis KIM
uaaucgccugaugcuuuucuu

SEQ ID NO: 4198973 - RNA, 18 nt, Yersinia pestis KIM
uaaucgcgcauuucuucu

SEQ ID NO: 4198974 - RNA, 16 nt, Yersinia pestis KIM
uaaucgcugaacagac

SEQ ID NO: 4198975 - RNA, 21 nt, Yersinia pestis KIM
uaaucggaaaccgcuguuuua

SEQ ID NO: 4198976 - RNA, 15 nt, Yersinia pestis KIM
uaaucggauggucau

SEQ ID NO: 4198977 - RNA, 22 nt, Yersinia pestis KIM
uaaucgucccacaugaacucaa

SEQ ID NO: 4198978 - RNA, 23 nt, Yersinia pestis KIM
uaaucgucuuguuggucaccacu

SEQ ID NO: 4198979 - RNA, 14 nt, Yersinia pestis KIM
uaaucuauuaauau

SEQ ID NO: 4198980 - RNA, 15 nt, Yersinia pestis KIM
uaaucuccaucaugg

SEQ ID NO: 4198981 - RNA, 14 nt, Yersinia pestis KIM
uaaucugcccagcc

SEQ ID NO: 4198982 - RNA, 18 nt, Yersinia pestis KIM
uaaucuggaugaguauua

SEQ ID NO: 4198983 - RNA, 23 nt, Yersinia pestis KIM
uaaucuggcucaggaaucuucaa

SEQ ID NO: 4198984 - RNA, 18 nt, Yersinia pestis KIM
uaaucugggguuccaggc

SEQ ID NO: 4198985 - RNA, 15 nt, Yersinia pestis KIM
uaaucuuaaguaaau

SEQ ID NO: 4198986 - RNA, 14 nt, Yersinia pestis KIM
uaaucuugugauga

SEQ ID NO: 4198987 - RNA, 15 nt, Yersinia pestis KIM
uaaucuuuacugcau

SEQ ID NO: 4198988 - RNA, 17 nt, Yersinia pestis KIM
uaaugaacaaauaucgg

SEQ ID NO: 4198989 - RNA, 19 nt, Yersinia pestis KIM
uaaugaacgaguaaaaaga

SEQ ID NO: 4198990 - RNA, 22 nt, Yersinia pestis KIM
uaaugaccacgcaucaauaaua

SEQ ID NO: 4198991 - RNA, 14 nt, Yersinia pestis KIM
uaaugacgcccgca

SEQ ID NO: 4198992 - RNA, 22 nt, Yersinia pestis KIM
uaaugagauuaauucaaaaauu

SEQ ID NO: 4198993 - RNA, 20 nt, Yersinia pestis KIM
uaaugagccgcauugauccu

SEQ ID NO: 4198994 - RNA, 13 nt, Yersinia pestis KIM
uaaugagcguuau

SEQ ID NO: 4198995 - RNA, 20 nt, Yersinia pestis KIM
uaaugagcguuauuauuagu

SEQ ID NO: 4198996 - RNA, 19 nt, Yersinia pestis KIM
uaaugaggguaagugaaua

SEQ ID NO: 4198997 - RNA, 15 nt, Yersinia pestis KIM
uaaugaguuggcauu

SEQ ID NO: 4198998 - RNA, 20 nt, Yersinia pestis KIM
uaaugaugagguaauacuca

SEQ ID NO: 4198999 - RNA, 14 nt, Yersinia pestis KIM
uaaugauugauuau

SEQ ID NO: 4199000 - RNA, 23 nt, Yersinia pestis KIM
uaaugauugauuaucaaguuaaa

SEQ ID NO: 4199001 - RNA, 16 nt, Yersinia pestis KIM
uaaugcaauggcucca

SEQ ID NO: 4199002 - RNA, 20 nt, Yersinia pestis KIM
uaaugcacgucaguuaaaua

SEQ ID NO: 4199003 - RNA, 15 nt, Yersinia pestis KIM
uaaugcauuccccug

SEQ ID NO: 4199004 - RNA, 18 nt, Yersinia pestis KIM
uaaugcauucugcugguu

SEQ ID NO: 4199005 - RNA, 14 nt, Yersinia pestis KIM
uaaugccacacuca

SEQ ID NO: 4199006 - RNA, 19 nt, Yersinia pestis KIM
uaaugccacccccagugcu

SEQ ID NO: 4199007 - RNA, 22 nt, Yersinia pestis KIM
uaaugccagcguggcccaggca

SEQ ID NO: 4199008 - RNA, 20 nt, Yersinia pestis KIM
uaaugccccgcauaaauacu

SEQ ID NO: 4199009 - RNA, 17 nt, Yersinia pestis KIM
uaaugccgaaugauuca

SEQ ID NO: 4199010 - RNA, 19 nt, Yersinia pestis KIM
uaaugccgcugaucaggaa

SEQ ID NO: 4199011 - RNA, 13 nt, Yersinia pestis KIM
uaaugcgaaaaaa

SEQ ID NO: 4199012 - RNA, 14 nt, Yersinia pestis KIM
uaaugcgaaaaaag

SEQ ID NO: 4199013 - RNA, 14 nt, Yersinia pestis KIM
uaaugcgcgcagca

SEQ ID NO: 4199014 - RNA, 12 nt, Yersinia pestis KIM
uaaugcggcucu

SEQ ID NO: 4199015 - RNA, 20 nt, Yersinia pestis KIM
uaaugcggugguuaacagcg

SEQ ID NO: 4199016 - RNA, 15 nt, Yersinia pestis KIM
uaaugcucgcucauc

SEQ ID NO: 4199017 - RNA, 16 nt, Yersinia pestis KIM
uaaugcugaugcaaua

SEQ ID NO: 4199018 - RNA, 23 nt, Yersinia pestis KIM
uaaugcuguuguagcgccaggua

SEQ ID NO: 4199019 - RNA, 21 nt, Yersinia pestis KIM
uaauggauugaucauucucug

SEQ ID NO: 4199020 - RNA, 20 nt, Yersinia pestis KIM
uaauggcaccaucggcucua

SEQ ID NO: 4199021 - RNA, 17 nt, Yersinia pestis KIM
uaauggcauacuccgcu

SEQ ID NO: 4199022 - RNA, 15 nt, Yersinia pestis KIM
uaauggcauuuucag

SEQ ID NO: 4199023 - RNA, 14 nt, Yersinia pestis KIM
uaauggccuaaauu

SEQ ID NO: 4199024 - RNA, 17 nt, Yersinia pestis KIM
uaauggcgcacauuaca

SEQ ID NO: 4199025 - RNA, 22 nt, Yersinia pestis KIM
uaauggguuagcgguuaaaaac

SEQ ID NO: 4199026 - RNA, 15 nt, Yersinia pestis KIM
uaauggucaagguga

SEQ ID NO: 4199027 - RNA, 19 nt, Yersinia pestis KIM
uaauggugcuauuucuggc

SEQ ID NO: 4199028 - RNA, 18 nt, Yersinia pestis KIM
uaaugguuguuaauuaag

SEQ ID NO: 4199029 - RNA, 21 nt, Yersinia pestis KIM
uaaugguuguuaauuaagauu

SEQ ID NO: 4199030 - RNA, 15 nt, Yersinia pestis KIM
uaaugucaugaaucc

SEQ ID NO: 4199031 - RNA, 14 nt, Yersinia pestis KIM
uaaugucuuuacua

SEQ ID NO: 4199032 - RNA, 12 nt, Yersinia pestis KIM
uaauguuaauau

SEQ ID NO: 4199033 - RNA, 13 nt, Yersinia pestis KIM
uaauguucauuca

SEQ ID NO: 4199034 - RNA, 17 nt, Yersinia pestis KIM
uaauuaaacgcucauca

SEQ ID NO: 4199035 - RNA, 20 nt, Yersinia pestis KIM
uaauuaacacccaauaauaa

SEQ ID NO: 4199036 - RNA, 18 nt, Yersinia pestis KIM
uaauuaacagcaucacug

SEQ ID NO: 4199037 - RNA, 22 nt, Yersinia pestis KIM
uaauuaacagcaucacugucua

SEQ ID NO: 4199038 - RNA, 22 nt, Yersinia pestis KIM
uaauuaauucaaucggcagauu

SEQ ID NO: 4199039 - RNA, 14 nt, Yersinia pestis KIM
uaauuaauuuaaac

SEQ ID NO: 4199040 - RNA, 18 nt, Yersinia pestis KIM
uaauuaauuuaaacaacc

SEQ ID NO: 4199041 - RNA, 21 nt, Yersinia pestis KIM
uaauuacaguugauauuauua

SEQ ID NO: 4199042 - RNA, 15 nt, Yersinia pestis KIM
uaauuacgcguucac

SEQ ID NO: 4199043 - RNA, 23 nt, Yersinia pestis KIM
uaauuacuuuauuuaaaauuaau

SEQ ID NO: 4199044 - RNA, 14 nt, Yersinia pestis KIM
uaauuaguuuuaau

SEQ ID NO: 4199045 - RNA, 15 nt, Yersinia pestis KIM
uaauuaguuuuaaua

SEQ ID NO: 4199046 - RNA, 16 nt, Yersinia pestis KIM
uaauuauagugaaaac

SEQ ID NO: 4199047 - RNA, 17 nt, Yersinia pestis KIM
uaauuaucgauaaauaa

SEQ ID NO: 4199048 - RNA, 15 nt, Yersinia pestis KIM
uaauuaugauaaaug

SEQ ID NO: 4199049 - RNA, 18 nt, Yersinia pestis KIM
uaauuauuuauaaugggu

SEQ ID NO: 4199050 - RNA, 14 nt, Yersinia pestis KIM
uaauucaaaaugua

SEQ ID NO: 4199051 - RNA, 22 nt, Yersinia pestis KIM
uaauucaauauauacaauccaa

SEQ ID NO: 4199052 - RNA, 18 nt, Yersinia pestis KIM
uaauucacugcuuaaucc

SEQ ID NO: 4199053 - RNA, 19 nt, Yersinia pestis KIM
uaauucaggcaaauucuca

SEQ ID NO: 4199054 - RNA, 14 nt, Yersinia pestis KIM
uaauucaguuaaua

SEQ ID NO: 4199055 - RNA, 14 nt, Yersinia pestis KIM
uaauucaucagauu

SEQ ID NO: 4199056 - RNA, 19 nt, Yersinia pestis KIM
uaauucaugugagauaaca

SEQ ID NO: 4199057 - RNA, 13 nt, Yersinia pestis KIM
uaauucauuauua

SEQ ID NO: 4199058 - RNA, 17 nt, Yersinia pestis KIM
uaauuccaugcaaaaua

SEQ ID NO: 4199059 - RNA, 19 nt, Yersinia pestis KIM
uaauucgaguuucaggaag

SEQ ID NO: 4199060 - RNA, 19 nt, Yersinia pestis KIM
uaauucuggguacaacaca

SEQ ID NO: 4199061 - RNA, 16 nt, Yersinia pestis KIM
uaauugaagauuuaaa

SEQ ID NO: 4199062 - RNA, 17 nt, Yersinia pestis KIM
uaauugaagauuuaaau

SEQ ID NO: 4199063 - RNA, 20 nt, Yersinia pestis KIM
uaauugaagauuuaaauaac

SEQ ID NO: 4199064 - RNA, 21 nt, Yersinia pestis KIM
uaauugaagauuuaaauaaca

SEQ ID NO: 4199065 - RNA, 22 nt, Yersinia pestis KIM
uaauugaauugccccccaauau

SEQ ID NO: 4199066 - RNA, 17 nt, Yersinia pestis KIM
uaauugagaauuauaac

SEQ ID NO: 4199067 - RNA, 18 nt, Yersinia pestis KIM
uaauugcggucaguuggc

SEQ ID NO: 4199068 - RNA, 15 nt, Yersinia pestis KIM
uaauuggcaauaaug

SEQ ID NO: 4199069 - RNA, 16 nt, Yersinia pestis KIM
uacauccuaaauaauu

SEQ ID NO: 4199070 - RNA, 21 nt, Yersinia pestis KIM
uacaucuccgcuauuuuccac

SEQ ID NO: 4199071 - RNA, 20 nt, Yersinia pestis KIM
uacaucuuacugauaucuuu

SEQ ID NO: 4199072 - RNA, 16 nt, Yersinia pestis KIM
uacaugauugaaaaac

SEQ ID NO: 4199073 - RNA, 16 nt, Yersinia pestis KIM
uacaugcguaaaugaa

SEQ ID NO: 4199074 - RNA, 13 nt, Yersinia pestis KIM
uacaugcuguuca

SEQ ID NO: 4199075 - RNA, 13 nt, Yersinia pestis KIM
uacauuuaaacac

SEQ ID NO: 4199076 - RNA, 18 nt, Yersinia pestis KIM
uacauuuaaacacucaau

SEQ ID NO: 4199077 - RNA, 22 nt, Yersinia pestis KIM
uacauuuaaacacucaauaagu

SEQ ID NO: 4199078 - RNA, 13 nt, Yersinia pestis KIM
uacauuucaucuu

SEQ ID NO: 4199079 - RNA, 13 nt, Yersinia pestis KIM
uacauuuuuaaca

SEQ ID NO: 4199080 - RNA, 14 nt, Yersinia pestis KIM
uaccaaauaaacca

SEQ ID NO: 4199081 - RNA, 15 nt, Yersinia pestis KIM
uaccaaauaacaaca

SEQ ID NO: 4199082 - RNA, 17 nt, Yersinia pestis KIM
uaccaacccgauaccga

SEQ ID NO: 4199083 - RNA, 19 nt, Yersinia pestis KIM
uaccaacucugaaguaaau

SEQ ID NO: 4199084 - RNA, 14 nt, Yersinia pestis KIM
uaccaauaaaaccu

SEQ ID NO: 4199085 - RNA, 13 nt, Yersinia pestis KIM
uaccaaugcacgu

SEQ ID NO: 4199086 - RNA, 16 nt, Yersinia pestis KIM
uaccaauggugcccau

SEQ ID NO: 4199087 - RNA, 18 nt, Yersinia pestis KIM
uaccaauggugcccauca

SEQ ID NO: 4199088 - RNA, 23 nt, Yersinia pestis KIM
uaccaaugucucaggauacaaau

SEQ ID NO: 4199089 - RNA, 14 nt, Yersinia pestis KIM
uaccaauuaauaag

SEQ ID NO: 4199090 - RNA, 15 nt, Yersinia pestis KIM
uaccaauuaauaaga

SEQ ID NO: 4199091 - RNA, 12 nt, Yersinia pestis KIM
uaccaauugaug

SEQ ID NO: 4199092 - RNA, 15 nt, Yersinia pestis KIM
uaccaauugauguca

SEQ ID NO: 4199093 - RNA, 15 nt, Yersinia pestis KIM
uaccaccaccaacag

SEQ ID NO: 4199094 - RNA, 18 nt, Yersinia pestis KIM
uaccaccaccaacagcau

SEQ ID NO: 4199095 - RNA, 16 nt, Yersinia pestis KIM
uaccaccaccacaccg

SEQ ID NO: 4199096 - RNA, 22 nt, Yersinia pestis KIM
uaccacgucuaauugcugccca

SEQ ID NO: 4199097 - RNA, 14 nt, Yersinia pestis KIM
uaccacugcucacu

SEQ ID NO: 4199098 - RNA, 13 nt, Yersinia pestis KIM
uaccagcaagaau

SEQ ID NO: 4199099 - RNA, 17 nt, Yersinia pestis KIM
uaccagccgcgcccuaa

SEQ ID NO: 4199100 - RNA, 20 nt, Yersinia pestis KIM
uaccagccgcgcccuaacag

SEQ ID NO: 4199101 - RNA, 20 nt, Yersinia pestis KIM
uaccagcguagguacuucuc

SEQ ID NO: 4199102 - RNA, 14 nt, Yersinia pestis KIM
uaccaggaagcggc

SEQ ID NO: 4199103 - RNA, 20 nt, Yersinia pestis KIM
uaccagucgucaaaagcggc

SEQ ID NO: 4199104 - RNA, 15 nt, Yersinia pestis KIM
uaccauaacaauggc

SEQ ID NO: 4199105 - RNA, 16 nt, Yersinia pestis KIM
uaccauaaggccaggc

SEQ ID NO: 4199106 - RNA, 24 nt, Yersinia pestis KIM
uaccauauccacgguauuaguauu

SEQ ID NO: 4199107 - RNA, 22 nt, Yersinia pestis KIM
uaccaugagugaaaauauguag

SEQ ID NO: 4199108 - RNA, 15 nt, Yersinia pestis KIM
uaccaugcucauguu

SEQ ID NO: 4199109 - RNA, 21 nt, Yersinia pestis KIM
uaccauuucacgguucacccc

SEQ ID NO: 4199110 - RNA, 20 nt, Yersinia pestis KIM
uacccaaaauaauucgaguu

SEQ ID NO: 4199111 - RNA, 13 nt, Yersinia pestis KIM
uacccaaaccaac

SEQ ID NO: 4199112 - RNA, 14 nt, Yersinia pestis KIM
uacccaaagucauu

SEQ ID NO: 4199113 - RNA, 14 nt, Yersinia pestis KIM
uacccacuaauauu

SEQ ID NO: 4199114 - RNA, 23 nt, Yersinia pestis KIM
uacccacuuuauuuuuuuccagg

SEQ ID NO: 4199115 - RNA, 22 nt, Yersinia pestis KIM
uacccagcuucuuuuaaagaag

SEQ ID NO: 4199116 - RNA, 17 nt, Yersinia pestis KIM
uacccauuauaaauaau

SEQ ID NO: 4199117 - RNA, 22 nt, Yersinia pestis KIM
uacccauuauaaauaauuaaug

SEQ ID NO: 4199118 - RNA, 13 nt, Yersinia pestis KIM
uacccauuuuaau

SEQ ID NO: 4199119 - RNA, 15 nt, Yersinia pestis KIM
uaccccccaagcuuu

SEQ ID NO: 4199120 - RNA, 20 nt, Yersinia pestis KIM
uacccccgacgacuuguuca

SEQ ID NO: 4199121 - RNA, 22 nt, Yersinia pestis KIM
uacccgacaccggcugauuacc

SEQ ID NO: 4199122 - RNA, 16 nt, Yersinia pestis KIM
uacccgaguaugguua

SEQ ID NO: 4199123 - RNA, 14 nt, Yersinia pestis KIM
uacccggaauggag

SEQ ID NO: 4199124 - RNA, 20 nt, Yersinia pestis KIM
uacccggaauggagccgcua

SEQ ID NO: 4199125 - RNA, 22 nt, Yersinia pestis KIM
uacccgucguacuuuaagcugc

SEQ ID NO: 4199126 - RNA, 20 nt, Yersinia pestis KIM
uacccguuauauuucaagcu

SEQ ID NO: 4199127 - RNA, 21 nt, Yersinia pestis KIM
uacccuaacucuuuggauggg

SEQ ID NO: 4199128 - RNA, 18 nt, Yersinia pestis KIM
uacccuacccauuauaaa

SEQ ID NO: 4199129 - RNA, 22 nt, Yersinia pestis KIM
uacccuacccauuauaaauaau

SEQ ID NO: 4199130 - RNA, 16 nt, Yersinia pestis KIM
uacccucgacaccaaa

SEQ ID NO: 4199131 - RNA, 17 nt, Yersinia pestis KIM
uacccucgacaccaaaa

SEQ ID NO: 4199132 - RNA, 19 nt, Yersinia pestis KIM
uacccucgacaccaaaacu

SEQ ID NO: 4199133 - RNA, 14 nt, Yersinia pestis KIM
uacccugcaccaua

SEQ ID NO: 4199134 - RNA, 13 nt, Yersinia pestis KIM
uacccuuugagaa

SEQ ID NO: 4199135 - RNA, 23 nt, Yersinia pestis KIM
uaccgaaauauucgucucaucaa

SEQ ID NO: 4199136 - RNA, 17 nt, Yersinia pestis KIM
uaccgaacgaacacagu

SEQ ID NO: 4199137 - RNA, 20 nt, Yersinia pestis KIM
uaccgacaucaacagaggca

SEQ ID NO: 4199138 - RNA, 18 nt, Yersinia pestis KIM
uaccgaguucucaccaag

SEQ ID NO: 4199139 - RNA, 19 nt, Yersinia pestis KIM
uaccgauaauaaauauccu

SEQ ID NO: 4199140 - RNA, 22 nt, Yersinia pestis KIM
uaccgauaugcccuguagaagu

SEQ ID NO: 4199141 - RNA, 19 nt, Yersinia pestis KIM
uaccgaucaucaggcaggu

SEQ ID NO: 4199142 - RNA, 23 nt, Yersinia pestis KIM
uaccgcaaccaccuuuaccaugc

SEQ ID NO: 4199143 - RNA, 23 nt, Yersinia pestis KIM
uaccgcaaccgggccggguugau

SEQ ID NO: 4199144 - RNA, 13 nt, Yersinia pestis KIM
uaccgccaagcgc

SEQ ID NO: 4199145 - RNA, 16 nt, Yersinia pestis KIM
uaccgccaauaucugu

SEQ ID NO: 4199146 - RNA, 15 nt, Yersinia pestis KIM
uaccgcuaugcuaaa

SEQ ID NO: 4199147 - RNA, 22 nt, Yersinia pestis KIM
uaccgcugcccggcucaucaag

SEQ ID NO: 4199148 - RNA, 20 nt, Yersinia pestis KIM
uaccggauacaccguaucug

SEQ ID NO: 4199149 - RNA, 16 nt, Yersinia pestis KIM
uaccggcauuggcugg

SEQ ID NO: 4199150 - RNA, 18 nt, Yersinia pestis KIM
uaccgggcgaacagaaau

SEQ ID NO: 4199151 - RNA, 18 nt, Yersinia pestis KIM
uaccggguucaaggaaac

SEQ ID NO: 4199152 - RNA, 23 nt, Yersinia pestis KIM
uaccgguaaaauuauugccgcag

SEQ ID NO: 4199153 - RNA, 23 nt, Yersinia pestis KIM
uaccgguucauuuagcagcgcac

SEQ ID NO: 4199154 - RNA, 18 nt, Yersinia pestis KIM
uaccgguuugggcaucaa

SEQ ID NO: 4199155 - RNA, 15 nt, Yersinia pestis KIM
uaccgucauccagca

SEQ ID NO: 4199156 - RNA, 17 nt, Yersinia pestis KIM
uaccgugagcagcaaua

SEQ ID NO: 4199157 - RNA, 14 nt, Yersinia pestis KIM
uaccguugggcuuu

SEQ ID NO: 4199158 - RNA, 19 nt, Yersinia pestis KIM
uaccguuuuauuucccccu

SEQ ID NO: 4199159 - RNA, 15 nt, Yersinia pestis KIM
uaccuaaccaaacau

SEQ ID NO: 4199160 - RNA, 14 nt, Yersinia pestis KIM
uaccuaggccagca

SEQ ID NO: 4199161 - RNA, 19 nt, Yersinia pestis KIM
uaccuauaaacauuuacuu

SEQ ID NO: 4199162 - RNA, 20 nt, Yersinia pestis KIM
uaccuauaaacauuuacuua

SEQ ID NO: 4199163 - RNA, 23 nt, Yersinia pestis KIM
uaccuauuuauugccauuuuaau

SEQ ID NO: 4199164 - RNA, 20 nt, Yersinia pestis KIM
uaccucaguuaucagggccu

SEQ ID NO: 4199165 - RNA, 12 nt, Yersinia pestis KIM
uaccucaucauu

SEQ ID NO: 4199166 - RNA, 23 nt, Yersinia pestis KIM
uaccucauccguaaaaaaccuua

SEQ ID NO: 4199167 - RNA, 16 nt, Yersinia pestis KIM
uaccuccauauccugg

SEQ ID NO: 4199168 - RNA, 22 nt, Yersinia pestis KIM
uaccucguaguaaugacgcuau

SEQ ID NO: 4199169 - RNA, 14 nt, Yersinia pestis KIM
uaccugacacugca

SEQ ID NO: 4199170 - RNA, 17 nt, Yersinia pestis KIM
uaccugacacugcaucu

SEQ ID NO: 4199171 - RNA, 16 nt, Yersinia pestis KIM
uaccugagagagguug

SEQ ID NO: 4199172 - RNA, 17 nt, Yersinia pestis KIM
uaccugauuccuaagca

SEQ ID NO: 4199173 - RNA, 19 nt, Yersinia pestis KIM
uaccugauuccuaagcaaa

SEQ ID NO: 4199174 - RNA, 20 nt, Yersinia pestis KIM
uaccugcaccaaugacuaau

SEQ ID NO: 4199175 - RNA, 15 nt, Yersinia pestis KIM
uaccugcauauccuc

SEQ ID NO: 4199176 - RNA, 15 nt, Yersinia pestis KIM
uaccugcaucaucac

SEQ ID NO: 4199177 - RNA, 13 nt, Yersinia pestis KIM
uaccugccccaca

SEQ ID NO: 4199178 - RNA, 21 nt, Yersinia pestis KIM
uaccugcgaacaucaucccca

SEQ ID NO: 4199179 - RNA, 18 nt, Yersinia pestis KIM
uaccugcgacaccguuga

SEQ ID NO: 4199180 - RNA, 13 nt, Yersinia pestis KIM
uaccugcucaacu

SEQ ID NO: 4199181 - RNA, 21 nt, Yersinia pestis KIM
uaccuuaauuaacucuucugu

SEQ ID NO: 4199182 - RNA, 14 nt, Yersinia pestis KIM
uaccuuacuguauc

SEQ ID NO: 4199183 - RNA, 13 nt, Yersinia pestis KIM
uacuuuugcuaac

SEQ ID NO: 4199184 - RNA, 14 nt, Yersinia pestis KIM
uacuuuuuccuuau

SEQ ID NO: 4199185 - RNA, 19 nt, Yersinia pestis KIM
uacuuuuuccuuauuucuu

SEQ ID NO: 4199186 - RNA, 18 nt, Yersinia pestis KIM
uagaaaaacacuggcagc

SEQ ID NO: 4199187 - RNA, 19 nt, Yersinia pestis KIM
uagaaaaacacuggcagcc

SEQ ID NO: 4199188 - RNA, 23 nt, Yersinia pestis KIM
uagaaaaaucacauacuggcauu

SEQ ID NO: 4199189 - RNA, 15 nt, Yersinia pestis KIM
uagaaacguucaaua

SEQ ID NO: 4199190 - RNA, 15 nt, Yersinia pestis KIM
uagaaaucacacugg

SEQ ID NO: 4199191 - RNA, 20 nt, Yersinia pestis KIM
uagaacggcggacuguuaau

SEQ ID NO: 4199192 - RNA, 13 nt, Yersinia pestis KIM
uagaacuuaagca

SEQ ID NO: 4199193 - RNA, 14 nt, Yersinia pestis KIM
uagaacuuaagcaa

SEQ ID NO: 4199194 - RNA, 15 nt, Yersinia pestis KIM
uagaacuuaagcaau

SEQ ID NO: 4199195 - RNA, 19 nt, Yersinia pestis KIM
uagaagagauagauuuuaa

SEQ ID NO: 4199196 - RNA, 14 nt, Yersinia pestis KIM
uagaagcucauaug

SEQ ID NO: 4199197 - RNA, 19 nt, Yersinia pestis KIM
uagaauuugaucagccaga

SEQ ID NO: 4199198 - RNA, 22 nt, Yersinia pestis KIM
uagaauuuucucauuaauaaug

SEQ ID NO: 4199199 - RNA, 15 nt, Yersinia pestis KIM
uagacaccuucccua

SEQ ID NO: 4199200 - RNA, 16 nt, Yersinia pestis KIM
uagacaguaacuaaag

SEQ ID NO: 4199201 - RNA, 16 nt, Yersinia pestis KIM
uagaccaaugaauuac

SEQ ID NO: 4199202 - RNA, 21 nt, Yersinia pestis KIM
uagaccaguuaauaucaauga

SEQ ID NO: 4199203 - RNA, 12 nt, Yersinia pestis KIM
uagacgaaggca

SEQ ID NO: 4199204 - RNA, 17 nt, Yersinia pestis KIM
uagacgaaggcacggcc

SEQ ID NO: 4199205 - RNA, 17 nt, Yersinia pestis KIM
uagacgacacaaaugcu

SEQ ID NO: 4199206 - RNA, 17 nt, Yersinia pestis KIM
uagacgcgggauauaag

SEQ ID NO: 4199207 - RNA, 20 nt, Yersinia pestis KIM
uagacgucagauuagcuuua

SEQ ID NO: 4199208 - RNA, 20 nt, Yersinia pestis KIM
uagacgucagauuaguuuua

SEQ ID NO: 4199209 - RNA, 19 nt, Yersinia pestis KIM
uagacucaucuaauuuucu

SEQ ID NO: 4199210 - RNA, 16 nt, Yersinia pestis KIM
uagacuguuuuauuau

SEQ ID NO: 4199211 - RNA, 17 nt, Yersinia pestis KIM
uagacuguuuuauuaua

SEQ ID NO: 4199212 - RNA, 21 nt, Yersinia pestis KIM
uagacuguuuuauuauauauu

SEQ ID NO: 4199213 - RNA, 14 nt, Yersinia pestis KIM
uagagcacagcacu

SEQ ID NO: 4199214 - RNA, 21 nt, Yersinia pestis KIM
uagagcaccaaaucuuccagc

SEQ ID NO: 4199215 - RNA, 19 nt, Yersinia pestis KIM
uagagcacgcgacucauaa

SEQ ID NO: 4199216 - RNA, 22 nt, Yersinia pestis KIM
uagagcauaacugguggcaggc

SEQ ID NO: 4199217 - RNA, 20 nt, Yersinia pestis KIM
uagagcgguuuguugcuacu

SEQ ID NO: 4199218 - RNA, 22 nt, Yersinia pestis KIM
uagagcuguuuggcauggauau

SEQ ID NO: 4199219 - RNA, 19 nt, Yersinia pestis KIM
uagagcuuccagugcauua

SEQ ID NO: 4199220 - RNA, 13 nt, Yersinia pestis KIM
uagaggccuuaca

SEQ ID NO: 4199221 - RNA, 19 nt, Yersinia pestis KIM
uagaggcucccuuccauuu

SEQ ID NO: 4199222 - RNA, 19 nt, Yersinia pestis KIM
uagagugaaguaucaccac

SEQ ID NO: 4199223 - RNA, 19 nt, Yersinia pestis KIM
uagaguucguguugugcca

SEQ ID NO: 4199224 - RNA, 16 nt, Yersinia pestis KIM
uagaguugauaaacaa

SEQ ID NO: 4199225 - RNA, 14 nt, Yersinia pestis KIM
uagauaaaaacauu

SEQ ID NO: 4199226 - RNA, 18 nt, Yersinia pestis KIM
uagauaaaaacauuuaaa

SEQ ID NO: 4199227 - RNA, 21 nt, Yersinia pestis KIM
uagauaaaaacauuuaaauau

SEQ ID NO: 4199228 - RNA, 18 nt, Yersinia pestis KIM
uagauaacaaacuacuug

SEQ ID NO: 4199229 - RNA, 18 nt, Yersinia pestis KIM
uagauaccgcaaccauug

SEQ ID NO: 4199230 - RNA, 16 nt, Yersinia pestis KIM
uagauagaaaucacug

SEQ ID NO: 4199231 - RNA, 14 nt, Yersinia pestis KIM
uagauagccauaau

SEQ ID NO: 4199232 - RNA, 17 nt, Yersinia pestis KIM
uagauagccauaauaau

SEQ ID NO: 4199233 - RNA, 18 nt, Yersinia pestis KIM
uagauaggcaguauucca

SEQ ID NO: 4199234 - RNA, 22 nt, Yersinia pestis KIM
uagauauuguuuugacuaaaau

SEQ ID NO: 4199235 - RNA, 14 nt, Yersinia pestis KIM
uagaucaaacauaa

SEQ ID NO: 4199236 - RNA, 18 nt, Yersinia pestis KIM
uagauccacuccagugcc

SEQ ID NO: 4199237 - RNA, 20 nt, Yersinia pestis KIM
uagaucccauacccacuaau

SEQ ID NO: 4199238 - RNA, 21 nt, Yersinia pestis KIM
uagaucccauacccacuaaua

SEQ ID NO: 4199239 - RNA, 19 nt, Yersinia pestis KIM
uagaucgagucaucggguu

SEQ ID NO: 4199240 - RNA, 18 nt, Yersinia pestis KIM
uagaucggccaaugcuuu

SEQ ID NO: 4199241 - RNA, 21 nt, Yersinia pestis KIM
uagaucuccugcaacgccuuc

SEQ ID NO: 4199242 - RNA, 19 nt, Yersinia pestis KIM
uagaucucuguuuuccauc

SEQ ID NO: 4199243 - RNA, 19 nt, Yersinia pestis KIM
uagaugauugaaaaucagu

SEQ ID NO: 4199244 - RNA, 15 nt, Yersinia pestis KIM
uagauggaaaucaca

SEQ ID NO: 4199245 - RNA, 16 nt, Yersinia pestis KIM
uagauggaaaucacac

SEQ ID NO: 4199246 - RNA, 13 nt, Yersinia pestis KIM
uagaugucagauu

SEQ ID NO: 4199247 - RNA, 13 nt, Yersinia pestis KIM
uagauuaaucgaa

SEQ ID NO: 4199248 - RNA, 19 nt, Yersinia pestis KIM
uagauuaaugaaaaggcau

SEQ ID NO: 4199249 - RNA, 18 nt, Yersinia pestis KIM
uagauuuuaaugaaaacu

SEQ ID NO: 4199250 - RNA, 19 nt, Yersinia pestis KIM
uagauuuuaaugaaaacua

SEQ ID NO: 4199251 - RNA, 20 nt, Yersinia pestis KIM
uagcaaacccaccugaaucu

SEQ ID NO: 4199252 - RNA, 15 nt, Yersinia pestis KIM
uagcaaccgcugcag

SEQ ID NO: 4199253 - RNA, 15 nt, Yersinia pestis KIM
uagcaagcacggcag

SEQ ID NO: 4199254 - RNA, 22 nt, Yersinia pestis KIM
uagcaauaccuugcccuaggcc

SEQ ID NO: 4199255 - RNA, 18 nt, Yersinia pestis KIM
uagcaauccaguuaucau

SEQ ID NO: 4199256 - RNA, 14 nt, Yersinia pestis KIM
uagcacauaugcag

SEQ ID NO: 4199257 - RNA, 12 nt, Yersinia pestis KIM
uagcagcaccau

SEQ ID NO: 4199258 - RNA, 19 nt, Yersinia pestis KIM
uagcagccacaugguuuca

SEQ ID NO: 4199259 - RNA, 14 nt, Yersinia pestis KIM
uagcagcgcacugg

SEQ ID NO: 4199260 - RNA, 14 nt, Yersinia pestis KIM
uagcaggcagcacg

SEQ ID NO: 4199261 - RNA, 15 nt, Yersinia pestis KIM
uagcagugauuucag

SEQ ID NO: 4199262 - RNA, 13 nt, Yersinia pestis KIM
uagcauaaaaauc

SEQ ID NO: 4199263 - RNA, 23 nt, Yersinia pestis KIM
uagcaucggcuagcguuuacuuu

SEQ ID NO: 4199264 - RNA, 18 nt, Yersinia pestis KIM
uagcauggcuuuaugacc

SEQ ID NO: 4199265 - RNA, 16 nt, Yersinia pestis KIM
uagcauggucaucgcu

SEQ ID NO: 4199266 - RNA, 13 nt, Yersinia pestis KIM
uagcauuggcaca

SEQ ID NO: 4199267 - RNA, 19 nt, Yersinia pestis KIM
uagccaaaauaauuaccgu

SEQ ID NO: 4199268 - RNA, 20 nt, Yersinia pestis KIM
uagccaaauacauauaacca

SEQ ID NO: 4199269 - RNA, 22 nt, Yersinia pestis KIM
uagccaaauacccuaauucaga

SEQ ID NO: 4199270 - RNA, 23 nt, Yersinia pestis KIM
uagccaacacgaccugugcacca

SEQ ID NO: 4199271 - RNA, 20 nt, Yersinia pestis KIM
uagccaaucccgauaaaaac

SEQ ID NO: 4199272 - RNA, 17 nt, Yersinia pestis KIM
uagccacagucauuuga

SEQ ID NO: 4199273 - RNA, 22 nt, Yersinia pestis KIM
uagccaccaguuuauuuucccu

SEQ ID NO: 4199274 - RNA, 16 nt, Yersinia pestis KIM
uagccacgucugcgga

SEQ ID NO: 4199275 - RNA, 22 nt, Yersinia pestis KIM
uagccacgucugcggaucagag

SEQ ID NO: 4199276 - RNA, 16 nt, Yersinia pestis KIM
uagccacuuaauaaug

SEQ ID NO: 4199277 - RNA, 21 nt, Yersinia pestis KIM
uagccagccaccgcacacuga

SEQ ID NO: 4199278 - RNA, 19 nt, Yersinia pestis KIM
uagccagcggcguaacaua

SEQ ID NO: 4199279 - RNA, 20 nt, Yersinia pestis KIM
uagccaguauguuguucgaa

SEQ ID NO: 4199280 - RNA, 12 nt, Yersinia pestis KIM
uagccauuucaa

SEQ ID NO: 4199281 - RNA, 22 nt, Yersinia pestis KIM
uagccauuuggugauaagcugc

SEQ ID NO: 4199282 - RNA, 12 nt, Yersinia pestis KIM
uagcccaaggcg

SEQ ID NO: 4199283 - RNA, 16 nt, Yersinia pestis KIM
uagcccaaggcgacuu

SEQ ID NO: 4199284 - RNA, 24 nt, Yersinia pestis KIM
uagcccacuggaggaacugagucu

SEQ ID NO: 4199285 - RNA, 12 nt, Yersinia pestis KIM
uagcccagugcg

SEQ ID NO: 4199286 - RNA, 18 nt, Yersinia pestis KIM
uagcccaucuuaugcaug

SEQ ID NO: 4199287 - RNA, 21 nt, Yersinia pestis KIM
uagcccaucuuaugcauguuc

SEQ ID NO: 4199288 - RNA, 21 nt, Yersinia pestis KIM
uagccccggcaaguugaucac

SEQ ID NO: 4199289 - RNA, 23 nt, Yersinia pestis KIM
uagcccuucagcaaaugauugca

SEQ ID NO: 4199290 - RNA, 23 nt, Yersinia pestis KIM
uagcccuucccccaaguaaaaaa

SEQ ID NO: 4199291 - RNA, 20 nt, Yersinia pestis KIM
uagccgcaggcgaugcaagg

SEQ ID NO: 4199292 - RNA, 19 nt, Yersinia pestis KIM
uagccugcaccucaucaac

SEQ ID NO: 4199293 - RNA, 21 nt, Yersinia pestis KIM
uagcgaaauaucaggaugaac

SEQ ID NO: 4199294 - RNA, 17 nt, Yersinia pestis KIM
uagcgacacccucagag

SEQ ID NO: 4199295 - RNA, 13 nt, Yersinia pestis KIM
uagcgagaaaguc

SEQ ID NO: 4199296 - RNA, 12 nt, Yersinia pestis KIM
uagcgauaacag

SEQ ID NO: 4199297 - RNA, 13 nt, Yersinia pestis KIM
uaguuuuucuccu

SEQ ID NO: 4199298 - RNA, 11 nt, Yersinia pestis KIM
uauaaaaauag

SEQ ID NO: 4199299 - RNA, 18 nt, Yersinia pestis KIM
uauaaaaccacugaccua

SEQ ID NO: 4199300 - RNA, 21 nt, Yersinia pestis KIM
uauaaaagcacagacaaacaa

SEQ ID NO: 4199301 - RNA, 24 nt, Yersinia pestis KIM
uauaaacacugauuuauaaauaau

SEQ ID NO: 4199302 - RNA, 23 nt, Yersinia pestis KIM
uauaaacacuuaccuauaaacau

SEQ ID NO: 4199303 - RNA, 18 nt, Yersinia pestis KIM
uauaaacauuuacuuaua

SEQ ID NO: 4199304 - RNA, 20 nt, Yersinia pestis KIM
uauaaacauuuacuuauaaa

SEQ ID NO: 4199305 - RNA, 18 nt, Yersinia pestis KIM
uauaaaccagccagugau

SEQ ID NO: 4199306 - RNA, 15 nt, Yersinia pestis KIM
uauaaacuugauuca

SEQ ID NO: 4199307 - RNA, 23 nt, Yersinia pestis KIM
uauaaagcauuuaucauauuaac

SEQ ID NO: 4199308 - RNA, 18 nt, Yersinia pestis KIM
uauaaauaauuaucgaua

SEQ ID NO: 4199309 - RNA, 12 nt, Yersinia pestis KIM
uauaaauuaaaa

SEQ ID NO: 4199310 - RNA, 22 nt, Yersinia pestis KIM
uauaaauuacucguauaaaaaa

SEQ ID NO: 4199311 - RNA, 17 nt, Yersinia pestis KIM
uauaacaaguuacauuu

SEQ ID NO: 4199312 - RNA, 21 nt, Yersinia pestis KIM
uauaacaauguuuauccgcua

SEQ ID NO: 4199313 - RNA, 12 nt, Yersinia pestis KIM
uauaacauaaua

SEQ ID NO: 4199314 - RNA, 19 nt, Yersinia pestis KIM
uauaacauaauaaauuaau

SEQ ID NO: 4199315 - RNA, 21 nt, Yersinia pestis KIM
uauaacauaauaaauuaauag

SEQ ID NO: 4199316 - RNA, 17 nt, Yersinia pestis KIM
uauaaccauuuuaauau

SEQ ID NO: 4199317 - RNA, 18 nt, Yersinia pestis KIM
uauaaccgucaccaaaau

SEQ ID NO: 4199318 - RNA, 18 nt, Yersinia pestis KIM
uauaacgaauauucaaga

SEQ ID NO: 4199319 - RNA, 21 nt, Yersinia pestis KIM
uauaacgcccggcaauaauag

SEQ ID NO: 4199320 - RNA, 15 nt, Yersinia pestis KIM
uauaagcaauaccga

SEQ ID NO: 4199321 - RNA, 16 nt, Yersinia pestis KIM
uauaagcgcucaaaua

SEQ ID NO: 4199322 - RNA, 16 nt, Yersinia pestis KIM
uauaaggagagauuag

SEQ ID NO: 4199323 - RNA, 22 nt, Yersinia pestis KIM
uauaauagcuggcggauaaaaa

SEQ ID NO: 4199324 - RNA, 23 nt, Yersinia pestis KIM
uauaauagcuggcggauaaaaau

SEQ ID NO: 4199325 - RNA, 22 nt, Yersinia pestis KIM
uauaauccaaaaagcgcugcaa

SEQ ID NO: 4199326 - RNA, 14 nt, Yersinia pestis KIM
uauaauccaaaaua

SEQ ID NO: 4199327 - RNA, 22 nt, Yersinia pestis KIM
uauaaugaugagguaauacuca

SEQ ID NO: 4199328 - RNA, 13 nt, Yersinia pestis KIM
uauaauuauugaa

SEQ ID NO: 4199329 - RNA, 15 nt, Yersinia pestis KIM
uauaauuauuucucu

SEQ ID NO: 4199330 - RNA, 13 nt, Yersinia pestis KIM
uauaauucauuuu

SEQ ID NO: 4199331 - RNA, 23 nt, Yersinia pestis KIM
uauaauugaagauuuaaauaaca

SEQ ID NO: 4199332 - RNA, 13 nt, Yersinia pestis KIM
uauaauuucaaga

SEQ ID NO: 4199333 - RNA, 14 nt, Yersinia pestis KIM
uauaauuucucuca

SEQ ID NO: 4199334 - RNA, 19 nt, Yersinia pestis KIM
uauacaaggcacaucucca

SEQ ID NO: 4199335 - RNA, 22 nt, Yersinia pestis KIM
uauacaauugccugauuuuuau

SEQ ID NO: 4199336 - RNA, 14 nt, Yersinia pestis KIM
uauacaccccauca

SEQ ID NO: 4199337 - RNA, 21 nt, Yersinia pestis KIM
uauacagucaauugagaauaa

SEQ ID NO: 4199338 - RNA, 14 nt, Yersinia pestis KIM
uauacauaccacuu

SEQ ID NO: 4199339 - RNA, 14 nt, Yersinia pestis KIM
uauacccaccagag

SEQ ID NO: 4199340 - RNA, 16 nt, Yersinia pestis KIM
uauacccaccagagac

SEQ ID NO: 4199341 - RNA, 21 nt, Yersinia pestis KIM
uauacccagcaucauaagacu

SEQ ID NO: 4199342 - RNA, 15 nt, Yersinia pestis KIM
uauacccgucauaaa

SEQ ID NO: 4199343 - RNA, 15 nt, Yersinia pestis KIM
uauaccgauuaccgg

SEQ ID NO: 4199344 - RNA, 16 nt, Yersinia pestis KIM
uauaccggggccauca

SEQ ID NO: 4199345 - RNA, 16 nt, Yersinia pestis KIM
uauacggacaaugcca

SEQ ID NO: 4199346 - RNA, 19 nt, Yersinia pestis KIM
uauacggcggcuacuggua

SEQ ID NO: 4199347 - RNA, 14 nt, Yersinia pestis KIM
uauacggcuauuuu

SEQ ID NO: 4199348 - RNA, 13 nt, Yersinia pestis KIM
uauacuaaaacag

SEQ ID NO: 4199349 - RNA, 17 nt, Yersinia pestis KIM
uauacuaaaacagcuca

SEQ ID NO: 4199350 - RNA, 15 nt, Yersinia pestis KIM
uauacuaaagaaaua

SEQ ID NO: 4199351 - RNA, 13 nt, Yersinia pestis KIM
uauacuaaauaga

SEQ ID NO: 4199352 - RNA, 19 nt, Yersinia pestis KIM
uauacuaugggauaaacuu

SEQ ID NO: 4199353 - RNA, 21 nt, Yersinia pestis KIM
uauacuguuaacucgccaaca

SEQ ID NO: 4199354 - RNA, 17 nt, Yersinia pestis KIM
uauagaauucauucaga

SEQ ID NO: 4199355 - RNA, 23 nt, Yersinia pestis KIM
uauagacaccuucccuauucaaa

SEQ ID NO: 4199356 - RNA, 20 nt, Yersinia pestis KIM
uauagacuguuuuauuauau

SEQ ID NO: 4199357 - RNA, 13 nt, Yersinia pestis KIM
uauagagaaaucu

SEQ ID NO: 4199358 - RNA, 14 nt, Yersinia pestis KIM
uauagagaaaucua

SEQ ID NO: 4199359 - RNA, 20 nt, Yersinia pestis KIM
uauagcgguaaccgacauca

SEQ ID NO: 4199360 - RNA, 12 nt, Yersinia pestis KIM
uauagcguucau

SEQ ID NO: 4199361 - RNA, 17 nt, Yersinia pestis KIM
uauaggguuguguggua

SEQ ID NO: 4199362 - RNA, 15 nt, Yersinia pestis KIM
uauagguuauaagcc

SEQ ID NO: 4199363 - RNA, 22 nt, Yersinia pestis KIM
uauaguuuauuuuauuuaauca

SEQ ID NO: 4199364 - RNA, 12 nt, Yersinia pestis KIM
uauauaaaugau

SEQ ID NO: 4199365 - RNA, 13 nt, Yersinia pestis KIM
uauauaaauggcu

SEQ ID NO: 4199366 - RNA, 21 nt, Yersinia pestis KIM
uauauaaauggcuguuauaua

SEQ ID NO: 4199367 - RNA, 15 nt, Yersinia pestis KIM
uauauaagagaugaa

SEQ ID NO: 4199368 - RNA, 20 nt, Yersinia pestis KIM
uauauacccgucauaaauaa

SEQ ID NO: 4199369 - RNA, 17 nt, Yersinia pestis KIM
uauauagagaaaucuac

SEQ ID NO: 4199370 - RNA, 13 nt, Yersinia pestis KIM
uauauauuuugaa

SEQ ID NO: 4199371 - RNA, 16 nt, Yersinia pestis KIM
uauauauuuugaauau

SEQ ID NO: 4199372 - RNA, 15 nt, Yersinia pestis KIM
uauaucaaggcggca

SEQ ID NO: 4199373 - RNA, 12 nt, Yersinia pestis KIM
uauaucacuauu

SEQ ID NO: 4199374 - RNA, 17 nt, Yersinia pestis KIM
uauaucacuauuucaga

SEQ ID NO: 4199375 - RNA, 17 nt, Yersinia pestis KIM
uauaucacuucugcugu

SEQ ID NO: 4199376 - RNA, 19 nt, Yersinia pestis KIM
uauaucccaauaauagcua

SEQ ID NO: 4199377 - RNA, 13 nt, Yersinia pestis KIM
uauaucuauauug

SEQ ID NO: 4199378 - RNA, 16 nt, Yersinia pestis KIM
uauaugaucagugggg

SEQ ID NO: 4199379 - RNA, 21 nt, Yersinia pestis KIM
uauaugcgcuggcucuauuuu

SEQ ID NO: 4199380 - RNA, 15 nt, Yersinia pestis KIM
uauauuaucauucaa

SEQ ID NO: 4199381 - RNA, 15 nt, Yersinia pestis KIM
uauauucaauaucac

SEQ ID NO: 4199382 - RNA, 18 nt, Yersinia pestis KIM
uauauucaauaucacuga

SEQ ID NO: 4199383 - RNA, 18 nt, Yersinia pestis KIM
uauauucaauugaaauaa

SEQ ID NO: 4199384 - RNA, 23 nt, Yersinia pestis KIM
uauauugccaucgggcaauugaa

SEQ ID NO: 4199385 - RNA, 19 nt, Yersinia pestis KIM
uauauuuacgcauaaugag

SEQ ID NO: 4199386 - RNA, 14 nt, Yersinia pestis KIM
uauauuucaagcua

SEQ ID NO: 4199387 - RNA, 17 nt, Yersinia pestis KIM
uauauuuggcuuucagc

SEQ ID NO: 4199388 - RNA, 21 nt, Yersinia pestis KIM
uauauuuugaauauuuuuaau

SEQ ID NO: 4199389 - RNA, 22 nt, Yersinia pestis KIM
uauauuuugaauauuuuuaauc

SEQ ID NO: 4199390 - RNA, 13 nt, Yersinia pestis KIM
uauauuuugagau

SEQ ID NO: 4199391 - RNA, 12 nt, Yersinia pestis KIM
uaucaaaacuga

SEQ ID NO: 4199392 - RNA, 13 nt, Yersinia pestis KIM
uaucaaaacugau

SEQ ID NO: 4199393 - RNA, 14 nt, Yersinia pestis KIM
uaucaaaaggauaa

SEQ ID NO: 4199394 - RNA, 15 nt, Yersinia pestis KIM
uaucaaaauaaaaau

SEQ ID NO: 4199395 - RNA, 19 nt, Yersinia pestis KIM
uaucaaagugcuuaaccca

SEQ ID NO: 4199396 - RNA, 11 nt, Yersinia pestis KIM
uaucaacagaa

SEQ ID NO: 4199397 - RNA, 14 nt, Yersinia pestis KIM
uaucaacagaacua

SEQ ID NO: 4199398 - RNA, 14 nt, Yersinia pestis KIM
uaucaacgauguaa

SEQ ID NO: 4199399 - RNA, 20 nt, Yersinia pestis KIM
uaucaacgauguaaacgaau

SEQ ID NO: 4199400 - RNA, 22 nt, Yersinia pestis KIM
uaucaacguagcugaauugcuu

SEQ ID NO: 4199401 - RNA, 18 nt, Yersinia pestis KIM
uaucaaggcggcagagcc

SEQ ID NO: 4199402 - RNA, 16 nt, Yersinia pestis KIM
uaucaauaagugcaaa

SEQ ID NO: 4199403 - RNA, 19 nt, Yersinia pestis KIM
uaucaaucaaaaaauaaau

SEQ ID NO: 4199404 - RNA, 24 nt, Yersinia pestis KIM
uaucaaucagcugauaugaaaaau

SEQ ID NO: 4199405 - RNA, 16 nt, Yersinia pestis KIM
uaucaauugcuggcua

SEQ ID NO: 4199406 - RNA, 18 nt, Yersinia pestis KIM
uaucaccccguuacggcu

SEQ ID NO: 4199407 - RNA, 18 nt, Yersinia pestis KIM
uaucaccguaaacauuga

SEQ ID NO: 4199408 - RNA, 17 nt, Yersinia pestis KIM
uaucacuauaauuauuu

SEQ ID NO: 4199409 - RNA, 19 nt, Yersinia pestis KIM
uaucacucgggauaugacu

SEQ ID NO: 4199410 - RNA, 21 nt, Yersinia pestis KIM
uaucagaaacaauaaauaucc

SEQ ID NO: 4199411 - RNA, 14 nt, Yersinia pestis KIM
uaucagaaauacgc

SEQ ID NO: 4199412 - RNA, 14 nt, Yersinia pestis KIM
uaugccauuaucuu

SEQ ID NO: 4199413 - RNA, 22 nt, Yersinia pestis KIM
uaugcccccagguuucagucaa

SEQ ID NO: 4199414 - RNA, 20 nt, Yersinia pestis KIM
uaugccuuggcaaagagacu

SEQ ID NO: 4199415 - RNA, 16 nt, Yersinia pestis KIM
uaugccuuuucuuccg

SEQ ID NO: 4199416 - RNA, 15 nt, Yersinia pestis KIM
uaugcgcuggcucua

SEQ ID NO: 4199417 - RNA, 13 nt, Yersinia pestis KIM
uaugcguggguuc

SEQ ID NO: 4199418 - RNA, 17 nt, Yersinia pestis KIM
uaugcuguauaaaagaa

SEQ ID NO: 4199419 - RNA, 14 nt, Yersinia pestis KIM
uaugcugugguuca

SEQ ID NO: 4199420 - RNA, 16 nt, Yersinia pestis KIM
uaugcuucacaucaua

SEQ ID NO: 4199421 - RNA, 14 nt, Yersinia pestis KIM
uauggauaaauccu

SEQ ID NO: 4199422 - RNA, 17 nt, Yersinia pestis KIM
uauggaugguguagcau

SEQ ID NO: 4199423 - RNA, 13 nt, Yersinia pestis KIM
uauggaugugauc

SEQ ID NO: 4199424 - RNA, 12 nt, Yersinia pestis KIM
uauggauuggca

SEQ ID NO: 4199425 - RNA, 22 nt, Yersinia pestis KIM
uauggcauaaacugaaguuaaa

SEQ ID NO: 4199426 - RNA, 13 nt, Yersinia pestis KIM
uauggcgaagaga

SEQ ID NO: 4199427 - RNA, 22 nt, Yersinia pestis KIM
uaugggggauggccgggcuguc

SEQ ID NO: 4199428 - RNA, 16 nt, Yersinia pestis KIM
uaugguuaaucuaccc

SEQ ID NO: 4199429 - RNA, 23 nt, Yersinia pestis KIM
uauguaaauaguuacuauauaaa

SEQ ID NO: 4199430 - RNA, 16 nt, Yersinia pestis KIM
uauguaacacauauuu

SEQ ID NO: 4199431 - RNA, 13 nt, Yersinia pestis KIM
uauguaaugccac

SEQ ID NO: 4199432 - RNA, 14 nt, Yersinia pestis KIM
uauguaaugccaca

SEQ ID NO: 4199433 - RNA, 20 nt, Yersinia pestis KIM
uauguaaugccacacucaga

SEQ ID NO: 4199434 - RNA, 13 nt, Yersinia pestis KIM
uaugucgucgcau

SEQ ID NO: 4199435 - RNA, 15 nt, Yersinia pestis KIM
uaugugccaaaaaaa

SEQ ID NO: 4199436 - RNA, 13 nt, Yersinia pestis KIM
uauguuaaaucag

SEQ ID NO: 4199437 - RNA, 13 nt, Yersinia pestis KIM
uauguuccaucag

SEQ ID NO: 4199438 - RNA, 14 nt, Yersinia pestis KIM
uauguugcacugac

SEQ ID NO: 4199439 - RNA, 19 nt, Yersinia pestis KIM
uauguuguucgaaaauaga

SEQ ID NO: 4199440 - RNA, 22 nt, Yersinia pestis KIM
uauuaaacagauucaauauuua

SEQ ID NO: 4199441 - RNA, 22 nt, Yersinia pestis KIM
uauuaaacgggccgcgcagauu

SEQ ID NO: 4199442 - RNA, 18 nt, Yersinia pestis KIM
uauuaacugcagugaaaa

SEQ ID NO: 4199443 - RNA, 22 nt, Yersinia pestis KIM
uauuaauaggaggguguuuuuu

SEQ ID NO: 4199444 - RNA, 17 nt, Yersinia pestis KIM
uauuaaucuauuaauau

SEQ ID NO: 4199445 - RNA, 23 nt, Yersinia pestis KIM
uauuaauggugaacaaagagcau

SEQ ID NO: 4199446 - RNA, 19 nt, Yersinia pestis KIM
uauuacgcagccauaccca

SEQ ID NO: 4199447 - RNA, 21 nt, Yersinia pestis KIM
uauuacuacaaacgcguuaau

SEQ ID NO: 4199448 - RNA, 14 nt, Yersinia pestis KIM
uauuacuaucgaaa

SEQ ID NO: 4199449 - RNA, 15 nt, Yersinia pestis KIM
uauuacugucauugc

SEQ ID NO: 4199450 - RNA, 22 nt, Yersinia pestis KIM
uauuagaauguguaguugaagu

SEQ ID NO: 4199451 - RNA, 18 nt, Yersinia pestis KIM
uauuagccaaauacccua

SEQ ID NO: 4199452 - RNA, 21 nt, Yersinia pestis KIM
uauuagccgccagucauucac

SEQ ID NO: 4199453 - RNA, 20 nt, Yersinia pestis KIM
uauuagcgcugcucaaucac

SEQ ID NO: 4199454 - RNA, 20 nt, Yersinia pestis KIM
uauuaguuaacccuauuuuu

SEQ ID NO: 4199455 - RNA, 12 nt, Yersinia pestis KIM
uauuauaaauuu

SEQ ID NO: 4199456 - RNA, 13 nt, Yersinia pestis KIM
uauuauauucaau

SEQ ID NO: 4199457 - RNA, 15 nt, Yersinia pestis KIM
uauuauauucaauug

SEQ ID NO: 4199458 - RNA, 13 nt, Yersinia pestis KIM
uauuaucaauggc

SEQ ID NO: 4199459 - RNA, 12 nt, Yersinia pestis KIM
uauuaucaucac

SEQ ID NO: 4199460 - RNA, 16 nt, Yersinia pestis KIM
uauuaucaucaccauc

SEQ ID NO: 4199461 - RNA, 21 nt, Yersinia pestis KIM
uauuaucaucaccaucagaca

SEQ ID NO: 4199462 - RNA, 14 nt, Yersinia pestis KIM
uauuaucaucuuuc

SEQ ID NO: 4199463 - RNA, 22 nt, Yersinia pestis KIM
uauuaucgggaacguagccaau

SEQ ID NO: 4199464 - RNA, 17 nt, Yersinia pestis KIM
uauuaucugguuggcau

SEQ ID NO: 4199465 - RNA, 16 nt, Yersinia pestis KIM
uauuaugguuauaugc

SEQ ID NO: 4199466 - RNA, 23 nt, Yersinia pestis KIM
uauuauguaaauaguuacuauau

SEQ ID NO: 4199467 - RNA, 24 nt, Yersinia pestis KIM
uauuauguaaauaguuacuauaua

SEQ ID NO: 4199468 - RNA, 14 nt, Yersinia pestis KIM
uauuauguauuuuu

SEQ ID NO: 4199469 - RNA, 16 nt, Yersinia pestis KIM
uauuauuaaauuuuau

SEQ ID NO: 4199470 - RNA, 15 nt, Yersinia pestis KIM
uauuauucucaaccg

SEQ ID NO: 4199471 - RNA, 18 nt, Yersinia pestis KIM
uauucaaacggugugcaa

SEQ ID NO: 4199472 - RNA, 22 nt, Yersinia pestis KIM
uauucaaacggugugcaaugca

SEQ ID NO: 4199473 - RNA, 13 nt, Yersinia pestis KIM
uauucaagugcuc

SEQ ID NO: 4199474 - RNA, 21 nt, Yersinia pestis KIM
uauucaaugacuccugaaaua

SEQ ID NO: 4199475 - RNA, 14 nt, Yersinia pestis KIM
uauucaauugaaau

SEQ ID NO: 4199476 - RNA, 21 nt, Yersinia pestis KIM
uauucacagcagaacaaaaca

SEQ ID NO: 4199477 - RNA, 22 nt, Yersinia pestis KIM
uauucagcaacucgguuuuaau

SEQ ID NO: 4199478 - RNA, 17 nt, Yersinia pestis KIM
uauucagcagcauuucu

SEQ ID NO: 4199479 - RNA, 20 nt, Yersinia pestis KIM
uauucagccgccagccauua

SEQ ID NO: 4199480 - RNA, 16 nt, Yersinia pestis KIM
uauucaguaaaaacug

SEQ ID NO: 4199481 - RNA, 20 nt, Yersinia pestis KIM
uauucauauugaauuaaauu

SEQ ID NO: 4199482 - RNA, 17 nt, Yersinia pestis KIM
uauucauauuucacugu

SEQ ID NO: 4199483 - RNA, 18 nt, Yersinia pestis KIM
uauucauauuucacuguu

SEQ ID NO: 4199484 - RNA, 20 nt, Yersinia pestis KIM
uauucauuaaaaaauaauuu

SEQ ID NO: 4199485 - RNA, 11 nt, Yersinia pestis KIM
uauucauuaga

SEQ ID NO: 4199486 - RNA, 21 nt, Yersinia pestis KIM
uauucccagccaacuccuuga

SEQ ID NO: 4199487 - RNA, 19 nt, Yersinia pestis KIM
uauuccgagcaaucaaaag

SEQ ID NO: 4199488 - RNA, 19 nt, Yersinia pestis KIM
uauuccggggguggcugcc

SEQ ID NO: 4199489 - RNA, 16 nt, Yersinia pestis KIM
uauuccgucgauaucu

SEQ ID NO: 4199490 - RNA, 12 nt, Yersinia pestis KIM
uauuccuaauua

SEQ ID NO: 4199491 - RNA, 16 nt, Yersinia pestis KIM
uauuccucucugucug

SEQ ID NO: 4199492 - RNA, 23 nt, Yersinia pestis KIM
uauucgccccguucacacgauuc

SEQ ID NO: 4199493 - RNA, 15 nt, Yersinia pestis KIM
uauucgcguuucauu

SEQ ID NO: 4199494 - RNA, 18 nt, Yersinia pestis KIM
uauucgggcaacuaauuc

SEQ ID NO: 4199495 - RNA, 14 nt, Yersinia pestis KIM
uauucgucaccauc

SEQ ID NO: 4199496 - RNA, 15 nt, Yersinia pestis KIM
uauucgucauucguu

SEQ ID NO: 4199497 - RNA, 20 nt, Yersinia pestis KIM
uauucuaauugauauuauuu

SEQ ID NO: 4199498 - RNA, 23 nt, Yersinia pestis KIM
uauucuaauugauauuauuuaua

SEQ ID NO: 4199499 - RNA, 14 nt, Yersinia pestis KIM
uauucuaggcauga

SEQ ID NO: 4199500 - RNA, 15 nt, Yersinia pestis KIM
uauucuauugaggac

SEQ ID NO: 4199501 - RNA, 16 nt, Yersinia pestis KIM
uauucucaaccgcugg

SEQ ID NO: 4199502 - RNA, 16 nt, Yersinia pestis KIM
uauucuccaacaacug

SEQ ID NO: 4199503 - RNA, 21 nt, Yersinia pestis KIM
uauucucgccccgugcuacuc

SEQ ID NO: 4199504 - RNA, 18 nt, Yersinia pestis KIM
uauucugauggugucaac

SEQ ID NO: 4199505 - RNA, 14 nt, Yersinia pestis KIM
uauucugccuaucc

SEQ ID NO: 4199506 - RNA, 22 nt, Yersinia pestis KIM
uauucugcuuccaggauauuca

SEQ ID NO: 4199507 - RNA, 15 nt, Yersinia pestis KIM
uauucuuagccagug

SEQ ID NO: 4199508 - RNA, 18 nt, Yersinia pestis KIM
uauucuuaucaaucaaaa

SEQ ID NO: 4199509 - RNA, 13 nt, Yersinia pestis KIM
uauugaacauuca

SEQ ID NO: 4199510 - RNA, 23 nt, Yersinia pestis KIM
uauugaaccuacccuuauucuua

SEQ ID NO: 4199511 - RNA, 18 nt, Yersinia pestis KIM
uauugaagcuguuuccug

SEQ ID NO: 4199512 - RNA, 21 nt, Yersinia pestis KIM
uauugaauuaaauuuuauauu

SEQ ID NO: 4199513 - RNA, 15 nt, Yersinia pestis KIM
uauugacaaagugcc

SEQ ID NO: 4199514 - RNA, 21 nt, Yersinia pestis KIM
uauugaccaauauaaaagcca

SEQ ID NO: 4199515 - RNA, 18 nt, Yersinia pestis KIM
uauugacccucuuaauga

SEQ ID NO: 4199516 - RNA, 16 nt, Yersinia pestis KIM
uauugagagcaggcgc

SEQ ID NO: 4199517 - RNA, 16 nt, Yersinia pestis KIM
uauugaggacaauuca

SEQ ID NO: 4199518 - RNA, 21 nt, Yersinia pestis KIM
uauugauaaaaauauccagca

SEQ ID NO: 4199519 - RNA, 16 nt, Yersinia pestis KIM
uauugauaaaaccacu

SEQ ID NO: 4199520 - RNA, 16 nt, Yersinia pestis KIM
uauugauaaaaccgcu

SEQ ID NO: 4199521 - RNA, 13 nt, Yersinia pestis KIM
uauugauagccac

SEQ ID NO: 4199522 - RNA, 19 nt, Yersinia pestis KIM
uauugauagccacaucauu

SEQ ID NO: 4199523 - RNA, 15 nt, Yersinia pestis KIM
uauugaucacaguaa

SEQ ID NO: 4199524 - RNA, 21 nt, Yersinia pestis KIM
uauugaucuuuaauauugcau

SEQ ID NO: 4199525 - RNA, 19 nt, Yersinia pestis KIM
uauugaugacgcuaaccac

SEQ ID NO: 4199526 - RNA, 19 nt, Yersinia pestis KIM
uauugaugggggauauuca

SEQ ID NO: 4199527 - RNA, 17 nt, Yersinia pestis KIM
ucaaacggugugcaaug

SEQ ID NO: 4199528 - RNA, 15 nt, Yersinia pestis KIM
ucaaacucagcauca

SEQ ID NO: 4199529 - RNA, 17 nt, Yersinia pestis KIM
ucaaacugauaaagcaa

SEQ ID NO: 4199530 - RNA, 17 nt, Yersinia pestis KIM
ucaaagaaaaaucgcca

SEQ ID NO: 4199531 - RNA, 14 nt, Yersinia pestis KIM
ucaaagaauaacug

SEQ ID NO: 4199532 - RNA, 16 nt, Yersinia pestis KIM
ucaaagaccacaucaa

SEQ ID NO: 4199533 - RNA, 19 nt, Yersinia pestis KIM
ucaaagacuaaccucugca

SEQ ID NO: 4199534 - RNA, 20 nt, Yersinia pestis KIM
ucaaauacggcaccaauggc

SEQ ID NO: 4199535 - RNA, 21 nt, Yersinia pestis KIM
ucaaauacggcaccaauggcu

SEQ ID NO: 4199536 - RNA, 22 nt, Yersinia pestis KIM
ucaaaucagaggcuucauucgu

SEQ ID NO: 4199537 - RNA, 16 nt, Yersinia pestis KIM
ucaaaucaguuccuga

SEQ ID NO: 4199538 - RNA, 16 nt, Yersinia pestis KIM
ucaaaucgccaaacug

SEQ ID NO: 4199539 - RNA, 14 nt, Yersinia pestis KIM
ucaaaugauucagu

SEQ ID NO: 4199540 - RNA, 22 nt, Yersinia pestis KIM
ucaaauugcacaugcagcauuu

SEQ ID NO: 4199541 - RNA, 15 nt, Yersinia pestis KIM
ucaacaaacaguuca

SEQ ID NO: 4199542 - RNA, 12 nt, Yersinia pestis KIM
ucaacaagaaau

SEQ ID NO: 4199543 - RNA, 15 nt, Yersinia pestis KIM
ucaacaaucaaucac

SEQ ID NO: 4199544 - RNA, 14 nt, Yersinia pestis KIM
ucaacacauaaaau

SEQ ID NO: 4199545 - RNA, 19 nt, Yersinia pestis KIM
ucaacacugccugaugcua

SEQ ID NO: 4199546 - RNA, 22 nt, Yersinia pestis KIM
ucaacagauaugcauuauugau

SEQ ID NO: 4199547 - RNA, 18 nt, Yersinia pestis KIM
ucaacagcaucaucaaau

SEQ ID NO: 4199548 - RNA, 14 nt, Yersinia pestis KIM
ucaacaucgcaccg

SEQ ID NO: 4199549 - RNA, 17 nt, Yersinia pestis KIM
ucaacaucgcaccgaug

SEQ ID NO: 4199550 - RNA, 11 nt, Yersinia pestis KIM
ucaacaugacg

SEQ ID NO: 4199551 - RNA, 15 nt, Yersinia pestis KIM
ucaaccaagacauaa

SEQ ID NO: 4199552 - RNA, 16 nt, Yersinia pestis KIM
ucaaccucuuguaaac

SEQ ID NO: 4199553 - RNA, 11 nt, Yersinia pestis KIM
ucaaccugaau

SEQ ID NO: 4199554 - RNA, 17 nt, Yersinia pestis KIM
ucaaccugaucaucaaa

SEQ ID NO: 4199555 - RNA, 13 nt, Yersinia pestis KIM
ucaaccuuuuccg

SEQ ID NO: 4199556 - RNA, 21 nt, Yersinia pestis KIM
ucaacgacagcagcaggccau

SEQ ID NO: 4199557 - RNA, 15 nt, Yersinia pestis KIM
ucaacgaccaguaag

SEQ ID NO: 4199558 - RNA, 18 nt, Yersinia pestis KIM
ucaacgcaccauccagca

SEQ ID NO: 4199559 - RNA, 19 nt, Yersinia pestis KIM
ucaacgcaccauccagcaa

SEQ ID NO: 4199560 - RNA, 14 nt, Yersinia pestis KIM
ucaacgccaaaaua

SEQ ID NO: 4199561 - RNA, 17 nt, Yersinia pestis KIM
ucaacgccaaaauaacc

SEQ ID NO: 4199562 - RNA, 20 nt, Yersinia pestis KIM
ucaacgccauagcaaaucac

SEQ ID NO: 4199563 - RNA, 18 nt, Yersinia pestis KIM
ucaacgcccagcuuuagc

SEQ ID NO: 4199564 - RNA, 22 nt, Yersinia pestis KIM
ucaacgcccagcuuuuuacgca

SEQ ID NO: 4199565 - RNA, 22 nt, Yersinia pestis KIM
ucaacgcccgcggccaauagca

SEQ ID NO: 4199566 - RNA, 21 nt, Yersinia pestis KIM
ucaacgcgaauaucaggcacu

SEQ ID NO: 4199567 - RNA, 15 nt, Yersinia pestis KIM
ucaacgcucaaucac

SEQ ID NO: 4199568 - RNA, 20 nt, Yersinia pestis KIM
ucaacggguaauuuacugac

SEQ ID NO: 4199569 - RNA, 22 nt, Yersinia pestis KIM
ucaacuaccccacauucaguac

SEQ ID NO: 4199570 - RNA, 18 nt, Yersinia pestis KIM
ucaacuauugcaucuuua

SEQ ID NO: 4199571 - RNA, 14 nt, Yersinia pestis KIM
ucaacucaaaacaa

SEQ ID NO: 4199572 - RNA, 16 nt, Yersinia pestis KIM
ucaacucaaaacaauu

SEQ ID NO: 4199573 - RNA, 18 nt, Yersinia pestis KIM
ucaacucgagcauuugac

SEQ ID NO: 4199574 - RNA, 15 nt, Yersinia pestis KIM
ucaacugcucaacgc

SEQ ID NO: 4199575 - RNA, 17 nt, Yersinia pestis KIM
ucaacugcucaacugcu

SEQ ID NO: 4199576 - RNA, 18 nt, Yersinia pestis KIM
ucaacugcucaacugcuc

SEQ ID NO: 4199577 - RNA, 19 nt, Yersinia pestis KIM
ucaacugcucaacugcuca

SEQ ID NO: 4199578 - RNA, 14 nt, Yersinia pestis KIM
ucaacuuaauuuac

SEQ ID NO: 4199579 - RNA, 12 nt, Yersinia pestis KIM
ucaacuucaacg

SEQ ID NO: 4199580 - RNA, 21 nt, Yersinia pestis KIM
ucaacuuuaauaugcaaaaaa

SEQ ID NO: 4199581 - RNA, 14 nt, Yersinia pestis KIM
ucaagaaauuuaaa

SEQ ID NO: 4199582 - RNA, 18 nt, Yersinia pestis KIM
ucaagaaauuuaaaaacc

SEQ ID NO: 4199583 - RNA, 19 nt, Yersinia pestis KIM
ucaagaaccgaaauaucau

SEQ ID NO: 4199584 - RNA, 13 nt, Yersinia pestis KIM
ucaagauaaaguu

SEQ ID NO: 4199585 - RNA, 19 nt, Yersinia pestis KIM
ucaagaucaaaagcagaga

SEQ ID NO: 4199586 - RNA, 15 nt, Yersinia pestis KIM
ucaagaucgcgucau

SEQ ID NO: 4199587 - RNA, 15 nt, Yersinia pestis KIM
ucaagaugcagggcg

SEQ ID NO: 4199588 - RNA, 19 nt, Yersinia pestis KIM
ucaagcaccucaagaaauu

SEQ ID NO: 4199589 - RNA, 21 nt, Yersinia pestis KIM
ucaagcauugucauggccuga

SEQ ID NO: 4199590 - RNA, 16 nt, Yersinia pestis KIM
ucaagccaacccccau

SEQ ID NO: 4199591 - RNA, 15 nt, Yersinia pestis KIM
ucaagccaccgcugg

SEQ ID NO: 4199592 - RNA, 14 nt, Yersinia pestis KIM
ucaagccaguaacu

SEQ ID NO: 4199593 - RNA, 20 nt, Yersinia pestis KIM
ucaagcccaguuuugcucug

SEQ ID NO: 4199594 - RNA, 17 nt, Yersinia pestis KIM
ucaagcccgaaauucag

SEQ ID NO: 4199595 - RNA, 17 nt, Yersinia pestis KIM
ucaagccgauaaucccu

SEQ ID NO: 4199596 - RNA, 18 nt, Yersinia pestis KIM
ucaagccgauaaucccug

SEQ ID NO: 4199597 - RNA, 17 nt, Yersinia pestis KIM
ucaagccguuguuggca

SEQ ID NO: 4199598 - RNA, 16 nt, Yersinia pestis KIM
ucaagccuaaucggua

SEQ ID NO: 4199599 - RNA, 15 nt, Yersinia pestis KIM
ucaagcguacaucag

SEQ ID NO: 4199600 - RNA, 22 nt, Yersinia pestis KIM
ucaagcuguuacugcccugauc

SEQ ID NO: 4199601 - RNA, 16 nt, Yersinia pestis KIM
ucaaggcuuuaauauc

SEQ ID NO: 4199602 - RNA, 17 nt, Yersinia pestis KIM
ucaaggcuuucuggcga

SEQ ID NO: 4199603 - RNA, 19 nt, Yersinia pestis KIM
ucaagguacccauuauucu

SEQ ID NO: 4199604 - RNA, 17 nt, Yersinia pestis KIM
ucaaggugacuauuuaa

SEQ ID NO: 4199605 - RNA, 18 nt, Yersinia pestis KIM
ucaaggugacuauuuaaa

SEQ ID NO: 4199606 - RNA, 18 nt, Yersinia pestis KIM
ucaagugcucacucggua

SEQ ID NO: 4199607 - RNA, 20 nt, Yersinia pestis KIM
ucaaguuagcaggcagcacg

SEQ ID NO: 4199608 - RNA, 13 nt, Yersinia pestis KIM
ucaaguucuaagg

SEQ ID NO: 4199609 - RNA, 16 nt, Yersinia pestis KIM
ucaauaaaacucacuu

SEQ ID NO: 4199610 - RNA, 17 nt, Yersinia pestis KIM
ucaauaaaacucacuug

SEQ ID NO: 4199611 - RNA, 22 nt, Yersinia pestis KIM
ucaauaaaaugggccugagugg

SEQ ID NO: 4199612 - RNA, 21 nt, Yersinia pestis KIM
ucaauaaacccacagacauuu

SEQ ID NO: 4199613 - RNA, 14 nt, Yersinia pestis KIM
ucaauaacaguugu

SEQ ID NO: 4199614 - RNA, 13 nt, Yersinia pestis KIM
ucaauaacauuac

SEQ ID NO: 4199615 - RNA, 15 nt, Yersinia pestis KIM
ucaauaacauuacca

SEQ ID NO: 4199616 - RNA, 19 nt, Yersinia pestis KIM
ucaauaaccucaaaaggau

SEQ ID NO: 4199617 - RNA, 18 nt, Yersinia pestis KIM
ucaauaaccucagccuca

SEQ ID NO: 4199618 - RNA, 19 nt, Yersinia pestis KIM
ucaauaaccucagccucau

SEQ ID NO: 4199619 - RNA, 23 nt, Yersinia pestis KIM
ucaauaaccucagccucauucau

SEQ ID NO: 4199620 - RNA, 22 nt, Yersinia pestis KIM
ucaauaaccucagggagccaau

SEQ ID NO: 4199621 - RNA, 16 nt, Yersinia pestis KIM
ucaauaaccucagggc

SEQ ID NO: 4199622 - RNA, 18 nt, Yersinia pestis KIM
ucaauaagaaugacuuuc

SEQ ID NO: 4199623 - RNA, 21 nt, Yersinia pestis KIM
ucaauaaguagccacuuaaua

SEQ ID NO: 4199624 - RNA, 23 nt, Yersinia pestis KIM
ucaauaaguagccacuuaauaau

SEQ ID NO: 4199625 - RNA, 13 nt, Yersinia pestis KIM
ucaauaauaaaau

SEQ ID NO: 4199626 - RNA, 14 nt, Yersinia pestis KIM
ucaauaauaaaauc

SEQ ID NO: 4199627 - RNA, 15 nt, Yersinia pestis KIM
ucaauaauaaaaucu

SEQ ID NO: 4199628 - RNA, 22 nt, Yersinia pestis KIM
ucaauaauaacgaauuucauuu

SEQ ID NO: 4199629 - RNA, 12 nt, Yersinia pestis KIM
ucaauaauauuu

SEQ ID NO: 4199630 - RNA, 14 nt, Yersinia pestis KIM
ucaauaauuucacu

SEQ ID NO: 4199631 - RNA, 15 nt, Yersinia pestis KIM
ucaauaauuucacua

SEQ ID NO: 4199632 - RNA, 16 nt, Yersinia pestis KIM
ucaauaccaaauuuac

SEQ ID NO: 4199633 - RNA, 21 nt, Yersinia pestis KIM
ucaauacccugccaccuuggc

SEQ ID NO: 4199634 - RNA, 19 nt, Yersinia pestis KIM
ucaauaccgcuuuuaccaa

SEQ ID NO: 4199635 - RNA, 19 nt, Yersinia pestis KIM
ucaauaccgugagaacgca

SEQ ID NO: 4199636 - RNA, 19 nt, Yersinia pestis KIM
ucaauaccuuacugcauca

SEQ ID NO: 4199637 - RNA, 20 nt, Yersinia pestis KIM
ucaauaccuuacugcaucaa

SEQ ID NO: 4199638 - RNA, 16 nt, Yersinia pestis KIM
ucaauacguuagucau

SEQ ID NO: 4199639 - RNA, 19 nt, Yersinia pestis KIM
ucaauagcauaaauaucag

SEQ ID NO: 4199640 - RNA, 22 nt, Yersinia pestis KIM
ucaauagcauaaauaucaguga

SEQ ID NO: 4199641 - RNA, 22 nt, Yersinia pestis KIM
ucaauagcguuaacgauauaau

SEQ ID NO: 4199642 - RNA, 18 nt, Yersinia pestis KIM
ucaccguaaccauuggca

SEQ ID NO: 4199643 - RNA, 24 nt, Yersinia pestis KIM
ucaccguagaacgucaccgccaaa

SEQ ID NO: 4199644 - RNA, 16 nt, Yersinia pestis KIM
ucaccguauacgcuga

SEQ ID NO: 4199645 - RNA, 14 nt, Yersinia pestis KIM
ucaccuaaaucaua

SEQ ID NO: 4199646 - RNA, 16 nt, Yersinia pestis KIM
ucaccuaaaucauaca

SEQ ID NO: 4199647 - RNA, 22 nt, Yersinia pestis KIM
ucaccuacuuuggguauccucu

SEQ ID NO: 4199648 - RNA, 18 nt, Yersinia pestis KIM
ucaccucaccagcaucuu

SEQ ID NO: 4199649 - RNA, 15 nt, Yersinia pestis KIM
ucaccuccacuucaa

SEQ ID NO: 4199650 - RNA, 16 nt, Yersinia pestis KIM
ucaccucccugcaaga

SEQ ID NO: 4199651 - RNA, 21 nt, Yersinia pestis KIM
ucaccucuucagguaagccuu

SEQ ID NO: 4199652 - RNA, 23 nt, Yersinia pestis KIM
ucaccucuugcauacucaggccc

SEQ ID NO: 4199653 - RNA, 18 nt, Yersinia pestis KIM
ucaccugaaugccauuca

SEQ ID NO: 4199654 - RNA, 15 nt, Yersinia pestis KIM
ucaccugagccaauc

SEQ ID NO: 4199655 - RNA, 15 nt, Yersinia pestis KIM
ucaccugaguaauau

SEQ ID NO: 4199656 - RNA, 14 nt, Yersinia pestis KIM
ucaccugcuuaguu

SEQ ID NO: 4199657 - RNA, 17 nt, Yersinia pestis KIM
ucaccuuccaaacuuug

SEQ ID NO: 4199658 - RNA, 17 nt, Yersinia pestis KIM
ucaccuuggaaaacagc

SEQ ID NO: 4199659 - RNA, 24 nt, Yersinia pestis KIM
ucaccuuugaucauggcuugugca

SEQ ID NO: 4199660 - RNA, 14 nt, Yersinia pestis KIM
ucacgacgcgaugc

SEQ ID NO: 4199661 - RNA, 18 nt, Yersinia pestis KIM
ucacgagggcuuaugcuu

SEQ ID NO: 4199662 - RNA, 14 nt, Yersinia pestis KIM
ucacgaucaaccau

SEQ ID NO: 4199663 - RNA, 15 nt, Yersinia pestis KIM
ucacgauggaaaaaa

SEQ ID NO: 4199664 - RNA, 12 nt, Yersinia pestis KIM
ucacgcaaaggg

SEQ ID NO: 4199665 - RNA, 14 nt, Yersinia pestis KIM
ucacgcacgguaca

SEQ ID NO: 4199666 - RNA, 23 nt, Yersinia pestis KIM
ucacgcagguaguuaguggcuuu

SEQ ID NO: 4199667 - RNA, 13 nt, Yersinia pestis KIM
ucacgccaccuuc

SEQ ID NO: 4199668 - RNA, 17 nt, Yersinia pestis KIM
ucacgcccuacugagaa

SEQ ID NO: 4199669 - RNA, 12 nt, Yersinia pestis KIM
ucacgccuaucu

SEQ ID NO: 4199670 - RNA, 18 nt, Yersinia pestis KIM
ucacgcggguuaucacau

SEQ ID NO: 4199671 - RNA, 17 nt, Yersinia pestis KIM
ucacgcucaucgguacc

SEQ ID NO: 4199672 - RNA, 17 nt, Yersinia pestis KIM
ucacgcucuugcucuuc

SEQ ID NO: 4199673 - RNA, 14 nt, Yersinia pestis KIM
ucacgcugaauaac

SEQ ID NO: 4199674 - RNA, 22 nt, Yersinia pestis KIM
ucacgcugguuaucacagcaaa

SEQ ID NO: 4199675 - RNA, 19 nt, Yersinia pestis KIM
ucacggaagguugccccca

SEQ ID NO: 4199676 - RNA, 19 nt, Yersinia pestis KIM
ucacggacagcaaccacuu

SEQ ID NO: 4199677 - RNA, 20 nt, Yersinia pestis KIM
ucacgggcuuccaucaggaa

SEQ ID NO: 4199678 - RNA, 17 nt, Yersinia pestis KIM
ucacgguucaccccuca

SEQ ID NO: 4199679 - RNA, 20 nt, Yersinia pestis KIM
ucacgucgauaguccuucgu

SEQ ID NO: 4199680 - RNA, 22 nt, Yersinia pestis KIM
ucacgucuucaccaaugauuaa

SEQ ID NO: 4199681 - RNA, 15 nt, Yersinia pestis KIM
ucacguuuuuccauu

SEQ ID NO: 4199682 - RNA, 16 nt, Yersinia pestis KIM
ucacuaaaacugaagc

SEQ ID NO: 4199683 - RNA, 18 nt, Yersinia pestis KIM
ucacuaaaucaaaaggaa

SEQ ID NO: 4199684 - RNA, 21 nt, Yersinia pestis KIM
ucacuaaauccaaaugcccau

SEQ ID NO: 4199685 - RNA, 13 nt, Yersinia pestis KIM
ucacuagcgggcc

SEQ ID NO: 4199686 - RNA, 18 nt, Yersinia pestis KIM
ucacuauaauuauuucuc

SEQ ID NO: 4199687 - RNA, 20 nt, Yersinia pestis KIM
ucacuauaauuauuucucug

SEQ ID NO: 4199688 - RNA, 12 nt, Yersinia pestis KIM
ucacuauaauuu

SEQ ID NO: 4199689 - RNA, 12 nt, Yersinia pestis KIM
ucacuauuucag

SEQ ID NO: 4199690 - RNA, 21 nt, Yersinia pestis KIM
ucacuauuucguguauaucac

SEQ ID NO: 4199691 - RNA, 19 nt, Yersinia pestis KIM
ucacucaagccaguaacua

SEQ ID NO: 4199692 - RNA, 20 nt, Yersinia pestis KIM
ucacucaauuggacuaaccc

SEQ ID NO: 4199693 - RNA, 16 nt, Yersinia pestis KIM
ucacucaccgccagca

SEQ ID NO: 4199694 - RNA, 16 nt, Yersinia pestis KIM
ucacucagcgcuggcg

SEQ ID NO: 4199695 - RNA, 21 nt, Yersinia pestis KIM
ucacuccuugaaguguuuaau

SEQ ID NO: 4199696 - RNA, 13 nt, Yersinia pestis KIM
ucacucgaugacg

SEQ ID NO: 4199697 - RNA, 21 nt, Yersinia pestis KIM
ucacucgcgugccguucaggu

SEQ ID NO: 4199698 - RNA, 16 nt, Yersinia pestis KIM
ucacucgggauaugac

SEQ ID NO: 4199699 - RNA, 18 nt, Yersinia pestis KIM
ucacucuucgcaaaauuu

SEQ ID NO: 4199700 - RNA, 17 nt, Yersinia pestis KIM
ucacugaguugcaggaa

SEQ ID NO: 4199701 - RNA, 20 nt, Yersinia pestis KIM
ucacugaugagcuggcaaaa

SEQ ID NO: 4199702 - RNA, 17 nt, Yersinia pestis KIM
ucacugcauacucacuu

SEQ ID NO: 4199703 - RNA, 16 nt, Yersinia pestis KIM
ucacugccaucucaug

SEQ ID NO: 4199704 - RNA, 13 nt, Yersinia pestis KIM
ucacuggaaaaag

SEQ ID NO: 4199705 - RNA, 21 nt, Yersinia pestis KIM
ucacuggaguuaaaucccugu

SEQ ID NO: 4199706 - RNA, 14 nt, Yersinia pestis KIM
ucacuggcaccauu

SEQ ID NO: 4199707 - RNA, 16 nt, Yersinia pestis KIM
ucacuggccgcaggcg

SEQ ID NO: 4199708 - RNA, 21 nt, Yersinia pestis KIM
ucacugucaaaaagcaccuuu

SEQ ID NO: 4199709 - RNA, 17 nt, Yersinia pestis KIM
ucacuguccaagaagcc

SEQ ID NO: 4199710 - RNA, 14 nt, Yersinia pestis KIM
ucacugucuauuuu

SEQ ID NO: 4199711 - RNA, 18 nt, Yersinia pestis KIM
ucacuguggcggccagug

SEQ ID NO: 4199712 - RNA, 22 nt, Yersinia pestis KIM
ucacuguuggcgggauccaucu

SEQ ID NO: 4199713 - RNA, 23 nt, Yersinia pestis KIM
ucacuguuggcgggauccaucug

SEQ ID NO: 4199714 - RNA, 14 nt, Yersinia pestis KIM
ucacuuagaagcga

SEQ ID NO: 4199715 - RNA, 15 nt, Yersinia pestis KIM
ucacuuagcucaauc

SEQ ID NO: 4199716 - RNA, 13 nt, Yersinia pestis KIM
ucacuuucuuuug

SEQ ID NO: 4199717 - RNA, 23 nt, Yersinia pestis KIM
ucacuuugcauuuucuggugagc

SEQ ID NO: 4199718 - RNA, 14 nt, Yersinia pestis KIM
ucacuuuuacggac

SEQ ID NO: 4199719 - RNA, 19 nt, Yersinia pestis KIM
ucacuuuuaugacggcauc

SEQ ID NO: 4199720 - RNA, 11 nt, Yersinia pestis KIM
ucagaaaacag

SEQ ID NO: 4199721 - RNA, 20 nt, Yersinia pestis KIM
ucagaaaacagccaccagcc

SEQ ID NO: 4199722 - RNA, 14 nt, Yersinia pestis KIM
ucagaaacaucuuc

SEQ ID NO: 4199723 - RNA, 17 nt, Yersinia pestis KIM
ucagaaacggugaaaau

SEQ ID NO: 4199724 - RNA, 20 nt, Yersinia pestis KIM
ucagaaccgacagguuaggg

SEQ ID NO: 4199725 - RNA, 20 nt, Yersinia pestis KIM
ucagaaccuguuacaucaga

SEQ ID NO: 4199726 - RNA, 23 nt, Yersinia pestis KIM
ucagaaccuguuacaucagagcu

SEQ ID NO: 4199727 - RNA, 23 nt, Yersinia pestis KIM
ucagaaugaaaggcggugaacag

SEQ ID NO: 4199728 - RNA, 22 nt, Yersinia pestis KIM
ucagaaugaaguucaccagcuu

SEQ ID NO: 4199729 - RNA, 17 nt, Yersinia pestis KIM
ucagacacguaaaacag

SEQ ID NO: 4199730 - RNA, 21 nt, Yersinia pestis KIM
ucagacaggauaaucaucagu

SEQ ID NO: 4199731 - RNA, 20 nt, Yersinia pestis KIM
ucagacauuuuucuauuucu

SEQ ID NO: 4199732 - RNA, 21 nt, Yersinia pestis KIM
ucagaccaaauagcaagccaa

SEQ ID NO: 4199733 - RNA, 15 nt, Yersinia pestis KIM
ucagaccuuuaggaa

SEQ ID NO: 4199734 - RNA, 20 nt, Yersinia pestis KIM
ucagacgacgugcagcgcgc

SEQ ID NO: 4199735 - RNA, 13 nt, Yersinia pestis KIM
ucagacugcucuu

SEQ ID NO: 4199736 - RNA, 19 nt, Yersinia pestis KIM
ucagacugcucuuucccuu

SEQ ID NO: 4199737 - RNA, 16 nt, Yersinia pestis KIM
ucagacugcugacaac

SEQ ID NO: 4199738 - RNA, 20 nt, Yersinia pestis KIM
ucagagauucagaggaaaga

SEQ ID NO: 4199739 - RNA, 20 nt, Yersinia pestis KIM
ucagagccaacugaggcaga

SEQ ID NO: 4199740 - RNA, 12 nt, Yersinia pestis KIM
ucagaguccaau

SEQ ID NO: 4199741 - RNA, 15 nt, Yersinia pestis KIM
ucagaguccaauagc

SEQ ID NO: 4199742 - RNA, 23 nt, Yersinia pestis KIM
ucagagucugucauggcacgcuu

SEQ ID NO: 4199743 - RNA, 22 nt, Yersinia pestis KIM
ucagauaaaaaaggguaaucag

SEQ ID NO: 4199744 - RNA, 18 nt, Yersinia pestis KIM
ucagauaaaaagccaguc

SEQ ID NO: 4199745 - RNA, 12 nt, Yersinia pestis KIM
ucagauaucagc

SEQ ID NO: 4199746 - RNA, 18 nt, Yersinia pestis KIM
ucagauaucugcucauua

SEQ ID NO: 4199747 - RNA, 21 nt, Yersinia pestis KIM
ucagauaucugcucauuacca

SEQ ID NO: 4199748 - RNA, 14 nt, Yersinia pestis KIM
ucagaucaacagau

SEQ ID NO: 4199749 - RNA, 22 nt, Yersinia pestis KIM
ucagaucaacagauuuuccauc

SEQ ID NO: 4199750 - RNA, 16 nt, Yersinia pestis KIM
ucagaugaaaaacugu

SEQ ID NO: 4199751 - RNA, 19 nt, Yersinia pestis KIM
ucagauuaacggucacugg

SEQ ID NO: 4199752 - RNA, 21 nt, Yersinia pestis KIM
ucagauuagucuuagacguca

SEQ ID NO: 4199753 - RNA, 21 nt, Yersinia pestis KIM
ucagauuaguuuuagacguca

SEQ ID NO: 4199754 - RNA, 15 nt, Yersinia pestis KIM
ucagauugaacgcug

SEQ ID NO: 4199755 - RNA, 12 nt, Yersinia pestis KIM
ucagauugucag

SEQ ID NO: 4199756 - RNA, 16 nt, Yersinia pestis KIM
ucagugguuuuaucaa

SEQ ID NO: 4199757 - RNA, 16 nt, Yersinia pestis KIM
ucaguguuagccccuc

SEQ ID NO: 4199758 - RNA, 12 nt, Yersinia pestis KIM
ucaguuauaaaa

SEQ ID NO: 4199759 - RNA, 13 nt, Yersinia pestis KIM
ucaguucaguauu

SEQ ID NO: 4199760 - RNA, 14 nt, Yersinia pestis KIM
ucaguuccugauuc

SEQ ID NO: 4199761 - RNA, 15 nt, Yersinia pestis KIM
ucaguugcaguugga

SEQ ID NO: 4199762 - RNA, 14 nt, Yersinia pestis KIM
ucaguuuagcgaga

SEQ ID NO: 4199763 - RNA, 21 nt, Yersinia pestis KIM
ucaguuuagcuaaauuuaaga

SEQ ID NO: 4199764 - RNA, 20 nt, Yersinia pestis KIM
ucaguuuuaauuuaugaaca

SEQ ID NO: 4199765 - RNA, 21 nt, Yersinia pestis KIM
ucauaaaaaaagccggguggc

SEQ ID NO: 4199766 - RNA, 15 nt, Yersinia pestis KIM
ucauaaaaagcaccg

SEQ ID NO: 4199767 - RNA, 21 nt, Yersinia pestis KIM
ucauaaaccugauuuaccguc

SEQ ID NO: 4199768 - RNA, 15 nt, Yersinia pestis KIM
ucauaaauaaagaua

SEQ ID NO: 4199769 - RNA, 12 nt, Yersinia pestis KIM
ucauaaauauug

SEQ ID NO: 4199770 - RNA, 16 nt, Yersinia pestis KIM
ucauaaaucacaauuu

SEQ ID NO: 4199771 - RNA, 22 nt, Yersinia pestis KIM
ucauaaaucacaauuucacccc

SEQ ID NO: 4199772 - RNA, 12 nt, Yersinia pestis KIM
ucauaaauuaaa

SEQ ID NO: 4199773 - RNA, 17 nt, Yersinia pestis KIM
ucauaaauuaaaacuga

SEQ ID NO: 4199774 - RNA, 18 nt, Yersinia pestis KIM
ucauaacuaagagucaca

SEQ ID NO: 4199775 - RNA, 23 nt, Yersinia pestis KIM
ucauaacuaagagucacagcauu

SEQ ID NO: 4199776 - RNA, 23 nt, Yersinia pestis KIM
ucauaagacuaacagaauauuga

SEQ ID NO: 4199777 - RNA, 13 nt, Yersinia pestis KIM
ucauaauaaugau

SEQ ID NO: 4199778 - RNA, 15 nt, Yersinia pestis KIM
ucauaauaaugauua

SEQ ID NO: 4199779 - RNA, 23 nt, Yersinia pestis KIM
ucauaaucagggauggcgauagu

SEQ ID NO: 4199780 - RNA, 16 nt, Yersinia pestis KIM
ucauacacaugaaaau

SEQ ID NO: 4199781 - RNA, 21 nt, Yersinia pestis KIM
ucauacccaaauuacggcuca

SEQ ID NO: 4199782 - RNA, 19 nt, Yersinia pestis KIM
ucauacggcgauauuuauu

SEQ ID NO: 4199783 - RNA, 19 nt, Yersinia pestis KIM
ucauacucccccauuuccu

SEQ ID NO: 4199784 - RNA, 21 nt, Yersinia pestis KIM
ucauacucccccauuuccugu

SEQ ID NO: 4199785 - RNA, 22 nt, Yersinia pestis KIM
ucauacugacggggaguuuuua

SEQ ID NO: 4199786 - RNA, 19 nt, Yersinia pestis KIM
ucauagaacuuaagcaaua

SEQ ID NO: 4199787 - RNA, 23 nt, Yersinia pestis KIM
ucauagaaggcggagaauguuaa

SEQ ID NO: 4199788 - RNA, 18 nt, Yersinia pestis KIM
ucauagcgaauaauggca

SEQ ID NO: 4199789 - RNA, 22 nt, Yersinia pestis KIM
ucauagcuaaaugacauauugu

SEQ ID NO: 4199790 - RNA, 20 nt, Yersinia pestis KIM
ucauagcuacgggcaaacuc

SEQ ID NO: 4199791 - RNA, 22 nt, Yersinia pestis KIM
ucauagcuacgggcaaacuccu

SEQ ID NO: 4199792 - RNA, 17 nt, Yersinia pestis KIM
ucauagugauaaaaaga

SEQ ID NO: 4199793 - RNA, 20 nt, Yersinia pestis KIM
ucauaguuuuuauagacacg

SEQ ID NO: 4199794 - RNA, 18 nt, Yersinia pestis KIM
ucauauaagcaauaccga

SEQ ID NO: 4199795 - RNA, 17 nt, Yersinia pestis KIM
ucauauaaucauacugu

SEQ ID NO: 4199796 - RNA, 15 nt, Yersinia pestis KIM
ucauaucaaaauaaa

SEQ ID NO: 4199797 - RNA, 20 nt, Yersinia pestis KIM
ucauaucccagcgucuucug

SEQ ID NO: 4199798 - RNA, 22 nt, Yersinia pestis KIM
ucauaucccccccaagagaaac

SEQ ID NO: 4199799 - RNA, 15 nt, Yersinia pestis KIM
ucauaucgauaccga

SEQ ID NO: 4199800 - RNA, 18 nt, Yersinia pestis KIM
ucauaucgaugacagcau

SEQ ID NO: 4199801 - RNA, 15 nt, Yersinia pestis KIM
ucauaucgcuaaaac

SEQ ID NO: 4199802 - RNA, 18 nt, Yersinia pestis KIM
ucauaucgcucaucaugg

SEQ ID NO: 4199803 - RNA, 18 nt, Yersinia pestis KIM
ucauaugacaaauaaggc

SEQ ID NO: 4199804 - RNA, 19 nt, Yersinia pestis KIM
ucauaugcgccuauaaggc

SEQ ID NO: 4199805 - RNA, 21 nt, Yersinia pestis KIM
ucauauucagccgauguguuu

SEQ ID NO: 4199806 - RNA, 21 nt, Yersinia pestis KIM
ucauauucaugguuucaaaau

SEQ ID NO: 4199807 - RNA, 20 nt, Yersinia pestis KIM
ucauauuccucucugucuga

SEQ ID NO: 4199808 - RNA, 15 nt, Yersinia pestis KIM
ucauauugaauuaaa

SEQ ID NO: 4199809 - RNA, 18 nt, Yersinia pestis KIM
ucauauugaauuaaauuu

SEQ ID NO: 4199810 - RNA, 13 nt, Yersinia pestis KIM
ucauauuggccag

SEQ ID NO: 4199811 - RNA, 12 nt, Yersinia pestis KIM
ucaucaaaggca

SEQ ID NO: 4199812 - RNA, 20 nt, Yersinia pestis KIM
ucaucaaaggcaauaccggu

SEQ ID NO: 4199813 - RNA, 21 nt, Yersinia pestis KIM
ucaucaaccgggauaucaaau

SEQ ID NO: 4199814 - RNA, 15 nt, Yersinia pestis KIM
ucaucaaccucagcc

SEQ ID NO: 4199815 - RNA, 18 nt, Yersinia pestis KIM
ucaucaaccucagccuca

SEQ ID NO: 4199816 - RNA, 23 nt, Yersinia pestis KIM
ucaucaacgcgccuuucggcaau

SEQ ID NO: 4199817 - RNA, 15 nt, Yersinia pestis KIM
ucaucaacugacagc

SEQ ID NO: 4199818 - RNA, 15 nt, Yersinia pestis KIM
ucaucaacugguuga

SEQ ID NO: 4199819 - RNA, 16 nt, Yersinia pestis KIM
ucaucaagccaauggc

SEQ ID NO: 4199820 - RNA, 17 nt, Yersinia pestis KIM
ucaucaagccaauggcc

SEQ ID NO: 4199821 - RNA, 15 nt, Yersinia pestis KIM
ucaucaauaccgaaa

SEQ ID NO: 4199822 - RNA, 19 nt, Yersinia pestis KIM
ucaucaaucgagaagaauu

SEQ ID NO: 4199823 - RNA, 22 nt, Yersinia pestis KIM
ucaucaauggauucuugcugca

SEQ ID NO: 4199824 - RNA, 22 nt, Yersinia pestis KIM
ucaucacauucaaacacuuaug

SEQ ID NO: 4199825 - RNA, 19 nt, Yersinia pestis KIM
ucaucaccagucagccuua

SEQ ID NO: 4199826 - RNA, 13 nt, Yersinia pestis KIM
ucaucaccauuca

SEQ ID NO: 4199827 - RNA, 18 nt, Yersinia pestis KIM
ucaucacccagcaaaaua

SEQ ID NO: 4199828 - RNA, 20 nt, Yersinia pestis KIM
ucaucaccguugaaaugucc

SEQ ID NO: 4199829 - RNA, 17 nt, Yersinia pestis KIM
ucaucaccuuccaaacu

SEQ ID NO: 4199830 - RNA, 16 nt, Yersinia pestis KIM
ucaucagagucuguca

SEQ ID NO: 4199831 - RNA, 12 nt, Yersinia pestis KIM
ucaucagcagag

SEQ ID NO: 4199832 - RNA, 14 nt, Yersinia pestis KIM
ucaucaguaaaaua

SEQ ID NO: 4199833 - RNA, 20 nt, Yersinia pestis KIM
ucaucaguuggucuuuaauc

SEQ ID NO: 4199834 - RNA, 11 nt, Yersinia pestis KIM
ucaucaguuua

SEQ ID NO: 4199835 - RNA, 18 nt, Yersinia pestis KIM
ucaucauaaaaauacaua

SEQ ID NO: 4199836 - RNA, 12 nt, Yersinia pestis KIM
ucaucaucaaca

SEQ ID NO: 4199837 - RNA, 23 nt, Yersinia pestis KIM
ucaucaucaauggauucuugcug

SEQ ID NO: 4199838 - RNA, 16 nt, Yersinia pestis KIM
ucaucaucacaaauaa

SEQ ID NO: 4199839 - RNA, 14 nt, Yersinia pestis KIM
ucaucaucgguacc

SEQ ID NO: 4199840 - RNA, 15 nt, Yersinia pestis KIM
ucaucaucuucuuca

SEQ ID NO: 4199841 - RNA, 19 nt, Yersinia pestis KIM
ucaucaucuuuaauaauag

SEQ ID NO: 4199842 - RNA, 20 nt, Yersinia pestis KIM
ucaucaugguucugcucaau

SEQ ID NO: 4199843 - RNA, 15 nt, Yersinia pestis KIM
ucaucauuaauggca

SEQ ID NO: 4199844 - RNA, 22 nt, Yersinia pestis KIM
ucaucauucauuuuaaaaaaau

SEQ ID NO: 4199845 - RNA, 13 nt, Yersinia pestis KIM
ucaucauuuuuua

SEQ ID NO: 4199846 - RNA, 21 nt, Yersinia pestis KIM
ucauccaacuuaccuugaucc

SEQ ID NO: 4199847 - RNA, 13 nt, Yersinia pestis KIM
ucauccagcucaa

SEQ ID NO: 4199848 - RNA, 19 nt, Yersinia pestis KIM
ucauccaguuuggcugcca

SEQ ID NO: 4199849 - RNA, 16 nt, Yersinia pestis KIM
ucaucccaaucaucau

SEQ ID NO: 4199850 - RNA, 23 nt, Yersinia pestis KIM
ucaucccuaaaaucauugacguu

SEQ ID NO: 4199851 - RNA, 20 nt, Yersinia pestis KIM
ucaucccuuuagcgucuaac

SEQ ID NO: 4199852 - RNA, 16 nt, Yersinia pestis KIM
ucauccgcucagcaaa

SEQ ID NO: 4199853 - RNA, 19 nt, Yersinia pestis KIM
ucauccgcucagcaaaaau

SEQ ID NO: 4199854 - RNA, 14 nt, Yersinia pestis KIM
ucauccguaaaaaa

SEQ ID NO: 4199855 - RNA, 17 nt, Yersinia pestis KIM
ucauccguaaaaaaccu

SEQ ID NO: 4199856 - RNA, 14 nt, Yersinia pestis KIM
ucauccuaaagaua

SEQ ID NO: 4199857 - RNA, 14 nt, Yersinia pestis KIM
ucaucgaaauuccc

SEQ ID NO: 4199858 - RNA, 23 nt, Yersinia pestis KIM
ucaucgacuugaugaaguuauuu

SEQ ID NO: 4199859 - RNA, 19 nt, Yersinia pestis KIM
ucaucgagaauaaauauuc

SEQ ID NO: 4199860 - RNA, 20 nt, Yersinia pestis KIM
ucaucgcaccauaaccaauc

SEQ ID NO: 4199861 - RNA, 20 nt, Yersinia pestis KIM
ucaucgccaaagccgucagu

SEQ ID NO: 4199862 - RNA, 18 nt, Yersinia pestis KIM
ucaucgcggguuuuuaac

SEQ ID NO: 4199863 - RNA, 19 nt, Yersinia pestis KIM
ucaucgcggguuuuuaacu

SEQ ID NO: 4199864 - RNA, 18 nt, Yersinia pestis KIM
ucaucgcuaaauacugcu

SEQ ID NO: 4199865 - RNA, 20 nt, Yersinia pestis KIM
ucaucgcuaacccucaguaa

SEQ ID NO: 4199866 - RNA, 20 nt, Yersinia pestis KIM
ucaucgcugagggccaugcc

SEQ ID NO: 4199867 - RNA, 17 nt, Yersinia pestis KIM
ucaucggcaaaaacagu

SEQ ID NO: 4199868 - RNA, 21 nt, Yersinia pestis KIM
ucaucggcauacuccuuaauc

SEQ ID NO: 4199869 - RNA, 22 nt, Yersinia pestis KIM
ucaucgggaacaggaucugcuc

SEQ ID NO: 4199870 - RNA, 17 nt, Yersinia pestis KIM
uccaacugauaauucag

SEQ ID NO: 4199871 - RNA, 22 nt, Yersinia pestis KIM
uccaacuucgcacgcccaucaa

SEQ ID NO: 4199872 - RNA, 15 nt, Yersinia pestis KIM
uccaacuuuucauug

SEQ ID NO: 4199873 - RNA, 23 nt, Yersinia pestis KIM
uccaagcacacugguugaaaccu

SEQ ID NO: 4199874 - RNA, 14 nt, Yersinia pestis KIM
uccaagccauggua

SEQ ID NO: 4199875 - RNA, 21 nt, Yersinia pestis KIM
uccaauaugcggcauaacuga

SEQ ID NO: 4199876 - RNA, 20 nt, Yersinia pestis KIM
uccaaucauucugucaucaa

SEQ ID NO: 4199877 - RNA, 23 nt, Yersinia pestis KIM
uccaaucuugguuaauagcauuu

SEQ ID NO: 4199878 - RNA, 16 nt, Yersinia pestis KIM
uccaauucauaauagc

SEQ ID NO: 4199879 - RNA, 17 nt, Yersinia pestis KIM
uccaauucauaauagcg

SEQ ID NO: 4199880 - RNA, 18 nt, Yersinia pestis KIM
uccacaagcguucgagga

SEQ ID NO: 4199881 - RNA, 11 nt, Yersinia pestis KIM
uccacacaaaa

SEQ ID NO: 4199882 - RNA, 20 nt, Yersinia pestis KIM
uccacacagcauucugcuuc

SEQ ID NO: 4199883 - RNA, 16 nt, Yersinia pestis KIM
uccacacaguauucug

SEQ ID NO: 4199884 - RNA, 20 nt, Yersinia pestis KIM
uccacacaguauucugcuuc

SEQ ID NO: 4199885 - RNA, 15 nt, Yersinia pestis KIM
uccacaccaacagac

SEQ ID NO: 4199886 - RNA, 21 nt, Yersinia pestis KIM
uccacacccucucuuuccagc

SEQ ID NO: 4199887 - RNA, 19 nt, Yersinia pestis KIM
uccacacguguacucauau

SEQ ID NO: 4199888 - RNA, 17 nt, Yersinia pestis KIM
uccacagucaguucauu

SEQ ID NO: 4199889 - RNA, 20 nt, Yersinia pestis KIM
uccacauaaaauagcccagu

SEQ ID NO: 4199890 - RNA, 23 nt, Yersinia pestis KIM
uccaccaacggcccaauauugau

SEQ ID NO: 4199891 - RNA, 18 nt, Yersinia pestis KIM
uccaccgggccuaaucau

SEQ ID NO: 4199892 - RNA, 23 nt, Yersinia pestis KIM
uccaccguuuuacucaggauuag

SEQ ID NO: 4199893 - RNA, 15 nt, Yersinia pestis KIM
uccaccugaucaugc

SEQ ID NO: 4199894 - RNA, 16 nt, Yersinia pestis KIM
uccacgcccaacucuu

SEQ ID NO: 4199895 - RNA, 17 nt, Yersinia pestis KIM
uccacgcccaacucuuu

SEQ ID NO: 4199896 - RNA, 22 nt, Yersinia pestis KIM
uccacgcuuuaagcuaauucug

SEQ ID NO: 4199897 - RNA, 14 nt, Yersinia pestis KIM
uccacgguauuagu

SEQ ID NO: 4199898 - RNA, 20 nt, Yersinia pestis KIM
uccacguuuggauacaguuu

SEQ ID NO: 4199899 - RNA, 13 nt, Yersinia pestis KIM
uccacuaauucau

SEQ ID NO: 4199900 - RNA, 22 nt, Yersinia pestis KIM
uccacuacuuauuuccgcgccg

SEQ ID NO: 4199901 - RNA, 21 nt, Yersinia pestis KIM
uccacugcggccacucgcauc

SEQ ID NO: 4199902 - RNA, 16 nt, Yersinia pestis KIM
uccacuugaucggcgu

SEQ ID NO: 4199903 - RNA, 20 nt, Yersinia pestis KIM
uccacuugugguaaccccgu

SEQ ID NO: 4199904 - RNA, 15 nt, Yersinia pestis KIM
uccacuuuucagaua

SEQ ID NO: 4199905 - RNA, 21 nt, Yersinia pestis KIM
uccacuuuucagauagcccau

SEQ ID NO: 4199906 - RNA, 20 nt, Yersinia pestis KIM
uccagaacaauaccgccaau

SEQ ID NO: 4199907 - RNA, 13 nt, Yersinia pestis KIM
uccagaacaccaa

SEQ ID NO: 4199908 - RNA, 13 nt, Yersinia pestis KIM
uccagaagccauu

SEQ ID NO: 4199909 - RNA, 16 nt, Yersinia pestis KIM
uccagaauauaaaagc

SEQ ID NO: 4199910 - RNA, 23 nt, Yersinia pestis KIM
uccagaauauaaaagcacagaca

SEQ ID NO: 4199911 - RNA, 19 nt, Yersinia pestis KIM
uccagaccgcguaagccgu

SEQ ID NO: 4199912 - RNA, 23 nt, Yersinia pestis KIM
uccagaugaauauguuccaucag

SEQ ID NO: 4199913 - RNA, 14 nt, Yersinia pestis KIM
uccagaugccaaau

SEQ ID NO: 4199914 - RNA, 14 nt, Yersinia pestis KIM
uccagcaacucaag

SEQ ID NO: 4199915 - RNA, 20 nt, Yersinia pestis KIM
uccagcaacucaagccacuc

SEQ ID NO: 4199916 - RNA, 21 nt, Yersinia pestis KIM
uccagcaccacaauggcagag

SEQ ID NO: 4199917 - RNA, 20 nt, Yersinia pestis KIM
uccagcagccucuaacauac

SEQ ID NO: 4199918 - RNA, 15 nt, Yersinia pestis KIM
uccagcaucgcugag

SEQ ID NO: 4199919 - RNA, 16 nt, Yersinia pestis KIM
uccagccaccuuaagu

SEQ ID NO: 4199920 - RNA, 15 nt, Yersinia pestis KIM
uccagccugguuggu

SEQ ID NO: 4199921 - RNA, 17 nt, Yersinia pestis KIM
uccagcgaacguaguug

SEQ ID NO: 4199922 - RNA, 20 nt, Yersinia pestis KIM
uccagcgcggcgaaacugac

SEQ ID NO: 4199923 - RNA, 17 nt, Yersinia pestis KIM
uccagcucauauaauca

SEQ ID NO: 4199924 - RNA, 19 nt, Yersinia pestis KIM
uccaggacgacauccacau

SEQ ID NO: 4199925 - RNA, 22 nt, Yersinia pestis KIM
uccaggauauucacguuuuucc

SEQ ID NO: 4199926 - RNA, 16 nt, Yersinia pestis KIM
uccaggcaccagggaa

SEQ ID NO: 4199927 - RNA, 21 nt, Yersinia pestis KIM
uccaggcuuuuguuaauucac

SEQ ID NO: 4199928 - RNA, 18 nt, Yersinia pestis KIM
uccagggcaaucaggaaa

SEQ ID NO: 4199929 - RNA, 16 nt, Yersinia pestis KIM
uccaggucaaucaauu

SEQ ID NO: 4199930 - RNA, 13 nt, Yersinia pestis KIM
uccaguaaaaaaa

SEQ ID NO: 4199931 - RNA, 17 nt, Yersinia pestis KIM
uccaguaaaagaauaaa

SEQ ID NO: 4199932 - RNA, 18 nt, Yersinia pestis KIM
uccaguaaaagaauaaau

SEQ ID NO: 4199933 - RNA, 22 nt, Yersinia pestis KIM
uccaguaaaagaauaaauguca

SEQ ID NO: 4199934 - RNA, 13 nt, Yersinia pestis KIM
uccaguaagccug

SEQ ID NO: 4199935 - RNA, 13 nt, Yersinia pestis KIM
uccaguaauaccu

SEQ ID NO: 4199936 - RNA, 14 nt, Yersinia pestis KIM
uccaguaauaccuu

SEQ ID NO: 4199937 - RNA, 16 nt, Yersinia pestis KIM
uccagugcaaauuuau

SEQ ID NO: 4199938 - RNA, 15 nt, Yersinia pestis KIM
uccaguugccagcag

SEQ ID NO: 4199939 - RNA, 18 nt, Yersinia pestis KIM
uccaguugccagcaggcu

SEQ ID NO: 4199940 - RNA, 22 nt, Yersinia pestis KIM
uccauaaaaucgaacccuucag

SEQ ID NO: 4199941 - RNA, 20 nt, Yersinia pestis KIM
uccauaaacggaacucaucu

SEQ ID NO: 4199942 - RNA, 21 nt, Yersinia pestis KIM
uccauaauagagcuucgcgau

SEQ ID NO: 4199943 - RNA, 18 nt, Yersinia pestis KIM
uccauagauacacuccau

SEQ ID NO: 4199944 - RNA, 15 nt, Yersinia pestis KIM
uccauagcuaaaaua

SEQ ID NO: 4199945 - RNA, 17 nt, Yersinia pestis KIM
uccauagcuaaaauaag

SEQ ID NO: 4199946 - RNA, 22 nt, Yersinia pestis KIM
uccauagugauuauuuaaacaa

SEQ ID NO: 4199947 - RNA, 19 nt, Yersinia pestis KIM
uccauauuuuagcggccuc

SEQ ID NO: 4199948 - RNA, 15 nt, Yersinia pestis KIM
uccaucaaaggagaa

SEQ ID NO: 4199949 - RNA, 15 nt, Yersinia pestis KIM
uccaucagacauauu

SEQ ID NO: 4199950 - RNA, 22 nt, Yersinia pestis KIM
uccaucagccuaaauucuccuu

SEQ ID NO: 4199951 - RNA, 20 nt, Yersinia pestis KIM
uccaucagcgcacugcaugc

SEQ ID NO: 4199952 - RNA, 11 nt, Yersinia pestis KIM
uccaucaggaa

SEQ ID NO: 4199953 - RNA, 21 nt, Yersinia pestis KIM
uccauccccaacucuuucaac

SEQ ID NO: 4199954 - RNA, 23 nt, Yersinia pestis KIM
uccaucggccagugcgccggccu

SEQ ID NO: 4199955 - RNA, 20 nt, Yersinia pestis KIM
uccaucgggaugaccuuccc

SEQ ID NO: 4199956 - RNA, 18 nt, Yersinia pestis KIM
uccaucgucaauucacug

SEQ ID NO: 4199957 - RNA, 23 nt, Yersinia pestis KIM
uccaucuaauagaauagauccca

SEQ ID NO: 4199958 - RNA, 17 nt, Yersinia pestis KIM
uccaucugaaauuuauu

SEQ ID NO: 4199959 - RNA, 16 nt, Yersinia pestis KIM
uccaugacacauauuu

SEQ ID NO: 4199960 - RNA, 17 nt, Yersinia pestis KIM
uccaugacacauauuuc

SEQ ID NO: 4199961 - RNA, 22 nt, Yersinia pestis KIM
uccaugacacauauuucaggcu

SEQ ID NO: 4199962 - RNA, 22 nt, Yersinia pestis KIM
uccaugccagcccaucaccauu

SEQ ID NO: 4199963 - RNA, 13 nt, Yersinia pestis KIM
uccaugccauucu

SEQ ID NO: 4199964 - RNA, 15 nt, Yersinia pestis KIM
uccauguaggcucga

SEQ ID NO: 4199965 - RNA, 23 nt, Yersinia pestis KIM
uccauuaaaagaggaugccacug

SEQ ID NO: 4199966 - RNA, 22 nt, Yersinia pestis KIM
uccauuaccugccccacaauga

SEQ ID NO: 4199967 - RNA, 18 nt, Yersinia pestis KIM
uccauuagcguauuaaac

SEQ ID NO: 4199968 - RNA, 20 nt, Yersinia pestis KIM
uccauucacgcccuacugag

SEQ ID NO: 4199969 - RNA, 20 nt, Yersinia pestis KIM
uccauuccguuauuaaacag

SEQ ID NO: 4199970 - RNA, 14 nt, Yersinia pestis KIM
uccauucugcagau

SEQ ID NO: 4199971 - RNA, 17 nt, Yersinia pestis KIM
uccauuuuauuuaacgu

SEQ ID NO: 4199972 - RNA, 18 nt, Yersinia pestis KIM
uccauuuucaucguauga

SEQ ID NO: 4199973 - RNA, 12 nt, Yersinia pestis KIM
ucccaaaauaug

SEQ ID NO: 4199974 - RNA, 17 nt, Yersinia pestis KIM
ucccaagaaaagcaccg

SEQ ID NO: 4199975 - RNA, 19 nt, Yersinia pestis KIM
ucccaagaaaagcaccgca

SEQ ID NO: 4199976 - RNA, 23 nt, Yersinia pestis KIM
ucccaaggguauaacucaucagu

SEQ ID NO: 4199977 - RNA, 22 nt, Yersinia pestis KIM
ucccaaugaauauuauucaguu

SEQ ID NO: 4199978 - RNA, 14 nt, Yersinia pestis KIM
ucccacaugaacuc

SEQ ID NO: 4199979 - RNA, 16 nt, Yersinia pestis KIM
ucccacgcagauacug

SEQ ID NO: 4199980 - RNA, 18 nt, Yersinia pestis KIM
ucccacuuauuauaaagc

SEQ ID NO: 4199981 - RNA, 15 nt, Yersinia pestis KIM
ucccacuuccaucug

SEQ ID NO: 4199982 - RNA, 18 nt, Yersinia pestis KIM
ucccagaacauaugccca

SEQ ID NO: 4199983 - RNA, 17 nt, Yersinia pestis KIM
ucccagaaccucaacau

SEQ ID NO: 4199984 - RNA, 14 nt, Yersinia pestis KIM
uccuccgacauagc

SEQ ID NO: 4199985 - RNA, 23 nt, Yersinia pestis KIM
uccuccggcauagccggagguuu

SEQ ID NO: 4199986 - RNA, 18 nt, Yersinia pestis KIM
uccuccugaucuucauug

SEQ ID NO: 4199987 - RNA, 19 nt, Yersinia pestis KIM
uccuccuuggggccucacu

SEQ ID NO: 4199988 - RNA, 21 nt, Yersinia pestis KIM
uccucucaccaagauaccgag

SEQ ID NO: 4199989 - RNA, 20 nt, Yersinia pestis KIM
uccucuccccuaccucaucc

SEQ ID NO: 4199990 - RNA, 23 nt, Yersinia pestis KIM
uccucugccuauucucaccguuu

SEQ ID NO: 4199991 - RNA, 12 nt, Yersinia pestis KIM
uccucuucuucg

SEQ ID NO: 4199992 - RNA, 14 nt, Yersinia pestis KIM
uccucuuucuuaau

SEQ ID NO: 4199993 - RNA, 17 nt, Yersinia pestis KIM
uccucuuucuuaauaau

SEQ ID NO: 4199994 - RNA, 13 nt, Yersinia pestis KIM
uccugaaaauaga

SEQ ID NO: 4199995 - RNA, 13 nt, Yersinia pestis KIM
uccugaaauaaag

SEQ ID NO: 4199996 - RNA, 14 nt, Yersinia pestis KIM
uccugaaauaaaga

SEQ ID NO: 4199997 - RNA, 22 nt, Yersinia pestis KIM
uccugaacgaggacuuccugcc

SEQ ID NO: 4199998 - RNA, 20 nt, Yersinia pestis KIM
uccugacaccggauaugccg

SEQ ID NO: 4199999 - RNA, 22 nt, Yersinia pestis KIM
uccugacggauacgcaaaccau

SEQ ID NO: 4200000 - RNA, 18 nt, Yersinia pestis KIM
uccugauauuccggugau

SEQ ID NO: 4200001 - RNA, 18 nt, Yersinia pestis KIM
uccugaucuucauugccu

SEQ ID NO: 4200002 - RNA, 18 nt, Yersinia pestis KIM
uccugaugacucaucugg

SEQ ID NO: 4200003 - RNA, 15 nt, Yersinia pestis KIM
uccugauuuaguuua

SEQ ID NO: 4200004 - RNA, 16 nt, Yersinia pestis KIM
uccugcaauaacacca

SEQ ID NO: 4200005 - RNA, 17 nt, Yersinia pestis KIM
uccugcaaugcauaagc

SEQ ID NO: 4200006 - RNA, 21 nt, Yersinia pestis KIM
uccugcacaguagaagcuacc

SEQ ID NO: 4200007 - RNA, 17 nt, Yersinia pestis KIM
uccugccacagacuuuc

SEQ ID NO: 4200008 - RNA, 14 nt, Yersinia pestis KIM
uccugcccaugcuc

SEQ ID NO: 4200009 - RNA, 16 nt, Yersinia pestis KIM
uccugccgccucugcu

SEQ ID NO: 4200010 - RNA, 17 nt, Yersinia pestis KIM
uccugccgccucugcuc

SEQ ID NO: 4200011 - RNA, 23 nt, Yersinia pestis KIM
uccugccgccucugcuccgguaa

SEQ ID NO: 4200012 - RNA, 20 nt, Yersinia pestis KIM
uccugcgucucuaacccauu

SEQ ID NO: 4200013 - RNA, 22 nt, Yersinia pestis KIM
uccugcuuaaugcgaacagccc

SEQ ID NO: 4200014 - RNA, 19 nt, Yersinia pestis KIM
uccuggccguguuuuuccc

SEQ ID NO: 4200015 - RNA, 20 nt, Yersinia pestis KIM
uccuggccguguuuuucccu

SEQ ID NO: 4200016 - RNA, 21 nt, Yersinia pestis KIM
uccuggcgguaauaaaucaug

SEQ ID NO: 4200017 - RNA, 15 nt, Yersinia pestis KIM
uccuggcuauuuauu

SEQ ID NO: 4200018 - RNA, 15 nt, Yersinia pestis KIM
uccugugcaaagugc

SEQ ID NO: 4200019 - RNA, 12 nt, Yersinia pestis KIM
uccuuaccacug

SEQ ID NO: 4200020 - RNA, 19 nt, Yersinia pestis KIM
uccuuaccacugcucacuu

SEQ ID NO: 4200021 - RNA, 20 nt, Yersinia pestis KIM
uccuuauuucuuacucuguu

SEQ ID NO: 4200022 - RNA, 13 nt, Yersinia pestis KIM
uccuucaauggca

SEQ ID NO: 4200023 - RNA, 23 nt, Yersinia pestis KIM
uccuucacuuacucucuccgcaa

SEQ ID NO: 4200024 - RNA, 15 nt, Yersinia pestis KIM
uccuucagacugcug

SEQ ID NO: 4200025 - RNA, 20 nt, Yersinia pestis KIM
uccuucggacgcuccucacu

SEQ ID NO: 4200026 - RNA, 13 nt, Yersinia pestis KIM
uccuugaaguguu

SEQ ID NO: 4200027 - RNA, 19 nt, Yersinia pestis KIM
uccuugaaguguuuaauca

SEQ ID NO: 4200028 - RNA, 17 nt, Yersinia pestis KIM
uccuugggucaguuuua

SEQ ID NO: 4200029 - RNA, 17 nt, Yersinia pestis KIM
uccuuuccauuuucauc

SEQ ID NO: 4200030 - RNA, 20 nt, Yersinia pestis KIM
uccuuucucuccuuauacua

SEQ ID NO: 4200031 - RNA, 20 nt, Yersinia pestis KIM
uccuuucuuuucgcuauuuc

SEQ ID NO: 4200032 - RNA, 17 nt, Yersinia pestis KIM
uccuuugcccauaaacc

SEQ ID NO: 4200033 - RNA, 22 nt, Yersinia pestis KIM
ucgaaaacucaaagauuucauc

SEQ ID NO: 4200034 - RNA, 23 nt, Yersinia pestis KIM
ucgaaaauagacucgguagcggg

SEQ ID NO: 4200035 - RNA, 21 nt, Yersinia pestis KIM
ucgaaacacccuccuauuaau

SEQ ID NO: 4200036 - RNA, 13 nt, Yersinia pestis KIM
ucgaaagaaauaa

SEQ ID NO: 4200037 - RNA, 18 nt, Yersinia pestis KIM
ucgaacauuuucuaagcu

SEQ ID NO: 4200038 - RNA, 17 nt, Yersinia pestis KIM
ucgaacccauucaucaa

SEQ ID NO: 4200039 - RNA, 18 nt, Yersinia pestis KIM
ucgaaccugaacgcagga

SEQ ID NO: 4200040 - RNA, 17 nt, Yersinia pestis KIM
ucgaacuaucuuuucga

SEQ ID NO: 4200041 - RNA, 21 nt, Yersinia pestis KIM
ucgaauaaacggauuugucug

SEQ ID NO: 4200042 - RNA, 23 nt, Yersinia pestis KIM
ucgaauuauuuagagucuauaau

SEQ ID NO: 4200043 - RNA, 15 nt, Yersinia pestis KIM
ucgacaccaaaacuc

SEQ ID NO: 4200044 - RNA, 17 nt, Yersinia pestis KIM
ucgacaccaagacugaa

SEQ ID NO: 4200045 - RNA, 16 nt, Yersinia pestis KIM
ucgacagcaucaacau

SEQ ID NO: 4200046 - RNA, 17 nt, Yersinia pestis KIM
ucgacggccaauuucag

SEQ ID NO: 4200047 - RNA, 18 nt, Yersinia pestis KIM
ucgacggccaauuucagu

SEQ ID NO: 4200048 - RNA, 16 nt, Yersinia pestis KIM
ucgacuaaggcaaccu

SEQ ID NO: 4200049 - RNA, 15 nt, Yersinia pestis KIM
ucgacucugggccgu

SEQ ID NO: 4200050 - RNA, 23 nt, Yersinia pestis KIM
ucgacucugggccgugaguuuuc

SEQ ID NO: 4200051 - RNA, 18 nt, Yersinia pestis KIM
ucgagauguauccaaggc

SEQ ID NO: 4200052 - RNA, 19 nt, Yersinia pestis KIM
ucgagauguauccaaggca

SEQ ID NO: 4200053 - RNA, 16 nt, Yersinia pestis KIM
ucgagcaacuuuuacu

SEQ ID NO: 4200054 - RNA, 21 nt, Yersinia pestis KIM
ucgagcaggcuuugugccaaa

SEQ ID NO: 4200055 - RNA, 14 nt, Yersinia pestis KIM
ucgagcaucaccgg

SEQ ID NO: 4200056 - RNA, 21 nt, Yersinia pestis KIM
ucgagccgcgccauccuuggc

SEQ ID NO: 4200057 - RNA, 17 nt, Yersinia pestis KIM
ucgagccgcgcccuccc

SEQ ID NO: 4200058 - RNA, 13 nt, Yersinia pestis KIM
ucgagccuacaua

SEQ ID NO: 4200059 - RNA, 17 nt, Yersinia pestis KIM
ucgagcggggcaaaaau

SEQ ID NO: 4200060 - RNA, 20 nt, Yersinia pestis KIM
ucgagcuguuugcuguaaac

SEQ ID NO: 4200061 - RNA, 12 nt, Yersinia pestis KIM
ucgaguuuauau

SEQ ID NO: 4200062 - RNA, 20 nt, Yersinia pestis KIM
ucgauaaaaggcuauuuaaa

SEQ ID NO: 4200063 - RNA, 19 nt, Yersinia pestis KIM
ucgauaacccuaucgucag

SEQ ID NO: 4200064 - RNA, 13 nt, Yersinia pestis KIM
ucgauacaguggc

SEQ ID NO: 4200065 - RNA, 18 nt, Yersinia pestis KIM
ucgauacuaauuucuaau

SEQ ID NO: 4200066 - RNA, 14 nt, Yersinia pestis KIM
ucgauacuuuuuau

SEQ ID NO: 4200067 - RNA, 15 nt, Yersinia pestis KIM
ucgauagcaacaucg

SEQ ID NO: 4200068 - RNA, 21 nt, Yersinia pestis KIM
ucgauaguaacaccagcaucc

SEQ ID NO: 4200069 - RNA, 16 nt, Yersinia pestis KIM
ucgauagucagcuuca

SEQ ID NO: 4200070 - RNA, 14 nt, Yersinia pestis KIM
ucgauauuacaguu

SEQ ID NO: 4200071 - RNA, 23 nt, Yersinia pestis KIM
ucgaucaaaacaauaaaaagauc

SEQ ID NO: 4200072 - RNA, 17 nt, Yersinia pestis KIM
ucgaucacaugcucagu

SEQ ID NO: 4200073 - RNA, 19 nt, Yersinia pestis KIM
ucgaucagcgucagcagau

SEQ ID NO: 4200074 - RNA, 20 nt, Yersinia pestis KIM
ucgaugccggguuggcuccc

SEQ ID NO: 4200075 - RNA, 18 nt, Yersinia pestis KIM
ucgaugccuucuuucaaa

SEQ ID NO: 4200076 - RNA, 15 nt, Yersinia pestis KIM
ucgauuucacuugcc

SEQ ID NO: 4200077 - RNA, 13 nt, Yersinia pestis KIM
ucgauuucugcau

SEQ ID NO: 4200078 - RNA, 14 nt, Yersinia pestis KIM
ucgauuugcucuuu

SEQ ID NO: 4200079 - RNA, 14 nt, Yersinia pestis KIM
ucgcaaaacuucac

SEQ ID NO: 4200080 - RNA, 13 nt, Yersinia pestis KIM
ucgcaaaaugcca

SEQ ID NO: 4200081 - RNA, 16 nt, Yersinia pestis KIM
ucgcaaagcgggccag

SEQ ID NO: 4200082 - RNA, 21 nt, Yersinia pestis KIM
ucgcaaccagcguugagaaga

SEQ ID NO: 4200083 - RNA, 19 nt, Yersinia pestis KIM
ucgcaccgaugucuaacaa

SEQ ID NO: 4200084 - RNA, 21 nt, Yersinia pestis KIM
ucgcacgggcuuuaaugagua

SEQ ID NO: 4200085 - RNA, 17 nt, Yersinia pestis KIM
ucgcacugauagccaac

SEQ ID NO: 4200086 - RNA, 13 nt, Yersinia pestis KIM
ucgcacuucaacc

SEQ ID NO: 4200087 - RNA, 15 nt, Yersinia pestis KIM
ucgcagaccaaauuc

SEQ ID NO: 4200088 - RNA, 20 nt, Yersinia pestis KIM
ucgcagaccaaauuccccag

SEQ ID NO: 4200089 - RNA, 18 nt, Yersinia pestis KIM
ucgcaguaauagaaaaag

SEQ ID NO: 4200090 - RNA, 22 nt, Yersinia pestis KIM
ucgcauaggccaauagaaaaac

SEQ ID NO: 4200091 - RNA, 17 nt, Yersinia pestis KIM
ucgcaucaggucgucua

SEQ ID NO: 4200092 - RNA, 15 nt, Yersinia pestis KIM
ucgcauccgggaacc

SEQ ID NO: 4200093 - RNA, 13 nt, Yersinia pestis KIM
ucgcaucuuccaa

SEQ ID NO: 4200094 - RNA, 15 nt, Yersinia pestis KIM
ucgcaucuuccaaag

SEQ ID NO: 4200095 - RNA, 22 nt, Yersinia pestis KIM
ucgcaucuuccaaaggaaggga

SEQ ID NO: 4200096 - RNA, 17 nt, Yersinia pestis KIM
ucgcauggcuaaaauua

SEQ ID NO: 4200097 - RNA, 15 nt, Yersinia pestis KIM
ucgcaugguuaaaac

SEQ ID NO: 4200098 - RNA, 16 nt, Yersinia pestis KIM
ucuaaaauuuuaaguu

SEQ ID NO: 4200099 - RNA, 14 nt, Yersinia pestis KIM
ucuaaauugcuuaa

SEQ ID NO: 4200100 - RNA, 17 nt, Yersinia pestis KIM
ucuaacagggaugaaua

SEQ ID NO: 4200101 - RNA, 15 nt, Yersinia pestis KIM
ucuaacuaauaauaa

SEQ ID NO: 4200102 - RNA, 14 nt, Yersinia pestis KIM
ucuaacucauucau

SEQ ID NO: 4200103 - RNA, 15 nt, Yersinia pestis KIM
ucuaacucauucaua

SEQ ID NO: 4200104 - RNA, 22 nt, Yersinia pestis KIM
ucuaacugauguauucccucaa

SEQ ID NO: 4200105 - RNA, 11 nt, Yersinia pestis KIM
ucuaagcugcc

SEQ ID NO: 4200106 - RNA, 19 nt, Yersinia pestis KIM
ucuaaggaaaauacccaaa

SEQ ID NO: 4200107 - RNA, 16 nt, Yersinia pestis KIM
ucuaaguaaaacaaag

SEQ ID NO: 4200108 - RNA, 12 nt, Yersinia pestis KIM
ucuaaguccaag

SEQ ID NO: 4200109 - RNA, 17 nt, Yersinia pestis KIM
ucuaagugccaguuaau

SEQ ID NO: 4200110 - RNA, 13 nt, Yersinia pestis KIM
ucuaaguucagcg

SEQ ID NO: 4200111 - RNA, 22 nt, Yersinia pestis KIM
ucuaaguucagcgcuuaauauu

SEQ ID NO: 4200112 - RNA, 23 nt, Yersinia pestis KIM
ucuaauaaaccugcaauaaccag

SEQ ID NO: 4200113 - RNA, 22 nt, Yersinia pestis KIM
ucuaaucacuuauuccauaacg

SEQ ID NO: 4200114 - RNA, 20 nt, Yersinia pestis KIM
ucuaaucgcgcauuucuucu

SEQ ID NO: 4200115 - RNA, 15 nt, Yersinia pestis KIM
ucuaaucuccucucc

SEQ ID NO: 4200116 - RNA, 21 nt, Yersinia pestis KIM
ucuaaugacuacuaaucaauc

SEQ ID NO: 4200117 - RNA, 14 nt, Yersinia pestis KIM
ucuaauuauuaaac

SEQ ID NO: 4200118 - RNA, 14 nt, Yersinia pestis KIM
ucuaauugcugccc

SEQ ID NO: 4200119 - RNA, 15 nt, Yersinia pestis KIM
ucuaauugcugccca

SEQ ID NO: 4200120 - RNA, 16 nt, Yersinia pestis KIM
ucuaauuguuauuauu

SEQ ID NO: 4200121 - RNA, 14 nt, Yersinia pestis KIM
ucuaauuuauaacc

SEQ ID NO: 4200122 - RNA, 17 nt, Yersinia pestis KIM
ucuacccuggcggcaaa

SEQ ID NO: 4200123 - RNA, 23 nt, Yersinia pestis KIM
ucuaccgcagaaccuuguuuuac

SEQ ID NO: 4200124 - RNA, 17 nt, Yersinia pestis KIM
ucuaccugaaugcgccg

SEQ ID NO: 4200125 - RNA, 20 nt, Yersinia pestis KIM
ucuaccuucaggccuuuacu

SEQ ID NO: 4200126 - RNA, 18 nt, Yersinia pestis KIM
ucuacgccgucaucaucu

SEQ ID NO: 4200127 - RNA, 21 nt, Yersinia pestis KIM
ucuagaccugaggauaaaaac

SEQ ID NO: 4200128 - RNA, 17 nt, Yersinia pestis KIM
ucuagcagugauuucag

SEQ ID NO: 4200129 - RNA, 22 nt, Yersinia pestis KIM
ucuagcgacggagagucagcaa

SEQ ID NO: 4200130 - RNA, 15 nt, Yersinia pestis KIM
ucuagcgccagcaau

SEQ ID NO: 4200131 - RNA, 16 nt, Yersinia pestis KIM
ucuagcuguagcaaua

SEQ ID NO: 4200132 - RNA, 17 nt, Yersinia pestis KIM
ucuagcuguguuuuauc

SEQ ID NO: 4200133 - RNA, 19 nt, Yersinia pestis KIM
ucuagcuguguuuuaucug

SEQ ID NO: 4200134 - RNA, 20 nt, Yersinia pestis KIM
ucuaggugcucugccuuaug

SEQ ID NO: 4200135 - RNA, 16 nt, Yersinia pestis KIM
ucuaguacguaaauuu

SEQ ID NO: 4200136 - RNA, 22 nt, Yersinia pestis KIM
ucuaguuugugcugcuaauauu

SEQ ID NO: 4200137 - RNA, 21 nt, Yersinia pestis KIM
ucuaucaggucaaucuuauug

SEQ ID NO: 4200138 - RNA, 20 nt, Yersinia pestis KIM
ucuauccaauccuuuggauu

SEQ ID NO: 4200139 - RNA, 14 nt, Yersinia pestis KIM
ucuauccgaaaaau

SEQ ID NO: 4200140 - RNA, 16 nt, Yersinia pestis KIM
ucuauccgaaaaauau

SEQ ID NO: 4200141 - RNA, 16 nt, Yersinia pestis KIM
ucuaucgauaaaguca

SEQ ID NO: 4200142 - RNA, 21 nt, Yersinia pestis KIM
ucuaucgcgguuuuaaauaca

SEQ ID NO: 4200143 - RNA, 17 nt, Yersinia pestis KIM
ucuaucgggcagguaaa

SEQ ID NO: 4200144 - RNA, 13 nt, Yersinia pestis KIM
ucuaucggugcag

SEQ ID NO: 4200145 - RNA, 21 nt, Yersinia pestis KIM
ucuaucugguuuaaauucuau

SEQ ID NO: 4200146 - RNA, 15 nt, Yersinia pestis KIM
ucuauucugcuuuuu

SEQ ID NO: 4200147 - RNA, 14 nt, Yersinia pestis KIM
ucuauugaaaaaau

SEQ ID NO: 4200148 - RNA, 19 nt, Yersinia pestis KIM
ucuauugaaaaaauaaugu

SEQ ID NO: 4200149 - RNA, 19 nt, Yersinia pestis KIM
ucuauugaucacaguaaau

SEQ ID NO: 4200150 - RNA, 16 nt, Yersinia pestis KIM
ucuauugauuacaaaa

SEQ ID NO: 4200151 - RNA, 18 nt, Yersinia pestis KIM
ucuauuuauuuauaaaac

SEQ ID NO: 4200152 - RNA, 23 nt, Yersinia pestis KIM
ucuauuuauuuauaaaaccacug

SEQ ID NO: 4200153 - RNA, 14 nt, Yersinia pestis KIM
ucuauuuuuauaau

SEQ ID NO: 4200154 - RNA, 23 nt, Yersinia pestis KIM
ucuauuuuuauaaucaucuacaa

SEQ ID NO: 4200155 - RNA, 21 nt, Yersinia pestis KIM
ucucaacauaguugaauaacu

SEQ ID NO: 4200156 - RNA, 17 nt, Yersinia pestis KIM
ucucaagacacuauucc

SEQ ID NO: 4200157 - RNA, 12 nt, Yersinia pestis KIM
ucucaauaauau

SEQ ID NO: 4200158 - RNA, 22 nt, Yersinia pestis KIM
ucucaauacgcugucugaauag

SEQ ID NO: 4200159 - RNA, 16 nt, Yersinia pestis KIM
ucucaauauuaauaau

SEQ ID NO: 4200160 - RNA, 17 nt, Yersinia pestis KIM
ucucaauauuaauaaug

SEQ ID NO: 4200161 - RNA, 19 nt, Yersinia pestis KIM
ucucaauauuaauaaugcc

SEQ ID NO: 4200162 - RNA, 17 nt, Yersinia pestis KIM
ucucaauggcuuuuuua

SEQ ID NO: 4200163 - RNA, 13 nt, Yersinia pestis KIM
ucucaauucaaua

SEQ ID NO: 4200164 - RNA, 19 nt, Yersinia pestis KIM
ucucacaacuuuuauuggc

SEQ ID NO: 4200165 - RNA, 22 nt, Yersinia pestis KIM
ucucacaccauagcgguuuauu

SEQ ID NO: 4200166 - RNA, 13 nt, Yersinia pestis KIM
ucucacauagcug

SEQ ID NO: 4200167 - RNA, 16 nt, Yersinia pestis KIM
ucucacccaauaagau

SEQ ID NO: 4200168 - RNA, 19 nt, Yersinia pestis KIM
ucucaccugcuuaguuaca

SEQ ID NO: 4200169 - RNA, 22 nt, Yersinia pestis KIM
ucucacguucggcgauaaucac

SEQ ID NO: 4200170 - RNA, 15 nt, Yersinia pestis KIM
ucucacuuacuauga

SEQ ID NO: 4200171 - RNA, 15 nt, Yersinia pestis KIM
ucucagaauuuuuuu

SEQ ID NO: 4200172 - RNA, 14 nt, Yersinia pestis KIM
ucucagacugcuga

SEQ ID NO: 4200173 - RNA, 15 nt, Yersinia pestis KIM
ucucaguugaaaccc

SEQ ID NO: 4200174 - RNA, 14 nt, Yersinia pestis KIM
ucucaucaaggaaa

SEQ ID NO: 4200175 - RNA, 17 nt, Yersinia pestis KIM
ucucaucaauaccgaaa

SEQ ID NO: 4200176 - RNA, 20 nt, Yersinia pestis KIM
ucucaucgagaauaaauauu

SEQ ID NO: 4200177 - RNA, 15 nt, Yersinia pestis KIM
ucucauuccauaauu

SEQ ID NO: 4200178 - RNA, 15 nt, Yersinia pestis KIM
ucucauuuagcauua

SEQ ID NO: 4200179 - RNA, 23 nt, Yersinia pestis KIM
ucucauuuagcauuauucuucac

SEQ ID NO: 4200180 - RNA, 23 nt, Yersinia pestis KIM
ucuccaacgccccacgguugaua

SEQ ID NO: 4200181 - RNA, 12 nt, Yersinia pestis KIM
ucuccaagcaca

SEQ ID NO: 4200182 - RNA, 15 nt, Yersinia pestis KIM
ucuccaagcacacug

SEQ ID NO: 4200183 - RNA, 17 nt, Yersinia pestis KIM
ucuccaccaacggccca

SEQ ID NO: 4200184 - RNA, 15 nt, Yersinia pestis KIM
ucuccagaauauaaa

SEQ ID NO: 4200185 - RNA, 20 nt, Yersinia pestis KIM
ucuccaguaaaagaauaaau

SEQ ID NO: 4200186 - RNA, 16 nt, Yersinia pestis KIM
ucuccagugcaaauuu

SEQ ID NO: 4200187 - RNA, 14 nt, Yersinia pestis KIM
ucuccaguugccag

SEQ ID NO: 4200188 - RNA, 21 nt, Yersinia pestis KIM
ucuccaguuggcgcacguucc

SEQ ID NO: 4200189 - RNA, 21 nt, Yersinia pestis KIM
ucuccauggucaaacguucug

SEQ ID NO: 4200190 - RNA, 18 nt, Yersinia pestis KIM
ucuccccuaccucauccg

SEQ ID NO: 4200191 - RNA, 20 nt, Yersinia pestis KIM
ucuccgucgcgggcacuuug

SEQ ID NO: 4200192 - RNA, 22 nt, Yersinia pestis KIM
ucuccgucgcgggcacuuuguc

SEQ ID NO: 4200193 - RNA, 23 nt, Yersinia pestis KIM
ucuccgucgcgggcacuuuguca

SEQ ID NO: 4200194 - RNA, 15 nt, Yersinia pestis KIM
ucuccguugaaaccu

SEQ ID NO: 4200195 - RNA, 15 nt, Yersinia pestis KIM
ucuccuuauacuaaa

SEQ ID NO: 4200196 - RNA, 17 nt, Yersinia pestis KIM
ucucgaaguccuucgga

SEQ ID NO: 4200197 - RNA, 21 nt, Yersinia pestis KIM
ucucgacaaauccuuuuaaaa

SEQ ID NO: 4200198 - RNA, 21 nt, Yersinia pestis KIM
ucucgagguguuuuccccaau

SEQ ID NO: 4200199 - RNA, 16 nt, Yersinia pestis KIM
ucucgauacaauuuuu

SEQ ID NO: 4200200 - RNA, 15 nt, Yersinia pestis KIM
ucucgauauuaaccc

SEQ ID NO: 4200201 - RNA, 16 nt, Yersinia pestis KIM
ucucggcaugcuucca

SEQ ID NO: 4200202 - RNA, 19 nt, Yersinia pestis KIM
ucucggccaacaucuucca

SEQ ID NO: 4200203 - RNA, 15 nt, Yersinia pestis KIM
ucucggcuuucaggu

SEQ ID NO: 4200204 - RNA, 18 nt, Yersinia pestis KIM
ucucuaaucgcgcauuuc

SEQ ID NO: 4200205 - RNA, 15 nt, Yersinia pestis KIM
ucucuagauuaaccu

SEQ ID NO: 4200206 - RNA, 13 nt, Yersinia pestis KIM
ucucuauucacua

SEQ ID NO: 4200207 - RNA, 14 nt, Yersinia pestis KIM
ucucuauucugcuu

SEQ ID NO: 4200208 - RNA, 14 nt, Yersinia pestis KIM
ucucuccagugcaa

SEQ ID NO: 4200209 - RNA, 22 nt, Yersinia pestis KIM
ucucucuuuuuacguauuaucc

SEQ ID NO: 4200210 - RNA, 19 nt, Yersinia pestis KIM
ucucugcaucacguauuag

SEQ ID NO: 4200211 - RNA, 13 nt, Yersinia pestis KIM
ucucugcaucucu

SEQ ID NO: 4200212 - RNA, 22 nt, Yersinia pestis KIM
ucucuggcaacggcacauccca

SEQ ID NO: 4200213 - RNA, 17 nt, Yersinia pestis KIM
ucugucguacuuuccuu

SEQ ID NO: 4200214 - RNA, 21 nt, Yersinia pestis KIM
ucugucucugguaguuuugca

SEQ ID NO: 4200215 - RNA, 13 nt, Yersinia pestis KIM
ucugucugagucg

SEQ ID NO: 4200216 - RNA, 18 nt, Yersinia pestis KIM
ucugugccagucuaaaau

SEQ ID NO: 4200217 - RNA, 15 nt, Yersinia pestis KIM
ucuguggugccauaa

SEQ ID NO: 4200218 - RNA, 20 nt, Yersinia pestis KIM
ucuguuaauccuaaugaaca

SEQ ID NO: 4200219 - RNA, 14 nt, Yersinia pestis KIM
ucuguuauaaaaaa

SEQ ID NO: 4200220 - RNA, 13 nt, Yersinia pestis KIM
ucuguucagauuu

SEQ ID NO: 4200221 - RNA, 21 nt, Yersinia pestis KIM
ucuguucagcauaaauauuca

SEQ ID NO: 4200222 - RNA, 14 nt, Yersinia pestis KIM
ucuguucuuuuggc

SEQ ID NO: 4200223 - RNA, 20 nt, Yersinia pestis KIM
ucuguugauaaaaaucuuuu

SEQ ID NO: 4200224 - RNA, 18 nt, Yersinia pestis KIM
ucuguuucaaauaaguau

SEQ ID NO: 4200225 - RNA, 12 nt, Yersinia pestis KIM
ucuguuuuacuc

SEQ ID NO: 4200226 - RNA, 18 nt, Yersinia pestis KIM
ucuguuuuguuuccccua

SEQ ID NO: 4200227 - RNA, 14 nt, Yersinia pestis KIM
ucuguuuuugccac

SEQ ID NO: 4200228 - RNA, 16 nt, Yersinia pestis KIM
ucuguuuuugccaccu

SEQ ID NO: 4200229 - RNA, 11 nt, Yersinia pestis KIM
ucuuaaaaaua

SEQ ID NO: 4200230 - RNA, 15 nt, Yersinia pestis KIM
ucuuaaaaauaacuu

SEQ ID NO: 4200231 - RNA, 16 nt, Yersinia pestis KIM
ucuuaacgauauuuac

SEQ ID NO: 4200232 - RNA, 20 nt, Yersinia pestis KIM
ucuuaaggacccguuuauaa

SEQ ID NO: 4200233 - RNA, 20 nt, Yersinia pestis KIM
ucuuaauaauaucaaauguc

SEQ ID NO: 4200234 - RNA, 22 nt, Yersinia pestis KIM
ucuuaaucuuuaauucaucaga

SEQ ID NO: 4200235 - RNA, 16 nt, Yersinia pestis KIM
ucuuaaugaaugaguu

SEQ ID NO: 4200236 - RNA, 21 nt, Yersinia pestis KIM
ucuuaauuuaaauaagaucca

SEQ ID NO: 4200237 - RNA, 17 nt, Yersinia pestis KIM
ucuuaccggccucuuuc

SEQ ID NO: 4200238 - RNA, 13 nt, Yersinia pestis KIM
ucuuacuaaaaua

SEQ ID NO: 4200239 - RNA, 14 nt, Yersinia pestis KIM
ucuuacugauaucu

SEQ ID NO: 4200240 - RNA, 21 nt, Yersinia pestis KIM
ucuuacuguuuucauuauuuu

SEQ ID NO: 4200241 - RNA, 16 nt, Yersinia pestis KIM
ucuuaucacggccaaa

SEQ ID NO: 4200242 - RNA, 23 nt, Yersinia pestis KIM
ucuuauucauaucgcucaucaug

SEQ ID NO: 4200243 - RNA, 15 nt, Yersinia pestis KIM
ucuuauuuuuuguag

SEQ ID NO: 4200244 - RNA, 12 nt, Yersinia pestis KIM
ucuucaaaagca

SEQ ID NO: 4200245 - RNA, 21 nt, Yersinia pestis KIM
ucuucaaccuggaaccaagcc

SEQ ID NO: 4200246 - RNA, 20 nt, Yersinia pestis KIM
ucuucaaugaccggaugaua

SEQ ID NO: 4200247 - RNA, 22 nt, Yersinia pestis KIM
ucuucaaugguguuaucuucac

SEQ ID NO: 4200248 - RNA, 13 nt, Yersinia pestis KIM
ucuucaccaauga

SEQ ID NO: 4200249 - RNA, 15 nt, Yersinia pestis KIM
ucuucaccaaugauu

SEQ ID NO: 4200250 - RNA, 18 nt, Yersinia pestis KIM
ucuucacguacaacucgu

SEQ ID NO: 4200251 - RNA, 14 nt, Yersinia pestis KIM
ucuucagccuaucc

SEQ ID NO: 4200252 - RNA, 21 nt, Yersinia pestis KIM
ucuucagccuauccucaccgu

SEQ ID NO: 4200253 - RNA, 19 nt, Yersinia pestis KIM
ucuucagguaagccuuucu

SEQ ID NO: 4200254 - RNA, 15 nt, Yersinia pestis KIM
ucuucaguggcugga

SEQ ID NO: 4200255 - RNA, 20 nt, Yersinia pestis KIM
ucuucauaacgcuuuuucau

SEQ ID NO: 4200256 - RNA, 15 nt, Yersinia pestis KIM
ucuucauugccuucu

SEQ ID NO: 4200257 - RNA, 16 nt, Yersinia pestis KIM
ucuuccaacgcuucac

SEQ ID NO: 4200258 - RNA, 17 nt, Yersinia pestis KIM
ucuuccaacgcuucacc

SEQ ID NO: 4200259 - RNA, 20 nt, Yersinia pestis KIM
ucuuccaagaaugcagauau

SEQ ID NO: 4200260 - RNA, 20 nt, Yersinia pestis KIM
ucuuccaauagcaguggcca

SEQ ID NO: 4200261 - RNA, 19 nt, Yersinia pestis KIM
ucuuccacucuuucaauga

SEQ ID NO: 4200262 - RNA, 21 nt, Yersinia pestis KIM
ucuuccagacaaagugaggga

SEQ ID NO: 4200263 - RNA, 13 nt, Yersinia pestis KIM
ucuuccagcggca

SEQ ID NO: 4200264 - RNA, 23 nt, Yersinia pestis KIM
ucuuccauuuuauuuaacguguu

SEQ ID NO: 4200265 - RNA, 14 nt, Yersinia pestis KIM
ucuucccuguccag

SEQ ID NO: 4200266 - RNA, 19 nt, Yersinia pestis KIM
ucuuccgcccguucaucac

SEQ ID NO: 4200267 - RNA, 22 nt, Yersinia pestis KIM
ucuuccgcccguucaucaccca

SEQ ID NO: 4200268 - RNA, 18 nt, Yersinia pestis KIM
ucuuccggcguaccacaa

SEQ ID NO: 4200269 - RNA, 21 nt, Yersinia pestis KIM
ucuuccgucgcauggcuaaaa

SEQ ID NO: 4200270 - RNA, 18 nt, Yersinia pestis KIM
ucuuccuugcucucuuca

SEQ ID NO: 4200271 - RNA, 22 nt, Yersinia pestis KIM
ucuucgcaaugauuacaucacu

SEQ ID NO: 4200272 - RNA, 23 nt, Yersinia pestis KIM
ucuucgcgagucacauuuuuaau

SEQ ID NO: 4200273 - RNA, 22 nt, Yersinia pestis KIM
ucuucgcggaggguaaaacugc

SEQ ID NO: 4200274 - RNA, 23 nt, Yersinia pestis KIM
ucuucguugccccaucagcacuc

SEQ ID NO: 4200275 - RNA, 15 nt, Yersinia pestis KIM
ucuucuaacacuuca

SEQ ID NO: 4200276 - RNA, 12 nt, Yersinia pestis KIM
ucuucucacccc

SEQ ID NO: 4200277 - RNA, 18 nt, Yersinia pestis KIM
ucuucugauucaauuucg

SEQ ID NO: 4200278 - RNA, 10 nt, Yersinia pestis KIM
ucuucuggaa

SEQ ID NO: 4200279 - RNA, 18 nt, Yersinia pestis KIM
ucuucuggaauggggaug

SEQ ID NO: 4200280 - RNA, 13 nt, Yersinia pestis KIM
ucuucuguugccc

SEQ ID NO: 4200281 - RNA, 15 nt, Yersinia pestis KIM
ucuucuucucagaua

SEQ ID NO: 4200282 - RNA, 19 nt, Yersinia pestis KIM
ucuucuuuauuguuuugua

SEQ ID NO: 4200283 - RNA, 22 nt, Yersinia pestis KIM
ucuugaaccaauuuuucuguau

SEQ ID NO: 4200284 - RNA, 18 nt, Yersinia pestis KIM
ucuugaauaauauucaau

SEQ ID NO: 4200285 - RNA, 18 nt, Yersinia pestis KIM
ucuugaccgauaccgguu

SEQ ID NO: 4200286 - RNA, 20 nt, Yersinia pestis KIM
ucuugauggucaauaauguc

SEQ ID NO: 4200287 - RNA, 23 nt, Yersinia pestis KIM
ucuugcaacaacgccucaucuuc

SEQ ID NO: 4200288 - RNA, 21 nt, Yersinia pestis KIM
ucuugcaaggggcgagccacg

SEQ ID NO: 4200289 - RNA, 23 nt, Yersinia pestis KIM
ucuugcucgaucagcgucagcag

SEQ ID NO: 4200290 - RNA, 15 nt, Yersinia pestis KIM
ucuuggaacaggcca

SEQ ID NO: 4200291 - RNA, 15 nt, Yersinia pestis KIM
ucuuggauaacagau

SEQ ID NO: 4200292 - RNA, 15 nt, Yersinia pestis KIM
ucuuguaaauaguca

SEQ ID NO: 4200293 - RNA, 23 nt, Yersinia pestis KIM
ucuuguaaauagucauauauuuu

SEQ ID NO: 4200294 - RNA, 15 nt, Yersinia pestis KIM
ucuuguaguaaccac

SEQ ID NO: 4200295 - RNA, 14 nt, Yersinia pestis KIM
ucuuguauauaaaa

SEQ ID NO: 4200296 - RNA, 14 nt, Yersinia pestis KIM
ucuugugaugcaua

SEQ ID NO: 4200297 - RNA, 16 nt, Yersinia pestis KIM
ucuuguuaauuuaaac

SEQ ID NO: 4200298 - RNA, 13 nt, Yersinia pestis KIM
ucuuguucuaaua

SEQ ID NO: 4200299 - RNA, 16 nt, Yersinia pestis KIM
ucuuguucuaauaaua

SEQ ID NO: 4200300 - RNA, 15 nt, Yersinia pestis KIM
ucuuguuuaguaauu

SEQ ID NO: 4200301 - RNA, 13 nt, Yersinia pestis KIM
ucuuuaaaaucuu

SEQ ID NO: 4200302 - RNA, 14 nt, Yersinia pestis KIM
ucuuuaaaaucuug

SEQ ID NO: 4200303 - RNA, 19 nt, Yersinia pestis KIM
ucuuuaaguauugacccuc

SEQ ID NO: 4200304 - RNA, 18 nt, Yersinia pestis KIM
ucuuuaauuuuucccuug

SEQ ID NO: 4200305 - RNA, 14 nt, Yersinia pestis KIM
ucuuuacgaucugc

SEQ ID NO: 4200306 - RNA, 16 nt, Yersinia pestis KIM
ucuuuacgaucugccu

SEQ ID NO: 4200307 - RNA, 16 nt, Yersinia pestis KIM
ucuuuacggaauaacc

SEQ ID NO: 4200308 - RNA, 21 nt, Yersinia pestis KIM
ucuuuacggucgucgagaaua

SEQ ID NO: 4200309 - RNA, 14 nt, Yersinia pestis KIM
ucuuuagauuucac

SEQ ID NO: 4200310 - RNA, 14 nt, Yersinia pestis KIM
ucuuuauacccaaa

SEQ ID NO: 4200311 - RNA, 14 nt, Yersinia pestis KIM
ucuuuauauucaau

SEQ ID NO: 4200312 - RNA, 17 nt, Yersinia pestis KIM
ucuuuauuauuauuuau

SEQ ID NO: 4200313 - RNA, 15 nt, Yersinia pestis KIM
ucuuucaaagugaca

SEQ ID NO: 4200314 - RNA, 16 nt, Yersinia pestis KIM
ucuuucaacugcucau

SEQ ID NO: 4200315 - RNA, 20 nt, Yersinia pestis KIM
ucuuucaauggcugcccaga

SEQ ID NO: 4200316 - RNA, 18 nt, Yersinia pestis KIM
ucuuucaccacugccaca

SEQ ID NO: 4200317 - RNA, 17 nt, Yersinia pestis KIM
ucuuucauuucaacaug

SEQ ID NO: 4200318 - RNA, 13 nt, Yersinia pestis KIM
ucuuuccagcaaa

SEQ ID NO: 4200319 - RNA, 19 nt, Yersinia pestis KIM
ucuuuccggguuuuuaaca

SEQ ID NO: 4200320 - RNA, 21 nt, Yersinia pestis KIM
ucuuucucgauacaauuuuug

SEQ ID NO: 4200321 - RNA, 18 nt, Yersinia pestis KIM
ucuuucuggcuaaacgau

SEQ ID NO: 4200322 - RNA, 22 nt, Yersinia pestis KIM
ucuuucuggcuaaacgaucaga

SEQ ID NO: 4200323 - RNA, 20 nt, Yersinia pestis KIM
ucuuucuguucagcauaaau

SEQ ID NO: 4200324 - RNA, 22 nt, Yersinia pestis KIM
ucuuucuguucagcauaaauau

SEQ ID NO: 4200325 - RNA, 14 nt, Yersinia pestis KIM
ucuuugaccgaacc

SEQ ID NO: 4200326 - RNA, 20 nt, Yersinia pestis KIM
ucuuugauuccucugugacu

SEQ ID NO: 4200327 - RNA, 16 nt, Yersinia pestis KIM
ucuuuggcaaauuuag

SEQ ID NO: 4200328 - RNA, 16 nt, Yersinia pestis KIM
ugaauacuuugcggcu

SEQ ID NO: 4200329 - RNA, 18 nt, Yersinia pestis KIM
ugaauacuuugcggcuca

SEQ ID NO: 4200330 - RNA, 19 nt, Yersinia pestis KIM
ugaauagagaauaaauuua

SEQ ID NO: 4200331 - RNA, 15 nt, Yersinia pestis KIM
ugaauagaggacuau

SEQ ID NO: 4200332 - RNA, 14 nt, Yersinia pestis KIM
ugaauagcgcugca

SEQ ID NO: 4200333 - RNA, 17 nt, Yersinia pestis KIM
ugaauagggaauaagua

SEQ ID NO: 4200334 - RNA, 19 nt, Yersinia pestis KIM
ugaauagggaauaaguaga

SEQ ID NO: 4200335 - RNA, 13 nt, Yersinia pestis KIM
ugaauaucaucuu

SEQ ID NO: 4200336 - RNA, 15 nt, Yersinia pestis KIM
ugaauauccaauggu

SEQ ID NO: 4200337 - RNA, 13 nt, Yersinia pestis KIM
ugaauauccgccg

SEQ ID NO: 4200338 - RNA, 16 nt, Yersinia pestis KIM
ugaauauccgccgccc

SEQ ID NO: 4200339 - RNA, 13 nt, Yersinia pestis KIM
ugaauauuauuca

SEQ ID NO: 4200340 - RNA, 15 nt, Yersinia pestis KIM
ugaauauuuuuaauc

SEQ ID NO: 4200341 - RNA, 15 nt, Yersinia pestis KIM
ugaaucaaaauaccc

SEQ ID NO: 4200342 - RNA, 21 nt, Yersinia pestis KIM
ugaaucaagaauacacaaaaa

SEQ ID NO: 4200343 - RNA, 15 nt, Yersinia pestis KIM
ugaaucagccagaga

SEQ ID NO: 4200344 - RNA, 16 nt, Yersinia pestis KIM
ugaaucaggugauggc

SEQ ID NO: 4200345 - RNA, 17 nt, Yersinia pestis KIM
ugaauccauaagauuga

SEQ ID NO: 4200346 - RNA, 16 nt, Yersinia pestis KIM
ugaaucgccguuaccc

SEQ ID NO: 4200347 - RNA, 21 nt, Yersinia pestis KIM
ugaaucuguaagucauucuug

SEQ ID NO: 4200348 - RNA, 20 nt, Yersinia pestis KIM
ugaaugaccaagguuauaca

SEQ ID NO: 4200349 - RNA, 19 nt, Yersinia pestis KIM
ugaaugaguuucaagucaa

SEQ ID NO: 4200350 - RNA, 23 nt, Yersinia pestis KIM
ugaaugaguuucaagucaauaaa

SEQ ID NO: 4200351 - RNA, 18 nt, Yersinia pestis KIM
ugaauggaaguuaaaaaa

SEQ ID NO: 4200352 - RNA, 21 nt, Yersinia pestis KIM
ugaauggcaacgcgcagugcc

SEQ ID NO: 4200353 - RNA, 15 nt, Yersinia pestis KIM
ugaauggcuauuuac

SEQ ID NO: 4200354 - RNA, 19 nt, Yersinia pestis KIM
ugaauggggggcaaccugg

SEQ ID NO: 4200355 - RNA, 18 nt, Yersinia pestis KIM
ugaauggugcuguauuua

SEQ ID NO: 4200356 - RNA, 18 nt, Yersinia pestis KIM
ugaaugucucuggcgcga

SEQ ID NO: 4200357 - RNA, 22 nt, Yersinia pestis KIM
ugaaugugaguguucauugaga

SEQ ID NO: 4200358 - RNA, 17 nt, Yersinia pestis KIM
ugaauguuccggacuuc

SEQ ID NO: 4200359 - RNA, 12 nt, Yersinia pestis KIM
ugaauuaaauuu

SEQ ID NO: 4200360 - RNA, 17 nt, Yersinia pestis KIM
ugaauuaaauuuuauau

SEQ ID NO: 4200361 - RNA, 13 nt, Yersinia pestis KIM
ugaauuaacauac

SEQ ID NO: 4200362 - RNA, 14 nt, Yersinia pestis KIM
ugaauuaaccuuac

SEQ ID NO: 4200363 - RNA, 18 nt, Yersinia pestis KIM
ugaauuacguuuuggauc

SEQ ID NO: 4200364 - RNA, 16 nt, Yersinia pestis KIM
ugaauuauuucaguag

SEQ ID NO: 4200365 - RNA, 12 nt, Yersinia pestis KIM
ugaauucaccaa

SEQ ID NO: 4200366 - RNA, 23 nt, Yersinia pestis KIM
ugaauugagagagcuuacauuaa

SEQ ID NO: 4200367 - RNA, 15 nt, Yersinia pestis KIM
ugaauuugauacagu

SEQ ID NO: 4200368 - RNA, 16 nt, Yersinia pestis KIM
ugaauuuuuuuaacuu

SEQ ID NO: 4200369 - RNA, 19 nt, Yersinia pestis KIM
ugacaaaaacagcacuauc

SEQ ID NO: 4200370 - RNA, 16 nt, Yersinia pestis KIM
ugacaaacagauacau

SEQ ID NO: 4200371 - RNA, 22 nt, Yersinia pestis KIM
ugacaaaccccgaugacucacu

SEQ ID NO: 4200372 - RNA, 22 nt, Yersinia pestis KIM
ugacaacaaaaaauaaggcgcu

SEQ ID NO: 4200373 - RNA, 12 nt, Yersinia pestis KIM
ugacaacaccgu

SEQ ID NO: 4200374 - RNA, 19 nt, Yersinia pestis KIM
ugacaacaccguaacgccc

SEQ ID NO: 4200375 - RNA, 16 nt, Yersinia pestis KIM
ugacaacaucaaauga

SEQ ID NO: 4200376 - RNA, 18 nt, Yersinia pestis KIM
ugacaacaucaaaugaag

SEQ ID NO: 4200377 - RNA, 19 nt, Yersinia pestis KIM
ugacaacgucacuuccauc

SEQ ID NO: 4200378 - RNA, 17 nt, Yersinia pestis KIM
ugacaaugcguuauaac

SEQ ID NO: 4200379 - RNA, 19 nt, Yersinia pestis KIM
ugacaaugcguuauaacca

SEQ ID NO: 4200380 - RNA, 19 nt, Yersinia pestis KIM
ugacaaugcguuauaacua

SEQ ID NO: 4200381 - RNA, 13 nt, Yersinia pestis KIM
ugacacaauuccc

SEQ ID NO: 4200382 - RNA, 20 nt, Yersinia pestis KIM
ugacaccauugauaauaaua

SEQ ID NO: 4200383 - RNA, 21 nt, Yersinia pestis KIM
ugacaccauugauaauaauau

SEQ ID NO: 4200384 - RNA, 19 nt, Yersinia pestis KIM
ugacaccggggauccauag

SEQ ID NO: 4200385 - RNA, 16 nt, Yersinia pestis KIM
ugacacgagaaggguu

SEQ ID NO: 4200386 - RNA, 18 nt, Yersinia pestis KIM
ugacacgagagauaauag

SEQ ID NO: 4200387 - RNA, 16 nt, Yersinia pestis KIM
ugacacggguauuggc

SEQ ID NO: 4200388 - RNA, 19 nt, Yersinia pestis KIM
ugacacugacauuuaugcc

SEQ ID NO: 4200389 - RNA, 13 nt, Yersinia pestis KIM
ugacacugcaucu

SEQ ID NO: 4200390 - RNA, 11 nt, Yersinia pestis KIM
ugacagcaacg

SEQ ID NO: 4200391 - RNA, 21 nt, Yersinia pestis KIM
ugacagccacaaccgccacuu

SEQ ID NO: 4200392 - RNA, 16 nt, Yersinia pestis KIM
ugacaguauuuguagu

SEQ ID NO: 4200393 - RNA, 14 nt, Yersinia pestis KIM
ugacauaaacacgc

SEQ ID NO: 4200394 - RNA, 13 nt, Yersinia pestis KIM
ugacaucccagca

SEQ ID NO: 4200395 - RNA, 17 nt, Yersinia pestis KIM
ugacaugcuuaauuauu

SEQ ID NO: 4200396 - RNA, 14 nt, Yersinia pestis KIM
ugacauguuccagu

SEQ ID NO: 4200397 - RNA, 14 nt, Yersinia pestis KIM
ugacauuuccuugu

SEQ ID NO: 4200398 - RNA, 20 nt, Yersinia pestis KIM
ugacauuucuuuuuauguua

SEQ ID NO: 4200399 - RNA, 15 nt, Yersinia pestis KIM
ugacauuuucuaucu

SEQ ID NO: 4200400 - RNA, 13 nt, Yersinia pestis KIM
ugaccaaacauug

SEQ ID NO: 4200401 - RNA, 14 nt, Yersinia pestis KIM
ugaccaauagucac

SEQ ID NO: 4200402 - RNA, 19 nt, Yersinia pestis KIM
ugaccacgcaucaauaaua

SEQ ID NO: 4200403 - RNA, 20 nt, Yersinia pestis KIM
ugaccacgcaucaauaauaa

SEQ ID NO: 4200404 - RNA, 16 nt, Yersinia pestis KIM
ugaccagaacgcaacg

SEQ ID NO: 4200405 - RNA, 15 nt, Yersinia pestis KIM
ugaccagauagcugu

SEQ ID NO: 4200406 - RNA, 19 nt, Yersinia pestis KIM
ugaccagcauacgugccaa

SEQ ID NO: 4200407 - RNA, 22 nt, Yersinia pestis KIM
ugaccagcgaaucaaacagguu

SEQ ID NO: 4200408 - RNA, 16 nt, Yersinia pestis KIM
ugaccagugaauaagu

SEQ ID NO: 4200409 - RNA, 16 nt, Yersinia pestis KIM
ugaccauuuauuucca

SEQ ID NO: 4200410 - RNA, 17 nt, Yersinia pestis KIM
ugacccgucagcguccu

SEQ ID NO: 4200411 - RNA, 17 nt, Yersinia pestis KIM
ugaccgaaccaccgcag

SEQ ID NO: 4200412 - RNA, 17 nt, Yersinia pestis KIM
ugaccgauugaaucaag

SEQ ID NO: 4200413 - RNA, 17 nt, Yersinia pestis KIM
ugaccgcacugcccagg

SEQ ID NO: 4200414 - RNA, 14 nt, Yersinia pestis KIM
ugaccgcagccuuc

SEQ ID NO: 4200415 - RNA, 15 nt, Yersinia pestis KIM
ugaccgcuguuugau

SEQ ID NO: 4200416 - RNA, 18 nt, Yersinia pestis KIM
ugaccggaugauaaaacg

SEQ ID NO: 4200417 - RNA, 13 nt, Yersinia pestis KIM
ugaccgguauaga

SEQ ID NO: 4200418 - RNA, 13 nt, Yersinia pestis KIM
ugaccuaaaccgc

SEQ ID NO: 4200419 - RNA, 20 nt, Yersinia pestis KIM
ugaccuauugauaaaaccgc

SEQ ID NO: 4200420 - RNA, 18 nt, Yersinia pestis KIM
ugaccuggaagaacagcu

SEQ ID NO: 4200421 - RNA, 15 nt, Yersinia pestis KIM
ugaccuuaauaccgu

SEQ ID NO: 4200422 - RNA, 21 nt, Yersinia pestis KIM
ugaccuuaauaccguguaccc

SEQ ID NO: 4200423 - RNA, 21 nt, Yersinia pestis KIM
ugacgaaauuuaagaaaucua

SEQ ID NO: 4200424 - RNA, 12 nt, Yersinia pestis KIM
ugacgaaugagc

SEQ ID NO: 4200425 - RNA, 15 nt, Yersinia pestis KIM
ugacgaugauaaauc

SEQ ID NO: 4200426 - RNA, 15 nt, Yersinia pestis KIM
ugacgcagcaggcgu

SEQ ID NO: 4200427 - RNA, 20 nt, Yersinia pestis KIM
ugacgccaacuucaagccga

SEQ ID NO: 4200428 - RNA, 16 nt, Yersinia pestis KIM
ugacgcgaucugaaac

SEQ ID NO: 4200429 - RNA, 21 nt, Yersinia pestis KIM
ugacgcuaaccaccgucacca

SEQ ID NO: 4200430 - RNA, 23 nt, Yersinia pestis KIM
ugacgcuaaccaccgucaccaaa

SEQ ID NO: 4200431 - RNA, 22 nt, Yersinia pestis KIM
ugacgcugacauucaaauacgg

SEQ ID NO: 4200432 - RNA, 15 nt, Yersinia pestis KIM
ugacgcugcaccgcu

SEQ ID NO: 4200433 - RNA, 14 nt, Yersinia pestis KIM
ugacgcuugaauau

SEQ ID NO: 4200434 - RNA, 21 nt, Yersinia pestis KIM
ugacggaaaauuaacuuauug

SEQ ID NO: 4200435 - RNA, 14 nt, Yersinia pestis KIM
ugacggcagcgagc

SEQ ID NO: 4200436 - RNA, 17 nt, Yersinia pestis KIM
ugacggcggcggaucaa

SEQ ID NO: 4200437 - RNA, 18 nt, Yersinia pestis KIM
ugacggggaguuuuuauu

SEQ ID NO: 4200438 - RNA, 17 nt, Yersinia pestis KIM
ugacggguauauuuaug

SEQ ID NO: 4200439 - RNA, 12 nt, Yersinia pestis KIM
ugacgggucagc

SEQ ID NO: 4200440 - RNA, 20 nt, Yersinia pestis KIM
ugacgggucagcugacgcag

SEQ ID NO: 4200441 - RNA, 15 nt, Yersinia pestis KIM
ugacggucagccaac

SEQ ID NO: 4200442 - RNA, 16 nt, Yersinia pestis KIM
ugacgguuuucugaau

SEQ ID NO: 4200443 - RNA, 22 nt, Yersinia pestis KIM
ugaguugcccuaaacagcaaca

SEQ ID NO: 4200444 - RNA, 21 nt, Yersinia pestis KIM
ugaguugcucaaguucaagca

SEQ ID NO: 4200445 - RNA, 16 nt, Yersinia pestis KIM
ugaguuucauuaguca

SEQ ID NO: 4200446 - RNA, 21 nt, Yersinia pestis KIM
ugaguuuuagcccaaaauaga

SEQ ID NO: 4200447 - RNA, 17 nt, Yersinia pestis KIM
ugaguuuucgauaacca

SEQ ID NO: 4200448 - RNA, 14 nt, Yersinia pestis KIM
ugauaaaauccuga

SEQ ID NO: 4200449 - RNA, 16 nt, Yersinia pestis KIM
ugauaaacaauaaaca

SEQ ID NO: 4200450 - RNA, 21 nt, Yersinia pestis KIM
ugauaaacccuacagcaaaca

SEQ ID NO: 4200451 - RNA, 18 nt, Yersinia pestis KIM
ugauaaacuguuuaagcu

SEQ ID NO: 4200452 - RNA, 15 nt, Yersinia pestis KIM
ugauaacaccggcuu

SEQ ID NO: 4200453 - RNA, 21 nt, Yersinia pestis KIM
ugauaaccucgguggcucaau

SEQ ID NO: 4200454 - RNA, 19 nt, Yersinia pestis KIM
ugauaacgccggauaaauu

SEQ ID NO: 4200455 - RNA, 21 nt, Yersinia pestis KIM
ugauaacgccggauaaauuaa

SEQ ID NO: 4200456 - RNA, 23 nt, Yersinia pestis KIM
ugauaacgucauuccaguaggga

SEQ ID NO: 4200457 - RNA, 19 nt, Yersinia pestis KIM
ugauaagccauuuuuuaua

SEQ ID NO: 4200458 - RNA, 15 nt, Yersinia pestis KIM
ugauaauaauauuga

SEQ ID NO: 4200459 - RNA, 14 nt, Yersinia pestis KIM
ugauaauaguucau

SEQ ID NO: 4200460 - RNA, 15 nt, Yersinia pestis KIM
ugauaaugccuuuua

SEQ ID NO: 4200461 - RNA, 20 nt, Yersinia pestis KIM
ugauaauuaaugcaccuaca

SEQ ID NO: 4200462 - RNA, 13 nt, Yersinia pestis KIM
ugauacagcaguu

SEQ ID NO: 4200463 - RNA, 16 nt, Yersinia pestis KIM
ugauaccacaauccgg

SEQ ID NO: 4200464 - RNA, 18 nt, Yersinia pestis KIM
ugauaccauugggucagu

SEQ ID NO: 4200465 - RNA, 12 nt, Yersinia pestis KIM
ugauacccaguu

SEQ ID NO: 4200466 - RNA, 17 nt, Yersinia pestis KIM
ugauaccggaaaaugcg

SEQ ID NO: 4200467 - RNA, 24 nt, Yersinia pestis KIM
ugauaccggaaaaugcgccagcca

SEQ ID NO: 4200468 - RNA, 19 nt, Yersinia pestis KIM
ugauaccguuuuauauuga

SEQ ID NO: 4200469 - RNA, 15 nt, Yersinia pestis KIM
ugauacuaaauuuag

SEQ ID NO: 4200470 - RNA, 22 nt, Yersinia pestis KIM
ugauacuccguuggcaaucugg

SEQ ID NO: 4200471 - RNA, 20 nt, Yersinia pestis KIM
ugauagaaaguugagcagca

SEQ ID NO: 4200472 - RNA, 20 nt, Yersinia pestis KIM
ugauagcaaacaaacaguaa

SEQ ID NO: 4200473 - RNA, 20 nt, Yersinia pestis KIM
ugauagcagaaacccccaac

SEQ ID NO: 4200474 - RNA, 23 nt, Yersinia pestis KIM
ugauagccaacacgaccugugca

SEQ ID NO: 4200475 - RNA, 13 nt, Yersinia pestis KIM
ugauaggcacggc

SEQ ID NO: 4200476 - RNA, 18 nt, Yersinia pestis KIM
ugauagguauugcgggug

SEQ ID NO: 4200477 - RNA, 15 nt, Yersinia pestis KIM
ugauauaaagcauuu

SEQ ID NO: 4200478 - RNA, 18 nt, Yersinia pestis KIM
ugauauaacgaauauuca

SEQ ID NO: 4200479 - RNA, 19 nt, Yersinia pestis KIM
ugauauaacgaauauucaa

SEQ ID NO: 4200480 - RNA, 22 nt, Yersinia pestis KIM
ugauaucagccagcuccugcca

SEQ ID NO: 4200481 - RNA, 15 nt, Yersinia pestis KIM
ugauaucucuuuauc

SEQ ID NO: 4200482 - RNA, 16 nt, Yersinia pestis KIM
ugauaucucuuuauca

SEQ ID NO: 4200483 - RNA, 17 nt, Yersinia pestis KIM
ugauaucuucacucagc

SEQ ID NO: 4200484 - RNA, 21 nt, Yersinia pestis KIM
ugauaucuucggcggcuaaag

SEQ ID NO: 4200485 - RNA, 17 nt, Yersinia pestis KIM
ugauaugaaaaaucuga

SEQ ID NO: 4200486 - RNA, 22 nt, Yersinia pestis KIM
ugauaugccugaaguugaucaa

SEQ ID NO: 4200487 - RNA, 15 nt, Yersinia pestis KIM
ugauauuaauaucag

SEQ ID NO: 4200488 - RNA, 19 nt, Yersinia pestis KIM
ugauauucucaccugcuua

SEQ ID NO: 4200489 - RNA, 13 nt, Yersinia pestis KIM
ugaucaacugccu

SEQ ID NO: 4200490 - RNA, 21 nt, Yersinia pestis KIM
ugaucaauaucccgagaaaca

SEQ ID NO: 4200491 - RNA, 18 nt, Yersinia pestis KIM
ugaucacaguaaauucuu

SEQ ID NO: 4200492 - RNA, 15 nt, Yersinia pestis KIM
ugaucacgcugaauu

SEQ ID NO: 4200493 - RNA, 20 nt, Yersinia pestis KIM
ugaucagauuucugaccgga

SEQ ID NO: 4200494 - RNA, 11 nt, Yersinia pestis KIM
ugaucagcagu

SEQ ID NO: 4200495 - RNA, 19 nt, Yersinia pestis KIM
ugaucagcaguggcuuggc

SEQ ID NO: 4200496 - RNA, 20 nt, Yersinia pestis KIM
ugaucagcuaacaaaaccgg

SEQ ID NO: 4200497 - RNA, 13 nt, Yersinia pestis KIM
ugaucaucaaacu

SEQ ID NO: 4200498 - RNA, 13 nt, Yersinia pestis KIM
ugaucaucagcag

SEQ ID NO: 4200499 - RNA, 14 nt, Yersinia pestis KIM
ugaucaucagcagc

SEQ ID NO: 4200500 - RNA, 16 nt, Yersinia pestis KIM
ugaucaucgcaccaua

SEQ ID NO: 4200501 - RNA, 14 nt, Yersinia pestis KIM
ugaucaucuuuuuu

SEQ ID NO: 4200502 - RNA, 16 nt, Yersinia pestis KIM
ugaucaugauuucucg

SEQ ID NO: 4200503 - RNA, 20 nt, Yersinia pestis KIM
ugaucauggcuugugcagca

SEQ ID NO: 4200504 - RNA, 14 nt, Yersinia pestis KIM
ugauccaggggucg

SEQ ID NO: 4200505 - RNA, 23 nt, Yersinia pestis KIM
ugaucccacugcccgaacggcag

SEQ ID NO: 4200506 - RNA, 21 nt, Yersinia pestis KIM
ugauccgauaaacuucacaau

SEQ ID NO: 4200507 - RNA, 18 nt, Yersinia pestis KIM
ugauccggcgaugaccga

SEQ ID NO: 4200508 - RNA, 17 nt, Yersinia pestis KIM
ugauccuggguuuuauu

SEQ ID NO: 4200509 - RNA, 17 nt, Yersinia pestis KIM
ugaucgagcaucaccaa

SEQ ID NO: 4200510 - RNA, 19 nt, Yersinia pestis KIM
ugaucgccgcuaauuuucc

SEQ ID NO: 4200511 - RNA, 15 nt, Yersinia pestis KIM
ugaucgccguacuug

SEQ ID NO: 4200512 - RNA, 17 nt, Yersinia pestis KIM
ugaucgguuagcuacug

SEQ ID NO: 4200513 - RNA, 18 nt, Yersinia pestis KIM
ugaucguuacggcugcgc

SEQ ID NO: 4200514 - RNA, 16 nt, Yersinia pestis KIM
ugaucugaguuucauu

SEQ ID NO: 4200515 - RNA, 12 nt, Yersinia pestis KIM
ugaucuggcuuu

SEQ ID NO: 4200516 - RNA, 23 nt, Yersinia pestis KIM
ugaucuguacccccguaucaacg

SEQ ID NO: 4200517 - RNA, 19 nt, Yersinia pestis KIM
ugaucuugaauaauauuca

SEQ ID NO: 4200518 - RNA, 22 nt, Yersinia pestis KIM
ugaucuugaauaauauucaaua

SEQ ID NO: 4200519 - RNA, 16 nt, Yersinia pestis KIM
ugaugaaacuaaaaua

SEQ ID NO: 4200520 - RNA, 13 nt, Yersinia pestis KIM
ugaugaaauuaaa

SEQ ID NO: 4200521 - RNA, 13 nt, Yersinia pestis KIM
ugaugaaguuauu

SEQ ID NO: 4200522 - RNA, 20 nt, Yersinia pestis KIM
ugaugaaguuauuuuuauua

SEQ ID NO: 4200523 - RNA, 15 nt, Yersinia pestis KIM
ugaugaaugacuggc

SEQ ID NO: 4200524 - RNA, 13 nt, Yersinia pestis KIM
ugaugacaaugcg

SEQ ID NO: 4200525 - RNA, 15 nt, Yersinia pestis KIM
ugaugacaaugcguu

SEQ ID NO: 4200526 - RNA, 16 nt, Yersinia pestis KIM
ugaugacaaugcguua

SEQ ID NO: 4200527 - RNA, 17 nt, Yersinia pestis KIM
ugaugacaaugcguuau

SEQ ID NO: 4200528 - RNA, 19 nt, Yersinia pestis KIM
ugaugacgccguacaaaua

SEQ ID NO: 4200529 - RNA, 22 nt, Yersinia pestis KIM
ugaugacgccguacaaauauaa

SEQ ID NO: 4200530 - RNA, 16 nt, Yersinia pestis KIM
ugaugacuauccucgu

SEQ ID NO: 4200531 - RNA, 16 nt, Yersinia pestis KIM
ugaugagcuguagaac

SEQ ID NO: 4200532 - RNA, 15 nt, Yersinia pestis KIM
ugaugaguaacauaa

SEQ ID NO: 4200533 - RNA, 14 nt, Yersinia pestis KIM
ugaugaguaauuuc

SEQ ID NO: 4200534 - RNA, 17 nt, Yersinia pestis KIM
ugaugagucuauuuauu

SEQ ID NO: 4200535 - RNA, 12 nt, Yersinia pestis KIM
ugaugauaucac

SEQ ID NO: 4200536 - RNA, 14 nt, Yersinia pestis KIM
ugaugaucaugcuc

SEQ ID NO: 4200537 - RNA, 20 nt, Yersinia pestis KIM
ugaugauuuggcugaauacc

SEQ ID NO: 4200538 - RNA, 14 nt, Yersinia pestis KIM
ugaugccaaauuaa

SEQ ID NO: 4200539 - RNA, 19 nt, Yersinia pestis KIM
ugaugccgguauccccgcu

SEQ ID NO: 4200540 - RNA, 15 nt, Yersinia pestis KIM
ugaugcgaucuaucc

SEQ ID NO: 4200541 - RNA, 22 nt, Yersinia pestis KIM
ugaugcguguaaugcgcaucug

SEQ ID NO: 4200542 - RNA, 21 nt, Yersinia pestis KIM
ugaugcucauuuaaaauacuc

SEQ ID NO: 4200543 - RNA, 18 nt, Yersinia pestis KIM
ugauggcaucuuauuauu

SEQ ID NO: 4200544 - RNA, 12 nt, Yersinia pestis KIM
ugauggccgcua

SEQ ID NO: 4200545 - RNA, 14 nt, Yersinia pestis KIM
ugauggccuugaau

SEQ ID NO: 4200546 - RNA, 17 nt, Yersinia pestis KIM
ugauggccuugaaucaa

SEQ ID NO: 4200547 - RNA, 17 nt, Yersinia pestis KIM
ugauggcgaucaaaauc

SEQ ID NO: 4200548 - RNA, 15 nt, Yersinia pestis KIM
ugaugggauuaauaa

SEQ ID NO: 4200549 - RNA, 19 nt, Yersinia pestis KIM
ugaugggauuaauaauggu

SEQ ID NO: 4200550 - RNA, 19 nt, Yersinia pestis KIM
ugauggguauauuaucauu

SEQ ID NO: 4200551 - RNA, 22 nt, Yersinia pestis KIM
ugauggguauauuaucauucaa

SEQ ID NO: 4200552 - RNA, 18 nt, Yersinia pestis KIM
ugauguaacagcggcgau

SEQ ID NO: 4200553 - RNA, 13 nt, Yersinia pestis KIM
ugauguaacucag

SEQ ID NO: 4200554 - RNA, 18 nt, Yersinia pestis KIM
ugauguaacucaggaucc

SEQ ID NO: 4200555 - RNA, 24 nt, Yersinia pestis KIM
ugauguaguguguuuucuuguaua

SEQ ID NO: 4200556 - RNA, 14 nt, Yersinia pestis KIM
ugaugucagugcuc

SEQ ID NO: 4200557 - RNA, 20 nt, Yersinia pestis KIM
ugaugucaugauaaaacuau

SEQ ID NO: 4200558 - RNA, 20 nt, Yersinia pestis KIM
ugcaggcuaccagaaauaac

SEQ ID NO: 4200559 - RNA, 17 nt, Yersinia pestis KIM
ugcaggcugucaggaac

SEQ ID NO: 4200560 - RNA, 12 nt, Yersinia pestis KIM
ugcaguaaaaau

SEQ ID NO: 4200561 - RNA, 17 nt, Yersinia pestis KIM
ugcaguaaaaauauuaa

SEQ ID NO: 4200562 - RNA, 14 nt, Yersinia pestis KIM
ugcaguaaauaguc

SEQ ID NO: 4200563 - RNA, 15 nt, Yersinia pestis KIM
ugcaguaacauaauc

SEQ ID NO: 4200564 - RNA, 13 nt, Yersinia pestis KIM
ugcaguaaccagu

SEQ ID NO: 4200565 - RNA, 23 nt, Yersinia pestis KIM
ugcaguaaccccuucgagcaccg

SEQ ID NO: 4200566 - RNA, 14 nt, Yersinia pestis KIM
ugcaguacagauaa

SEQ ID NO: 4200567 - RNA, 17 nt, Yersinia pestis KIM
ugcaguaucccuggcuc

SEQ ID NO: 4200568 - RNA, 22 nt, Yersinia pestis KIM
ugcagucagcacuccguuacca

SEQ ID NO: 4200569 - RNA, 16 nt, Yersinia pestis KIM
ugcagugcaaccaaca

SEQ ID NO: 4200570 - RNA, 17 nt, Yersinia pestis KIM
ugcaguuggaucugcac

SEQ ID NO: 4200571 - RNA, 19 nt, Yersinia pestis KIM
ugcaguuucuaccgcuuca

SEQ ID NO: 4200572 - RNA, 18 nt, Yersinia pestis KIM
ugcaguuuuccucccugc

SEQ ID NO: 4200573 - RNA, 22 nt, Yersinia pestis KIM
ugcaguuuuccucccugccaag

SEQ ID NO: 4200574 - RNA, 23 nt, Yersinia pestis KIM
ugcauacccgucguacuuuaagc

SEQ ID NO: 4200575 - RNA, 20 nt, Yersinia pestis KIM
ugcauacucacuuaagccac

SEQ ID NO: 4200576 - RNA, 19 nt, Yersinia pestis KIM
ugcauagcgugauuuuuau

SEQ ID NO: 4200577 - RNA, 14 nt, Yersinia pestis KIM
ugcauagcuaaccu

SEQ ID NO: 4200578 - RNA, 14 nt, Yersinia pestis KIM
ugcauauaaaacac

SEQ ID NO: 4200579 - RNA, 19 nt, Yersinia pestis KIM
ugcauauaaaacacgcaua

SEQ ID NO: 4200580 - RNA, 20 nt, Yersinia pestis KIM
ugcauauaaaacacgcauau

SEQ ID NO: 4200581 - RNA, 20 nt, Yersinia pestis KIM
ugcauaucauucgguuauuu

SEQ ID NO: 4200582 - RNA, 22 nt, Yersinia pestis KIM
ugcauauguagggguacagcag

SEQ ID NO: 4200583 - RNA, 12 nt, Yersinia pestis KIM
ugcauauuucuc

SEQ ID NO: 4200584 - RNA, 14 nt, Yersinia pestis KIM
ugcauauuucucuu

SEQ ID NO: 4200585 - RNA, 20 nt, Yersinia pestis KIM
ugcaucaacgacagcagcag

SEQ ID NO: 4200586 - RNA, 21 nt, Yersinia pestis KIM
ugcaucaacgacagcagcagg

SEQ ID NO: 4200587 - RNA, 16 nt, Yersinia pestis KIM
ugcaucaauaaauaga

SEQ ID NO: 4200588 - RNA, 17 nt, Yersinia pestis KIM
ugcaucaucacauucaa

SEQ ID NO: 4200589 - RNA, 19 nt, Yersinia pestis KIM
ugcaucaucacauucaaac

SEQ ID NO: 4200590 - RNA, 21 nt, Yersinia pestis KIM
ugcauccacuuuuucucuccu

SEQ ID NO: 4200591 - RNA, 23 nt, Yersinia pestis KIM
ugcaucgcgggcgcgcugcugcu

SEQ ID NO: 4200592 - RNA, 17 nt, Yersinia pestis KIM
ugcaucggauugcaaca

SEQ ID NO: 4200593 - RNA, 19 nt, Yersinia pestis KIM
ugcaucguggucaccgcca

SEQ ID NO: 4200594 - RNA, 11 nt, Yersinia pestis KIM
ugcaucucugc

SEQ ID NO: 4200595 - RNA, 15 nt, Yersinia pestis KIM
ugcaucucugcauca

SEQ ID NO: 4200596 - RNA, 19 nt, Yersinia pestis KIM
ugcaucuggucaucaugua

SEQ ID NO: 4200597 - RNA, 20 nt, Yersinia pestis KIM
ugcaucuggugacccgucag

SEQ ID NO: 4200598 - RNA, 17 nt, Yersinia pestis KIM
ugcaugaaaacccuguu

SEQ ID NO: 4200599 - RNA, 12 nt, Yersinia pestis KIM
ugcauugauuaa

SEQ ID NO: 4200600 - RNA, 12 nt, Yersinia pestis KIM
ugcauuggaaaa

SEQ ID NO: 4200601 - RNA, 20 nt, Yersinia pestis KIM
ugcauuucguuccagugagc

SEQ ID NO: 4200602 - RNA, 19 nt, Yersinia pestis KIM
ugcauuugauacuaaauuu

SEQ ID NO: 4200603 - RNA, 18 nt, Yersinia pestis KIM
ugccaaauaucuuucagc

SEQ ID NO: 4200604 - RNA, 12 nt, Yersinia pestis KIM
ugccaaauauug

SEQ ID NO: 4200605 - RNA, 18 nt, Yersinia pestis KIM
ugccaacaacuuaauucc

SEQ ID NO: 4200606 - RNA, 21 nt, Yersinia pestis KIM
ugccaacagcgagauagucag

SEQ ID NO: 4200607 - RNA, 22 nt, Yersinia pestis KIM
ugccaacggacggaauccaaca

SEQ ID NO: 4200608 - RNA, 18 nt, Yersinia pestis KIM
ugccaaggccgaucaaca

SEQ ID NO: 4200609 - RNA, 19 nt, Yersinia pestis KIM
ugccaagguucgaaaaaac

SEQ ID NO: 4200610 - RNA, 22 nt, Yersinia pestis KIM
ugccaagguucgaaaaaacauc

SEQ ID NO: 4200611 - RNA, 14 nt, Yersinia pestis KIM
ugccaagucucuag

SEQ ID NO: 4200612 - RNA, 23 nt, Yersinia pestis KIM
ugccaaucgcucugcguuuuucc

SEQ ID NO: 4200613 - RNA, 18 nt, Yersinia pestis KIM
ugccaaugccucuucaau

SEQ ID NO: 4200614 - RNA, 20 nt, Yersinia pestis KIM
ugccaaugccucuucaauac

SEQ ID NO: 4200615 - RNA, 21 nt, Yersinia pestis KIM
ugccaauugacgccacuuauc

SEQ ID NO: 4200616 - RNA, 21 nt, Yersinia pestis KIM
ugccacacagaaucaccaaca

SEQ ID NO: 4200617 - RNA, 14 nt, Yersinia pestis KIM
ugccacacucagac

SEQ ID NO: 4200618 - RNA, 19 nt, Yersinia pestis KIM
ugccacagacuuucuuuaa

SEQ ID NO: 4200619 - RNA, 13 nt, Yersinia pestis KIM
ugccacauuuccc

SEQ ID NO: 4200620 - RNA, 21 nt, Yersinia pestis KIM
ugccacgccaguaaacagcca

SEQ ID NO: 4200621 - RNA, 19 nt, Yersinia pestis KIM
ugccacggauauccaacgg

SEQ ID NO: 4200622 - RNA, 21 nt, Yersinia pestis KIM
ugccacggauauccaacggua

SEQ ID NO: 4200623 - RNA, 15 nt, Yersinia pestis KIM
ugccacugacugcuu

SEQ ID NO: 4200624 - RNA, 16 nt, Yersinia pestis KIM
ugccacugacugcuuu

SEQ ID NO: 4200625 - RNA, 12 nt, Yersinia pestis KIM
ugccacuguuca

SEQ ID NO: 4200626 - RNA, 13 nt, Yersinia pestis KIM
ugccacuguuuuu

SEQ ID NO: 4200627 - RNA, 15 nt, Yersinia pestis KIM
ugccacuguuuuucc

SEQ ID NO: 4200628 - RNA, 21 nt, Yersinia pestis KIM
ugccacuguuuuuccagcccu

SEQ ID NO: 4200629 - RNA, 15 nt, Yersinia pestis KIM
ugccagaacagcagg

SEQ ID NO: 4200630 - RNA, 20 nt, Yersinia pestis KIM
ugccagaaucgccugcacac

SEQ ID NO: 4200631 - RNA, 22 nt, Yersinia pestis KIM
ugccagaaucgccugcacacgg

SEQ ID NO: 4200632 - RNA, 17 nt, Yersinia pestis KIM
ugccagacacaagauaa

SEQ ID NO: 4200633 - RNA, 19 nt, Yersinia pestis KIM
ugccagacacaagauaaau

SEQ ID NO: 4200634 - RNA, 22 nt, Yersinia pestis KIM
ugccagacacaagauaaauacc

SEQ ID NO: 4200635 - RNA, 13 nt, Yersinia pestis KIM
ugccagauaguca

SEQ ID NO: 4200636 - RNA, 18 nt, Yersinia pestis KIM
ugccagcaaagacaauaa

SEQ ID NO: 4200637 - RNA, 18 nt, Yersinia pestis KIM
ugccagcaccgcuuucaa

SEQ ID NO: 4200638 - RNA, 14 nt, Yersinia pestis KIM
ugccagcagcaagu

SEQ ID NO: 4200639 - RNA, 12 nt, Yersinia pestis KIM
ugccagcccauc

SEQ ID NO: 4200640 - RNA, 16 nt, Yersinia pestis KIM
ugccagccccaaucac

SEQ ID NO: 4200641 - RNA, 13 nt, Yersinia pestis KIM
ugccagcccugau

SEQ ID NO: 4200642 - RNA, 21 nt, Yersinia pestis KIM
ugccagccuguuuaguaaaua

SEQ ID NO: 4200643 - RNA, 14 nt, Yersinia pestis KIM
ugccagcgaaaauu

SEQ ID NO: 4200644 - RNA, 19 nt, Yersinia pestis KIM
ugccagcgcuuuaggcaag

SEQ ID NO: 4200645 - RNA, 22 nt, Yersinia pestis KIM
ugccagggcguuuaccauccag

SEQ ID NO: 4200646 - RNA, 21 nt, Yersinia pestis KIM
ugccaguaauucacugcuuaa

SEQ ID NO: 4200647 - RNA, 20 nt, Yersinia pestis KIM
ugccaguuauuauuuuuaau

SEQ ID NO: 4200648 - RNA, 21 nt, Yersinia pestis KIM
ugccaguuauuauuuuuaaug

SEQ ID NO: 4200649 - RNA, 22 nt, Yersinia pestis KIM
ugccaguucaucagcccagcgg

SEQ ID NO: 4200650 - RNA, 22 nt, Yersinia pestis KIM
ugccauaaaguuuuuccucaaa

SEQ ID NO: 4200651 - RNA, 14 nt, Yersinia pestis KIM
ugccauaacaucgu

SEQ ID NO: 4200652 - RNA, 21 nt, Yersinia pestis KIM
ugccauaaccgcuaaggccaa

SEQ ID NO: 4200653 - RNA, 22 nt, Yersinia pestis KIM
ugccauaagcggacauggcaac

SEQ ID NO: 4200654 - RNA, 23 nt, Yersinia pestis KIM
ugccauaagcggacauggcaaca

SEQ ID NO: 4200655 - RNA, 13 nt, Yersinia pestis KIM
ugccauaauccag

SEQ ID NO: 4200656 - RNA, 14 nt, Yersinia pestis KIM
ugccauaccaggcc

SEQ ID NO: 4200657 - RNA, 21 nt, Yersinia pestis KIM
ugccauacccugguagcacca

SEQ ID NO: 4200658 - RNA, 16 nt, Yersinia pestis KIM
ugccauacggcgucuu

SEQ ID NO: 4200659 - RNA, 20 nt, Yersinia pestis KIM
ugccauauuacucucuauug

SEQ ID NO: 4200660 - RNA, 19 nt, Yersinia pestis KIM
ugccaucaauaccaauaaa

SEQ ID NO: 4200661 - RNA, 12 nt, Yersinia pestis KIM
ugccauccugcc

SEQ ID NO: 4200662 - RNA, 15 nt, Yersinia pestis KIM
ugccaucgccaacag

SEQ ID NO: 4200663 - RNA, 18 nt, Yersinia pestis KIM
ugccaucgcuugauaaca

SEQ ID NO: 4200664 - RNA, 21 nt, Yersinia pestis KIM
ugccaugauguggcugcuguu

SEQ ID NO: 4200665 - RNA, 16 nt, Yersinia pestis KIM
ugccaugucacuguuc

SEQ ID NO: 4200666 - RNA, 16 nt, Yersinia pestis KIM
ugcccaauggcaaaac

SEQ ID NO: 4200667 - RNA, 13 nt, Yersinia pestis KIM
ugcccagaaaacc

SEQ ID NO: 4200668 - RNA, 16 nt, Yersinia pestis KIM
ugcccagaaaaccccc

SEQ ID NO: 4200669 - RNA, 19 nt, Yersinia pestis KIM
ugcccagagcgcggcuuca

SEQ ID NO: 4200670 - RNA, 15 nt, Yersinia pestis KIM
ugcccagagugacaa

SEQ ID NO: 4200671 - RNA, 14 nt, Yersinia pestis KIM
ugcccagccucugg

SEQ ID NO: 4200672 - RNA, 14 nt, Yersinia pestis KIM
ugcggauucaccca

SEQ ID NO: 4200673 - RNA, 23 nt, Yersinia pestis KIM
ugcggauuuuuuugcaauuaauu

SEQ ID NO: 4200674 - RNA, 22 nt, Yersinia pestis KIM
ugcggcauaaauucuagcaaca

SEQ ID NO: 4200675 - RNA, 23 nt, Yersinia pestis KIM
ugcggcggagagaaauaggcagg

SEQ ID NO: 4200676 - RNA, 18 nt, Yersinia pestis KIM
ugcggcggcugaccacaa

SEQ ID NO: 4200677 - RNA, 21 nt, Yersinia pestis KIM
ugcggcuugagcuuauaucaa

SEQ ID NO: 4200678 - RNA, 17 nt, Yersinia pestis KIM
ugcgggauucgaaccug

SEQ ID NO: 4200679 - RNA, 23 nt, Yersinia pestis KIM
ugcggguauuugucgucccaggc

SEQ ID NO: 4200680 - RNA, 14 nt, Yersinia pestis KIM
ugcgggugccgcau

SEQ ID NO: 4200681 - RNA, 19 nt, Yersinia pestis KIM
ugcggguucaagucccgcc

SEQ ID NO: 4200682 - RNA, 23 nt, Yersinia pestis KIM
ugcgguaaccagcaucaguagca

SEQ ID NO: 4200683 - RNA, 15 nt, Yersinia pestis KIM
ugcgguacgcaggcc

SEQ ID NO: 4200684 - RNA, 11 nt, Yersinia pestis KIM
ugcggucuggc

SEQ ID NO: 4200685 - RNA, 15 nt, Yersinia pestis KIM
ugcgguggcacugac

SEQ ID NO: 4200686 - RNA, 12 nt, Yersinia pestis KIM
ugcgguggccag

SEQ ID NO: 4200687 - RNA, 17 nt, Yersinia pestis KIM
ugcgguuacgggugauu

SEQ ID NO: 4200688 - RNA, 16 nt, Yersinia pestis KIM
ugcgguuauuugcuau

SEQ ID NO: 4200689 - RNA, 22 nt, Yersinia pestis KIM
ugcgguucuguaucauauguuc

SEQ ID NO: 4200690 - RNA, 16 nt, Yersinia pestis KIM
ugcguacaacauccag

SEQ ID NO: 4200691 - RNA, 23 nt, Yersinia pestis KIM
ugcguaccauauggaugaugcac

SEQ ID NO: 4200692 - RNA, 19 nt, Yersinia pestis KIM
ugcguacgccaacuuuugc

SEQ ID NO: 4200693 - RNA, 16 nt, Yersinia pestis KIM
ugcgucaguucaagca

SEQ ID NO: 4200694 - RNA, 19 nt, Yersinia pestis KIM
ugcgucaguucaagcagcu

SEQ ID NO: 4200695 - RNA, 14 nt, Yersinia pestis KIM
ugcgucauaccauu

SEQ ID NO: 4200696 - RNA, 22 nt, Yersinia pestis KIM
ugcguccuuugcccauaaaccc

SEQ ID NO: 4200697 - RNA, 23 nt, Yersinia pestis KIM
ugcgugacauacuuugccuuauc

SEQ ID NO: 4200698 - RNA, 19 nt, Yersinia pestis KIM
ugcgugcaauaaagcgaua

SEQ ID NO: 4200699 - RNA, 23 nt, Yersinia pestis KIM
ugcgugcaauaaagcgauaaaua

SEQ ID NO: 4200700 - RNA, 16 nt, Yersinia pestis KIM
ugcguguggucagcac

SEQ ID NO: 4200701 - RNA, 21 nt, Yersinia pestis KIM
ugcguguggucagcacaaaca

SEQ ID NO: 4200702 - RNA, 20 nt, Yersinia pestis KIM
ugcguguucuucucaccccg

SEQ ID NO: 4200703 - RNA, 23 nt, Yersinia pestis KIM
ugcguugugguuggucguauccu

SEQ ID NO: 4200704 - RNA, 18 nt, Yersinia pestis KIM
ugcguuuuugaaauacca

SEQ ID NO: 4200705 - RNA, 22 nt, Yersinia pestis KIM
ugcuacggauugcaaauccguc

SEQ ID NO: 4200706 - RNA, 12 nt, Yersinia pestis KIM
ugcuacggcaaa

SEQ ID NO: 4200707 - RNA, 15 nt, Yersinia pestis KIM
ugcuacggcaaaaua

SEQ ID NO: 4200708 - RNA, 21 nt, Yersinia pestis KIM
ugcuacguaaugaugaugagu

SEQ ID NO: 4200709 - RNA, 14 nt, Yersinia pestis KIM
ugcuacuuaacguu

SEQ ID NO: 4200710 - RNA, 16 nt, Yersinia pestis KIM
ugcuagguuuacuguu

SEQ ID NO: 4200711 - RNA, 13 nt, Yersinia pestis KIM
ugcuaguauuauc

SEQ ID NO: 4200712 - RNA, 15 nt, Yersinia pestis KIM
ugcuagugaaccgua

SEQ ID NO: 4200713 - RNA, 18 nt, Yersinia pestis KIM
ugcuauauuuuuuauaua

SEQ ID NO: 4200714 - RNA, 13 nt, Yersinia pestis KIM
ugcuaucaauaaa

SEQ ID NO: 4200715 - RNA, 20 nt, Yersinia pestis KIM
ugcuauggguaauccccacc

SEQ ID NO: 4200716 - RNA, 14 nt, Yersinia pestis KIM
ugcuauuaaacauu

SEQ ID NO: 4200717 - RNA, 16 nt, Yersinia pestis KIM
ugcuauuaacccgcug

SEQ ID NO: 4200718 - RNA, 16 nt, Yersinia pestis KIM
ugcuauugaacauuca

SEQ ID NO: 4200719 - RNA, 22 nt, Yersinia pestis KIM
ugcuauuuagguaguuuuauuc

SEQ ID NO: 4200720 - RNA, 15 nt, Yersinia pestis KIM
ugcuauuucauugau

SEQ ID NO: 4200721 - RNA, 15 nt, Yersinia pestis KIM
ugcuauuuuauaucg

SEQ ID NO: 4200722 - RNA, 16 nt, Yersinia pestis KIM
ugcuauuuuauaucga

SEQ ID NO: 4200723 - RNA, 15 nt, Yersinia pestis KIM
ugcucaaacucagca

SEQ ID NO: 4200724 - RNA, 18 nt, Yersinia pestis KIM
ugcucaaacucagcauca

SEQ ID NO: 4200725 - RNA, 17 nt, Yersinia pestis KIM
ugcucaaacuugaucag

SEQ ID NO: 4200726 - RNA, 13 nt, Yersinia pestis KIM
ugcucaacugcuc

SEQ ID NO: 4200727 - RNA, 16 nt, Yersinia pestis KIM
ugcucaccauguacau

SEQ ID NO: 4200728 - RNA, 19 nt, Yersinia pestis KIM
ugcucacccauuuuauccu

SEQ ID NO: 4200729 - RNA, 15 nt, Yersinia pestis KIM
ugcucacgcaaauaa

SEQ ID NO: 4200730 - RNA, 21 nt, Yersinia pestis KIM
ugcucacgcagaacgaucugu

SEQ ID NO: 4200731 - RNA, 21 nt, Yersinia pestis KIM
ugcucacgguagguuucuggg

SEQ ID NO: 4200732 - RNA, 14 nt, Yersinia pestis KIM
ugcucacucaccgc

SEQ ID NO: 4200733 - RNA, 21 nt, Yersinia pestis KIM
ugcucacuggaguuaaauccc

SEQ ID NO: 4200734 - RNA, 16 nt, Yersinia pestis KIM
ugcucacuuuuaucca

SEQ ID NO: 4200735 - RNA, 18 nt, Yersinia pestis KIM
ugcucaucaaccucagcc

SEQ ID NO: 4200736 - RNA, 19 nt, Yersinia pestis KIM
ugcucaucaaccucagccu

SEQ ID NO: 4200737 - RNA, 20 nt, Yersinia pestis KIM
ugcucaucaguuggucuuua

SEQ ID NO: 4200738 - RNA, 13 nt, Yersinia pestis KIM
ugcucauguucau

SEQ ID NO: 4200739 - RNA, 15 nt, Yersinia pestis KIM
ugcucauguucaugu

SEQ ID NO: 4200740 - RNA, 16 nt, Yersinia pestis KIM
ugcucauuaccaauac

SEQ ID NO: 4200741 - RNA, 14 nt, Yersinia pestis KIM
ugcucauuuaaaau

SEQ ID NO: 4200742 - RNA, 18 nt, Yersinia pestis KIM
ugcucauuuaaaauacuc

SEQ ID NO: 4200743 - RNA, 21 nt, Yersinia pestis KIM
ugcuccaucuuuuacaaauuu

SEQ ID NO: 4200744 - RNA, 13 nt, Yersinia pestis KIM
ugcucccauguca

SEQ ID NO: 4200745 - RNA, 14 nt, Yersinia pestis KIM
ugcucccgcacucu

SEQ ID NO: 4200746 - RNA, 15 nt, Yersinia pestis KIM
ugcucccuccugccc

SEQ ID NO: 4200747 - RNA, 17 nt, Yersinia pestis KIM
ugcuccgcaauuugccc

SEQ ID NO: 4200748 - RNA, 13 nt, Yersinia pestis KIM
ugcuccgggcaag

SEQ ID NO: 4200749 - RNA, 14 nt, Yersinia pestis KIM
ugcuccugaugacu

SEQ ID NO: 4200750 - RNA, 18 nt, Yersinia pestis KIM
ugcuccuuacuauuuuca

SEQ ID NO: 4200751 - RNA, 23 nt, Yersinia pestis KIM
ugcucgauuucacuugccgccuu

SEQ ID NO: 4200752 - RNA, 18 nt, Yersinia pestis KIM
ugcucgucuucgacagca

SEQ ID NO: 4200753 - RNA, 23 nt, Yersinia pestis KIM
ugcucuacgccccaugcaccuuc

SEQ ID NO: 4200754 - RNA, 16 nt, Yersinia pestis KIM
ugcucucguugcauua

SEQ ID NO: 4200755 - RNA, 16 nt, Yersinia pestis KIM
ugcucuucaccaaagg

SEQ ID NO: 4200756 - RNA, 15 nt, Yersinia pestis KIM
ugcugaaaacaauau

SEQ ID NO: 4200757 - RNA, 17 nt, Yersinia pestis KIM
ugcugaagccagcaccg

SEQ ID NO: 4200758 - RNA, 13 nt, Yersinia pestis KIM
ugcugacaaaccc

SEQ ID NO: 4200759 - RNA, 21 nt, Yersinia pestis KIM
ugcugacaaaguuaaaugaag

SEQ ID NO: 4200760 - RNA, 22 nt, Yersinia pestis KIM
ugcugacaaaguuaaaugaagg

SEQ ID NO: 4200761 - RNA, 14 nt, Yersinia pestis KIM
ugcugacaacccuc

SEQ ID NO: 4200762 - RNA, 18 nt, Yersinia pestis KIM
ugcugaccccaaauuuga

SEQ ID NO: 4200763 - RNA, 20 nt, Yersinia pestis KIM
ugcugacgauaacuuuuggc

SEQ ID NO: 4200764 - RNA, 14 nt, Yersinia pestis KIM
ugcugagugaagac

SEQ ID NO: 4200765 - RNA, 16 nt, Yersinia pestis KIM
ugcugaucgagcauca

SEQ ID NO: 4200766 - RNA, 14 nt, Yersinia pestis KIM
ugcugaugcccauc

SEQ ID NO: 4200767 - RNA, 16 nt, Yersinia pestis KIM
ugcugcaaggcauuaa

SEQ ID NO: 4200768 - RNA, 20 nt, Yersinia pestis KIM
ugcugcacaaguuggugcag

SEQ ID NO: 4200769 - RNA, 21 nt, Yersinia pestis KIM
ugcugcccggucgccauaauu

SEQ ID NO: 4200770 - RNA, 15 nt, Yersinia pestis KIM
ugcugcccuuugcug

SEQ ID NO: 4200771 - RNA, 16 nt, Yersinia pestis KIM
ugcugcgggcacuauc

SEQ ID NO: 4200772 - RNA, 12 nt, Yersinia pestis KIM
ugcugcuguuau

SEQ ID NO: 4200773 - RNA, 13 nt, Yersinia pestis KIM
ugcugcuguuauu

SEQ ID NO: 4200774 - RNA, 13 nt, Yersinia pestis KIM
ugcugcuuccugc

SEQ ID NO: 4200775 - RNA, 21 nt, Yersinia pestis KIM
ugcuggauuuuuaucuuucug

SEQ ID NO: 4200776 - RNA, 22 nt, Yersinia pestis KIM
ugcuggcguuuuccucgugaaa

SEQ ID NO: 4200777 - RNA, 21 nt, Yersinia pestis KIM
ugcuggcuaauacuggcuaaa

SEQ ID NO: 4200778 - RNA, 17 nt, Yersinia pestis KIM
ugcuggggacuuuucuu

SEQ ID NO: 4200779 - RNA, 18 nt, Yersinia pestis KIM
ugcuggucuccgcuggca

SEQ ID NO: 4200780 - RNA, 17 nt, Yersinia pestis KIM
ugcuggugggccugcug

SEQ ID NO: 4200781 - RNA, 21 nt, Yersinia pestis KIM
ugcuguagcgauaagugcagc

SEQ ID NO: 4200782 - RNA, 15 nt, Yersinia pestis KIM
ugcuguauuuaaccg

SEQ ID NO: 4200783 - RNA, 21 nt, Yersinia pestis KIM
ugcugugacucuuaguuauga

SEQ ID NO: 4200784 - RNA, 23 nt, Yersinia pestis KIM
ugcugugagccagagacauaaag

SEQ ID NO: 4200785 - RNA, 16 nt, Yersinia pestis KIM
ugcugugcgauuucac

SEQ ID NO: 4200786 - RNA, 19 nt, Yersinia pestis KIM
ugcuguggguucaucaacu

SEQ ID NO: 4200787 - RNA, 15 nt, Yersinia pestis KIM
uggcauauucaccag

SEQ ID NO: 4200788 - RNA, 15 nt, Yersinia pestis KIM
uggcaucaaauuuag

SEQ ID NO: 4200789 - RNA, 18 nt, Yersinia pestis KIM
uggcaucaaauuuaguca

SEQ ID NO: 4200790 - RNA, 22 nt, Yersinia pestis KIM
uggcaucaccgcuaucacugau

SEQ ID NO: 4200791 - RNA, 17 nt, Yersinia pestis KIM
uggcauccucaggaugg

SEQ ID NO: 4200792 - RNA, 12 nt, Yersinia pestis KIM
uggcaugacuga

SEQ ID NO: 4200793 - RNA, 18 nt, Yersinia pestis KIM
uggcauguucacaucggu

SEQ ID NO: 4200794 - RNA, 19 nt, Yersinia pestis KIM
uggcauuagacauucaagc

SEQ ID NO: 4200795 - RNA, 22 nt, Yersinia pestis KIM
uggcauuggcguuuuggauaac

SEQ ID NO: 4200796 - RNA, 14 nt, Yersinia pestis KIM
uggcauuuaaaagg

SEQ ID NO: 4200797 - RNA, 18 nt, Yersinia pestis KIM
uggcauuuaaaaggcgcu

SEQ ID NO: 4200798 - RNA, 12 nt, Yersinia pestis KIM
uggcauuuucag

SEQ ID NO: 4200799 - RNA, 15 nt, Yersinia pestis KIM
uggcauuuucaguau

SEQ ID NO: 4200800 - RNA, 17 nt, Yersinia pestis KIM
uggcauuuuuuacgguu

SEQ ID NO: 4200801 - RNA, 20 nt, Yersinia pestis KIM
uggcauuuuuuacgguucca

SEQ ID NO: 4200802 - RNA, 23 nt, Yersinia pestis KIM
uggccaacaggcggguucuucag

SEQ ID NO: 4200803 - RNA, 16 nt, Yersinia pestis KIM
uggccacagaguggcg

SEQ ID NO: 4200804 - RNA, 21 nt, Yersinia pestis KIM
uggccagacacugacaucauc

SEQ ID NO: 4200805 - RNA, 22 nt, Yersinia pestis KIM
uggccagaugauaccgcgguca

SEQ ID NO: 4200806 - RNA, 19 nt, Yersinia pestis KIM
uggccagcgggaaucaaac

SEQ ID NO: 4200807 - RNA, 15 nt, Yersinia pestis KIM
uggccaguaaaaccu

SEQ ID NO: 4200808 - RNA, 17 nt, Yersinia pestis KIM
uggccaguaaaaccuga

SEQ ID NO: 4200809 - RNA, 18 nt, Yersinia pestis KIM
uggccaugaaucaaauua

SEQ ID NO: 4200810 - RNA, 16 nt, Yersinia pestis KIM
uggccauggaaaccgg

SEQ ID NO: 4200811 - RNA, 13 nt, Yersinia pestis KIM
uggccauguugug

SEQ ID NO: 4200812 - RNA, 12 nt, Yersinia pestis KIM
uggcccaagcca

SEQ ID NO: 4200813 - RNA, 15 nt, Yersinia pestis KIM
uggcccaagccaucc

SEQ ID NO: 4200814 - RNA, 17 nt, Yersinia pestis KIM
uggcccaagccauccuu

SEQ ID NO: 4200815 - RNA, 18 nt, Yersinia pestis KIM
uggcccaagccauccuuc

SEQ ID NO: 4200816 - RNA, 16 nt, Yersinia pestis KIM
uggcccacuguuaccc

SEQ ID NO: 4200817 - RNA, 20 nt, Yersinia pestis KIM
uggccccaauuguuucuucc

SEQ ID NO: 4200818 - RNA, 21 nt, Yersinia pestis KIM
uggccccaucaucucugcccc

SEQ ID NO: 4200819 - RNA, 16 nt, Yersinia pestis KIM
uggcccggaagguuuc

SEQ ID NO: 4200820 - RNA, 13 nt, Yersinia pestis KIM
uggcccucugccg

SEQ ID NO: 4200821 - RNA, 19 nt, Yersinia pestis KIM
uggcccugauuguuuuuau

SEQ ID NO: 4200822 - RNA, 14 nt, Yersinia pestis KIM
uggccgaaauggaa

SEQ ID NO: 4200823 - RNA, 18 nt, Yersinia pestis KIM
uggccgaaauggaaaggc

SEQ ID NO: 4200824 - RNA, 17 nt, Yersinia pestis KIM
uggccgacauuauguuc

SEQ ID NO: 4200825 - RNA, 23 nt, Yersinia pestis KIM
uggccgcuuugguugccagauaa

SEQ ID NO: 4200826 - RNA, 15 nt, Yersinia pestis KIM
uggccggauaaugag

SEQ ID NO: 4200827 - RNA, 17 nt, Yersinia pestis KIM
uggccggcuacugguca

SEQ ID NO: 4200828 - RNA, 19 nt, Yersinia pestis KIM
uggccgggauuugcucaga

SEQ ID NO: 4200829 - RNA, 21 nt, Yersinia pestis KIM
uggccuacggaggucaaauga

SEQ ID NO: 4200830 - RNA, 21 nt, Yersinia pestis KIM
uggccuauuaagauaauuauc

SEQ ID NO: 4200831 - RNA, 14 nt, Yersinia pestis KIM
uggccucgaagagg

SEQ ID NO: 4200832 - RNA, 15 nt, Yersinia pestis KIM
uggccugcacaucaa

SEQ ID NO: 4200833 - RNA, 21 nt, Yersinia pestis KIM
uggccuuagcacguuuuucag

SEQ ID NO: 4200834 - RNA, 21 nt, Yersinia pestis KIM
uggcgaagagaacaggcagca

SEQ ID NO: 4200835 - RNA, 22 nt, Yersinia pestis KIM
uggcgagguaccgcugcccggc

SEQ ID NO: 4200836 - RNA, 16 nt, Yersinia pestis KIM
uggcgaucaagguuuc

SEQ ID NO: 4200837 - RNA, 22 nt, Yersinia pestis KIM
uggcgauuuaauguauucaagc

SEQ ID NO: 4200838 - RNA, 12 nt, Yersinia pestis KIM
uggcgauuucag

SEQ ID NO: 4200839 - RNA, 23 nt, Yersinia pestis KIM
uggcgccauuuuuauaucagauu

SEQ ID NO: 4200840 - RNA, 15 nt, Yersinia pestis KIM
uggcgccucucuggc

SEQ ID NO: 4200841 - RNA, 15 nt, Yersinia pestis KIM
uggcgcgccacuucu

SEQ ID NO: 4200842 - RNA, 17 nt, Yersinia pestis KIM
uggcgcggcucgagccu

SEQ ID NO: 4200843 - RNA, 14 nt, Yersinia pestis KIM
uggcggaaauuaaa

SEQ ID NO: 4200844 - RNA, 21 nt, Yersinia pestis KIM
uggcggcacgcguugguuguc

SEQ ID NO: 4200845 - RNA, 23 nt, Yersinia pestis KIM
uggcggcgagcucucacugcucc

SEQ ID NO: 4200846 - RNA, 17 nt, Yersinia pestis KIM
uggcgggauccaucuga

SEQ ID NO: 4200847 - RNA, 19 nt, Yersinia pestis KIM
uggcgggcgcuucgucauu

SEQ ID NO: 4200848 - RNA, 23 nt, Yersinia pestis KIM
uggcggucgcacugugagcggca

SEQ ID NO: 4200849 - RNA, 14 nt, Yersinia pestis KIM
uggcgguuccaaag

SEQ ID NO: 4200850 - RNA, 14 nt, Yersinia pestis KIM
uggcguaaccgccg

SEQ ID NO: 4200851 - RNA, 17 nt, Yersinia pestis KIM
uggcguaaguacugaug

SEQ ID NO: 4200852 - RNA, 16 nt, Yersinia pestis KIM
uggcguuacagcaagg

SEQ ID NO: 4200853 - RNA, 23 nt, Yersinia pestis KIM
uggcguugccgugcugucagcca

SEQ ID NO: 4200854 - RNA, 23 nt, Yersinia pestis KIM
uggcguuuaaaguaaaucagacc

SEQ ID NO: 4200855 - RNA, 14 nt, Yersinia pestis KIM
uggcguuuauuuac

SEQ ID NO: 4200856 - RNA, 17 nt, Yersinia pestis KIM
uggcguuuuuguuacau

SEQ ID NO: 4200857 - RNA, 14 nt, Yersinia pestis KIM
uggcuaaacccaac

SEQ ID NO: 4200858 - RNA, 15 nt, Yersinia pestis KIM
uggcuaauauaucuc

SEQ ID NO: 4200859 - RNA, 22 nt, Yersinia pestis KIM
uggcuaccccaacauugguuac

SEQ ID NO: 4200860 - RNA, 22 nt, Yersinia pestis KIM
uggcuagccugcaccucaucaa

SEQ ID NO: 4200861 - RNA, 14 nt, Yersinia pestis KIM
uggcuaucaucccu

SEQ ID NO: 4200862 - RNA, 21 nt, Yersinia pestis KIM
uggcucaauccaaaugacacu

SEQ ID NO: 4200863 - RNA, 14 nt, Yersinia pestis KIM
uggcucaucaaagg

SEQ ID NO: 4200864 - RNA, 14 nt, Yersinia pestis KIM
uggcucgugaucag

SEQ ID NO: 4200865 - RNA, 16 nt, Yersinia pestis KIM
uggcucugccaauaaa

SEQ ID NO: 4200866 - RNA, 18 nt, Yersinia pestis KIM
uggcugaaauaccaaccc

SEQ ID NO: 4200867 - RNA, 22 nt, Yersinia pestis KIM
uggcugaauaucaucuuuuucu

SEQ ID NO: 4200868 - RNA, 19 nt, Yersinia pestis KIM
uggcugcccagagugacaa

SEQ ID NO: 4200869 - RNA, 21 nt, Yersinia pestis KIM
uggcugcccagagugacaaca

SEQ ID NO: 4200870 - RNA, 16 nt, Yersinia pestis KIM
uggcugccuaccugca

SEQ ID NO: 4200871 - RNA, 16 nt, Yersinia pestis KIM
uggcugcgagauggcg

SEQ ID NO: 4200872 - RNA, 21 nt, Yersinia pestis KIM
uggcugcgggugccgcauuac

SEQ ID NO: 4200873 - RNA, 23 nt, Yersinia pestis KIM
uggcuguauuguugcucaacaua

SEQ ID NO: 4200874 - RNA, 13 nt, Yersinia pestis KIM
uggcugucugaug

SEQ ID NO: 4200875 - RNA, 20 nt, Yersinia pestis KIM
uggcuguuuuucauuuacuu

SEQ ID NO: 4200876 - RNA, 16 nt, Yersinia pestis KIM
uggcuucaaaaucacc

SEQ ID NO: 4200877 - RNA, 22 nt, Yersinia pestis KIM
uggcuugcaaucagaggccauc

SEQ ID NO: 4200878 - RNA, 17 nt, Yersinia pestis KIM
uggcuugcuugauggca

SEQ ID NO: 4200879 - RNA, 12 nt, Yersinia pestis KIM
uggcuuuacggc

SEQ ID NO: 4200880 - RNA, 13 nt, Yersinia pestis KIM
uggcuuuauuaua

SEQ ID NO: 4200881 - RNA, 13 nt, Yersinia pestis KIM
uggcuuucaggau

SEQ ID NO: 4200882 - RNA, 22 nt, Yersinia pestis KIM
uggcuuucagugagcauuuugu

SEQ ID NO: 4200883 - RNA, 17 nt, Yersinia pestis KIM
uggcuuucgaucaucac

SEQ ID NO: 4200884 - RNA, 16 nt, Yersinia pestis KIM
uggcuuugcaccauca

SEQ ID NO: 4200885 - RNA, 19 nt, Yersinia pestis KIM
uggcuuuuuuaauaaaaaa

SEQ ID NO: 4200886 - RNA, 19 nt, Yersinia pestis KIM
uggcuuuuuuguuuuuaua

SEQ ID NO: 4200887 - RNA, 13 nt, Yersinia pestis KIM
ugggaaugcaccc

SEQ ID NO: 4200888 - RNA, 12 nt, Yersinia pestis KIM
ugggauaaaaua

SEQ ID NO: 4200889 - RNA, 14 nt, Yersinia pestis KIM
ugggauaugccgua

SEQ ID NO: 4200890 - RNA, 13 nt, Yersinia pestis KIM
ugggauccauagg

SEQ ID NO: 4200891 - RNA, 14 nt, Yersinia pestis KIM
ugggauguucagcu

SEQ ID NO: 4200892 - RNA, 17 nt, Yersinia pestis KIM
ugggcaaagaauugagg

SEQ ID NO: 4200893 - RNA, 14 nt, Yersinia pestis KIM
ugggcaaucuccag

SEQ ID NO: 4200894 - RNA, 20 nt, Yersinia pestis KIM
ugggcagaagaguaaagcgu

SEQ ID NO: 4200895 - RNA, 16 nt, Yersinia pestis KIM
ugggcaucccuuuacg

SEQ ID NO: 4200896 - RNA, 22 nt, Yersinia pestis KIM
ugggccaggcaaugagugcagc

SEQ ID NO: 4200897 - RNA, 22 nt, Yersinia pestis KIM
ugggcgacaaucaauggccagc

SEQ ID NO: 4200898 - RNA, 18 nt, Yersinia pestis KIM
ugggcgauaguaauuuuu

SEQ ID NO: 4200899 - RNA, 16 nt, Yersinia pestis KIM
ugggcgggaucuccag

SEQ ID NO: 4200900 - RNA, 23 nt, Yersinia pestis KIM
ugggcugccugugcggcagugaa

SEQ ID NO: 4200901 - RNA, 19 nt, Yersinia pestis KIM
ugucugccgcucaugcccc

SEQ ID NO: 4200902 - RNA, 20 nt, Yersinia pestis KIM
ugucuggguggcugaaauac

SEQ ID NO: 4200903 - RNA, 21 nt, Yersinia pestis KIM
ugucuggguggcugaaauacc

SEQ ID NO: 4200904 - RNA, 19 nt, Yersinia pestis KIM
ugucuguaaccucacgcca

SEQ ID NO: 4200905 - RNA, 14 nt, Yersinia pestis KIM
ugucuguaauaaua

SEQ ID NO: 4200906 - RNA, 12 nt, Yersinia pestis KIM
ugucuuaagccu

SEQ ID NO: 4200907 - RNA, 15 nt, Yersinia pestis KIM
ugucuuaagccuguu

SEQ ID NO: 4200908 - RNA, 21 nt, Yersinia pestis KIM
ugucuuaggugacaggcaaag

SEQ ID NO: 4200909 - RNA, 12 nt, Yersinia pestis KIM
ugucuuaugaua

SEQ ID NO: 4200910 - RNA, 22 nt, Yersinia pestis KIM
ugucuuaugauauagcuguuug

SEQ ID NO: 4200911 - RNA, 16 nt, Yersinia pestis KIM
ugucuuuuucuuuuua

SEQ ID NO: 4200912 - RNA, 14 nt, Yersinia pestis KIM
ugucuuuuuuggua

SEQ ID NO: 4200913 - RNA, 19 nt, Yersinia pestis KIM
ugucuuuuuugguaauaag

SEQ ID NO: 4200914 - RNA, 22 nt, Yersinia pestis KIM
ugugaauuagguaacuuuccau

SEQ ID NO: 4200915 - RNA, 14 nt, Yersinia pestis KIM
ugugagagugaaug

SEQ ID NO: 4200916 - RNA, 16 nt, Yersinia pestis KIM
ugugagauaacacaua

SEQ ID NO: 4200917 - RNA, 14 nt, Yersinia pestis KIM
ugugauaaacuguu

SEQ ID NO: 4200918 - RNA, 16 nt, Yersinia pestis KIM
ugugauaaagaaugcg

SEQ ID NO: 4200919 - RNA, 21 nt, Yersinia pestis KIM
ugugauaaccguucaagaggg

SEQ ID NO: 4200920 - RNA, 23 nt, Yersinia pestis KIM
ugugauccacacagcauucugcu

SEQ ID NO: 4200921 - RNA, 14 nt, Yersinia pestis KIM
ugugaucgcugccg

SEQ ID NO: 4200922 - RNA, 16 nt, Yersinia pestis KIM
ugugaugaaacuaaaa

SEQ ID NO: 4200923 - RNA, 19 nt, Yersinia pestis KIM
ugugaugaaacuaaaauaa

SEQ ID NO: 4200924 - RNA, 14 nt, Yersinia pestis KIM
ugugaugaaauuaa

SEQ ID NO: 4200925 - RNA, 16 nt, Yersinia pestis KIM
ugugaugcauauuaua

SEQ ID NO: 4200926 - RNA, 22 nt, Yersinia pestis KIM
ugugauuucagccaggcgaucu

SEQ ID NO: 4200927 - RNA, 20 nt, Yersinia pestis KIM
ugugauuuccaucuagcuca

SEQ ID NO: 4200928 - RNA, 15 nt, Yersinia pestis KIM
ugugcaaucaagggc

SEQ ID NO: 4200929 - RNA, 16 nt, Yersinia pestis KIM
ugugcaccacacagcg

SEQ ID NO: 4200930 - RNA, 15 nt, Yersinia pestis KIM
ugugcggauggcugc

SEQ ID NO: 4200931 - RNA, 13 nt, Yersinia pestis KIM
ugugcggcaguga

SEQ ID NO: 4200932 - RNA, 14 nt, Yersinia pestis KIM
ugugcguuggcagc

SEQ ID NO: 4200933 - RNA, 18 nt, Yersinia pestis KIM
ugugcuccgggcaagcgg

SEQ ID NO: 4200934 - RNA, 12 nt, Yersinia pestis KIM
ugugcugaauug

SEQ ID NO: 4200935 - RNA, 19 nt, Yersinia pestis KIM
ugugcuuugccauucuggg

SEQ ID NO: 4200936 - RNA, 23 nt, Yersinia pestis KIM
uguggaucagaccuuuacaggac

SEQ ID NO: 4200937 - RNA, 14 nt, Yersinia pestis KIM
ugugggcuggugcg

SEQ ID NO: 4200938 - RNA, 14 nt, Yersinia pestis KIM
ugugguuaccauca

SEQ ID NO: 4200939 - RNA, 17 nt, Yersinia pestis KIM
uguguaaacuccuugga

SEQ ID NO: 4200940 - RNA, 13 nt, Yersinia pestis KIM
ugugugucuuuaa

SEQ ID NO: 4200941 - RNA, 19 nt, Yersinia pestis KIM
uguguugaaauuuguucaa

SEQ ID NO: 4200942 - RNA, 15 nt, Yersinia pestis KIM
uguguugaaugacgc

SEQ ID NO: 4200943 - RNA, 19 nt, Yersinia pestis KIM
uguguugcgccauaauucc

SEQ ID NO: 4200944 - RNA, 14 nt, Yersinia pestis KIM
uguguuuaaaucuu

SEQ ID NO: 4200945 - RNA, 13 nt, Yersinia pestis KIM
uguguuuuggcua

SEQ ID NO: 4200946 - RNA, 16 nt, Yersinia pestis KIM
uguuaacucagccaca

SEQ ID NO: 4200947 - RNA, 23 nt, Yersinia pestis KIM
uguuaacucagccacaagauagu

SEQ ID NO: 4200948 - RNA, 16 nt, Yersinia pestis KIM
uguuaauuaagauuaa

SEQ ID NO: 4200949 - RNA, 14 nt, Yersinia pestis KIM
uguuaauuuaaaca

SEQ ID NO: 4200950 - RNA, 23 nt, Yersinia pestis KIM
uguuacagcaaggcagcaagcaa

SEQ ID NO: 4200951 - RNA, 18 nt, Yersinia pestis KIM
uguuacccgcgaucauuu

SEQ ID NO: 4200952 - RNA, 22 nt, Yersinia pestis KIM
uguuaccgcgcuugcaucaacu

SEQ ID NO: 4200953 - RNA, 13 nt, Yersinia pestis KIM
uguuacuuuuaau

SEQ ID NO: 4200954 - RNA, 15 nt, Yersinia pestis KIM
uguuagcaauuugag

SEQ ID NO: 4200955 - RNA, 16 nt, Yersinia pestis KIM
uguuagcccaaggcga

SEQ ID NO: 4200956 - RNA, 19 nt, Yersinia pestis KIM
uguuagcugccgaccugca

SEQ ID NO: 4200957 - RNA, 19 nt, Yersinia pestis KIM
uguuaguucagacguacau

SEQ ID NO: 4200958 - RNA, 15 nt, Yersinia pestis KIM
uguuauauuuuacuu

SEQ ID NO: 4200959 - RNA, 18 nt, Yersinia pestis KIM
uguuaugaggggaggcug

SEQ ID NO: 4200960 - RNA, 20 nt, Yersinia pestis KIM
uguuauggauuuuuaaggac

SEQ ID NO: 4200961 - RNA, 20 nt, Yersinia pestis KIM
uguuauuggacaucaggcag

SEQ ID NO: 4200962 - RNA, 15 nt, Yersinia pestis KIM
uguuauuucugggau

SEQ ID NO: 4200963 - RNA, 19 nt, Yersinia pestis KIM
uguuauuuuggcuuucagu

SEQ ID NO: 4200964 - RNA, 12 nt, Yersinia pestis KIM
uguuauuuuucu

SEQ ID NO: 4200965 - RNA, 23 nt, Yersinia pestis KIM
uguucaaaaacgcacgaaaacac

SEQ ID NO: 4200966 - RNA, 16 nt, Yersinia pestis KIM
uguucaagcaccucaa

SEQ ID NO: 4200967 - RNA, 18 nt, Yersinia pestis KIM
uguucaagcguacaagaa

SEQ ID NO: 4200968 - RNA, 13 nt, Yersinia pestis KIM
uguucacggcuuu

SEQ ID NO: 4200969 - RNA, 19 nt, Yersinia pestis KIM
uguucagcauaaauauuca

SEQ ID NO: 4200970 - RNA, 17 nt, Yersinia pestis KIM
uguucagcauuguuggc

SEQ ID NO: 4200971 - RNA, 13 nt, Yersinia pestis KIM
uguucauaaauua

SEQ ID NO: 4200972 - RNA, 16 nt, Yersinia pestis KIM
uguucauaaauuaaaa

SEQ ID NO: 4200973 - RNA, 13 nt, Yersinia pestis KIM
uguucauugagac

SEQ ID NO: 4200974 - RNA, 20 nt, Yersinia pestis KIM
uguuccagugcguuuuauuc

SEQ ID NO: 4200975 - RNA, 21 nt, Yersinia pestis KIM
uguuccagugcguuuuauuca

SEQ ID NO: 4200976 - RNA, 22 nt, Yersinia pestis KIM
uguuccagugcguuuuauucaa

SEQ ID NO: 4200977 - RNA, 20 nt, Yersinia pestis KIM
uguucgaucaaaacaauaaa

SEQ ID NO: 4200978 - RNA, 15 nt, Yersinia pestis KIM
uguucgcacugcucu

SEQ ID NO: 4200979 - RNA, 19 nt, Yersinia pestis KIM
uguucgcacugcucugccc

SEQ ID NO: 4200980 - RNA, 15 nt, Yersinia pestis KIM
uguucggcaaugggu

SEQ ID NO: 4200981 - RNA, 20 nt, Yersinia pestis KIM
uguucggggguugucagcag

SEQ ID NO: 4200982 - RNA, 13 nt, Yersinia pestis KIM
uguucgugaaagc

SEQ ID NO: 4200983 - RNA, 15 nt, Yersinia pestis KIM
uguucuaucucaucu

SEQ ID NO: 4200984 - RNA, 19 nt, Yersinia pestis KIM
uguucugauuuagcuaucg

SEQ ID NO: 4200985 - RNA, 14 nt, Yersinia pestis KIM
uguucugcuggauc

SEQ ID NO: 4200986 - RNA, 20 nt, Yersinia pestis KIM
uguucugcuggaucaugaaa

SEQ ID NO: 4200987 - RNA, 13 nt, Yersinia pestis KIM
uguucuggcaggc

SEQ ID NO: 4200988 - RNA, 19 nt, Yersinia pestis KIM
uguucugguaccguuuuau

SEQ ID NO: 4200989 - RNA, 15 nt, Yersinia pestis KIM
uguucuuaauuuuau

SEQ ID NO: 4200990 - RNA, 12 nt, Yersinia pestis KIM
uguucuuaucac

SEQ ID NO: 4200991 - RNA, 21 nt, Yersinia pestis KIM
uguucuuaucacggccaaaaa

SEQ ID NO: 4200992 - RNA, 16 nt, Yersinia pestis KIM
uguugagucaacucuu

SEQ ID NO: 4200993 - RNA, 14 nt, Yersinia pestis KIM
uguugaucugaguu

SEQ ID NO: 4200994 - RNA, 22 nt, Yersinia pestis KIM
uguugauuaacauccauuguau

SEQ ID NO: 4200995 - RNA, 21 nt, Yersinia pestis KIM
uguugauuacgggucagcuca

SEQ ID NO: 4200996 - RNA, 22 nt, Yersinia pestis KIM
uguugcaagcugagauaagccu

SEQ ID NO: 4200997 - RNA, 15 nt, Yersinia pestis KIM
uguugcaugaaauca

SEQ ID NO: 4200998 - RNA, 21 nt, Yersinia pestis KIM
uguugccaaugggccaagguc

SEQ ID NO: 4200999 - RNA, 22 nt, Yersinia pestis KIM
uguugccaaugggccaagguca

SEQ ID NO: 4201000 - RNA, 15 nt, Yersinia pestis KIM
uguugccaugccaug

SEQ ID NO: 4201001 - RNA, 16 nt, Yersinia pestis KIM
uguugccauggccgcc

SEQ ID NO: 4201002 - RNA, 17 nt, Yersinia pestis KIM
uguugcccccugcucca

SEQ ID NO: 4201003 - RNA, 14 nt, Yersinia pestis KIM
uguugcgccauaau

SEQ ID NO: 4201004 - RNA, 15 nt, Yersinia pestis KIM
uguugcgccauaauu

SEQ ID NO: 4201005 - RNA, 16 nt, Yersinia pestis KIM
uguuggcaaauaaucc

SEQ ID NO: 4201006 - RNA, 13 nt, Yersinia pestis KIM
uguuggcccgcau

SEQ ID NO: 4201007 - RNA, 17 nt, Yersinia pestis KIM
uguuggugaucuggcuu

SEQ ID NO: 4201008 - RNA, 14 nt, Yersinia pestis KIM
uguuguagcgccag

SEQ ID NO: 4201009 - RNA, 13 nt, Yersinia pestis KIM
uguuguauaaccc

SEQ ID NO: 4201010 - RNA, 15 nt, Yersinia pestis KIM
uguuguggcagcguu

SEQ ID NO: 4201011 - RNA, 12 nt, Yersinia pestis KIM
uguuuaaaucuu

SEQ ID NO: 4201012 - RNA, 17 nt, Yersinia pestis KIM
uguuuaacccaaugcuc

SEQ ID NO: 4201013 - RNA, 18 nt, Yersinia pestis KIM
uguuuaaucauaggccac

SEQ ID NO: 4201014 - RNA, 14 nt, Yersinia pestis KIM
uguuuauaaauuaa

SEQ ID NO: 4201015 - RNA, 17 nt, Yersinia pestis KIM
uguuuauucucccgaua

SEQ ID NO: 4201016 - RNA, 22 nt, Yersinia pestis KIM
uguuucaaauaaguacuuccaa

SEQ ID NO: 4201017 - RNA, 19 nt, Yersinia pestis KIM
uguuucauuucgcuccacc

SEQ ID NO: 4201018 - RNA, 21 nt, Yersinia pestis KIM
uguuucggguauucggcggcu

SEQ ID NO: 4201019 - RNA, 15 nt, Yersinia pestis KIM
uguuucuauccgaaa

SEQ ID NO: 4201020 - RNA, 21 nt, Yersinia pestis KIM
uguuucuauccgaaaaauauu

SEQ ID NO: 4201021 - RNA, 16 nt, Yersinia pestis KIM
uguuucuauuuucagc

SEQ ID NO: 4201022 - RNA, 19 nt, Yersinia pestis KIM
uguuugagaacaguucgau

SEQ ID NO: 4201023 - RNA, 22 nt, Yersinia pestis KIM
uguuugauaaggccaugucacu

SEQ ID NO: 4201024 - RNA, 13 nt, Yersinia pestis KIM
uguuugcccuaga

SEQ ID NO: 4201025 - RNA, 21 nt, Yersinia pestis KIM
uguuugcgcagcaaauaaaca

SEQ ID NO: 4201026 - RNA, 20 nt, Yersinia pestis KIM
uguuuggcauggauaucagc

SEQ ID NO: 4201027 - RNA, 13 nt, Yersinia pestis KIM
uguuuguaaauuu

SEQ ID NO: 4201028 - RNA, 20 nt, Yersinia pestis KIM
uguuugugugucuuuaagua

SEQ ID NO: 4201029 - RNA, 19 nt, Yersinia pestis KIM
uguuuguugauguaagcug

SEQ ID NO: 4201030 - RNA, 14 nt, Yersinia pestis KIM
uguuuguuuggaua

SEQ ID NO: 4201031 - RNA, 12 nt, Yersinia pestis KIM
uguuuuaaaaaa

SEQ ID NO: 4201032 - RNA, 12 nt, Yersinia pestis KIM
uguuuuaaucgg

SEQ ID NO: 4201033 - RNA, 20 nt, Yersinia pestis KIM
uguuuucuaaccucacaacc

SEQ ID NO: 4201034 - RNA, 18 nt, Yersinia pestis KIM
uguuuucuuguauauaaa

SEQ ID NO: 4201035 - RNA, 12 nt, Yersinia pestis KIM
uguuuuuuugau

SEQ ID NO: 4201036 - RNA, 15 nt, Yersinia pestis KIM
uuaaaaaaauuauca

SEQ ID NO: 4201037 - RNA, 17 nt, Yersinia pestis KIM
uuaaaaaaauuaucauc

SEQ ID NO: 4201038 - RNA, 17 nt, Yersinia pestis KIM
uuaaaaagccugaauuc

SEQ ID NO: 4201039 - RNA, 20 nt, Yersinia pestis KIM
uuaaaaagucauuaacuguu

SEQ ID NO: 4201040 - RNA, 23 nt, Yersinia pestis KIM
uuaaaaauacaaccaacaaacaa

SEQ ID NO: 4201041 - RNA, 20 nt, Yersinia pestis KIM
uuaaaacagauaaaaaauaa

SEQ ID NO: 4201042 - RNA, 22 nt, Yersinia pestis KIM
uuaaaacaggcgaguuucccuu

SEQ ID NO: 4201043 - RNA, 13 nt, Yersinia pestis KIM
uuaaaacugguca

SEQ ID NO: 4201044 - RNA, 22 nt, Yersinia pestis KIM
uuaaaauaguggcacaaauaaa

SEQ ID NO: 4201045 - RNA, 23 nt, Yersinia pestis KIM
uuaaaauaguggcacaaauaaaa

SEQ ID NO: 4201046 - RNA, 13 nt, Yersinia pestis KIM
uuaaaauuaauaa

SEQ ID NO: 4201047 - RNA, 16 nt, Yersinia pestis KIM
uuaaacccggcaucaa

SEQ ID NO: 4201048 - RNA, 18 nt, Yersinia pestis KIM
uuaaacuuguaucaaaac

SEQ ID NO: 4201049 - RNA, 14 nt, Yersinia pestis KIM
uuaaagaaugcaac

SEQ ID NO: 4201050 - RNA, 23 nt, Yersinia pestis KIM
uuaaagacgcaugagcuuaugcg

SEQ ID NO: 4201051 - RNA, 17 nt, Yersinia pestis KIM
uuaaagauuaagacuuu

SEQ ID NO: 4201052 - RNA, 22 nt, Yersinia pestis KIM
uuaaagauuucaucauucaaua

SEQ ID NO: 4201053 - RNA, 15 nt, Yersinia pestis KIM
uuaaagccuuucagc

SEQ ID NO: 4201054 - RNA, 19 nt, Yersinia pestis KIM
uuaaagccuuucagcgcug

SEQ ID NO: 4201055 - RNA, 13 nt, Yersinia pestis KIM
uuaaagguaaaag

SEQ ID NO: 4201056 - RNA, 19 nt, Yersinia pestis KIM
uuaaaguaaaucagaccau

SEQ ID NO: 4201057 - RNA, 18 nt, Yersinia pestis KIM
uuaaagugagaaggguau

SEQ ID NO: 4201058 - RNA, 12 nt, Yersinia pestis KIM
uuaaauaaaaaa

SEQ ID NO: 4201059 - RNA, 13 nt, Yersinia pestis KIM
uuaaauaaagaua

SEQ ID NO: 4201060 - RNA, 23 nt, Yersinia pestis KIM
uuaaauaaagauaaugugacuga

SEQ ID NO: 4201061 - RNA, 15 nt, Yersinia pestis KIM
uuaaauaacuaaaaa

SEQ ID NO: 4201062 - RNA, 16 nt, Yersinia pestis KIM
uuaaauaacuaaaaaa

SEQ ID NO: 4201063 - RNA, 17 nt, Yersinia pestis KIM
uuaaauaagaaguagaa

SEQ ID NO: 4201064 - RNA, 17 nt, Yersinia pestis KIM
uuaaauacaaaaauaca

SEQ ID NO: 4201065 - RNA, 15 nt, Yersinia pestis KIM
uuaaauacagaucau

SEQ ID NO: 4201066 - RNA, 11 nt, Yersinia pestis KIM
uuaaauaccag

SEQ ID NO: 4201067 - RNA, 14 nt, Yersinia pestis KIM
uuaaauccaauauu

SEQ ID NO: 4201068 - RNA, 19 nt, Yersinia pestis KIM
uuaaauccaauauucccug

SEQ ID NO: 4201069 - RNA, 19 nt, Yersinia pestis KIM
uuaaaugaaccaaaauuca

SEQ ID NO: 4201070 - RNA, 13 nt, Yersinia pestis KIM
uuaaaugaagcag

SEQ ID NO: 4201071 - RNA, 19 nt, Yersinia pestis KIM
uuaaaugaccacccacguu

SEQ ID NO: 4201072 - RNA, 14 nt, Yersinia pestis KIM
uuaaaugagaauaa

SEQ ID NO: 4201073 - RNA, 14 nt, Yersinia pestis KIM
uuaaauggagggca

SEQ ID NO: 4201074 - RNA, 20 nt, Yersinia pestis KIM
uuaaauuaucccguucaaua

SEQ ID NO: 4201075 - RNA, 20 nt, Yersinia pestis KIM
uuaaauuuuuauauaauuga

SEQ ID NO: 4201076 - RNA, 22 nt, Yersinia pestis KIM
uuaacaaaccgcuuacgcugua

SEQ ID NO: 4201077 - RNA, 17 nt, Yersinia pestis KIM
uuaacaaagcuauuuuu

SEQ ID NO: 4201078 - RNA, 19 nt, Yersinia pestis KIM
uuaacaaucagugcaauaa

SEQ ID NO: 4201079 - RNA, 20 nt, Yersinia pestis KIM
uuaacaaucagugcaauaaa

SEQ ID NO: 4201080 - RNA, 19 nt, Yersinia pestis KIM
uuaacaauuacuuuggcau

SEQ ID NO: 4201081 - RNA, 15 nt, Yersinia pestis KIM
uuaacaauuuuauug

SEQ ID NO: 4201082 - RNA, 15 nt, Yersinia pestis KIM
uuaacacaucaaaau

SEQ ID NO: 4201083 - RNA, 17 nt, Yersinia pestis KIM
uuaacacaucaaaauua

SEQ ID NO: 4201084 - RNA, 19 nt, Yersinia pestis KIM
uuaacacauuaauuuaucu

SEQ ID NO: 4201085 - RNA, 20 nt, Yersinia pestis KIM
uuaacacauuccaguaaaaa

SEQ ID NO: 4201086 - RNA, 21 nt, Yersinia pestis KIM
uuaacacauuccaguaaaaaa

SEQ ID NO: 4201087 - RNA, 22 nt, Yersinia pestis KIM
uuaacacauuccaguaaaaaaa

SEQ ID NO: 4201088 - RNA, 20 nt, Yersinia pestis KIM
uuaacacccaauaauaaaaa

SEQ ID NO: 4201089 - RNA, 21 nt, Yersinia pestis KIM
uuaacacccaauaauaaaaaa

SEQ ID NO: 4201090 - RNA, 16 nt, Yersinia pestis KIM
uuaacaccccuucagc

SEQ ID NO: 4201091 - RNA, 15 nt, Yersinia pestis KIM
uuaacagcaucacug

SEQ ID NO: 4201092 - RNA, 18 nt, Yersinia pestis KIM
uuaacagccccgucucaa

SEQ ID NO: 4201093 - RNA, 15 nt, Yersinia pestis KIM
uuaacccaaagcccu

SEQ ID NO: 4201094 - RNA, 15 nt, Yersinia pestis KIM
uuaacccaccaauag

SEQ ID NO: 4201095 - RNA, 13 nt, Yersinia pestis KIM
uuaacccauauua

SEQ ID NO: 4201096 - RNA, 17 nt, Yersinia pestis KIM
uuaaccgaugcaauaaa

SEQ ID NO: 4201097 - RNA, 22 nt, Yersinia pestis KIM
uuaacgaugaccgugacauuuu

SEQ ID NO: 4201098 - RNA, 18 nt, Yersinia pestis KIM
uuaacgucagauaaacaa

SEQ ID NO: 4201099 - RNA, 21 nt, Yersinia pestis KIM
uuaacuacaccgcuaaccuua

SEQ ID NO: 4201100 - RNA, 22 nt, Yersinia pestis KIM
uuaacuacaccgcuaaccuuaa

SEQ ID NO: 4201101 - RNA, 17 nt, Yersinia pestis KIM
uuaacuauuugaugcua

SEQ ID NO: 4201102 - RNA, 20 nt, Yersinia pestis KIM
uuaacucauuuaucuaaaac

SEQ ID NO: 4201103 - RNA, 12 nt, Yersinia pestis KIM
uuaacugaaagc

SEQ ID NO: 4201104 - RNA, 11 nt, Yersinia pestis KIM
uuaacugcagu

SEQ ID NO: 4201105 - RNA, 18 nt, Yersinia pestis KIM
uuaacugcaguaaaaaua

SEQ ID NO: 4201106 - RNA, 20 nt, Yersinia pestis KIM
uuaacugcaguaaaaauauu

SEQ ID NO: 4201107 - RNA, 21 nt, Yersinia pestis KIM
uuaacugccguuucaguaaaa

SEQ ID NO: 4201108 - RNA, 12 nt, Yersinia pestis KIM
uuaacuguuaaa

SEQ ID NO: 4201109 - RNA, 14 nt, Yersinia pestis KIM
uuaacuguuaaaac

SEQ ID NO: 4201110 - RNA, 15 nt, Yersinia pestis KIM
uuaacuguuaaaaca

SEQ ID NO: 4201111 - RNA, 12 nt, Yersinia pestis KIM
uuaacuguuuua

SEQ ID NO: 4201112 - RNA, 17 nt, Yersinia pestis KIM
uuaacuguuuuauauuu

SEQ ID NO: 4201113 - RNA, 14 nt, Yersinia pestis KIM
uuaacuuauugauu

SEQ ID NO: 4201114 - RNA, 18 nt, Yersinia pestis KIM
uuaacuuuaaauccaucg

SEQ ID NO: 4201115 - RNA, 22 nt, Yersinia pestis KIM
uuaacuuuucuucauugcugcu

SEQ ID NO: 4201116 - RNA, 17 nt, Yersinia pestis KIM
uuaagaaaucuauuaau

SEQ ID NO: 4201117 - RNA, 17 nt, Yersinia pestis KIM
uuaagaaaucugcagua

SEQ ID NO: 4201118 - RNA, 13 nt, Yersinia pestis KIM
uuaagaacgcuug

SEQ ID NO: 4201119 - RNA, 13 nt, Yersinia pestis KIM
uuaagaagccuca

SEQ ID NO: 4201120 - RNA, 14 nt, Yersinia pestis KIM
uuaagagagaugca

SEQ ID NO: 4201121 - RNA, 20 nt, Yersinia pestis KIM
uuaagauaggcagaaaagca

SEQ ID NO: 4201122 - RNA, 12 nt, Yersinia pestis KIM
uuaagcaaaaag

SEQ ID NO: 4201123 - RNA, 21 nt, Yersinia pestis KIM
uuaagcaauauuuuagcauuu

SEQ ID NO: 4201124 - RNA, 14 nt, Yersinia pestis KIM
uuaagccaauaaua

SEQ ID NO: 4201125 - RNA, 17 nt, Yersinia pestis KIM
uuaagcgggcuuuaaua

SEQ ID NO: 4201126 - RNA, 21 nt, Yersinia pestis KIM
uuaagcuauugguuauugauu

SEQ ID NO: 4201127 - RNA, 21 nt, Yersinia pestis KIM
uuaaggaaaaguagccaauag

SEQ ID NO: 4201128 - RNA, 14 nt, Yersinia pestis KIM
uuaaggaacgggua

SEQ ID NO: 4201129 - RNA, 12 nt, Yersinia pestis KIM
uuaaggacucuu

SEQ ID NO: 4201130 - RNA, 20 nt, Yersinia pestis KIM
uuaaggccagcagaacuaac

SEQ ID NO: 4201131 - RNA, 15 nt, Yersinia pestis KIM
uuacucguuuuacau

SEQ ID NO: 4201132 - RNA, 17 nt, Yersinia pestis KIM
uuacucguuuuacauug

SEQ ID NO: 4201133 - RNA, 19 nt, Yersinia pestis KIM
uuacucucuauugaucaca

SEQ ID NO: 4201134 - RNA, 18 nt, Yersinia pestis KIM
uuacucuucagccuaucc

SEQ ID NO: 4201135 - RNA, 21 nt, Yersinia pestis KIM
uuacucuucagccuauccuca

SEQ ID NO: 4201136 - RNA, 22 nt, Yersinia pestis KIM
uuacucuucagccuauccucac

SEQ ID NO: 4201137 - RNA, 17 nt, Yersinia pestis KIM
uuacugaaaagaggcac

SEQ ID NO: 4201138 - RNA, 21 nt, Yersinia pestis KIM
uuacugcaucuauugugucaa

SEQ ID NO: 4201139 - RNA, 21 nt, Yersinia pestis KIM
uuacugccugcagcaacaaua

SEQ ID NO: 4201140 - RNA, 21 nt, Yersinia pestis KIM
uuacugcgauauuguuggcga

SEQ ID NO: 4201141 - RNA, 12 nt, Yersinia pestis KIM
uuacugcuuuca

SEQ ID NO: 4201142 - RNA, 16 nt, Yersinia pestis KIM
uuacuggcugaauaca

SEQ ID NO: 4201143 - RNA, 18 nt, Yersinia pestis KIM
uuacuguaagauaauucg

SEQ ID NO: 4201144 - RNA, 14 nt, Yersinia pestis KIM
uuacugucauugcu

SEQ ID NO: 4201145 - RNA, 21 nt, Yersinia pestis KIM
uuacuuccugccaacaacuua

SEQ ID NO: 4201146 - RNA, 18 nt, Yersinia pestis KIM
uuacuugauggcuguuuu

SEQ ID NO: 4201147 - RNA, 12 nt, Yersinia pestis KIM
uuacuugguuac

SEQ ID NO: 4201148 - RNA, 15 nt, Yersinia pestis KIM
uuacuuuaaauuuua

SEQ ID NO: 4201149 - RNA, 12 nt, Yersinia pestis KIM
uuacuuuauuua

SEQ ID NO: 4201150 - RNA, 14 nt, Yersinia pestis KIM
uuacuuuauuuaaa

SEQ ID NO: 4201151 - RNA, 14 nt, Yersinia pestis KIM
uuacuuugaaauua

SEQ ID NO: 4201152 - RNA, 13 nt, Yersinia pestis KIM
uuacuuuuuauua

SEQ ID NO: 4201153 - RNA, 20 nt, Yersinia pestis KIM
uuacuuuuuauuaaugcuua

SEQ ID NO: 4201154 - RNA, 12 nt, Yersinia pestis KIM
uuacuuuuuccu

SEQ ID NO: 4201155 - RNA, 14 nt, Yersinia pestis KIM
uuacuuuuuuauuu

SEQ ID NO: 4201156 - RNA, 19 nt, Yersinia pestis KIM
uuagaauguguaguugaag

SEQ ID NO: 4201157 - RNA, 22 nt, Yersinia pestis KIM
uuagacacgccggcuuuuuucu

SEQ ID NO: 4201158 - RNA, 22 nt, Yersinia pestis KIM
uuagacgucagauuagcuuuaa

SEQ ID NO: 4201159 - RNA, 23 nt, Yersinia pestis KIM
uuagacgucagauuaguuuuaga

SEQ ID NO: 4201160 - RNA, 16 nt, Yersinia pestis KIM
uuagaggcugauaacc

SEQ ID NO: 4201161 - RNA, 20 nt, Yersinia pestis KIM
uuagagguuauugacaaaga

SEQ ID NO: 4201162 - RNA, 14 nt, Yersinia pestis KIM
uuagagucuauaau

SEQ ID NO: 4201163 - RNA, 20 nt, Yersinia pestis KIM
uuagauaccgcaaccauugc

SEQ ID NO: 4201164 - RNA, 20 nt, Yersinia pestis KIM
uuagauguguuuaaaucuuu

SEQ ID NO: 4201165 - RNA, 21 nt, Yersinia pestis KIM
uuagcaacgguaucccgguga

SEQ ID NO: 4201166 - RNA, 14 nt, Yersinia pestis KIM
uuagcaauaauaga

SEQ ID NO: 4201167 - RNA, 17 nt, Yersinia pestis KIM
uuagcacauaugcagcu

SEQ ID NO: 4201168 - RNA, 18 nt, Yersinia pestis KIM
uuagcaccggauggucac

SEQ ID NO: 4201169 - RNA, 12 nt, Yersinia pestis KIM
uuagcagggcau

SEQ ID NO: 4201170 - RNA, 20 nt, Yersinia pestis KIM
uuagcauuaccgguaauauu

SEQ ID NO: 4201171 - RNA, 19 nt, Yersinia pestis KIM
uuagcauugcagauuucuu

SEQ ID NO: 4201172 - RNA, 20 nt, Yersinia pestis KIM
uuagcauugcagauuucuuc

SEQ ID NO: 4201173 - RNA, 15 nt, Yersinia pestis KIM
uuagcauuuuccaau

SEQ ID NO: 4201174 - RNA, 23 nt, Yersinia pestis KIM
uuagccaagcaaccuuguuuuau

SEQ ID NO: 4201175 - RNA, 15 nt, Yersinia pestis KIM
uuagccauaagauaa

SEQ ID NO: 4201176 - RNA, 16 nt, Yersinia pestis KIM
uuagccauuucaaaac

SEQ ID NO: 4201177 - RNA, 17 nt, Yersinia pestis KIM
uuagccgaauaucccac

SEQ ID NO: 4201178 - RNA, 17 nt, Yersinia pestis KIM
uuagccuacuggcggcg

SEQ ID NO: 4201179 - RNA, 15 nt, Yersinia pestis KIM
uuagcgaugacugag

SEQ ID NO: 4201180 - RNA, 18 nt, Yersinia pestis KIM
uuagcgcacggggaaaca

SEQ ID NO: 4201181 - RNA, 13 nt, Yersinia pestis KIM
uuagcuacgcugc

SEQ ID NO: 4201182 - RNA, 23 nt, Yersinia pestis KIM
uuagcugauuugauauuagccaa

SEQ ID NO: 4201183 - RNA, 18 nt, Yersinia pestis KIM
uuagcugcaagcguuacu

SEQ ID NO: 4201184 - RNA, 17 nt, Yersinia pestis KIM
uuagcuggcugaacgcu

SEQ ID NO: 4201185 - RNA, 19 nt, Yersinia pestis KIM
uuagcuguccucuaccaga

SEQ ID NO: 4201186 - RNA, 12 nt, Yersinia pestis KIM
uuagcuguuuua

SEQ ID NO: 4201187 - RNA, 21 nt, Yersinia pestis KIM
uuaggcaccacuacacgcuuu

SEQ ID NO: 4201188 - RNA, 16 nt, Yersinia pestis KIM
uuaggcaugauaagca

SEQ ID NO: 4201189 - RNA, 18 nt, Yersinia pestis KIM
uuaggccaauuuggccaa

SEQ ID NO: 4201190 - RNA, 17 nt, Yersinia pestis KIM
uuaggcgggcaguauaa

SEQ ID NO: 4201191 - RNA, 18 nt, Yersinia pestis KIM
uuaggggcuagccagcgu

SEQ ID NO: 4201192 - RNA, 18 nt, Yersinia pestis KIM
uuagguaauaccaaugcu

SEQ ID NO: 4201193 - RNA, 14 nt, Yersinia pestis KIM
uuaggugacaggca

SEQ ID NO: 4201194 - RNA, 19 nt, Yersinia pestis KIM
uuagguucuaaaccuauug

SEQ ID NO: 4201195 - RNA, 19 nt, Yersinia pestis KIM
uuagucacuaaagcggaau

SEQ ID NO: 4201196 - RNA, 15 nt, Yersinia pestis KIM
uuagucuuagacguc

SEQ ID NO: 4201197 - RNA, 20 nt, Yersinia pestis KIM
uuagugaaucaucaauaccc

SEQ ID NO: 4201198 - RNA, 18 nt, Yersinia pestis KIM
uuagugcuacagcagcag

SEQ ID NO: 4201199 - RNA, 13 nt, Yersinia pestis KIM
uuagugcucauga

SEQ ID NO: 4201200 - RNA, 21 nt, Yersinia pestis KIM
uuaguggcuuuaagauccagu

SEQ ID NO: 4201201 - RNA, 17 nt, Yersinia pestis KIM
uuagugggugagcagag

SEQ ID NO: 4201202 - RNA, 19 nt, Yersinia pestis KIM
uuaguuacaauaaaucaau

SEQ ID NO: 4201203 - RNA, 20 nt, Yersinia pestis KIM
uuaguugguaauaaggucac

SEQ ID NO: 4201204 - RNA, 13 nt, Yersinia pestis KIM
uuauaaaaacccc

SEQ ID NO: 4201205 - RNA, 16 nt, Yersinia pestis KIM
uuauaaacaaucugau

SEQ ID NO: 4201206 - RNA, 15 nt, Yersinia pestis KIM
uuauaaaccaaaugg

SEQ ID NO: 4201207 - RNA, 15 nt, Yersinia pestis KIM
uuauaaauaauuauc

SEQ ID NO: 4201208 - RNA, 17 nt, Yersinia pestis KIM
uuauaaauuacucguau

SEQ ID NO: 4201209 - RNA, 14 nt, Yersinia pestis KIM
uuauaaauuuucag

SEQ ID NO: 4201210 - RNA, 15 nt, Yersinia pestis KIM
uuauaacuauauucu

SEQ ID NO: 4201211 - RNA, 14 nt, Yersinia pestis KIM
uuauaagcguuauu

SEQ ID NO: 4201212 - RNA, 17 nt, Yersinia pestis KIM
uuauaagcguuauuuuu

SEQ ID NO: 4201213 - RNA, 13 nt, Yersinia pestis KIM
uuauaaugaaaua

SEQ ID NO: 4201214 - RNA, 14 nt, Yersinia pestis KIM
uuauaaugaaauag

SEQ ID NO: 4201215 - RNA, 17 nt, Yersinia pestis KIM
uuauacccaaaauaauu

SEQ ID NO: 4201216 - RNA, 17 nt, Yersinia pestis KIM
uuauacccguuauauuu

SEQ ID NO: 4201217 - RNA, 16 nt, Yersinia pestis KIM
uuauaccuacccuuua

SEQ ID NO: 4201218 - RNA, 13 nt, Yersinia pestis KIM
uuauacggcuauu

SEQ ID NO: 4201219 - RNA, 15 nt, Yersinia pestis KIM
uuauacuaaagaaau

SEQ ID NO: 4201220 - RNA, 21 nt, Yersinia pestis KIM
uuauaggucaucccagcacag

SEQ ID NO: 4201221 - RNA, 22 nt, Yersinia pestis KIM
uuauaguccuuccaugacacau

SEQ ID NO: 4201222 - RNA, 13 nt, Yersinia pestis KIM
uuauaguuaaaac

SEQ ID NO: 4201223 - RNA, 12 nt, Yersinia pestis KIM
uuauauaacuag

SEQ ID NO: 4201224 - RNA, 22 nt, Yersinia pestis KIM
uuauauaauugaagauuuaaau

SEQ ID NO: 4201225 - RNA, 22 nt, Yersinia pestis KIM
uuauauccgccauccuucaaga

SEQ ID NO: 4201226 - RNA, 22 nt, Yersinia pestis KIM
uuauaucuauauuggacaguaa

SEQ ID NO: 4201227 - RNA, 21 nt, Yersinia pestis KIM
uuauaucuugcugaaaacaau

SEQ ID NO: 4201228 - RNA, 13 nt, Yersinia pestis KIM
uuauaugaaucag

SEQ ID NO: 4201229 - RNA, 18 nt, Yersinia pestis KIM
uuauaugaucaguggggu

SEQ ID NO: 4201230 - RNA, 21 nt, Yersinia pestis KIM
uuauaugcuguauaaaagaau

SEQ ID NO: 4201231 - RNA, 21 nt, Yersinia pestis KIM
uuauaugcuugacugcguucu

SEQ ID NO: 4201232 - RNA, 22 nt, Yersinia pestis KIM
uuauaugcuugacugcguucug

SEQ ID NO: 4201233 - RNA, 14 nt, Yersinia pestis KIM
uuauauuauuuauc

SEQ ID NO: 4201234 - RNA, 16 nt, Yersinia pestis KIM
uuauauugcucaguuc

SEQ ID NO: 4201235 - RNA, 19 nt, Yersinia pestis KIM
uuaucaaauacgaccguca

SEQ ID NO: 4201236 - RNA, 16 nt, Yersinia pestis KIM
uuaucaagaucaaaag

SEQ ID NO: 4201237 - RNA, 19 nt, Yersinia pestis KIM
uuaucaagaucaaaagcag

SEQ ID NO: 4201238 - RNA, 17 nt, Yersinia pestis KIM
uuaucaauacugcaaau

SEQ ID NO: 4201239 - RNA, 15 nt, Yersinia pestis KIM
uuaucaaucaaaaaa

SEQ ID NO: 4201240 - RNA, 15 nt, Yersinia pestis KIM
uuaucaaucagcuga

SEQ ID NO: 4201241 - RNA, 14 nt, Yersinia pestis KIM
uuaucaccaaaagc

SEQ ID NO: 4201242 - RNA, 23 nt, Yersinia pestis KIM
uuaucaccuuccgucccaagaaa

SEQ ID NO: 4201243 - RNA, 14 nt, Yersinia pestis KIM
uuaucacgucgcca

SEQ ID NO: 4201244 - RNA, 22 nt, Yersinia pestis KIM
uuaucacuguccaagaagccaa

SEQ ID NO: 4201245 - RNA, 21 nt, Yersinia pestis KIM
uuaucaguugguuuauccuuu

SEQ ID NO: 4201246 - RNA, 20 nt, Yersinia pestis KIM
uucaaaaggugcaagcagcu

SEQ ID NO: 4201247 - RNA, 21 nt, Yersinia pestis KIM
uucaaaaucugauacugaacg

SEQ ID NO: 4201248 - RNA, 14 nt, Yersinia pestis KIM
uucaaacacuuaug

SEQ ID NO: 4201249 - RNA, 15 nt, Yersinia pestis KIM
uucaaaccgcuggug

SEQ ID NO: 4201250 - RNA, 16 nt, Yersinia pestis KIM
uucaaacguguacuuu

SEQ ID NO: 4201251 - RNA, 19 nt, Yersinia pestis KIM
uucaaacguguacuuuccc

SEQ ID NO: 4201252 - RNA, 22 nt, Yersinia pestis KIM
uucaaauaaguauuucaaauaa

SEQ ID NO: 4201253 - RNA, 18 nt, Yersinia pestis KIM
uucaaauaaguguuucaa

SEQ ID NO: 4201254 - RNA, 21 nt, Yersinia pestis KIM
uucaaauaaguguuucaaaua

SEQ ID NO: 4201255 - RNA, 17 nt, Yersinia pestis KIM
uucaaauaauucagacg

SEQ ID NO: 4201256 - RNA, 14 nt, Yersinia pestis KIM
uucaaauaucauua

SEQ ID NO: 4201257 - RNA, 13 nt, Yersinia pestis KIM
uucaaaucaugca

SEQ ID NO: 4201258 - RNA, 14 nt, Yersinia pestis KIM
uucaacauccaguu

SEQ ID NO: 4201259 - RNA, 18 nt, Yersinia pestis KIM
uucaaccccuucuucacc

SEQ ID NO: 4201260 - RNA, 18 nt, Yersinia pestis KIM
uucaacgccaauaccggu

SEQ ID NO: 4201261 - RNA, 19 nt, Yersinia pestis KIM
uucaacucuacauugacua

SEQ ID NO: 4201262 - RNA, 14 nt, Yersinia pestis KIM
uucaacuucuccug

SEQ ID NO: 4201263 - RNA, 19 nt, Yersinia pestis KIM
uucaacuucuccuguauuu

SEQ ID NO: 4201264 - RNA, 14 nt, Yersinia pestis KIM
uucaacuugccuga

SEQ ID NO: 4201265 - RNA, 12 nt, Yersinia pestis KIM
uucaacuuuuuu

SEQ ID NO: 4201266 - RNA, 16 nt, Yersinia pestis KIM
uucaagaaccgaaaua

SEQ ID NO: 4201267 - RNA, 16 nt, Yersinia pestis KIM
uucaagagcgauagau

SEQ ID NO: 4201268 - RNA, 14 nt, Yersinia pestis KIM
uucaagaugcaggg

SEQ ID NO: 4201269 - RNA, 15 nt, Yersinia pestis KIM
uucaagcaauucaga

SEQ ID NO: 4201270 - RNA, 19 nt, Yersinia pestis KIM
uucaagccgcgccaucucu

SEQ ID NO: 4201271 - RNA, 21 nt, Yersinia pestis KIM
uucaagucaauaaauaaaaac

SEQ ID NO: 4201272 - RNA, 13 nt, Yersinia pestis KIM
uucaagugcucac

SEQ ID NO: 4201273 - RNA, 22 nt, Yersinia pestis KIM
uucaauaacaccgucuuugacc

SEQ ID NO: 4201274 - RNA, 12 nt, Yersinia pestis KIM
uucaauaccaua

SEQ ID NO: 4201275 - RNA, 18 nt, Yersinia pestis KIM
uucaauacuggccaugug

SEQ ID NO: 4201276 - RNA, 21 nt, Yersinia pestis KIM
uucaauaguuucauaugaaac

SEQ ID NO: 4201277 - RNA, 23 nt, Yersinia pestis KIM
uucaauauuuauccauuuaauaa

SEQ ID NO: 4201278 - RNA, 12 nt, Yersinia pestis KIM
uucaaucacugc

SEQ ID NO: 4201279 - RNA, 23 nt, Yersinia pestis KIM
uucaaucauugagaucaguucag

SEQ ID NO: 4201280 - RNA, 17 nt, Yersinia pestis KIM
uucaaucggauaaccgc

SEQ ID NO: 4201281 - RNA, 18 nt, Yersinia pestis KIM
uucaaugacuccugaaau

SEQ ID NO: 4201282 - RNA, 21 nt, Yersinia pestis KIM
uucaaugacuccugaaauaaa

SEQ ID NO: 4201283 - RNA, 18 nt, Yersinia pestis KIM
uucaaugcgcccaagccu

SEQ ID NO: 4201284 - RNA, 20 nt, Yersinia pestis KIM
uucaauucucccauuuauua

SEQ ID NO: 4201285 - RNA, 14 nt, Yersinia pestis KIM
uucaauugaaauaa

SEQ ID NO: 4201286 - RNA, 14 nt, Yersinia pestis KIM
uucaauugccaugc

SEQ ID NO: 4201287 - RNA, 20 nt, Yersinia pestis KIM
uucacagcagaacaaaacaa

SEQ ID NO: 4201288 - RNA, 19 nt, Yersinia pestis KIM
uucacaucggucaauacca

SEQ ID NO: 4201289 - RNA, 12 nt, Yersinia pestis KIM
uucaccaaacag

SEQ ID NO: 4201290 - RNA, 17 nt, Yersinia pestis KIM
uucaccaaauugcagaa

SEQ ID NO: 4201291 - RNA, 16 nt, Yersinia pestis KIM
uucaccaauacaaaca

SEQ ID NO: 4201292 - RNA, 16 nt, Yersinia pestis KIM
uucaccaucugccugc

SEQ ID NO: 4201293 - RNA, 14 nt, Yersinia pestis KIM
uucacccaggcugu

SEQ ID NO: 4201294 - RNA, 20 nt, Yersinia pestis KIM
uucacccaggcugugguggc

SEQ ID NO: 4201295 - RNA, 18 nt, Yersinia pestis KIM
uucacccauaccaaccau

SEQ ID NO: 4201296 - RNA, 13 nt, Yersinia pestis KIM
uucacccucuuuc

SEQ ID NO: 4201297 - RNA, 23 nt, Yersinia pestis KIM
uucacccuuggcuaccagagaac

SEQ ID NO: 4201298 - RNA, 23 nt, Yersinia pestis KIM
uucaccgccuuucauucugaaga

SEQ ID NO: 4201299 - RNA, 18 nt, Yersinia pestis KIM
uucaccgcuuuucuggua

SEQ ID NO: 4201300 - RNA, 14 nt, Yersinia pestis KIM
uucaccgguaugca

SEQ ID NO: 4201301 - RNA, 23 nt, Yersinia pestis KIM
uucaccuaucgguaucucccgca

SEQ ID NO: 4201302 - RNA, 23 nt, Yersinia pestis KIM
uucaccuugcgcaauuuguuggc

SEQ ID NO: 4201303 - RNA, 16 nt, Yersinia pestis KIM
uucacgauggaaaaaa

SEQ ID NO: 4201304 - RNA, 23 nt, Yersinia pestis KIM
uucacgauggaaaaaauacaggu

SEQ ID NO: 4201305 - RNA, 20 nt, Yersinia pestis KIM
uucacgcaucacaucuugca

SEQ ID NO: 4201306 - RNA, 17 nt, Yersinia pestis KIM
uucacgccaugccgguu

SEQ ID NO: 4201307 - RNA, 19 nt, Yersinia pestis KIM
uucacgcccuacugagaau

SEQ ID NO: 4201308 - RNA, 20 nt, Yersinia pestis KIM
uucacggacagcaaccacuu

SEQ ID NO: 4201309 - RNA, 12 nt, Yersinia pestis KIM
uucacggauauc

SEQ ID NO: 4201310 - RNA, 17 nt, Yersinia pestis KIM
uucacggcaccaaccau

SEQ ID NO: 4201311 - RNA, 21 nt, Yersinia pestis KIM
uucacuauaauuucucucaau

SEQ ID NO: 4201312 - RNA, 19 nt, Yersinia pestis KIM
uucacuccggcaucauccu

SEQ ID NO: 4201313 - RNA, 22 nt, Yersinia pestis KIM
uucacuccggcaucauccucau

SEQ ID NO: 4201314 - RNA, 18 nt, Yersinia pestis KIM
uucacucuguuuuaaaaa

SEQ ID NO: 4201315 - RNA, 23 nt, Yersinia pestis KIM
uucacuggggagaucagugccag

SEQ ID NO: 4201316 - RNA, 23 nt, Yersinia pestis KIM
uucacuguggcggccagugcggu

SEQ ID NO: 4201317 - RNA, 20 nt, Yersinia pestis KIM
uucacuuacugccaaagaau

SEQ ID NO: 4201318 - RNA, 14 nt, Yersinia pestis KIM
uucacuuaucccuu

SEQ ID NO: 4201319 - RNA, 22 nt, Yersinia pestis KIM
uucacuucuggggucaucaacg

SEQ ID NO: 4201320 - RNA, 15 nt, Yersinia pestis KIM
uucacuuucaacuau

SEQ ID NO: 4201321 - RNA, 19 nt, Yersinia pestis KIM
uucagaaaacccccugcua

SEQ ID NO: 4201322 - RNA, 15 nt, Yersinia pestis KIM
uucagaagacaauaa

SEQ ID NO: 4201323 - RNA, 22 nt, Yersinia pestis KIM
uucagaauugugccccuuuuuu

SEQ ID NO: 4201324 - RNA, 13 nt, Yersinia pestis KIM
uucagacauacaa

SEQ ID NO: 4201325 - RNA, 10 nt, Yersinia pestis KIM
uucagacucc

SEQ ID NO: 4201326 - RNA, 14 nt, Yersinia pestis KIM
uucagacugaaagu

SEQ ID NO: 4201327 - RNA, 22 nt, Yersinia pestis KIM
uucagacugaaaguagaaauaa

SEQ ID NO: 4201328 - RNA, 15 nt, Yersinia pestis KIM
uucagaggaaagaga

SEQ ID NO: 4201329 - RNA, 21 nt, Yersinia pestis KIM
uucagcaaagagucgcaaaac

SEQ ID NO: 4201330 - RNA, 15 nt, Yersinia pestis KIM
uucagcaagccaaua

SEQ ID NO: 4201331 - RNA, 12 nt, Yersinia pestis KIM
uucagcaccaua

SEQ ID NO: 4201332 - RNA, 16 nt, Yersinia pestis KIM
uucagcaccauaaaaa

SEQ ID NO: 4201333 - RNA, 16 nt, Yersinia pestis KIM
uucagcacgcuuucca

SEQ ID NO: 4201334 - RNA, 15 nt, Yersinia pestis KIM
uucagcacggugugu

SEQ ID NO: 4201335 - RNA, 22 nt, Yersinia pestis KIM
uucagcacgguguguugaaauu

SEQ ID NO: 4201336 - RNA, 17 nt, Yersinia pestis KIM
uucagcaggggcaaccu

SEQ ID NO: 4201337 - RNA, 21 nt, Yersinia pestis KIM
uucagcaggggcaaccucuuc

SEQ ID NO: 4201338 - RNA, 19 nt, Yersinia pestis KIM
uucagcauaucccuguuuu

SEQ ID NO: 4201339 - RNA, 20 nt, Yersinia pestis KIM
uucagccaccagauuacgcg

SEQ ID NO: 4201340 - RNA, 21 nt, Yersinia pestis KIM
uucagcccccucaauaccggu

SEQ ID NO: 4201341 - RNA, 18 nt, Yersinia pestis KIM
uucagcccggauagaauu

SEQ ID NO: 4201342 - RNA, 16 nt, Yersinia pestis KIM
uucagccgccagccau

SEQ ID NO: 4201343 - RNA, 14 nt, Yersinia pestis KIM
uucagccuauccuc

SEQ ID NO: 4201344 - RNA, 16 nt, Yersinia pestis KIM
uucagccuauccucac

SEQ ID NO: 4201345 - RNA, 17 nt, Yersinia pestis KIM
uucagccuauccucacc

SEQ ID NO: 4201346 - RNA, 17 nt, Yersinia pestis KIM
uucagcguuuuauuugg

SEQ ID NO: 4201347 - RNA, 14 nt, Yersinia pestis KIM
uucagcucugccag

SEQ ID NO: 4201348 - RNA, 16 nt, Yersinia pestis KIM
uucagcucuucuaaca

SEQ ID NO: 4201349 - RNA, 15 nt, Yersinia pestis KIM
uucagcuucagcucu

SEQ ID NO: 4201350 - RNA, 19 nt, Yersinia pestis KIM
uucagcuuccgcuucaacu

SEQ ID NO: 4201351 - RNA, 17 nt, Yersinia pestis KIM
uucagcuugcaacaaaa

SEQ ID NO: 4201352 - RNA, 20 nt, Yersinia pestis KIM
uucaggacugucuucaacuu

SEQ ID NO: 4201353 - RNA, 16 nt, Yersinia pestis KIM
uucaggcagauaaauc

SEQ ID NO: 4201354 - RNA, 15 nt, Yersinia pestis KIM
uucaggccaagugcu

SEQ ID NO: 4201355 - RNA, 14 nt, Yersinia pestis KIM
uucaggccgauacg

SEQ ID NO: 4201356 - RNA, 20 nt, Yersinia pestis KIM
uucaggccuuuacuguuaau

SEQ ID NO: 4201357 - RNA, 19 nt, Yersinia pestis KIM
uucagggcguauaaacaga

SEQ ID NO: 4201358 - RNA, 22 nt, Yersinia pestis KIM
uucagguaagcagagaauuuca

SEQ ID NO: 4201359 - RNA, 21 nt, Yersinia pestis KIM
uucagguaccccauaaauccc

SEQ ID NO: 4201360 - RNA, 13 nt, Yersinia pestis KIM
uuccuuauaaauc

SEQ ID NO: 4201361 - RNA, 18 nt, Yersinia pestis KIM
uuccuuauaaauccgcua

SEQ ID NO: 4201362 - RNA, 14 nt, Yersinia pestis KIM
uuccuucagccacc

SEQ ID NO: 4201363 - RNA, 13 nt, Yersinia pestis KIM
uuccuuccucuuu

SEQ ID NO: 4201364 - RNA, 21 nt, Yersinia pestis KIM
uuccuuuauuuuucauucuau

SEQ ID NO: 4201365 - RNA, 16 nt, Yersinia pestis KIM
uucgaaaacucaaaga

SEQ ID NO: 4201366 - RNA, 21 nt, Yersinia pestis KIM
uucgaaagaaauaaaagaaaa

SEQ ID NO: 4201367 - RNA, 22 nt, Yersinia pestis KIM
uucgaagggaauaaugguauuu

SEQ ID NO: 4201368 - RNA, 14 nt, Yersinia pestis KIM
uucgacaaaaucag

SEQ ID NO: 4201369 - RNA, 17 nt, Yersinia pestis KIM
uucgacaggcaauuauc

SEQ ID NO: 4201370 - RNA, 18 nt, Yersinia pestis KIM
uucgacaggcaauuaucc

SEQ ID NO: 4201371 - RNA, 19 nt, Yersinia pestis KIM
uucgacaggcaauuaucca

SEQ ID NO: 4201372 - RNA, 20 nt, Yersinia pestis KIM
uucgaccaauaauaggguca

SEQ ID NO: 4201373 - RNA, 14 nt, Yersinia pestis KIM
uucgagcaccgcgc

SEQ ID NO: 4201374 - RNA, 15 nt, Yersinia pestis KIM
uucgagcggcauauc

SEQ ID NO: 4201375 - RNA, 16 nt, Yersinia pestis KIM
uucgagcggcauaucc

SEQ ID NO: 4201376 - RNA, 19 nt, Yersinia pestis KIM
uucgagguggcgauaaaga

SEQ ID NO: 4201377 - RNA, 21 nt, Yersinia pestis KIM
uucgagguggcgauaaagagu

SEQ ID NO: 4201378 - RNA, 23 nt, Yersinia pestis KIM
uucgagguggcgauaaagaguga

SEQ ID NO: 4201379 - RNA, 22 nt, Yersinia pestis KIM
uucgauuugaucgaccacgccc

SEQ ID NO: 4201380 - RNA, 17 nt, Yersinia pestis KIM
uucgcaaaaugccaaca

SEQ ID NO: 4201381 - RNA, 12 nt, Yersinia pestis KIM
uucgcaggccag

SEQ ID NO: 4201382 - RNA, 14 nt, Yersinia pestis KIM
uucgcaucuuccaa

SEQ ID NO: 4201383 - RNA, 17 nt, Yersinia pestis KIM
uucgcaucuuccaaagg

SEQ ID NO: 4201384 - RNA, 16 nt, Yersinia pestis KIM
uucgcccuaacauuga

SEQ ID NO: 4201385 - RNA, 15 nt, Yersinia pestis KIM
uucgcggccugcugu

SEQ ID NO: 4201386 - RNA, 15 nt, Yersinia pestis KIM
uucgcguuucauuuu

SEQ ID NO: 4201387 - RNA, 17 nt, Yersinia pestis KIM
uucgcuauuucucucua

SEQ ID NO: 4201388 - RNA, 18 nt, Yersinia pestis KIM
uucgcuauuucucucuac

SEQ ID NO: 4201389 - RNA, 19 nt, Yersinia pestis KIM
uucgcugaaaucaggcugu

SEQ ID NO: 4201390 - RNA, 23 nt, Yersinia pestis KIM
uucgcugaaaucaggcuguucuu

SEQ ID NO: 4201391 - RNA, 14 nt, Yersinia pestis KIM
uucgcugauuaaug

SEQ ID NO: 4201392 - RNA, 22 nt, Yersinia pestis KIM
uucgcuggggcauuuaauucag

SEQ ID NO: 4201393 - RNA, 20 nt, Yersinia pestis KIM
uucgcuggucauaaucaucu

SEQ ID NO: 4201394 - RNA, 14 nt, Yersinia pestis KIM
uucgcuuuacccug

SEQ ID NO: 4201395 - RNA, 14 nt, Yersinia pestis KIM
uucgcuuucaucuu

SEQ ID NO: 4201396 - RNA, 22 nt, Yersinia pestis KIM
uucggauaaauacaggcucuau

SEQ ID NO: 4201397 - RNA, 21 nt, Yersinia pestis KIM
uucggauaaccgcauucccug

SEQ ID NO: 4201398 - RNA, 19 nt, Yersinia pestis KIM
uucggauuaccggcacugg

SEQ ID NO: 4201399 - RNA, 16 nt, Yersinia pestis KIM
uucggcaggcagaaau

SEQ ID NO: 4201400 - RNA, 19 nt, Yersinia pestis KIM
uucggcaggcagaaauaau

SEQ ID NO: 4201401 - RNA, 15 nt, Yersinia pestis KIM
uucggcuacuguuuu

SEQ ID NO: 4201402 - RNA, 18 nt, Yersinia pestis KIM
uucgggcugaugaauaga

SEQ ID NO: 4201403 - RNA, 17 nt, Yersinia pestis KIM
uucggggguugucagca

SEQ ID NO: 4201404 - RNA, 23 nt, Yersinia pestis KIM
uucgggugagugagcgcggguaa

SEQ ID NO: 4201405 - RNA, 21 nt, Yersinia pestis KIM
uucgguaaugccagcccugau

SEQ ID NO: 4201406 - RNA, 17 nt, Yersinia pestis KIM
uucggugcaaaacccca

SEQ ID NO: 4201407 - RNA, 13 nt, Yersinia pestis KIM
uucgguggcccuu

SEQ ID NO: 4201408 - RNA, 20 nt, Yersinia pestis KIM
uucgguuaagagugcuggca

SEQ ID NO: 4201409 - RNA, 17 nt, Yersinia pestis KIM
uucgguuguuauggcuu

SEQ ID NO: 4201410 - RNA, 22 nt, Yersinia pestis KIM
uucguagaaacaucgccagcgg

SEQ ID NO: 4201411 - RNA, 20 nt, Yersinia pestis KIM
uucgucaauuuuugccuuuc

SEQ ID NO: 4201412 - RNA, 22 nt, Yersinia pestis KIM
uucgucaccaucaauauaagag

SEQ ID NO: 4201413 - RNA, 22 nt, Yersinia pestis KIM
uucgucaugauaaugccaugcu

SEQ ID NO: 4201414 - RNA, 23 nt, Yersinia pestis KIM
uucgucgggggugccguagguaa

SEQ ID NO: 4201415 - RNA, 14 nt, Yersinia pestis KIM
uucgucucaucaau

SEQ ID NO: 4201416 - RNA, 14 nt, Yersinia pestis KIM
uucgugcucaucaa

SEQ ID NO: 4201417 - RNA, 20 nt, Yersinia pestis KIM
uucgugcucaucaaccucag

SEQ ID NO: 4201418 - RNA, 23 nt, Yersinia pestis KIM
uucguggugggcgguaguauuug

SEQ ID NO: 4201419 - RNA, 21 nt, Yersinia pestis KIM
uucguuucccccuguaaaaca

SEQ ID NO: 4201420 - RNA, 14 nt, Yersinia pestis KIM
uucuaacaauaagu

SEQ ID NO: 4201421 - RNA, 16 nt, Yersinia pestis KIM
uucuaacacuucauga

SEQ ID NO: 4201422 - RNA, 15 nt, Yersinia pestis KIM
uucuaagcugccugu

SEQ ID NO: 4201423 - RNA, 22 nt, Yersinia pestis KIM
uucuaauucgugggcauuuuuu

SEQ ID NO: 4201424 - RNA, 13 nt, Yersinia pestis KIM
uucuacaauggcc

SEQ ID NO: 4201425 - RNA, 16 nt, Yersinia pestis KIM
uucuacagggcauauc

SEQ ID NO: 4201426 - RNA, 21 nt, Yersinia pestis KIM
uucuacccuggcggcaaacgc

SEQ ID NO: 4201427 - RNA, 17 nt, Yersinia pestis KIM
uucuaccguaucagccc

SEQ ID NO: 4201428 - RNA, 15 nt, Yersinia pestis KIM
uucuaccuggcucaa

SEQ ID NO: 4201429 - RNA, 22 nt, Yersinia pestis KIM
uucuaccuggcucaaauuuggg

SEQ ID NO: 4201430 - RNA, 18 nt, Yersinia pestis KIM
uucuacucugucugcugu

SEQ ID NO: 4201431 - RNA, 15 nt, Yersinia pestis KIM
uucuagcaacauggu

SEQ ID NO: 4201432 - RNA, 20 nt, Yersinia pestis KIM
uucuaggugcucugccuuau

SEQ ID NO: 4201433 - RNA, 13 nt, Yersinia pestis KIM
uucuauaaugaug

SEQ ID NO: 4201434 - RNA, 15 nt, Yersinia pestis KIM
uucuauaccaauuga

SEQ ID NO: 4201435 - RNA, 17 nt, Yersinia pestis KIM
uucuaucgggcagguaa

SEQ ID NO: 4201436 - RNA, 18 nt, Yersinia pestis KIM
uucuauuuccacaagcgu

SEQ ID NO: 4201437 - RNA, 18 nt, Yersinia pestis KIM
uucucaacagcaucauca

SEQ ID NO: 4201438 - RNA, 22 nt, Yersinia pestis KIM
uucucaaccgcuggcaguugcc

SEQ ID NO: 4201439 - RNA, 17 nt, Yersinia pestis KIM
uucucaaugauaaaauc

SEQ ID NO: 4201440 - RNA, 11 nt, Yersinia pestis KIM
uucucaccaag

SEQ ID NO: 4201441 - RNA, 16 nt, Yersinia pestis KIM
uucucaucgcuuuuuu

SEQ ID NO: 4201442 - RNA, 14 nt, Yersinia pestis KIM
uucucauuaauaau

SEQ ID NO: 4201443 - RNA, 16 nt, Yersinia pestis KIM
uucucauuaauaauga

SEQ ID NO: 4201444 - RNA, 13 nt, Yersinia pestis KIM
uucucccuuucac

SEQ ID NO: 4201445 - RNA, 15 nt, Yersinia pestis KIM
uucucccuuuccagc

SEQ ID NO: 4201446 - RNA, 18 nt, Yersinia pestis KIM
uucuccugcgguggccag

SEQ ID NO: 4201447 - RNA, 15 nt, Yersinia pestis KIM
uucucggcaugcuuc

SEQ ID NO: 4201448 - RNA, 19 nt, Yersinia pestis KIM
uucucuauucugcuuuuug

SEQ ID NO: 4201449 - RNA, 15 nt, Yersinia pestis KIM
uucucucaauauauu

SEQ ID NO: 4201450 - RNA, 20 nt, Yersinia pestis KIM
uucucucaauauauucucuu

SEQ ID NO: 4201451 - RNA, 14 nt, Yersinia pestis KIM
uucucugauaaucc

SEQ ID NO: 4201452 - RNA, 13 nt, Yersinia pestis KIM
uucucuuggcuga

SEQ ID NO: 4201453 - RNA, 16 nt, Yersinia pestis KIM
uucucuuucaauggcu

SEQ ID NO: 4201454 - RNA, 18 nt, Yersinia pestis KIM
uucugaacaaaauaguca

SEQ ID NO: 4201455 - RNA, 17 nt, Yersinia pestis KIM
uucugaacgaccagaau

SEQ ID NO: 4201456 - RNA, 14 nt, Yersinia pestis KIM
uucugaagaugcca

SEQ ID NO: 4201457 - RNA, 23 nt, Yersinia pestis KIM
uucugaaucgcugccauaugcau

SEQ ID NO: 4201458 - RNA, 23 nt, Yersinia pestis KIM
uucugacgggacaaucuguuccu

SEQ ID NO: 4201459 - RNA, 22 nt, Yersinia pestis KIM
uucugauagagacgggcguuau

SEQ ID NO: 4201460 - RNA, 15 nt, Yersinia pestis KIM
uucugaucauuauua

SEQ ID NO: 4201461 - RNA, 13 nt, Yersinia pestis KIM
uucugcccauccu

SEQ ID NO: 4201462 - RNA, 15 nt, Yersinia pestis KIM
uucugccuauccuca

SEQ ID NO: 4201463 - RNA, 17 nt, Yersinia pestis KIM
uucugccuauccucacc

SEQ ID NO: 4201464 - RNA, 12 nt, Yersinia pestis KIM
uucugcuuggac

SEQ ID NO: 4201465 - RNA, 23 nt, Yersinia pestis KIM
uucuggaaugagaugaacacaga

SEQ ID NO: 4201466 - RNA, 10 nt, Yersinia pestis KIM
uucuggcagg

SEQ ID NO: 4201467 - RNA, 13 nt, Yersinia pestis KIM
uucuggggucauc

SEQ ID NO: 4201468 - RNA, 17 nt, Yersinia pestis KIM
uucuggguacaacacaa

SEQ ID NO: 4201469 - RNA, 21 nt, Yersinia pestis KIM
uucuggguacaacacaaaaac

SEQ ID NO: 4201470 - RNA, 21 nt, Yersinia pestis KIM
uucuguagcugacacgccaua

SEQ ID NO: 4201471 - RNA, 22 nt, Yersinia pestis KIM
uucugucggagccugauacacc

SEQ ID NO: 4201472 - RNA, 13 nt, Yersinia pestis KIM
uucuguugcuuca

SEQ ID NO: 4201473 - RNA, 13 nt, Yersinia pestis KIM
uucuuaauuuuau

SEQ ID NO: 4201474 - RNA, 16 nt, Yersinia pestis KIM
uucuuacuaaaauauc

SEQ ID NO: 4201475 - RNA, 21 nt, Yersinia pestis KIM
uugcaaugcuuauuucacacu

SEQ ID NO: 4201476 - RNA, 21 nt, Yersinia pestis KIM
uugcaauuaauuggcccauaa

SEQ ID NO: 4201477 - RNA, 17 nt, Yersinia pestis KIM
uugcaauugggguaaau

SEQ ID NO: 4201478 - RNA, 20 nt, Yersinia pestis KIM
uugcacaaagcuuacuguuc

SEQ ID NO: 4201479 - RNA, 12 nt, Yersinia pestis KIM
uugcacacccau

SEQ ID NO: 4201480 - RNA, 17 nt, Yersinia pestis KIM
uugcacacccauacaua

SEQ ID NO: 4201481 - RNA, 17 nt, Yersinia pestis KIM
uugcacacgauuaccug

SEQ ID NO: 4201482 - RNA, 19 nt, Yersinia pestis KIM
uugcaccccacaugccacc

SEQ ID NO: 4201483 - RNA, 16 nt, Yersinia pestis KIM
uugcaccuuugcgagg

SEQ ID NO: 4201484 - RNA, 14 nt, Yersinia pestis KIM
uugcagaaaguaau

SEQ ID NO: 4201485 - RNA, 22 nt, Yersinia pestis KIM
uugcagagguugcgcacaauca

SEQ ID NO: 4201486 - RNA, 14 nt, Yersinia pestis KIM
uugcagauaaacau

SEQ ID NO: 4201487 - RNA, 17 nt, Yersinia pestis KIM
uugcagaucggcauuau

SEQ ID NO: 4201488 - RNA, 16 nt, Yersinia pestis KIM
uugcagcacaccggcc

SEQ ID NO: 4201489 - RNA, 20 nt, Yersinia pestis KIM
uugcagcacaccggccaaaa

SEQ ID NO: 4201490 - RNA, 12 nt, Yersinia pestis KIM
uugcauacucag

SEQ ID NO: 4201491 - RNA, 14 nt, Yersinia pestis KIM
uugcauauuucucu

SEQ ID NO: 4201492 - RNA, 15 nt, Yersinia pestis KIM
uugcaucgcacugau

SEQ ID NO: 4201493 - RNA, 14 nt, Yersinia pestis KIM
uugcaucuuuaauu

SEQ ID NO: 4201494 - RNA, 24 nt, Yersinia pestis KIM
uugcauguaacggucauaaucagg

SEQ ID NO: 4201495 - RNA, 14 nt, Yersinia pestis KIM
uugccaaaugcaaa

SEQ ID NO: 4201496 - RNA, 22 nt, Yersinia pestis KIM
uugccacgccaguaaacagcca

SEQ ID NO: 4201497 - RNA, 17 nt, Yersinia pestis KIM
uugccacucauauucaa

SEQ ID NO: 4201498 - RNA, 18 nt, Yersinia pestis KIM
uugccagugaaucagcca

SEQ ID NO: 4201499 - RNA, 23 nt, Yersinia pestis KIM
uugccauaagcgacgacauuaau

SEQ ID NO: 4201500 - RNA, 21 nt, Yersinia pestis KIM
uugccaucuuguucuaauaau

SEQ ID NO: 4201501 - RNA, 22 nt, Yersinia pestis KIM
uugccauuuuaaucagaaaauu

SEQ ID NO: 4201502 - RNA, 15 nt, Yersinia pestis KIM
uugcccccaucacua

SEQ ID NO: 4201503 - RNA, 20 nt, Yersinia pestis KIM
uugcccgcgcuuccaggcug

SEQ ID NO: 4201504 - RNA, 21 nt, Yersinia pestis KIM
uugcccgcgcuuccaggcuga

SEQ ID NO: 4201505 - RNA, 13 nt, Yersinia pestis KIM
uugcccggaguuu

SEQ ID NO: 4201506 - RNA, 18 nt, Yersinia pestis KIM
uugcccguuagccaugca

SEQ ID NO: 4201507 - RNA, 13 nt, Yersinia pestis KIM
uugcccuucagau

SEQ ID NO: 4201508 - RNA, 20 nt, Yersinia pestis KIM
uugccgccgauaacauuauu

SEQ ID NO: 4201509 - RNA, 20 nt, Yersinia pestis KIM
uugccgguaugccaaaccca

SEQ ID NO: 4201510 - RNA, 14 nt, Yersinia pestis KIM
uugccgugcaaucu

SEQ ID NO: 4201511 - RNA, 16 nt, Yersinia pestis KIM
uugccgugcugucagc

SEQ ID NO: 4201512 - RNA, 16 nt, Yersinia pestis KIM
uugccguguaagaacu

SEQ ID NO: 4201513 - RNA, 15 nt, Yersinia pestis KIM
uugccuacuaccaaa

SEQ ID NO: 4201514 - RNA, 21 nt, Yersinia pestis KIM
uugccucugcuagcaaauucc

SEQ ID NO: 4201515 - RNA, 21 nt, Yersinia pestis KIM
uugccugacagccugugccca

SEQ ID NO: 4201516 - RNA, 13 nt, Yersinia pestis KIM
uugccugcucagc

SEQ ID NO: 4201517 - RNA, 12 nt, Yersinia pestis KIM
uugccuggccca

SEQ ID NO: 4201518 - RNA, 17 nt, Yersinia pestis KIM
uugccuggcccaucuau

SEQ ID NO: 4201519 - RNA, 19 nt, Yersinia pestis KIM
uugcgcaaaauuaagacau

SEQ ID NO: 4201520 - RNA, 21 nt, Yersinia pestis KIM
uugcgcacaaucagggcacuc

SEQ ID NO: 4201521 - RNA, 14 nt, Yersinia pestis KIM
uugcgccacaaccc

SEQ ID NO: 4201522 - RNA, 19 nt, Yersinia pestis KIM
uugcgccacaacccaauaa

SEQ ID NO: 4201523 - RNA, 21 nt, Yersinia pestis KIM
uugcgccgaaauaaaaccauc

SEQ ID NO: 4201524 - RNA, 13 nt, Yersinia pestis KIM
uugcggaucacau

SEQ ID NO: 4201525 - RNA, 14 nt, Yersinia pestis KIM
uugcggcaccugcc

SEQ ID NO: 4201526 - RNA, 21 nt, Yersinia pestis KIM
uugcggcgcacccuccaauaa

SEQ ID NO: 4201527 - RNA, 22 nt, Yersinia pestis KIM
uugcggcgcacccuccaauaau

SEQ ID NO: 4201528 - RNA, 20 nt, Yersinia pestis KIM
uugcggcguuucucagacug

SEQ ID NO: 4201529 - RNA, 20 nt, Yersinia pestis KIM
uugcgugacauacuuugccu

SEQ ID NO: 4201530 - RNA, 20 nt, Yersinia pestis KIM
uugcuaaauuuuguacaacu

SEQ ID NO: 4201531 - RNA, 14 nt, Yersinia pestis KIM
uugcuaauuugcgg

SEQ ID NO: 4201532 - RNA, 22 nt, Yersinia pestis KIM
uugcuacuggaauauuccauac

SEQ ID NO: 4201533 - RNA, 14 nt, Yersinia pestis KIM
uugcuacuggccug

SEQ ID NO: 4201534 - RNA, 20 nt, Yersinia pestis KIM
uugcuaggcgcagcagggcu

SEQ ID NO: 4201535 - RNA, 18 nt, Yersinia pestis KIM
uugcuauauuuuuuauau

SEQ ID NO: 4201536 - RNA, 15 nt, Yersinia pestis KIM
uugcuaucaauaaac

SEQ ID NO: 4201537 - RNA, 15 nt, Yersinia pestis KIM
uugcucaauaccauu

SEQ ID NO: 4201538 - RNA, 16 nt, Yersinia pestis KIM
uugcucacucaccgcc

SEQ ID NO: 4201539 - RNA, 18 nt, Yersinia pestis KIM
uugcucagauacaucaau

SEQ ID NO: 4201540 - RNA, 15 nt, Yersinia pestis KIM
uugcucauguucgca

SEQ ID NO: 4201541 - RNA, 19 nt, Yersinia pestis KIM
uugcuccaguugauacagg

SEQ ID NO: 4201542 - RNA, 18 nt, Yersinia pestis KIM
uugcugaugucauucuau

SEQ ID NO: 4201543 - RNA, 16 nt, Yersinia pestis KIM
uugcugauuugccaga

SEQ ID NO: 4201544 - RNA, 12 nt, Yersinia pestis KIM
uugcugcaaccg

SEQ ID NO: 4201545 - RNA, 15 nt, Yersinia pestis KIM
uugcuggcgcugauc

SEQ ID NO: 4201546 - RNA, 14 nt, Yersinia pestis KIM
uugcuggcuaucau

SEQ ID NO: 4201547 - RNA, 22 nt, Yersinia pestis KIM
uugcuguaaacaucgacaccaa

SEQ ID NO: 4201548 - RNA, 18 nt, Yersinia pestis KIM
uugcuguaaugccuggug

SEQ ID NO: 4201549 - RNA, 21 nt, Yersinia pestis KIM
uugcuguuguuauuacuguca

SEQ ID NO: 4201550 - RNA, 14 nt, Yersinia pestis KIM
uugcuuaucacccc

SEQ ID NO: 4201551 - RNA, 17 nt, Yersinia pestis KIM
uugcuuauccagccgcu

SEQ ID NO: 4201552 - RNA, 14 nt, Yersinia pestis KIM
uugcuuaucgucaa

SEQ ID NO: 4201553 - RNA, 14 nt, Yersinia pestis KIM
uugcuucugaacga

SEQ ID NO: 4201554 - RNA, 18 nt, Yersinia pestis KIM
uugcuugauagcgggcag

SEQ ID NO: 4201555 - RNA, 14 nt, Yersinia pestis KIM
uugcuugauuaccu

SEQ ID NO: 4201556 - RNA, 22 nt, Yersinia pestis KIM
uuggaaaaaucaguauuauaaa

SEQ ID NO: 4201557 - RNA, 14 nt, Yersinia pestis KIM
uuggaaaacagcaa

SEQ ID NO: 4201558 - RNA, 15 nt, Yersinia pestis KIM
uuggaaaugacaaau

SEQ ID NO: 4201559 - RNA, 14 nt, Yersinia pestis KIM
uuggaacaggccaa

SEQ ID NO: 4201560 - RNA, 23 nt, Yersinia pestis KIM
uuggaauagcuguaaaauaccaa

SEQ ID NO: 4201561 - RNA, 15 nt, Yersinia pestis KIM
uuggacccgucacca

SEQ ID NO: 4201562 - RNA, 16 nt, Yersinia pestis KIM
uuggacuaaccccaau

SEQ ID NO: 4201563 - RNA, 14 nt, Yersinia pestis KIM
uuggacucuggaau

SEQ ID NO: 4201564 - RNA, 15 nt, Yersinia pestis KIM
uuggagccagccauu

SEQ ID NO: 4201565 - RNA, 18 nt, Yersinia pestis KIM
uuggauaaaccggcuggg

SEQ ID NO: 4201566 - RNA, 20 nt, Yersinia pestis KIM
uuggauaauaaccugauauu

SEQ ID NO: 4201567 - RNA, 18 nt, Yersinia pestis KIM
uuggauauagagauaaaa

SEQ ID NO: 4201568 - RNA, 23 nt, Yersinia pestis KIM
uuggcaaauucaacaaucaauca

SEQ ID NO: 4201569 - RNA, 15 nt, Yersinia pestis KIM
uuggcauguucacau

SEQ ID NO: 4201570 - RNA, 23 nt, Yersinia pestis KIM
uuggcauuaaacugaauaucccc

SEQ ID NO: 4201571 - RNA, 21 nt, Yersinia pestis KIM
uuggccauuaaccuaaaaacg

SEQ ID NO: 4201572 - RNA, 17 nt, Yersinia pestis KIM
uuggccgcgcacagcac

SEQ ID NO: 4201573 - RNA, 18 nt, Yersinia pestis KIM
uuggcggaagacuuccag

SEQ ID NO: 4201574 - RNA, 13 nt, Yersinia pestis KIM
uuggcggcaccuu

SEQ ID NO: 4201575 - RNA, 22 nt, Yersinia pestis KIM
uuggcggcuauuauugcuguuu

SEQ ID NO: 4201576 - RNA, 16 nt, Yersinia pestis KIM
uuggcgggauccaucu

SEQ ID NO: 4201577 - RNA, 19 nt, Yersinia pestis KIM
uuggcuaaugcgagugcca

SEQ ID NO: 4201578 - RNA, 23 nt, Yersinia pestis KIM
uuggcucgugaucagcagacuca

SEQ ID NO: 4201579 - RNA, 15 nt, Yersinia pestis KIM
uuggcuguuguggca

SEQ ID NO: 4201580 - RNA, 18 nt, Yersinia pestis KIM
uuggcuugcuugauggca

SEQ ID NO: 4201581 - RNA, 20 nt, Yersinia pestis KIM
uuggcuuuugccucacuguc

SEQ ID NO: 4201582 - RNA, 20 nt, Yersinia pestis KIM
uugggauucaggcugcgguu

SEQ ID NO: 4201583 - RNA, 19 nt, Yersinia pestis KIM
uugggcgggaucuccagaa

SEQ ID NO: 4201584 - RNA, 13 nt, Yersinia pestis KIM
uugggcuaaaacu

SEQ ID NO: 4201585 - RNA, 16 nt, Yersinia pestis KIM
uuggggguguuacauc

SEQ ID NO: 4201586 - RNA, 13 nt, Yersinia pestis KIM
uuggguauaggcc

SEQ ID NO: 4201587 - RNA, 16 nt, Yersinia pestis KIM
uugggucaguuuuauu

SEQ ID NO: 4201588 - RNA, 15 nt, Yersinia pestis KIM
uugggugaacacaga

SEQ ID NO: 4201589 - RNA, 23 nt, Yersinia pestis KIM
uugggugacaacgucacuuccau

SEQ ID NO: 4201590 - RNA, 20 nt, Yersinia pestis KIM
uuuaccuguuugcaacauua

SEQ ID NO: 4201591 - RNA, 21 nt, Yersinia pestis KIM
uuuacgccuauccucaugauu

SEQ ID NO: 4201592 - RNA, 18 nt, Yersinia pestis KIM
uuuacgggcggcauaauc

SEQ ID NO: 4201593 - RNA, 21 nt, Yersinia pestis KIM
uuuacguagggcggccuuugg

SEQ ID NO: 4201594 - RNA, 16 nt, Yersinia pestis KIM
uuuacgugaucaucuu

SEQ ID NO: 4201595 - RNA, 20 nt, Yersinia pestis KIM
uuuacuccccugccuauccu

SEQ ID NO: 4201596 - RNA, 14 nt, Yersinia pestis KIM
uuuacuccucugcc

SEQ ID NO: 4201597 - RNA, 16 nt, Yersinia pestis KIM
uuuacucgccuuucac

SEQ ID NO: 4201598 - RNA, 16 nt, Yersinia pestis KIM
uuuacugaucucauca

SEQ ID NO: 4201599 - RNA, 15 nt, Yersinia pestis KIM
uuuacugccacugac

SEQ ID NO: 4201600 - RNA, 21 nt, Yersinia pestis KIM
uuuacugcuuuucuaccugag

SEQ ID NO: 4201601 - RNA, 17 nt, Yersinia pestis KIM
uuuacuggcugccuacc

SEQ ID NO: 4201602 - RNA, 21 nt, Yersinia pestis KIM
uuuacuguuaauccaguugag

SEQ ID NO: 4201603 - RNA, 14 nt, Yersinia pestis KIM
uuuacuugauaauu

SEQ ID NO: 4201604 - RNA, 20 nt, Yersinia pestis KIM
uuuacuugguuacuuuccug

SEQ ID NO: 4201605 - RNA, 23 nt, Yersinia pestis KIM
uuuagacaagcgcaguagcggcu

SEQ ID NO: 4201606 - RNA, 17 nt, Yersinia pestis KIM
uuuagaggcugauaacc

SEQ ID NO: 4201607 - RNA, 14 nt, Yersinia pestis KIM
uuuagaucucagaa

SEQ ID NO: 4201608 - RNA, 15 nt, Yersinia pestis KIM
uuuagaugucagauu

SEQ ID NO: 4201609 - RNA, 11 nt, Yersinia pestis KIM
uuuagcaaagc

SEQ ID NO: 4201610 - RNA, 12 nt, Yersinia pestis KIM
uuuagcauugca

SEQ ID NO: 4201611 - RNA, 16 nt, Yersinia pestis KIM
uuuagcccguugagug

SEQ ID NO: 4201612 - RNA, 21 nt, Yersinia pestis KIM
uuuagccgcuucgcugacauu

SEQ ID NO: 4201613 - RNA, 13 nt, Yersinia pestis KIM
uuuagcgaugacc

SEQ ID NO: 4201614 - RNA, 15 nt, Yersinia pestis KIM
uuuaggaaagcccaa

SEQ ID NO: 4201615 - RNA, 15 nt, Yersinia pestis KIM
uuuaggccuauaacc

SEQ ID NO: 4201616 - RNA, 19 nt, Yersinia pestis KIM
uuuaggcgggcaguauaau

SEQ ID NO: 4201617 - RNA, 23 nt, Yersinia pestis KIM
uuuaggucaauaucgauuuuuaa

SEQ ID NO: 4201618 - RNA, 21 nt, Yersinia pestis KIM
uuuagugaugauauuuaucga

SEQ ID NO: 4201619 - RNA, 18 nt, Yersinia pestis KIM
uuuagugggugagcagag

SEQ ID NO: 4201620 - RNA, 23 nt, Yersinia pestis KIM
uuuauaaauuacucguauaaaaa

SEQ ID NO: 4201621 - RNA, 18 nt, Yersinia pestis KIM
uuuauaaccgucaccaaa

SEQ ID NO: 4201622 - RNA, 15 nt, Yersinia pestis KIM
uuuauaagcguuauu

SEQ ID NO: 4201623 - RNA, 20 nt, Yersinia pestis KIM
uuuauacagcauauaaaaaa

SEQ ID NO: 4201624 - RNA, 23 nt, Yersinia pestis KIM
uuuauacagcauauaaaaaagca

SEQ ID NO: 4201625 - RNA, 15 nt, Yersinia pestis KIM
uuuauacauaucaga

SEQ ID NO: 4201626 - RNA, 16 nt, Yersinia pestis KIM
uuuauacccaaaauaa

SEQ ID NO: 4201627 - RNA, 18 nt, Yersinia pestis KIM
uuuauacggcuauuuuua

SEQ ID NO: 4201628 - RNA, 13 nt, Yersinia pestis KIM
uuuauauccccua

SEQ ID NO: 4201629 - RNA, 17 nt, Yersinia pestis KIM
uuuauauuauuauaaau

SEQ ID NO: 4201630 - RNA, 16 nt, Yersinia pestis KIM
uuuauauucuuagcca

SEQ ID NO: 4201631 - RNA, 14 nt, Yersinia pestis KIM
uuuaucaaucagcu

SEQ ID NO: 4201632 - RNA, 19 nt, Yersinia pestis KIM
uuuaucaaucagcugauau

SEQ ID NO: 4201633 - RNA, 22 nt, Yersinia pestis KIM
uuuaucaguagucaauacaauu

SEQ ID NO: 4201634 - RNA, 14 nt, Yersinia pestis KIM
uuuauccaaucuug

SEQ ID NO: 4201635 - RNA, 16 nt, Yersinia pestis KIM
uuuauccacuuggcua

SEQ ID NO: 4201636 - RNA, 15 nt, Yersinia pestis KIM
uuuaucgaccacuuu

SEQ ID NO: 4201637 - RNA, 13 nt, Yersinia pestis KIM
uuuaucgauaacc

SEQ ID NO: 4201638 - RNA, 14 nt, Yersinia pestis KIM
uuuaucgcaguaau

SEQ ID NO: 4201639 - RNA, 15 nt, Yersinia pestis KIM
uuuaucuaucuguuc

SEQ ID NO: 4201640 - RNA, 15 nt, Yersinia pestis KIM
uuuaucuuccacucu

SEQ ID NO: 4201641 - RNA, 20 nt, Yersinia pestis KIM
uuuaucuuccacucuuucaa

SEQ ID NO: 4201642 - RNA, 14 nt, Yersinia pestis KIM
uuuaucuucuucag

SEQ ID NO: 4201643 - RNA, 13 nt, Yersinia pestis KIM
uuuaugacuucuu

SEQ ID NO: 4201644 - RNA, 16 nt, Yersinia pestis KIM
uuuaugcaugaaaacc

SEQ ID NO: 4201645 - RNA, 13 nt, Yersinia pestis KIM
uuuaugcugccca

SEQ ID NO: 4201646 - RNA, 15 nt, Yersinia pestis KIM
uuuauggcuuauccc

SEQ ID NO: 4201647 - RNA, 21 nt, Yersinia pestis KIM
uuuauguacauccaauuuuuu

SEQ ID NO: 4201648 - RNA, 12 nt, Yersinia pestis KIM
uuuauuaucaau

SEQ ID NO: 4201649 - RNA, 11 nt, Yersinia pestis KIM
uuuauuauuca

SEQ ID NO: 4201650 - RNA, 21 nt, Yersinia pestis KIM
uuuauuggucaauaaaauuaa

SEQ ID NO: 4201651 - RNA, 19 nt, Yersinia pestis KIM
uuuauugucuuuaauaaaa

SEQ ID NO: 4201652 - RNA, 14 nt, Yersinia pestis KIM
uuuauuugcugccu

SEQ ID NO: 4201653 - RNA, 14 nt, Yersinia pestis KIM
uuucaauaacaccg

SEQ ID NO: 4201654 - RNA, 18 nt, Yersinia pestis KIM
uuucaauucucccauuua

SEQ ID NO: 4201655 - RNA, 12 nt, Yersinia pestis KIM
uuucaauugccc

SEQ ID NO: 4201656 - RNA, 13 nt, Yersinia pestis KIM
uuucacaccggcg

SEQ ID NO: 4201657 - RNA, 23 nt, Yersinia pestis KIM
uuucacccaaccgggaugaaucg

SEQ ID NO: 4201658 - RNA, 15 nt, Yersinia pestis KIM
uuucacccucugcgu

SEQ ID NO: 4201659 - RNA, 20 nt, Yersinia pestis KIM
uuucacccuugauuuuacca

SEQ ID NO: 4201660 - RNA, 23 nt, Yersinia pestis KIM
uuucacccuugauuuuaccaaca

SEQ ID NO: 4201661 - RNA, 17 nt, Yersinia pestis KIM
uuucacggauaucaaca

SEQ ID NO: 4201662 - RNA, 20 nt, Yersinia pestis KIM
uuucacuggccuauuaagau

SEQ ID NO: 4201663 - RNA, 22 nt, Yersinia pestis KIM
uuucacuggccuauuaagauaa

SEQ ID NO: 4201664 - RNA, 23 nt, Yersinia pestis KIM
uuucacuggccuauuaagauaau

SEQ ID NO: 4201665 - RNA, 11 nt, Yersinia pestis KIM
uuucagacucc

SEQ ID NO: 4201666 - RNA, 18 nt, Yersinia pestis KIM
uuucagacugcugacaac

SEQ ID NO: 4201667 - RNA, 22 nt, Yersinia pestis KIM
uuucagacugcugacaacccuc

SEQ ID NO: 4201668 - RNA, 17 nt, Yersinia pestis KIM
uuucagauaaaaagcca

SEQ ID NO: 4201669 - RNA, 14 nt, Yersinia pestis KIM
uuucagauaaaaau

SEQ ID NO: 4201670 - RNA, 15 nt, Yersinia pestis KIM
uuucagcaccauaaa

SEQ ID NO: 4201671 - RNA, 15 nt, Yersinia pestis KIM
uuucagcauaucccu

SEQ ID NO: 4201672 - RNA, 12 nt, Yersinia pestis KIM
uuucagcugcuu

SEQ ID NO: 4201673 - RNA, 19 nt, Yersinia pestis KIM
uuucagcuucaagguacug

SEQ ID NO: 4201674 - RNA, 18 nt, Yersinia pestis KIM
uuucagcuugcaacaaaa

SEQ ID NO: 4201675 - RNA, 19 nt, Yersinia pestis KIM
uuucaggagugaauuucuu

SEQ ID NO: 4201676 - RNA, 19 nt, Yersinia pestis KIM
uuucagggaguaacuugac

SEQ ID NO: 4201677 - RNA, 16 nt, Yersinia pestis KIM
uuucaguggcuucucu

SEQ ID NO: 4201678 - RNA, 19 nt, Yersinia pestis KIM
uuucaucccauauuccggu

SEQ ID NO: 4201679 - RNA, 16 nt, Yersinia pestis KIM
uuucaucgcugaauuu

SEQ ID NO: 4201680 - RNA, 18 nt, Yersinia pestis KIM
uuucaucggcaaaaacag

SEQ ID NO: 4201681 - RNA, 14 nt, Yersinia pestis KIM
uuucauuagucaau

SEQ ID NO: 4201682 - RNA, 17 nt, Yersinia pestis KIM
uuucauuagucaauguu

SEQ ID NO: 4201683 - RNA, 14 nt, Yersinia pestis KIM
uuucauuauuuuca

SEQ ID NO: 4201684 - RNA, 21 nt, Yersinia pestis KIM
uuucauuccagauaaaauacu

SEQ ID NO: 4201685 - RNA, 13 nt, Yersinia pestis KIM
uuucauuuacuug

SEQ ID NO: 4201686 - RNA, 21 nt, Yersinia pestis KIM
uuucauuuguuggcaaauuaa

SEQ ID NO: 4201687 - RNA, 23 nt, Yersinia pestis KIM
uuuccaacuccaucgccacuucu

SEQ ID NO: 4201688 - RNA, 21 nt, Yersinia pestis KIM
uuuccacgcccaacucuuuag

SEQ ID NO: 4201689 - RNA, 14 nt, Yersinia pestis KIM
uuuccagcaaaagc

SEQ ID NO: 4201690 - RNA, 13 nt, Yersinia pestis KIM
uuucccaaaguga

SEQ ID NO: 4201691 - RNA, 19 nt, Yersinia pestis KIM
uuucccgcuagcuacccga

SEQ ID NO: 4201692 - RNA, 18 nt, Yersinia pestis KIM
uuucccgcucuucaccaa

SEQ ID NO: 4201693 - RNA, 22 nt, Yersinia pestis KIM
uuucccuuagggcaauggcguu

SEQ ID NO: 4201694 - RNA, 15 nt, Yersinia pestis KIM
uuucccuuucucagu

SEQ ID NO: 4201695 - RNA, 21 nt, Yersinia pestis KIM
uuuccgucagcccaacgucau

SEQ ID NO: 4201696 - RNA, 22 nt, Yersinia pestis KIM
uuuccugagucuguuuccacuc

SEQ ID NO: 4201697 - RNA, 14 nt, Yersinia pestis KIM
uuuccuuauuucuu

SEQ ID NO: 4201698 - RNA, 23 nt, Yersinia pestis KIM
uuucgacgguuuuuuggcugaua

SEQ ID NO: 4201699 - RNA, 18 nt, Yersinia pestis KIM
uuucgaguaguuuggcua

SEQ ID NO: 4201700 - RNA, 14 nt, Yersinia pestis KIM
uuucgaguugaacu

SEQ ID NO: 4201701 - RNA, 20 nt, Yersinia pestis KIM
uuucgcgccaaauuguugca

SEQ ID NO: 4201702 - RNA, 18 nt, Yersinia pestis KIM
uuucgcugacagcuaucu

SEQ ID NO: 4201703 - RNA, 22 nt, Yersinia pestis KIM
uuucgcuggggcauuuaauuca

SEQ ID NO: 4201704 - RNA, 18 nt, Yersinia pestis KIM
uuucgcuggucuuaauca

SEQ ID NO: 4201705 - RNA, 14 nt, Yersinia pestis KIM
uuuuaaaaaaaaag

SEQ ID NO: 4201706 - RNA, 20 nt, Yersinia pestis KIM
uuuuaaaaaaauuaaaauaa

SEQ ID NO: 4201707 - RNA, 13 nt, Yersinia pestis KIM
uuuuaaaaaauca

SEQ ID NO: 4201708 - RNA, 15 nt, Yersinia pestis KIM
uuuuaaaaaaucagu

SEQ ID NO: 4201709 - RNA, 19 nt, Yersinia pestis KIM
uuuuaaacgucagauuagu

SEQ ID NO: 4201710 - RNA, 18 nt, Yersinia pestis KIM
uuuuaaacuuguaucaaa

SEQ ID NO: 4201711 - RNA, 16 nt, Yersinia pestis KIM
uuuuaaagaaaaaacg

SEQ ID NO: 4201712 - RNA, 20 nt, Yersinia pestis KIM
uuuuaaauauggguuaaaaa

SEQ ID NO: 4201713 - RNA, 21 nt, Yersinia pestis KIM
uuuuaacgucgcugaaaugcu

SEQ ID NO: 4201714 - RNA, 16 nt, Yersinia pestis KIM
uuuuaacguuagagca

SEQ ID NO: 4201715 - RNA, 17 nt, Yersinia pestis KIM
uuuuaagaaaacugugc

SEQ ID NO: 4201716 - RNA, 13 nt, Yersinia pestis KIM
uuuuaauaaaaaa

SEQ ID NO: 4201717 - RNA, 16 nt, Yersinia pestis KIM
uuuuaauaaaaaacug

SEQ ID NO: 4201718 - RNA, 14 nt, Yersinia pestis KIM
uuuuaauaaccauu

SEQ ID NO: 4201719 - RNA, 23 nt, Yersinia pestis KIM
uuuuaauaaccauuaauugguuu

SEQ ID NO: 4201720 - RNA, 18 nt, Yersinia pestis KIM
uuuuaaucucuccaugau

SEQ ID NO: 4201721 - RNA, 16 nt, Yersinia pestis KIM
uuuuaaugaaaacuac

SEQ ID NO: 4201722 - RNA, 16 nt, Yersinia pestis KIM
uuuuaaugccaauuga

SEQ ID NO: 4201723 - RNA, 18 nt, Yersinia pestis KIM
uuuuaauggcauuaaaaa

SEQ ID NO: 4201724 - RNA, 16 nt, Yersinia pestis KIM
uuuuaauuuaaacucu

SEQ ID NO: 4201725 - RNA, 23 nt, Yersinia pestis KIM
uuuuacaaauuugacauuuccuu

SEQ ID NO: 4201726 - RNA, 13 nt, Yersinia pestis KIM
uuuuacaauuacg

SEQ ID NO: 4201727 - RNA, 18 nt, Yersinia pestis KIM
uuuuacaggauuaaauaa

SEQ ID NO: 4201728 - RNA, 20 nt, Yersinia pestis KIM
uuuuaccgcagggcguucag

SEQ ID NO: 4201729 - RNA, 23 nt, Yersinia pestis KIM
uuuuaccgggcgacuauagauac

SEQ ID NO: 4201730 - RNA, 23 nt, Yersinia pestis KIM
uuuuaccuuuaacuguuuuauau

SEQ ID NO: 4201731 - RNA, 14 nt, Yersinia pestis KIM
uuuuacgaucaacc

SEQ ID NO: 4201732 - RNA, 14 nt, Yersinia pestis KIM
uuuuacgcaaguaa

SEQ ID NO: 4201733 - RNA, 16 nt, Yersinia pestis KIM
uuuuacgggccuuuua

SEQ ID NO: 4201734 - RNA, 19 nt, Yersinia pestis KIM
uuuuacgggccuuuuaauu

SEQ ID NO: 4201735 - RNA, 14 nt, Yersinia pestis KIM
uuuuacuuugaaau

SEQ ID NO: 4201736 - RNA, 13 nt, Yersinia pestis KIM
uuuuagacgucag

SEQ ID NO: 4201737 - RNA, 15 nt, Yersinia pestis KIM
uuuuagcgcuuuuac

SEQ ID NO: 4201738 - RNA, 17 nt, Yersinia pestis KIM
uuuuagcgcuuuuacau

SEQ ID NO: 4201739 - RNA, 20 nt, Yersinia pestis KIM
uuuuaggcaauccaaacaua

SEQ ID NO: 4201740 - RNA, 20 nt, Yersinia pestis KIM
uuuuaguauuggaaaaauca

SEQ ID NO: 4201741 - RNA, 21 nt, Yersinia pestis KIM
uuuuauaaacacuuaccuaua

SEQ ID NO: 4201742 - RNA, 15 nt, Yersinia pestis KIM
uuuuauaaucaucua

SEQ ID NO: 4201743 - RNA, 16 nt, Yersinia pestis KIM
uuuuauauaauugaag

SEQ ID NO: 4201744 - RNA, 16 nt, Yersinia pestis KIM
uuuuauauauccaaaa

SEQ ID NO: 4201745 - RNA, 14 nt, Yersinia pestis KIM
uuuuauaucagauu

SEQ ID NO: 4201746 - RNA, 18 nt, Yersinia pestis KIM
uuuuauauccgccauccu

SEQ ID NO: 4201747 - RNA, 22 nt, Yersinia pestis KIM
uuuuauauccgccauccuucaa

SEQ ID NO: 4201748 - RNA, 12 nt, Yersinia pestis KIM
uuuuaucaauag

SEQ ID NO: 4201749 - RNA, 12 nt, Yersinia pestis KIM
uuuuaugccuuu

SEQ ID NO: 4201750 - RNA, 21 nt, Yersinia pestis KIM
uuuuauggcauaaacugaagu

SEQ ID NO: 4201751 - RNA, 22 nt, Yersinia pestis KIM
uuuuauggcauaaacugaaguu

SEQ ID NO: 4201752 - RNA, 21 nt, Yersinia pestis KIM
uuuuaugucagagauaaaccc

SEQ ID NO: 4201753 - RNA, 18 nt, Yersinia pestis KIM
uuuuauucgcguuucauu

SEQ ID NO: 4201754 - RNA, 14 nt, Yersinia pestis KIM
uuuuauugacggcu

SEQ ID NO: 4201755 - RNA, 16 nt, Yersinia pestis KIM
uuuuauugucuuuaau

SEQ ID NO: 4201756 - RNA, 14 nt, Yersinia pestis KIM
uuuuauuucccccu

SEQ ID NO: 4201757 - RNA, 13 nt, Yersinia pestis KIM
uuuuauuuuacuu

SEQ ID NO: 4201758 - RNA, 17 nt, Yersinia pestis KIM
uuuucaaucuauucuuu

SEQ ID NO: 4201759 - RNA, 19 nt, Yersinia pestis KIM
uuuucacuccggcaucauc

SEQ ID NO: 4201760 - RNA, 23 nt, Yersinia pestis KIM
uuuucacuccggcaucauccuca

SEQ ID NO: 4201761 - RNA, 23 nt, Yersinia pestis KIM
uuuucaguaucgaagacaaacac

SEQ ID NO: 4201762 - RNA, 15 nt, Yersinia pestis KIM
uuuucaguuuuaauu

SEQ ID NO: 4201763 - RNA, 12 nt, Yersinia pestis KIM
uuuucauccuaa

SEQ ID NO: 4201764 - RNA, 13 nt, Yersinia pestis KIM
uuuucauuuacuu

SEQ ID NO: 4201765 - RNA, 13 nt, Yersinia pestis KIM
uuuuccaggucaa

SEQ ID NO: 4201766 - RNA, 22 nt, Yersinia pestis KIM
uuuucccaguaagcucuacuaa

SEQ ID NO: 4201767 - RNA, 14 nt, Yersinia pestis KIM
uuuucccucagcca

SEQ ID NO: 4201768 - RNA, 18 nt, Yersinia pestis KIM
uuuuccgccaugagaacc

SEQ ID NO: 4201769 - RNA, 15 nt, Yersinia pestis KIM
uuuucgaacuuaacu

SEQ ID NO: 4201770 - RNA, 22 nt, Yersinia pestis KIM
uuuucgacguaaccgcauaauc

SEQ ID NO: 4201771 - RNA, 16 nt, Yersinia pestis KIM
uuuucgcgcaccaacu

SEQ ID NO: 4201772 - RNA, 19 nt, Yersinia pestis KIM
uuuucgucauuauuaaacu

SEQ ID NO: 4201773 - RNA, 18 nt, Yersinia pestis KIM
uuuucgugucguaaccca

SEQ ID NO: 4201774 - RNA, 13 nt, Yersinia pestis KIM
uuuucuaaccuca

SEQ ID NO: 4201775 - RNA, 18 nt, Yersinia pestis KIM
uuuucuaagcugccugug

SEQ ID NO: 4201776 - RNA, 18 nt, Yersinia pestis KIM
uuuucuacugaauaaaca

SEQ ID NO: 4201777 - RNA, 21 nt, Yersinia pestis KIM
uuuucuacugaauaaacacca

SEQ ID NO: 4201778 - RNA, 20 nt, Yersinia pestis KIM
uuuucuagcuguagcaauau

SEQ ID NO: 4201779 - RNA, 14 nt, Yersinia pestis KIM
uuuucucagcauaa

SEQ ID NO: 4201780 - RNA, 21 nt, Yersinia pestis KIM
uuuucuccugggcugauauau

SEQ ID NO: 4201781 - RNA, 17 nt, Yersinia pestis KIM
uuuucugauuuuuuacu

SEQ ID NO: 4201782 - RNA, 13 nt, Yersinia pestis KIM
uuuucugccuauc

SEQ ID NO: 4201783 - RNA, 22 nt, Yersinia pestis KIM
uuuucuggcguuuugcaucaac

SEQ ID NO: 4201784 - RNA, 21 nt, Yersinia pestis KIM
uuuucuggugagcaucaacau

SEQ ID NO: 4201785 - RNA, 22 nt, Yersinia pestis KIM
uuuucuuguauauaaaaaauga

SEQ ID NO: 4201786 - RNA, 15 nt, Yersinia pestis KIM
uuuucuuucaacugc

SEQ ID NO: 4201787 - RNA, 23 nt, Yersinia pestis KIM
uuuugacacgggaucaacauggu

SEQ ID NO: 4201788 - RNA, 20 nt, Yersinia pestis KIM
uuuugaggauauuagggcug

SEQ ID NO: 4201789 - RNA, 17 nt, Yersinia pestis KIM
uuuugcaucaccaucau

SEQ ID NO: 4201790 - RNA, 23 nt, Yersinia pestis KIM
uuuugccaaugcugcugucagua

SEQ ID NO: 4201791 - RNA, 18 nt, Yersinia pestis KIM
uuuugccacauuucccuu

SEQ ID NO: 4201792 - RNA, 16 nt, Yersinia pestis KIM
uuuugccagauaaaaa

SEQ ID NO: 4201793 - RNA, 15 nt, Yersinia pestis KIM
uuuugccucacuguc

SEQ ID NO: 4201794 - RNA, 23 nt, Yersinia pestis KIM
uuuugcgccacaacccaauaaua

SEQ ID NO: 4201795 - RNA, 11 nt, Yersinia pestis KIM
uuuugcugcca

SEQ ID NO: 4201796 - RNA, 12 nt, Yersinia pestis KIM
uuuuggaaugcu

SEQ ID NO: 4201797 - RNA, 15 nt, Yersinia pestis KIM
uuuuggccgcuacug

SEQ ID NO: 4201798 - RNA, 22 nt, Yersinia pestis KIM
uuuuggccgggauuugcucaga

SEQ ID NO: 4201799 - RNA, 14 nt, Yersinia pestis KIM
uuuugggauaaaau

SEQ ID NO: 4201800 - RNA, 17 nt, Yersinia pestis KIM
uuuuggucguauucaua

SEQ ID NO: 4201801 - RNA, 17 nt, Yersinia pestis KIM
uuuuggugacaaacgcu

SEQ ID NO: 4201802 - RNA, 11 nt, Yersinia pestis KIM
uuuuguauucc

SEQ ID NO: 4201803 - RNA, 15 nt, Yersinia pestis KIM
uuuuguuacccacua

SEQ ID NO: 4201804 - RNA, 23 nt, Yersinia pestis KIM
uuuuguuacugcuuaccuuguuu

SEQ ID NO: 4201805 - RNA, 14 nt, Yersinia pestis KIM
uuuuguuuccccua

SEQ ID NO: 4201806 - RNA, 19 nt, Yersinia pestis KIM
uuuuuaaacuuguaucaaa

SEQ ID NO: 4201807 - RNA, 15 nt, Yersinia pestis KIM
uuuuuaaagaaaaaa

SEQ ID NO: 4201808 - RNA, 12 nt, Yersinia pestis KIM
uuuuuaaccucu

SEQ ID NO: 4201809 - RNA, 21 nt, Yersinia pestis KIM
uuuuuaaugauugauuaucaa

SEQ ID NO: 4201810 - RNA, 20 nt, Yersinia pestis KIM
uuuuuacauauaauccaaaa

SEQ ID NO: 4201811 - RNA, 21 nt, Yersinia pestis KIM
uuuuuacccguacaaaaauaa

SEQ ID NO: 4201812 - RNA, 17 nt, Yersinia pestis KIM
uuuuuaccugagaaaaa

SEQ ID NO: 4201813 - RNA, 14 nt, Yersinia pestis KIM
uuuuuauaaacacu

SEQ ID NO: 4201814 - RNA, 16 nt, Yersinia pestis KIM
uuuuuauaaucgauac

SEQ ID NO: 4201815 - RNA, 19 nt, Yersinia pestis KIM
uuuuuauaggucaucccag

SEQ ID NO: 4201816 - RNA, 12 nt, Yersinia pestis KIM
uuuuuaucccua

SEQ ID NO: 4201817 - RNA, 20 nt, Yersinia pestis KIM
uuuuuauuucuccuuacuau

SEQ ID NO: 4201818 - RNA, 23 nt, Yersinia pestis KIM
uuuuucaucaauuggcagcggca

SEQ ID NO: 4201819 - RNA, 11 nt, Yersinia pestis KIM
uuuuuccagcc

SEQ ID NO: 4201820 - RNA, 14 nt, Yersinia pestis KIM
augaucaugcucac

SEQ ID NO: 4201821 - RNA, 15 nt, Yersinia pestis KIM
augaucuuuauuauu

SEQ ID NO: 4201822 - RNA, 17 nt, Yersinia pestis KIM
augaugaaaauugcagg

SEQ ID NO: 4201823 - RNA, 20 nt, Yersinia pestis KIM
augaugaaaauugcaggugg

SEQ ID NO: 4201824 - RNA, 14 nt, Yersinia pestis KIM
augaugauaucacc

SEQ ID NO: 4201825 - RNA, 17 nt, Yersinia pestis KIM
augaugauaucaccuuu

SEQ ID NO: 4201826 - RNA, 14 nt, Yersinia pestis KIM
augaugauuauuuu

SEQ ID NO: 4201827 - RNA, 19 nt, Yersinia pestis KIM
augaugcccgcuuucugau

SEQ ID NO: 4201828 - RNA, 15 nt, Yersinia pestis KIM
augaugccgaucauc

SEQ ID NO: 4201829 - RNA, 18 nt, Yersinia pestis KIM
augaugcggaagaaggcu

SEQ ID NO: 4201830 - RNA, 20 nt, Yersinia pestis KIM
augaugcuggguauauauac

SEQ ID NO: 4201831 - RNA, 20 nt, Yersinia pestis KIM
augauggcaucuuauuauua

SEQ ID NO: 4201832 - RNA, 20 nt, Yersinia pestis KIM
augauguugauuaacccuuu

SEQ ID NO: 4201833 - RNA, 16 nt, Yersinia pestis KIM
augauuaaacgccugg

SEQ ID NO: 4201834 - RNA, 14 nt, Yersinia pestis KIM
augauuacaucacu

SEQ ID NO: 4201835 - RNA, 22 nt, Yersinia pestis KIM
augauuaggcauaaauaauaaa

SEQ ID NO: 4201836 - RNA, 22 nt, Yersinia pestis KIM
augauuauuuauuuacagccac

SEQ ID NO: 4201837 - RNA, 15 nt, Yersinia pestis KIM
augauucauugaguu

SEQ ID NO: 4201838 - RNA, 14 nt, Yersinia pestis KIM
augauugaaaaaca

SEQ ID NO: 4201839 - RNA, 16 nt, Yersinia pestis KIM
augauugaaaaacaga

SEQ ID NO: 4201840 - RNA, 15 nt, Yersinia pestis KIM
augauugauuaucaa

SEQ ID NO: 4201841 - RNA, 16 nt, Yersinia pestis KIM
augauuggagcaaaug

SEQ ID NO: 4201842 - RNA, 13 nt, Yersinia pestis KIM
augauuucucgcu

SEQ ID NO: 4201843 - RNA, 20 nt, Yersinia pestis KIM
augcaaaaaaagacacuaac

SEQ ID NO: 4201844 - RNA, 23 nt, Yersinia pestis KIM
augcaaauaauaacgccugcaau

SEQ ID NO: 4201845 - RNA, 21 nt, Yersinia pestis KIM
augcaaucuaacuaauaauaa

SEQ ID NO: 4201846 - RNA, 13 nt, Yersinia pestis KIM
augcaauuuugga

SEQ ID NO: 4201847 - RNA, 19 nt, Yersinia pestis KIM
augcaauuuuugcagugca

SEQ ID NO: 4201848 - RNA, 16 nt, Yersinia pestis KIM
augcacaguaggcuga

SEQ ID NO: 4201849 - RNA, 17 nt, Yersinia pestis KIM
augcacaguaggcugaa

SEQ ID NO: 4201850 - RNA, 15 nt, Yersinia pestis KIM
augcacaguugucug

SEQ ID NO: 4201851 - RNA, 17 nt, Yersinia pestis KIM
augcaccaaauucagaa

SEQ ID NO: 4201852 - RNA, 20 nt, Yersinia pestis KIM
augcaccgcccagauucauu

SEQ ID NO: 4201853 - RNA, 14 nt, Yersinia pestis KIM
augcaccuguuaaa

SEQ ID NO: 4201854 - RNA, 14 nt, Yersinia pestis KIM
augcaccuuccggg

SEQ ID NO: 4201855 - RNA, 14 nt, Yersinia pestis KIM
augcacuucaccug

SEQ ID NO: 4201856 - RNA, 16 nt, Yersinia pestis KIM
augcagacucuuauau

SEQ ID NO: 4201857 - RNA, 16 nt, Yersinia pestis KIM
augcagauuuuugcuu

SEQ ID NO: 4201858 - RNA, 15 nt, Yersinia pestis KIM
augcagcauuucagg

SEQ ID NO: 4201859 - RNA, 15 nt, Yersinia pestis KIM
augcagcuaaaagau

SEQ ID NO: 4201860 - RNA, 16 nt, Yersinia pestis KIM
augcagggaagcuggc

SEQ ID NO: 4201861 - RNA, 18 nt, Yersinia pestis KIM
augcagggaagcuggccu

SEQ ID NO: 4201862 - RNA, 14 nt, Yersinia pestis KIM
augcaguaaauagu

SEQ ID NO: 4201863 - RNA, 20 nt, Yersinia pestis KIM
augcauacccgucguacuuu

SEQ ID NO: 4201864 - RNA, 12 nt, Yersinia pestis KIM
augcauauguag

SEQ ID NO: 4201865 - RNA, 21 nt, Yersinia pestis KIM
augcauauuugcagaaaguaa

SEQ ID NO: 4201866 - RNA, 12 nt, Yersinia pestis KIM
augcauccaagc

SEQ ID NO: 4201867 - RNA, 19 nt, Yersinia pestis KIM
augcauccaagccaucauu

SEQ ID NO: 4201868 - RNA, 19 nt, Yersinia pestis KIM
augcauguuauuggcuaaa

SEQ ID NO: 4201869 - RNA, 23 nt, Yersinia pestis KIM
augcauuccccuguauuaaccag

SEQ ID NO: 4201870 - RNA, 14 nt, Yersinia pestis KIM
augccaagaauaau

SEQ ID NO: 4201871 - RNA, 15 nt, Yersinia pestis KIM
augccaagaauaauu

SEQ ID NO: 4201872 - RNA, 12 nt, Yersinia pestis KIM
augccacacuca

SEQ ID NO: 4201873 - RNA, 21 nt, Yersinia pestis KIM
augccacacucagacaaucau

SEQ ID NO: 4201874 - RNA, 13 nt, Yersinia pestis KIM
augccacccccag

SEQ ID NO: 4201875 - RNA, 16 nt, Yersinia pestis KIM
augccacuucgcuacg

SEQ ID NO: 4201876 - RNA, 14 nt, Yersinia pestis KIM
augccagcccauca

SEQ ID NO: 4201877 - RNA, 21 nt, Yersinia pestis KIM
augccagcgcaaaaggcaucc

SEQ ID NO: 4201878 - RNA, 15 nt, Yersinia pestis KIM
augccaguuauuauu

SEQ ID NO: 4201879 - RNA, 23 nt, Yersinia pestis KIM
augccauaacaucguuaauccau

SEQ ID NO: 4201880 - RNA, 16 nt, Yersinia pestis KIM
augccauauuacucuc

SEQ ID NO: 4201881 - RNA, 14 nt, Yersinia pestis KIM
augccaucaagcac

SEQ ID NO: 4201882 - RNA, 19 nt, Yersinia pestis KIM
augccaucccccuuuggcc

SEQ ID NO: 4201883 - RNA, 20 nt, Yersinia pestis KIM
augccauggcgaaaauccuu

SEQ ID NO: 4201884 - RNA, 16 nt, Yersinia pestis KIM
augcccagcguuggca

SEQ ID NO: 4201885 - RNA, 16 nt, Yersinia pestis KIM
augcccugagauuauu

SEQ ID NO: 4201886 - RNA, 22 nt, Yersinia pestis KIM
augccgccugacugcccgccug

SEQ ID NO: 4201887 - RNA, 17 nt, Yersinia pestis KIM
augccgcuaacaaccgu

SEQ ID NO: 4201888 - RNA, 15 nt, Yersinia pestis KIM
augccgcuccagcac

SEQ ID NO: 4201889 - RNA, 17 nt, Yersinia pestis KIM
augccgcugaucaggaa

SEQ ID NO: 4201890 - RNA, 17 nt, Yersinia pestis KIM
augccggaaucagccag

SEQ ID NO: 4201891 - RNA, 17 nt, Yersinia pestis KIM
augccggucaauugagu

SEQ ID NO: 4201892 - RNA, 23 nt, Yersinia pestis KIM
augccggucaauugagucucugg

SEQ ID NO: 4201893 - RNA, 15 nt, Yersinia pestis KIM
augccggugagcacg

SEQ ID NO: 4201894 - RNA, 20 nt, Yersinia pestis KIM
augccuaauaauuuauacau

SEQ ID NO: 4201895 - RNA, 21 nt, Yersinia pestis KIM
augccuauuugcagaaaguaa

SEQ ID NO: 4201896 - RNA, 20 nt, Yersinia pestis KIM
augccuguuauaaggcuaac

SEQ ID NO: 4201897 - RNA, 17 nt, Yersinia pestis KIM
augccuuggcaaagaga

SEQ ID NO: 4201898 - RNA, 21 nt, Yersinia pestis KIM
augccuuggcauguucagggu

SEQ ID NO: 4201899 - RNA, 16 nt, Yersinia pestis KIM
augccuuguuucuggc

SEQ ID NO: 4201900 - RNA, 16 nt, Yersinia pestis KIM
augcgaaaaaagaugg

SEQ ID NO: 4201901 - RNA, 13 nt, Yersinia pestis KIM
augcgagcaguga

SEQ ID NO: 4201902 - RNA, 16 nt, Yersinia pestis KIM
augcgauuaaccucgg

SEQ ID NO: 4201903 - RNA, 13 nt, Yersinia pestis KIM
augcgauuuuuga

SEQ ID NO: 4201904 - RNA, 18 nt, Yersinia pestis KIM
augcgcagaaaaccacuu

SEQ ID NO: 4201905 - RNA, 15 nt, Yersinia pestis KIM
augcgcggguaacaa

SEQ ID NO: 4201906 - RNA, 19 nt, Yersinia pestis KIM
augcggcauaacugaauac

SEQ ID NO: 4201907 - RNA, 21 nt, Yersinia pestis KIM
augcggcauaacugaauacuu

SEQ ID NO: 4201908 - RNA, 22 nt, Yersinia pestis KIM
augcggguuuuuuuacauauaa

SEQ ID NO: 4201909 - RNA, 17 nt, Yersinia pestis KIM
augcgguucuguaucau

SEQ ID NO: 4201910 - RNA, 15 nt, Yersinia pestis KIM
augcguagagucagu

SEQ ID NO: 4201911 - RNA, 16 nt, Yersinia pestis KIM
augcgucuuuagauuu

SEQ ID NO: 4201912 - RNA, 19 nt, Yersinia pestis KIM
augcgucuuuagauuucac

SEQ ID NO: 4201913 - RNA, 19 nt, Yersinia pestis KIM
augcguugaugcucuucuu

SEQ ID NO: 4201914 - RNA, 15 nt, Yersinia pestis KIM
augcguuguaauaac

SEQ ID NO: 4201915 - RNA, 18 nt, Yersinia pestis KIM
augcuacggauugcaaau

SEQ ID NO: 4201916 - RNA, 12 nt, Yersinia pestis KIM
augcuauauuug

SEQ ID NO: 4201917 - RNA, 22 nt, Yersinia pestis KIM
augcucuacgccccaugcaccu

SEQ ID NO: 4201918 - RNA, 21 nt, Yersinia pestis KIM
augcucuucaccaaaggaagc

SEQ ID NO: 4201919 - RNA, 17 nt, Yersinia pestis KIM
augcucuucuucacuga

SEQ ID NO: 4201920 - RNA, 18 nt, Yersinia pestis KIM
augcucuuuuuaugcagg

SEQ ID NO: 4201921 - RNA, 22 nt, Yersinia pestis KIM
augcugaaucuguaagucauuc

SEQ ID NO: 4201922 - RNA, 23 nt, Yersinia pestis KIM
augcugaaugaauuguuguaauu

SEQ ID NO: 4201923 - RNA, 18 nt, Yersinia pestis KIM
augcugaccccaaauuug

SEQ ID NO: 4201924 - RNA, 17 nt, Yersinia pestis KIM
augcugaggauaggccg

SEQ ID NO: 4201925 - RNA, 15 nt, Yersinia pestis KIM
augcugauuaaugag

SEQ ID NO: 4201926 - RNA, 21 nt, Yersinia pestis KIM
augcugcacaucaacggacag

SEQ ID NO: 4201927 - RNA, 22 nt, Yersinia pestis KIM
augcugcaguucgacuaucuca

SEQ ID NO: 4201928 - RNA, 14 nt, Yersinia pestis KIM
augcugcccgcaca

SEQ ID NO: 4201929 - RNA, 16 nt, Yersinia pestis KIM
augcugcccgcacacu

SEQ ID NO: 4201930 - RNA, 18 nt, Yersinia pestis KIM
augcugcccgcacacuga

SEQ ID NO: 4201931 - RNA, 22 nt, Yersinia pestis KIM
augcuggcuuuuuuguuuuuau

SEQ ID NO: 4201932 - RNA, 17 nt, Yersinia pestis KIM
augcuggguauauauac

SEQ ID NO: 4201933 - RNA, 15 nt, Yersinia pestis KIM
augcuguagcagccu

SEQ ID NO: 4201934 - RNA, 21 nt, Yersinia pestis KIM
augcuguagcagccuguaggc

SEQ ID NO: 4201935 - RNA, 12 nt, Yersinia pestis KIM
auguauccaucu

SEQ ID NO: 4201936 - RNA, 15 nt, Yersinia pestis KIM
auguauuuauucaaa

SEQ ID NO: 4201937 - RNA, 13 nt, Yersinia pestis KIM
augucaccuccac

SEQ ID NO: 4201938 - RNA, 15 nt, Yersinia pestis KIM
augucacguuaaguu

SEQ ID NO: 4201939 - RNA, 17 nt, Yersinia pestis KIM
augucagccguuuacga

SEQ ID NO: 4201940 - RNA, 21 nt, Yersinia pestis KIM
augucaguggcgguucgcuga

SEQ ID NO: 4201941 - RNA, 20 nt, Yersinia pestis KIM
augucaucuuccgucaguug

SEQ ID NO: 4201942 - RNA, 21 nt, Yersinia pestis KIM
augucaugauaaaacuauucu

SEQ ID NO: 4201943 - RNA, 16 nt, Yersinia pestis KIM
augucaugguuaaacu

SEQ ID NO: 4201944 - RNA, 14 nt, Yersinia pestis KIM
auguccaguuauca

SEQ ID NO: 4201945 - RNA, 17 nt, Yersinia pestis KIM
auguccaguuaucaucg

SEQ ID NO: 4201946 - RNA, 16 nt, Yersinia pestis KIM
auguccucaccauuua

SEQ ID NO: 4201947 - RNA, 17 nt, Yersinia pestis KIM
auguccucaccauuuau

SEQ ID NO: 4201948 - RNA, 21 nt, Yersinia pestis KIM
auguccucaccauuuauugcc

SEQ ID NO: 4201949 - RNA, 22 nt, Yersinia pestis KIM
auguccucaccauuuauugcca

SEQ ID NO: 4201950 - RNA, 23 nt, Yersinia pestis KIM
auguccucaccauuuauugccac

SEQ ID NO: 4201951 - RNA, 22 nt, Yersinia pestis KIM
augucgaaagauagcaaaagaa

SEQ ID NO: 4201952 - RNA, 18 nt, Yersinia pestis KIM
augucgauugggccacau

SEQ ID NO: 4201953 - RNA, 21 nt, Yersinia pestis KIM
augucgcgacucaagccucua

SEQ ID NO: 4201954 - RNA, 20 nt, Yersinia pestis KIM
augucuaaugacagacgcgg

SEQ ID NO: 4201955 - RNA, 13 nt, Yersinia pestis KIM
augugaaaagcag

SEQ ID NO: 4201956 - RNA, 18 nt, Yersinia pestis KIM
augugaaaagcagucgac

SEQ ID NO: 4201957 - RNA, 14 nt, Yersinia pestis KIM
augugacugauuaa

SEQ ID NO: 4201958 - RNA, 14 nt, Yersinia pestis KIM
augugauguggcuu

SEQ ID NO: 4201959 - RNA, 23 nt, Yersinia pestis KIM
augugauguggcuugcaaucaga

SEQ ID NO: 4201960 - RNA, 17 nt, Yersinia pestis KIM
augugcaaucuaaaggc

SEQ ID NO: 4201961 - RNA, 12 nt, Yersinia pestis KIM
augugcccuugu

SEQ ID NO: 4201962 - RNA, 16 nt, Yersinia pestis KIM
auguggcauguucagc

SEQ ID NO: 4201963 - RNA, 22 nt, Yersinia pestis KIM
augugguguuggcgauaaagcg

SEQ ID NO: 4201964 - RNA, 22 nt, Yersinia pestis KIM
auguguaguaugcgauuuuuga

SEQ ID NO: 4201965 - RNA, 18 nt, Yersinia pestis KIM
auguguuuguaccgauuu

SEQ ID NO: 4201966 - RNA, 18 nt, Yersinia pestis KIM
auguuaaaucagugaagg

SEQ ID NO: 4201967 - RNA, 18 nt, Yersinia pestis KIM
auguuaugaggggaggcu

SEQ ID NO: 4201968 - RNA, 16 nt, Yersinia pestis KIM
auguuauuugaauaaa

SEQ ID NO: 4201969 - RNA, 17 nt, Yersinia pestis KIM
auguucaacaaguguca

SEQ ID NO: 4201970 - RNA, 23 nt, Yersinia pestis KIM
auguuccggacuucauaaauauu

SEQ ID NO: 4201971 - RNA, 21 nt, Yersinia pestis KIM
auguuccugaauggcaucacc

SEQ ID NO: 4201972 - RNA, 14 nt, Yersinia pestis KIM
auguucgaacaugc

SEQ ID NO: 4201973 - RNA, 19 nt, Yersinia pestis KIM
auguucgcacugcucugcc

SEQ ID NO: 4201974 - RNA, 22 nt, Yersinia pestis KIM
auguucgcucccccggaucacu

SEQ ID NO: 4201975 - RNA, 13 nt, Yersinia pestis KIM
auguucuuuaggu

SEQ ID NO: 4201976 - RNA, 17 nt, Yersinia pestis KIM
auguugaaucaauugcu

SEQ ID NO: 4201977 - RNA, 22 nt, Yersinia pestis KIM
auguugcaucgcacugauagcc

SEQ ID NO: 4201978 - RNA, 18 nt, Yersinia pestis KIM
auguugcgggaauagcuc

SEQ ID NO: 4201979 - RNA, 23 nt, Yersinia pestis KIM
auguugggguagccaauguuggg

SEQ ID NO: 4201980 - RNA, 23 nt, Yersinia pestis KIM
auguuuacuuuaccgcuuaaggc

SEQ ID NO: 4201981 - RNA, 17 nt, Yersinia pestis KIM
auguuuauauugauaaa

SEQ ID NO: 4201982 - RNA, 16 nt, Yersinia pestis KIM
auguuuauccgcuauu

SEQ ID NO: 4201983 - RNA, 18 nt, Yersinia pestis KIM
auguuugaugguuaugug

SEQ ID NO: 4201984 - RNA, 17 nt, Yersinia pestis KIM
auguuugugugucuuua

SEQ ID NO: 4201985 - RNA, 22 nt, Yersinia pestis KIM
auguuuuacgaucaacccccug

SEQ ID NO: 4201986 - RNA, 20 nt, Yersinia pestis KIM
auuaaaaaauaauuuuaugg

SEQ ID NO: 4201987 - RNA, 12 nt, Yersinia pestis KIM
auuaaaaacaaa

SEQ ID NO: 4201988 - RNA, 12 nt, Yersinia pestis KIM
auuaaaaauaca

SEQ ID NO: 4201989 - RNA, 21 nt, Yersinia pestis KIM
auuaaaaaucugcaauaucau

SEQ ID NO: 4201990 - RNA, 13 nt, Yersinia pestis KIM
auuaaaaauuaau

SEQ ID NO: 4201991 - RNA, 11 nt, Yersinia pestis KIM
auuaaaaugau

SEQ ID NO: 4201992 - RNA, 16 nt, Yersinia pestis KIM
auuaaacagucuuauu

SEQ ID NO: 4201993 - RNA, 22 nt, Yersinia pestis KIM
auuaaacagucuuauuacucau

SEQ ID NO: 4201994 - RNA, 23 nt, Yersinia pestis KIM
auuaaacagucuuauuacucauu

SEQ ID NO: 4201995 - RNA, 22 nt, Yersinia pestis KIM
auuaaacgccugggauccauag

SEQ ID NO: 4201996 - RNA, 16 nt, Yersinia pestis KIM
auuaaacgcucaucaa

SEQ ID NO: 4201997 - RNA, 17 nt, Yersinia pestis KIM
auuaaacgcucaucaac

SEQ ID NO: 4201998 - RNA, 19 nt, Yersinia pestis KIM
auuaaacgucucuuuuuca

SEQ ID NO: 4201999 - RNA, 20 nt, Yersinia pestis KIM
auuaaacgucucuuuuucau

SEQ ID NO: 4202000 - RNA, 14 nt, Yersinia pestis KIM
auuaaacuugcucu

SEQ ID NO: 4202001 - RNA, 16 nt, Yersinia pestis KIM
auuaaaggccgcaaua

SEQ ID NO: 4202002 - RNA, 12 nt, Yersinia pestis KIM
auuaaauaagaa

SEQ ID NO: 4202003 - RNA, 14 nt, Yersinia pestis KIM
auuaaaugguuuau

SEQ ID NO: 4202004 - RNA, 19 nt, Yersinia pestis KIM
auuaaaugguuuauuuaag

SEQ ID NO: 4202005 - RNA, 21 nt, Yersinia pestis KIM
auuaaauucuaccuggcucaa

SEQ ID NO: 4202006 - RNA, 16 nt, Yersinia pestis KIM
auuaaauuuuauauua

SEQ ID NO: 4202007 - RNA, 14 nt, Yersinia pestis KIM
auuaaauuuuauga

SEQ ID NO: 4202008 - RNA, 12 nt, Yersinia pestis KIM
auuaacaagcga

SEQ ID NO: 4202009 - RNA, 19 nt, Yersinia pestis KIM
auuaacacaguaaaaaaac

SEQ ID NO: 4202010 - RNA, 13 nt, Yersinia pestis KIM
auuaacauccauu

SEQ ID NO: 4202011 - RNA, 18 nt, Yersinia pestis KIM
auuaaccgcuccaggcug

SEQ ID NO: 4202012 - RNA, 23 nt, Yersinia pestis KIM
auuaaccgcuccaggcuggccac

SEQ ID NO: 4202013 - RNA, 17 nt, Yersinia pestis KIM
auuaaccuuaucaccaa

SEQ ID NO: 4202014 - RNA, 19 nt, Yersinia pestis KIM
auuaacgacauuucguuua

SEQ ID NO: 4202015 - RNA, 22 nt, Yersinia pestis KIM
auuaacgcucuacaacguccag

SEQ ID NO: 4202016 - RNA, 20 nt, Yersinia pestis KIM
auuaacggucacuggcguuu

SEQ ID NO: 4202017 - RNA, 18 nt, Yersinia pestis KIM
auuaacuauuugaugcua

SEQ ID NO: 4202018 - RNA, 22 nt, Yersinia pestis KIM
auuaacucuucuguugcccccu

SEQ ID NO: 4202019 - RNA, 18 nt, Yersinia pestis KIM
auuaacuguuaaaacagg

SEQ ID NO: 4202020 - RNA, 18 nt, Yersinia pestis KIM
auuaacuucuauuuuucg

SEQ ID NO: 4202021 - RNA, 23 nt, Yersinia pestis KIM
auuaacuuuucuucauugcugcu

SEQ ID NO: 4202022 - RNA, 14 nt, Yersinia pestis KIM
auuaagaaaccagc

SEQ ID NO: 4202023 - RNA, 17 nt, Yersinia pestis KIM
auuaagacccucucaca

SEQ ID NO: 4202024 - RNA, 17 nt, Yersinia pestis KIM
auuaagauuaagccaug

SEQ ID NO: 4202025 - RNA, 20 nt, Yersinia pestis KIM
auuaagccaugggucauuaa

SEQ ID NO: 4202026 - RNA, 22 nt, Yersinia pestis KIM
auuaagccaugggucauuaauu

SEQ ID NO: 4202027 - RNA, 16 nt, Yersinia pestis KIM
auuaagccguaacuga

SEQ ID NO: 4202028 - RNA, 15 nt, Yersinia pestis KIM
auuaagcggcguauu

SEQ ID NO: 4202029 - RNA, 16 nt, Yersinia pestis KIM
auuaaggaaacucaug

SEQ ID NO: 4202030 - RNA, 22 nt, Yersinia pestis KIM
auuaaggcgauauuauuaguag

SEQ ID NO: 4202031 - RNA, 23 nt, Yersinia pestis KIM
auuaaggguuaaccagaagaaca

SEQ ID NO: 4202032 - RNA, 15 nt, Yersinia pestis KIM
auuaaggugguuuug

SEQ ID NO: 4202033 - RNA, 22 nt, Yersinia pestis KIM
auuaaggugguuuuggccggga

SEQ ID NO: 4202034 - RNA, 15 nt, Yersinia pestis KIM
auuaauaaaaccuuu

SEQ ID NO: 4202035 - RNA, 16 nt, Yersinia pestis KIM
auuaauaaauuauaau

SEQ ID NO: 4202036 - RNA, 15 nt, Yersinia pestis KIM
auuaauacaucauca

SEQ ID NO: 4202037 - RNA, 16 nt, Yersinia pestis KIM
auuaauacaucaucaa

SEQ ID NO: 4202038 - RNA, 17 nt, Yersinia pestis KIM
auuaauacaucaucaaa

SEQ ID NO: 4202039 - RNA, 20 nt, Yersinia pestis KIM
auuaaucaccucaccagcau

SEQ ID NO: 4202040 - RNA, 15 nt, Yersinia pestis KIM
auuaaucagcauuaa

SEQ ID NO: 4202041 - RNA, 18 nt, Yersinia pestis KIM
auuaaucuauuaauaucg

SEQ ID NO: 4202042 - RNA, 22 nt, Yersinia pestis KIM
auuaaucuauuaauaucgaggu

SEQ ID NO: 4202043 - RNA, 14 nt, Yersinia pestis KIM
auuaaugcaccuac

SEQ ID NO: 4202044 - RNA, 23 nt, Yersinia pestis KIM
auuaauggauaaugcugaugcaa

SEQ ID NO: 4202045 - RNA, 15 nt, Yersinia pestis KIM
auuaauggucaaggu

SEQ ID NO: 4202046 - RNA, 13 nt, Yersinia pestis KIM
auuaauuaacacc

SEQ ID NO: 4202047 - RNA, 11 nt, Yersinia pestis KIM
auuaauuacuu

SEQ ID NO: 4202048 - RNA, 21 nt, Yersinia pestis KIM
auuaauuaguuuuaauaacca

SEQ ID NO: 4202049 - RNA, 13 nt, Yersinia pestis KIM
auucaauugaucu

SEQ ID NO: 4202050 - RNA, 15 nt, Yersinia pestis KIM
auucaauugaucuaa

SEQ ID NO: 4202051 - RNA, 19 nt, Yersinia pestis KIM
auucaauugugcaaaauca

SEQ ID NO: 4202052 - RNA, 21 nt, Yersinia pestis KIM
auucaauugugcaaaaucagc

SEQ ID NO: 4202053 - RNA, 12 nt, Yersinia pestis KIM
auucacaacagu

SEQ ID NO: 4202054 - RNA, 20 nt, Yersinia pestis KIM
auucacaacagugcaacauu

SEQ ID NO: 4202055 - RNA, 14 nt, Yersinia pestis KIM
auucacagcagaac

SEQ ID NO: 4202056 - RNA, 13 nt, Yersinia pestis KIM
auucacaggcgag

SEQ ID NO: 4202057 - RNA, 13 nt, Yersinia pestis KIM
auucaccaccauu

SEQ ID NO: 4202058 - RNA, 17 nt, Yersinia pestis KIM
auucaccaccauuaaca

SEQ ID NO: 4202059 - RNA, 23 nt, Yersinia pestis KIM
auucaccagauggcgaucaaggu

SEQ ID NO: 4202060 - RNA, 15 nt, Yersinia pestis KIM
auucaccagcaauaa

SEQ ID NO: 4202061 - RNA, 20 nt, Yersinia pestis KIM
auucaccaucugccugcaaa

SEQ ID NO: 4202062 - RNA, 16 nt, Yersinia pestis KIM
auucacgcaaggccag

SEQ ID NO: 4202063 - RNA, 18 nt, Yersinia pestis KIM
auucacguaugguuuuua

SEQ ID NO: 4202064 - RNA, 19 nt, Yersinia pestis KIM
auucacguccucuuauuaa

SEQ ID NO: 4202065 - RNA, 14 nt, Yersinia pestis KIM
auucacguuuuucc

SEQ ID NO: 4202066 - RNA, 13 nt, Yersinia pestis KIM
auucacugcuaac

SEQ ID NO: 4202067 - RNA, 19 nt, Yersinia pestis KIM
auucagacccgauuucaac

SEQ ID NO: 4202068 - RNA, 16 nt, Yersinia pestis KIM
auucagacgacgugca

SEQ ID NO: 4202069 - RNA, 16 nt, Yersinia pestis KIM
auucagaggaaagaga

SEQ ID NO: 4202070 - RNA, 17 nt, Yersinia pestis KIM
auucagaggaaagagag

SEQ ID NO: 4202071 - RNA, 21 nt, Yersinia pestis KIM
auucagaugagaaucucucca

SEQ ID NO: 4202072 - RNA, 18 nt, Yersinia pestis KIM
auucagcaacucgguuuu

SEQ ID NO: 4202073 - RNA, 23 nt, Yersinia pestis KIM
auucagcaucaaauuauuuuucc

SEQ ID NO: 4202074 - RNA, 13 nt, Yersinia pestis KIM
auucagccacuca

SEQ ID NO: 4202075 - RNA, 22 nt, Yersinia pestis KIM
auucagcccggauagaauugaa

SEQ ID NO: 4202076 - RNA, 15 nt, Yersinia pestis KIM
auucagcucugccag

SEQ ID NO: 4202077 - RNA, 19 nt, Yersinia pestis KIM
auucaggccuugauggcua

SEQ ID NO: 4202078 - RNA, 16 nt, Yersinia pestis KIM
auucagguugagcauc

SEQ ID NO: 4202079 - RNA, 14 nt, Yersinia pestis KIM
auucaguaaaaacu

SEQ ID NO: 4202080 - RNA, 13 nt, Yersinia pestis KIM
auucauaaaaaaa

SEQ ID NO: 4202081 - RNA, 16 nt, Yersinia pestis KIM
auucauaccgcagaua

SEQ ID NO: 4202082 - RNA, 19 nt, Yersinia pestis KIM
auucauaccgcagauaaaa

SEQ ID NO: 4202083 - RNA, 21 nt, Yersinia pestis KIM
auucauacggcgauauuuauu

SEQ ID NO: 4202084 - RNA, 14 nt, Yersinia pestis KIM
auucauaguuaaga

SEQ ID NO: 4202085 - RNA, 16 nt, Yersinia pestis KIM
auucauaguuaagaca

SEQ ID NO: 4202086 - RNA, 17 nt, Yersinia pestis KIM
auucauaucgcuaaaac

SEQ ID NO: 4202087 - RNA, 18 nt, Yersinia pestis KIM
auucauaugacaaauaag

SEQ ID NO: 4202088 - RNA, 20 nt, Yersinia pestis KIM
auucauauugaauuaaauuu

SEQ ID NO: 4202089 - RNA, 16 nt, Yersinia pestis KIM
auucauauuucacugu

SEQ ID NO: 4202090 - RNA, 18 nt, Yersinia pestis KIM
auucauauuucacuguua

SEQ ID NO: 4202091 - RNA, 13 nt, Yersinia pestis KIM
auucaucagcaau

SEQ ID NO: 4202092 - RNA, 15 nt, Yersinia pestis KIM
auucaucccuaaaau

SEQ ID NO: 4202093 - RNA, 18 nt, Yersinia pestis KIM
auucaucccuaaaaucau

SEQ ID NO: 4202094 - RNA, 18 nt, Yersinia pestis KIM
auucaucggcgucaaggu

SEQ ID NO: 4202095 - RNA, 15 nt, Yersinia pestis KIM
auucaucuuuaacaa

SEQ ID NO: 4202096 - RNA, 19 nt, Yersinia pestis KIM
auucaucuuuaacaacaac

SEQ ID NO: 4202097 - RNA, 13 nt, Yersinia pestis KIM
auucaugaggcuu

SEQ ID NO: 4202098 - RNA, 17 nt, Yersinia pestis KIM
auucaugugagauaaca

SEQ ID NO: 4202099 - RNA, 20 nt, Yersinia pestis KIM
auucaugugagauaacacau

SEQ ID NO: 4202100 - RNA, 21 nt, Yersinia pestis KIM
auucauuagccagccaauggc

SEQ ID NO: 4202101 - RNA, 17 nt, Yersinia pestis KIM
auucauuauuacucagc

SEQ ID NO: 4202102 - RNA, 13 nt, Yersinia pestis KIM
auucauugagcaa

SEQ ID NO: 4202103 - RNA, 13 nt, Yersinia pestis KIM
auucauuuuaaaa

SEQ ID NO: 4202104 - RNA, 14 nt, Yersinia pestis KIM
auucauuuuaaaaa

SEQ ID NO: 4202105 - RNA, 15 nt, Yersinia pestis KIM
auucauuuuaaaaaa

SEQ ID NO: 4202106 - RNA, 16 nt, Yersinia pestis KIM
auucauuuuaaaaaaa

SEQ ID NO: 4202107 - RNA, 17 nt, Yersinia pestis KIM
auucauuuuaaaaaaau

SEQ ID NO: 4202108 - RNA, 20 nt, Yersinia pestis KIM
auucauuuuaaaaaaauuaa

SEQ ID NO: 4202109 - RNA, 15 nt, Yersinia pestis KIM
auucauuuugcugga

SEQ ID NO: 4202110 - RNA, 21 nt, Yersinia pestis KIM
auucauuuugcuggaaaagua

SEQ ID NO: 4202111 - RNA, 13 nt, Yersinia pestis KIM
auuccaaugaucu

SEQ ID NO: 4202112 - RNA, 20 nt, Yersinia pestis KIM
auuccaguagggaaucacgc

SEQ ID NO: 4202113 - RNA, 19 nt, Yersinia pestis KIM
auuccaucagcgcacugca

SEQ ID NO: 4202114 - RNA, 21 nt, Yersinia pestis KIM
auucccaccauaaugugccuc

SEQ ID NO: 4202115 - RNA, 19 nt, Yersinia pestis KIM
ucgcuguagcgccagguaa

SEQ ID NO: 4202116 - RNA, 21 nt, Yersinia pestis KIM
ucgcuguaggauuucauaccg

SEQ ID NO: 4202117 - RNA, 19 nt, Yersinia pestis KIM
ucgcugugaauuuaucagg

SEQ ID NO: 4202118 - RNA, 21 nt, Yersinia pestis KIM
ucgcugugaauuuaucaggcu

SEQ ID NO: 4202119 - RNA, 23 nt, Yersinia pestis KIM
ucgcuucugcgaggccgcugcaa

SEQ ID NO: 4202120 - RNA, 16 nt, Yersinia pestis KIM
ucggacgcuccucacu

SEQ ID NO: 4202121 - RNA, 14 nt, Yersinia pestis KIM
ucggauaaccgcau

SEQ ID NO: 4202122 - RNA, 19 nt, Yersinia pestis KIM
ucggauaaccgcauucccu

SEQ ID NO: 4202123 - RNA, 17 nt, Yersinia pestis KIM
ucggauaguuaucuggg

SEQ ID NO: 4202124 - RNA, 21 nt, Yersinia pestis KIM
ucggaucagcgccugcuguua

SEQ ID NO: 4202125 - RNA, 18 nt, Yersinia pestis KIM
ucggaugccgcuccagca

SEQ ID NO: 4202126 - RNA, 19 nt, Yersinia pestis KIM
ucggaugccgcuccagcac

SEQ ID NO: 4202127 - RNA, 16 nt, Yersinia pestis KIM
ucggauggucauccac

SEQ ID NO: 4202128 - RNA, 16 nt, Yersinia pestis KIM
ucggcaauauaaagcc

SEQ ID NO: 4202129 - RNA, 11 nt, Yersinia pestis KIM
ucggcaggcaa

SEQ ID NO: 4202130 - RNA, 14 nt, Yersinia pestis KIM
ucggccaacaucuu

SEQ ID NO: 4202131 - RNA, 14 nt, Yersinia pestis KIM
ucggccaauucagc

SEQ ID NO: 4202132 - RNA, 22 nt, Yersinia pestis KIM
ucggccaguguuuucuccacac

SEQ ID NO: 4202133 - RNA, 22 nt, Yersinia pestis KIM
ucggcccaacuugcuggcagga

SEQ ID NO: 4202134 - RNA, 14 nt, Yersinia pestis KIM
ucggcccagauauc

SEQ ID NO: 4202135 - RNA, 22 nt, Yersinia pestis KIM
ucggcccgcaaccugacugcug

SEQ ID NO: 4202136 - RNA, 15 nt, Yersinia pestis KIM
ucggccuccccugcg

SEQ ID NO: 4202137 - RNA, 18 nt, Yersinia pestis KIM
ucggccuccccugcgggu

SEQ ID NO: 4202138 - RNA, 17 nt, Yersinia pestis KIM
ucggccuguucucgccg

SEQ ID NO: 4202139 - RNA, 22 nt, Yersinia pestis KIM
ucggcgaaaucacguacacggc

SEQ ID NO: 4202140 - RNA, 19 nt, Yersinia pestis KIM
ucggcgauugaacaugaug

SEQ ID NO: 4202141 - RNA, 14 nt, Yersinia pestis KIM
ucggcgcgcuugcc

SEQ ID NO: 4202142 - RNA, 22 nt, Yersinia pestis KIM
ucggcggucugagucagucagg

SEQ ID NO: 4202143 - RNA, 13 nt, Yersinia pestis KIM
ucggcuuuaccuu

SEQ ID NO: 4202144 - RNA, 12 nt, Yersinia pestis KIM
ucgggccacuga

SEQ ID NO: 4202145 - RNA, 16 nt, Yersinia pestis KIM
ucgggcuaucaucaaa

SEQ ID NO: 4202146 - RNA, 23 nt, Yersinia pestis KIM
ucgggcuaucuuauuuaccuguu

SEQ ID NO: 4202147 - RNA, 22 nt, Yersinia pestis KIM
ucgggcugaguaaagcccagca

SEQ ID NO: 4202148 - RNA, 17 nt, Yersinia pestis KIM
ucgggggcucguuggcc

SEQ ID NO: 4202149 - RNA, 16 nt, Yersinia pestis KIM
ucggggguugucagca

SEQ ID NO: 4202150 - RNA, 16 nt, Yersinia pestis KIM
ucgggguuugucagca

SEQ ID NO: 4202151 - RNA, 19 nt, Yersinia pestis KIM
ucgggguuugucagcaguc

SEQ ID NO: 4202152 - RNA, 19 nt, Yersinia pestis KIM
ucggguucuaaauccugca

SEQ ID NO: 4202153 - RNA, 17 nt, Yersinia pestis KIM
ucggguuuaauucaggc

SEQ ID NO: 4202154 - RNA, 14 nt, Yersinia pestis KIM
ucgguaaccugaaa

SEQ ID NO: 4202155 - RNA, 13 nt, Yersinia pestis KIM
uggcgaucaaaau

SEQ ID NO: 4202156 - RNA, 15 nt, Yersinia pestis KIM
uggcgaucaaaggcg

SEQ ID NO: 4202157 - RNA, 14 nt, Yersinia pestis KIM
uggcgcacauuaca

SEQ ID NO: 4202158 - RNA, 23 nt, Yersinia pestis KIM
uggcgcauccccacuuguaccug

SEQ ID NO: 4202159 - RNA, 22 nt, Yersinia pestis KIM
uggcgcgguucuaguauucagg

SEQ ID NO: 4202160 - RNA, 17 nt, Yersinia pestis KIM
uggcgcuacuuccccua

SEQ ID NO: 4202161 - RNA, 16 nt, Yersinia pestis KIM
uggcgcugaucaucau

SEQ ID NO: 4202162 - RNA, 18 nt, Yersinia pestis KIM
uggcggcagcacagagca

SEQ ID NO: 4202163 - RNA, 21 nt, Yersinia pestis KIM
uggcggcuugccugacagccu

SEQ ID NO: 4202164 - RNA, 16 nt, Yersinia pestis KIM
uggcggucgcacugug

SEQ ID NO: 4202165 - RNA, 15 nt, Yersinia pestis KIM
uggcguuaaucaagc

SEQ ID NO: 4202166 - RNA, 21 nt, Yersinia pestis KIM
uggcguuacagcaaggcagca

SEQ ID NO: 4202167 - RNA, 20 nt, Yersinia pestis KIM
uggcguucaccgguaugcag

SEQ ID NO: 4202168 - RNA, 20 nt, Yersinia pestis KIM
uggcguugacagacaacggg

SEQ ID NO: 4202169 - RNA, 22 nt, Yersinia pestis KIM
uggcguugacagacaacgggcg

SEQ ID NO: 4202170 - RNA, 24 nt, Yersinia pestis KIM
uggcguuucugaagaugccaauca

SEQ ID NO: 4202171 - RNA, 20 nt, Yersinia pestis KIM
uggcuaagauccagucgguc

SEQ ID NO: 4202172 - RNA, 16 nt, Yersinia pestis KIM
uggcuaagcaugccgc

SEQ ID NO: 4202173 - RNA, 22 nt, Yersinia pestis KIM
uggcuaagccgcaauaaauggc

SEQ ID NO: 4202174 - RNA, 16 nt, Yersinia pestis KIM
uggcuaagguaucucg

SEQ ID NO: 4202175 - RNA, 16 nt, Yersinia pestis KIM
uggcuaauuaauuuaa

SEQ ID NO: 4202176 - RNA, 19 nt, Yersinia pestis KIM
uggcuaauuaggcuucuaa

SEQ ID NO: 4202177 - RNA, 15 nt, Yersinia pestis KIM
uggcuaauuuuauua

SEQ ID NO: 4202178 - RNA, 20 nt, Yersinia pestis KIM
uggcuaccccaacauugguu

SEQ ID NO: 4202179 - RNA, 21 nt, Yersinia pestis KIM
uggcuauaagccuaggcuaau

SEQ ID NO: 4202180 - RNA, 21 nt, Yersinia pestis KIM
uggcuaucaauuguuugcuau

SEQ ID NO: 4202181 - RNA, 14 nt, Yersinia pestis KIM
uggcuaucugaaac

SEQ ID NO: 4202182 - RNA, 16 nt, Yersinia pestis KIM
uggcucacugcauacu

SEQ ID NO: 4202183 - RNA, 15 nt, Yersinia pestis KIM
uggcucagcaagaac

SEQ ID NO: 4202184 - RNA, 19 nt, Yersinia pestis KIM
uggcucucucgaaguccuu

SEQ ID NO: 4202185 - RNA, 14 nt, Yersinia pestis KIM
uggcucucuuuuuu

SEQ ID NO: 4202186 - RNA, 22 nt, Yersinia pestis KIM
uggcucuggccagcgucuucag

SEQ ID NO: 4202187 - RNA, 21 nt, Yersinia pestis KIM
uggcugaauaucaucuuuuuc

SEQ ID NO: 4202188 - RNA, 16 nt, Yersinia pestis KIM
uggcugagauuuagau

SEQ ID NO: 4202189 - RNA, 19 nt, Yersinia pestis KIM
uggcugaggccagcggcau

SEQ ID NO: 4202190 - RNA, 18 nt, Yersinia pestis KIM
uggcugcacucauugccu

SEQ ID NO: 4202191 - RNA, 17 nt, Yersinia pestis KIM
uggcuggcaaaguuauu

SEQ ID NO: 4202192 - RNA, 19 nt, Yersinia pestis KIM
uggcuggggcgaugcgagu

SEQ ID NO: 4202193 - RNA, 22 nt, Yersinia pestis KIM
uggcuguuauauaaaugguuau

SEQ ID NO: 4202194 - RNA, 18 nt, Yersinia pestis KIM
uggcuuaaucgccagcaa

SEQ ID NO: 4202195 - RNA, 17 nt, Yersinia pestis KIM
uggcuuagucauuaaga

SEQ ID NO: 4202196 - RNA, 13 nt, Yersinia pestis KIM
uggcuucugcuuc

SEQ ID NO: 4202197 - RNA, 23 nt, Yersinia pestis KIM
uggcuuuacggcucaccuggccu

SEQ ID NO: 4202198 - RNA, 13 nt, Yersinia pestis KIM
uggcuuucgcuuu

SEQ ID NO: 4202199 - RNA, 16 nt, Yersinia pestis KIM
uggcuuucucaacagc

SEQ ID NO: 4202200 - RNA, 20 nt, Yersinia pestis KIM
uggcuuuugccucacugucu

SEQ ID NO: 4202201 - RNA, 14 nt, Yersinia pestis KIM
uggcuuuuucacac

SEQ ID NO: 4202202 - RNA, 13 nt, Yersinia pestis KIM
uggcuuuuuuaau

SEQ ID NO: 4202203 - RNA, 14 nt, Yersinia pestis KIM
uggcuuuuuuaaua

SEQ ID NO: 4202204 - RNA, 23 nt, Yersinia pestis KIM
uggcuuuuuuaauaaaaaacuga

SEQ ID NO: 4202205 - RNA, 23 nt, Yersinia pestis KIM
uggcuuuuuuguuuuuauaucaa

SEQ ID NO: 4202206 - RNA, 21 nt, Yersinia pestis KIM
ugggaaaaguggcuaucugaa

SEQ ID NO: 4202207 - RNA, 22 nt, Yersinia pestis KIM
ugggaaaaguggcuaucugaaa

SEQ ID NO: 4202208 - RNA, 12 nt, Yersinia pestis KIM
ugggaacaacag

SEQ ID NO: 4202209 - RNA, 23 nt, Yersinia pestis KIM
ugggaaccccucugcagcgucaa

SEQ ID NO: 4202210 - RNA, 20 nt, Yersinia pestis KIM
ugggaauuaagaagccucau

SEQ ID NO: 4202211 - RNA, 22 nt, Yersinia pestis KIM
ugggaauuaagaagccucauga

SEQ ID NO: 4202212 - RNA, 16 nt, Yersinia pestis KIM
ugggacuuuaucugcc

SEQ ID NO: 4202213 - RNA, 23 nt, Yersinia pestis KIM
ugggaucccuucggcaugcaacu

SEQ ID NO: 4202214 - RNA, 18 nt, Yersinia pestis KIM
ugggauguucagcucaag

SEQ ID NO: 4202215 - RNA, 19 nt, Yersinia pestis KIM
ugggauuaauaaugguggg

SEQ ID NO: 4202216 - RNA, 17 nt, Yersinia pestis KIM
ugggauucguuaguaua

SEQ ID NO: 4202217 - RNA, 22 nt, Yersinia pestis KIM
ugggcaaagaauugagguaaac

SEQ ID NO: 4202218 - RNA, 16 nt, Yersinia pestis KIM
ugggcaagcucugggc

SEQ ID NO: 4202219 - RNA, 13 nt, Yersinia pestis KIM
ugggcagggcagc

SEQ ID NO: 4202220 - RNA, 19 nt, Yersinia pestis KIM
ugggcaucaacgcccagcu

SEQ ID NO: 4202221 - RNA, 19 nt, Yersinia pestis KIM
ugggcauuggauaauuugc

SEQ ID NO: 4202222 - RNA, 21 nt, Yersinia pestis KIM
ugggccacgaugugaagcaau

SEQ ID NO: 4202223 - RNA, 17 nt, Yersinia pestis KIM
ugggccgacucugcaug

SEQ ID NO: 4202224 - RNA, 17 nt, Yersinia pestis KIM
ugggccgaugccaggca

SEQ ID NO: 4202225 - RNA, 14 nt, Yersinia pestis KIM
ugggccugaguggg

SEQ ID NO: 4202226 - RNA, 14 nt, Yersinia pestis KIM
ugggccugccaugu

SEQ ID NO: 4202227 - RNA, 14 nt, Yersinia pestis KIM
ugggcgauaguaau

SEQ ID NO: 4202228 - RNA, 13 nt, Yersinia pestis KIM
ugggcgauagucg

SEQ ID NO: 4202229 - RNA, 14 nt, Yersinia pestis KIM
ugggcgcagaagaa

SEQ ID NO: 4202230 - RNA, 21 nt, Yersinia pestis KIM
ugggcgcauaaaaugagccug

SEQ ID NO: 4202231 - RNA, 21 nt, Yersinia pestis KIM
ugggcgggaucuccagaagca

SEQ ID NO: 4202232 - RNA, 17 nt, Yersinia pestis KIM
ugggcgggcaccaugcc

SEQ ID NO: 4202233 - RNA, 20 nt, Yersinia pestis KIM
ugggcgguaguauuuguagu

SEQ ID NO: 4202234 - RNA, 20 nt, Yersinia pestis KIM
ugggcuaaaacucaaauaga

SEQ ID NO: 4202235 - RNA, 14 nt, Yersinia pestis KIM
ugggcugccugugc

SEQ ID NO: 4202236 - RNA, 20 nt, Yersinia pestis KIM
ugggcuucacauccaauggc

SEQ ID NO: 4202237 - RNA, 20 nt, Yersinia pestis KIM
uggggcugccaguaaaauca

SEQ ID NO: 4202238 - RNA, 21 nt, Yersinia pestis KIM
uggggucaucaacgcacucag

SEQ ID NO: 4202239 - RNA, 22 nt, Yersinia pestis KIM
uggggugucacaaaguagguua

SEQ ID NO: 4202240 - RNA, 15 nt, Yersinia pestis KIM
uggguaaaccaauca

SEQ ID NO: 4202241 - RNA, 23 nt, Yersinia pestis KIM
uggguaacauguagcacacuacc

SEQ ID NO: 4202242 - RNA, 19 nt, Yersinia pestis KIM
uggguaauccccaccaaca

SEQ ID NO: 4202243 - RNA, 15 nt, Yersinia pestis KIM
uggguagacauggca

SEQ ID NO: 4202244 - RNA, 14 nt, Yersinia pestis KIM
uggguaucguggua

SEQ ID NO: 4202245 - RNA, 15 nt, Yersinia pestis KIM
uggguaucuggagcc

SEQ ID NO: 4202246 - RNA, 17 nt, Yersinia pestis KIM
uggguauggucagcaau

SEQ ID NO: 4202247 - RNA, 16 nt, Yersinia pestis KIM
ugggucaguuuuauua

SEQ ID NO: 4202248 - RNA, 19 nt, Yersinia pestis KIM
ugggucauguggaacggca

SEQ ID NO: 4202249 - RNA, 19 nt, Yersinia pestis KIM
ugggucguugauauuccua

SEQ ID NO: 4202250 - RNA, 22 nt, Yersinia pestis KIM
ugggugccucaacgcaccccac

SEQ ID NO: 4202251 - RNA, 17 nt, Yersinia pestis KIM
uggguuaaaaacuuuua

SEQ ID NO: 4202252 - RNA, 13 nt, Yersinia pestis KIM
uggguuaaugcug

SEQ ID NO: 4202253 - RNA, 17 nt, Yersinia pestis KIM
uggguuacauccugaau

SEQ ID NO: 4202254 - RNA, 22 nt, Yersinia pestis KIM
uggguuaucccuaccaaauguu

SEQ ID NO: 4202255 - RNA, 13 nt, Yersinia pestis KIM
uggguucuucaaa

SEQ ID NO: 4202256 - RNA, 19 nt, Yersinia pestis KIM
uggguuucgacauccaaca

SEQ ID NO: 4202257 - RNA, 20 nt, Yersinia pestis KIM
ugguaaauuccuauaaauuu

SEQ ID NO: 4202258 - RNA, 12 nt, Yersinia pestis KIM
ugguaacccgca

SEQ ID NO: 4202259 - RNA, 20 nt, Yersinia pestis KIM
ugguaacccgcaagcaaacu

SEQ ID NO: 4202260 - RNA, 23 nt, Yersinia pestis KIM
ugguaacccgcaagcaaacugau

SEQ ID NO: 4202261 - RNA, 20 nt, Yersinia pestis KIM
ugguaaccgguuugggcagg

SEQ ID NO: 4202262 - RNA, 15 nt, Yersinia pestis KIM
ugguaagguuucaaa

SEQ ID NO: 4202263 - RNA, 21 nt, Yersinia pestis KIM
ugguaaucgucccacaugaac

SEQ ID NO: 4202264 - RNA, 13 nt, Yersinia pestis KIM
ugguaauuucagg

SEQ ID NO: 4202265 - RNA, 17 nt, Yersinia pestis KIM
ugguaccggcaccaaga

SEQ ID NO: 4202266 - RNA, 18 nt, Yersinia pestis KIM
ugguaccugcaucaucac

SEQ ID NO: 4202267 - RNA, 21 nt, Yersinia pestis KIM
ugguaccuuucagguaagcag

SEQ ID NO: 4202268 - RNA, 19 nt, Yersinia pestis KIM
ugguacugugucuuuaggg

SEQ ID NO: 4202269 - RNA, 14 nt, Yersinia pestis KIM
ugguagcaccacau

SEQ ID NO: 4202270 - RNA, 17 nt, Yersinia pestis KIM
ugguauagacuguuuua

SEQ ID NO: 4202271 - RNA, 12 nt, Yersinia pestis KIM
ugguaugccacu

SEQ ID NO: 4202272 - RNA, 19 nt, Yersinia pestis KIM
uggucaaggugauuucaaa

SEQ ID NO: 4202273 - RNA, 14 nt, Yersinia pestis KIM
uggucaauaaaauu

SEQ ID NO: 4202274 - RNA, 17 nt, Yersinia pestis KIM
uggucaauaaaauuaac

SEQ ID NO: 4202275 - RNA, 14 nt, Yersinia pestis KIM
uggucaaucaaguu

SEQ ID NO: 4202276 - RNA, 20 nt, Yersinia pestis KIM
uggucacccuuuugaauuca

SEQ ID NO: 4202277 - RNA, 22 nt, Yersinia pestis KIM
uggucaccgccaaaugaaaacc

SEQ ID NO: 4202278 - RNA, 22 nt, Yersinia pestis KIM
uggucacuguaguaaagcagca

SEQ ID NO: 4202279 - RNA, 24 nt, Yersinia pestis KIM
uggucacuguaguaaagcagcauc

SEQ ID NO: 4202280 - RNA, 14 nt, Yersinia pestis KIM
uggucagcaauaac

SEQ ID NO: 4202281 - RNA, 21 nt, Yersinia pestis KIM
uggucagcaauaaccaacggg

SEQ ID NO: 4202282 - RNA, 16 nt, Yersinia pestis KIM
uggucagcacaaacag

SEQ ID NO: 4202283 - RNA, 17 nt, Yersinia pestis KIM
uggucagcacaaacagc

SEQ ID NO: 4202284 - RNA, 18 nt, Yersinia pestis KIM
uggucaguugaauauucc

SEQ ID NO: 4202285 - RNA, 14 nt, Yersinia pestis KIM
uggucaguuuaaug

SEQ ID NO: 4202286 - RNA, 13 nt, Yersinia pestis KIM
uggucauccacaa

SEQ ID NO: 4202287 - RNA, 14 nt, Yersinia pestis KIM
uggucaugcacagu

SEQ ID NO: 4202288 - RNA, 20 nt, Yersinia pestis KIM
uggucauuaauuucaccaca

SEQ ID NO: 4202289 - RNA, 22 nt, Yersinia pestis KIM
uggucauuaauuucaccacauc

SEQ ID NO: 4202290 - RNA, 16 nt, Yersinia pestis KIM
uggucauuuuucccuu

SEQ ID NO: 4202291 - RNA, 19 nt, Yersinia pestis KIM
ugguccacagucaguucau

SEQ ID NO: 4202292 - RNA, 19 nt, Yersinia pestis KIM
uggucccgacaaauacugc

SEQ ID NO: 4202293 - RNA, 23 nt, Yersinia pestis KIM
uggucgcuuuuuacugaccgcua

SEQ ID NO: 4202294 - RNA, 17 nt, Yersinia pestis KIM
uggucguauccuuacuu

SEQ ID NO: 4202295 - RNA, 17 nt, Yersinia pestis KIM
uggucuuggucauaccg

SEQ ID NO: 4202296 - RNA, 13 nt, Yersinia pestis KIM
uggugaaaaauga

SEQ ID NO: 4202297 - RNA, 16 nt, Yersinia pestis KIM
uggugaaccagauaac

SEQ ID NO: 4202298 - RNA, 17 nt, Yersinia pestis KIM
uggugaauacagguacu

SEQ ID NO: 4202299 - RNA, 21 nt, Yersinia pestis KIM
uggugacuacggcuacagcgu

SEQ ID NO: 4202300 - RNA, 18 nt, Yersinia pestis KIM
uggugagcgccaugcgcu

SEQ ID NO: 4202301 - RNA, 17 nt, Yersinia pestis KIM
uggugaguaaaugcccc

SEQ ID NO: 4202302 - RNA, 21 nt, Yersinia pestis KIM
uggugguaccugcaucaucac

SEQ ID NO: 4202303 - RNA, 19 nt, Yersinia pestis KIM
uggugguugcagugucagu

SEQ ID NO: 4202304 - RNA, 20 nt, Yersinia pestis KIM
uggugucacaaucucuggca

SEQ ID NO: 4202305 - RNA, 12 nt, Yersinia pestis KIM
uggugucuuuac

SEQ ID NO: 4202306 - RNA, 23 nt, Yersinia pestis KIM
ugguuaaaucaccgacaccaacc

SEQ ID NO: 4202307 - RNA, 15 nt, Yersinia pestis KIM
ugguuaaucuacccg

SEQ ID NO: 4202308 - RNA, 17 nt, Yersinia pestis KIM
ugguuaaucuacccgaa

SEQ ID NO: 4202309 - RNA, 15 nt, Yersinia pestis KIM
ugguuaccaucaacc

SEQ ID NO: 4202310 - RNA, 17 nt, Yersinia pestis KIM
ugguuaucacagcaaau

SEQ ID NO: 4202311 - RNA, 19 nt, Yersinia pestis KIM
ugguucaccacuuuccagg

SEQ ID NO: 4202312 - RNA, 16 nt, Yersinia pestis KIM
ugguucgagacaacgu

SEQ ID NO: 4202313 - RNA, 22 nt, Yersinia pestis KIM
ugguugcacgugaggauucaag

SEQ ID NO: 4202314 - RNA, 16 nt, Yersinia pestis KIM
ugguugccagauaaug

SEQ ID NO: 4202315 - RNA, 22 nt, Yersinia pestis KIM
ugguugcccggcaaacuuaauu

SEQ ID NO: 4202316 - RNA, 15 nt, Yersinia pestis KIM
ugguuggcaccacgg

SEQ ID NO: 4202317 - RNA, 15 nt, Yersinia pestis KIM
ugguuggcagcucag

SEQ ID NO: 4202318 - RNA, 17 nt, Yersinia pestis KIM
ugguuggcagcucagca

SEQ ID NO: 4202319 - RNA, 13 nt, Yersinia pestis KIM
ugguugucuaugu

SEQ ID NO: 4202320 - RNA, 23 nt, Yersinia pestis KIM
ugguuguuuuuucccagaacaua

SEQ ID NO: 4202321 - RNA, 16 nt, Yersinia pestis KIM
ugguuuauccccuucg

SEQ ID NO: 4202322 - RNA, 21 nt, Yersinia pestis KIM
ugguuugacauacucuuccaa

SEQ ID NO: 4202323 - RNA, 17 nt, Yersinia pestis KIM
ugguuugauagcaaaac

SEQ ID NO: 4202324 - RNA, 15 nt, Yersinia pestis KIM
ugguuugcucuuccc

SEQ ID NO: 4202325 - RNA, 18 nt, Yersinia pestis KIM
ugguuuggugguuuggug

SEQ ID NO: 4202326 - RNA, 14 nt, Yersinia pestis KIM
ugguuuuaauaacc

SEQ ID NO: 4202327 - RNA, 14 nt, Yersinia pestis KIM
ugguuuuaccauca

SEQ ID NO: 4202328 - RNA, 17 nt, Yersinia pestis KIM
ugguuuuaucaauaggu

SEQ ID NO: 4202329 - RNA, 17 nt, Yersinia pestis KIM
ugguuuucuauuuccac

SEQ ID NO: 4202330 - RNA, 14 nt, Yersinia pestis KIM
ugguuuuuacaccc

SEQ ID NO: 4202331 - RNA, 12 nt, Yersinia pestis KIM
ugguuuuuuaaa

SEQ ID NO: 4202332 - RNA, 13 nt, Yersinia pestis KIM
ugguuuuuuaaaa

SEQ ID NO: 4202333 - RNA, 11 nt, Yersinia pestis KIM
uguaaaacaag

SEQ ID NO: 4202334 - RNA, 20 nt, Yersinia pestis KIM
uguaaaacgaguaaauacaa

SEQ ID NO: 4202335 - RNA, 21 nt, Yersinia pestis KIM
uguaaaauaccaauuaauaag

SEQ ID NO: 4202336 - RNA, 22 nt, Yersinia pestis KIM
uguaaaggcaaagaagaauaag

SEQ ID NO: 4202337 - RNA, 22 nt, Yersinia pestis KIM
uguaaauaguuacuauauaaau

SEQ ID NO: 4202338 - RNA, 23 nt, Yersinia pestis KIM
uguaaauaguuacuauauaaaug

SEQ ID NO: 4202339 - RNA, 13 nt, Yersinia pestis KIM
uguaaauauaaaa

SEQ ID NO: 4202340 - RNA, 16 nt, Yersinia pestis KIM
uguaaauauaaaauaa

SEQ ID NO: 4202341 - RNA, 13 nt, Yersinia pestis KIM
uguaaauuaauac

SEQ ID NO: 4202342 - RNA, 20 nt, Yersinia pestis KIM
uguaacaauccgaacaaaau

SEQ ID NO: 4202343 - RNA, 20 nt, Yersinia pestis KIM
uguaacacacagcagacagc

SEQ ID NO: 4202344 - RNA, 15 nt, Yersinia pestis KIM
uguaacacauauuuc

SEQ ID NO: 4202345 - RNA, 22 nt, Yersinia pestis KIM
uguaacagagcagaaagcagca

SEQ ID NO: 4202346 - RNA, 22 nt, Yersinia pestis KIM
uguaacgaugaauuaucaaccg

SEQ ID NO: 4202347 - RNA, 14 nt, Yersinia pestis KIM
uguaagauaauucg

SEQ ID NO: 4202348 - RNA, 18 nt, Yersinia pestis KIM
uguaagcguaauucagca

SEQ ID NO: 4202349 - RNA, 16 nt, Yersinia pestis KIM
uguaagcgugcaaccc

SEQ ID NO: 4202350 - RNA, 20 nt, Yersinia pestis KIM
uguaagcugggaaggcguaa

SEQ ID NO: 4202351 - RNA, 17 nt, Yersinia pestis KIM
uguaagucauucuuggu

SEQ ID NO: 4202352 - RNA, 14 nt, Yersinia pestis KIM
uguaauccggcaaa

SEQ ID NO: 4202353 - RNA, 16 nt, Yersinia pestis KIM
uguaaugccacacuca

SEQ ID NO: 4202354 - RNA, 18 nt, Yersinia pestis KIM
uguaaugccacacucaga

SEQ ID NO: 4202355 - RNA, 20 nt, Yersinia pestis KIM
uguaaugccacacucagaca

SEQ ID NO: 4202356 - RNA, 13 nt, Yersinia pestis KIM
uguacaacaagau

SEQ ID NO: 4202357 - RNA, 16 nt, Yersinia pestis KIM
uguacauaaauuugug

SEQ ID NO: 4202358 - RNA, 21 nt, Yersinia pestis KIM
uguacauccaauuuuuucauc

SEQ ID NO: 4202359 - RNA, 12 nt, Yersinia pestis KIM
uguacauuauuc

SEQ ID NO: 4202360 - RNA, 17 nt, Yersinia pestis KIM
uguacauuucguagccu

SEQ ID NO: 4202361 - RNA, 21 nt, Yersinia pestis KIM
uguaccgguucauuuagcagc

SEQ ID NO: 4202362 - RNA, 21 nt, Yersinia pestis KIM
uguaccuaucguuuguaccug

SEQ ID NO: 4202363 - RNA, 14 nt, Yersinia pestis KIM
uguacguauggcau

SEQ ID NO: 4202364 - RNA, 16 nt, Yersinia pestis KIM
uguacguauggcauga

SEQ ID NO: 4202365 - RNA, 16 nt, Yersinia pestis KIM
uguacuaccaaaacgu

SEQ ID NO: 4202366 - RNA, 17 nt, Yersinia pestis KIM
uguacugcugcaacuca

SEQ ID NO: 4202367 - RNA, 14 nt, Yersinia pestis KIM
uguagaccucuuua

SEQ ID NO: 4202368 - RNA, 17 nt, Yersinia pestis KIM
uguagacgucauaaaaa

SEQ ID NO: 4202369 - RNA, 21 nt, Yersinia pestis KIM
uguagccacggcgcaacauua

SEQ ID NO: 4202370 - RNA, 14 nt, Yersinia pestis KIM
uguagcuuuuuaaa

SEQ ID NO: 4202371 - RNA, 19 nt, Yersinia pestis KIM
uguagcuuuuuaaauacca

SEQ ID NO: 4202372 - RNA, 12 nt, Yersinia pestis KIM
uguaggcaccac

SEQ ID NO: 4202373 - RNA, 17 nt, Yersinia pestis KIM
uguaguaacucaaguau

SEQ ID NO: 4202374 - RNA, 13 nt, Yersinia pestis KIM
uguaguacagcac

SEQ ID NO: 4202375 - RNA, 20 nt, Yersinia pestis KIM
uguaguacagcacucaguac

SEQ ID NO: 4202376 - RNA, 22 nt, Yersinia pestis KIM
uguagugacguaaaaaggcagu

SEQ ID NO: 4202377 - RNA, 22 nt, Yersinia pestis KIM
uguaguucagucgcgauaaaau

SEQ ID NO: 4202378 - RNA, 11 nt, Yersinia pestis KIM
uguauaaaaau

SEQ ID NO: 4202379 - RNA, 21 nt, Yersinia pestis KIM
uguauaaccccccugcugaua

SEQ ID NO: 4202380 - RNA, 19 nt, Yersinia pestis KIM
uguauacaauugccugauu

SEQ ID NO: 4202381 - RNA, 18 nt, Yersinia pestis KIM
uguauagucuccaaauuc

SEQ ID NO: 4202382 - RNA, 13 nt, Yersinia pestis KIM
uguauauaaaaaa

SEQ ID NO: 4202383 - RNA, 18 nt, Yersinia pestis KIM
uguauaucacuauuucag

SEQ ID NO: 4202384 - RNA, 13 nt, Yersinia pestis KIM
uguauccaaggca

SEQ ID NO: 4202385 - RNA, 20 nt, Yersinia pestis KIM
uguauccguagacauuaucc

SEQ ID NO: 4202386 - RNA, 23 nt, Yersinia pestis KIM
uguaugccgcucaaggagaauuu

SEQ ID NO: 4202387 - RNA, 16 nt, Yersinia pestis KIM
uguaugggcugcuaca

SEQ ID NO: 4202388 - RNA, 18 nt, Yersinia pestis KIM
uguaugguauagacuguu

SEQ ID NO: 4202389 - RNA, 22 nt, Yersinia pestis KIM
uguauguggcuguauucacgua

SEQ ID NO: 4202390 - RNA, 19 nt, Yersinia pestis KIM
uguauucgcaucuuccaaa

SEQ ID NO: 4202391 - RNA, 16 nt, Yersinia pestis KIM
uguauucuuguauccu

SEQ ID NO: 4202392 - RNA, 12 nt, Yersinia pestis KIM
uguauugcucca

SEQ ID NO: 4202393 - RNA, 23 nt, Yersinia pestis KIM
uguauuguugcucaacauauugc

SEQ ID NO: 4202394 - RNA, 13 nt, Yersinia pestis KIM
uguauuuaaaaga

SEQ ID NO: 4202395 - RNA, 16 nt, Yersinia pestis KIM
uguauuuaaauaguca

SEQ ID NO: 4202396 - RNA, 19 nt, Yersinia pestis KIM
uguauuuaaccgcccucuu

SEQ ID NO: 4202397 - RNA, 19 nt, Yersinia pestis KIM
uguauuuggguuaaauagu

SEQ ID NO: 4202398 - RNA, 21 nt, Yersinia pestis KIM
uguauuugguuauaucccaau

SEQ ID NO: 4202399 - RNA, 14 nt, Yersinia pestis KIM
ugucaauaaacuga

SEQ ID NO: 4202400 - RNA, 20 nt, Yersinia pestis KIM
ugucaauaaccucuaaucuc

SEQ ID NO: 4202401 - RNA, 18 nt, Yersinia pestis KIM
ugucaaucgaugagcugg

SEQ ID NO: 4202402 - RNA, 16 nt, Yersinia pestis KIM
ugucacaaucucuggc

SEQ ID NO: 4202403 - RNA, 14 nt, Yersinia pestis KIM
ugucacaaugcugu

SEQ ID NO: 4202404 - RNA, 22 nt, Yersinia pestis KIM
ugucaccacggcuuucaauaaa

SEQ ID NO: 4202405 - RNA, 13 nt, Yersinia pestis KIM
ugucaccugagua

SEQ ID NO: 4202406 - RNA, 17 nt, Yersinia pestis KIM
ugucacugccaucucau

SEQ ID NO: 4202407 - RNA, 17 nt, Yersinia pestis KIM
ugucacuugcccugagu

SEQ ID NO: 4202408 - RNA, 14 nt, Yersinia pestis KIM
ugucagcagucuga

SEQ ID NO: 4202409 - RNA, 16 nt, Yersinia pestis KIM
ugucagcagucugaaa

SEQ ID NO: 4202410 - RNA, 21 nt, Yersinia pestis KIM
ugucagcagucugaagccuac

SEQ ID NO: 4202411 - RNA, 20 nt, Yersinia pestis KIM
ugucagcagucugaagggua

SEQ ID NO: 4202412 - RNA, 13 nt, Yersinia pestis KIM
ugucagccagcga

SEQ ID NO: 4202413 - RNA, 13 nt, Yersinia pestis KIM
ugucagccaugcc

SEQ ID NO: 4202414 - RNA, 20 nt, Yersinia pestis KIM
ugucaggaaaugcagacucu

SEQ ID NO: 4202415 - RNA, 15 nt, Yersinia pestis KIM
ugucagggcaauaac

SEQ ID NO: 4202416 - RNA, 21 nt, Yersinia pestis KIM
ugucaguaucagcgauuuuaa

SEQ ID NO: 4202417 - RNA, 15 nt, Yersinia pestis KIM
ugucaguaugaaauu

SEQ ID NO: 4202418 - RNA, 12 nt, Yersinia pestis KIM
ugucagucaaaa

SEQ ID NO: 4202419 - RNA, 19 nt, Yersinia pestis KIM
ugucagucaaaagaaacug

SEQ ID NO: 4202420 - RNA, 17 nt, Yersinia pestis KIM
ugucaucgcuaaauacu

SEQ ID NO: 4202421 - RNA, 22 nt, Yersinia pestis KIM
ugucaugaguguuggccucaga

SEQ ID NO: 4202422 - RNA, 22 nt, Yersinia pestis KIM
ugucaugcgauuuaugcaugaa

SEQ ID NO: 4202423 - RNA, 15 nt, Yersinia pestis KIM
ugucauggugcuacc

SEQ ID NO: 4202424 - RNA, 19 nt, Yersinia pestis KIM
ugucauguugaccaaacag

SEQ ID NO: 4202425 - RNA, 14 nt, Yersinia pestis KIM
ugucauuaauuggu

SEQ ID NO: 4202426 - RNA, 13 nt, Yersinia pestis KIM
ugucauucuauca

SEQ ID NO: 4202427 - RNA, 13 nt, Yersinia pestis KIM
ugucauuuggauu

SEQ ID NO: 4202428 - RNA, 14 nt, Yersinia pestis KIM
uguccaaaggaagg

SEQ ID NO: 4202429 - RNA, 12 nt, Yersinia pestis KIM
uguccaagaagc

SEQ ID NO: 4202430 - RNA, 14 nt, Yersinia pestis KIM
uguccacauagcug

SEQ ID NO: 4202431 - RNA, 18 nt, Yersinia pestis KIM
uguccacugaccagcggu

SEQ ID NO: 4202432 - RNA, 20 nt, Yersinia pestis KIM
uguccagccaguugaucggc

SEQ ID NO: 4202433 - RNA, 21 nt, Yersinia pestis KIM
uguccagggcaaucaggaaag

SEQ ID NO: 4202434 - RNA, 15 nt, Yersinia pestis KIM
uguccguguuggcaa

SEQ ID NO: 4202435 - RNA, 17 nt, Yersinia pestis KIM
uguccucaagauuaucc

SEQ ID NO: 4202436 - RNA, 15 nt, Yersinia pestis KIM
uguccugcaauccuc

SEQ ID NO: 4202437 - RNA, 18 nt, Yersinia pestis KIM
ugucgcccugaauuucaa

SEQ ID NO: 4202438 - RNA, 14 nt, Yersinia pestis KIM
ugucgcuauuuccg

SEQ ID NO: 4202439 - RNA, 17 nt, Yersinia pestis KIM
ugucgcuguagcgccag

SEQ ID NO: 4202440 - RNA, 17 nt, Yersinia pestis KIM
ugucggcagguaaugca

SEQ ID NO: 4202441 - RNA, 18 nt, Yersinia pestis KIM
ugucggguuaacuuuuuc

SEQ ID NO: 4202442 - RNA, 16 nt, Yersinia pestis KIM
ugucguuuacuggcug

SEQ ID NO: 4202443 - RNA, 18 nt, Yersinia pestis KIM
ugucguuuacuggcugcc

SEQ ID NO: 4202444 - RNA, 18 nt, Yersinia pestis KIM
ugucguuucugcuuaacu

SEQ ID NO: 4202445 - RNA, 18 nt, Yersinia pestis KIM
ugucuauguuugaugguu

SEQ ID NO: 4202446 - RNA, 13 nt, Yersinia pestis KIM
ugucuauuuucau

SEQ ID NO: 4202447 - RNA, 14 nt, Yersinia pestis KIM
ugucucuacucucu

SEQ ID NO: 4202448 - RNA, 20 nt, Yersinia pestis KIM
ugucucuacucucuguuuug

SEQ ID NO: 4202449 - RNA, 13 nt, Yersinia pestis KIM
ugucugcuguugc

SEQ ID NO: 4202450 - RNA, 15 nt, Yersinia pestis KIM
ugucugcuguugcca

SEQ ID NO: 4202451 - RNA, 17 nt, Yersinia pestis KIM
ugucugggauacgcgcg

SEQ ID NO: 4202452 - RNA, 18 nt, Yersinia pestis KIM
ugucuggguggcugaaau

SEQ ID NO: 4202453 - RNA, 17 nt, Yersinia pestis KIM
ugucuugcguucuguga

SEQ ID NO: 4202454 - RNA, 14 nt, Yersinia pestis KIM
ugucuuuaaguauu

SEQ ID NO: 4202455 - RNA, 16 nt, Yersinia pestis KIM
ugucuuuaauaaaauc

SEQ ID NO: 4202456 - RNA, 18 nt, Yersinia pestis KIM
ugucuuuaauaaaaucaa

SEQ ID NO: 4202457 - RNA, 13 nt, Yersinia pestis KIM
ugugaacagugau

SEQ ID NO: 4202458 - RNA, 24 nt, Yersinia pestis KIM
ugugaagugugcaaauaaacgcga

SEQ ID NO: 4202459 - RNA, 18 nt, Yersinia pestis KIM
ugugaaucuuuuugcuga

SEQ ID NO: 4202460 - RNA, 19 nt, Yersinia pestis KIM
ugugaauuuaucaggcuaa

SEQ ID NO: 4202461 - RNA, 16 nt, Yersinia pestis KIM
ugugacgcuugaauau

SEQ ID NO: 4202462 - RNA, 20 nt, Yersinia pestis KIM
ugugauaaccagcaguugcu

SEQ ID NO: 4202463 - RNA, 18 nt, Yersinia pestis KIM
ugugauaaccguucaaga

SEQ ID NO: 4202464 - RNA, 13 nt, Yersinia pestis KIM
ugugaucagugug

SEQ ID NO: 4202465 - RNA, 23 nt, Yersinia pestis KIM
ugugauccacacaguauucugcu

SEQ ID NO: 4202466 - RNA, 14 nt, Yersinia pestis KIM
ugugaugaaacuaa

SEQ ID NO: 4202467 - RNA, 16 nt, Yersinia pestis KIM
ugugaugaaauuaaaa

SEQ ID NO: 4202468 - RNA, 15 nt, Yersinia pestis KIM
ugugcaaaauacaaa

SEQ ID NO: 4202469 - RNA, 13 nt, Yersinia pestis KIM
ugugcaaugcaga

SEQ ID NO: 4202470 - RNA, 15 nt, Yersinia pestis KIM
ugugcaccacacagc

SEQ ID NO: 4202471 - RNA, 12 nt, Yersinia pestis KIM
ugugcagcauca

SEQ ID NO: 4202472 - RNA, 17 nt, Yersinia pestis KIM
ugugccaguagcaauaa

SEQ ID NO: 4202473 - RNA, 15 nt, Yersinia pestis KIM
ugugcccagaaaacc

SEQ ID NO: 4202474 - RNA, 21 nt, Yersinia pestis KIM
ugugcccuuuuugguuuucua

SEQ ID NO: 4202475 - RNA, 21 nt, Yersinia pestis KIM
ugugccucgucgaggaucacc

SEQ ID NO: 4202476 - RNA, 23 nt, Yersinia pestis KIM
ugugcgcggcuagccaccucacu

SEQ ID NO: 4202477 - RNA, 15 nt, Yersinia pestis KIM
ugugcguaaagaaaa

SEQ ID NO: 4202478 - RNA, 15 nt, Yersinia pestis KIM
ugugcguuggcagcu

SEQ ID NO: 4202479 - RNA, 21 nt, Yersinia pestis KIM
ugugcucacaaucuucuucag

SEQ ID NO: 4202480 - RNA, 22 nt, Yersinia pestis KIM
ugugcugcccgucaauuugacu

SEQ ID NO: 4202481 - RNA, 19 nt, Yersinia pestis KIM
ugugcugcuaauauuuaua

SEQ ID NO: 4202482 - RNA, 17 nt, Yersinia pestis KIM
ugugcuuuuuggcaaac

SEQ ID NO: 4202483 - RNA, 13 nt, Yersinia pestis KIM
uguggaggaaggc

SEQ ID NO: 4202484 - RNA, 18 nt, Yersinia pestis KIM
uguggauccagcaccaca

SEQ ID NO: 4202485 - RNA, 21 nt, Yersinia pestis KIM
uguggcaacucuagcgccagc

SEQ ID NO: 4202486 - RNA, 14 nt, Yersinia pestis KIM
uguggcagucacug

SEQ ID NO: 4202487 - RNA, 18 nt, Yersinia pestis KIM
uguggcagucacugcugc

SEQ ID NO: 4202488 - RNA, 14 nt, Yersinia pestis KIM
uguggcuaaaccca

SEQ ID NO: 4202489 - RNA, 21 nt, Yersinia pestis KIM
uguggcuaccaauuauucggg

SEQ ID NO: 4202490 - RNA, 15 nt, Yersinia pestis KIM
ugugggcacucgcaa

SEQ ID NO: 4202491 - RNA, 19 nt, Yersinia pestis KIM
uguggguucaucgaggaau

SEQ ID NO: 4202492 - RNA, 14 nt, Yersinia pestis KIM
ugugguauagguau

SEQ ID NO: 4202493 - RNA, 18 nt, Yersinia pestis KIM
ugugguuguuuuuuccca

SEQ ID NO: 4202494 - RNA, 19 nt, Yersinia pestis KIM
uguguaccaaaacgaacaa

SEQ ID NO: 4202495 - RNA, 22 nt, Yersinia pestis KIM
uguguaguugaaguucacaccg

SEQ ID NO: 4202496 - RNA, 24 nt, Yersinia pestis KIM
ugugucagaccaaauagcaagcca

SEQ ID NO: 4202497 - RNA, 20 nt, Yersinia pestis KIM
ugugucauuaccuggacgcu

SEQ ID NO: 4202498 - RNA, 16 nt, Yersinia pestis KIM
ugugucgcuauuuccg

SEQ ID NO: 4202499 - RNA, 14 nt, Yersinia pestis KIM
ugugucuuaagccu

SEQ ID NO: 4202500 - RNA, 14 nt, Yersinia pestis KIM
ugugugguauucac

SEQ ID NO: 4202501 - RNA, 14 nt, Yersinia pestis KIM
uguguguauuuaaa

SEQ ID NO: 4202502 - RNA, 16 nt, Yersinia pestis KIM
uguguuuguuuggaua

SEQ ID NO: 4202503 - RNA, 11 nt, Yersinia pestis KIM
uguuaaaacag

SEQ ID NO: 4202504 - RNA, 12 nt, Yersinia pestis KIM
uguuaaaacagg

SEQ ID NO: 4202505 - RNA, 12 nt, Yersinia pestis KIM
uguuaaaccccc

SEQ ID NO: 4202506 - RNA, 22 nt, Yersinia pestis KIM
uguuaaacccccuguaaccgca

SEQ ID NO: 4202507 - RNA, 17 nt, Yersinia pestis KIM
uguuaaauucgcuuuuc

SEQ ID NO: 4202508 - RNA, 20 nt, Yersinia pestis KIM
uguuaaauucgcuuuucgca

SEQ ID NO: 4202509 - RNA, 20 nt, Yersinia pestis KIM
uguuaacauccagaccuuca

SEQ ID NO: 4202510 - RNA, 18 nt, Yersinia pestis KIM
uguuaacgcgccggaauu

SEQ ID NO: 4202511 - RNA, 17 nt, Yersinia pestis KIM
uguuaauccuaaugaac

SEQ ID NO: 4202512 - RNA, 21 nt, Yersinia pestis KIM
uguuaauuaagauuaagccau

SEQ ID NO: 4202513 - RNA, 23 nt, Yersinia pestis KIM
uguuacagcaaggcggcaagcaa

SEQ ID NO: 4202514 - RNA, 15 nt, Yersinia pestis KIM
uguuaccccuucucc

SEQ ID NO: 4202515 - RNA, 23 nt, Yersinia pestis KIM
uguuacccggaauggagccgcua

SEQ ID NO: 4202516 - RNA, 18 nt, Yersinia pestis KIM
uguuaccuaaccaaacau

SEQ ID NO: 4202517 - RNA, 20 nt, Yersinia pestis KIM
uguuaccuaaccaaacauug

SEQ ID NO: 4202518 - RNA, 14 nt, Yersinia pestis KIM
uguuacugaccgug

SEQ ID NO: 4202519 - RNA, 15 nt, Yersinia pestis KIM
uguuacugcuuaccu

SEQ ID NO: 4202520 - RNA, 23 nt, Yersinia pestis KIM
uguuagcccgcagaugaggccca

SEQ ID NO: 4202521 - RNA, 11 nt, Yersinia pestis KIM
uguuagcucaa

SEQ ID NO: 4202522 - RNA, 14 nt, Yersinia pestis KIM
uguuagucuuauga

SEQ ID NO: 4202523 - RNA, 14 nt, Yersinia pestis KIM
uguuauauuuuacu

SEQ ID NO: 4202524 - RNA, 14 nt, Yersinia pestis KIM
uguuaucugcuauu

SEQ ID NO: 4202525 - RNA, 16 nt, Yersinia pestis KIM
uguuauggauuuuuaa

SEQ ID NO: 4202526 - RNA, 16 nt, Yersinia pestis KIM
uguuauuaaugauaac

SEQ ID NO: 4202527 - RNA, 15 nt, Yersinia pestis KIM
uguuauuacugucac

SEQ ID NO: 4202528 - RNA, 16 nt, Yersinia pestis KIM
uguuauuauuaaauuu

SEQ ID NO: 4202529 - RNA, 14 nt, Yersinia pestis KIM
uguucaaaaacgca

SEQ ID NO: 4202530 - RNA, 22 nt, Yersinia pestis KIM
uguucaaaaacgcacgaaaaca

SEQ ID NO: 4202531 - RNA, 12 nt, Yersinia pestis KIM
uguucaaucacc

SEQ ID NO: 4202532 - RNA, 20 nt, Yersinia pestis KIM
uguucacccacuugccauaa

SEQ ID NO: 4202533 - RNA, 17 nt, Yersinia pestis KIM
uguucacgaucucuauc

SEQ ID NO: 4202534 - RNA, 17 nt, Yersinia pestis KIM
uguucagcauaaauauu

SEQ ID NO: 4202535 - RNA, 14 nt, Yersinia pestis KIM
uguucauaaauuaa

SEQ ID NO: 4202536 - RNA, 15 nt, Yersinia pestis KIM
uguucauaaauuaaa

SEQ ID NO: 4202537 - RNA, 20 nt, Yersinia pestis KIM
uguucauauaguugcuuauc

SEQ ID NO: 4202538 - RNA, 22 nt, Yersinia pestis KIM
uguucauggugccugcacuuaa

SEQ ID NO: 4202539 - RNA, 17 nt, Yersinia pestis KIM
uguucauucggcgcggu

SEQ ID NO: 4202540 - RNA, 22 nt, Yersinia pestis KIM
uguuccggcgcgauguccacaa

SEQ ID NO: 4202541 - RNA, 16 nt, Yersinia pestis KIM
uguuccugauuccaaa

SEQ ID NO: 4202542 - RNA, 20 nt, Yersinia pestis KIM
uguucgagguggcgauaaag

SEQ ID NO: 4202543 - RNA, 22 nt, Yersinia pestis KIM
uguucgaucaaaacaauaaaaa

SEQ ID NO: 4202544 - RNA, 18 nt, Yersinia pestis KIM
uguucgcacugcucugcc

SEQ ID NO: 4202545 - RNA, 21 nt, Yersinia pestis KIM
uguucggggguugucagcagu

SEQ ID NO: 4202546 - RNA, 14 nt, Yersinia pestis KIM
uguucguagguuug

SEQ ID NO: 4202547 - RNA, 14 nt, Yersinia pestis KIM
uguucuacagggaa

SEQ ID NO: 4202548 - RNA, 18 nt, Yersinia pestis KIM
uguucuacagggaaaaac

SEQ ID NO: 4202549 - RNA, 23 nt, Yersinia pestis KIM
uguucucacgaauaaacacgucu

SEQ ID NO: 4202550 - RNA, 22 nt, Yersinia pestis KIM
uguucucuggguaagaacagag

SEQ ID NO: 4202551 - RNA, 22 nt, Yersinia pestis KIM
uguucugauagagacgggcguu

SEQ ID NO: 4202552 - RNA, 11 nt, Yersinia pestis KIM
uguucugcugg

SEQ ID NO: 4202553 - RNA, 20 nt, Yersinia pestis KIM
uguucugguaccguuuuauu

SEQ ID NO: 4202554 - RNA, 20 nt, Yersinia pestis KIM
uguucuuacuguuuucauua

SEQ ID NO: 4202555 - RNA, 17 nt, Yersinia pestis KIM
uguucuuauugcuaucu

SEQ ID NO: 4202556 - RNA, 19 nt, Yersinia pestis KIM
uguucuucaucuaaauauu

SEQ ID NO: 4202557 - RNA, 15 nt, Yersinia pestis KIM
uguucuuccugugcg

SEQ ID NO: 4202558 - RNA, 20 nt, Yersinia pestis KIM
uguucuucuuggcuauucag

SEQ ID NO: 4202559 - RNA, 18 nt, Yersinia pestis KIM
uguugacguucaggccug

SEQ ID NO: 4202560 - RNA, 21 nt, Yersinia pestis KIM
uguugauaaaaaucuuuuaau

SEQ ID NO: 4202561 - RNA, 17 nt, Yersinia pestis KIM
uguugauacuccauuug

SEQ ID NO: 4202562 - RNA, 16 nt, Yersinia pestis KIM
uguugaugaguaaaca

SEQ ID NO: 4202563 - RNA, 18 nt, Yersinia pestis KIM
uguugcaaacggauaaug

SEQ ID NO: 4202564 - RNA, 16 nt, Yersinia pestis KIM
uguugccacagagggg

SEQ ID NO: 4202565 - RNA, 20 nt, Yersinia pestis KIM
uguugccggcggcgcuggcg

SEQ ID NO: 4202566 - RNA, 13 nt, Yersinia pestis KIM
uguuggcaaauaa

SEQ ID NO: 4202567 - RNA, 15 nt, Yersinia pestis KIM
uguuggcaauuucac

SEQ ID NO: 4202568 - RNA, 13 nt, Yersinia pestis KIM
uguuggggcacaa

SEQ ID NO: 4202569 - RNA, 16 nt, Yersinia pestis KIM
uguuggguugugguau

SEQ ID NO: 4202570 - RNA, 17 nt, Yersinia pestis KIM
uguugguagcguuuuuu

SEQ ID NO: 4202571 - RNA, 22 nt, Yersinia pestis KIM
uguuggucaccacuugcagguu

SEQ ID NO: 4202572 - RNA, 15 nt, Yersinia pestis KIM
uguuguaagauuuca

SEQ ID NO: 4202573 - RNA, 19 nt, Yersinia pestis KIM
uguuguagcgccagguaag

SEQ ID NO: 4202574 - RNA, 13 nt, Yersinia pestis KIM
uguugucaccugg

SEQ ID NO: 4202575 - RNA, 19 nt, Yersinia pestis KIM
uguuguuauuacugucacu

SEQ ID NO: 4202576 - RNA, 22 nt, Yersinia pestis KIM
uguuguuggcuaaugcgagugc

SEQ ID NO: 4202577 - RNA, 19 nt, Yersinia pestis KIM
uguuuaaaaaggcguuauc

SEQ ID NO: 4202578 - RNA, 22 nt, Yersinia pestis KIM
uguuuaacuuucgucaauuuuu

SEQ ID NO: 4202579 - RNA, 22 nt, Yersinia pestis KIM
uguuuaaucaccgcuguggaau

SEQ ID NO: 4202580 - RNA, 14 nt, Yersinia pestis KIM
uguuuaguaauuuc

SEQ ID NO: 4202581 - RNA, 20 nt, Yersinia pestis KIM
uguuuaguaauuuccuuggc

SEQ ID NO: 4202582 - RNA, 16 nt, Yersinia pestis KIM
uguuuauaaauuaaaa

SEQ ID NO: 4202583 - RNA, 13 nt, Yersinia pestis KIM
uguuucaaauaag

SEQ ID NO: 4202584 - RNA, 17 nt, Yersinia pestis KIM
uguuucaauacuauucc

SEQ ID NO: 4202585 - RNA, 16 nt, Yersinia pestis KIM
uguuucaguucuucac

SEQ ID NO: 4202586 - RNA, 18 nt, Yersinia pestis KIM
uguuuccccuaauucucc

SEQ ID NO: 4202587 - RNA, 18 nt, Yersinia pestis KIM
uguuucgacgguuuuuug

SEQ ID NO: 4202588 - RNA, 18 nt, Yersinia pestis KIM
uguuucuauccgaaaaau

SEQ ID NO: 4202589 - RNA, 21 nt, Yersinia pestis KIM
uguuugaugguuauguguauu

SEQ ID NO: 4202590 - RNA, 15 nt, Yersinia pestis KIM
uguuugcaacauuau

SEQ ID NO: 4202591 - RNA, 21 nt, Yersinia pestis KIM
uguuugcccgguacaggcaaa

SEQ ID NO: 4202592 - RNA, 16 nt, Yersinia pestis KIM
uguuuggauaaaaaca

SEQ ID NO: 4202593 - RNA, 22 nt, Yersinia pestis KIM
uguuugguacggaaaauagggg

SEQ ID NO: 4202594 - RNA, 17 nt, Yersinia pestis KIM
uguuuguaaauuuuaaa

SEQ ID NO: 4202595 - RNA, 16 nt, Yersinia pestis KIM
uguuuuaaaugccaac

SEQ ID NO: 4202596 - RNA, 14 nt, Yersinia pestis KIM
uguuuuauuauaua

SEQ ID NO: 4202597 - RNA, 22 nt, Yersinia pestis KIM
uguuuuauuauauauuuugaau

SEQ ID NO: 4202598 - RNA, 13 nt, Yersinia pestis KIM
uguuuuccaacuc

SEQ ID NO: 4202599 - RNA, 21 nt, Yersinia pestis KIM
uguuuucuuguauauaaaaaa

SEQ ID NO: 4202600 - RNA, 15 nt, Yersinia pestis KIM
uguuuuguaaaugcu

SEQ ID NO: 4202601 - RNA, 15 nt, Yersinia pestis KIM
uguuuuuuagcauca

SEQ ID NO: 4202602 - RNA, 13 nt, Yersinia pestis KIM
uguuuuuuugaua

SEQ ID NO: 4202603 - RNA, 20 nt, Yersinia pestis KIM
uguuuuuuugauauucucac

SEQ ID NO: 4202604 - RNA, 17 nt, Yersinia pestis KIM
uuaaaaaaauuaaaaua

SEQ ID NO: 4202605 - RNA, 13 nt, Yersinia pestis KIM
uuaaaaaauuaug

SEQ ID NO: 4202606 - RNA, 19 nt, Yersinia pestis KIM
uuaaaaacugugccugaau

SEQ ID NO: 4202607 - RNA, 23 nt, Yersinia pestis KIM
uuaaaaagaaaaagacauaaaga

SEQ ID NO: 4202608 - RNA, 15 nt, Yersinia pestis KIM
uuaaaaagccugaau

SEQ ID NO: 4202609 - RNA, 15 nt, Yersinia pestis KIM
uuaaaaauacaacca

SEQ ID NO: 4202610 - RNA, 18 nt, Yersinia pestis KIM
uuaaaaauacaaccaaca

SEQ ID NO: 4202611 - RNA, 14 nt, Yersinia pestis KIM
uuaaaaaucaaaag

SEQ ID NO: 4202612 - RNA, 13 nt, Yersinia pestis KIM
uuaaaaaucugca

SEQ ID NO: 4202613 - RNA, 15 nt, Yersinia pestis KIM
uuaaaacagauaaaa

SEQ ID NO: 4202614 - RNA, 16 nt, Yersinia pestis KIM
uuaaaacagauaaaaa

SEQ ID NO: 4202615 - RNA, 13 nt, Yersinia pestis KIM
uuaaaacaggcga

SEQ ID NO: 4202616 - RNA, 22 nt, Yersinia pestis KIM
uuaaaauacugccaaucgcucu

SEQ ID NO: 4202617 - RNA, 14 nt, Yersinia pestis KIM
uuaaaauaguggca

SEQ ID NO: 4202618 - RNA, 21 nt, Yersinia pestis KIM
uuaaaaucguauaacauaaua

SEQ ID NO: 4202619 - RNA, 18 nt, Yersinia pestis KIM
uuaaaaucuguaauuaau

SEQ ID NO: 4202620 - RNA, 22 nt, Yersinia pestis KIM
uuaaacaagcuuauauuauuca

SEQ ID NO: 4202621 - RNA, 20 nt, Yersinia pestis KIM
uuaaacagucuuauuacuca

SEQ ID NO: 4202622 - RNA, 19 nt, Yersinia pestis KIM
uuaaacccggcaucaacca

SEQ ID NO: 4202623 - RNA, 16 nt, Yersinia pestis KIM
uuaaaccucagaaaaa

SEQ ID NO: 4202624 - RNA, 17 nt, Yersinia pestis KIM
uuaaacgcacaucaauc

SEQ ID NO: 4202625 - RNA, 16 nt, Yersinia pestis KIM
uuaaacgcucaucaac

SEQ ID NO: 4202626 - RNA, 16 nt, Yersinia pestis KIM
uuaaacuguuauuggg

SEQ ID NO: 4202627 - RNA, 19 nt, Yersinia pestis KIM
uuaaacuugcucuuucacg

SEQ ID NO: 4202628 - RNA, 13 nt, Yersinia pestis KIM
uuaaacuuugcua

SEQ ID NO: 4202629 - RNA, 20 nt, Yersinia pestis KIM
uuaaagaagaauccacauaa

SEQ ID NO: 4202630 - RNA, 23 nt, Yersinia pestis KIM
uuaaagaagaauccacauaaaaa

SEQ ID NO: 4202631 - RNA, 13 nt, Yersinia pestis KIM
uuaaagaagacga

SEQ ID NO: 4202632 - RNA, 16 nt, Yersinia pestis KIM
uuaaagaagacgagua

SEQ ID NO: 4202633 - RNA, 16 nt, Yersinia pestis KIM
uuaaagaaugcaacca

SEQ ID NO: 4202634 - RNA, 19 nt, Yersinia pestis KIM
uuaaagauuucaucauuca

SEQ ID NO: 4202635 - RNA, 19 nt, Yersinia pestis KIM
uuaaaguaucgcuaucacc

SEQ ID NO: 4202636 - RNA, 17 nt, Yersinia pestis KIM
uuaaaguuuagcaaagc

SEQ ID NO: 4202637 - RNA, 14 nt, Yersinia pestis KIM
uuaaauaaaacacc

SEQ ID NO: 4202638 - RNA, 20 nt, Yersinia pestis KIM
uuaaauaacagcuaaaauga

SEQ ID NO: 4202639 - RNA, 11 nt, Yersinia pestis KIM
uuaaauaacuc

SEQ ID NO: 4202640 - RNA, 22 nt, Yersinia pestis KIM
uuaaauaagaaguagaaugaga

SEQ ID NO: 4202641 - RNA, 22 nt, Yersinia pestis KIM
uuaaauaagauccagaacacca

SEQ ID NO: 4202642 - RNA, 15 nt, Yersinia pestis KIM
uuaaauacaaaaaua

SEQ ID NO: 4202643 - RNA, 16 nt, Yersinia pestis KIM
uuaaauacaaaaauac

SEQ ID NO: 4202644 - RNA, 14 nt, Yersinia pestis KIM
uuaaauacagauca

SEQ ID NO: 4202645 - RNA, 15 nt, Yersinia pestis KIM
uuaaauaccagagac

SEQ ID NO: 4202646 - RNA, 21 nt, Yersinia pestis KIM
uuaaauacugcacguuuaauu

SEQ ID NO: 4202647 - RNA, 18 nt, Yersinia pestis KIM
uuaaauagucaccuugaa

SEQ ID NO: 4202648 - RNA, 13 nt, Yersinia pestis KIM
uuaaauccaauau

SEQ ID NO: 4202649 - RNA, 18 nt, Yersinia pestis KIM
uuaaaugcguagagucag

SEQ ID NO: 4202650 - RNA, 21 nt, Yersinia pestis KIM
uuaaauuacgguuuaccaccu

SEQ ID NO: 4202651 - RNA, 21 nt, Yersinia pestis KIM
uuaaauuaucccguucaauaa

SEQ ID NO: 4202652 - RNA, 17 nt, Yersinia pestis KIM
uuaaauucuaccuggcu

SEQ ID NO: 4202653 - RNA, 18 nt, Yersinia pestis KIM
uuaaauugcuuccaggca

SEQ ID NO: 4202654 - RNA, 14 nt, Yersinia pestis KIM
uuaaauuucuucaa

SEQ ID NO: 4202655 - RNA, 15 nt, Yersinia pestis KIM
uuaaauuuuauauua

SEQ ID NO: 4202656 - RNA, 13 nt, Yersinia pestis KIM
uuaaauuuuuaua

SEQ ID NO: 4202657 - RNA, 15 nt, Yersinia pestis KIM
uuaaauuuuuauaua

SEQ ID NO: 4202658 - RNA, 13 nt, Yersinia pestis KIM
uuaacaauucucu

SEQ ID NO: 4202659 - RNA, 19 nt, Yersinia pestis KIM
uuaacacccaauaauaaaa

SEQ ID NO: 4202660 - RNA, 22 nt, Yersinia pestis KIM
uuaacacccaauaauaaaaaaa

SEQ ID NO: 4202661 - RNA, 15 nt, Yersinia pestis KIM
uuaacacgggcauga

SEQ ID NO: 4202662 - RNA, 17 nt, Yersinia pestis KIM
uuaacaucgccacgaau

SEQ ID NO: 4202663 - RNA, 13 nt, Yersinia pestis KIM
uuaaccaacauga

SEQ ID NO: 4202664 - RNA, 21 nt, Yersinia pestis KIM
uuaaccaacaugagccacaca

SEQ ID NO: 4202665 - RNA, 15 nt, Yersinia pestis KIM
uuaacccaaagccau

SEQ ID NO: 4202666 - RNA, 21 nt, Yersinia pestis KIM
uuaacccauauuacucacaca

SEQ ID NO: 4202667 - RNA, 17 nt, Yersinia pestis KIM
uuaacccggcgacgauc

SEQ ID NO: 4202668 - RNA, 21 nt, Yersinia pestis KIM
uuaacccuucucgugucacag

SEQ ID NO: 4202669 - RNA, 23 nt, Yersinia pestis KIM
uuaaccugagcggcguuguucuc

SEQ ID NO: 4202670 - RNA, 14 nt, Yersinia pestis KIM
uuaacgacauuucg

SEQ ID NO: 4202671 - RNA, 17 nt, Yersinia pestis KIM
uuaacgauauagucuug

SEQ ID NO: 4202672 - RNA, 13 nt, Yersinia pestis KIM
uuaacgcuuuauc

SEQ ID NO: 4202673 - RNA, 19 nt, Yersinia pestis KIM
uuaacggaaaugauaucug

SEQ ID NO: 4202674 - RNA, 23 nt, Yersinia pestis KIM
uuaacggcgugcgaacaaaaauu

SEQ ID NO: 4202675 - RNA, 18 nt, Yersinia pestis KIM
uuaacgucgcugaaaugc

SEQ ID NO: 4202676 - RNA, 19 nt, Yersinia pestis KIM
uuaacuacaccgcuaaccu

SEQ ID NO: 4202677 - RNA, 13 nt, Yersinia pestis KIM
uuaacucaaauaa

SEQ ID NO: 4202678 - RNA, 13 nt, Yersinia pestis KIM
uuaacucuucaac

SEQ ID NO: 4202679 - RNA, 11 nt, Yersinia pestis KIM
uuaacugcacg

SEQ ID NO: 4202680 - RNA, 15 nt, Yersinia pestis KIM
uuaacugcaguaaaa

SEQ ID NO: 4202681 - RNA, 16 nt, Yersinia pestis KIM
uuaacugcaguaaaaa

SEQ ID NO: 4202682 - RNA, 19 nt, Yersinia pestis KIM
uuaacugcauagcuaaccu

SEQ ID NO: 4202683 - RNA, 22 nt, Yersinia pestis KIM
uuaacugcauagcuaaccuuaa

SEQ ID NO: 4202684 - RNA, 21 nt, Yersinia pestis KIM
uuaacuggccaauuaacggau

SEQ ID NO: 4202685 - RNA, 19 nt, Yersinia pestis KIM
uuaacuuuucuucauugcu

SEQ ID NO: 4202686 - RNA, 19 nt, Yersinia pestis KIM
uuaacuuuuucuaucccua

SEQ ID NO: 4202687 - RNA, 13 nt, Yersinia pestis KIM
uuaagaaaacauu

SEQ ID NO: 4202688 - RNA, 14 nt, Yersinia pestis KIM
uuaagaagccucau

SEQ ID NO: 4202689 - RNA, 21 nt, Yersinia pestis KIM
uuaagaauccucugaauaaaa

SEQ ID NO: 4202690 - RNA, 22 nt, Yersinia pestis KIM
uuaagaauccucugaauaaaaa

SEQ ID NO: 4202691 - RNA, 21 nt, Yersinia pestis KIM
uuaagacauugcgcaagcccc

SEQ ID NO: 4202692 - RNA, 19 nt, Yersinia pestis KIM
uuaagaccccugcgauaau

SEQ ID NO: 4202693 - RNA, 16 nt, Yersinia pestis KIM
uuaagauaauuaucca

SEQ ID NO: 4202694 - RNA, 20 nt, Yersinia pestis KIM
uuaagaugacuacugucuuu

SEQ ID NO: 4202695 - RNA, 16 nt, Yersinia pestis KIM
uuaagauuaagccaug

SEQ ID NO: 4202696 - RNA, 14 nt, Yersinia pestis KIM
uuaagcaauuuaga

SEQ ID NO: 4202697 - RNA, 16 nt, Yersinia pestis KIM
uuaagcauuggcaaau

SEQ ID NO: 4202698 - RNA, 13 nt, Yersinia pestis KIM
uuaagccaauaau

SEQ ID NO: 4202699 - RNA, 21 nt, Yersinia pestis KIM
uuaagccaauaauauaaucag

SEQ ID NO: 4202700 - RNA, 21 nt, Yersinia pestis KIM
uuaagccgcaaggauaaacga

SEQ ID NO: 4202701 - RNA, 17 nt, Yersinia pestis KIM
uuaagcuaauucugggu

SEQ ID NO: 4202702 - RNA, 22 nt, Yersinia pestis KIM
uuaaggaaaaguagccaauaga

SEQ ID NO: 4202703 - RNA, 15 nt, Yersinia pestis KIM
uuaaggaaacucaug

SEQ ID NO: 4202704 - RNA, 16 nt, Yersinia pestis KIM
uuaaggaacggguaau

SEQ ID NO: 4202705 - RNA, 20 nt, Yersinia pestis KIM
uuaaggacccguuuauaaag

SEQ ID NO: 4202706 - RNA, 16 nt, Yersinia pestis KIM
uuaaggacucuuaguu

SEQ ID NO: 4202707 - RNA, 19 nt, Yersinia pestis KIM
uuaaggagcccucugucau

SEQ ID NO: 4202708 - RNA, 20 nt, Yersinia pestis KIM
uuaaggcgauauuauuagua

SEQ ID NO: 4202709 - RNA, 13 nt, Yersinia pestis KIM
uuaaggcgcgacu

SEQ ID NO: 4202710 - RNA, 15 nt, Yersinia pestis KIM
uuaagguaacggcau

SEQ ID NO: 4202711 - RNA, 19 nt, Yersinia pestis KIM
uuaagguuagcuaugcagu

SEQ ID NO: 4202712 - RNA, 23 nt, Yersinia pestis KIM
uuaaguaaguuuaaacuguuauu

SEQ ID NO: 4202713 - RNA, 18 nt, Yersinia pestis KIM
uuaaguugaguugaauuu

SEQ ID NO: 4202714 - RNA, 15 nt, Yersinia pestis KIM
uuaaguugaugcagu

SEQ ID NO: 4202715 - RNA, 17 nt, Yersinia pestis KIM
uuaaguugaugcaguga

SEQ ID NO: 4202716 - RNA, 16 nt, Yersinia pestis KIM
uuaauaaaaaacugac

SEQ ID NO: 4202717 - RNA, 19 nt, Yersinia pestis KIM
uuaauaaauuauaaugaug

SEQ ID NO: 4202718 - RNA, 19 nt, Yersinia pestis KIM
uuaauaaauuuucuaagcu

SEQ ID NO: 4202719 - RNA, 20 nt, Yersinia pestis KIM
uuaauaagcccaguauugca

SEQ ID NO: 4202720 - RNA, 14 nt, Yersinia pestis KIM
uuaauaauaucaaa

SEQ ID NO: 4202721 - RNA, 18 nt, Yersinia pestis KIM
uuaauacaauagagaaua

SEQ ID NO: 4202722 - RNA, 19 nt, Yersinia pestis KIM
uuaauacaggcugacauuu

SEQ ID NO: 4202723 - RNA, 16 nt, Yersinia pestis KIM
uuaauacaucaucaaa

SEQ ID NO: 4202724 - RNA, 18 nt, Yersinia pestis KIM
uuaauacaucaucaaaac

SEQ ID NO: 4202725 - RNA, 13 nt, Yersinia pestis KIM
uuaauaccaugca

SEQ ID NO: 4202726 - RNA, 19 nt, Yersinia pestis KIM
uuaauaccuuguucccgca

SEQ ID NO: 4202727 - RNA, 19 nt, Yersinia pestis KIM
uuaauagaagguuaaauuu

SEQ ID NO: 4202728 - RNA, 15 nt, Yersinia pestis KIM
uuaauauauuuaauu

SEQ ID NO: 4202729 - RNA, 16 nt, Yersinia pestis KIM
uuaauaucaaaacuga

SEQ ID NO: 4202730 - RNA, 15 nt, Yersinia pestis KIM
uuaauaugcaaaaaa

SEQ ID NO: 4202731 - RNA, 22 nt, Yersinia pestis KIM
uuaauaugcaaaaaaagacacu

SEQ ID NO: 4202732 - RNA, 13 nt, Yersinia pestis KIM
uuaaucaccucac

SEQ ID NO: 4202733 - RNA, 12 nt, Yersinia pestis KIM
uuaaucagugac

SEQ ID NO: 4202734 - RNA, 17 nt, Yersinia pestis KIM
uuaaucagugacaagaa

SEQ ID NO: 4202735 - RNA, 22 nt, Yersinia pestis KIM
uuaaucaguggcugaaggggcu

SEQ ID NO: 4202736 - RNA, 18 nt, Yersinia pestis KIM
uuaaucauuggcaacuua

SEQ ID NO: 4202737 - RNA, 16 nt, Yersinia pestis KIM
uuaaucauuuguuucu

SEQ ID NO: 4202738 - RNA, 23 nt, Yersinia pestis KIM
uuaauccccaugaugauaucacc

SEQ ID NO: 4202739 - RNA, 22 nt, Yersinia pestis KIM
uuaauccuaaugaacacuuaau

SEQ ID NO: 4202740 - RNA, 15 nt, Yersinia pestis KIM
uuaauccuucacuua

SEQ ID NO: 4202741 - RNA, 17 nt, Yersinia pestis KIM
uuaaucgcaguuaucau

SEQ ID NO: 4202742 - RNA, 20 nt, Yersinia pestis KIM
uuaaucgccguggugccauc

SEQ ID NO: 4202743 - RNA, 19 nt, Yersinia pestis KIM
uuaaucggauggucaucca

SEQ ID NO: 4202744 - RNA, 13 nt, Yersinia pestis KIM
uuaaucuauuaau

SEQ ID NO: 4202745 - RNA, 17 nt, Yersinia pestis KIM
uuaaucuccuggugguu

SEQ ID NO: 4202746 - RNA, 21 nt, Yersinia pestis KIM
uuaaucugcccagccugguuu

SEQ ID NO: 4202747 - RNA, 20 nt, Yersinia pestis KIM
uuaaucuuuaauucaucaga

SEQ ID NO: 4202748 - RNA, 21 nt, Yersinia pestis KIM
uuaauggcaccguggauaaac

SEQ ID NO: 4202749 - RNA, 22 nt, Yersinia pestis KIM
uuaauggcugcacggaucacgc

SEQ ID NO: 4202750 - RNA, 16 nt, Yersinia pestis KIM
uuaaugucuuuacuaa

SEQ ID NO: 4202751 - RNA, 15 nt, Yersinia pestis KIM
uuaauguuuauauug

SEQ ID NO: 4202752 - RNA, 12 nt, Yersinia pestis KIM
uuaauuaaucag

SEQ ID NO: 4202753 - RNA, 11 nt, Yersinia pestis KIM
uuaauucaguu

SEQ ID NO: 4202754 - RNA, 21 nt, Yersinia pestis KIM
uuaauucaugugagauaacac

SEQ ID NO: 4202755 - RNA, 12 nt, Yersinia pestis KIM
uuaauuccaugc

SEQ ID NO: 4202756 - RNA, 18 nt, Yersinia pestis KIM
uuaauuccaugcaaaaua

SEQ ID NO: 4202757 - RNA, 22 nt, Yersinia pestis KIM
uuaauuccgcccugaauaucgg

SEQ ID NO: 4202758 - RNA, 12 nt, Yersinia pestis KIM
uuaauugccgcg

SEQ ID NO: 4202759 - RNA, 18 nt, Yersinia pestis KIM
uuaauuggcccauaacaa

SEQ ID NO: 4202760 - RNA, 23 nt, Yersinia pestis KIM
uuaauuggcucauaacacuuaau

SEQ ID NO: 4202761 - RNA, 16 nt, Yersinia pestis KIM
uuaauugguuuuaaua

SEQ ID NO: 4202762 - RNA, 17 nt, Yersinia pestis KIM
uuaauugguuuuaauaa

SEQ ID NO: 4202763 - RNA, 15 nt, Yersinia pestis KIM
uuaauuucagucaau

SEQ ID NO: 4202764 - RNA, 15 nt, Yersinia pestis KIM
uuaauuugcuuuaaa

SEQ ID NO: 4202765 - RNA, 17 nt, Yersinia pestis KIM
uuaauuuggcuauugag

SEQ ID NO: 4202766 - RNA, 17 nt, Yersinia pestis KIM
uuaauuuuucauaauaa

SEQ ID NO: 4202767 - RNA, 19 nt, Yersinia pestis KIM
uuacaaaauauacugauaa

SEQ ID NO: 4202768 - RNA, 15 nt, Yersinia pestis KIM
uuacaauuacacacc

SEQ ID NO: 4202769 - RNA, 22 nt, Yersinia pestis KIM
uuacacacccucaacucaaaac

SEQ ID NO: 4202770 - RNA, 15 nt, Yersinia pestis KIM
uuacagacuggccaa

SEQ ID NO: 4202771 - RNA, 19 nt, Yersinia pestis KIM
uuacagacuggccaacagg

SEQ ID NO: 4202772 - RNA, 17 nt, Yersinia pestis KIM
uuacagcaaggcagcaa

SEQ ID NO: 4202773 - RNA, 18 nt, Yersinia pestis KIM
uuacagcaaggcagcaag

SEQ ID NO: 4202774 - RNA, 23 nt, Yersinia pestis KIM
uuacagcaaggcggcaagcaagc

SEQ ID NO: 4202775 - RNA, 21 nt, Yersinia pestis KIM
uuacagccgcccccuuucuua

SEQ ID NO: 4202776 - RNA, 22 nt, Yersinia pestis KIM
uuacaggauuaaauaaagauaa

SEQ ID NO: 4202777 - RNA, 16 nt, Yersinia pestis KIM
uuacaguaaggcagca

SEQ ID NO: 4202778 - RNA, 17 nt, Yersinia pestis KIM
uuacaguaaggcagcaa

SEQ ID NO: 4202779 - RNA, 18 nt, Yersinia pestis KIM
uuacaguaaggcagcaag

SEQ ID NO: 4202780 - RNA, 18 nt, Yersinia pestis KIM
uuacagugaucaugggaa

SEQ ID NO: 4202781 - RNA, 18 nt, Yersinia pestis KIM
uuacaguugauauuauua

SEQ ID NO: 4202782 - RNA, 17 nt, Yersinia pestis KIM
uuacauauaauccaaaa

SEQ ID NO: 4202783 - RNA, 19 nt, Yersinia pestis KIM
uuacauauaggaaaugucg

SEQ ID NO: 4202784 - RNA, 14 nt, Yersinia pestis KIM
uuacauaugauggc

SEQ ID NO: 4202785 - RNA, 21 nt, Yersinia pestis KIM
uuacaucaaccccuuucuuaa

SEQ ID NO: 4202786 - RNA, 19 nt, Yersinia pestis KIM
uuacaucaugaguaaaaga

SEQ ID NO: 4202787 - RNA, 22 nt, Yersinia pestis KIM
uuacauuaaucagcgaaugccg

SEQ ID NO: 4202788 - RNA, 11 nt, Yersinia pestis KIM
uuacauuuuua

SEQ ID NO: 4202789 - RNA, 13 nt, Yersinia pestis KIM
uuacauuuuuaac

SEQ ID NO: 4202790 - RNA, 18 nt, Yersinia pestis KIM
uuaccaacagacucacuc

SEQ ID NO: 4202791 - RNA, 11 nt, Yersinia pestis KIM
uuaccacaccu

SEQ ID NO: 4202792 - RNA, 21 nt, Yersinia pestis KIM
uuaccaccgucaagacaacaa

SEQ ID NO: 4202793 - RNA, 14 nt, Yersinia pestis KIM
uuaccauccacuag

SEQ ID NO: 4202794 - RNA, 17 nt, Yersinia pestis KIM
uuaccauccguccucag

SEQ ID NO: 4202795 - RNA, 13 nt, Yersinia pestis KIM
uuaccaugcucau

SEQ ID NO: 4202796 - RNA, 14 nt, Yersinia pestis KIM
uuacccacauuaaa

SEQ ID NO: 4202797 - RNA, 18 nt, Yersinia pestis KIM
uuacccacauucaggccg

SEQ ID NO: 4202798 - RNA, 19 nt, Yersinia pestis KIM
uuacccacuugcaacauua

SEQ ID NO: 4202799 - RNA, 22 nt, Yersinia pestis KIM
uuacccgcgaucauuucaacua

SEQ ID NO: 4202800 - RNA, 15 nt, Yersinia pestis KIM
uuacccggaauggag

SEQ ID NO: 4202801 - RNA, 14 nt, Yersinia pestis KIM
uuacccguacaaaa

SEQ ID NO: 4202802 - RNA, 21 nt, Yersinia pestis KIM
uuacccguuacacaaucagua

SEQ ID NO: 4202803 - RNA, 19 nt, Yersinia pestis KIM
uuacccucuaucgcucacu

SEQ ID NO: 4202804 - RNA, 22 nt, Yersinia pestis KIM
uuacccugcgggugcuuuaaug

SEQ ID NO: 4202805 - RNA, 22 nt, Yersinia pestis KIM
uuaccgagcgucaagccaaccc

SEQ ID NO: 4202806 - RNA, 23 nt, Yersinia pestis KIM
uuaccgauaaaggccgcagauaa

SEQ ID NO: 4202807 - RNA, 15 nt, Yersinia pestis KIM
uuaccgaugauuggu

SEQ ID NO: 4202808 - RNA, 18 nt, Yersinia pestis KIM
uuaccgccgucaugcuga

SEQ ID NO: 4202809 - RNA, 20 nt, Yersinia pestis KIM
uuaccgcgcuugcaucaacu

SEQ ID NO: 4202810 - RNA, 15 nt, Yersinia pestis KIM
uuaccggccucuuuc

SEQ ID NO: 4202811 - RNA, 16 nt, Yersinia pestis KIM
uuaccgggcgaacaga

SEQ ID NO: 4202812 - RNA, 15 nt, Yersinia pestis KIM
uuaccguaagauucg

SEQ ID NO: 4202813 - RNA, 17 nt, Yersinia pestis KIM
uuaccgugguuauuggc

SEQ ID NO: 4202814 - RNA, 15 nt, Yersinia pestis KIM
uuaccguugauugga

SEQ ID NO: 4202815 - RNA, 11 nt, Yersinia pestis KIM
uuaccuaacca

SEQ ID NO: 4202816 - RNA, 21 nt, Yersinia pestis KIM
uuaccuauaaacuugauucac

SEQ ID NO: 4202817 - RNA, 13 nt, Yersinia pestis KIM
uuaccuauuuauu

SEQ ID NO: 4202818 - RNA, 21 nt, Yersinia pestis KIM
uuaccuauuuuagguccaggc

SEQ ID NO: 4202819 - RNA, 22 nt, Yersinia pestis KIM
uuaccucgccguuauuggccga

SEQ ID NO: 4202820 - RNA, 12 nt, Yersinia pestis KIM
uuaccugcauau

SEQ ID NO: 4202821 - RNA, 14 nt, Yersinia pestis KIM
uuaccuugugcggu

SEQ ID NO: 4202822 - RNA, 21 nt, Yersinia pestis KIM
uuaccuuguuuguuacugcuu

SEQ ID NO: 4202823 - RNA, 22 nt, Yersinia pestis KIM
uuacgaucgauaguaacaccag

SEQ ID NO: 4202824 - RNA, 14 nt, Yersinia pestis KIM
uuacgcaacaagcc

SEQ ID NO: 4202825 - RNA, 15 nt, Yersinia pestis KIM
uuacgccauacauca

SEQ ID NO: 4202826 - RNA, 23 nt, Yersinia pestis KIM
uuacggcgggucguauucaggua

SEQ ID NO: 4202827 - RNA, 22 nt, Yersinia pestis KIM
uuacgggcggcauaauccucaa

SEQ ID NO: 4202828 - RNA, 22 nt, Yersinia pestis KIM
uuacgggucagcucaccaccuc

SEQ ID NO: 4202829 - RNA, 22 nt, Yersinia pestis KIM
uuacgguauuugaacuucaaau

SEQ ID NO: 4202830 - RNA, 14 nt, Yersinia pestis KIM
uuacgucaaaacua

SEQ ID NO: 4202831 - RNA, 14 nt, Yersinia pestis KIM
uuacgucagaaaua

SEQ ID NO: 4202832 - RNA, 15 nt, Yersinia pestis KIM
uuacgucagaaauaa

SEQ ID NO: 4202833 - RNA, 19 nt, Yersinia pestis KIM
uuacguguucuuaauuuaa

SEQ ID NO: 4202834 - RNA, 21 nt, Yersinia pestis KIM
uuacuacaaacgcguuaauua

SEQ ID NO: 4202835 - RNA, 12 nt, Yersinia pestis KIM
uuacuauauaaa

SEQ ID NO: 4202836 - RNA, 14 nt, Yersinia pestis KIM
uuacucaggaacaa

SEQ ID NO: 4202837 - RNA, 19 nt, Yersinia pestis KIM
uuacucaggauuagcuucu

SEQ ID NO: 4202838 - RNA, 17 nt, Yersinia pestis KIM
uuacucaguucagcccc

SEQ ID NO: 4202839 - RNA, 12 nt, Yersinia pestis KIM
uuacuccucugc

SEQ ID NO: 4202840 - RNA, 14 nt, Yersinia pestis KIM
uuacuccucugccu

SEQ ID NO: 4202841 - RNA, 18 nt, Yersinia pestis KIM
uuacuccucugccuaucc

SEQ ID NO: 4202842 - RNA, 21 nt, Yersinia pestis KIM
uuacuccucugccuauccuca

SEQ ID NO: 4202843 - RNA, 22 nt, Yersinia pestis KIM
uuacuccucugccuauccucac

SEQ ID NO: 4202844 - RNA, 18 nt, Yersinia pestis KIM
uuacucguauaaaaaaua

SEQ ID NO: 4202845 - RNA, 14 nt, Yersinia pestis KIM
uuacucuucugccu

SEQ ID NO: 4202846 - RNA, 16 nt, Yersinia pestis KIM
uuacugaaaagaggca

SEQ ID NO: 4202847 - RNA, 14 nt, Yersinia pestis KIM
uuacugauaucuuu

SEQ ID NO: 4202848 - RNA, 14 nt, Yersinia pestis KIM
uuacugcauucuga

SEQ ID NO: 4202849 - RNA, 13 nt, Yersinia pestis KIM
uuacugccacuga

SEQ ID NO: 4202850 - RNA, 11 nt, Yersinia pestis KIM
uuacuguaaga

SEQ ID NO: 4202851 - RNA, 12 nt, Yersinia pestis KIM
uuacuuauaaac

SEQ ID NO: 4202852 - RNA, 21 nt, Yersinia pestis KIM
uuacuugugcgcgggcacggg

SEQ ID NO: 4202853 - RNA, 18 nt, Yersinia pestis KIM
uuacuuuaucguccaugc

SEQ ID NO: 4202854 - RNA, 15 nt, Yersinia pestis KIM
uuagaagagauagau

SEQ ID NO: 4202855 - RNA, 22 nt, Yersinia pestis KIM
uuagacaugggcagugcacagu

SEQ ID NO: 4202856 - RNA, 17 nt, Yersinia pestis KIM
uuagaccggacauuaau

SEQ ID NO: 4202857 - RNA, 22 nt, Yersinia pestis KIM
uuagaccggacauuaauuauuu

SEQ ID NO: 4202858 - RNA, 11 nt, Yersinia pestis KIM
uuagacgucag

SEQ ID NO: 4202859 - RNA, 18 nt, Yersinia pestis KIM
uuagacgucagauuagcu

SEQ ID NO: 4202860 - RNA, 17 nt, Yersinia pestis KIM
uuagacgucagauuagu

SEQ ID NO: 4202861 - RNA, 20 nt, Yersinia pestis KIM
uuagauaggcuuuccccccu

SEQ ID NO: 4202862 - RNA, 15 nt, Yersinia pestis KIM
uuagaucaacauuau

SEQ ID NO: 4202863 - RNA, 19 nt, Yersinia pestis KIM
uuagaugauugaaaaucag

SEQ ID NO: 4202864 - RNA, 14 nt, Yersinia pestis KIM
uuagauuucaccua

SEQ ID NO: 4202865 - RNA, 16 nt, Yersinia pestis KIM
uuagcacauaugcagc

SEQ ID NO: 4202866 - RNA, 19 nt, Yersinia pestis KIM
uuagcacguuuuucagcuu

SEQ ID NO: 4202867 - RNA, 15 nt, Yersinia pestis KIM
uuagcaugcauccau

SEQ ID NO: 4202868 - RNA, 16 nt, Yersinia pestis KIM
uuagccaaauacccua

SEQ ID NO: 4202869 - RNA, 20 nt, Yersinia pestis KIM
uuagccacugguugaaaguu

SEQ ID NO: 4202870 - RNA, 15 nt, Yersinia pestis KIM
uuagccccaaaugcc

SEQ ID NO: 4202871 - RNA, 15 nt, Yersinia pestis KIM
uuagccgaauauccc

SEQ ID NO: 4202872 - RNA, 18 nt, Yersinia pestis KIM
uuagccuucguuugucaa

SEQ ID NO: 4202873 - RNA, 14 nt, Yersinia pestis KIM
uuagcgagaaaguc

SEQ ID NO: 4202874 - RNA, 15 nt, Yersinia pestis KIM
uuagcgagaaaguca

SEQ ID NO: 4202875 - RNA, 23 nt, Yersinia pestis KIM
uuagcgaugaccauuuauuucca

SEQ ID NO: 4202876 - RNA, 17 nt, Yersinia pestis KIM
uuagcgccgcuucgguc

SEQ ID NO: 4202877 - RNA, 14 nt, Yersinia pestis KIM
uuagcggcaacgau

SEQ ID NO: 4202878 - RNA, 19 nt, Yersinia pestis KIM
uuagcuacgcugcugaauu

SEQ ID NO: 4202879 - RNA, 20 nt, Yersinia pestis KIM
uuagcucccccguguucuga

SEQ ID NO: 4202880 - RNA, 15 nt, Yersinia pestis KIM
uuagcuuacaccaug

SEQ ID NO: 4202881 - RNA, 17 nt, Yersinia pestis KIM
uuaggauaaccaauucu

SEQ ID NO: 4202882 - RNA, 18 nt, Yersinia pestis KIM
uuaggauacguucgccgu

SEQ ID NO: 4202883 - RNA, 23 nt, Yersinia pestis KIM
uuaggauuuauuucucugauaau

SEQ ID NO: 4202884 - RNA, 20 nt, Yersinia pestis KIM
uuaggcaauccaaacauaca

SEQ ID NO: 4202885 - RNA, 15 nt, Yersinia pestis KIM
uuaggcauaaauaau

SEQ ID NO: 4202886 - RNA, 16 nt, Yersinia pestis KIM
uuagguaauaccaaug

SEQ ID NO: 4202887 - RNA, 15 nt, Yersinia pestis KIM
uuagguaguuuuauu

SEQ ID NO: 4202888 - RNA, 16 nt, Yersinia pestis KIM
uuagguucuaaaccua

SEQ ID NO: 4202889 - RNA, 22 nt, Yersinia pestis KIM
uuaguauacuaugggauaaacu

SEQ ID NO: 4202890 - RNA, 23 nt, Yersinia pestis KIM
uuagucacucaagccaguaacua

SEQ ID NO: 4202891 - RNA, 21 nt, Yersinia pestis KIM
uuagucagcgcggcccauaua

SEQ ID NO: 4202892 - RNA, 19 nt, Yersinia pestis KIM
uuagucucaucgagaauaa

SEQ ID NO: 4202893 - RNA, 13 nt, Yersinia pestis KIM
uuagucucuuauu

SEQ ID NO: 4202894 - RNA, 18 nt, Yersinia pestis KIM
uuagugccuaucugaaug

SEQ ID NO: 4202895 - RNA, 13 nt, Yersinia pestis KIM
uuaguggcuuuaa

SEQ ID NO: 4202896 - RNA, 15 nt, Yersinia pestis KIM
uuaguuuuaauaacc

SEQ ID NO: 4202897 - RNA, 15 nt, Yersinia pestis KIM
uuaguuuuagacguc

SEQ ID NO: 4202898 - RNA, 15 nt, Yersinia pestis KIM
uuauaaaaaccccuu

SEQ ID NO: 4202899 - RNA, 11 nt, Yersinia pestis KIM
uuauaaaacca

SEQ ID NO: 4202900 - RNA, 21 nt, Yersinia pestis KIM
uuauaaacacugauuuauaaa

SEQ ID NO: 4202901 - RNA, 19 nt, Yersinia pestis KIM
uuauaaacacuuaccuaua

SEQ ID NO: 4202902 - RNA, 16 nt, Yersinia pestis KIM
uuauaaauaauuaaug

SEQ ID NO: 4202903 - RNA, 16 nt, Yersinia pestis KIM
uuauaaaucagggcag

SEQ ID NO: 4202904 - RNA, 13 nt, Yersinia pestis KIM
uuauaagcguuau

SEQ ID NO: 4202905 - RNA, 16 nt, Yersinia pestis KIM
uuauaaggaauauacu

SEQ ID NO: 4202906 - RNA, 23 nt, Yersinia pestis KIM
uuauaaggaauauacuuuacaua

SEQ ID NO: 4202907 - RNA, 16 nt, Yersinia pestis KIM
uuauaauuaauuugug

SEQ ID NO: 4202908 - RNA, 16 nt, Yersinia pestis KIM
uuauaauucauuuuuu

SEQ ID NO: 4202909 - RNA, 12 nt, Yersinia pestis KIM
uuauaauuuaua

SEQ ID NO: 4202910 - RNA, 17 nt, Yersinia pestis KIM
uuauacagcauauaaaa

SEQ ID NO: 4202911 - RNA, 22 nt, Yersinia pestis KIM
uuauacagcauauaaaaaagca

SEQ ID NO: 4202912 - RNA, 21 nt, Yersinia pestis KIM
uuauacauaucuuuauuauca

SEQ ID NO: 4202913 - RNA, 14 nt, Yersinia pestis KIM
uuauacauauguug

SEQ ID NO: 4202914 - RNA, 15 nt, Yersinia pestis KIM
uuauaccccgcgcag

SEQ ID NO: 4202915 - RNA, 14 nt, Yersinia pestis KIM
uuauacuauuuaug

SEQ ID NO: 4202916 - RNA, 16 nt, Yersinia pestis KIM
uuauagaacggcagug

SEQ ID NO: 4202917 - RNA, 14 nt, Yersinia pestis KIM
uuauagccaaaucu

SEQ ID NO: 4202918 - RNA, 22 nt, Yersinia pestis KIM
uuauagcucaucgguaacuuac

SEQ ID NO: 4202919 - RNA, 14 nt, Yersinia pestis KIM
uuauaggcucuguu

SEQ ID NO: 4202920 - RNA, 15 nt, Yersinia pestis KIM
uuauagguauacacc

SEQ ID NO: 4202921 - RNA, 20 nt, Yersinia pestis KIM
uuauaguuaaacugauuggu

SEQ ID NO: 4202922 - RNA, 20 nt, Yersinia pestis KIM
uuauauaaauggcuguuaua

SEQ ID NO: 4202923 - RNA, 17 nt, Yersinia pestis KIM
uuauauauccaaaauaa

SEQ ID NO: 4202924 - RNA, 13 nt, Yersinia pestis KIM
uuauauauuuuga

SEQ ID NO: 4202925 - RNA, 19 nt, Yersinia pestis KIM
uuauaugcgcuggcucuau

SEQ ID NO: 4202926 - RNA, 15 nt, Yersinia pestis KIM
uuauaugcuguauaa

SEQ ID NO: 4202927 - RNA, 18 nt, Yersinia pestis KIM
uuauauucauauuucacu

SEQ ID NO: 4202928 - RNA, 20 nt, Yersinia pestis KIM
uuaucaaagugcuuaaccca

SEQ ID NO: 4202929 - RNA, 15 nt, Yersinia pestis KIM
uuaucaaguuaaaua

SEQ ID NO: 4202930 - RNA, 12 nt, Yersinia pestis KIM
uuaucaauacug

SEQ ID NO: 4202931 - RNA, 13 nt, Yersinia pestis KIM
uuaucaauacugc

SEQ ID NO: 4202932 - RNA, 14 nt, Yersinia pestis KIM
uuaucaaucaaaaa

SEQ ID NO: 4202933 - RNA, 23 nt, Yersinia pestis KIM
uuaucacaucaacaguugccgac

SEQ ID NO: 4202934 - RNA, 21 nt, Yersinia pestis KIM
uuaucaccaacguuuauaucc

SEQ ID NO: 4202935 - RNA, 20 nt, Yersinia pestis KIM
uuaucaccaguauuauuggc

SEQ ID NO: 4202936 - RNA, 19 nt, Yersinia pestis KIM
uuaucacgucgccaauuuu

SEQ ID NO: 4202937 - RNA, 20 nt, Yersinia pestis KIM
uuaucacugggcagaugacg

SEQ ID NO: 4202938 - RNA, 19 nt, Yersinia pestis KIM
uuaucagcgaaaaauuuca

SEQ ID NO: 4202939 - RNA, 18 nt, Yersinia pestis KIM
uuaucagggccuacguuc

SEQ ID NO: 4202940 - RNA, 22 nt, Yersinia pestis KIM
uuaucaucauuacacugaauug

SEQ ID NO: 4202941 - RNA, 17 nt, Yersinia pestis KIM
uuaucauugaguucuga

SEQ ID NO: 4202942 - RNA, 14 nt, Yersinia pestis KIM
uuaucauuuaaaua

SEQ ID NO: 4202943 - RNA, 21 nt, Yersinia pestis KIM
uuaucauuuaaauacagauca

SEQ ID NO: 4202944 - RNA, 13 nt, Yersinia pestis KIM
uuauccacagcau

SEQ ID NO: 4202945 - RNA, 18 nt, Yersinia pestis KIM
uuaucccaguuuuuaauu

SEQ ID NO: 4202946 - RNA, 21 nt, Yersinia pestis KIM
uuauccccgccucgacaagca

SEQ ID NO: 4202947 - RNA, 15 nt, Yersinia pestis KIM
uuaucccuccaucaa

SEQ ID NO: 4202948 - RNA, 21 nt, Yersinia pestis KIM
uuaucccuccaucaagccacc

SEQ ID NO: 4202949 - RNA, 22 nt, Yersinia pestis KIM
uuaucccuuacgaucacuuacc

SEQ ID NO: 4202950 - RNA, 17 nt, Yersinia pestis KIM
uuauccgcaccauagau

SEQ ID NO: 4202951 - RNA, 15 nt, Yersinia pestis KIM
uuauccguuaaccca

SEQ ID NO: 4202952 - RNA, 14 nt, Yersinia pestis KIM
uuauccguuugcaa

SEQ ID NO: 4202953 - RNA, 15 nt, Yersinia pestis KIM
uuauccuuuuuauuu

SEQ ID NO: 4202954 - RNA, 22 nt, Yersinia pestis KIM
uuaucgauaaauaauuacuuau

SEQ ID NO: 4202955 - RNA, 20 nt, Yersinia pestis KIM
uuaucgcaguaauagaaaaa

SEQ ID NO: 4202956 - RNA, 13 nt, Yersinia pestis KIM
uuaucgccagcug

SEQ ID NO: 4202957 - RNA, 20 nt, Yersinia pestis KIM
uuaucgguuguccuucaaug

SEQ ID NO: 4202958 - RNA, 13 nt, Yersinia pestis KIM
uuaucuaaaacug

SEQ ID NO: 4202959 - RNA, 21 nt, Yersinia pestis KIM
uuaucuauacuaaauagauaa

SEQ ID NO: 4202960 - RNA, 16 nt, Yersinia pestis KIM
uuaucuaucuguucac

SEQ ID NO: 4202961 - RNA, 15 nt, Yersinia pestis KIM
uuaucucccauuaau

SEQ ID NO: 4202962 - RNA, 19 nt, Yersinia pestis KIM
uuaucucccauuaauuaau

SEQ ID NO: 4202963 - RNA, 21 nt, Yersinia pestis KIM
uuaucucccauuaauuaauca

SEQ ID NO: 4202964 - RNA, 20 nt, Yersinia pestis KIM
uuaucucuuacauaaagacc

SEQ ID NO: 4202965 - RNA, 22 nt, Yersinia pestis KIM
uuaucugaauagcgcugcauca

SEQ ID NO: 4202966 - RNA, 14 nt, Yersinia pestis KIM
uuaucugcuauuuc

SEQ ID NO: 4202967 - RNA, 16 nt, Yersinia pestis KIM
uuaucuguuguauacu

SEQ ID NO: 4202968 - RNA, 22 nt, Yersinia pestis KIM
uuaucuguuguauacuguuuau

SEQ ID NO: 4202969 - RNA, 23 nt, Yersinia pestis KIM
uuaucuguuguauacuguuuauu

SEQ ID NO: 4202970 - RNA, 18 nt, Yersinia pestis KIM
uuaucuguuucaaauaag

SEQ ID NO: 4202971 - RNA, 16 nt, Yersinia pestis KIM
uuaucuuuaauuuucu

SEQ ID NO: 4202972 - RNA, 21 nt, Yersinia pestis KIM
uuaugacacccguacgaauuu

SEQ ID NO: 4202973 - RNA, 17 nt, Yersinia pestis KIM
uuaugaccaauagucac

SEQ ID NO: 4202974 - RNA, 13 nt, Yersinia pestis KIM
uuaugaguucugc

SEQ ID NO: 4202975 - RNA, 17 nt, Yersinia pestis KIM
uuaugccccucacccgu

SEQ ID NO: 4202976 - RNA, 13 nt, Yersinia pestis KIM
uuauggagaggcg

SEQ ID NO: 4202977 - RNA, 22 nt, Yersinia pestis KIM
uuauggauauggaccugaguca

SEQ ID NO: 4202978 - RNA, 16 nt, Yersinia pestis KIM
uuauggcggguaucuu

SEQ ID NO: 4202979 - RNA, 18 nt, Yersinia pestis KIM
uuauggggacucuuuauu

SEQ ID NO: 4202980 - RNA, 19 nt, Yersinia pestis KIM
uuauguaaauaguuacuau

SEQ ID NO: 4202981 - RNA, 16 nt, Yersinia pestis KIM
uuauguaguuaaucua

SEQ ID NO: 4202982 - RNA, 19 nt, Yersinia pestis KIM
uuauguaguuaaucuaccc

SEQ ID NO: 4202983 - RNA, 15 nt, Yersinia pestis KIM
uuaugucagagauaa

SEQ ID NO: 4202984 - RNA, 21 nt, Yersinia pestis KIM
uuauguucauucucuacugaa

SEQ ID NO: 4202985 - RNA, 19 nt, Yersinia pestis KIM
uuauuaaacagauucaaua

SEQ ID NO: 4202986 - RNA, 21 nt, Yersinia pestis KIM
uuauuaaacagauucaauauu

SEQ ID NO: 4202987 - RNA, 16 nt, Yersinia pestis KIM
uuauuaaacagucuua

SEQ ID NO: 4202988 - RNA, 21 nt, Yersinia pestis KIM
uuauuaaauaagaaguagaau

SEQ ID NO: 4202989 - RNA, 22 nt, Yersinia pestis KIM
uuauuacuacaaacgcguuaau

SEQ ID NO: 4202990 - RNA, 15 nt, Yersinia pestis KIM
uuauuacucauuaug

SEQ ID NO: 4202991 - RNA, 12 nt, Yersinia pestis KIM
uuauuacugaua

SEQ ID NO: 4202992 - RNA, 14 nt, Yersinia pestis KIM
uuauuauguaaaua

SEQ ID NO: 4202993 - RNA, 12 nt, Yersinia pestis KIM
uuauuauugauu

SEQ ID NO: 4202994 - RNA, 13 nt, Yersinia pestis KIM
uuauucaauacug

SEQ ID NO: 4202995 - RNA, 15 nt, Yersinia pestis KIM
uuauucagcaacucg

SEQ ID NO: 4202996 - RNA, 17 nt, Yersinia pestis KIM
uuauucagcuucagcuc

SEQ ID NO: 4202997 - RNA, 19 nt, Yersinia pestis KIM
uuauucauaguuaagacaa

SEQ ID NO: 4202998 - RNA, 17 nt, Yersinia pestis KIM
uuauucugcucccaugu

SEQ ID NO: 4202999 - RNA, 21 nt, Yersinia pestis KIM
uuauucuuauuucgcgacuca

SEQ ID NO: 4203000 - RNA, 18 nt, Yersinia pestis KIM
uuauugacuguaaauauu

SEQ ID NO: 4203001 - RNA, 18 nt, Yersinia pestis KIM
uuauugaugagcuguaga

SEQ ID NO: 4203002 - RNA, 20 nt, Yersinia pestis KIM
uuauugcagugcguaaucag

SEQ ID NO: 4203003 - RNA, 18 nt, Yersinia pestis KIM
uuauuggaaguacuuauu

SEQ ID NO: 4203004 - RNA, 22 nt, Yersinia pestis KIM
uuauuggaaguacuuauuugaa

SEQ ID NO: 4203005 - RNA, 18 nt, Yersinia pestis KIM
uuauuggacaucaggcag

SEQ ID NO: 4203006 - RNA, 21 nt, Yersinia pestis KIM
uuauuggcuggcaaaguuauu

SEQ ID NO: 4203007 - RNA, 16 nt, Yersinia pestis KIM
uuauugggcugccugu

SEQ ID NO: 4203008 - RNA, 23 nt, Yersinia pestis KIM
uuauuggggacaggcuccuccuu

SEQ ID NO: 4203009 - RNA, 14 nt, Yersinia pestis KIM
uuauuguaagucag

SEQ ID NO: 4203010 - RNA, 16 nt, Yersinia pestis KIM
uuauugucuuuaauaa

SEQ ID NO: 4203011 - RNA, 21 nt, Yersinia pestis KIM
uuauugucuuuaauaaaauca

SEQ ID NO: 4203012 - RNA, 20 nt, Yersinia pestis KIM
uuauuuaagcaguucacucu

SEQ ID NO: 4203013 - RNA, 14 nt, Yersinia pestis KIM
uuauuuacaccgug

SEQ ID NO: 4203014 - RNA, 17 nt, Yersinia pestis KIM
uuauuuaccuguuugca

SEQ ID NO: 4203015 - RNA, 23 nt, Yersinia pestis KIM
uuauuuagagucuauaaugcuau

SEQ ID NO: 4203016 - RNA, 23 nt, Yersinia pestis KIM
uuauuuaggcuacagcuacugca

SEQ ID NO: 4203017 - RNA, 13 nt, Yersinia pestis KIM
uuauuuauaaaac

SEQ ID NO: 4203018 - RNA, 14 nt, Yersinia pestis KIM
uuauuuauagguau

SEQ ID NO: 4203019 - RNA, 23 nt, Yersinia pestis KIM
uuauuuauaugauaauaguucau

SEQ ID NO: 4203020 - RNA, 19 nt, Yersinia pestis KIM
uuauuucacgcuaauuauu

SEQ ID NO: 4203021 - RNA, 21 nt, Yersinia pestis KIM
uuauuucacuggaaaaagugu

SEQ ID NO: 4203022 - RNA, 17 nt, Yersinia pestis KIM
uuauuucgauucauuca

SEQ ID NO: 4203023 - RNA, 18 nt, Yersinia pestis KIM
uuauuucuguuccaggca

SEQ ID NO: 4203024 - RNA, 18 nt, Yersinia pestis KIM
uuauuugaaauacuuauu

SEQ ID NO: 4203025 - RNA, 13 nt, Yersinia pestis KIM
uuauuugaauaaa

SEQ ID NO: 4203026 - RNA, 13 nt, Yersinia pestis KIM
uuauuugaauaag

SEQ ID NO: 4203027 - RNA, 19 nt, Yersinia pestis KIM
uuauuugaguaagacaacu

SEQ ID NO: 4203028 - RNA, 23 nt, Yersinia pestis KIM
uuauuuggcucagcaagaacuca

SEQ ID NO: 4203029 - RNA, 13 nt, Yersinia pestis KIM
uuauuuucacuuu

SEQ ID NO: 4203030 - RNA, 15 nt, Yersinia pestis KIM
uuauuuucccuuucu

SEQ ID NO: 4203031 - RNA, 17 nt, Yersinia pestis KIM
uuauuuuggguauauag

SEQ ID NO: 4203032 - RNA, 21 nt, Yersinia pestis KIM
uuauuuuuaccaauuguauaa

SEQ ID NO: 4203033 - RNA, 22 nt, Yersinia pestis KIM
uuauuuuuggucguuuaaauaa

SEQ ID NO: 4203034 - RNA, 17 nt, Yersinia pestis KIM
uuauuuuuuuccagguc

SEQ ID NO: 4203035 - RNA, 19 nt, Yersinia pestis KIM
uucaaaaacgcacgaaaac

SEQ ID NO: 4203036 - RNA, 20 nt, Yersinia pestis KIM
uucaaaaacgcacgaaaaca

SEQ ID NO: 4203037 - RNA, 19 nt, Yersinia pestis KIM
uucaaaauagaggaaauaa

SEQ ID NO: 4203038 - RNA, 21 nt, Yersinia pestis KIM
uucaaaauagaggaaauaaau

SEQ ID NO: 4203039 - RNA, 20 nt, Yersinia pestis KIM
uucaaaauagucaguaaaau

SEQ ID NO: 4203040 - RNA, 15 nt, Yersinia pestis KIM
uucaaaaucaaaaau

SEQ ID NO: 4203041 - RNA, 21 nt, Yersinia pestis KIM
uucaaacaguacuucagguaa

SEQ ID NO: 4203042 - RNA, 12 nt, Yersinia pestis KIM
uucaaauacggc

SEQ ID NO: 4203043 - RNA, 17 nt, Yersinia pestis KIM
uucaaauagcugguuaa

SEQ ID NO: 4203044 - RNA, 22 nt, Yersinia pestis KIM
uucaaauagcugguuaauccgc

SEQ ID NO: 4203045 - RNA, 19 nt, Yersinia pestis KIM
uucaacaaauucaccagca

SEQ ID NO: 4203046 - RNA, 14 nt, Yersinia pestis KIM
uucaacaagaaauc

SEQ ID NO: 4203047 - RNA, 20 nt, Yersinia pestis KIM
uucaacacggugaauaaacc

SEQ ID NO: 4203048 - RNA, 13 nt, Yersinia pestis KIM
uucaaccucaauu

SEQ ID NO: 4203049 - RNA, 20 nt, Yersinia pestis KIM
uucaacgcaccauccagcaa

SEQ ID NO: 4203050 - RNA, 15 nt, Yersinia pestis KIM
uucaacgcauccaaa

SEQ ID NO: 4203051 - RNA, 23 nt, Yersinia pestis KIM
uucaacgcugcccgucaauauca

SEQ ID NO: 4203052 - RNA, 22 nt, Yersinia pestis KIM
uucaacguggaaguucagaucc

SEQ ID NO: 4203053 - RNA, 17 nt, Yersinia pestis KIM
uucaacugcucauccau

SEQ ID NO: 4203054 - RNA, 23 nt, Yersinia pestis KIM
uucaagacgggucgcguuggcua

SEQ ID NO: 4203055 - RNA, 20 nt, Yersinia pestis KIM
uucaagagcgauagaucgau

SEQ ID NO: 4203056 - RNA, 19 nt, Yersinia pestis KIM
uucaagagggcgguuaaau

SEQ ID NO: 4203057 - RNA, 18 nt, Yersinia pestis KIM
uucaagcccgaaauucag

SEQ ID NO: 4203058 - RNA, 20 nt, Yersinia pestis KIM
uucaagcccgaaauucaguu

SEQ ID NO: 4203059 - RNA, 19 nt, Yersinia pestis KIM
uucaagccgauaaucccug

SEQ ID NO: 4203060 - RNA, 17 nt, Yersinia pestis KIM
uucaagcguacaagaau

SEQ ID NO: 4203061 - RNA, 21 nt, Yersinia pestis KIM
uucaaggugacuauuuaaaua

SEQ ID NO: 4203062 - RNA, 22 nt, Yersinia pestis KIM
uucaauaaaacucacuugugug

SEQ ID NO: 4203063 - RNA, 20 nt, Yersinia pestis KIM
uucaauaauuauaccuaccc

SEQ ID NO: 4203064 - RNA, 22 nt, Yersinia pestis KIM
uucaauacccuaacucuuugga

SEQ ID NO: 4203065 - RNA, 21 nt, Yersinia pestis KIM
uucaauacuggccaugugugu

SEQ ID NO: 4203066 - RNA, 16 nt, Yersinia pestis KIM
uucaauaguuucauau

SEQ ID NO: 4203067 - RNA, 20 nt, Yersinia pestis KIM
uucaauaguuucauaugaaa

SEQ ID NO: 4203068 - RNA, 16 nt, Yersinia pestis KIM
uucaauccuacaauau

SEQ ID NO: 4203069 - RNA, 18 nt, Yersinia pestis KIM
uucaaugagcauaccggu

SEQ ID NO: 4203070 - RNA, 15 nt, Yersinia pestis KIM
uucaauggcugccca

SEQ ID NO: 4203071 - RNA, 22 nt, Yersinia pestis KIM
uucaauuaccgugguuauuggc

SEQ ID NO: 4203072 - RNA, 16 nt, Yersinia pestis KIM
uucaauuccugauauu

SEQ ID NO: 4203073 - RNA, 21 nt, Yersinia pestis KIM
uucaauugcccccuagugaug

SEQ ID NO: 4203074 - RNA, 22 nt, Yersinia pestis KIM
uucacaagccaaacaaaugaac

SEQ ID NO: 4203075 - RNA, 21 nt, Yersinia pestis KIM
uucacacgcccaggccauagc

SEQ ID NO: 4203076 - RNA, 19 nt, Yersinia pestis KIM
uucacacugguaguaaucg

SEQ ID NO: 4203077 - RNA, 12 nt, Yersinia pestis KIM
uucaccaaaaaa

SEQ ID NO: 4203078 - RNA, 14 nt, Yersinia pestis KIM
uucaccaaaaaaac

SEQ ID NO: 4203079 - RNA, 21 nt, Yersinia pestis KIM
uucaccaaaaaaaccaccaaa

SEQ ID NO: 4203080 - RNA, 19 nt, Yersinia pestis KIM
uucaccaaaggaagccgag

SEQ ID NO: 4203081 - RNA, 19 nt, Yersinia pestis KIM
uucaccacgauuagccaua

SEQ ID NO: 4203082 - RNA, 10 nt, Yersinia pestis KIM
uucaccagua

SEQ ID NO: 4203083 - RNA, 15 nt, Yersinia pestis KIM
uucaccaucugccug

SEQ ID NO: 4203084 - RNA, 14 nt, Yersinia pestis KIM
uucacccauuaaua

SEQ ID NO: 4203085 - RNA, 16 nt, Yersinia pestis KIM
uucacccauuaauaga

SEQ ID NO: 4203086 - RNA, 14 nt, Yersinia pestis KIM
uucacccuugauuu

SEQ ID NO: 4203087 - RNA, 15 nt, Yersinia pestis KIM
uucaccgauucgaug

SEQ ID NO: 4203088 - RNA, 14 nt, Yersinia pestis KIM
uucaccgcuggcaa

SEQ ID NO: 4203089 - RNA, 17 nt, Yersinia pestis KIM
uucaccgcuuuucuggu

SEQ ID NO: 4203090 - RNA, 23 nt, Yersinia pestis KIM
uucaccguaucaucaccaaacag

SEQ ID NO: 4203091 - RNA, 23 nt, Yersinia pestis KIM
uucaccgugacuguuaacaucca

SEQ ID NO: 4203092 - RNA, 22 nt, Yersinia pestis KIM
uucaccguuuccagaaucaaug

SEQ ID NO: 4203093 - RNA, 20 nt, Yersinia pestis KIM
uucaccuauaauuaacagca

SEQ ID NO: 4203094 - RNA, 17 nt, Yersinia pestis KIM
uucacgauggaaaaaau

SEQ ID NO: 4203095 - RNA, 17 nt, Yersinia pestis KIM
uucacgcccuacugaga

SEQ ID NO: 4203096 - RNA, 15 nt, Yersinia pestis KIM
uucacguacaacucg

SEQ ID NO: 4203097 - RNA, 15 nt, Yersinia pestis KIM
uucacguugguauac

SEQ ID NO: 4203098 - RNA, 20 nt, Yersinia pestis KIM
uucacguuuuuccauucgca

SEQ ID NO: 4203099 - RNA, 20 nt, Yersinia pestis KIM
uucacuauuuauuaaucuau

SEQ ID NO: 4203100 - RNA, 19 nt, Yersinia pestis KIM
uucacuccuugaaguguuu

SEQ ID NO: 4203101 - RNA, 19 nt, Yersinia pestis KIM
uucacucuguuuuaaaaaa

SEQ ID NO: 4203102 - RNA, 12 nt, Yersinia pestis KIM
uucacugaacca

SEQ ID NO: 4203103 - RNA, 15 nt, Yersinia pestis KIM
uucacugaaucccag

SEQ ID NO: 4203104 - RNA, 19 nt, Yersinia pestis KIM
uucacugaguugcaggaau

SEQ ID NO: 4203105 - RNA, 21 nt, Yersinia pestis KIM
uucacuggccuauuaagauaa

SEQ ID NO: 4203106 - RNA, 22 nt, Yersinia pestis KIM
uucacuggccuauuaagauaau

SEQ ID NO: 4203107 - RNA, 21 nt, Yersinia pestis KIM
uucacuggggagaucagugcc

SEQ ID NO: 4203108 - RNA, 13 nt, Yersinia pestis KIM
uucacugguuuuc

SEQ ID NO: 4203109 - RNA, 18 nt, Yersinia pestis KIM
uucacuuauucccacuua

SEQ ID NO: 4203110 - RNA, 22 nt, Yersinia pestis KIM
uucacuuuuuaucuaaacagua

SEQ ID NO: 4203111 - RNA, 20 nt, Yersinia pestis KIM
uucagacaguaaauccugau

SEQ ID NO: 4203112 - RNA, 20 nt, Yersinia pestis KIM
uucagacggcagauccugaa

SEQ ID NO: 4203113 - RNA, 21 nt, Yersinia pestis KIM
uucagacggcagauccugaac

SEQ ID NO: 4203114 - RNA, 19 nt, Yersinia pestis KIM
uucagacgguugcuagagc

SEQ ID NO: 4203115 - RNA, 17 nt, Yersinia pestis KIM
uucagacugaaaugaca

SEQ ID NO: 4203116 - RNA, 13 nt, Yersinia pestis KIM
uucagacugcuga

SEQ ID NO: 4203117 - RNA, 13 nt, Yersinia pestis KIM
uucagauuuacca

SEQ ID NO: 4203118 - RNA, 19 nt, Yersinia pestis KIM
uucagcaacgguuucaacu

SEQ ID NO: 4203119 - RNA, 16 nt, Yersinia pestis KIM
uucagcauaaauauuc

SEQ ID NO: 4203120 - RNA, 14 nt, Yersinia pestis KIM
uucagccaggcgau

SEQ ID NO: 4203121 - RNA, 23 nt, Yersinia pestis KIM
uucagcccauggcugaaauaacu

SEQ ID NO: 4203122 - RNA, 18 nt, Yersinia pestis KIM
uucagcguugacaccaga

SEQ ID NO: 4203123 - RNA, 19 nt, Yersinia pestis KIM
uucagcguuuugaucauca

SEQ ID NO: 4203124 - RNA, 22 nt, Yersinia pestis KIM
uucagcucuucuaacacuucau

SEQ ID NO: 4203125 - RNA, 23 nt, Yersinia pestis KIM
uucagcucuucuaacacuucaug

SEQ ID NO: 4203126 - RNA, 14 nt, Yersinia pestis KIM
uucagcuugcaaca

SEQ ID NO: 4203127 - RNA, 18 nt, Yersinia pestis KIM
uucaggaauaaacagcag

SEQ ID NO: 4203128 - RNA, 22 nt, Yersinia pestis KIM
uucaggaaugguguaaaugccc

SEQ ID NO: 4203129 - RNA, 18 nt, Yersinia pestis KIM
uucaggaucgaucuggau

SEQ ID NO: 4203130 - RNA, 20 nt, Yersinia pestis KIM
uucaggccaagugcuuuuuu

SEQ ID NO: 4203131 - RNA, 13 nt, Yersinia pestis KIM
uucaggccaauag

SEQ ID NO: 4203132 - RNA, 16 nt, Yersinia pestis KIM
uucaggccauccacgc

SEQ ID NO: 4203133 - RNA, 13 nt, Yersinia pestis KIM
uucaggcuuuuuu

SEQ ID NO: 4203134 - RNA, 13 nt, Yersinia pestis KIM
uucaggguacugu

SEQ ID NO: 4203135 - RNA, 15 nt, Yersinia pestis KIM
uucaguacauaaacc

SEQ ID NO: 4203136 - RNA, 16 nt, Yersinia pestis KIM
uucagucgcgauaaaa

SEQ ID NO: 4203137 - RNA, 19 nt, Yersinia pestis KIM
uucagugcgauguuuucca

SEQ ID NO: 4203138 - RNA, 22 nt, Yersinia pestis KIM
uucagugcgauguuuuccaacu

SEQ ID NO: 4203139 - RNA, 16 nt, Yersinia pestis KIM
uucaguuggccaccau

SEQ ID NO: 4203140 - RNA, 21 nt, Yersinia pestis KIM
uucaguuggccaccauucgcc

SEQ ID NO: 4203141 - RNA, 19 nt, Yersinia pestis KIM
uucaguuuauuuaagcuga

SEQ ID NO: 4203142 - RNA, 22 nt, Yersinia pestis KIM
uucauaauugaagaguugaucc

SEQ ID NO: 4203143 - RNA, 13 nt, Yersinia pestis KIM
uucauacaucauu

SEQ ID NO: 4203144 - RNA, 20 nt, Yersinia pestis KIM
uucauaccuuaauuaacucu

SEQ ID NO: 4203145 - RNA, 19 nt, Yersinia pestis KIM
uucauacgaucuuauuaau

SEQ ID NO: 4203146 - RNA, 19 nt, Yersinia pestis KIM
uucauacggcgauauuuau

SEQ ID NO: 4203147 - RNA, 21 nt, Yersinia pestis KIM
uucauacugccgaccauaucu

SEQ ID NO: 4203148 - RNA, 14 nt, Yersinia pestis KIM
uucauagaacuuaa

SEQ ID NO: 4203149 - RNA, 21 nt, Yersinia pestis KIM
uucauauccgaugauauaccc

SEQ ID NO: 4203150 - RNA, 13 nt, Yersinia pestis KIM
uucauaugacaaa

SEQ ID NO: 4203151 - RNA, 21 nt, Yersinia pestis KIM
uucauauucaugguuucaaaa

SEQ ID NO: 4203152 - RNA, 19 nt, Yersinia pestis KIM
uucauauuucacuguuaua

SEQ ID NO: 4203153 - RNA, 20 nt, Yersinia pestis KIM
uucaucacccaucaauaauu

SEQ ID NO: 4203154 - RNA, 15 nt, Yersinia pestis KIM
uucaucagcccagcg

SEQ ID NO: 4203155 - RNA, 18 nt, Yersinia pestis KIM
uucaucagcguuacccag

SEQ ID NO: 4203156 - RNA, 15 nt, Yersinia pestis KIM
uucaucaguaaaaua

SEQ ID NO: 4203157 - RNA, 21 nt, Yersinia pestis KIM
uucaucagucacuaaaccauu

SEQ ID NO: 4203158 - RNA, 11 nt, Yersinia pestis KIM
uucaucaucaa

SEQ ID NO: 4203159 - RNA, 13 nt, Yersinia pestis KIM
uucaucaucaaca

SEQ ID NO: 4203160 - RNA, 20 nt, Yersinia pestis KIM
uucaucauggauaaagccuu

SEQ ID NO: 4203161 - RNA, 18 nt, Yersinia pestis KIM
uucauccaacuuaccuug

SEQ ID NO: 4203162 - RNA, 17 nt, Yersinia pestis KIM
uucaucccaaucaucau

SEQ ID NO: 4203163 - RNA, 18 nt, Yersinia pestis KIM
uucaucccaaucaucauc

SEQ ID NO: 4203164 - RNA, 17 nt, Yersinia pestis KIM
uucauccuaaagauaau

SEQ ID NO: 4203165 - RNA, 18 nt, Yersinia pestis KIM
uucauccuaaagauaauu

SEQ ID NO: 4203166 - RNA, 22 nt, Yersinia pestis KIM
uucaucgcccuguaacuuuauu

SEQ ID NO: 4203167 - RNA, 21 nt, Yersinia pestis KIM
uucaucgcgaccaauucauca

SEQ ID NO: 4203168 - RNA, 13 nt, Yersinia pestis KIM
uucaucgcuuaac

SEQ ID NO: 4203169 - RNA, 21 nt, Yersinia pestis KIM
uucaucugcacugguaccuuu

SEQ ID NO: 4203170 - RNA, 20 nt, Yersinia pestis KIM
uucaucuuuaacaacaacca

SEQ ID NO: 4203171 - RNA, 15 nt, Yersinia pestis KIM
uucaugacaaauugc

SEQ ID NO: 4203172 - RNA, 22 nt, Yersinia pestis KIM
uucaugaggcucagacugcuga

SEQ ID NO: 4203173 - RNA, 14 nt, Yersinia pestis KIM
uucauguugcaaca

SEQ ID NO: 4203174 - RNA, 15 nt, Yersinia pestis KIM
uucauuaaaaaauaa

SEQ ID NO: 4203175 - RNA, 17 nt, Yersinia pestis KIM
uucauuaaaaaauaauu

SEQ ID NO: 4203176 - RNA, 18 nt, Yersinia pestis KIM
uucauugauucaucaacu

SEQ ID NO: 4203177 - RNA, 14 nt, Yersinia pestis KIM
uucauuucaggacu

SEQ ID NO: 4203178 - RNA, 12 nt, Yersinia pestis KIM
uucauuucaggu

SEQ ID NO: 4203179 - RNA, 14 nt, Yersinia pestis KIM
uucauuuugaccag

SEQ ID NO: 4203180 - RNA, 16 nt, Yersinia pestis KIM
uucauuuugcuggaaa

SEQ ID NO: 4203181 - RNA, 22 nt, Yersinia pestis KIM
uucauuuuuugggaugaaaaau

SEQ ID NO: 4203182 - RNA, 13 nt, Yersinia pestis KIM
uuccaaaaugcgu

SEQ ID NO: 4203183 - RNA, 16 nt, Yersinia pestis KIM
uuccaaaggaagggau

SEQ ID NO: 4203184 - RNA, 22 nt, Yersinia pestis KIM
uuccaaaugacagcaucaauau

SEQ ID NO: 4203185 - RNA, 21 nt, Yersinia pestis KIM
uuccaacaucucgccaaagua

SEQ ID NO: 4203186 - RNA, 20 nt, Yersinia pestis KIM
uuccaacugauaauucagug

SEQ ID NO: 4203187 - RNA, 13 nt, Yersinia pestis KIM
uuccaauauugag

SEQ ID NO: 4203188 - RNA, 16 nt, Yersinia pestis KIM
uuccaauuggugcuuu

SEQ ID NO: 4203189 - RNA, 16 nt, Yersinia pestis KIM
uuccacaauguugaua

SEQ ID NO: 4203190 - RNA, 17 nt, Yersinia pestis KIM
uuccacgcccaacucuu

SEQ ID NO: 4203191 - RNA, 21 nt, Yersinia pestis KIM
uuccacucuuucaaugauggc

SEQ ID NO: 4203192 - RNA, 12 nt, Yersinia pestis KIM
uuccagauaucc

SEQ ID NO: 4203193 - RNA, 11 nt, Yersinia pestis KIM
uuccagaucuu

SEQ ID NO: 4203194 - RNA, 18 nt, Yersinia pestis KIM
uuccagcaccccuucacc

SEQ ID NO: 4203195 - RNA, 12 nt, Yersinia pestis KIM
uuccagcggcaa

SEQ ID NO: 4203196 - RNA, 23 nt, Yersinia pestis KIM
uuccagcggcaaauagagcacca

SEQ ID NO: 4203197 - RNA, 18 nt, Yersinia pestis KIM
uuccaguucgauauuauu

SEQ ID NO: 4203198 - RNA, 23 nt, Yersinia pestis KIM
uuccauaaacggaacucaucuuu

SEQ ID NO: 4203199 - RNA, 18 nt, Yersinia pestis KIM
uuccauagccaggcagcc

SEQ ID NO: 4203200 - RNA, 22 nt, Yersinia pestis KIM
uuccauauugauauagcgguaa

SEQ ID NO: 4203201 - RNA, 23 nt, Yersinia pestis KIM
uuccaugcccagcguuggcagaa

SEQ ID NO: 4203202 - RNA, 20 nt, Yersinia pestis KIM
uuccauuuaagccaauaaua

SEQ ID NO: 4203203 - RNA, 18 nt, Yersinia pestis KIM
uuccauuuuauuuaacgu

SEQ ID NO: 4203204 - RNA, 12 nt, Yersinia pestis KIM
uucccaaaguga

SEQ ID NO: 4203205 - RNA, 18 nt, Yersinia pestis KIM
uucccaaucgauaauauu

SEQ ID NO: 4203206 - RNA, 21 nt, Yersinia pestis KIM
uucccaaucgauaauauuauu

SEQ ID NO: 4203207 - RNA, 18 nt, Yersinia pestis KIM
uucccacggguugccauu

SEQ ID NO: 4203208 - RNA, 13 nt, Yersinia pestis KIM
uucccagccacuc

SEQ ID NO: 4203209 - RNA, 20 nt, Yersinia pestis KIM
uucccaguaagcucuacuaa

SEQ ID NO: 4203210 - RNA, 23 nt, Yersinia pestis KIM
uucccaguaagcucuacuaauau

SEQ ID NO: 4203211 - RNA, 10 nt, Yersinia pestis KIM
uucccauuua

SEQ ID NO: 4203212 - RNA, 13 nt, Yersinia pestis KIM
uucccauuuaugg

SEQ ID NO: 4203213 - RNA, 22 nt, Yersinia pestis KIM
uuccccaccauugcaaacauca

SEQ ID NO: 4203214 - RNA, 12 nt, Yersinia pestis KIM
uuccccagccca

SEQ ID NO: 4203215 - RNA, 14 nt, Yersinia pestis KIM
uuccccccagucac

SEQ ID NO: 4203216 - RNA, 19 nt, Yersinia pestis KIM
uucccgauggaacaggauu

SEQ ID NO: 4203217 - RNA, 20 nt, Yersinia pestis KIM
uucccgauuauugugccgcc

SEQ ID NO: 4203218 - RNA, 18 nt, Yersinia pestis KIM
uucccggcgauucuccac

SEQ ID NO: 4203219 - RNA, 18 nt, Yersinia pestis KIM
uucccguaggcugaccac

SEQ ID NO: 4203220 - RNA, 20 nt, Yersinia pestis KIM
uucccuguucucuguuucca

SEQ ID NO: 4203221 - RNA, 17 nt, Yersinia pestis KIM
uucccuucaggaucuuu

SEQ ID NO: 4203222 - RNA, 18 nt, Yersinia pestis KIM
uucccuuguuugcgccgu

SEQ ID NO: 4203223 - RNA, 17 nt, Yersinia pestis KIM
uuccgagcaaucaaaag

SEQ ID NO: 4203224 - RNA, 17 nt, Yersinia pestis KIM
uuccgauaaccagaccg

SEQ ID NO: 4203225 - RNA, 18 nt, Yersinia pestis KIM
uuccgccgccaacaguga

SEQ ID NO: 4203226 - RNA, 20 nt, Yersinia pestis KIM
uuccgccgccaacagugaau

SEQ ID NO: 4203227 - RNA, 21 nt, Yersinia pestis KIM
uuccgccucuuuuuccacacc

SEQ ID NO: 4203228 - RNA, 22 nt, Yersinia pestis KIM
uuccgcgcaggauuucaauaua

SEQ ID NO: 4203229 - RNA, 15 nt, Yersinia pestis KIM
uuccgcuggacaacu

SEQ ID NO: 4203230 - RNA, 10 nt, Yersinia pestis KIM
uuccggcgua

SEQ ID NO: 4203231 - RNA, 21 nt, Yersinia pestis KIM
uuccggcugcgccauaugcca

SEQ ID NO: 4203232 - RNA, 23 nt, Yersinia pestis KIM
uuccguuauuaaacagucuuauu

SEQ ID NO: 4203233 - RNA, 21 nt, Yersinia pestis KIM
uuccucccagaauaauaagcc

SEQ ID NO: 4203234 - RNA, 14 nt, Yersinia pestis KIM
uuccucgugaaaaa

SEQ ID NO: 4203235 - RNA, 22 nt, Yersinia pestis KIM
uuccucgugaaaaauaauguuc

SEQ ID NO: 4203236 - RNA, 17 nt, Yersinia pestis KIM
uuccucugugacucuau

SEQ ID NO: 4203237 - RNA, 19 nt, Yersinia pestis KIM
uuccugaauggcaucaccg

SEQ ID NO: 4203238 - RNA, 15 nt, Yersinia pestis KIM
uuccugccaacaacu

SEQ ID NO: 4203239 - RNA, 20 nt, Yersinia pestis KIM
uuccugcgccacgcuuuagc

SEQ ID NO: 4203240 - RNA, 18 nt, Yersinia pestis KIM
uuccugggccaguuucca

SEQ ID NO: 4203241 - RNA, 16 nt, Yersinia pestis KIM
uuccuuaccugaugug

SEQ ID NO: 4203242 - RNA, 18 nt, Yersinia pestis KIM
uuccuugcucucuucaua

SEQ ID NO: 4203243 - RNA, 14 nt, Yersinia pestis KIM
uuccuuugcccuua

SEQ ID NO: 4203244 - RNA, 22 nt, Yersinia pestis KIM
uuccuuugcccuuacuauuuuu

SEQ ID NO: 4203245 - RNA, 15 nt, Yersinia pestis KIM
uucgaaagaaauaaa

SEQ ID NO: 4203246 - RNA, 22 nt, Yersinia pestis KIM
uucgaaagaaauaaaagaaaac

SEQ ID NO: 4203247 - RNA, 23 nt, Yersinia pestis KIM
uucgaaagaaauaaaagaaaacc

SEQ ID NO: 4203248 - RNA, 21 nt, Yersinia pestis KIM
uucgacaucagguuguauuuu

SEQ ID NO: 4203249 - RNA, 13 nt, Yersinia pestis KIM
uucgacauucucu

SEQ ID NO: 4203250 - RNA, 17 nt, Yersinia pestis KIM
uucgaccaaacguuuua

SEQ ID NO: 4203251 - RNA, 15 nt, Yersinia pestis KIM
uucgagcaacuuuua

SEQ ID NO: 4203252 - RNA, 15 nt, Yersinia pestis KIM
uucgagcaccgcgcu

SEQ ID NO: 4203253 - RNA, 15 nt, Yersinia pestis KIM
uucgaguugaacuca

SEQ ID NO: 4203254 - RNA, 18 nt, Yersinia pestis KIM
uucgaguugaacucauau

SEQ ID NO: 4203255 - RNA, 13 nt, Yersinia pestis KIM
uucgauaacagcu

SEQ ID NO: 4203256 - RNA, 19 nt, Yersinia pestis KIM
uucgauagucagcuucacu

SEQ ID NO: 4203257 - RNA, 22 nt, Yersinia pestis KIM
uucgauaugaucagauuucuga

SEQ ID NO: 4203258 - RNA, 14 nt, Yersinia pestis KIM
uucgaucaaaacaa

SEQ ID NO: 4203259 - RNA, 13 nt, Yersinia pestis KIM
uucgaugauuauu

SEQ ID NO: 4203260 - RNA, 16 nt, Yersinia pestis KIM
uucgcaaaauuuauau

SEQ ID NO: 4203261 - RNA, 23 nt, Yersinia pestis KIM
uucgcaaagcgggccagcaacca

SEQ ID NO: 4203262 - RNA, 13 nt, Yersinia pestis KIM
uucgcaagaagcg

SEQ ID NO: 4203263 - RNA, 16 nt, Yersinia pestis KIM
uucgcacuuuaaauac

SEQ ID NO: 4203264 - RNA, 18 nt, Yersinia pestis KIM
uucgcagaccaaauuccc

SEQ ID NO: 4203265 - RNA, 15 nt, Yersinia pestis KIM
uucgcagccaaaaua

SEQ ID NO: 4203266 - RNA, 19 nt, Yersinia pestis KIM
uucgcagccaaaauaauca

SEQ ID NO: 4203267 - RNA, 16 nt, Yersinia pestis KIM
uucgcagcuuccagca

SEQ ID NO: 4203268 - RNA, 23 nt, Yersinia pestis KIM
uucgcaggauugauuaaccgauu

SEQ ID NO: 4203269 - RNA, 22 nt, Yersinia pestis KIM
uucgcauaggguucuagagcau

SEQ ID NO: 4203270 - RNA, 15 nt, Yersinia pestis KIM
uucgcaucuuccaaa

SEQ ID NO: 4203271 - RNA, 19 nt, Yersinia pestis KIM
uucgcauucgugccauaaa

SEQ ID NO: 4203272 - RNA, 11 nt, Yersinia pestis KIM
uucgccccuua

SEQ ID NO: 4203273 - RNA, 13 nt, Yersinia pestis KIM
uucgcgaacacaa

SEQ ID NO: 4203274 - RNA, 17 nt, Yersinia pestis KIM
uucgcgaucagacauuu

SEQ ID NO: 4203275 - RNA, 19 nt, Yersinia pestis KIM
uucgcuauuucucucuacu

SEQ ID NO: 4203276 - RNA, 17 nt, Yersinia pestis KIM
uucgcugcuaaacaggg

SEQ ID NO: 4203277 - RNA, 17 nt, Yersinia pestis KIM
uucgcuggucauaauca

SEQ ID NO: 4203278 - RNA, 15 nt, Yersinia pestis KIM
uucggacaggaaaac

SEQ ID NO: 4203279 - RNA, 13 nt, Yersinia pestis KIM
uucggccacccgc

SEQ ID NO: 4203280 - RNA, 17 nt, Yersinia pestis KIM
uucggcgucgccacccc

SEQ ID NO: 4203281 - RNA, 18 nt, Yersinia pestis KIM
uucggcuuucucuugcca

SEQ ID NO: 4203282 - RNA, 17 nt, Yersinia pestis KIM
uucggguaucuguuuuu

SEQ ID NO: 4203283 - RNA, 22 nt, Yersinia pestis KIM
uucgggugagugagcgcaggua

SEQ ID NO: 4203284 - RNA, 13 nt, Yersinia pestis KIM
uucgguaaucaau

SEQ ID NO: 4203285 - RNA, 15 nt, Yersinia pestis KIM
uucggugcaaaaccc

SEQ ID NO: 4203286 - RNA, 13 nt, Yersinia pestis KIM
uucgguggcccug

SEQ ID NO: 4203287 - RNA, 18 nt, Yersinia pestis KIM
uucguaggccgcuuuagu

SEQ ID NO: 4203288 - RNA, 16 nt, Yersinia pestis KIM
uucgucagugaugaca

SEQ ID NO: 4203289 - RNA, 23 nt, Yersinia pestis KIM
uucgucgcgaauagccaagccuu

SEQ ID NO: 4203290 - RNA, 19 nt, Yersinia pestis KIM
uucgucuucgcccagauca

SEQ ID NO: 4203291 - RNA, 11 nt, Yersinia pestis KIM
uucgugaaagc

SEQ ID NO: 4203292 - RNA, 12 nt, Yersinia pestis KIM
uucgugaaagca

SEQ ID NO: 4203293 - RNA, 22 nt, Yersinia pestis KIM
uucguggaaaucgggugauaaa

SEQ ID NO: 4203294 - RNA, 13 nt, Yersinia pestis KIM
uucguguauauca

SEQ ID NO: 4203295 - RNA, 16 nt, Yersinia pestis KIM
uucguguauaucacua

SEQ ID NO: 4203296 - RNA, 16 nt, Yersinia pestis KIM
uucguuagcucuucac

SEQ ID NO: 4203297 - RNA, 16 nt, Yersinia pestis KIM
uucguuuacuugaugg

SEQ ID NO: 4203298 - RNA, 13 nt, Yersinia pestis KIM
uucguuucugucu

SEQ ID NO: 4203299 - RNA, 17 nt, Yersinia pestis KIM
uucuaacacuucaugac

SEQ ID NO: 4203300 - RNA, 19 nt, Yersinia pestis KIM
uucuaaguaaaacaaagua

SEQ ID NO: 4203301 - RNA, 14 nt, Yersinia pestis KIM
uucuaauuauuaaa

SEQ ID NO: 4203302 - RNA, 17 nt, Yersinia pestis KIM
uucuaauugauauuauu

SEQ ID NO: 4203303 - RNA, 16 nt, Yersinia pestis KIM
uucuacagggaaaaac

SEQ ID NO: 4203304 - RNA, 16 nt, Yersinia pestis KIM
uucuacugaauaaaca

SEQ ID NO: 4203305 - RNA, 19 nt, Yersinia pestis KIM
uucuacugaauaaacacca

SEQ ID NO: 4203306 - RNA, 16 nt, Yersinia pestis KIM
uucuacugcguccuuu

SEQ ID NO: 4203307 - RNA, 24 nt, Yersinia pestis KIM
uucuaguauucaggaaugcucuuu

SEQ ID NO: 4203308 - RNA, 15 nt, Yersinia pestis KIM
uucuaucaaugccuu

SEQ ID NO: 4203309 - RNA, 17 nt, Yersinia pestis KIM
uucuauccgaaaaauau

SEQ ID NO: 4203310 - RNA, 23 nt, Yersinia pestis KIM
uucuauccgaaaaauauucucaa

SEQ ID NO: 4203311 - RNA, 18 nt, Yersinia pestis KIM
uucuaucgggcagguaaa

SEQ ID NO: 4203312 - RNA, 23 nt, Yersinia pestis KIM
uucuaucgggcagguaaauccuu

SEQ ID NO: 4203313 - RNA, 13 nt, Yersinia pestis KIM
uucuauuacccuu

SEQ ID NO: 4203314 - RNA, 17 nt, Yersinia pestis KIM
uucucaauggcuuuuuu

SEQ ID NO: 4203315 - RNA, 19 nt, Yersinia pestis KIM
uucucagaaaagguauauu

SEQ ID NO: 4203316 - RNA, 13 nt, Yersinia pestis KIM
uucucagcaaggu

SEQ ID NO: 4203317 - RNA, 13 nt, Yersinia pestis KIM
uucuccaacaacu

SEQ ID NO: 4203318 - RNA, 19 nt, Yersinia pestis KIM
uucuccaacaacugccccu

SEQ ID NO: 4203319 - RNA, 15 nt, Yersinia pestis KIM
uucuccacaccaacg

SEQ ID NO: 4203320 - RNA, 14 nt, Yersinia pestis KIM
uucuccaguugcca

SEQ ID NO: 4203321 - RNA, 20 nt, Yersinia pestis KIM
uucuccccacuucaucauca

SEQ ID NO: 4203322 - RNA, 17 nt, Yersinia pestis KIM
uucuccgcgcaaccugg

SEQ ID NO: 4203323 - RNA, 23 nt, Yersinia pestis KIM
uucuccugcgguggccagagcau

SEQ ID NO: 4203324 - RNA, 18 nt, Yersinia pestis KIM
uucucgacauccaauuca

SEQ ID NO: 4203325 - RNA, 17 nt, Yersinia pestis KIM
uucucuacaucauaacg

SEQ ID NO: 4203326 - RNA, 24 nt, Yersinia pestis KIM
uucucuacugaauggaucacauca

SEQ ID NO: 4203327 - RNA, 22 nt, Yersinia pestis KIM
uucucugaugaacggagaugau

SEQ ID NO: 4203328 - RNA, 20 nt, Yersinia pestis KIM
uucucuggcacgcuuucugc

SEQ ID NO: 4203329 - RNA, 17 nt, Yersinia pestis KIM
uucucuggcuaaugucu

SEQ ID NO: 4203330 - RNA, 13 nt, Yersinia pestis KIM
uucucuuuaucaa

SEQ ID NO: 4203331 - RNA, 15 nt, Yersinia pestis KIM
uucugagauauguag

SEQ ID NO: 4203332 - RNA, 14 nt, Yersinia pestis KIM
uucugauaaaacag

SEQ ID NO: 4203333 - RNA, 23 nt, Yersinia pestis KIM
uucugaucguugccgcuaauucu

SEQ ID NO: 4203334 - RNA, 20 nt, Yersinia pestis KIM
uucugauuuuuuacuuuuuc

SEQ ID NO: 4203335 - RNA, 17 nt, Yersinia pestis KIM
uucugcauaagcaucag

SEQ ID NO: 4203336 - RNA, 21 nt, Yersinia pestis KIM
uucugccacaccgucaucucu

SEQ ID NO: 4203337 - RNA, 16 nt, Yersinia pestis KIM
uucugccuauccucac

SEQ ID NO: 4203338 - RNA, 21 nt, Yersinia pestis KIM
uucugcgaauuagucucuuau

SEQ ID NO: 4203339 - RNA, 14 nt, Yersinia pestis KIM
uucugcgacuuuau

SEQ ID NO: 4203340 - RNA, 14 nt, Yersinia pestis KIM
uucugcgagcguuu

SEQ ID NO: 4203341 - RNA, 20 nt, Yersinia pestis KIM
uucugcucccaugucagaca

SEQ ID NO: 4203342 - RNA, 11 nt, Yersinia pestis KIM
uucugcugcca

SEQ ID NO: 4203343 - RNA, 13 nt, Yersinia pestis KIM
uucuggauuugau

SEQ ID NO: 4203344 - RNA, 23 nt, Yersinia pestis KIM
uucuggggcgguuuuccucuuua

SEQ ID NO: 4203345 - RNA, 18 nt, Yersinia pestis KIM
uucuggguacaacacaaa

SEQ ID NO: 4203346 - RNA, 15 nt, Yersinia pestis KIM
uucuggugagcauca

SEQ ID NO: 4203347 - RNA, 13 nt, Yersinia pestis KIM
uucugucaucaag

SEQ ID NO: 4203348 - RNA, 21 nt, Yersinia pestis KIM
uucugugcuugaguccaacca

SEQ ID NO: 4203349 - RNA, 13 nt, Yersinia pestis KIM
uucuguucagauu

SEQ ID NO: 4203350 - RNA, 15 nt, Yersinia pestis KIM
uucuguucagcauaa

SEQ ID NO: 4203351 - RNA, 13 nt, Yersinia pestis KIM
uucuguuccaggc

SEQ ID NO: 4203352 - RNA, 16 nt, Yersinia pestis KIM
uucuguuccaggcaag

SEQ ID NO: 4203353 - RNA, 22 nt, Yersinia pestis KIM
uucuguugcuucacggacagca

SEQ ID NO: 4203354 - RNA, 14 nt, Yersinia pestis KIM
uucuguuuugugcg

SEQ ID NO: 4203355 - RNA, 14 nt, Yersinia pestis KIM
uucuuaauaauauc

SEQ ID NO: 4203356 - RNA, 15 nt, Yersinia pestis KIM
uucuuacuaaaauau

SEQ ID NO: 4203357 - RNA, 17 nt, Yersinia pestis KIM
uucuuacuaaaauauca

SEQ ID NO: 4203358 - RNA, 14 nt, Yersinia pestis KIM
uucuuacuguuuuc

SEQ ID NO: 4203359 - RNA, 17 nt, Yersinia pestis KIM
uucuuaggucaucguca

SEQ ID NO: 4203360 - RNA, 18 nt, Yersinia pestis KIM
uucuuaucaaucaaaaaa

SEQ ID NO: 4203361 - RNA, 14 nt, Yersinia pestis KIM
uucuuaucgauacu

SEQ ID NO: 4203362 - RNA, 13 nt, Yersinia pestis KIM
uucuucacgaaga

SEQ ID NO: 4203363 - RNA, 19 nt, Yersinia pestis KIM
uucuucauaacgcuuuuuc

SEQ ID NO: 4203364 - RNA, 21 nt, Yersinia pestis KIM
uucuucauugcugcuguuauu

SEQ ID NO: 4203365 - RNA, 18 nt, Yersinia pestis KIM
uucuuccaagaaugcaga

SEQ ID NO: 4203366 - RNA, 14 nt, Yersinia pestis KIM
uucuucgaucaacg

SEQ ID NO: 4203367 - RNA, 15 nt, Yersinia pestis KIM
uucuucucucacuuu

SEQ ID NO: 4203368 - RNA, 20 nt, Yersinia pestis KIM
uucuucugggucuaucaggu

SEQ ID NO: 4203369 - RNA, 14 nt, Yersinia pestis KIM
uucuugauaccaua

SEQ ID NO: 4203370 - RNA, 21 nt, Yersinia pestis KIM
uucuuggaacaggccaaagcu

SEQ ID NO: 4203371 - RNA, 21 nt, Yersinia pestis KIM
uucuugguacaaggucuugga

SEQ ID NO: 4203372 - RNA, 12 nt, Yersinia pestis KIM
uucuuguauaua

SEQ ID NO: 4203373 - RNA, 22 nt, Yersinia pestis KIM
uucuugucaccugaguaauauu

SEQ ID NO: 4203374 - RNA, 20 nt, Yersinia pestis KIM
uucuuuauacccaaaauaau

SEQ ID NO: 4203375 - RNA, 14 nt, Yersinia pestis KIM
uucuuuaugacaag

SEQ ID NO: 4203376 - RNA, 13 nt, Yersinia pestis KIM
uucuuucaacgca

SEQ ID NO: 4203377 - RNA, 13 nt, Yersinia pestis KIM
uucuuucaggcug

SEQ ID NO: 4203378 - RNA, 11 nt, Yersinia pestis KIM
uucuuucuuca

SEQ ID NO: 4203379 - RNA, 16 nt, Yersinia pestis KIM
uucuuucuucagcggu

SEQ ID NO: 4203380 - RNA, 16 nt, Yersinia pestis KIM
uucuuuggcaucaaug

SEQ ID NO: 4203381 - RNA, 21 nt, Yersinia pestis KIM
uucuuuucucccuuucacuuu

SEQ ID NO: 4203382 - RNA, 15 nt, Yersinia pestis KIM
uugaaaaguuuuuug

SEQ ID NO: 4203383 - RNA, 19 nt, Yersinia pestis KIM
uugaaaguuuauaugcuug

SEQ ID NO: 4203384 - RNA, 16 nt, Yersinia pestis KIM
uugaaauaacugccag

SEQ ID NO: 4203385 - RNA, 22 nt, Yersinia pestis KIM
uugaaauaagaggcaaagguaa

SEQ ID NO: 4203386 - RNA, 14 nt, Yersinia pestis KIM
uugaaaucagauca

SEQ ID NO: 4203387 - RNA, 16 nt, Yersinia pestis KIM
uugaaaucagaucaac

SEQ ID NO: 4203388 - RNA, 14 nt, Yersinia pestis KIM
uugaacaaacccca

SEQ ID NO: 4203389 - RNA, 18 nt, Yersinia pestis KIM
uugaacauucaucuuuug

SEQ ID NO: 4203390 - RNA, 20 nt, Yersinia pestis KIM
uugaaccaauuuuucuguau

SEQ ID NO: 4203391 - RNA, 11 nt, Yersinia pestis KIM
uugaaccauaa

SEQ ID NO: 4203392 - RNA, 18 nt, Yersinia pestis KIM
uugaaccgcuaucugcug

SEQ ID NO: 4203393 - RNA, 20 nt, Yersinia pestis KIM
uugaaccguaugcuuucauc

SEQ ID NO: 4203394 - RNA, 13 nt, Yersinia pestis KIM
uugaacgacaugu

SEQ ID NO: 4203395 - RNA, 20 nt, Yersinia pestis KIM
uugaacgacaugugaguggu

SEQ ID NO: 4203396 - RNA, 16 nt, Yersinia pestis KIM
uugaacggugaggaua

SEQ ID NO: 4203397 - RNA, 21 nt, Yersinia pestis KIM
uugaacggugaggauaggcag

SEQ ID NO: 4203398 - RNA, 11 nt, Yersinia pestis KIM
uugaagauacc

SEQ ID NO: 4203399 - RNA, 18 nt, Yersinia pestis KIM
uugaagauucaaccaauu

SEQ ID NO: 4203400 - RNA, 16 nt, Yersinia pestis KIM
uugaagauuuaaauaa

SEQ ID NO: 4203401 - RNA, 15 nt, Yersinia pestis KIM
uugaagcagauaaag

SEQ ID NO: 4203402 - RNA, 22 nt, Yersinia pestis KIM
uugaaguacggugccagcagca

SEQ ID NO: 4203403 - RNA, 22 nt, Yersinia pestis KIM
uugaagugcgaagcgcacccaa

SEQ ID NO: 4203404 - RNA, 16 nt, Yersinia pestis KIM
uugaauuaaauuuuau

SEQ ID NO: 4203405 - RNA, 17 nt, Yersinia pestis KIM
uugaauuaaauuuuaua

SEQ ID NO: 4203406 - RNA, 19 nt, Yersinia pestis KIM
uugaauucaagaaggccgu

SEQ ID NO: 4203407 - RNA, 13 nt, Yersinia pestis KIM
uugaauuuuuaua

SEQ ID NO: 4203408 - RNA, 18 nt, Yersinia pestis KIM
uugaauuuuuauaauuaa

SEQ ID NO: 4203409 - RNA, 17 nt, Yersinia pestis KIM
uugaccaauaaaaugca

SEQ ID NO: 4203410 - RNA, 19 nt, Yersinia pestis KIM
uugaccgacgcugaacuga

SEQ ID NO: 4203411 - RNA, 22 nt, Yersinia pestis KIM
uugaccgcuguuugauuaaaac

SEQ ID NO: 4203412 - RNA, 15 nt, Yersinia pestis KIM
uugaccggucacacc

SEQ ID NO: 4203413 - RNA, 13 nt, Yersinia pestis KIM
uugaccugaagaa

SEQ ID NO: 4203414 - RNA, 17 nt, Yersinia pestis KIM
uugacgguuuucugaau

SEQ ID NO: 4203415 - RNA, 20 nt, Yersinia pestis KIM
uugacugaccauaaaaggau

SEQ ID NO: 4203416 - RNA, 15 nt, Yersinia pestis KIM
uugacuuaacaguua

SEQ ID NO: 4203417 - RNA, 17 nt, Yersinia pestis KIM
uugacuuuaaaaaaauu

SEQ ID NO: 4203418 - RNA, 17 nt, Yersinia pestis KIM
uugagauaaucacugag

SEQ ID NO: 4203419 - RNA, 22 nt, Yersinia pestis KIM
uugagauagucauuuuauuuag

SEQ ID NO: 4203420 - RNA, 11 nt, Yersinia pestis KIM
uugagcagcaa

SEQ ID NO: 4203421 - RNA, 14 nt, Yersinia pestis KIM
uugagcauauucag

SEQ ID NO: 4203422 - RNA, 21 nt, Yersinia pestis KIM
uugagccaccgcauuccagcg

SEQ ID NO: 4203423 - RNA, 23 nt, Yersinia pestis KIM
uugagcggugaauacguucaaau

SEQ ID NO: 4203424 - RNA, 15 nt, Yersinia pestis KIM
uugagcuauuucuug

SEQ ID NO: 4203425 - RNA, 13 nt, Yersinia pestis KIM
uugagcucagcca

SEQ ID NO: 4203426 - RNA, 15 nt, Yersinia pestis KIM
uugaggaaauuucag

SEQ ID NO: 4203427 - RNA, 17 nt, Yersinia pestis KIM
uugaggaaauuucaguu

SEQ ID NO: 4203428 - RNA, 19 nt, Yersinia pestis KIM
uugaggcaggguauauguu

SEQ ID NO: 4203429 - RNA, 19 nt, Yersinia pestis KIM
uugagggcgucucuacgac

SEQ ID NO: 4203430 - RNA, 16 nt, Yersinia pestis KIM
uugaggguugucagca

SEQ ID NO: 4203431 - RNA, 23 nt, Yersinia pestis KIM
uugaguacgcuaagacauuagga

SEQ ID NO: 4203432 - RNA, 14 nt, Yersinia pestis KIM
uugaguauacuaaa

SEQ ID NO: 4203433 - RNA, 18 nt, Yersinia pestis KIM
uugagucgcgacaucaug

SEQ ID NO: 4203434 - RNA, 23 nt, Yersinia pestis KIM
uugaguuuaacgccgacuuuauu

SEQ ID NO: 4203435 - RNA, 17 nt, Yersinia pestis KIM
uugauacaguaauuaag

SEQ ID NO: 4203436 - RNA, 13 nt, Yersinia pestis KIM
uugauacagugau

SEQ ID NO: 4203437 - RNA, 19 nt, Yersinia pestis KIM
uugauacggcuuacuuuua

SEQ ID NO: 4203438 - RNA, 16 nt, Yersinia pestis KIM
uugauaguuaccaugg

SEQ ID NO: 4203439 - RNA, 13 nt, Yersinia pestis KIM
uugauauauagaa

SEQ ID NO: 4203440 - RNA, 18 nt, Yersinia pestis KIM
uugauaucuucggcggcu

SEQ ID NO: 4203441 - RNA, 20 nt, Yersinia pestis KIM
uugauaugcuucacaucaua

SEQ ID NO: 4203442 - RNA, 15 nt, Yersinia pestis KIM
uugauauuauuuaua

SEQ ID NO: 4203443 - RNA, 16 nt, Yersinia pestis KIM
uugauauuauuuauau

SEQ ID NO: 4203444 - RNA, 18 nt, Yersinia pestis KIM
uugaucaaacgaaacuaa

SEQ ID NO: 4203445 - RNA, 22 nt, Yersinia pestis KIM
uugaucaguaaacgguugcugu

SEQ ID NO: 4203446 - RNA, 22 nt, Yersinia pestis KIM
uugauccucguuagucacucaa

SEQ ID NO: 4203447 - RNA, 11 nt, Yersinia pestis KIM
uugaucuaccu

SEQ ID NO: 4203448 - RNA, 22 nt, Yersinia pestis KIM
uugaucugaguuucauuaguca

SEQ ID NO: 4203449 - RNA, 14 nt, Yersinia pestis KIM
uugaugaaguuauu

SEQ ID NO: 4203450 - RNA, 16 nt, Yersinia pestis KIM
uugaugaguaaacaga

SEQ ID NO: 4203451 - RNA, 13 nt, Yersinia pestis KIM
uugaugaucgcag

SEQ ID NO: 4203452 - RNA, 17 nt, Yersinia pestis KIM
uugaugcaaaaccguac

SEQ ID NO: 4203453 - RNA, 18 nt, Yersinia pestis KIM
uugaugcagugaggguaa

SEQ ID NO: 4203454 - RNA, 15 nt, Yersinia pestis KIM
uugaugcauauguag

SEQ ID NO: 4203455 - RNA, 14 nt, Yersinia pestis KIM
uugaugccaaggcc

SEQ ID NO: 4203456 - RNA, 18 nt, Yersinia pestis KIM
uugaugcucauuuaaaau

SEQ ID NO: 4203457 - RNA, 17 nt, Yersinia pestis KIM
uugaugcucuucuucac

SEQ ID NO: 4203458 - RNA, 11 nt, Yersinia pestis KIM
uugauggcugu

SEQ ID NO: 4203459 - RNA, 20 nt, Yersinia pestis KIM
uugauggcugucuauugauu

SEQ ID NO: 4203460 - RNA, 20 nt, Yersinia pestis KIM
uugaugguuauguguauuug

SEQ ID NO: 4203461 - RNA, 23 nt, Yersinia pestis KIM
uugaugucgggugguugucuaug

SEQ ID NO: 4203462 - RNA, 16 nt, Yersinia pestis KIM
uugauuaauuuuucau

SEQ ID NO: 4203463 - RNA, 16 nt, Yersinia pestis KIM
uugauuacaaaauaua

SEQ ID NO: 4203464 - RNA, 20 nt, Yersinia pestis KIM
uugauuaggcaugauaagca

SEQ ID NO: 4203465 - RNA, 16 nt, Yersinia pestis KIM
uugauuauaugcguuu

SEQ ID NO: 4203466 - RNA, 19 nt, Yersinia pestis KIM
uugauuaucaaguuaaaua

SEQ ID NO: 4203467 - RNA, 12 nt, Yersinia pestis KIM
uugauucaccag

SEQ ID NO: 4203468 - RNA, 22 nt, Yersinia pestis KIM
uugauuccucugugacucuauu

SEQ ID NO: 4203469 - RNA, 13 nt, Yersinia pestis KIM
uugauugauaacg

SEQ ID NO: 4203470 - RNA, 17 nt, Yersinia pestis KIM
uugauugcugacaaacc

SEQ ID NO: 4203471 - RNA, 15 nt, Yersinia pestis KIM
uugauuuguuaaaac

SEQ ID NO: 4203472 - RNA, 18 nt, Yersinia pestis KIM
uugauuuguuaaaacagu

SEQ ID NO: 4203473 - RNA, 18 nt, Yersinia pestis KIM
uugcaaacggauaauguu

SEQ ID NO: 4203474 - RNA, 19 nt, Yersinia pestis KIM
uugcaacaacgccagauaa

SEQ ID NO: 4203475 - RNA, 18 nt, Yersinia pestis KIM
uugcaacauuauccguuu

SEQ ID NO: 4203476 - RNA, 22 nt, Yersinia pestis KIM
uugcaacauuauccguuugcaa

SEQ ID NO: 4203477 - RNA, 23 nt, Yersinia pestis KIM
uugcaaccuacgccauuaaaagg

SEQ ID NO: 4203478 - RNA, 22 nt, Yersinia pestis KIM
uugcaacgcaggcacugcagaa

SEQ ID NO: 4203479 - RNA, 23 nt, Yersinia pestis KIM
uugcaacugggcgacaaucaaug

SEQ ID NO: 4203480 - RNA, 18 nt, Yersinia pestis KIM
uugcaauucauguugcca

SEQ ID NO: 4203481 - RNA, 22 nt, Yersinia pestis KIM
uugcacaaagcuuacuguucac

SEQ ID NO: 4203482 - RNA, 21 nt, Yersinia pestis KIM
uugcacacccauacauaccag

SEQ ID NO: 4203483 - RNA, 15 nt, Yersinia pestis KIM
uugcaccuuugcgag

SEQ ID NO: 4203484 - RNA, 13 nt, Yersinia pestis KIM
uugcacugcaggg

SEQ ID NO: 4203485 - RNA, 22 nt, Yersinia pestis KIM
uugcagcaagccgauaaucaau

SEQ ID NO: 4203486 - RNA, 12 nt, Yersinia pestis KIM
uugcagcggaac

SEQ ID NO: 4203487 - RNA, 21 nt, Yersinia pestis KIM
uugcaggcacuuugucaauaa

SEQ ID NO: 4203488 - RNA, 14 nt, Yersinia pestis KIM
uugcaguauuuugg

SEQ ID NO: 4203489 - RNA, 14 nt, Yersinia pestis KIM
uugcagugcguaau

SEQ ID NO: 4203490 - RNA, 19 nt, Yersinia pestis KIM
uugcaguggaugauaaaua

SEQ ID NO: 4203491 - RNA, 13 nt, Yersinia pestis KIM
uugcauacucagg

SEQ ID NO: 4203492 - RNA, 17 nt, Yersinia pestis KIM
uugcauacucaggcccu

SEQ ID NO: 4203493 - RNA, 22 nt, Yersinia pestis KIM
uugcauacucaggcccugagau

SEQ ID NO: 4203494 - RNA, 15 nt, Yersinia pestis KIM
uugcaucuuuaauua

SEQ ID NO: 4203495 - RNA, 23 nt, Yersinia pestis KIM
uugcaugaaaucaguguauuacu

SEQ ID NO: 4203496 - RNA, 16 nt, Yersinia pestis KIM
uugcauugccucccau

SEQ ID NO: 4203497 - RNA, 19 nt, Yersinia pestis KIM
uugccaaaauccaccagcg

SEQ ID NO: 4203498 - RNA, 14 nt, Yersinia pestis KIM
uugccaaaauuuua

SEQ ID NO: 4203499 - RNA, 20 nt, Yersinia pestis KIM
uugccaaaugcaaaccaggc

SEQ ID NO: 4203500 - RNA, 21 nt, Yersinia pestis KIM
uugccaaccggauaaaacaau

SEQ ID NO: 4203501 - RNA, 13 nt, Yersinia pestis KIM
uugccacauuucc

SEQ ID NO: 4203502 - RNA, 15 nt, Yersinia pestis KIM
uugccacauuucccu

SEQ ID NO: 4203503 - RNA, 13 nt, Yersinia pestis KIM
uugccaccagcgu

SEQ ID NO: 4203504 - RNA, 16 nt, Yersinia pestis KIM
uugccagauaaaaauu

SEQ ID NO: 4203505 - RNA, 19 nt, Yersinia pestis KIM
uugccagccaucuugggcc

SEQ ID NO: 4203506 - RNA, 11 nt, Yersinia pestis KIM
uugccagugaa

SEQ ID NO: 4203507 - RNA, 14 nt, Yersinia pestis KIM
uugccagugacucu

SEQ ID NO: 4203508 - RNA, 14 nt, Yersinia pestis KIM
uugcccaacuugua

SEQ ID NO: 4203509 - RNA, 21 nt, Yersinia pestis KIM
uugcccaaucuaacuggcccu

SEQ ID NO: 4203510 - RNA, 15 nt, Yersinia pestis KIM
uugcccaauggcaaa

SEQ ID NO: 4203511 - RNA, 16 nt, Yersinia pestis KIM
uugcccaauggcaaaa

SEQ ID NO: 4203512 - RNA, 17 nt, Yersinia pestis KIM
uugcccaccgacgccac

SEQ ID NO: 4203513 - RNA, 15 nt, Yersinia pestis KIM
uugcccccugcucca

SEQ ID NO: 4203514 - RNA, 18 nt, Yersinia pestis KIM
uugcccgauucaccuuca

SEQ ID NO: 4203515 - RNA, 14 nt, Yersinia pestis KIM
uugcccggcugaua

SEQ ID NO: 4203516 - RNA, 16 nt, Yersinia pestis KIM
uugcccugcaauaccg

SEQ ID NO: 4203517 - RNA, 20 nt, Yersinia pestis KIM
uugcccuggagcaagauuuu

SEQ ID NO: 4203518 - RNA, 16 nt, Yersinia pestis KIM
uugccgauaguuggca

SEQ ID NO: 4203519 - RNA, 15 nt, Yersinia pestis KIM
uugccgccgggcagc

SEQ ID NO: 4203520 - RNA, 16 nt, Yersinia pestis KIM
uugccgccuuccugcu

SEQ ID NO: 4203521 - RNA, 16 nt, Yersinia pestis KIM
uugccgcgucuguuau

SEQ ID NO: 4203522 - RNA, 16 nt, Yersinia pestis KIM
uugccgugguucaaau

SEQ ID NO: 4203523 - RNA, 23 nt, Yersinia pestis KIM
uugccucacugucuuugacaucu

SEQ ID NO: 4203524 - RNA, 14 nt, Yersinia pestis KIM
uugccuuucugggc

SEQ ID NO: 4203525 - RNA, 13 nt, Yersinia pestis KIM
uugcgcgaaauau

SEQ ID NO: 4203526 - RNA, 16 nt, Yersinia pestis KIM
uugcgcgccuguuuac

SEQ ID NO: 4203527 - RNA, 15 nt, Yersinia pestis KIM
uugcgcucaaccgaa

SEQ ID NO: 4203528 - RNA, 14 nt, Yersinia pestis KIM
uugcgcuccacgcc

SEQ ID NO: 4203529 - RNA, 22 nt, Yersinia pestis KIM
uugcggaguaacacuucagacu

SEQ ID NO: 4203530 - RNA, 14 nt, Yersinia pestis KIM
uugcggcaauggcu

SEQ ID NO: 4203531 - RNA, 21 nt, Yersinia pestis KIM
uugcgggcucuuugucaauaa

SEQ ID NO: 4203532 - RNA, 17 nt, Yersinia pestis KIM
uugcggguuaacucuuc

SEQ ID NO: 4203533 - RNA, 13 nt, Yersinia pestis KIM
uugcgugcaauaa

SEQ ID NO: 4203534 - RNA, 19 nt, Yersinia pestis KIM
uugcguuaccuaaaacuga

SEQ ID NO: 4203535 - RNA, 19 nt, Yersinia pestis KIM
uugcuacuggccuggcuga

SEQ ID NO: 4203536 - RNA, 21 nt, Yersinia pestis KIM
uugcuaugagcgcuguugcaa

SEQ ID NO: 4203537 - RNA, 18 nt, Yersinia pestis KIM
uugcuauuaaacauuuau

SEQ ID NO: 4203538 - RNA, 18 nt, Yersinia pestis KIM
uugcuauugaacauucau

SEQ ID NO: 4203539 - RNA, 23 nt, Yersinia pestis KIM
uugcuauuuacucguuuugcuau

SEQ ID NO: 4203540 - RNA, 23 nt, Yersinia pestis KIM
uugcucacccauuuuauccucuu

SEQ ID NO: 4203541 - RNA, 17 nt, Yersinia pestis KIM
uugcucagauacaucaa

SEQ ID NO: 4203542 - RNA, 23 nt, Yersinia pestis KIM
uugcucagauacaucaauggguu

SEQ ID NO: 4203543 - RNA, 17 nt, Yersinia pestis KIM
uugcucauagcccugcu

SEQ ID NO: 4203544 - RNA, 18 nt, Yersinia pestis KIM
uugcucuucccugcgcug

SEQ ID NO: 4203545 - RNA, 11 nt, Yersinia pestis KIM
uugcugaauca

SEQ ID NO: 4203546 - RNA, 21 nt, Yersinia pestis KIM
uugcugaguggacgauaaauu

SEQ ID NO: 4203547 - RNA, 15 nt, Yersinia pestis KIM
uugcugccaacggcu

SEQ ID NO: 4203548 - RNA, 21 nt, Yersinia pestis KIM
uugcugcuguuauuacuguca

SEQ ID NO: 4203549 - RNA, 19 nt, Yersinia pestis KIM
uugcuggcuaucaucccuu

SEQ ID NO: 4203550 - RNA, 20 nt, Yersinia pestis KIM
uugcuguaacuaccugcuuu

SEQ ID NO: 4203551 - RNA, 22 nt, Yersinia pestis KIM
uugcuuaagcacuaaaucgcag

SEQ ID NO: 4203552 - RNA, 22 nt, Yersinia pestis KIM
uugcuuaucgucaaguucauau

SEQ ID NO: 4203553 - RNA, 17 nt, Yersinia pestis KIM
uugcuucacggacagca

SEQ ID NO: 4203554 - RNA, 12 nt, Yersinia pestis KIM
uugcuucaucca

SEQ ID NO: 4203555 - RNA, 15 nt, Yersinia pestis KIM
uugcuugccagcgcu

SEQ ID NO: 4203556 - RNA, 17 nt, Yersinia pestis KIM
uugcuugccagcgcuuu

SEQ ID NO: 4203557 - RNA, 17 nt, Yersinia pestis KIM
uugcuuuaaauaacgca

SEQ ID NO: 4203558 - RNA, 22 nt, Yersinia pestis KIM
uugcuuuuaacuccuugaaacu

SEQ ID NO: 4203559 - RNA, 14 nt, Yersinia pestis KIM
uugcuuuuugcuuu

SEQ ID NO: 4203560 - RNA, 20 nt, Yersinia pestis KIM
uuggaaaugacaaaucagcg

SEQ ID NO: 4203561 - RNA, 22 nt, Yersinia pestis KIM
uuggaauagcuguaaaauacca

SEQ ID NO: 4203562 - RNA, 14 nt, Yersinia pestis KIM
uuggacaucugcuu

SEQ ID NO: 4203563 - RNA, 17 nt, Yersinia pestis KIM
uuggaucaggaucacca

SEQ ID NO: 4203564 - RNA, 17 nt, Yersinia pestis KIM
uuggaucaucgggaaca

SEQ ID NO: 4203565 - RNA, 17 nt, Yersinia pestis KIM
uuggaugucaggaucau

SEQ ID NO: 4203566 - RNA, 15 nt, Yersinia pestis KIM
uuggauugagccacc

SEQ ID NO: 4203567 - RNA, 14 nt, Yersinia pestis KIM
uuggcaaaaauaau

SEQ ID NO: 4203568 - RNA, 17 nt, Yersinia pestis KIM
uuggcaaaggccagcgc

SEQ ID NO: 4203569 - RNA, 17 nt, Yersinia pestis KIM
uuggcaaucacaacccc

SEQ ID NO: 4203570 - RNA, 17 nt, Yersinia pestis KIM
uuggcagcggcaaauag

SEQ ID NO: 4203571 - RNA, 16 nt, Yersinia pestis KIM
uuggcaucaaauuuag

SEQ ID NO: 4203572 - RNA, 15 nt, Yersinia pestis KIM
uuggcaugacaucag

SEQ ID NO: 4203573 - RNA, 15 nt, Yersinia pestis KIM
uuggcauuuaaaagg

SEQ ID NO: 4203574 - RNA, 22 nt, Yersinia pestis KIM
uuggcccacuggccugagaacc

SEQ ID NO: 4203575 - RNA, 13 nt, Yersinia pestis KIM
uuggccgcuuugg

SEQ ID NO: 4203576 - RNA, 17 nt, Yersinia pestis KIM
uuggccugcacaucaau

SEQ ID NO: 4203577 - RNA, 23 nt, Yersinia pestis KIM
uuggcgcggacgcuuuacucuuc

SEQ ID NO: 4203578 - RNA, 18 nt, Yersinia pestis KIM
uuggcuaaaccacggcgu

SEQ ID NO: 4203579 - RNA, 16 nt, Yersinia pestis KIM
uuggcuaacuggcgcu

SEQ ID NO: 4203580 - RNA, 21 nt, Yersinia pestis KIM
uuggcuagaaaucacacuggc

SEQ ID NO: 4203581 - RNA, 18 nt, Yersinia pestis KIM
uuggcuggcaaaguuauu

SEQ ID NO: 4203582 - RNA, 16 nt, Yersinia pestis KIM
uugggcaucaacgccc

SEQ ID NO: 4203583 - RNA, 17 nt, Yersinia pestis KIM
uuggguauaugacugug

SEQ ID NO: 4203584 - RNA, 22 nt, Yersinia pestis KIM
uugggucgaucuguugauaaaa

SEQ ID NO: 4203585 - RNA, 18 nt, Yersinia pestis KIM
uugguaaaauauuuugcu

SEQ ID NO: 4203586 - RNA, 16 nt, Yersinia pestis KIM
uugguaacgcagaaau

SEQ ID NO: 4203587 - RNA, 20 nt, Yersinia pestis KIM
uugguaacguucgcguggca

SEQ ID NO: 4203588 - RNA, 15 nt, Yersinia pestis KIM
uugguaauacgcggc

SEQ ID NO: 4203589 - RNA, 21 nt, Yersinia pestis KIM
uugguagucccgguauuugcu

SEQ ID NO: 4203590 - RNA, 17 nt, Yersinia pestis KIM
uuggucucagaacaaga

SEQ ID NO: 4203591 - RNA, 22 nt, Yersinia pestis KIM
uuggugccgcuggcauacaguu

SEQ ID NO: 4203592 - RNA, 20 nt, Yersinia pestis KIM
uugguggcucaaagaaaaau

SEQ ID NO: 4203593 - RNA, 23 nt, Yersinia pestis KIM
uugguuagcgccuuuuuuauaau

SEQ ID NO: 4203594 - RNA, 16 nt, Yersinia pestis KIM
uugguucacugaacca

SEQ ID NO: 4203595 - RNA, 18 nt, Yersinia pestis KIM
uugguugaacauuuccac

SEQ ID NO: 4203596 - RNA, 14 nt, Yersinia pestis KIM
uugguuggcuuuaa

SEQ ID NO: 4203597 - RNA, 11 nt, Yersinia pestis KIM
uugguuuauaa

SEQ ID NO: 4203598 - RNA, 14 nt, Yersinia pestis KIM
uugguuuauaacaa

SEQ ID NO: 4203599 - RNA, 15 nt, Yersinia pestis KIM
uuguaacucaauaau

SEQ ID NO: 4203600 - RNA, 20 nt, Yersinia pestis KIM
uuguaagcgauccugcucaa

SEQ ID NO: 4203601 - RNA, 19 nt, Yersinia pestis KIM
uuguaagucagauugucag

SEQ ID NO: 4203602 - RNA, 13 nt, Yersinia pestis KIM
uuguaauguuucu

SEQ ID NO: 4203603 - RNA, 22 nt, Yersinia pestis KIM
uuguaauuguauuauaugcgcu

SEQ ID NO: 4203604 - RNA, 15 nt, Yersinia pestis KIM
uuguaccccugaauc

SEQ ID NO: 4203605 - RNA, 14 nt, Yersinia pestis KIM
uuguaccuguuuuu

SEQ ID NO: 4203606 - RNA, 16 nt, Yersinia pestis KIM
uuguacgugaagauaa

SEQ ID NO: 4203607 - RNA, 16 nt, Yersinia pestis KIM
uuguacuuuauuguua

SEQ ID NO: 4203608 - RNA, 19 nt, Yersinia pestis KIM
uuguagcccacugacacug

SEQ ID NO: 4203609 - RNA, 13 nt, Yersinia pestis KIM
uuguaguaaccac

SEQ ID NO: 4203610 - RNA, 14 nt, Yersinia pestis KIM
uuguagugaaugac

SEQ ID NO: 4203611 - RNA, 20 nt, Yersinia pestis KIM
uuguauacuguuuauuaaug

SEQ ID NO: 4203612 - RNA, 14 nt, Yersinia pestis KIM
uuguauagucucca

SEQ ID NO: 4203613 - RNA, 13 nt, Yersinia pestis KIM
uuguaucacagca

SEQ ID NO: 4203614 - RNA, 14 nt, Yersinia pestis KIM
uuguaucggggggu

SEQ ID NO: 4203615 - RNA, 12 nt, Yersinia pestis KIM
uuguaugacaag

SEQ ID NO: 4203616 - RNA, 19 nt, Yersinia pestis KIM
uuguauugauaaaaauauc

SEQ ID NO: 4203617 - RNA, 14 nt, Yersinia pestis KIM
uuguauugcucagg

SEQ ID NO: 4203618 - RNA, 16 nt, Yersinia pestis KIM
uuguauuuaaauaguc

SEQ ID NO: 4203619 - RNA, 11 nt, Yersinia pestis KIM
uuguauuuugu

SEQ ID NO: 4203620 - RNA, 21 nt, Yersinia pestis KIM
uugucaauaaccucaaaagga

SEQ ID NO: 4203621 - RNA, 22 nt, Yersinia pestis KIM
uugucaauaaccucaaaaggau

SEQ ID NO: 4203622 - RNA, 24 nt, Yersinia pestis KIM
uugucaauaaccucuaaucuccuc

SEQ ID NO: 4203623 - RNA, 14 nt, Yersinia pestis KIM
uugucaaucacugg

SEQ ID NO: 4203624 - RNA, 14 nt, Yersinia pestis KIM
uugucaccuaacca

SEQ ID NO: 4203625 - RNA, 18 nt, Yersinia pestis KIM
uugucaccuaaccaaaca

SEQ ID NO: 4203626 - RNA, 20 nt, Yersinia pestis KIM
uugucagcagucugaaacgc

SEQ ID NO: 4203627 - RNA, 20 nt, Yersinia pestis KIM
uugucagcagucugaaaucu

SEQ ID NO: 4203628 - RNA, 19 nt, Yersinia pestis KIM
uugucagcagucugaagcc

SEQ ID NO: 4203629 - RNA, 22 nt, Yersinia pestis KIM
uugucagcagucugaagccuac

SEQ ID NO: 4203630 - RNA, 22 nt, Yersinia pestis KIM
uugucagcagucugagccucau

SEQ ID NO: 4203631 - RNA, 20 nt, Yersinia pestis KIM
uugucagcagucugagggcc

SEQ ID NO: 4203632 - RNA, 19 nt, Yersinia pestis KIM
uugucaggcugaugccauc

SEQ ID NO: 4203633 - RNA, 18 nt, Yersinia pestis KIM
uugucagguuaauaccug

SEQ ID NO: 4203634 - RNA, 13 nt, Yersinia pestis KIM
uugucauacacgg

SEQ ID NO: 4203635 - RNA, 16 nt, Yersinia pestis KIM
uugucauguugaccaa

SEQ ID NO: 4203636 - RNA, 19 nt, Yersinia pestis KIM
uugucauguugaccaaaca

SEQ ID NO: 4203637 - RNA, 17 nt, Yersinia pestis KIM
uugucgcguguaggcga

SEQ ID NO: 4203638 - RNA, 17 nt, Yersinia pestis KIM
uugucucuacucucugu

SEQ ID NO: 4203639 - RNA, 18 nt, Yersinia pestis KIM
uugucuguaauaauaauu

SEQ ID NO: 4203640 - RNA, 18 nt, Yersinia pestis KIM
uugugagucauuaauaga

SEQ ID NO: 4203641 - RNA, 20 nt, Yersinia pestis KIM
uugugagugacaugcuuaau

SEQ ID NO: 4203642 - RNA, 13 nt, Yersinia pestis KIM
uugugaugaaauu

SEQ ID NO: 4203643 - RNA, 21 nt, Yersinia pestis KIM
uugugaugcauauuauaauga

SEQ ID NO: 4203644 - RNA, 22 nt, Yersinia pestis KIM
uugugcaaaauacaaaguaaac

SEQ ID NO: 4203645 - RNA, 20 nt, Yersinia pestis KIM
uugugcaaaaucagcauaac

SEQ ID NO: 4203646 - RNA, 17 nt, Yersinia pestis KIM
uugugccaguagaucuc

SEQ ID NO: 4203647 - RNA, 18 nt, Yersinia pestis KIM
uugugccaguagaucucu

SEQ ID NO: 4203648 - RNA, 15 nt, Yersinia pestis KIM
uugugccccaagaag

SEQ ID NO: 4203649 - RNA, 20 nt, Yersinia pestis KIM
uugugcgccaaccgcuugca

SEQ ID NO: 4203650 - RNA, 18 nt, Yersinia pestis KIM
uugugcguaaagaaaaaa

SEQ ID NO: 4203651 - RNA, 17 nt, Yersinia pestis KIM
uugugcuacggcaaaau

SEQ ID NO: 4203652 - RNA, 18 nt, Yersinia pestis KIM
uugugcuaucccucccca

SEQ ID NO: 4203653 - RNA, 20 nt, Yersinia pestis KIM
uugugcuccugaugacucau

SEQ ID NO: 4203654 - RNA, 17 nt, Yersinia pestis KIM
uugugcugccgcuauug

SEQ ID NO: 4203655 - RNA, 16 nt, Yersinia pestis KIM
uuguguaucccccuca

SEQ ID NO: 4203656 - RNA, 22 nt, Yersinia pestis KIM
uugugucaauaccuuacuguau

SEQ ID NO: 4203657 - RNA, 20 nt, Yersinia pestis KIM
uuguguuucaucgacucuuu

SEQ ID NO: 4203658 - RNA, 19 nt, Yersinia pestis KIM
uuguuaaaacaguuugcgg

SEQ ID NO: 4203659 - RNA, 23 nt, Yersinia pestis KIM
uuguuaaaacaguuugcggucug

SEQ ID NO: 4203660 - RNA, 21 nt, Yersinia pestis KIM
uuguuacccacuaauauuccu

SEQ ID NO: 4203661 - RNA, 16 nt, Yersinia pestis KIM
uuguuacgccuucagc

SEQ ID NO: 4203662 - RNA, 16 nt, Yersinia pestis KIM
uuguuaucaucaccac

SEQ ID NO: 4203663 - RNA, 12 nt, Yersinia pestis KIM
uuguuauuacug

SEQ ID NO: 4203664 - RNA, 17 nt, Yersinia pestis KIM
uuguucacggcuuugcu

SEQ ID NO: 4203665 - RNA, 22 nt, Yersinia pestis KIM
uuguucagcaccaguugaccau

SEQ ID NO: 4203666 - RNA, 16 nt, Yersinia pestis KIM
uuguucaggcagauaa

SEQ ID NO: 4203667 - RNA, 21 nt, Yersinia pestis KIM
uuguucaggcagauaaaucca

SEQ ID NO: 4203668 - RNA, 21 nt, Yersinia pestis KIM
uuguucauccuguaccgcgcu

SEQ ID NO: 4203669 - RNA, 15 nt, Yersinia pestis KIM
uuguucuaauaauaa

SEQ ID NO: 4203670 - RNA, 15 nt, Yersinia pestis KIM
uuguucugcuggauc

SEQ ID NO: 4203671 - RNA, 12 nt, Yersinia pestis KIM
uuguugcaauac

SEQ ID NO: 4203672 - RNA, 12 nt, Yersinia pestis KIM
uuguugccggua

SEQ ID NO: 4203673 - RNA, 16 nt, Yersinia pestis KIM
uuguuucaauaaaucc

SEQ ID NO: 4203674 - RNA, 22 nt, Yersinia pestis KIM
uuguuuuuucccagaacauaug

SEQ ID NO: 4203675 - RNA, 11 nt, Yersinia pestis KIM
uuuaaaaaaau

SEQ ID NO: 4203676 - RNA, 17 nt, Yersinia pestis KIM
uuuaaaaaaauuaucau

SEQ ID NO: 4203677 - RNA, 13 nt, Yersinia pestis KIM
uuuaaaaaauauc

SEQ ID NO: 4203678 - RNA, 17 nt, Yersinia pestis KIM
uuuaaaacuguggcuga

SEQ ID NO: 4203679 - RNA, 10 nt, Yersinia pestis KIM
uuuaaaaggc

SEQ ID NO: 4203680 - RNA, 13 nt, Yersinia pestis KIM
uuuaaaaucccuc

SEQ ID NO: 4203681 - RNA, 17 nt, Yersinia pestis KIM
uuuaaacgcacaucaau

SEQ ID NO: 4203682 - RNA, 17 nt, Yersinia pestis KIM
uuuaaagaagaauccac

SEQ ID NO: 4203683 - RNA, 20 nt, Yersinia pestis KIM
uuuaaagccuguaaaauaua

SEQ ID NO: 4203684 - RNA, 14 nt, Yersinia pestis KIM
uuuaaauaugaucu

SEQ ID NO: 4203685 - RNA, 19 nt, Yersinia pestis KIM
uuuaaauuccgguguuuuu

SEQ ID NO: 4203686 - RNA, 12 nt, Yersinia pestis KIM
uuuaacaacaac

SEQ ID NO: 4203687 - RNA, 17 nt, Yersinia pestis KIM
uuuaacaacccauuucc

SEQ ID NO: 4203688 - RNA, 17 nt, Yersinia pestis KIM
uuuaaccgcucaguauu

SEQ ID NO: 4203689 - RNA, 15 nt, Yersinia pestis KIM
uuuaaccuuucuaau

SEQ ID NO: 4203690 - RNA, 19 nt, Yersinia pestis KIM
uuuaaccuuucuaauuauu

SEQ ID NO: 4203691 - RNA, 14 nt, Yersinia pestis KIM
uuuaacgucgcuga

SEQ ID NO: 4203692 - RNA, 13 nt, Yersinia pestis KIM
uuuaacucaaaua

SEQ ID NO: 4203693 - RNA, 13 nt, Yersinia pestis KIM
uuuaacucauccu

SEQ ID NO: 4203694 - RNA, 12 nt, Yersinia pestis KIM
uuuaagaaaucu

SEQ ID NO: 4203695 - RNA, 14 nt, Yersinia pestis KIM
uuuaagcaauuuag

SEQ ID NO: 4203696 - RNA, 22 nt, Yersinia pestis KIM
uuuaagccaauaauauaaucag

SEQ ID NO: 4203697 - RNA, 22 nt, Yersinia pestis KIM
uuuaagcugcagaggugaacga

SEQ ID NO: 4203698 - RNA, 17 nt, Yersinia pestis KIM
uuuaagcugucuaaauu

SEQ ID NO: 4203699 - RNA, 16 nt, Yersinia pestis KIM
uuuaagucaauuucag

SEQ ID NO: 4203700 - RNA, 17 nt, Yersinia pestis KIM
uuuaagucaauuucagc

SEQ ID NO: 4203701 - RNA, 20 nt, Yersinia pestis KIM
uuuaaguucacuugagagaa

SEQ ID NO: 4203702 - RNA, 13 nt, Yersinia pestis KIM
uuuaauaaccauu

SEQ ID NO: 4203703 - RNA, 19 nt, Yersinia pestis KIM
uuuaauaacuuaaauaauu

SEQ ID NO: 4203704 - RNA, 19 nt, Yersinia pestis KIM
uuuaauagccaaaauaauu

SEQ ID NO: 4203705 - RNA, 20 nt, Yersinia pestis KIM
uuuaauagcccgcgaauuaa

SEQ ID NO: 4203706 - RNA, 18 nt, Yersinia pestis KIM
uuuaauaugacuagauau

SEQ ID NO: 4203707 - RNA, 18 nt, Yersinia pestis KIM
uuuaauccacuuuucaga

SEQ ID NO: 4203708 - RNA, 19 nt, Yersinia pestis KIM
uuuaaucgccugaugcuuu

SEQ ID NO: 4203709 - RNA, 19 nt, Yersinia pestis KIM
uuuaaugauugauuaucaa

SEQ ID NO: 4203710 - RNA, 12 nt, Yersinia pestis KIM
uuuaauucaggc

SEQ ID NO: 4203711 - RNA, 14 nt, Yersinia pestis KIM
uuuaauucaggcca

SEQ ID NO: 4203712 - RNA, 15 nt, Yersinia pestis KIM
uuuaauucaggccaa

SEQ ID NO: 4203713 - RNA, 18 nt, Yersinia pestis KIM
uuuaauucaggccaagug

SEQ ID NO: 4203714 - RNA, 18 nt, Yersinia pestis KIM
uuuaauugagaauuauaa

SEQ ID NO: 4203715 - RNA, 17 nt, Yersinia pestis KIM
uuuaauugcugauguca

SEQ ID NO: 4203716 - RNA, 16 nt, Yersinia pestis KIM
uuuaauuuaugaacac

SEQ ID NO: 4203717 - RNA, 13 nt, Yersinia pestis KIM
uuuaauuuucuga

SEQ ID NO: 4203718 - RNA, 22 nt, Yersinia pestis KIM
uuuacagcuauuccaaaauugc

SEQ ID NO: 4203719 - RNA, 19 nt, Yersinia pestis KIM
uuuacaugauugaaaaaca

SEQ ID NO: 4203720 - RNA, 18 nt, Yersinia pestis KIM
uuuaccaaaagcauccaa

SEQ ID NO: 4203721 - RNA, 23 nt, Yersinia pestis KIM
uuuaccacgucuaauugcugccc

SEQ ID NO: 4203722 - RNA, 16 nt, Yersinia pestis KIM
uuuaccguugggcuuu

SEQ ID NO: 4203723 - RNA, 18 nt, Yersinia pestis KIM
uuuaccugcucaacugcu

SEQ ID NO: 4203724 - RNA, 14 nt, Yersinia pestis KIM
uuuacgaucggccu

SEQ ID NO: 4203725 - RNA, 19 nt, Yersinia pestis KIM
uuuacgcaaguaaaaguca

SEQ ID NO: 4203726 - RNA, 16 nt, Yersinia pestis KIM
uuuacggcucaccugg

SEQ ID NO: 4203727 - RNA, 18 nt, Yersinia pestis KIM
uuuacggcuuaucaaucu

SEQ ID NO: 4203728 - RNA, 17 nt, Yersinia pestis KIM
uuuacuaaauuagaaaa

SEQ ID NO: 4203729 - RNA, 19 nt, Yersinia pestis KIM
uuuacuccccaaagccuac

SEQ ID NO: 4203730 - RNA, 15 nt, Yersinia pestis KIM
uuuacugcauugaga

SEQ ID NO: 4203731 - RNA, 15 nt, Yersinia pestis KIM
uuuacugcuuuucua

SEQ ID NO: 4203732 - RNA, 21 nt, Yersinia pestis KIM
uuuacuggcgggcauuuucua

SEQ ID NO: 4203733 - RNA, 13 nt, Yersinia pestis KIM
uuuacuuuaaauu

SEQ ID NO: 4203734 - RNA, 21 nt, Yersinia pestis KIM
uuuacuuuaucguccaugcuu

SEQ ID NO: 4203735 - RNA, 15 nt, Yersinia pestis KIM
uuuacuuuuuccuua

SEQ ID NO: 4203736 - RNA, 14 nt, Yersinia pestis KIM
uuuagcauuuucca

SEQ ID NO: 4203737 - RNA, 16 nt, Yersinia pestis KIM
uuuagcgcugcaucug

SEQ ID NO: 4203738 - RNA, 13 nt, Yersinia pestis KIM
uuuaggcaagagu

SEQ ID NO: 4203739 - RNA, 20 nt, Yersinia pestis KIM
uuuaggcaauccaaacauac

SEQ ID NO: 4203740 - RNA, 19 nt, Yersinia pestis KIM
uuuaggccaauuuggccaa

SEQ ID NO: 4203741 - RNA, 18 nt, Yersinia pestis KIM
uuuagucaaaacaauauc

SEQ ID NO: 4203742 - RNA, 13 nt, Yersinia pestis KIM
uuuagugaaauac

SEQ ID NO: 4203743 - RNA, 13 nt, Yersinia pestis KIM
uuuaguuaaauaa

SEQ ID NO: 4203744 - RNA, 20 nt, Yersinia pestis KIM
uuuaguugcuauuuccccgc

SEQ ID NO: 4203745 - RNA, 19 nt, Yersinia pestis KIM
uuuauaaaaaauggaguuu

SEQ ID NO: 4203746 - RNA, 14 nt, Yersinia pestis KIM
uuuauaaaaccacu

SEQ ID NO: 4203747 - RNA, 18 nt, Yersinia pestis KIM
uuuauaaaaccacugacc

SEQ ID NO: 4203748 - RNA, 20 nt, Yersinia pestis KIM
uuuauaccggggccaucauc

SEQ ID NO: 4203749 - RNA, 12 nt, Yersinia pestis KIM
uuuauaucagau

SEQ ID NO: 4203750 - RNA, 21 nt, Yersinia pestis KIM
uuuauauuauuauaaauuuuc

SEQ ID NO: 4203751 - RNA, 14 nt, Yersinia pestis KIM
uuuauauugauacg

SEQ ID NO: 4203752 - RNA, 17 nt, Yersinia pestis KIM
uuuauauugccaucuug

SEQ ID NO: 4203753 - RNA, 17 nt, Yersinia pestis KIM
uuuaucaauaggucagu

SEQ ID NO: 4203754 - RNA, 19 nt, Yersinia pestis KIM
uuuaucacuuagcucaauc

SEQ ID NO: 4203755 - RNA, 15 nt, Yersinia pestis KIM
uuuaucaucauaaau

SEQ ID NO: 4203756 - RNA, 13 nt, Yersinia pestis KIM
uuuauccccuucg

SEQ ID NO: 4203757 - RNA, 13 nt, Yersinia pestis KIM
uuuaucggcauuu

SEQ ID NO: 4203758 - RNA, 21 nt, Yersinia pestis KIM
uuuaucucacgcugaauaaca

SEQ ID NO: 4203759 - RNA, 19 nt, Yersinia pestis KIM
uuuaucuuguaaauaguca

SEQ ID NO: 4203760 - RNA, 15 nt, Yersinia pestis KIM
uuuaugcaugaaaac

SEQ ID NO: 4203761 - RNA, 16 nt, Yersinia pestis KIM
uuuauggauaaugucc

SEQ ID NO: 4203762 - RNA, 14 nt, Yersinia pestis KIM
uuuauggcgaugau

SEQ ID NO: 4203763 - RNA, 21 nt, Yersinia pestis KIM
uuuauggcgaugaugauuauu

SEQ ID NO: 4203764 - RNA, 17 nt, Yersinia pestis KIM
uuuauggugugggcgca

SEQ ID NO: 4203765 - RNA, 15 nt, Yersinia pestis KIM
uuuauguaacacaua

SEQ ID NO: 4203766 - RNA, 20 nt, Yersinia pestis KIM
uuuauuaauggggccgggac

SEQ ID NO: 4203767 - RNA, 23 nt, Yersinia pestis KIM
uuuauuacuacaaacgcguuaau

SEQ ID NO: 4203768 - RNA, 15 nt, Yersinia pestis KIM
uuuauuauauauuuu

SEQ ID NO: 4203769 - RNA, 18 nt, Yersinia pestis KIM
uuuauuaucaucuuucau

SEQ ID NO: 4203770 - RNA, 16 nt, Yersinia pestis KIM
uuuauucaagugcuca

SEQ ID NO: 4203771 - RNA, 23 nt, Yersinia pestis KIM
uuuauucacagcagaacaaaaca

SEQ ID NO: 4203772 - RNA, 23 nt, Yersinia pestis KIM
uuuauucagcaacucgguuuuaa

SEQ ID NO: 4203773 - RNA, 16 nt, Yersinia pestis KIM
uuuauugacuguaaau

SEQ ID NO: 4203774 - RNA, 16 nt, Yersinia pestis KIM
uuuauugggaaccccu

SEQ ID NO: 4203775 - RNA, 15 nt, Yersinia pestis KIM
uuuauuuaacuguuc

SEQ ID NO: 4203776 - RNA, 20 nt, Yersinia pestis KIM
uuuauuuaagcugaaauuuu

SEQ ID NO: 4203777 - RNA, 13 nt, Yersinia pestis KIM
uuuauuuuacuuu

SEQ ID NO: 4203778 - RNA, 20 nt, Yersinia pestis KIM
uuucaaaccacuguuuuuca

SEQ ID NO: 4203779 - RNA, 22 nt, Yersinia pestis KIM
uuucaaaccacuguuuuucauu

SEQ ID NO: 4203780 - RNA, 21 nt, Yersinia pestis KIM
uuucaaauuaucgaucacaug

SEQ ID NO: 4203781 - RNA, 18 nt, Yersinia pestis KIM
uuucaacgcauccaaaua

SEQ ID NO: 4203782 - RNA, 19 nt, Yersinia pestis KIM
uuucaagcuguuacugccc

SEQ ID NO: 4203783 - RNA, 16 nt, Yersinia pestis KIM
uuucaagucaauaaau

SEQ ID NO: 4203784 - RNA, 17 nt, Yersinia pestis KIM
uuucaauacuauuccgu

SEQ ID NO: 4203785 - RNA, 14 nt, Yersinia pestis KIM
uuucaaucacugcg

SEQ ID NO: 4203786 - RNA, 18 nt, Yersinia pestis KIM
uuucaaugccaauugacg

SEQ ID NO: 4203787 - RNA, 21 nt, Yersinia pestis KIM
uuucaauugcccccuagugau

SEQ ID NO: 4203788 - RNA, 19 nt, Yersinia pestis KIM
uuucacacgcccaggccau

SEQ ID NO: 4203789 - RNA, 17 nt, Yersinia pestis KIM
uuucaccaaccaauuug

SEQ ID NO: 4203790 - RNA, 14 nt, Yersinia pestis KIM
uuucacccucugcg

SEQ ID NO: 4203791 - RNA, 19 nt, Yersinia pestis KIM
uuucaccuugcgcaauuug

SEQ ID NO: 4203792 - RNA, 23 nt, Yersinia pestis KIM
uuucacgaggaaaacgccagcag

SEQ ID NO: 4203793 - RNA, 23 nt, Yersinia pestis KIM
uuucacuguuauauuuuacuucc

SEQ ID NO: 4203794 - RNA, 13 nt, Yersinia pestis KIM
uuucacuuccauu

SEQ ID NO: 4203795 - RNA, 15 nt, Yersinia pestis KIM
uuucagacugcugac

SEQ ID NO: 4203796 - RNA, 23 nt, Yersinia pestis KIM
uuucagcaccauaaaaacuucag

SEQ ID NO: 4203797 - RNA, 20 nt, Yersinia pestis KIM
uuucaggacugucuucaacu

SEQ ID NO: 4203798 - RNA, 14 nt, Yersinia pestis KIM
uuucaggugacuga

SEQ ID NO: 4203799 - RNA, 17 nt, Yersinia pestis KIM
uuucagugagcauuuug

SEQ ID NO: 4203800 - RNA, 17 nt, Yersinia pestis KIM
uuucagugucaguucga

SEQ ID NO: 4203801 - RNA, 15 nt, Yersinia pestis KIM
uuucauaauaaugau

SEQ ID NO: 4203802 - RNA, 22 nt, Yersinia pestis KIM
uuucauagaacuuaagcaauau

SEQ ID NO: 4203803 - RNA, 12 nt, Yersinia pestis KIM
uuucauauguca

SEQ ID NO: 4203804 - RNA, 22 nt, Yersinia pestis KIM
uuucauccuaaagauaauuaau

SEQ ID NO: 4203805 - RNA, 18 nt, Yersinia pestis KIM
uuucaucgcugaauuuag

SEQ ID NO: 4203806 - RNA, 15 nt, Yersinia pestis KIM
uuucaucugugccug

SEQ ID NO: 4203807 - RNA, 19 nt, Yersinia pestis KIM
uuucaugauccacaaugau

SEQ ID NO: 4203808 - RNA, 13 nt, Yersinia pestis KIM
uuucaugauucuc

SEQ ID NO: 4203809 - RNA, 17 nt, Yersinia pestis KIM
uuucaugauucucuauu

SEQ ID NO: 4203810 - RNA, 20 nt, Yersinia pestis KIM
uuucauugauucaucaacug

SEQ ID NO: 4203811 - RNA, 14 nt, Yersinia pestis KIM
uuucauuuacuuga

SEQ ID NO: 4203812 - RNA, 20 nt, Yersinia pestis KIM
uuucauuuuaacaauuuuau

SEQ ID NO: 4203813 - RNA, 22 nt, Yersinia pestis KIM
uuuccaacugaucucaucauug

SEQ ID NO: 4203814 - RNA, 18 nt, Yersinia pestis KIM
uuuccacgucgcaagaga

SEQ ID NO: 4203815 - RNA, 17 nt, Yersinia pestis KIM
uuuccagaaucaauggg

SEQ ID NO: 4203816 - RNA, 19 nt, Yersinia pestis KIM
uuuccagcggcguaucaaa

SEQ ID NO: 4203817 - RNA, 20 nt, Yersinia pestis KIM
uuuccagcggcguaucaaac

SEQ ID NO: 4203818 - RNA, 14 nt, Yersinia pestis KIM
uuuccaggcuacca

SEQ ID NO: 4203819 - RNA, 15 nt, Yersinia pestis KIM
uuuccagguuuuggc

SEQ ID NO: 4203820 - RNA, 13 nt, Yersinia pestis KIM
uuuccaucacugc

SEQ ID NO: 4203821 - RNA, 20 nt, Yersinia pestis KIM
uuuccauuggagauccguuu

SEQ ID NO: 4203822 - RNA, 15 nt, Yersinia pestis KIM
uuuccccuucauuug

SEQ ID NO: 4203823 - RNA, 16 nt, Yersinia pestis KIM
uuucccgacagaacug

SEQ ID NO: 4203824 - RNA, 17 nt, Yersinia pestis KIM
uuucccgcuccaaauua

SEQ ID NO: 4203825 - RNA, 13 nt, Yersinia pestis KIM
uuucccguugaua

SEQ ID NO: 4203826 - RNA, 18 nt, Yersinia pestis KIM
uuucccucagccaaagca

SEQ ID NO: 4203827 - RNA, 18 nt, Yersinia pestis KIM
uuucccugcggccaucca

SEQ ID NO: 4203828 - RNA, 16 nt, Yersinia pestis KIM
uuuccgccaugagaac

SEQ ID NO: 4203829 - RNA, 14 nt, Yersinia pestis KIM
uuuccguuaaccca

SEQ ID NO: 4203830 - RNA, 16 nt, Yersinia pestis KIM
uuuccucaaacgugau

SEQ ID NO: 4203831 - RNA, 11 nt, Yersinia pestis KIM
uuuccucuuua

SEQ ID NO: 4203832 - RNA, 14 nt, Yersinia pestis KIM
uuuccugagucugu

SEQ ID NO: 4203833 - RNA, 12 nt, Yersinia pestis KIM
uuuccugcugcu

SEQ ID NO: 4203834 - RNA, 19 nt, Yersinia pestis KIM
uuuccuuggcagcaauagc

SEQ ID NO: 4203835 - RNA, 12 nt, Yersinia pestis KIM
uuucgaccucag

SEQ ID NO: 4203836 - RNA, 19 nt, Yersinia pestis KIM
uuucgcgguucggauaaau

SEQ ID NO: 4203837 - RNA, 14 nt, Yersinia pestis KIM
uuucgggcaaaaaa

SEQ ID NO: 4203838 - RNA, 15 nt, Yersinia pestis KIM
uuucgguaauacuga

SEQ ID NO: 4203839 - RNA, 13 nt, Yersinia pestis KIM
uuucgguaccauc

SEQ ID NO: 4203840 - RNA, 14 nt, Yersinia pestis KIM
uuucguaacguuua

SEQ ID NO: 4203841 - RNA, 15 nt, Yersinia pestis KIM
uuucgucgugugaua

SEQ ID NO: 4203842 - RNA, 17 nt, Yersinia pestis KIM
uuucguuccagugagca

SEQ ID NO: 4203843 - RNA, 17 nt, Yersinia pestis KIM
uuucguuuaaaaaauau

SEQ ID NO: 4203844 - RNA, 21 nt, Yersinia pestis KIM
uuucguuuaaaaaauaucuau

SEQ ID NO: 4203845 - RNA, 14 nt, Yersinia pestis KIM
uuucguuuacuuga

SEQ ID NO: 4203846 - RNA, 15 nt, Yersinia pestis KIM
uuucguuucugucug

SEQ ID NO: 4203847 - RNA, 18 nt, Yersinia pestis KIM
uuucuaaccucacaacca

SEQ ID NO: 4203848 - RNA, 15 nt, Yersinia pestis KIM
uuucuaagcugccug

SEQ ID NO: 4203849 - RNA, 20 nt, Yersinia pestis KIM
uuucuaauucgugggcauuu

SEQ ID NO: 4203850 - RNA, 13 nt, Yersinia pestis KIM
uuucuaccgcuuc

SEQ ID NO: 4203851 - RNA, 19 nt, Yersinia pestis KIM
uuucuacgccgucaucauc

SEQ ID NO: 4203852 - RNA, 15 nt, Yersinia pestis KIM
uuucuaucucaucca

SEQ ID NO: 4203853 - RNA, 15 nt, Yersinia pestis KIM
uuucucaucgcuuuu

SEQ ID NO: 4203854 - RNA, 21 nt, Yersinia pestis KIM
uuucuccaccgggccuaauca

SEQ ID NO: 4203855 - RNA, 17 nt, Yersinia pestis KIM
uuucuccccacuucauc

SEQ ID NO: 4203856 - RNA, 14 nt, Yersinia pestis KIM
uuucucccuuucac

SEQ ID NO: 4203857 - RNA, 19 nt, Yersinia pestis KIM
uuucucggccaacaucuuc

SEQ ID NO: 4203858 - RNA, 17 nt, Yersinia pestis KIM
uuucucugaugaacgga

SEQ ID NO: 4203859 - RNA, 23 nt, Yersinia pestis KIM
uuucucuuggagccagccauucu

SEQ ID NO: 4203860 - RNA, 21 nt, Yersinia pestis KIM
uuucugaagaugccaaucaaa

SEQ ID NO: 4203861 - RNA, 23 nt, Yersinia pestis KIM
uuucugaagggcaaauugccgcu

SEQ ID NO: 4203862 - RNA, 17 nt, Yersinia pestis KIM
uuucugauuuuuuacuu

SEQ ID NO: 4203863 - RNA, 13 nt, Yersinia pestis KIM
uuucugccuaucu

SEQ ID NO: 4203864 - RNA, 13 nt, Yersinia pestis KIM
uuucuggaaugag

SEQ ID NO: 4203865 - RNA, 14 nt, Yersinia pestis KIM
uuucuggugagcau

SEQ ID NO: 4203866 - RNA, 20 nt, Yersinia pestis KIM
uuucugugguuggcagcuca

SEQ ID NO: 4203867 - RNA, 15 nt, Yersinia pestis KIM
uuucuuaauaauauc

SEQ ID NO: 4203868 - RNA, 17 nt, Yersinia pestis KIM
uuucuuacuaaaauauc

SEQ ID NO: 4203869 - RNA, 21 nt, Yersinia pestis KIM
uuucuucaauaauguggcaug

SEQ ID NO: 4203870 - RNA, 11 nt, Yersinia pestis KIM
uuucuugccag

SEQ ID NO: 4203871 - RNA, 20 nt, Yersinia pestis KIM
uuucuugccuuuuuauaagc

SEQ ID NO: 4203872 - RNA, 18 nt, Yersinia pestis KIM
uuucuuguauauaaaaaa

SEQ ID NO: 4203873 - RNA, 14 nt, Yersinia pestis KIM
uuucuuuaugucuu

SEQ ID NO: 4203874 - RNA, 19 nt, Yersinia pestis KIM
uuucuuucaggcugguugg

SEQ ID NO: 4203875 - RNA, 14 nt, Yersinia pestis KIM
uuucuuucaguaau

SEQ ID NO: 4203876 - RNA, 20 nt, Yersinia pestis KIM
uuucuuuucgcuauuucucu

SEQ ID NO: 4203877 - RNA, 13 nt, Yersinia pestis KIM
uuucuuuugguga

SEQ ID NO: 4203878 - RNA, 20 nt, Yersinia pestis KIM
uuugaaccgcuaucugcuga

SEQ ID NO: 4203879 - RNA, 18 nt, Yersinia pestis KIM
uuugaacgauauuuuuau

SEQ ID NO: 4203880 - RNA, 21 nt, Yersinia pestis KIM
uuugaacgcgacuuguaguga

SEQ ID NO: 4203881 - RNA, 15 nt, Yersinia pestis KIM
uuugaacgugcucuc

SEQ ID NO: 4203882 - RNA, 21 nt, Yersinia pestis KIM
uuugaagacaacucuucuauc

SEQ ID NO: 4203883 - RNA, 22 nt, Yersinia pestis KIM
uuugaagauuuaacgcauuagc

SEQ ID NO: 4203884 - RNA, 22 nt, Yersinia pestis KIM
uuugaauaaaagagauguuauu

SEQ ID NO: 4203885 - RNA, 21 nt, Yersinia pestis KIM
uuugaauuaagcgaaggggaa

SEQ ID NO: 4203886 - RNA, 18 nt, Yersinia pestis KIM
uuugacacgggaucaaca

SEQ ID NO: 4203887 - RNA, 20 nt, Yersinia pestis KIM
uuugacauacucuuccaacg

SEQ ID NO: 4203888 - RNA, 23 nt, Yersinia pestis KIM
uuugacuuugucagcagucugag

SEQ ID NO: 4203889 - RNA, 17 nt, Yersinia pestis KIM
uuugaggaaauuucagu

SEQ ID NO: 4203890 - RNA, 20 nt, Yersinia pestis KIM
uuugaguaagacaacuuauu

SEQ ID NO: 4203891 - RNA, 21 nt, Yersinia pestis KIM
uuugauaaggccaugucacua

SEQ ID NO: 4203892 - RNA, 15 nt, Yersinia pestis KIM
uuugauacaguaauu

SEQ ID NO: 4203893 - RNA, 13 nt, Yersinia pestis KIM
uuugauacuguuc

SEQ ID NO: 4203894 - RNA, 15 nt, Yersinia pestis KIM
uuugauuaaaacccc

SEQ ID NO: 4203895 - RNA, 12 nt, Yersinia pestis KIM
uuugcaauuaau

SEQ ID NO: 4203896 - RNA, 20 nt, Yersinia pestis KIM
uuugcacgaucagugaagag

SEQ ID NO: 4203897 - RNA, 13 nt, Yersinia pestis KIM
uuugcacugcagg

SEQ ID NO: 4203898 - RNA, 22 nt, Yersinia pestis KIM
uuugcagauaaaacgccgccag

SEQ ID NO: 4203899 - RNA, 19 nt, Yersinia pestis KIM
uuugcaguggaugauaaau

SEQ ID NO: 4203900 - RNA, 15 nt, Yersinia pestis KIM
uuugcauauuucucu

SEQ ID NO: 4203901 - RNA, 12 nt, Yersinia pestis KIM
uuugcaucaacg

SEQ ID NO: 4203902 - RNA, 13 nt, Yersinia pestis KIM
uuugcauccgcaa

SEQ ID NO: 4203903 - RNA, 22 nt, Yersinia pestis KIM
uuugcauugaccgccaaaucca

SEQ ID NO: 4203904 - RNA, 20 nt, Yersinia pestis KIM
uuugcccgcgcuuccaggcu

SEQ ID NO: 4203905 - RNA, 22 nt, Yersinia pestis KIM
uuugcccucgaacgaagccacg

SEQ ID NO: 4203906 - RNA, 19 nt, Yersinia pestis KIM
uuugccguuguuaguguau

SEQ ID NO: 4203907 - RNA, 19 nt, Yersinia pestis KIM
uuugcgcagcaaauaaaca

SEQ ID NO: 4203908 - RNA, 23 nt, Yersinia pestis KIM
uuugcgcagcaaauaaacaaaau

SEQ ID NO: 4203909 - RNA, 23 nt, Yersinia pestis KIM
uuugcggucuggcaacugcaaau

SEQ ID NO: 4203910 - RNA, 15 nt, Yersinia pestis KIM
uuugcguauuaucau

SEQ ID NO: 4203911 - RNA, 12 nt, Yersinia pestis KIM
uuugcuauucag

SEQ ID NO: 4203912 - RNA, 20 nt, Yersinia pestis KIM
uuugcucgggcucucuucag

SEQ ID NO: 4203913 - RNA, 16 nt, Yersinia pestis KIM
uuugcucucguugcau

SEQ ID NO: 4203914 - RNA, 19 nt, Yersinia pestis KIM
uuugcugccugcaccagug

SEQ ID NO: 4203915 - RNA, 18 nt, Yersinia pestis KIM
uuugcugucuggguggcu

SEQ ID NO: 4203916 - RNA, 21 nt, Yersinia pestis KIM
uuugcuguucuaucucaucuu

SEQ ID NO: 4203917 - RNA, 13 nt, Yersinia pestis KIM
uuugcuuuuugcu

SEQ ID NO: 4203918 - RNA, 23 nt, Yersinia pestis KIM
uuuggaaccgccauaggcuguuu

SEQ ID NO: 4203919 - RNA, 18 nt, Yersinia pestis KIM
uuuggaucaggaucacca

SEQ ID NO: 4203920 - RNA, 13 nt, Yersinia pestis KIM
uuuggcaucaaug

SEQ ID NO: 4203921 - RNA, 20 nt, Yersinia pestis KIM
uuuggccgcucaacuuugcu

SEQ ID NO: 4203922 - RNA, 17 nt, Yersinia pestis KIM
uuugggaacaacagcau

SEQ ID NO: 4203923 - RNA, 18 nt, Yersinia pestis KIM
uuugggaacaacagcauc

SEQ ID NO: 4203924 - RNA, 18 nt, Yersinia pestis KIM
uuugguuauaucccaaua

SEQ ID NO: 4203925 - RNA, 23 nt, Yersinia pestis KIM
uuugguugaacauuuccacucuu

SEQ ID NO: 4203926 - RNA, 14 nt, Yersinia pestis KIM
uuugguuuucuauu

SEQ ID NO: 4203927 - RNA, 16 nt, Yersinia pestis KIM
uuuguaaauuuuaaac

SEQ ID NO: 4203928 - RNA, 17 nt, Yersinia pestis KIM
uuuguacaacuucuuca

SEQ ID NO: 4203929 - RNA, 13 nt, Yersinia pestis KIM
uuuguauuuuguu

SEQ ID NO: 4203930 - RNA, 15 nt, Yersinia pestis KIM
uuugucaauaaccuc

SEQ ID NO: 4203931 - RNA, 15 nt, Yersinia pestis KIM
uuugucacaaugcug

SEQ ID NO: 4203932 - RNA, 23 nt, Yersinia pestis KIM
uuugucagcagucugagggccac

SEQ ID NO: 4203933 - RNA, 15 nt, Yersinia pestis KIM
uuugucagcaucuuu

SEQ ID NO: 4203934 - RNA, 24 nt, Yersinia pestis KIM
uuugucauacacggucuggcaacg

SEQ ID NO: 4203935 - RNA, 13 nt, Yersinia pestis KIM
uuugucauguuga

SEQ ID NO: 4203936 - RNA, 22 nt, Yersinia pestis KIM
uuuguccggagagagacuuugu

SEQ ID NO: 4203937 - RNA, 16 nt, Yersinia pestis KIM
uuugucgcucaagccu

SEQ ID NO: 4203938 - RNA, 23 nt, Yersinia pestis KIM
uuugugucgggauuuuuuuuccu

SEQ ID NO: 4203939 - RNA, 21 nt, Yersinia pestis KIM
uuuguuaaaauaguggcacaa

SEQ ID NO: 4203940 - RNA, 16 nt, Yersinia pestis KIM
uuuguuagcaauuuga

SEQ ID NO: 4203941 - RNA, 12 nt, Yersinia pestis KIM
uuuguuauuucu

SEQ ID NO: 4203942 - RNA, 13 nt, Yersinia pestis KIM
uuuguugauguaa

SEQ ID NO: 4203943 - RNA, 14 nt, Yersinia pestis KIM
uuuguugcuacugg

SEQ ID NO: 4203944 - RNA, 20 nt, Yersinia pestis KIM
uuuguuuccccuaauucucc

SEQ ID NO: 4203945 - RNA, 20 nt, Yersinia pestis KIM
uuuguuuggauaaaaacauu

SEQ ID NO: 4203946 - RNA, 14 nt, Yersinia pestis KIM
uuuguuugugagag

SEQ ID NO: 4203947 - RNA, 13 nt, Yersinia pestis KIM
uuuguuuuuauau

SEQ ID NO: 4203948 - RNA, 16 nt, Yersinia pestis KIM
uuuuaaacgucagauu

SEQ ID NO: 4203949 - RNA, 16 nt, Yersinia pestis KIM
uuuuaaagaaugcaac

SEQ ID NO: 4203950 - RNA, 22 nt, Yersinia pestis KIM
uuuuaacgucgcugaaaugcua

SEQ ID NO: 4203951 - RNA, 14 nt, Yersinia pestis KIM
uuuuaagcaauuua

SEQ ID NO: 4203952 - RNA, 23 nt, Yersinia pestis KIM
uuuuaaggacucuuaguuucuac

SEQ ID NO: 4203953 - RNA, 17 nt, Yersinia pestis KIM
uuuuaaguuuauuuaac

SEQ ID NO: 4203954 - RNA, 23 nt, Yersinia pestis KIM
uuuuaauaaaaaacugacucacg

SEQ ID NO: 4203955 - RNA, 20 nt, Yersinia pestis KIM
uuuuaaucuccuggugguuu

SEQ ID NO: 4203956 - RNA, 16 nt, Yersinia pestis KIM
uuuuaaucucuccaug

SEQ ID NO: 4203957 - RNA, 20 nt, Yersinia pestis KIM
uuuuaaucucuccaugauau

SEQ ID NO: 4203958 - RNA, 13 nt, Yersinia pestis KIM
uuuuaccuaguag

SEQ ID NO: 4203959 - RNA, 19 nt, Yersinia pestis KIM
uuuuacgccuauccucaug

SEQ ID NO: 4203960 - RNA, 14 nt, Yersinia pestis KIM
uuuuacucaggauu

SEQ ID NO: 4203961 - RNA, 22 nt, Yersinia pestis KIM
uuuuacucaggauuagcuucug

SEQ ID NO: 4203962 - RNA, 17 nt, Yersinia pestis KIM
uuuuacugccacugacu

SEQ ID NO: 4203963 - RNA, 22 nt, Yersinia pestis KIM
uuuuacugucggucgauuuuua

SEQ ID NO: 4203964 - RNA, 16 nt, Yersinia pestis KIM
uuuuagauaucagaaa

SEQ ID NO: 4203965 - RNA, 22 nt, Yersinia pestis KIM
uuuuagccgcuucgcugacauu

SEQ ID NO: 4203966 - RNA, 22 nt, Yersinia pestis KIM
uuuuaggcaauccaaacauaca

SEQ ID NO: 4203967 - RNA, 18 nt, Yersinia pestis KIM
uuuuaguaacaaaaugcg

SEQ ID NO: 4203968 - RNA, 17 nt, Yersinia pestis KIM
uuuuagugauuaauuaa

SEQ ID NO: 4203969 - RNA, 13 nt, Yersinia pestis KIM
uuuuaguuaaaua

SEQ ID NO: 4203970 - RNA, 14 nt, Yersinia pestis KIM
uuuuaguuaaauaa

SEQ ID NO: 4203971 - RNA, 20 nt, Yersinia pestis KIM
uuuuauaccggggccaucau

SEQ ID NO: 4203972 - RNA, 17 nt, Yersinia pestis KIM
uuuuauaggucauccca

SEQ ID NO: 4203973 - RNA, 23 nt, Yersinia pestis KIM
uuuuaucaggcgaaugcccugcu

SEQ ID NO: 4203974 - RNA, 15 nt, Yersinia pestis KIM
uuuuaucaucauaaa

SEQ ID NO: 4203975 - RNA, 15 nt, Yersinia pestis KIM
uuuuaucauuuaaau

SEQ ID NO: 4203976 - RNA, 20 nt, Yersinia pestis KIM
uuuuaucgcaguaauagaaa

SEQ ID NO: 4203977 - RNA, 13 nt, Yersinia pestis KIM
uuuuauguuaaau

SEQ ID NO: 4203978 - RNA, 15 nt, Yersinia pestis KIM
uuuuauguuaaauca

SEQ ID NO: 4203979 - RNA, 14 nt, Yersinia pestis KIM
uuuuauuaaaucac

SEQ ID NO: 4203980 - RNA, 17 nt, Yersinia pestis KIM
uuuuauuaccugcuauu

SEQ ID NO: 4203981 - RNA, 21 nt, Yersinia pestis KIM
uuuuauuaccugcuauuuuau

SEQ ID NO: 4203982 - RNA, 13 nt, Yersinia pestis KIM
uuuuauugccuac

SEQ ID NO: 4203983 - RNA, 19 nt, Yersinia pestis KIM
uuuuauugucuuuaauaaa

SEQ ID NO: 4203984 - RNA, 13 nt, Yersinia pestis KIM
uuuucaaccaaca

SEQ ID NO: 4203985 - RNA, 18 nt, Yersinia pestis KIM
uuuucacacgcccaggcc

SEQ ID NO: 4203986 - RNA, 22 nt, Yersinia pestis KIM
uuuucacccccacaucaggccg

SEQ ID NO: 4203987 - RNA, 21 nt, Yersinia pestis KIM
uuuucaggcuaaugcgcucug

SEQ ID NO: 4203988 - RNA, 18 nt, Yersinia pestis KIM
uuuuccaggucaaugucu

SEQ ID NO: 4203989 - RNA, 23 nt, Yersinia pestis KIM
uuuucccgaccuuguucagauaa

SEQ ID NO: 4203990 - RNA, 18 nt, Yersinia pestis KIM
uuuucccuguagaacacc

SEQ ID NO: 4203991 - RNA, 15 nt, Yersinia pestis KIM
uuuuccuauaaacca

SEQ ID NO: 4203992 - RNA, 14 nt, Yersinia pestis KIM
uuuucgaacuuaac

SEQ ID NO: 4203993 - RNA, 21 nt, Yersinia pestis KIM
uuuucgaacuuaacuacugca

SEQ ID NO: 4203994 - RNA, 14 nt, Yersinia pestis KIM
uuuucgggaaaaaa

SEQ ID NO: 4203995 - RNA, 23 nt, Yersinia pestis KIM
uuuucgggccacuacggcgacuu

SEQ ID NO: 4203996 - RNA, 13 nt, Yersinia pestis KIM
uuuucguuuacuu

SEQ ID NO: 4203997 - RNA, 13 nt, Yersinia pestis KIM
uuuucuacugaau

SEQ ID NO: 4203998 - RNA, 15 nt, Yersinia pestis KIM
uuuucuauaccaauu

SEQ ID NO: 4203999 - RNA, 15 nt, Yersinia pestis KIM
uuuucucuuucuucu

SEQ ID NO: 4204000 - RNA, 22 nt, Yersinia pestis KIM
uuuucugcauaagcaucaguaa

SEQ ID NO: 4204001 - RNA, 14 nt, Yersinia pestis KIM
uuuucugccuaucu

SEQ ID NO: 4204002 - RNA, 20 nt, Yersinia pestis KIM
uuuucuuaacgauauuuacu

SEQ ID NO: 4204003 - RNA, 19 nt, Yersinia pestis KIM
uuuucuucugagauaugua

SEQ ID NO: 4204004 - RNA, 14 nt, Yersinia pestis KIM
uuuucuuucaggcu

SEQ ID NO: 4204005 - RNA, 16 nt, Yersinia pestis KIM
uuuugaacgauauuuu

SEQ ID NO: 4204006 - RNA, 19 nt, Yersinia pestis KIM
uuuugaauagguaaaacau

SEQ ID NO: 4204007 - RNA, 17 nt, Yersinia pestis KIM
uuuugacaacguguccg

SEQ ID NO: 4204008 - RNA, 20 nt, Yersinia pestis KIM
uuuugagcucagccaggcag

SEQ ID NO: 4204009 - RNA, 16 nt, Yersinia pestis KIM
uuuugaggaaauuuca

SEQ ID NO: 4204010 - RNA, 16 nt, Yersinia pestis KIM
uuuugccaauauugcc

SEQ ID NO: 4204011 - RNA, 18 nt, Yersinia pestis KIM
uuuugcccgcgcuuccag

SEQ ID NO: 4204012 - RNA, 22 nt, Yersinia pestis KIM
uuuugccggggagucgcuccuc

SEQ ID NO: 4204013 - RNA, 22 nt, Yersinia pestis KIM
uuuugcgacaggcucagcacaa

SEQ ID NO: 4204014 - RNA, 15 nt, Yersinia pestis KIM
gcucuccacucgguc

SEQ ID NO: 4204015 - RNA, 14 nt, Yersinia pestis KIM
gcucucgacaaccu

SEQ ID NO: 4204016 - RNA, 17 nt, Yersinia pestis KIM
gcucucucaauucaaua

SEQ ID NO: 4204017 - RNA, 18 nt, Yersinia pestis KIM
gcucucugagccauccag

SEQ ID NO: 4204018 - RNA, 19 nt, Yersinia pestis KIM
gcucucugaguaccagcaa

SEQ ID NO: 4204019 - RNA, 15 nt, Yersinia pestis KIM
gcucucuuuuuucuc

SEQ ID NO: 4204020 - RNA, 21 nt, Yersinia pestis KIM
gcucucuuuuuucucuuucuu

SEQ ID NO: 4204021 - RNA, 21 nt, Yersinia pestis KIM
gcucugacaaaaugccagaau

SEQ ID NO: 4204022 - RNA, 17 nt, Yersinia pestis KIM
gcucugauaguauuaga

SEQ ID NO: 4204023 - RNA, 13 nt, Yersinia pestis KIM
gcucugccgcagu

SEQ ID NO: 4204024 - RNA, 19 nt, Yersinia pestis KIM
gcucugcguuuuucccugu

SEQ ID NO: 4204025 - RNA, 19 nt, Yersinia pestis KIM
gcucugggacgugcauaaa

SEQ ID NO: 4204026 - RNA, 21 nt, Yersinia pestis KIM
gcucugggacgugcauaaaac

SEQ ID NO: 4204027 - RNA, 12 nt, Yersinia pestis KIM
gcucuucaucau

SEQ ID NO: 4204028 - RNA, 17 nt, Yersinia pestis KIM
gcucuucccugcgcuga

SEQ ID NO: 4204029 - RNA, 12 nt, Yersinia pestis KIM
gcucuucugggc

SEQ ID NO: 4204030 - RNA, 13 nt, Yersinia pestis KIM
gcucuuuacgguc

SEQ ID NO: 4204031 - RNA, 19 nt, Yersinia pestis KIM
gcucuuuuuugaaguugua

SEQ ID NO: 4204032 - RNA, 22 nt, Yersinia pestis KIM
gcugaaaaaugagucauuaucu

SEQ ID NO: 4204033 - RNA, 23 nt, Yersinia pestis KIM
gcugaaaaauggugagaaacgug

SEQ ID NO: 4204034 - RNA, 16 nt, Yersinia pestis KIM
gcugaaaucgaucaua

SEQ ID NO: 4204035 - RNA, 12 nt, Yersinia pestis KIM
gcugaaaugcua

SEQ ID NO: 4204036 - RNA, 16 nt, Yersinia pestis KIM
gcugaacaauugccag

SEQ ID NO: 4204037 - RNA, 15 nt, Yersinia pestis KIM
gcugaacuucuggga

SEQ ID NO: 4204038 - RNA, 13 nt, Yersinia pestis KIM
gcugaagacccaa

SEQ ID NO: 4204039 - RNA, 18 nt, Yersinia pestis KIM
gcugaauaucaucuuuuu

SEQ ID NO: 4204040 - RNA, 17 nt, Yersinia pestis KIM
gcugaaucuguaaguca

SEQ ID NO: 4204041 - RNA, 16 nt, Yersinia pestis KIM
gcugaauuuuugugcu

SEQ ID NO: 4204042 - RNA, 15 nt, Yersinia pestis KIM
gcugacaaacagaua

SEQ ID NO: 4204043 - RNA, 21 nt, Yersinia pestis KIM
gcugacaaaguuaaaugaagg

SEQ ID NO: 4204044 - RNA, 15 nt, Yersinia pestis KIM
gcugacaauuuacac

SEQ ID NO: 4204045 - RNA, 17 nt, Yersinia pestis KIM
gcugacagagcggguuu

SEQ ID NO: 4204046 - RNA, 22 nt, Yersinia pestis KIM
gcugaccacaaaaacaguguca

SEQ ID NO: 4204047 - RNA, 23 nt, Yersinia pestis KIM
gcugacgauaacuuuuggcagca

SEQ ID NO: 4204048 - RNA, 21 nt, Yersinia pestis KIM
gcugacgcagcaggcguagcg

SEQ ID NO: 4204049 - RNA, 17 nt, Yersinia pestis KIM
gcugacuugcagguuca

SEQ ID NO: 4204050 - RNA, 22 nt, Yersinia pestis KIM
gcugagauuauugggcugccug

SEQ ID NO: 4204051 - RNA, 16 nt, Yersinia pestis KIM
gcugaggggcacacuu

SEQ ID NO: 4204052 - RNA, 13 nt, Yersinia pestis KIM
gcugagguugaug

SEQ ID NO: 4204053 - RNA, 17 nt, Yersinia pestis KIM
gcugaguaaagcccagc

SEQ ID NO: 4204054 - RNA, 17 nt, Yersinia pestis KIM
gcugauaacuuccuuug

SEQ ID NO: 4204055 - RNA, 14 nt, Yersinia pestis KIM
gcugauaauuuauu

SEQ ID NO: 4204056 - RNA, 22 nt, Yersinia pestis KIM
gcugauagaaaguugagcagca

SEQ ID NO: 4204057 - RNA, 23 nt, Yersinia pestis KIM
gcugauagaaaguugagcagcaa

SEQ ID NO: 4204058 - RNA, 21 nt, Yersinia pestis KIM
gcugauaucauuugcucgaaa

SEQ ID NO: 4204059 - RNA, 13 nt, Yersinia pestis KIM
gcugaucaggaag

SEQ ID NO: 4204060 - RNA, 14 nt, Yersinia pestis KIM
gcugaucaucauca

SEQ ID NO: 4204061 - RNA, 15 nt, Yersinia pestis KIM
gcugaucugccagua

SEQ ID NO: 4204062 - RNA, 14 nt, Yersinia pestis KIM
gcugaucugccccu

SEQ ID NO: 4204063 - RNA, 16 nt, Yersinia pestis KIM
gcugaugaauagagga

SEQ ID NO: 4204064 - RNA, 15 nt, Yersinia pestis KIM
gcugaugcaauaacu

SEQ ID NO: 4204065 - RNA, 20 nt, Yersinia pestis KIM
gcugauggucauggagagca

SEQ ID NO: 4204066 - RNA, 17 nt, Yersinia pestis KIM
gcugaugucauucuauc

SEQ ID NO: 4204067 - RNA, 18 nt, Yersinia pestis KIM
gcugauguucugccaacc

SEQ ID NO: 4204068 - RNA, 20 nt, Yersinia pestis KIM
gcugauuaauaucaaaacug

SEQ ID NO: 4204069 - RNA, 13 nt, Yersinia pestis KIM
gcugauucaacac

SEQ ID NO: 4204070 - RNA, 16 nt, Yersinia pestis KIM
gcugauucacuggcaa

SEQ ID NO: 4204071 - RNA, 17 nt, Yersinia pestis KIM
gcugauucacuggcaaa

SEQ ID NO: 4204072 - RNA, 19 nt, Yersinia pestis KIM
gcugcaacuccuuaccacu

SEQ ID NO: 4204073 - RNA, 21 nt, Yersinia pestis KIM
gcugcaacuccuuaccacugc

SEQ ID NO: 4204074 - RNA, 23 nt, Yersinia pestis KIM
gcugcaacuccuuaccacugcuc

SEQ ID NO: 4204075 - RNA, 19 nt, Yersinia pestis KIM
gcugcaagcguuacucggc

SEQ ID NO: 4204076 - RNA, 15 nt, Yersinia pestis KIM
gcugcaauaagccag

SEQ ID NO: 4204077 - RNA, 22 nt, Yersinia pestis KIM
gcugcacaaguuggugcaguug

SEQ ID NO: 4204078 - RNA, 15 nt, Yersinia pestis KIM
gcugcacaucauuua

SEQ ID NO: 4204079 - RNA, 18 nt, Yersinia pestis KIM
gcugcaccucugcugaug

SEQ ID NO: 4204080 - RNA, 23 nt, Yersinia pestis KIM
gcugcagccgggaugaucaacag

SEQ ID NO: 4204081 - RNA, 20 nt, Yersinia pestis KIM
gcugcaucuggucaucaugu

SEQ ID NO: 4204082 - RNA, 20 nt, Yersinia pestis KIM
gcugccaguaaaaucaucag

SEQ ID NO: 4204083 - RNA, 17 nt, Yersinia pestis KIM
gcugcccacauaaagau

SEQ ID NO: 4204084 - RNA, 23 nt, Yersinia pestis KIM
gcugcccacauaaagauagccac

SEQ ID NO: 4204085 - RNA, 17 nt, Yersinia pestis KIM
gcugcccgaguaagcgc

SEQ ID NO: 4204086 - RNA, 15 nt, Yersinia pestis KIM
gcugcccgcacacug

SEQ ID NO: 4204087 - RNA, 19 nt, Yersinia pestis KIM
gcugccgcaagaaagaaaa

SEQ ID NO: 4204088 - RNA, 13 nt, Yersinia pestis KIM
gcugccuaccugc

SEQ ID NO: 4204089 - RNA, 20 nt, Yersinia pestis KIM
gcugccugugcggcagugaa

SEQ ID NO: 4204090 - RNA, 18 nt, Yersinia pestis KIM
gcugcgccauaugccaug

SEQ ID NO: 4204091 - RNA, 18 nt, Yersinia pestis KIM
gcugcguucuuugauuug

SEQ ID NO: 4204092 - RNA, 15 nt, Yersinia pestis KIM
gcugcuaaacagggu

SEQ ID NO: 4204093 - RNA, 21 nt, Yersinia pestis KIM
gcugcuaauauuuauaaaaaa

SEQ ID NO: 4204094 - RNA, 9 nt, Yersinia pestis KIM
gcugcucac

SEQ ID NO: 4204095 - RNA, 16 nt, Yersinia pestis KIM
gcugcuccgcccuaaa

SEQ ID NO: 4204096 - RNA, 15 nt, Yersinia pestis KIM
gcugcugcagccggg

SEQ ID NO: 4204097 - RNA, 20 nt, Yersinia pestis KIM
gcugcuguugccaugccaug

SEQ ID NO: 4204098 - RNA, 23 nt, Yersinia pestis KIM
gcugcuguugccaugccauggca

SEQ ID NO: 4204099 - RNA, 12 nt, Yersinia pestis KIM
gcugcuuccugc

SEQ ID NO: 4204100 - RNA, 13 nt, Yersinia pestis KIM
gcugcuuccugcu

SEQ ID NO: 4204101 - RNA, 23 nt, Yersinia pestis KIM
gcugcuugcgcguuaaucugcug

SEQ ID NO: 4204102 - RNA, 22 nt, Yersinia pestis KIM
gcugcuuuuaccgcagggcguu

SEQ ID NO: 4204103 - RNA, 19 nt, Yersinia pestis KIM
gcugcuuuuacgcaaguaa

SEQ ID NO: 4204104 - RNA, 20 nt, Yersinia pestis KIM
gcugcuuuucagugaaaucg

SEQ ID NO: 4204105 - RNA, 12 nt, Yersinia pestis KIM
gcuggaaauuca

SEQ ID NO: 4204106 - RNA, 18 nt, Yersinia pestis KIM
gcuggacgcaucagaucg

SEQ ID NO: 4204107 - RNA, 17 nt, Yersinia pestis KIM
gcuggauauaauccaaa

SEQ ID NO: 4204108 - RNA, 13 nt, Yersinia pestis KIM
gcuggaucagcag

SEQ ID NO: 4204109 - RNA, 15 nt, Yersinia pestis KIM
gcuggaucagcagac

SEQ ID NO: 4204110 - RNA, 16 nt, Yersinia pestis KIM
gcuggaucagcagacu

SEQ ID NO: 4204111 - RNA, 19 nt, Yersinia pestis KIM
gcuggcaaaguuauugacc

SEQ ID NO: 4204112 - RNA, 14 nt, Yersinia pestis KIM
gcuggcaaggcacg

SEQ ID NO: 4204113 - RNA, 22 nt, Yersinia pestis KIM
gcuggcagccuuuauccagcca

SEQ ID NO: 4204114 - RNA, 20 nt, Yersinia pestis KIM
gcuggccaguuucgguacca

SEQ ID NO: 4204115 - RNA, 20 nt, Yersinia pestis KIM
gcuggccggcuacuggucag

SEQ ID NO: 4204116 - RNA, 13 nt, Yersinia pestis KIM
gcuggccuaggcu

SEQ ID NO: 4204117 - RNA, 13 nt, Yersinia pestis KIM
gcuggcgagagcu

SEQ ID NO: 4204118 - RNA, 14 nt, Yersinia pestis KIM
gcuggcgcugauca

SEQ ID NO: 4204119 - RNA, 16 nt, Yersinia pestis KIM
gcuggcuaucaucccu

SEQ ID NO: 4204120 - RNA, 16 nt, Yersinia pestis KIM
gcuggcuuuuuuguuu

SEQ ID NO: 4204121 - RNA, 21 nt, Yersinia pestis KIM
gcuggucauaaucaucugcuc

SEQ ID NO: 4204122 - RNA, 20 nt, Yersinia pestis KIM
gcugguuaucacagcaaauu

SEQ ID NO: 4204123 - RNA, 21 nt, Yersinia pestis KIM
gcuguaaaggcaaagaagaau

SEQ ID NO: 4204124 - RNA, 18 nt, Yersinia pestis KIM
gcuguaaauauaaaauaa

SEQ ID NO: 4204125 - RNA, 13 nt, Yersinia pestis KIM
gcuguaaccgccu

SEQ ID NO: 4204126 - RNA, 19 nt, Yersinia pestis KIM
gcuguaaccgccugccgug

SEQ ID NO: 4204127 - RNA, 15 nt, Yersinia pestis KIM
gcuguagcagccugu

SEQ ID NO: 4204128 - RNA, 17 nt, Yersinia pestis KIM
gcuguaggugucaccaa

SEQ ID NO: 4204129 - RNA, 23 nt, Yersinia pestis KIM
gcuguaugccgcucaaggagaau

SEQ ID NO: 4204130 - RNA, 16 nt, Yersinia pestis KIM
gcugucagccagcgac

SEQ ID NO: 4204131 - RNA, 22 nt, Yersinia pestis KIM
gcugucggcgaugaaaaacaga

SEQ ID NO: 4204132 - RNA, 14 nt, Yersinia pestis KIM
gcugucugaauagu

SEQ ID NO: 4204133 - RNA, 15 nt, Yersinia pestis KIM
gcugugguugccaaa

SEQ ID NO: 4204134 - RNA, 21 nt, Yersinia pestis KIM
gcuguguuuugcuaaccgccu

SEQ ID NO: 4204135 - RNA, 13 nt, Yersinia pestis KIM
gcuguuacccaug

SEQ ID NO: 4204136 - RNA, 18 nt, Yersinia pestis KIM
gcuguuacccauggcaac

SEQ ID NO: 4204137 - RNA, 21 nt, Yersinia pestis KIM
gcuguuauuacugucauugcu

SEQ ID NO: 4204138 - RNA, 20 nt, Yersinia pestis KIM
gcuguucagaugaucaaauu

SEQ ID NO: 4204139 - RNA, 12 nt, Yersinia pestis KIM
gcuguuccaacc

SEQ ID NO: 4204140 - RNA, 17 nt, Yersinia pestis KIM
gcuguuuugucacaaug

SEQ ID NO: 4204141 - RNA, 20 nt, Yersinia pestis KIM
gcuguuuuuuaguuaaauaa

SEQ ID NO: 4204142 - RNA, 11 nt, Yersinia pestis KIM
gcuuaaaacag

SEQ ID NO: 4204143 - RNA, 19 nt, Yersinia pestis KIM
gcuuaaauaaaacacccuu

SEQ ID NO: 4204144 - RNA, 16 nt, Yersinia pestis KIM
gcuuaacugcacgacg

SEQ ID NO: 4204145 - RNA, 20 nt, Yersinia pestis KIM
gcuuaacugugcagcccauu

SEQ ID NO: 4204146 - RNA, 18 nt, Yersinia pestis KIM
gcuuaaucuuuuuaacca

SEQ ID NO: 4204147 - RNA, 14 nt, Yersinia pestis KIM
gcuuacauaaguaa

SEQ ID NO: 4204148 - RNA, 22 nt, Yersinia pestis KIM
gcuuaccgucugggcuggugga

SEQ ID NO: 4204149 - RNA, 22 nt, Yersinia pestis KIM
gcuuacuuuuauaccgcagcau

SEQ ID NO: 4204150 - RNA, 16 nt, Yersinia pestis KIM
gcuuaguuacaauaaa

SEQ ID NO: 4204151 - RNA, 16 nt, Yersinia pestis KIM
gcuuauccagccgcuc

SEQ ID NO: 4204152 - RNA, 22 nt, Yersinia pestis KIM
gcuuaucccuccaucaagccac

SEQ ID NO: 4204153 - RNA, 15 nt, Yersinia pestis KIM
gcuuauuaauuaaug

SEQ ID NO: 4204154 - RNA, 18 nt, Yersinia pestis KIM
gcuucaaaaucaccuggc

SEQ ID NO: 4204155 - RNA, 20 nt, Yersinia pestis KIM
gcuucaaaaucaccuggcca

SEQ ID NO: 4204156 - RNA, 15 nt, Yersinia pestis KIM
gcuucacaucauaau

SEQ ID NO: 4204157 - RNA, 18 nt, Yersinia pestis KIM
gcuucacauccaauggca

SEQ ID NO: 4204158 - RNA, 22 nt, Yersinia pestis KIM
gcuucacccuggcucuggccag

SEQ ID NO: 4204159 - RNA, 23 nt, Yersinia pestis KIM
gcuucauucguuagcucuucacg

SEQ ID NO: 4204160 - RNA, 16 nt, Yersinia pestis KIM
gcuuccaauauugagc

SEQ ID NO: 4204161 - RNA, 19 nt, Yersinia pestis KIM
gcuuccaauauugagcagu

SEQ ID NO: 4204162 - RNA, 23 nt, Yersinia pestis KIM
gcuuccagcucugggaucgauug

SEQ ID NO: 4204163 - RNA, 19 nt, Yersinia pestis KIM
gcuucccuguauaaaaaua

SEQ ID NO: 4204164 - RNA, 13 nt, Yersinia pestis KIM
gcuuccugcgcca

SEQ ID NO: 4204165 - RNA, 18 nt, Yersinia pestis KIM
gcuuccugcgccacgcuu

SEQ ID NO: 4204166 - RNA, 23 nt, Yersinia pestis KIM
gcuucgcucggcucgaaccugaa

SEQ ID NO: 4204167 - RNA, 20 nt, Yersinia pestis KIM
gcuucguccagaugccaaau

SEQ ID NO: 4204168 - RNA, 16 nt, Yersinia pestis KIM
gcuucuaacaauaagu

SEQ ID NO: 4204169 - RNA, 18 nt, Yersinia pestis KIM
gcuucuccuguaaugcau

SEQ ID NO: 4204170 - RNA, 17 nt, Yersinia pestis KIM
gcuucuggcacaaagca

SEQ ID NO: 4204171 - RNA, 14 nt, Yersinia pestis KIM
gcuucuguaauaaa

SEQ ID NO: 4204172 - RNA, 16 nt, Yersinia pestis KIM
gcuucuguaauaaagg

SEQ ID NO: 4204173 - RNA, 17 nt, Yersinia pestis KIM
gcuucuguggcggcaag

SEQ ID NO: 4204174 - RNA, 19 nt, Yersinia pestis KIM
gcuugaaguacggugccag

SEQ ID NO: 4204175 - RNA, 17 nt, Yersinia pestis KIM
gcuugacuaacacgacu

SEQ ID NO: 4204176 - RNA, 18 nt, Yersinia pestis KIM
gcuugagagucgagcggg

SEQ ID NO: 4204177 - RNA, 17 nt, Yersinia pestis KIM
gcuugagcuuauaucaa

SEQ ID NO: 4204178 - RNA, 23 nt, Yersinia pestis KIM
gcuugaucacaaucgcauugacg

SEQ ID NO: 4204179 - RNA, 22 nt, Yersinia pestis KIM
gcuugcauacgcuuaaccagca

SEQ ID NO: 4204180 - RNA, 19 nt, Yersinia pestis KIM
gcuugcaucaacuuugguu

SEQ ID NO: 4204181 - RNA, 20 nt, Yersinia pestis KIM
gcuugcgcguuaaucugcug

SEQ ID NO: 4204182 - RNA, 20 nt, Yersinia pestis KIM
gcuugcuauuaacccgcugc

SEQ ID NO: 4204183 - RNA, 14 nt, Yersinia pestis KIM
gcuuggcaaccgag

SEQ ID NO: 4204184 - RNA, 16 nt, Yersinia pestis KIM
gcuuggcccgauggug

SEQ ID NO: 4204185 - RNA, 13 nt, Yersinia pestis KIM
gcuuggcgggcug

SEQ ID NO: 4204186 - RNA, 18 nt, Yersinia pestis KIM
gcuuggcgggcuggccac

SEQ ID NO: 4204187 - RNA, 17 nt, Yersinia pestis KIM
gcuugggcuucacaucc

SEQ ID NO: 4204188 - RNA, 23 nt, Yersinia pestis KIM
gcuugucaccguaaccauuggca

SEQ ID NO: 4204189 - RNA, 14 nt, Yersinia pestis KIM
gcuugugcgccaac

SEQ ID NO: 4204190 - RNA, 20 nt, Yersinia pestis KIM
gcuugugcucacgucaccac

SEQ ID NO: 4204191 - RNA, 14 nt, Yersinia pestis KIM
gcuuguuagcugcc

SEQ ID NO: 4204192 - RNA, 19 nt, Yersinia pestis KIM
gcuuguucuguuagcgacu

SEQ ID NO: 4204193 - RNA, 17 nt, Yersinia pestis KIM
gcuuguuguugauaguu

SEQ ID NO: 4204194 - RNA, 20 nt, Yersinia pestis KIM
gcuuuaaccuuucuaauuau

SEQ ID NO: 4204195 - RNA, 23 nt, Yersinia pestis KIM
gcuuuaccuguuucgauccagcu

SEQ ID NO: 4204196 - RNA, 15 nt, Yersinia pestis KIM
gcuuuacucuucugc

SEQ ID NO: 4204197 - RNA, 16 nt, Yersinia pestis KIM
gcuuuagccagucacc

SEQ ID NO: 4204198 - RNA, 18 nt, Yersinia pestis KIM
gcuuuauaguccuuccau

SEQ ID NO: 4204199 - RNA, 15 nt, Yersinia pestis KIM
gcuuuauauugccau

SEQ ID NO: 4204200 - RNA, 14 nt, Yersinia pestis KIM
gcuuuaucaccagu

SEQ ID NO: 4204201 - RNA, 18 nt, Yersinia pestis KIM
gcuuuaucgguuguccuu

SEQ ID NO: 4204202 - RNA, 15 nt, Yersinia pestis KIM
gcuuucaauaaaacu

SEQ ID NO: 4204203 - RNA, 16 nt, Yersinia pestis KIM
gcuuucaauaaaacuc

SEQ ID NO: 4204204 - RNA, 20 nt, Yersinia pestis KIM
gcuuucagauaaugccuaag

SEQ ID NO: 4204205 - RNA, 18 nt, Yersinia pestis KIM
gcuuucagugagcauuuu

SEQ ID NO: 4204206 - RNA, 21 nt, Yersinia pestis KIM
gcuuucagugagcauuuuguu

SEQ ID NO: 4204207 - RNA, 14 nt, Yersinia pestis KIM
gcuuucaucuucuu

SEQ ID NO: 4204208 - RNA, 15 nt, Yersinia pestis KIM
gcuuucuugccauaa

SEQ ID NO: 4204209 - RNA, 17 nt, Yersinia pestis KIM
gcuuucuugccauaagc

SEQ ID NO: 4204210 - RNA, 19 nt, Yersinia pestis KIM
gcuuugacugacaaguuuu

SEQ ID NO: 4204211 - RNA, 19 nt, Yersinia pestis KIM
gcuuugaugccuaauaauu

SEQ ID NO: 4204212 - RNA, 14 nt, Yersinia pestis KIM
gcuuugcaccauca

SEQ ID NO: 4204213 - RNA, 19 nt, Yersinia pestis KIM
gcuuugcgauacaccauuu

SEQ ID NO: 4204214 - RNA, 22 nt, Yersinia pestis KIM
gcuuugguugccagauaauguu

SEQ ID NO: 4204215 - RNA, 18 nt, Yersinia pestis KIM
gcuuugugggcuuuugcu

SEQ ID NO: 4204216 - RNA, 18 nt, Yersinia pestis KIM
gcuuuguuggcacugcau

SEQ ID NO: 4204217 - RNA, 23 nt, Yersinia pestis KIM
gcuuuuagauaaaggcaaaagca

SEQ ID NO: 4204218 - RNA, 20 nt, Yersinia pestis KIM
gcuuuucauauaagcaauac

SEQ ID NO: 4204219 - RNA, 15 nt, Yersinia pestis KIM
gcuuuucugccuauc

SEQ ID NO: 4204220 - RNA, 16 nt, Yersinia pestis KIM
gcuuuucugccuaucu

SEQ ID NO: 4204221 - RNA, 14 nt, Yersinia pestis KIM
gcuuuuuacccagu

SEQ ID NO: 4204222 - RNA, 15 nt, Yersinia pestis KIM
gcuuuuuacgccuau

SEQ ID NO: 4204223 - RNA, 13 nt, Yersinia pestis KIM
gcuuuuuaucauu

SEQ ID NO: 4204224 - RNA, 11 nt, Yersinia pestis KIM
gcuuuuugcuu

SEQ ID NO: 4204225 - RNA, 12 nt, Yersinia pestis KIM
gcuuuuugcuuu

SEQ ID NO: 4204226 - RNA, 17 nt, Yersinia pestis KIM
gcuuuuugcuuuuugcu

SEQ ID NO: 4204227 - RNA, 22 nt, Yersinia pestis KIM
gcuuuuuuuauugggaaccccu

SEQ ID NO: 4204228 - RNA, 11 nt, Yersinia pestis KIM
ggaaaaaauac

SEQ ID NO: 4204229 - RNA, 15 nt, Yersinia pestis KIM
ggaaaaaaucuuccu

SEQ ID NO: 4204230 - RNA, 20 nt, Yersinia pestis KIM
ggaaaaacugaaaaaggcac

SEQ ID NO: 4204231 - RNA, 13 nt, Yersinia pestis KIM
ggaaaaaucagua

SEQ ID NO: 4204232 - RNA, 13 nt, Yersinia pestis KIM
ggaaaacagcaac

SEQ ID NO: 4204233 - RNA, 15 nt, Yersinia pestis KIM
ggaaacaaaaccuaa

SEQ ID NO: 4204234 - RNA, 17 nt, Yersinia pestis KIM
ggaaacgaacagggagu

SEQ ID NO: 4204235 - RNA, 22 nt, Yersinia pestis KIM
ggaaaucgaaauuaaggaaaag

SEQ ID NO: 4204236 - RNA, 12 nt, Yersinia pestis KIM
ggaaauuucccc

SEQ ID NO: 4204237 - RNA, 20 nt, Yersinia pestis KIM
ggaaauuucccccucacauu

SEQ ID NO: 4204238 - RNA, 21 nt, Yersinia pestis KIM
ggaaauuugcacugcagggaa

SEQ ID NO: 4204239 - RNA, 15 nt, Yersinia pestis KIM
ggaacagcucggcca

SEQ ID NO: 4204240 - RNA, 21 nt, Yersinia pestis KIM
ggaaccgcuaaagucacacug

SEQ ID NO: 4204241 - RNA, 22 nt, Yersinia pestis KIM
ggaacgguugcccguuaauauu

SEQ ID NO: 4204242 - RNA, 16 nt, Yersinia pestis KIM
ggaacguugcacccug

SEQ ID NO: 4204243 - RNA, 13 nt, Yersinia pestis KIM
ggaacuguaaaua

SEQ ID NO: 4204244 - RNA, 21 nt, Yersinia pestis KIM
ggaagacuuccagcaccacua

SEQ ID NO: 4204245 - RNA, 16 nt, Yersinia pestis KIM
ggaagagauagagcag

SEQ ID NO: 4204246 - RNA, 15 nt, Yersinia pestis KIM
ggaagcaagaaacug

SEQ ID NO: 4204247 - RNA, 16 nt, Yersinia pestis KIM
ggaagggugcggcuug

SEQ ID NO: 4204248 - RNA, 13 nt, Yersinia pestis KIM
ggaagguguuuaa

SEQ ID NO: 4204249 - RNA, 21 nt, Yersinia pestis KIM
ggaaguacuuauuugaaacac

SEQ ID NO: 4204250 - RNA, 19 nt, Yersinia pestis KIM
ggaauaaccuacaaaaaua

SEQ ID NO: 4204251 - RNA, 22 nt, Yersinia pestis KIM
ggaauaaguguguguauuuaaa

SEQ ID NO: 4204252 - RNA, 16 nt, Yersinia pestis KIM
ggaauagagccucuau

SEQ ID NO: 4204253 - RNA, 20 nt, Yersinia pestis KIM
ggaauagcuguaaaauacca

SEQ ID NO: 4204254 - RNA, 18 nt, Yersinia pestis KIM
ggaaucagcguuuuauuc

SEQ ID NO: 4204255 - RNA, 20 nt, Yersinia pestis KIM
ggaaucagcguuuuauucgu

SEQ ID NO: 4204256 - RNA, 23 nt, Yersinia pestis KIM
ggaaucuugauuagcuggcuguu

SEQ ID NO: 4204257 - RNA, 14 nt, Yersinia pestis KIM
ggaaugcuauauuu

SEQ ID NO: 4204258 - RNA, 18 nt, Yersinia pestis KIM
ggaauggcgcaauagcau

SEQ ID NO: 4204259 - RNA, 12 nt, Yersinia pestis KIM
ggaauuaauauc

SEQ ID NO: 4204260 - RNA, 15 nt, Yersinia pestis KIM
ggacaaaccagcccu

SEQ ID NO: 4204261 - RNA, 23 nt, Yersinia pestis KIM
ggacaacuucacuucagaaccga

SEQ ID NO: 4204262 - RNA, 19 nt, Yersinia pestis KIM
ggacagauuauuucagcuu

SEQ ID NO: 4204263 - RNA, 15 nt, Yersinia pestis KIM
ggacagcaaccacuu

SEQ ID NO: 4204264 - RNA, 16 nt, Yersinia pestis KIM
ggacauuuagcacugu

SEQ ID NO: 4204265 - RNA, 17 nt, Yersinia pestis KIM
ggacauuuagcacuguu

SEQ ID NO: 4204266 - RNA, 19 nt, Yersinia pestis KIM
ggacgaauacacagcgaga

SEQ ID NO: 4204267 - RNA, 21 nt, Yersinia pestis KIM
ggacgaccuguagcuuuuuaa

SEQ ID NO: 4204268 - RNA, 16 nt, Yersinia pestis KIM
ggacgacggguauauu

SEQ ID NO: 4204269 - RNA, 21 nt, Yersinia pestis KIM
ggacgauaaauucaaauauca

SEQ ID NO: 4204270 - RNA, 14 nt, Yersinia pestis KIM
ggacgcaucagauc

SEQ ID NO: 4204271 - RNA, 23 nt, Yersinia pestis KIM
ggacuuacccuacccauuauaaa

SEQ ID NO: 4204272 - RNA, 12 nt, Yersinia pestis KIM
ggagaaacauua

SEQ ID NO: 4204273 - RNA, 14 nt, Yersinia pestis KIM
ggagaaacauuaaa

SEQ ID NO: 4204274 - RNA, 21 nt, Yersinia pestis KIM
ggagaacaaugguucaucauu

SEQ ID NO: 4204275 - RNA, 14 nt, Yersinia pestis KIM
ggagaauagugggg

SEQ ID NO: 4204276 - RNA, 16 nt, Yersinia pestis KIM
ggagaauguuaaaccc

SEQ ID NO: 4204277 - RNA, 21 nt, Yersinia pestis KIM
ggagacuucgccaaucucaaa

SEQ ID NO: 4204278 - RNA, 14 nt, Yersinia pestis KIM
ggagagaacaggca

SEQ ID NO: 4204279 - RNA, 12 nt, Yersinia pestis KIM
ggagagauuaga

SEQ ID NO: 4204280 - RNA, 18 nt, Yersinia pestis KIM
ggagagcagggcccgcca

SEQ ID NO: 4204281 - RNA, 15 nt, Yersinia pestis KIM
ggagaggagauuaga

SEQ ID NO: 4204282 - RNA, 12 nt, Yersinia pestis KIM
ggagaggcuuac

SEQ ID NO: 4204283 - RNA, 12 nt, Yersinia pestis KIM
ggagaucgcucu

SEQ ID NO: 4204284 - RNA, 19 nt, Yersinia pestis KIM
ggagaucgcucucacccug

SEQ ID NO: 4204285 - RNA, 22 nt, Yersinia pestis KIM
ggagauugcuacugaagguuau

SEQ ID NO: 4204286 - RNA, 18 nt, Yersinia pestis KIM
ggagauuucagacugcug

SEQ ID NO: 4204287 - RNA, 21 nt, Yersinia pestis KIM
ggagauuucagacugcugaca

SEQ ID NO: 4204288 - RNA, 23 nt, Yersinia pestis KIM
ggagccaaguguccgcgccauaa

SEQ ID NO: 4204289 - RNA, 11 nt, Yersinia pestis KIM
ggagccaauag

SEQ ID NO: 4204290 - RNA, 17 nt, Yersinia pestis KIM
ggagccaauagaggcuc

SEQ ID NO: 4204291 - RNA, 19 nt, Yersinia pestis KIM
ggagccaauagaggcuccc

SEQ ID NO: 4204292 - RNA, 12 nt, Yersinia pestis KIM
ggagcguacacg

SEQ ID NO: 4204293 - RNA, 19 nt, Yersinia pestis KIM
ggaggagauuucagacugc

SEQ ID NO: 4204294 - RNA, 16 nt, Yersinia pestis KIM
ggaggagguagcaaca

SEQ ID NO: 4204295 - RNA, 13 nt, Yersinia pestis KIM
ggaggaugguaaa

SEQ ID NO: 4204296 - RNA, 19 nt, Yersinia pestis KIM
ggagucagggagucaggga

SEQ ID NO: 4204297 - RNA, 23 nt, Yersinia pestis KIM
ggaguuacucagcauccuccuga

SEQ ID NO: 4204298 - RNA, 17 nt, Yersinia pestis KIM
ggaguuugagaccccca

SEQ ID NO: 4204299 - RNA, 18 nt, Yersinia pestis KIM
ggaguuugagacccccaa

SEQ ID NO: 4204300 - RNA, 18 nt, Yersinia pestis KIM
ggaguuuuacugauaugg

SEQ ID NO: 4204301 - RNA, 13 nt, Yersinia pestis KIM
ggaguuuuuauuu

SEQ ID NO: 4204302 - RNA, 17 nt, Yersinia pestis KIM
ggauaaaucgcccaacc

SEQ ID NO: 4204303 - RNA, 17 nt, Yersinia pestis KIM
ggauaaauuaauaacgc

SEQ ID NO: 4204304 - RNA, 19 nt, Yersinia pestis KIM
ggauaaccgcauucccugc

SEQ ID NO: 4204305 - RNA, 13 nt, Yersinia pestis KIM
ggauaaccuauua

SEQ ID NO: 4204306 - RNA, 21 nt, Yersinia pestis KIM
ggauaaccuccgcuuuaaccu

SEQ ID NO: 4204307 - RNA, 19 nt, Yersinia pestis KIM
ggauaacguuucagggugg

SEQ ID NO: 4204308 - RNA, 16 nt, Yersinia pestis KIM
ggauaaggugaugaau

SEQ ID NO: 4204309 - RNA, 18 nt, Yersinia pestis KIM
ggauaaguuccggcagau

SEQ ID NO: 4204310 - RNA, 13 nt, Yersinia pestis KIM
ggauaaucaucag

SEQ ID NO: 4204311 - RNA, 17 nt, Yersinia pestis KIM
ggauaaucuaggccugg

SEQ ID NO: 4204312 - RNA, 18 nt, Yersinia pestis KIM
ggauaauguccuauuuaa

SEQ ID NO: 4204313 - RNA, 13 nt, Yersinia pestis KIM
ggauaauuucagc

SEQ ID NO: 4204314 - RNA, 14 nt, Yersinia pestis KIM
ggauagcaacugcc

SEQ ID NO: 4204315 - RNA, 16 nt, Yersinia pestis KIM
ggauagcggcuaaagg

SEQ ID NO: 4204316 - RNA, 20 nt, Yersinia pestis KIM
ggauaugacuaaacugauca

SEQ ID NO: 4204317 - RNA, 20 nt, Yersinia pestis KIM
ggauauuaucugguuggcau

SEQ ID NO: 4204318 - RNA, 18 nt, Yersinia pestis KIM
ggauauucacguuuuucc

SEQ ID NO: 4204319 - RNA, 21 nt, Yersinia pestis KIM
ggauauuucacguucaucaau

SEQ ID NO: 4204320 - RNA, 11 nt, Yersinia pestis KIM
ggauauuucgg

SEQ ID NO: 4204321 - RNA, 22 nt, Yersinia pestis KIM
ggaucacauagugcaaaauucc

SEQ ID NO: 4204322 - RNA, 20 nt, Yersinia pestis KIM
ggaucaccagcaaaggccac

SEQ ID NO: 4204323 - RNA, 23 nt, Yersinia pestis KIM
ggaucaccaggcucucauauccc

SEQ ID NO: 4204324 - RNA, 16 nt, Yersinia pestis KIM
ggaucaggaucaccag

SEQ ID NO: 4204325 - RNA, 15 nt, Yersinia pestis KIM
ggaucaggccagaga

SEQ ID NO: 4204326 - RNA, 13 nt, Yersinia pestis KIM
ggauccauaggau

SEQ ID NO: 4204327 - RNA, 16 nt, Yersinia pestis KIM
ggauccuugggucagu

SEQ ID NO: 4204328 - RNA, 14 nt, Yersinia pestis KIM
ggaugaaaagagcu

SEQ ID NO: 4204329 - RNA, 15 nt, Yersinia pestis KIM
ggaugaaaagagcuu

SEQ ID NO: 4204330 - RNA, 20 nt, Yersinia pestis KIM
ggaugaguauuaccucauca

SEQ ID NO: 4204331 - RNA, 19 nt, Yersinia pestis KIM
ggaugcgcuuguuagcugc

SEQ ID NO: 4204332 - RNA, 15 nt, Yersinia pestis KIM
ggauggucauccaca

SEQ ID NO: 4204333 - RNA, 18 nt, Yersinia pestis KIM
ggaugucaggaucauugc

SEQ ID NO: 4204334 - RNA, 22 nt, Yersinia pestis KIM
ggauguguggcagucacugcug

SEQ ID NO: 4204335 - RNA, 19 nt, Yersinia pestis KIM
ggauuaaauaaagauaaug

SEQ ID NO: 4204336 - RNA, 19 nt, Yersinia pestis KIM
ggauuaaauucuaccuggc

SEQ ID NO: 4204337 - RNA, 22 nt, Yersinia pestis KIM
ggauuaaauucuaccuggcuca

SEQ ID NO: 4204338 - RNA, 23 nt, Yersinia pestis KIM
ggauuaacuuuucuucauugcug

SEQ ID NO: 4204339 - RNA, 18 nt, Yersinia pestis KIM
ggauuacuucaauaagaa

SEQ ID NO: 4204340 - RNA, 22 nt, Yersinia pestis KIM
ggauucgugucaauauucuguu

SEQ ID NO: 4204341 - RNA, 14 nt, Yersinia pestis KIM
ggauucuugcugca

SEQ ID NO: 4204342 - RNA, 14 nt, Yersinia pestis KIM
ggauugaaaucaga

SEQ ID NO: 4204343 - RNA, 16 nt, Yersinia pestis KIM
ggauugcaaauccguc

SEQ ID NO: 4204344 - RNA, 15 nt, Yersinia pestis KIM
ggauugccaaaugca

SEQ ID NO: 4204345 - RNA, 19 nt, Yersinia pestis KIM
ggauuuaugcaaauaauaa

SEQ ID NO: 4204346 - RNA, 21 nt, Yersinia pestis KIM
ggauuucaauccgaccacuga

SEQ ID NO: 4204347 - RNA, 12 nt, Yersinia pestis KIM
ggauuucuucau

SEQ ID NO: 4204348 - RNA, 15 nt, Yersinia pestis KIM
ggauuuuccgcagcu

SEQ ID NO: 4204349 - RNA, 23 nt, Yersinia pestis KIM
ggcaaaaacagucauuaacacau

SEQ ID NO: 4204350 - RNA, 18 nt, Yersinia pestis KIM
ggcaaaacguauaaaagc

SEQ ID NO: 4204351 - RNA, 12 nt, Yersinia pestis KIM
ggcaaaaugauc

SEQ ID NO: 4204352 - RNA, 20 nt, Yersinia pestis KIM
ggcaaacgcuuuuaacugug

SEQ ID NO: 4204353 - RNA, 22 nt, Yersinia pestis KIM
ggcaaacggguaacgaacgcuc

SEQ ID NO: 4204354 - RNA, 15 nt, Yersinia pestis KIM
ggcaaacuccuccaa

SEQ ID NO: 4204355 - RNA, 14 nt, Yersinia pestis KIM
ggcaaaguguaauu

SEQ ID NO: 4204356 - RNA, 18 nt, Yersinia pestis KIM
ggcaaauagagcaccaaa

SEQ ID NO: 4204357 - RNA, 17 nt, Yersinia pestis KIM
ggcaaauucaacaauca

SEQ ID NO: 4204358 - RNA, 23 nt, Yersinia pestis KIM
ggcaaauugcgagcugagcuuau

SEQ ID NO: 4204359 - RNA, 17 nt, Yersinia pestis KIM
ggcaacacccaacucaa

SEQ ID NO: 4204360 - RNA, 22 nt, Yersinia pestis KIM
ggcaaccagcguucuaucaaug

SEQ ID NO: 4204361 - RNA, 19 nt, Yersinia pestis KIM
ggcaaccgguaacauauaa

SEQ ID NO: 4204362 - RNA, 15 nt, Yersinia pestis KIM
ggcaacgacugggua

SEQ ID NO: 4204363 - RNA, 20 nt, Yersinia pestis KIM
ggcaacucuagcgccagcaa

SEQ ID NO: 4204364 - RNA, 24 nt, Yersinia pestis KIM
ggcaacuucccggcgauucuccac

SEQ ID NO: 4204365 - RNA, 18 nt, Yersinia pestis KIM
ggcaacuuuuuucauccu

SEQ ID NO: 4204366 - RNA, 16 nt, Yersinia pestis KIM
ggcaagcaagcaaagc

SEQ ID NO: 4204367 - RNA, 21 nt, Yersinia pestis KIM
ggcaagcaagcaaagcccgau

SEQ ID NO: 4204368 - RNA, 16 nt, Yersinia pestis KIM
ggcaaggauggcgcgg

SEQ ID NO: 4204369 - RNA, 15 nt, Yersinia pestis KIM
ggcaauaaaggcaag

SEQ ID NO: 4204370 - RNA, 16 nt, Yersinia pestis KIM
ggcaauaacaaacaca

SEQ ID NO: 4204371 - RNA, 20 nt, Yersinia pestis KIM
ggcaauacaccgccaguaug

SEQ ID NO: 4204372 - RNA, 17 nt, Yersinia pestis KIM
ggcaaucuccaguaaau

SEQ ID NO: 4204373 - RNA, 19 nt, Yersinia pestis KIM
ggcaaucuggaaggcggcc

SEQ ID NO: 4204374 - RNA, 14 nt, Yersinia pestis KIM
ggcaauggcucagg

SEQ ID NO: 4204375 - RNA, 21 nt, Yersinia pestis KIM
ggcaauggcucaggcucauca

SEQ ID NO: 4204376 - RNA, 17 nt, Yersinia pestis KIM
ggcaauuaagcaaaaag

SEQ ID NO: 4204377 - RNA, 23 nt, Yersinia pestis KIM
ggcaauuaagcaaaaaggcugca

SEQ ID NO: 4204378 - RNA, 21 nt, Yersinia pestis KIM
ggcaauuaucuuauccacagc

SEQ ID NO: 4204379 - RNA, 14 nt, Yersinia pestis KIM
ggcacaguuuaucu

SEQ ID NO: 4204380 - RNA, 14 nt, Yersinia pestis KIM
ggcaccaauggcua

SEQ ID NO: 4204381 - RNA, 18 nt, Yersinia pestis KIM
ggcacggaucucauucag

SEQ ID NO: 4204382 - RNA, 16 nt, Yersinia pestis KIM
ggcacuaauagcauuu

SEQ ID NO: 4204383 - RNA, 15 nt, Yersinia pestis KIM
ggcacugcagaaaau

SEQ ID NO: 4204384 - RNA, 23 nt, Yersinia pestis KIM
ggcacugcagaaaaugcggcggc

SEQ ID NO: 4204385 - RNA, 20 nt, Yersinia pestis KIM
ggcacugcccugccugguau

SEQ ID NO: 4204386 - RNA, 17 nt, Yersinia pestis KIM
ggcacuggaaacaaaac

SEQ ID NO: 4204387 - RNA, 11 nt, Yersinia pestis KIM
ggcagaaacaa

SEQ ID NO: 4204388 - RNA, 14 nt, Yersinia pestis KIM
ggcagaaguccuga

SEQ ID NO: 4204389 - RNA, 23 nt, Yersinia pestis KIM
ggcagacauuccgucagcaugaa

SEQ ID NO: 4204390 - RNA, 21 nt, Yersinia pestis KIM
ggcagauaugccaggcaucau

SEQ ID NO: 4204391 - RNA, 20 nt, Yersinia pestis KIM
ggcagauuggauugaaauca

SEQ ID NO: 4204392 - RNA, 15 nt, Yersinia pestis KIM
ggcagcgacaaccug

SEQ ID NO: 4204393 - RNA, 16 nt, Yersinia pestis KIM
ggcagcgacaaccugu

SEQ ID NO: 4204394 - RNA, 15 nt, Yersinia pestis KIM
ggcagcuaaagcaaa

SEQ ID NO: 4204395 - RNA, 15 nt, Yersinia pestis KIM
ggcagcuugaagccu

SEQ ID NO: 4204396 - RNA, 22 nt, Yersinia pestis KIM
ggcaggaagcccguuauggcaa

SEQ ID NO: 4204397 - RNA, 13 nt, Yersinia pestis KIM
ggcaggagucuga

SEQ ID NO: 4204398 - RNA, 12 nt, Yersinia pestis KIM
ggcaggccccau

SEQ ID NO: 4204399 - RNA, 17 nt, Yersinia pestis KIM
ggcaggccccaucauaa

SEQ ID NO: 4204400 - RNA, 18 nt, Yersinia pestis KIM
ggcagggcgguaacgcag

SEQ ID NO: 4204401 - RNA, 17 nt, Yersinia pestis KIM
ggcagguagggcggccc

SEQ ID NO: 4204402 - RNA, 21 nt, Yersinia pestis KIM
ggcagguagggcggcccacuu

SEQ ID NO: 4204403 - RNA, 21 nt, Yersinia pestis KIM
ggcaguaaaaugccgcgcuug

SEQ ID NO: 4204404 - RNA, 18 nt, Yersinia pestis KIM
ggcaguauuuuaagaaaa

SEQ ID NO: 4204405 - RNA, 13 nt, Yersinia pestis KIM
ggcagucacugcu

SEQ ID NO: 4204406 - RNA, 22 nt, Yersinia pestis KIM
ggcagucacugcugcacuggcg

SEQ ID NO: 4204407 - RNA, 19 nt, Yersinia pestis KIM
ggcagugacugaauggcua

SEQ ID NO: 4204408 - RNA, 22 nt, Yersinia pestis KIM
ggcaguucauuccccaucgcca

SEQ ID NO: 4204409 - RNA, 21 nt, Yersinia pestis KIM
ggcaguuuuuuauggcauaaa

SEQ ID NO: 4204410 - RNA, 18 nt, Yersinia pestis KIM
ggcauaaauaauaaauaa

SEQ ID NO: 4204411 - RNA, 18 nt, Yersinia pestis KIM
ggcauacuccgcugagca

SEQ ID NO: 4204412 - RNA, 17 nt, Yersinia pestis KIM
ggcaucaaugaaaauau

SEQ ID NO: 4204413 - RNA, 13 nt, Yersinia pestis KIM
ggcaucauccuca

SEQ ID NO: 4204414 - RNA, 15 nt, Yersinia pestis KIM
ggcaucccaccuuca

SEQ ID NO: 4204415 - RNA, 22 nt, Yersinia pestis KIM
ggcaucgguaauacucuggcca

SEQ ID NO: 4204416 - RNA, 22 nt, Yersinia pestis KIM
ggcaucuaccuguguugcgcca

SEQ ID NO: 4204417 - RNA, 16 nt, Yersinia pestis KIM
ggcaugugggcagggc

SEQ ID NO: 4204418 - RNA, 16 nt, Yersinia pestis KIM
ggcauuaaacugaaua

SEQ ID NO: 4204419 - RNA, 19 nt, Yersinia pestis KIM
ggcauucgcugauuaaugu

SEQ ID NO: 4204420 - RNA, 21 nt, Yersinia pestis KIM
ggcauucuaguuugugcugcu

SEQ ID NO: 4204421 - RNA, 19 nt, Yersinia pestis KIM
ggcauuuuuauuuaccgaa

SEQ ID NO: 4204422 - RNA, 12 nt, Yersinia pestis KIM
ggccaacauaau

SEQ ID NO: 4204423 - RNA, 20 nt, Yersinia pestis KIM
ggccaacaucgaagggcggg

SEQ ID NO: 4204424 - RNA, 17 nt, Yersinia pestis KIM
ggccaaguuuacuuugu

SEQ ID NO: 4204425 - RNA, 22 nt, Yersinia pestis KIM
ggccaauagaaaaacacuggca

SEQ ID NO: 4204426 - RNA, 22 nt, Yersinia pestis KIM
ggccaauuggcuuaacucgcca

SEQ ID NO: 4204427 - RNA, 18 nt, Yersinia pestis KIM
ggccacaauaaaauaagc

SEQ ID NO: 4204428 - RNA, 14 nt, Yersinia pestis KIM
ggccacccccauaa

SEQ ID NO: 4204429 - RNA, 14 nt, Yersinia pestis KIM
ggccacccugccaa

SEQ ID NO: 4204430 - RNA, 18 nt, Yersinia pestis KIM
ggccacccugccaaaaaa

SEQ ID NO: 4204431 - RNA, 19 nt, Yersinia pestis KIM
ggccacccugccaaaaaau

SEQ ID NO: 4204432 - RNA, 16 nt, Yersinia pestis KIM
ggccacuucgguggcc

SEQ ID NO: 4204433 - RNA, 19 nt, Yersinia pestis KIM
ggccagagacaccgccagc

SEQ ID NO: 4204434 - RNA, 14 nt, Yersinia pestis KIM
ggccagagcauaga

SEQ ID NO: 4204435 - RNA, 14 nt, Yersinia pestis KIM
ggccaucaucuuca

SEQ ID NO: 4204436 - RNA, 22 nt, Yersinia pestis KIM
ggccauuacccucuaucgcuca

SEQ ID NO: 4204437 - RNA, 15 nt, Yersinia pestis KIM
ggccauuagcgcggg

SEQ ID NO: 4204438 - RNA, 15 nt, Yersinia pestis KIM
ggccauucagcguau

SEQ ID NO: 4204439 - RNA, 18 nt, Yersinia pestis KIM
ggcccaagccauccuuuu

SEQ ID NO: 4204440 - RNA, 20 nt, Yersinia pestis KIM
ggcccaucuuucggccuccc

SEQ ID NO: 4204441 - RNA, 19 nt, Yersinia pestis KIM
ggccccaauccaccacuga

SEQ ID NO: 4204442 - RNA, 14 nt, Yersinia pestis KIM
ggccccagcccagc

SEQ ID NO: 4204443 - RNA, 15 nt, Yersinia pestis KIM
ggccccagcccagca

SEQ ID NO: 4204444 - RNA, 23 nt, Yersinia pestis KIM
ggcccgcuagugauagcgggccu

SEQ ID NO: 4204445 - RNA, 23 nt, Yersinia pestis KIM
ggcccgcuaucacuagcgggccu

SEQ ID NO: 4204446 - RNA, 15 nt, Yersinia pestis KIM
ggccgacaauaccgc

SEQ ID NO: 4204447 - RNA, 18 nt, Yersinia pestis KIM
ggccgagacaccauguug

SEQ ID NO: 4204448 - RNA, 18 nt, Yersinia pestis KIM
ggccgauacacaugguug

SEQ ID NO: 4204449 - RNA, 20 nt, Yersinia pestis KIM
ggccgaucaacaggccaccu

SEQ ID NO: 4204450 - RNA, 16 nt, Yersinia pestis KIM
ggccgcaugcaacaga

SEQ ID NO: 4204451 - RNA, 20 nt, Yersinia pestis KIM
ggccgccgcggugaagaaca

SEQ ID NO: 4204452 - RNA, 20 nt, Yersinia pestis KIM
ggccgcuacugguaauaaug

SEQ ID NO: 4204453 - RNA, 14 nt, Yersinia pestis KIM
ggccgcuugccaau

SEQ ID NO: 4204454 - RNA, 19 nt, Yersinia pestis KIM
ggccgugaccaccgcagca

SEQ ID NO: 4204455 - RNA, 17 nt, Yersinia pestis KIM
ggccguguuuuucccua

SEQ ID NO: 4204456 - RNA, 20 nt, Yersinia pestis KIM
ggccguugaugcucauuuaa

SEQ ID NO: 4204457 - RNA, 20 nt, Yersinia pestis KIM
ggccguuugcccuuuuugcg

SEQ ID NO: 4204458 - RNA, 21 nt, Yersinia pestis KIM
ggccuaaugccgcgcccccag

SEQ ID NO: 4204459 - RNA, 20 nt, Yersinia pestis KIM
ggccuacggaggucaaauga

SEQ ID NO: 4204460 - RNA, 14 nt, Yersinia pestis KIM
ggccucuucuuuua

SEQ ID NO: 4204461 - RNA, 16 nt, Yersinia pestis KIM
ggccugcacaucaaua

SEQ ID NO: 4204462 - RNA, 23 nt, Yersinia pestis KIM
ggccugcugugucgcuauuuccg

SEQ ID NO: 4204463 - RNA, 22 nt, Yersinia pestis KIM
ggccuguaccaccaccaacagc

SEQ ID NO: 4204464 - RNA, 22 nt, Yersinia pestis KIM
ggccuguuugcagcgaauugac

SEQ ID NO: 4204465 - RNA, 23 nt, Yersinia pestis KIM
ggcgaaauugacuuuaaaaaaau

SEQ ID NO: 4204466 - RNA, 12 nt, Yersinia pestis KIM
ggcgaacagaaa

SEQ ID NO: 4204467 - RNA, 16 nt, Yersinia pestis KIM
ggcgaacagaaaucaa

SEQ ID NO: 4204468 - RNA, 19 nt, Yersinia pestis KIM
ggcgaagggcgcagccccc

SEQ ID NO: 4204469 - RNA, 20 nt, Yersinia pestis KIM
ggcgacaauauuccaaaaaa

SEQ ID NO: 4204470 - RNA, 19 nt, Yersinia pestis KIM
ggcgacuuacgucgcuacg

SEQ ID NO: 4204471 - RNA, 14 nt, Yersinia pestis KIM
ggcgagauggucau

SEQ ID NO: 4204472 - RNA, 11 nt, Yersinia pestis KIM
ggcgagcacug

SEQ ID NO: 4204473 - RNA, 22 nt, Yersinia pestis KIM
ggcgauaguaauuuuuagccgc

SEQ ID NO: 4204474 - RNA, 17 nt, Yersinia pestis KIM
ggcgauugaacaugaug

SEQ ID NO: 4204475 - RNA, 12 nt, Yersinia pestis KIM
ggcgauuucagc

SEQ ID NO: 4204476 - RNA, 17 nt, Yersinia pestis KIM
ggcgcacguucccaggc

SEQ ID NO: 4204477 - RNA, 16 nt, Yersinia pestis KIM
ggcgcacucauccucu

SEQ ID NO: 4204478 - RNA, 14 nt, Yersinia pestis KIM
ggcgcacugauucu

SEQ ID NO: 4204479 - RNA, 19 nt, Yersinia pestis KIM
ggcgcauauccugauagga

SEQ ID NO: 4204480 - RNA, 13 nt, Yersinia pestis KIM
ggcgcauccccac

SEQ ID NO: 4204481 - RNA, 14 nt, Yersinia pestis KIM
ggcgcggcucgagc

SEQ ID NO: 4204482 - RNA, 23 nt, Yersinia pestis KIM
ggcgcguuucuuagcugauuuga

SEQ ID NO: 4204483 - RNA, 20 nt, Yersinia pestis KIM
ggcgcuaagccauuaaacgu

SEQ ID NO: 4204484 - RNA, 13 nt, Yersinia pestis KIM
ggcgcuaaugaga

SEQ ID NO: 4204485 - RNA, 14 nt, Yersinia pestis KIM
ggcgcuacuucccc

SEQ ID NO: 4204486 - RNA, 20 nt, Yersinia pestis KIM
ggcgcugagguucuccaaca

SEQ ID NO: 4204487 - RNA, 14 nt, Yersinia pestis KIM
ggcgcuguugcaug

SEQ ID NO: 4204488 - RNA, 17 nt, Yersinia pestis KIM
ggcgcuuaacugcacga

SEQ ID NO: 4204489 - RNA, 17 nt, Yersinia pestis KIM
ggcggaaauaaggcgca

SEQ ID NO: 4204490 - RNA, 18 nt, Yersinia pestis KIM
ggcggaaauuaaaaauua

SEQ ID NO: 4204491 - RNA, 22 nt, Yersinia pestis KIM
ggcggaugaugaucaccgccug

SEQ ID NO: 4204492 - RNA, 14 nt, Yersinia pestis KIM
ggcggcagcacaga

SEQ ID NO: 4204493 - RNA, 19 nt, Yersinia pestis KIM
ggcggccagcaagagcagc

SEQ ID NO: 4204494 - RNA, 13 nt, Yersinia pestis KIM
ggcggccucugcu

SEQ ID NO: 4204495 - RNA, 19 nt, Yersinia pestis KIM
ggcggcguuagccgcccuu

SEQ ID NO: 4204496 - RNA, 18 nt, Yersinia pestis KIM
ggcggcuaaccugcacgc

SEQ ID NO: 4204497 - RNA, 12 nt, Yersinia pestis KIM
ggcggcucgccu

SEQ ID NO: 4204498 - RNA, 19 nt, Yersinia pestis KIM
ggcgguaguauuuguagug

SEQ ID NO: 4204499 - RNA, 22 nt, Yersinia pestis KIM
ggcgguccuccugccccuacgg

SEQ ID NO: 4204500 - RNA, 20 nt, Yersinia pestis KIM
ggcgguuaaucggaugguca

SEQ ID NO: 4204501 - RNA, 20 nt, Yersinia pestis KIM
ggcgguucauauuggccagu

SEQ ID NO: 4204502 - RNA, 14 nt, Yersinia pestis KIM
ggcgguucgcugaa

SEQ ID NO: 4204503 - RNA, 21 nt, Yersinia pestis KIM
ggcguaacauauccugugcca

SEQ ID NO: 4204504 - RNA, 11 nt, Yersinia pestis KIM
ggcguaaguac

SEQ ID NO: 4204505 - RNA, 17 nt, Yersinia pestis KIM
ggcguaauugcggucag

SEQ ID NO: 4204506 - RNA, 15 nt, Yersinia pestis KIM
ggcgucaagguaccc

SEQ ID NO: 4204507 - RNA, 15 nt, Yersinia pestis KIM
ggcguuaucggcgca

SEQ ID NO: 4204508 - RNA, 17 nt, Yersinia pestis KIM
ggcguuauugagaagaa

SEQ ID NO: 4204509 - RNA, 17 nt, Yersinia pestis KIM
ggcguucccgcaggcgg

SEQ ID NO: 4204510 - RNA, 20 nt, Yersinia pestis KIM
ggcguucuacugcguccuuu

SEQ ID NO: 4204511 - RNA, 12 nt, Yersinia pestis KIM
ggcguucuguca

SEQ ID NO: 4204512 - RNA, 12 nt, Yersinia pestis KIM
ggcguugaugac

SEQ ID NO: 4204513 - RNA, 17 nt, Yersinia pestis KIM
ggcguuucucagacugu

SEQ ID NO: 4204514 - RNA, 16 nt, Yersinia pestis KIM
ggcuaaaacucaaaua

SEQ ID NO: 4204515 - RNA, 18 nt, Yersinia pestis KIM
ggcuaaaacucaaauaga

SEQ ID NO: 4204516 - RNA, 14 nt, Yersinia pestis KIM
ggcuaaaacuggca

SEQ ID NO: 4204517 - RNA, 17 nt, Yersinia pestis KIM
ggcuaaccugcacgccu

SEQ ID NO: 4204518 - RNA, 21 nt, Yersinia pestis KIM
ggcuaauagcgucagucuugc

SEQ ID NO: 4204519 - RNA, 20 nt, Yersinia pestis KIM
ggcuaauauaucucuucuug

SEQ ID NO: 4204520 - RNA, 18 nt, Yersinia pestis KIM
ggcuacugguagcagcca

SEQ ID NO: 4204521 - RNA, 15 nt, Yersinia pestis KIM
ggcuauauugcugag

SEQ ID NO: 4204522 - RNA, 12 nt, Yersinia pestis KIM
ggcuaucaucaa

SEQ ID NO: 4204523 - RNA, 17 nt, Yersinia pestis KIM
ggcuaucaucaaaggca

SEQ ID NO: 4204524 - RNA, 12 nt, Yersinia pestis KIM
ggcucaaauuug

SEQ ID NO: 4204525 - RNA, 17 nt, Yersinia pestis KIM
ggcucaauccaaaugac

SEQ ID NO: 4204526 - RNA, 21 nt, Yersinia pestis KIM
ggcucaauccaaaugacacuu

SEQ ID NO: 4204527 - RNA, 20 nt, Yersinia pestis KIM
ggcucacacacuaauaauaa

SEQ ID NO: 4204528 - RNA, 14 nt, Yersinia pestis KIM
ggcucagcauggaa

SEQ ID NO: 4204529 - RNA, 20 nt, Yersinia pestis KIM
ggcucaucgcuaaccgccag

SEQ ID NO: 4204530 - RNA, 15 nt, Yersinia pestis KIM
ggcucccccuugauu

SEQ ID NO: 4204531 - RNA, 14 nt, Yersinia pestis KIM
ggcucgaagcgcgc

SEQ ID NO: 4204532 - RNA, 13 nt, Yersinia pestis KIM
ggcucgagccgcg

SEQ ID NO: 4204533 - RNA, 16 nt, Yersinia pestis KIM
ggcucgagccgcgcca

SEQ ID NO: 4204534 - RNA, 20 nt, Yersinia pestis KIM
ggcucgagccuacauggaug

SEQ ID NO: 4204535 - RNA, 13 nt, Yersinia pestis KIM
ggcucgugaucag

SEQ ID NO: 4204536 - RNA, 14 nt, Yersinia pestis KIM
ggcucugaaacgcu

SEQ ID NO: 4204537 - RNA, 14 nt, Yersinia pestis KIM
ggcucuggagcucu

SEQ ID NO: 4204538 - RNA, 17 nt, Yersinia pestis KIM
ggcucuggcaauggcua

SEQ ID NO: 4204539 - RNA, 14 nt, Yersinia pestis KIM
ggcucuguuuuacu

SEQ ID NO: 4204540 - RNA, 20 nt, Yersinia pestis KIM
ggcucuucucgaauaaacgg

SEQ ID NO: 4204541 - RNA, 15 nt, Yersinia pestis KIM
ggcugaacccugacg

SEQ ID NO: 4204542 - RNA, 22 nt, Yersinia pestis KIM
ggcugauacuacacuuuaggca

SEQ ID NO: 4204543 - RNA, 13 nt, Yersinia pestis KIM
ggcugauagaaag

SEQ ID NO: 4204544 - RNA, 12 nt, Yersinia pestis KIM
ggcugaugguca

SEQ ID NO: 4204545 - RNA, 17 nt, Yersinia pestis KIM
ggcugauuaccugcauc

SEQ ID NO: 4204546 - RNA, 15 nt, Yersinia pestis KIM
ggcugauucacuggc

SEQ ID NO: 4204547 - RNA, 19 nt, Yersinia pestis KIM
ggcugauucacuggcaaaa

SEQ ID NO: 4204548 - RNA, 17 nt, Yersinia pestis KIM
ggcugcaauaagccaga

SEQ ID NO: 4204549 - RNA, 20 nt, Yersinia pestis KIM
ggcugcaccuuacagcaggu

SEQ ID NO: 4204550 - RNA, 18 nt, Yersinia pestis KIM
ggcugcacuuuuacgggc

SEQ ID NO: 4204551 - RNA, 20 nt, Yersinia pestis KIM
ggcugccuggaauaagugug

SEQ ID NO: 4204552 - RNA, 22 nt, Yersinia pestis KIM
ggcugcgccauaugccaugaug

SEQ ID NO: 4204553 - RNA, 18 nt, Yersinia pestis KIM
ggcuggaaaaaauaaugg

SEQ ID NO: 4204554 - RNA, 21 nt, Yersinia pestis KIM
ggcuggaaaaaauaauggcca

SEQ ID NO: 4204555 - RNA, 21 nt, Yersinia pestis KIM
ggcuggaaugggcggcgagua

SEQ ID NO: 4204556 - RNA, 16 nt, Yersinia pestis KIM
ggcuggaucagcagac

SEQ ID NO: 4204557 - RNA, 16 nt, Yersinia pestis KIM
ggcuguaaauaaauaa

SEQ ID NO: 4204558 - RNA, 22 nt, Yersinia pestis KIM
ggcuguauuguugcucaacaua

SEQ ID NO: 4204559 - RNA, 20 nt, Yersinia pestis KIM
ggcugucggcgaugaaaaac

SEQ ID NO: 4204560 - RNA, 21 nt, Yersinia pestis KIM
ggcugucggcgaugaaaaaca

SEQ ID NO: 4204561 - RNA, 22 nt, Yersinia pestis KIM
ggcuguucuuggaacaggccaa

SEQ ID NO: 4204562 - RNA, 12 nt, Yersinia pestis KIM
ggcuuagccacu

SEQ ID NO: 4204563 - RNA, 17 nt, Yersinia pestis KIM
ggcuuagucauuaagaa

SEQ ID NO: 4204564 - RNA, 19 nt, Yersinia pestis KIM
ggcuucccuguauaaaaau

SEQ ID NO: 4204565 - RNA, 21 nt, Yersinia pestis KIM
ggcuucccuguauaaaaauag

SEQ ID NO: 4204566 - RNA, 15 nt, Yersinia pestis KIM
ggcuucuaacaauaa

SEQ ID NO: 4204567 - RNA, 19 nt, Yersinia pestis KIM
ggcuucuaggugcucugcc

SEQ ID NO: 4204568 - RNA, 20 nt, Yersinia pestis KIM
ggcuucuguaauaaaggcug

SEQ ID NO: 4204569 - RNA, 19 nt, Yersinia pestis KIM
ggcuugaaguucucaucaa

SEQ ID NO: 4204570 - RNA, 17 nt, Yersinia pestis KIM
ggcuugcaaucagaggc

SEQ ID NO: 4204571 - RNA, 19 nt, Yersinia pestis KIM
ggcuugcgcgaaauauugc

SEQ ID NO: 4204572 - RNA, 15 nt, Yersinia pestis KIM
ggcuugguuguuucu

SEQ ID NO: 4204573 - RNA, 19 nt, Yersinia pestis KIM
ggcuuuaagauccaguuca

SEQ ID NO: 4204574 - RNA, 19 nt, Yersinia pestis KIM
ggcuuuaccuuacguaaac

SEQ ID NO: 4204575 - RNA, 20 nt, Yersinia pestis KIM
ggcuuuacggcucaccuggc

SEQ ID NO: 4204576 - RNA, 17 nt, Yersinia pestis KIM
ggcuuuauuugcugccu

SEQ ID NO: 4204577 - RNA, 23 nt, Yersinia pestis KIM
ggcuuuuuuaauaaaaaacugac

SEQ ID NO: 4204578 - RNA, 20 nt, Yersinia pestis KIM
gggaaaaguggcuaucugaa

SEQ ID NO: 4204579 - RNA, 22 nt, Yersinia pestis KIM
gggaaauagcaacuaaacacga

SEQ ID NO: 4204580 - RNA, 21 nt, Yersinia pestis KIM
gggaaaucaaagacuaaccuc

SEQ ID NO: 4204581 - RNA, 12 nt, Yersinia pestis KIM
gggaaugcccuu

SEQ ID NO: 4204582 - RNA, 11 nt, Yersinia pestis KIM
gggaauucuuu

SEQ ID NO: 4204583 - RNA, 17 nt, Yersinia pestis KIM
gggacuaugagccucau

SEQ ID NO: 4204584 - RNA, 15 nt, Yersinia pestis KIM
gggagccgcccugca

SEQ ID NO: 4204585 - RNA, 12 nt, Yersinia pestis KIM
gggagggcgcgc

SEQ ID NO: 4204586 - RNA, 21 nt, Yersinia pestis KIM
gggaguuacucagcauccucc

SEQ ID NO: 4204587 - RNA, 18 nt, Yersinia pestis KIM
gggauagcauaaauacgg

SEQ ID NO: 4204588 - RNA, 15 nt, Yersinia pestis KIM
gggauauuaauucca

SEQ ID NO: 4204589 - RNA, 13 nt, Yersinia pestis KIM
gggaucaacaugg

SEQ ID NO: 4204590 - RNA, 15 nt, Yersinia pestis KIM
gggaucaccucuuca

SEQ ID NO: 4204591 - RNA, 12 nt, Yersinia pestis KIM
gggaucgcgcag

SEQ ID NO: 4204592 - RNA, 19 nt, Yersinia pestis KIM
gggaucuccagaagcauau

SEQ ID NO: 4204593 - RNA, 20 nt, Yersinia pestis KIM
gggaucuccggacaggcuug

SEQ ID NO: 4204594 - RNA, 18 nt, Yersinia pestis KIM
gggaugaaaaauacaaau

SEQ ID NO: 4204595 - RNA, 22 nt, Yersinia pestis KIM
gggaugccuuguuucuggcaca

SEQ ID NO: 4204596 - RNA, 17 nt, Yersinia pestis KIM
gggauggccgugggauc

SEQ ID NO: 4204597 - RNA, 14 nt, Yersinia pestis KIM
gggauucgaaccug

SEQ ID NO: 4204598 - RNA, 14 nt, Yersinia pestis KIM
gggauuugcucaga

SEQ ID NO: 4204599 - RNA, 20 nt, Yersinia pestis KIM
gggcaaaccauuugcggccu

SEQ ID NO: 4204600 - RNA, 20 nt, Yersinia pestis KIM
gggcaauugaaaauauaccc

SEQ ID NO: 4204601 - RNA, 11 nt, Yersinia pestis KIM
gggcagaaaau

SEQ ID NO: 4204602 - RNA, 12 nt, Yersinia pestis KIM
gggcagaaaaua

SEQ ID NO: 4204603 - RNA, 11 nt, Yersinia pestis KIM
gggcaguaacg

SEQ ID NO: 4204604 - RNA, 13 nt, Yersinia pestis KIM
gggcaguauaauu

SEQ ID NO: 4204605 - RNA, 18 nt, Yersinia pestis KIM
gggcaucgaaaagcgccu

SEQ ID NO: 4204606 - RNA, 23 nt, Yersinia pestis KIM
gggcauucauuucuuuggcugag

SEQ ID NO: 4204607 - RNA, 13 nt, Yersinia pestis KIM
gggccaucaagcc

SEQ ID NO: 4204608 - RNA, 16 nt, Yersinia pestis KIM
gggccgacucugcaug

SEQ ID NO: 4204609 - RNA, 18 nt, Yersinia pestis KIM
gggcgauagcccuacugg

SEQ ID NO: 4204610 - RNA, 15 nt, Yersinia pestis KIM
gggcgauggcaacau

SEQ ID NO: 4204611 - RNA, 16 nt, Yersinia pestis KIM
gggcgaugugcuccgc

SEQ ID NO: 4204612 - RNA, 13 nt, Yersinia pestis KIM
gggcgcagccccc

SEQ ID NO: 4204613 - RNA, 20 nt, Yersinia pestis KIM
gggcgcugagguucuccaac

SEQ ID NO: 4204614 - RNA, 14 nt, Yersinia pestis KIM
gggcggauccccug

SEQ ID NO: 4204615 - RNA, 14 nt, Yersinia pestis KIM
gggcggccagcaag

SEQ ID NO: 4204616 - RNA, 19 nt, Yersinia pestis KIM
gggcggcuguaaccgccug

SEQ ID NO: 4204617 - RNA, 20 nt, Yersinia pestis KIM
gggcgguaguauuuguagug

SEQ ID NO: 4204618 - RNA, 19 nt, Yersinia pestis KIM
gggcguuuaccauccagug

SEQ ID NO: 4204619 - RNA, 21 nt, Yersinia pestis KIM
gggcuaaaagggaguucauca

SEQ ID NO: 4204620 - RNA, 21 nt, Yersinia pestis KIM
gggcugaguaaagcccagcag

SEQ ID NO: 4204621 - RNA, 20 nt, Yersinia pestis KIM
gggcugcgcccuucgccggu

SEQ ID NO: 4204622 - RNA, 17 nt, Yersinia pestis KIM
gggcuuccaucaggaag

SEQ ID NO: 4204623 - RNA, 21 nt, Yersinia pestis KIM
gggcuuuaauacaauagagaa

SEQ ID NO: 4204624 - RNA, 14 nt, Yersinia pestis KIM
ggggauggccgggc

SEQ ID NO: 4204625 - RNA, 19 nt, Yersinia pestis KIM
ggggcacaauucugaaagu

SEQ ID NO: 4204626 - RNA, 23 nt, Yersinia pestis KIM
ggggcacacuuuucacuccggca

SEQ ID NO: 4204627 - RNA, 22 nt, Yersinia pestis KIM
ggggcaggagucugaaaccccu

SEQ ID NO: 4204628 - RNA, 17 nt, Yersinia pestis KIM
ggggccaauaggccccu

SEQ ID NO: 4204629 - RNA, 17 nt, Yersinia pestis KIM
ggggccaucaucuucaa

SEQ ID NO: 4204630 - RNA, 22 nt, Yersinia pestis KIM
ggggccaucaucuucaaccugg

SEQ ID NO: 4204631 - RNA, 12 nt, Yersinia pestis KIM
ggggcgguuggg

SEQ ID NO: 4204632 - RNA, 16 nt, Yersinia pestis KIM
gggggcaauugauuga

SEQ ID NO: 4204633 - RNA, 12 nt, Yersinia pestis KIM
gggggcaccgca

SEQ ID NO: 4204634 - RNA, 19 nt, Yersinia pestis KIM
ggggguugucagcagucug

SEQ ID NO: 4204635 - RNA, 14 nt, Yersinia pestis KIM
gggguaagauccac

SEQ ID NO: 4204636 - RNA, 18 nt, Yersinia pestis KIM
gggguucgcuauccccac

SEQ ID NO: 4204637 - RNA, 23 nt, Yersinia pestis KIM
gggguuuaggccuauaaccccca

SEQ ID NO: 4204638 - RNA, 22 nt, Yersinia pestis KIM
ggguaacgccauagggacugcc

SEQ ID NO: 4204639 - RNA, 16 nt, Yersinia pestis KIM
ggguaagauccaccac

SEQ ID NO: 4204640 - RNA, 21 nt, Yersinia pestis KIM
ggguaucaguguauuuaucaa

SEQ ID NO: 4204641 - RNA, 20 nt, Yersinia pestis KIM
ggguauguaaugccacacuc

SEQ ID NO: 4204642 - RNA, 17 nt, Yersinia pestis KIM
ggguauugaagauaccc

SEQ ID NO: 4204643 - RNA, 13 nt, Yersinia pestis KIM
gggucgugcggga

SEQ ID NO: 4204644 - RNA, 22 nt, Yersinia pestis KIM
gggugagucucagggaugaagc

SEQ ID NO: 4204645 - RNA, 22 nt, Yersinia pestis KIM
gggugagugaacauagcuaaca

SEQ ID NO: 4204646 - RNA, 16 nt, Yersinia pestis KIM
gggugagugagcgcgg

SEQ ID NO: 4204647 - RNA, 17 nt, Yersinia pestis KIM
gggugccauagcaaucc

SEQ ID NO: 4204648 - RNA, 24 nt, Yersinia pestis KIM
ggguggccgccgcggugaagaaca

SEQ ID NO: 4204649 - RNA, 20 nt, Yersinia pestis KIM
gggugguuagcagauaauaa

SEQ ID NO: 4204650 - RNA, 20 nt, Yersinia pestis KIM
ggguuaaccagaagaacagc

SEQ ID NO: 4204651 - RNA, 17 nt, Yersinia pestis KIM
ggguucaucaacugaca

SEQ ID NO: 4204652 - RNA, 15 nt, Yersinia pestis KIM
ggguuccaacugaua

SEQ ID NO: 4204653 - RNA, 20 nt, Yersinia pestis KIM
ggguugauuggcgaugcgcu

SEQ ID NO: 4204654 - RNA, 19 nt, Yersinia pestis KIM
ggguugcccaucagcauca

SEQ ID NO: 4204655 - RNA, 18 nt, Yersinia pestis KIM
ggguuuaauucaggccaa

SEQ ID NO: 4204656 - RNA, 20 nt, Yersinia pestis KIM
ggguuucauccccaccaggu

SEQ ID NO: 4204657 - RNA, 21 nt, Yersinia pestis KIM
ggguuucauccccaccaggua

SEQ ID NO: 4204658 - RNA, 20 nt, Yersinia pestis KIM
gguaaaaggcccgcuaguga

SEQ ID NO: 4204659 - RNA, 23 nt, Yersinia pestis KIM
gguaaaaucacguuuccaaaacu

SEQ ID NO: 4204660 - RNA, 20 nt, Yersinia pestis KIM
gguaaauuccguaccaguug

SEQ ID NO: 4204661 - RNA, 20 nt, Yersinia pestis KIM
gguaaauuuacgcuucgcug

SEQ ID NO: 4204662 - RNA, 17 nt, Yersinia pestis KIM
gguaacaaggcaaauag

SEQ ID NO: 4204663 - RNA, 17 nt, Yersinia pestis KIM
gguaaccagcaucagua

SEQ ID NO: 4204664 - RNA, 21 nt, Yersinia pestis KIM
gguaaccugaaagucaggauu

SEQ ID NO: 4204665 - RNA, 14 nt, Yersinia pestis KIM
gguaacggaagggg

SEQ ID NO: 4204666 - RNA, 18 nt, Yersinia pestis KIM
gguaacuuacaggcugcc

SEQ ID NO: 4204667 - RNA, 22 nt, Yersinia pestis KIM
gguaacuuacaggcugccugcc

SEQ ID NO: 4204668 - RNA, 17 nt, Yersinia pestis KIM
gguaagaauaggcaggg

SEQ ID NO: 4204669 - RNA, 13 nt, Yersinia pestis KIM
gguaagccuuucu

SEQ ID NO: 4204670 - RNA, 22 nt, Yersinia pestis KIM
gguaaggccgcgauaaaaaaua

SEQ ID NO: 4204671 - RNA, 15 nt, Yersinia pestis KIM
gguaagguaaagaaa

SEQ ID NO: 4204672 - RNA, 18 nt, Yersinia pestis KIM
gguaaguaauugaagugg

SEQ ID NO: 4204673 - RNA, 14 nt, Yersinia pestis KIM
gguaagucagcggg

SEQ ID NO: 4204674 - RNA, 22 nt, Yersinia pestis KIM
gguaaguccaucagccuaaauu

SEQ ID NO: 4204675 - RNA, 12 nt, Yersinia pestis KIM
gguaauaaauca

SEQ ID NO: 4204676 - RNA, 20 nt, Yersinia pestis KIM
gguaauaaugaacaaauauc

SEQ ID NO: 4204677 - RNA, 16 nt, Yersinia pestis KIM
gguaauaaugcucggc

SEQ ID NO: 4204678 - RNA, 21 nt, Yersinia pestis KIM
gguaauaucgguaaaaaauca

SEQ ID NO: 4204679 - RNA, 15 nt, Yersinia pestis KIM
gguaaucacauaacu

SEQ ID NO: 4204680 - RNA, 17 nt, Yersinia pestis KIM
gguaaucagacugcuga

SEQ ID NO: 4204681 - RNA, 16 nt, Yersinia pestis KIM
gguaaucccgaaucaa

SEQ ID NO: 4204682 - RNA, 17 nt, Yersinia pestis KIM
gguaaugacauauucaa

SEQ ID NO: 4204683 - RNA, 23 nt, Yersinia pestis KIM
gguaaugcuguuguagcgccagg

SEQ ID NO: 4204684 - RNA, 21 nt, Yersinia pestis KIM
gguaauuaaacgcucaucaac

SEQ ID NO: 4204685 - RNA, 23 nt, Yersinia pestis KIM
gguaauugacuuuuuuaucgcca

SEQ ID NO: 4204686 - RNA, 18 nt, Yersinia pestis KIM
gguacccauuauucuuua

SEQ ID NO: 4204687 - RNA, 16 nt, Yersinia pestis KIM
gguaccgcaggucaga

SEQ ID NO: 4204688 - RNA, 18 nt, Yersinia pestis KIM
gguaccguuuuauuuccc

SEQ ID NO: 4204689 - RNA, 17 nt, Yersinia pestis KIM
gguaccugaucagcauu

SEQ ID NO: 4204690 - RNA, 15 nt, Yersinia pestis KIM
gguacggccagcaau

SEQ ID NO: 4204691 - RNA, 13 nt, Yersinia pestis KIM
gguacuuaacugg

SEQ ID NO: 4204692 - RNA, 18 nt, Yersinia pestis KIM
gguacuuaacuggccaau

SEQ ID NO: 4204693 - RNA, 15 nt, Yersinia pestis KIM
gguacuugacgcugc

SEQ ID NO: 4204694 - RNA, 18 nt, Yersinia pestis KIM
gguagcagccacaugguu

SEQ ID NO: 4204695 - RNA, 23 nt, Yersinia pestis KIM
gguagccugcacggcucaggugc

SEQ ID NO: 4204696 - RNA, 19 nt, Yersinia pestis KIM
gguagguuucugggcuggc

SEQ ID NO: 4204697 - RNA, 15 nt, Yersinia pestis KIM
gguagucauauucag

SEQ ID NO: 4204698 - RNA, 21 nt, Yersinia pestis KIM
gguagucauauucaggcuggg

SEQ ID NO: 4204699 - RNA, 13 nt, Yersinia pestis KIM
gguagugacucau

SEQ ID NO: 4204700 - RNA, 17 nt, Yersinia pestis KIM
gguagugacucaucaaa

SEQ ID NO: 4204701 - RNA, 23 nt, Yersinia pestis KIM
gguauagcgauagaguugauaaa

SEQ ID NO: 4204702 - RNA, 14 nt, Yersinia pestis KIM
gguauagcggcggg

SEQ ID NO: 4204703 - RNA, 13 nt, Yersinia pestis KIM
gguauaugacugu

SEQ ID NO: 4204704 - RNA, 19 nt, Yersinia pestis KIM
gguauauuuaccaaaagca

SEQ ID NO: 4204705 - RNA, 20 nt, Yersinia pestis KIM
gguaucaccuuuuuccgcug

SEQ ID NO: 4204706 - RNA, 18 nt, Yersinia pestis KIM
gguaucaguggcgguucg

SEQ ID NO: 4204707 - RNA, 11 nt, Yersinia pestis KIM
gguauccaucc

SEQ ID NO: 4204708 - RNA, 20 nt, Yersinia pestis KIM
gguaucucccgcaaagccug

SEQ ID NO: 4204709 - RNA, 17 nt, Yersinia pestis KIM
gguauuccgagcaauca

SEQ ID NO: 4204710 - RNA, 14 nt, Yersinia pestis KIM
gguauucggcggcu

SEQ ID NO: 4204711 - RNA, 16 nt, Yersinia pestis KIM
gguauuuuacugauga

SEQ ID NO: 4204712 - RNA, 12 nt, Yersinia pestis KIM
gguauuuucuau

SEQ ID NO: 4204713 - RNA, 22 nt, Yersinia pestis KIM
ggucaaaaacacagguucucca

SEQ ID NO: 4204714 - RNA, 14 nt, Yersinia pestis KIM
ggucaagaugcaua

SEQ ID NO: 4204715 - RNA, 13 nt, Yersinia pestis KIM
ggucaauaccaua

SEQ ID NO: 4204716 - RNA, 18 nt, Yersinia pestis KIM
ggucacccucaagagcga

SEQ ID NO: 4204717 - RNA, 12 nt, Yersinia pestis KIM
ggucacuuaaau

SEQ ID NO: 4204718 - RNA, 20 nt, Yersinia pestis KIM
ggucacuuuaauacuggcau

SEQ ID NO: 4204719 - RNA, 16 nt, Yersinia pestis KIM
ggucacuuuuauuuuu

SEQ ID NO: 4204720 - RNA, 19 nt, Yersinia pestis KIM
ggucagccaacgacaggua

SEQ ID NO: 4204721 - RNA, 11 nt, Yersinia pestis KIM
ggucaggaaga

SEQ ID NO: 4204722 - RNA, 16 nt, Yersinia pestis KIM
ggucaguugaauauuc

SEQ ID NO: 4204723 - RNA, 20 nt, Yersinia pestis KIM
ggucauaguuuuuauagaca

SEQ ID NO: 4204724 - RNA, 20 nt, Yersinia pestis KIM
ggucauauuuaucuuaucca

SEQ ID NO: 4204725 - RNA, 17 nt, Yersinia pestis KIM
ggucaucacccagcaaa

SEQ ID NO: 4204726 - RNA, 17 nt, Yersinia pestis KIM
ggucaugaaaucagaga

SEQ ID NO: 4204727 - RNA, 14 nt, Yersinia pestis KIM
ggucaugcacaguu

SEQ ID NO: 4204728 - RNA, 14 nt, Yersinia pestis KIM
ggucauggagagca

SEQ ID NO: 4204729 - RNA, 12 nt, Yersinia pestis KIM
ggucauguggaa

SEQ ID NO: 4204730 - RNA, 17 nt, Yersinia pestis KIM
ggucccuaacgcaauac

SEQ ID NO: 4204731 - RNA, 21 nt, Yersinia pestis KIM
ggucgaacccauucaucaaac

SEQ ID NO: 4204732 - RNA, 22 nt, Yersinia pestis KIM
ggucgacaaaaugugaaaagca

SEQ ID NO: 4204733 - RNA, 16 nt, Yersinia pestis KIM
ggucgauuacauacuu

SEQ ID NO: 4204734 - RNA, 23 nt, Yersinia pestis KIM
ggucgggcugucggcgaugaaaa

SEQ ID NO: 4204735 - RNA, 15 nt, Yersinia pestis KIM
ggucgguaaccugaa

SEQ ID NO: 4204736 - RNA, 19 nt, Yersinia pestis KIM
ggucgucucuugcaaugaa

SEQ ID NO: 4204737 - RNA, 12 nt, Yersinia pestis KIM
ggucuaaugcaa

SEQ ID NO: 4204738 - RNA, 16 nt, Yersinia pestis KIM
ggucuauugguuucua

SEQ ID NO: 4204739 - RNA, 14 nt, Yersinia pestis KIM
ggucucaaugcagu

SEQ ID NO: 4204740 - RNA, 12 nt, Yersinia pestis KIM
ggucucacugcg

SEQ ID NO: 4204741 - RNA, 20 nt, Yersinia pestis KIM
ggucucuuucgggcaaaaaa

SEQ ID NO: 4204742 - RNA, 18 nt, Yersinia pestis KIM
ggucuggcaacugcaaau

SEQ ID NO: 4204743 - RNA, 14 nt, Yersinia pestis KIM
ggugaaaaaauauc

SEQ ID NO: 4204744 - RNA, 10 nt, Yersinia pestis KIM
ggugaacaga

SEQ ID NO: 4204745 - RNA, 17 nt, Yersinia pestis KIM
ggugaaguguuuaccac

SEQ ID NO: 4204746 - RNA, 20 nt, Yersinia pestis KIM
ggugaauacguucaaaugau

SEQ ID NO: 4204747 - RNA, 15 nt, Yersinia pestis KIM
ggugacccgugcggc

SEQ ID NO: 4204748 - RNA, 16 nt, Yersinia pestis KIM
ggugaccgcgauuaaa

SEQ ID NO: 4204749 - RNA, 20 nt, Yersinia pestis KIM
ggugacggcuuuauaguccu

SEQ ID NO: 4204750 - RNA, 21 nt, Yersinia pestis KIM
ggugagaaacgugaauugcua

SEQ ID NO: 4204751 - RNA, 16 nt, Yersinia pestis KIM
ggugagcugaucugcc

SEQ ID NO: 4204752 - RNA, 15 nt, Yersinia pestis KIM
ggugagggagucagg

SEQ ID NO: 4204753 - RNA, 12 nt, Yersinia pestis KIM
ggugagugagcg

SEQ ID NO: 4204754 - RNA, 14 nt, Yersinia pestis KIM
ggugagugagcgcg

SEQ ID NO: 4204755 - RNA, 14 nt, Yersinia pestis KIM
ggugauacaucucg

SEQ ID NO: 4204756 - RNA, 18 nt, Yersinia pestis KIM
ggugauauucgcccgcug

SEQ ID NO: 4204757 - RNA, 12 nt, Yersinia pestis KIM
ggugaucaacug

SEQ ID NO: 4204758 - RNA, 14 nt, Yersinia pestis KIM
ggugaucaacugcc

SEQ ID NO: 4204759 - RNA, 22 nt, Yersinia pestis KIM
ggugaucaucauccgccugcgu

SEQ ID NO: 4204760 - RNA, 24 nt, Yersinia pestis KIM
ggugaugugacgucacugaugcuu

SEQ ID NO: 4204761 - RNA, 12 nt, Yersinia pestis KIM
ggugccaacgca

SEQ ID NO: 4204762 - RNA, 16 nt, Yersinia pestis KIM
ggugccaacgcaauuc

SEQ ID NO: 4204763 - RNA, 23 nt, Yersinia pestis KIM
ggugccacacagaaucaccaaca

SEQ ID NO: 4204764 - RNA, 14 nt, Yersinia pestis KIM
ggugccucaacgca

SEQ ID NO: 4204765 - RNA, 17 nt, Yersinia pestis KIM
ggugcgccacuguucuu

SEQ ID NO: 4204766 - RNA, 15 nt, Yersinia pestis KIM
ggugcgggccagaau

SEQ ID NO: 4204767 - RNA, 19 nt, Yersinia pestis KIM
ggugcuaccucguaguaau

SEQ ID NO: 4204768 - RNA, 14 nt, Yersinia pestis KIM
ggugcugacaaaca

SEQ ID NO: 4204769 - RNA, 20 nt, Yersinia pestis KIM
ggugcuggugggccugcugc

SEQ ID NO: 4204770 - RNA, 15 nt, Yersinia pestis KIM
ggugcuguauuuaac

SEQ ID NO: 4204771 - RNA, 13 nt, Yersinia pestis KIM
ggugcuguuccaa

SEQ ID NO: 4204772 - RNA, 21 nt, Yersinia pestis KIM
gguggcaggccccaucauaaa

SEQ ID NO: 4204773 - RNA, 22 nt, Yersinia pestis KIM
gguggcgcuguuggucagugcg

SEQ ID NO: 4204774 - RNA, 14 nt, Yersinia pestis KIM
gguggcucaaucca

SEQ ID NO: 4204775 - RNA, 15 nt, Yersinia pestis KIM
ggugggccgugcggg

SEQ ID NO: 4204776 - RNA, 15 nt, Yersinia pestis KIM
ggugggucgugcggg

SEQ ID NO: 4204777 - RNA, 18 nt, Yersinia pestis KIM
gguguaaaugcccgucgg

SEQ ID NO: 4204778 - RNA, 12 nt, Yersinia pestis KIM
gguguaguguuu

SEQ ID NO: 4204779 - RNA, 13 nt, Yersinia pestis KIM
gguguguggcaau

SEQ ID NO: 4204780 - RNA, 15 nt, Yersinia pestis KIM
gguguguugaaauuu

SEQ ID NO: 4204781 - RNA, 19 nt, Yersinia pestis KIM
gguguuaaccgccccaaca

SEQ ID NO: 4204782 - RNA, 20 nt, Yersinia pestis KIM
gguguuauuuacaccgugca

SEQ ID NO: 4204783 - RNA, 12 nt, Yersinia pestis KIM
gguguuggcgau

SEQ ID NO: 4204784 - RNA, 13 nt, Yersinia pestis KIM
gguuaaacugacc

SEQ ID NO: 4204785 - RNA, 23 nt, Yersinia pestis KIM
gguuaaccagaagaacagcccuc

SEQ ID NO: 4204786 - RNA, 14 nt, Yersinia pestis KIM
gguuaaucaguggc

SEQ ID NO: 4204787 - RNA, 22 nt, Yersinia pestis KIM
gguuagcucccccguguucuga

SEQ ID NO: 4204788 - RNA, 23 nt, Yersinia pestis KIM
gguuaucacacccuaaagaucuu

SEQ ID NO: 4204789 - RNA, 13 nt, Yersinia pestis KIM
gguucaauucccg

SEQ ID NO: 4204790 - RNA, 15 nt, Yersinia pestis KIM
gguucaguaaaacca

SEQ ID NO: 4204791 - RNA, 15 nt, Yersinia pestis KIM
gguucaguaaagcuu

SEQ ID NO: 4204792 - RNA, 20 nt, Yersinia pestis KIM
gguucaucaaucgagaagaa

SEQ ID NO: 4204793 - RNA, 19 nt, Yersinia pestis KIM
gguucccaacggcagaagu

SEQ ID NO: 4204794 - RNA, 14 nt, Yersinia pestis KIM
gguucgucaugaug

SEQ ID NO: 4204795 - RNA, 12 nt, Yersinia pestis KIM
gguucuaaaccu

SEQ ID NO: 4204796 - RNA, 11 nt, Yersinia pestis KIM
gguugaaaguu

SEQ ID NO: 4204797 - RNA, 16 nt, Yersinia pestis KIM
gguugaggauuauaau

SEQ ID NO: 4204798 - RNA, 19 nt, Yersinia pestis KIM
gguugccaaagcugcgcca

SEQ ID NO: 4204799 - RNA, 19 nt, Yersinia pestis KIM
gguugccauuaauuggccg

SEQ ID NO: 4204800 - RNA, 16 nt, Yersinia pestis KIM
gguugcggcaccugcc

SEQ ID NO: 4204801 - RNA, 20 nt, Yersinia pestis KIM
gguuuaggccaauuuggcca

SEQ ID NO: 4204802 - RNA, 22 nt, Yersinia pestis KIM
gguuuaggccaauuuggccaau

SEQ ID NO: 4204803 - RNA, 13 nt, Yersinia pestis KIM
gguuucaaauagc

SEQ ID NO: 4204804 - RNA, 17 nt, Yersinia pestis KIM
gguuucaacauccaguu

SEQ ID NO: 4204805 - RNA, 17 nt, Yersinia pestis KIM
gguuucugccuuaucaa

SEQ ID NO: 4204806 - RNA, 19 nt, Yersinia pestis KIM
gguuugccaucacgcagca

SEQ ID NO: 4204807 - RNA, 14 nt, Yersinia pestis KIM
gguuugcuguucuu

SEQ ID NO: 4204808 - RNA, 17 nt, Yersinia pestis KIM
gguuuguaagucagauu

SEQ ID NO: 4204809 - RNA, 13 nt, Yersinia pestis KIM
gguuugucagcag

SEQ ID NO: 4204810 - RNA, 10 nt, Yersinia pestis KIM
gguuuuaauc

SEQ ID NO: 4204811 - RNA, 12 nt, Yersinia pestis KIM
gguuuuagucau

SEQ ID NO: 4204812 - RNA, 20 nt, Yersinia pestis KIM
gguuuuaucaauaggucagu

SEQ ID NO: 4204813 - RNA, 14 nt, Yersinia pestis KIM
gguuuucaccccca

SEQ ID NO: 4204814 - RNA, 12 nt, Yersinia pestis KIM
gguuuuccccuc

SEQ ID NO: 4204815 - RNA, 22 nt, Yersinia pestis KIM
gguuuugauuuuuucugugauu

SEQ ID NO: 4204816 - RNA, 23 nt, Yersinia pestis KIM
gguuuuuauauuuaccugcucaa

SEQ ID NO: 4204817 - RNA, 13 nt, Yersinia pestis KIM
guaaaaacucacu

SEQ ID NO: 4204818 - RNA, 20 nt, Yersinia pestis KIM
guaaaaacucacuguucaga

SEQ ID NO: 4204819 - RNA, 18 nt, Yersinia pestis KIM
guaaaacaaaguaguacg

SEQ ID NO: 4204820 - RNA, 20 nt, Yersinia pestis KIM
guaaaacaagggguuucaga

SEQ ID NO: 4204821 - RNA, 14 nt, Yersinia pestis KIM
guaaaacagggagc

SEQ ID NO: 4204822 - RNA, 20 nt, Yersinia pestis KIM
guaaaacugccauacccugg

SEQ ID NO: 4204823 - RNA, 17 nt, Yersinia pestis KIM
guaaaagaauaaauguc

SEQ ID NO: 4204824 - RNA, 16 nt, Yersinia pestis KIM
guaaaagucagcaaau

SEQ ID NO: 4204825 - RNA, 18 nt, Yersinia pestis KIM
guaaaagucagcaaauca

SEQ ID NO: 4204826 - RNA, 10 nt, Yersinia pestis KIM
guaaaauauu

SEQ ID NO: 4204827 - RNA, 17 nt, Yersinia pestis KIM
guaaaaucacguuucca

SEQ ID NO: 4204828 - RNA, 13 nt, Yersinia pestis KIM
guaaaaugccuuu

SEQ ID NO: 4204829 - RNA, 20 nt, Yersinia pestis KIM
guaaacaauaauucgcaugg

SEQ ID NO: 4204830 - RNA, 23 nt, Yersinia pestis KIM
guaaaccgcaccacaaaggcaaa

SEQ ID NO: 4204831 - RNA, 18 nt, Yersinia pestis KIM
guaaaccgguuaaaacag

SEQ ID NO: 4204832 - RNA, 16 nt, Yersinia pestis KIM
guaaaccguacauuaa

SEQ ID NO: 4204833 - RNA, 18 nt, Yersinia pestis KIM
guaaacgguugcuguaau

SEQ ID NO: 4204834 - RNA, 21 nt, Yersinia pestis KIM
guaaacuuggccgauaugaag

SEQ ID NO: 4204835 - RNA, 12 nt, Yersinia pestis KIM
guaaagaaaaaa

SEQ ID NO: 4204836 - RNA, 22 nt, Yersinia pestis KIM
guaaagacgccggcuucccugu

SEQ ID NO: 4204837 - RNA, 23 nt, Yersinia pestis KIM
guaaagcaaauucccaccauaau

SEQ ID NO: 4204838 - RNA, 16 nt, Yersinia pestis KIM
guaaagcacccacacc

SEQ ID NO: 4204839 - RNA, 16 nt, Yersinia pestis KIM
guaaagcaggccuucu

SEQ ID NO: 4204840 - RNA, 15 nt, Yersinia pestis KIM
guaaagcccagcagg

SEQ ID NO: 4204841 - RNA, 17 nt, Yersinia pestis KIM
guaaagguauagcgaua

SEQ ID NO: 4204842 - RNA, 20 nt, Yersinia pestis KIM
guaaauaguuacuauauaaa

SEQ ID NO: 4204843 - RNA, 18 nt, Yersinia pestis KIM
guaaaugcuguaagaauu

SEQ ID NO: 4204844 - RNA, 21 nt, Yersinia pestis KIM
guaaauguacagucauuuacu

SEQ ID NO: 4204845 - RNA, 23 nt, Yersinia pestis KIM
guaaauguacagucauuuacuga

SEQ ID NO: 4204846 - RNA, 14 nt, Yersinia pestis KIM
guaaauuagccacu

SEQ ID NO: 4204847 - RNA, 22 nt, Yersinia pestis KIM
guaaauucgggcuuuaauacaa

SEQ ID NO: 4204848 - RNA, 15 nt, Yersinia pestis KIM
guaaauuggcacggg

SEQ ID NO: 4204849 - RNA, 16 nt, Yersinia pestis KIM
guaacaacggcuggcc

SEQ ID NO: 4204850 - RNA, 15 nt, Yersinia pestis KIM
guaacaacugaacca

SEQ ID NO: 4204851 - RNA, 13 nt, Yersinia pestis KIM
guaacacacagca

SEQ ID NO: 4204852 - RNA, 17 nt, Yersinia pestis KIM
guaacacacagcagaca

SEQ ID NO: 4204853 - RNA, 20 nt, Yersinia pestis KIM
guaacacacagcagacagcg

SEQ ID NO: 4204854 - RNA, 19 nt, Yersinia pestis KIM
guaacacuugaccaaccug

SEQ ID NO: 4204855 - RNA, 13 nt, Yersinia pestis KIM
guaacagagcaga

SEQ ID NO: 4204856 - RNA, 22 nt, Yersinia pestis KIM
guaacagagcagaaagcagcag

SEQ ID NO: 4204857 - RNA, 18 nt, Yersinia pestis KIM
guaacaguucagcgccag

SEQ ID NO: 4204858 - RNA, 17 nt, Yersinia pestis KIM
guaacauuacuuugaau

SEQ ID NO: 4204859 - RNA, 20 nt, Yersinia pestis KIM
guaaccccgcguucacuuuc

SEQ ID NO: 4204860 - RNA, 19 nt, Yersinia pestis KIM
guaacccgccucgcuuacu

SEQ ID NO: 4204861 - RNA, 14 nt, Yersinia pestis KIM
guaacccgcuggcg

SEQ ID NO: 4204862 - RNA, 17 nt, Yersinia pestis KIM
guaaccugaaagucagg

SEQ ID NO: 4204863 - RNA, 16 nt, Yersinia pestis KIM
guaacgcagauaaauc

SEQ ID NO: 4204864 - RNA, 18 nt, Yersinia pestis KIM
guaacgccgcuaaaucau

SEQ ID NO: 4204865 - RNA, 17 nt, Yersinia pestis KIM
guaacguccaacugacg

SEQ ID NO: 4204866 - RNA, 17 nt, Yersinia pestis KIM
guaacguuuagcgauga

SEQ ID NO: 4204867 - RNA, 13 nt, Yersinia pestis KIM
guaacuaaagccg

SEQ ID NO: 4204868 - RNA, 15 nt, Yersinia pestis KIM
guaacuaagaguauc

SEQ ID NO: 4204869 - RNA, 24 nt, Yersinia pestis KIM
guaacuccaguaagccugaugccu

SEQ ID NO: 4204870 - RNA, 20 nt, Yersinia pestis KIM
guaacugaguuggaaaugac

SEQ ID NO: 4204871 - RNA, 13 nt, Yersinia pestis KIM
guaacugaucaau

SEQ ID NO: 4204872 - RNA, 16 nt, Yersinia pestis KIM
guaacuguaaggccaa

SEQ ID NO: 4204873 - RNA, 18 nt, Yersinia pestis KIM
guaacuuaaucuguucac

SEQ ID NO: 4204874 - RNA, 17 nt, Yersinia pestis KIM
guaacuuacaggcugcc

SEQ ID NO: 4204875 - RNA, 13 nt, Yersinia pestis KIM
guaacuuuucggg

SEQ ID NO: 4204876 - RNA, 21 nt, Yersinia pestis KIM
guaagaauaaauaauaucaau

SEQ ID NO: 4204877 - RNA, 17 nt, Yersinia pestis KIM
guaagaccaauugguaa

SEQ ID NO: 4204878 - RNA, 15 nt, Yersinia pestis KIM
guaagcagagaauuu

SEQ ID NO: 4204879 - RNA, 21 nt, Yersinia pestis KIM
guaagcagagaauuucaagcu

SEQ ID NO: 4204880 - RNA, 14 nt, Yersinia pestis KIM
guaagcaugccauc

SEQ ID NO: 4204881 - RNA, 11 nt, Yersinia pestis KIM
guaagccaacg

SEQ ID NO: 4204882 - RNA, 21 nt, Yersinia pestis KIM
guaagccgugccugcuggcaa

SEQ ID NO: 4204883 - RNA, 20 nt, Yersinia pestis KIM
guaagccuucaaccugaauc

SEQ ID NO: 4204884 - RNA, 21 nt, Yersinia pestis KIM
guaagcgcuggcuuaauuggc

SEQ ID NO: 4204885 - RNA, 18 nt, Yersinia pestis KIM
guaagcucuacuaauauu

SEQ ID NO: 4204886 - RNA, 15 nt, Yersinia pestis KIM
guaaggcaauaccaa

SEQ ID NO: 4204887 - RNA, 14 nt, Yersinia pestis KIM
guaaggcagcaagu

SEQ ID NO: 4204888 - RNA, 17 nt, Yersinia pestis KIM
guaaggccaauuggcuu

SEQ ID NO: 4204889 - RNA, 15 nt, Yersinia pestis KIM
guaaggcccgcagua

SEQ ID NO: 4204890 - RNA, 12 nt, Yersinia pestis KIM
guaagugauucg

SEQ ID NO: 4204891 - RNA, 21 nt, Yersinia pestis KIM
guaagugauucgggugaguga

SEQ ID NO: 4204892 - RNA, 17 nt, Yersinia pestis KIM
guaaguuaaaaagaaaa

SEQ ID NO: 4204893 - RNA, 15 nt, Yersinia pestis KIM
guaauaacgggcggc

SEQ ID NO: 4204894 - RNA, 16 nt, Yersinia pestis KIM
guaauaaguagaaaaa

SEQ ID NO: 4204895 - RNA, 22 nt, Yersinia pestis KIM
guaauacuauggcuaaugggua

SEQ ID NO: 4204896 - RNA, 18 nt, Yersinia pestis KIM
guaauacuggcaguaaaa

SEQ ID NO: 4204897 - RNA, 18 nt, Yersinia pestis KIM
guaauagcaaaaaaaaag

SEQ ID NO: 4204898 - RNA, 19 nt, Yersinia pestis KIM
guaauagcuuaaucaucau

SEQ ID NO: 4204899 - RNA, 14 nt, Yersinia pestis KIM
guaauaguaaaaca

SEQ ID NO: 4204900 - RNA, 23 nt, Yersinia pestis KIM
guaauaguuaaucgcagcagaga

SEQ ID NO: 4204901 - RNA, 20 nt, Yersinia pestis KIM
guaauaucgguaaaaaauca

SEQ ID NO: 4204902 - RNA, 13 nt, Yersinia pestis KIM
guaauauuauuca

SEQ ID NO: 4204903 - RNA, 16 nt, Yersinia pestis KIM
guaauauuuuguugcu

SEQ ID NO: 4204904 - RNA, 22 nt, Yersinia pestis KIM
guaaucaacacauaaaaucagc

SEQ ID NO: 4204905 - RNA, 11 nt, Yersinia pestis KIM
guaaucaccag

SEQ ID NO: 4204906 - RNA, 16 nt, Yersinia pestis KIM
guaaucaccauuaaua

SEQ ID NO: 4204907 - RNA, 19 nt, Yersinia pestis KIM
guaaucaccauuaauaaua

SEQ ID NO: 4204908 - RNA, 15 nt, Yersinia pestis KIM
guaaucagacugcug

SEQ ID NO: 4204909 - RNA, 17 nt, Yersinia pestis KIM
guaaucagacugcugac

SEQ ID NO: 4204910 - RNA, 18 nt, Yersinia pestis KIM
guaaucagacugcugaca

SEQ ID NO: 4204911 - RNA, 19 nt, Yersinia pestis KIM
guaauccaccccggcguua

SEQ ID NO: 4204912 - RNA, 16 nt, Yersinia pestis KIM
guaaucguauucucaa

SEQ ID NO: 4204913 - RNA, 13 nt, Yersinia pestis KIM
guaaucugacugu

SEQ ID NO: 4204914 - RNA, 22 nt, Yersinia pestis KIM
guaaucuguugauggaguuguu

SEQ ID NO: 4204915 - RNA, 11 nt, Yersinia pestis KIM
guaaugaaauc

SEQ ID NO: 4204916 - RNA, 16 nt, Yersinia pestis KIM
guaaugacucuggcag

SEQ ID NO: 4204917 - RNA, 16 nt, Yersinia pestis KIM
guaaugaguaaaaauu

SEQ ID NO: 4204918 - RNA, 22 nt, Yersinia pestis KIM
guaaugccacacucagacaauc

SEQ ID NO: 4204919 - RNA, 22 nt, Yersinia pestis KIM
guaaugcuguuguagcgccagg

SEQ ID NO: 4204920 - RNA, 17 nt, Yersinia pestis KIM
guaauggcgauaauauu

SEQ ID NO: 4204921 - RNA, 17 nt, Yersinia pestis KIM
guaauggcgcacauuac

SEQ ID NO: 4204922 - RNA, 18 nt, Yersinia pestis KIM
guaauuacgcaauaccga

SEQ ID NO: 4204923 - RNA, 18 nt, Yersinia pestis KIM
guaauucagauaagaucu

SEQ ID NO: 4204924 - RNA, 15 nt, Yersinia pestis KIM
guaauucagcacggu

SEQ ID NO: 4204925 - RNA, 18 nt, Yersinia pestis KIM
guaauucauuauuacuca

SEQ ID NO: 4204926 - RNA, 14 nt, Yersinia pestis KIM
guaauucgcagaca

SEQ ID NO: 4204927 - RNA, 16 nt, Yersinia pestis KIM
guaauugacuuuuuua

SEQ ID NO: 4204928 - RNA, 16 nt, Yersinia pestis KIM
guaauuuacugacggu

SEQ ID NO: 4204929 - RNA, 18 nt, Yersinia pestis KIM
guaauuuccaacugaucu

SEQ ID NO: 4204930 - RNA, 16 nt, Yersinia pestis KIM
guacaaaaaacaaacc

SEQ ID NO: 4204931 - RNA, 16 nt, Yersinia pestis KIM
guacaacaagauccca

SEQ ID NO: 4204932 - RNA, 14 nt, Yersinia pestis KIM
guacaacaauaaua

SEQ ID NO: 4204933 - RNA, 12 nt, Yersinia pestis KIM
guacaacacaaa

SEQ ID NO: 4204934 - RNA, 12 nt, Yersinia pestis KIM
guacaacacauc

SEQ ID NO: 4204935 - RNA, 17 nt, Yersinia pestis KIM
guacaacgcuuaucaaa

SEQ ID NO: 4204936 - RNA, 13 nt, Yersinia pestis KIM
guacaagacaaua

SEQ ID NO: 4204937 - RNA, 21 nt, Yersinia pestis KIM
guacaaucucugggugcugcu

SEQ ID NO: 4204938 - RNA, 22 nt, Yersinia pestis KIM
guacaaucucugggugcugcuc

SEQ ID NO: 4204939 - RNA, 16 nt, Yersinia pestis KIM
guacacauuauuuaua

SEQ ID NO: 4204940 - RNA, 24 nt, Yersinia pestis KIM
guacacuauuuuaccuauuuauug

SEQ ID NO: 4204941 - RNA, 11 nt, Yersinia pestis KIM
guacaggcaaa

SEQ ID NO: 4204942 - RNA, 15 nt, Yersinia pestis KIM
guacauuaaaugaau

SEQ ID NO: 4204943 - RNA, 14 nt, Yersinia pestis KIM
guaccaaugucuca

SEQ ID NO: 4204944 - RNA, 18 nt, Yersinia pestis KIM
guaccaccaccaacagca

SEQ ID NO: 4204945 - RNA, 23 nt, Yersinia pestis KIM
guacccgaucugagccauuaucg

SEQ ID NO: 4204946 - RNA, 21 nt, Yersinia pestis KIM
guacccguaggcccacaauca

SEQ ID NO: 4204947 - RNA, 23 nt, Yersinia pestis KIM
guaccgccuguucgacauucucu

SEQ ID NO: 4204948 - RNA, 23 nt, Yersinia pestis KIM
guaccgggccauagcccaugauu

SEQ ID NO: 4204949 - RNA, 14 nt, Yersinia pestis KIM
guaccguugagaac

SEQ ID NO: 4204950 - RNA, 18 nt, Yersinia pestis KIM
guaccugaucagcauuuc

SEQ ID NO: 4204951 - RNA, 17 nt, Yersinia pestis KIM
guaccugcacugagcca

SEQ ID NO: 4204952 - RNA, 18 nt, Yersinia pestis KIM
guaccugcacugagccag

SEQ ID NO: 4204953 - RNA, 16 nt, Yersinia pestis KIM
guaccugcaucaucac

SEQ ID NO: 4204954 - RNA, 20 nt, Yersinia pestis KIM
guaccuguaagguugaccug

SEQ ID NO: 4204955 - RNA, 23 nt, Yersinia pestis KIM
guaccuugacgccgaugaauaua

SEQ ID NO: 4204956 - RNA, 18 nt, Yersinia pestis KIM
guacgacgccagauagca

SEQ ID NO: 4204957 - RNA, 21 nt, Yersinia pestis KIM
guacgacgccagauagcauca

SEQ ID NO: 4204958 - RNA, 15 nt, Yersinia pestis KIM
guacgcaggccuucu

SEQ ID NO: 4204959 - RNA, 16 nt, Yersinia pestis KIM
guacgcuaaacaagga

SEQ ID NO: 4204960 - RNA, 13 nt, Yersinia pestis KIM
guacgcuggccag

SEQ ID NO: 4204961 - RNA, 17 nt, Yersinia pestis KIM
guacuaacgucaacaga

SEQ ID NO: 4204962 - RNA, 17 nt, Yersinia pestis KIM
guacuagaucacagacg

SEQ ID NO: 4204963 - RNA, 23 nt, Yersinia pestis KIM
guacucauauuguccaaaggaag

SEQ ID NO: 4204964 - RNA, 15 nt, Yersinia pestis KIM
guacuccugcucaaa

SEQ ID NO: 4204965 - RNA, 16 nt, Yersinia pestis KIM
guacugcugcaacuca

SEQ ID NO: 4204966 - RNA, 16 nt, Yersinia pestis KIM
guacuguuaacucaug

SEQ ID NO: 4204967 - RNA, 18 nt, Yersinia pestis KIM
guacuguuaguucagacg

SEQ ID NO: 4204968 - RNA, 12 nt, Yersinia pestis KIM
guacuguugaug

SEQ ID NO: 4204969 - RNA, 20 nt, Yersinia pestis KIM
guacuguugaugcagaugac

SEQ ID NO: 4204970 - RNA, 16 nt, Yersinia pestis KIM
guacuuggucacugua

SEQ ID NO: 4204971 - RNA, 15 nt, Yersinia pestis KIM
guacuuugucaauag

SEQ ID NO: 4204972 - RNA, 18 nt, Yersinia pestis KIM
guagaaaaucguuguauu

SEQ ID NO: 4204973 - RNA, 17 nt, Yersinia pestis KIM
guagacaaugacugugc

SEQ ID NO: 4204974 - RNA, 15 nt, Yersinia pestis KIM
guagacauggcaacg

SEQ ID NO: 4204975 - RNA, 19 nt, Yersinia pestis KIM
guagacgacacaaaugcug

SEQ ID NO: 4204976 - RNA, 19 nt, Yersinia pestis KIM
guagacgucauaaaaagca

SEQ ID NO: 4204977 - RNA, 17 nt, Yersinia pestis KIM
guagauaauuucuacgc

SEQ ID NO: 4204978 - RNA, 22 nt, Yersinia pestis KIM
guagaucccgugugauuuccau

SEQ ID NO: 4204979 - RNA, 18 nt, Yersinia pestis KIM
guagauggccaucucaau

SEQ ID NO: 4204980 - RNA, 17 nt, Yersinia pestis KIM
guagauuuaaccccaau

SEQ ID NO: 4204981 - RNA, 20 nt, Yersinia pestis KIM
guagauuuucucaggcacau

SEQ ID NO: 4204982 - RNA, 12 nt, Yersinia pestis KIM
guagcaaauaac

SEQ ID NO: 4204983 - RNA, 20 nt, Yersinia pestis KIM
guagcagccuguaggccagu

SEQ ID NO: 4204984 - RNA, 21 nt, Yersinia pestis KIM
guagcauggcuuuaugaccaa

SEQ ID NO: 4204985 - RNA, 20 nt, Yersinia pestis KIM
guagccaacacaugcugcuu

SEQ ID NO: 4204986 - RNA, 14 nt, Yersinia pestis KIM
guagcccacugaca

SEQ ID NO: 4204987 - RNA, 14 nt, Yersinia pestis KIM
guagcccuuugcuu

SEQ ID NO: 4204988 - RNA, 19 nt, Yersinia pestis KIM
guagccgcaggcgaugcaa

SEQ ID NO: 4204989 - RNA, 13 nt, Yersinia pestis KIM
guagcuaacaccg

SEQ ID NO: 4204990 - RNA, 12 nt, Yersinia pestis KIM
guagcuaauaaa

SEQ ID NO: 4204991 - RNA, 14 nt, Yersinia pestis KIM
guagcucagcuggu

SEQ ID NO: 4204992 - RNA, 15 nt, Yersinia pestis KIM
guagcuguuugcacc

SEQ ID NO: 4204993 - RNA, 16 nt, Yersinia pestis KIM
guaggacggugccaug

SEQ ID NO: 4204994 - RNA, 12 nt, Yersinia pestis KIM
guaggcaacuaa

SEQ ID NO: 4204995 - RNA, 15 nt, Yersinia pestis KIM
guaggcaacuaagcu

SEQ ID NO: 4204996 - RNA, 21 nt, Yersinia pestis KIM
guaggcaauacaccgccagua

SEQ ID NO: 4204997 - RNA, 19 nt, Yersinia pestis KIM
guaggcaucucugaagccu

SEQ ID NO: 4204998 - RNA, 21 nt, Yersinia pestis KIM
guaggcuaaagacuucagccc

SEQ ID NO: 4204999 - RNA, 21 nt, Yersinia pestis KIM
guagggauaaaucgcccaacc

SEQ ID NO: 4205000 - RNA, 23 nt, Yersinia pestis KIM
guaggggccaccaaauaaaacaa

SEQ ID NO: 4205001 - RNA, 15 nt, Yersinia pestis KIM
guagguaacuaagcu

SEQ ID NO: 4205002 - RNA, 14 nt, Yersinia pestis KIM
guagguuucugggc

SEQ ID NO: 4205003 - RNA, 13 nt, Yersinia pestis KIM
guaguaaccacac

SEQ ID NO: 4205004 - RNA, 16 nt, Yersinia pestis KIM
guaguauuuguaguga

SEQ ID NO: 4205005 - RNA, 23 nt, Yersinia pestis KIM
guagucauacaaaaugagccugu

SEQ ID NO: 4205006 - RNA, 19 nt, Yersinia pestis KIM
guagugaagauaauaacgg

SEQ ID NO: 4205007 - RNA, 11 nt, Yersinia pestis KIM
guaguggggcu

SEQ ID NO: 4205008 - RNA, 17 nt, Yersinia pestis KIM
guaguuacagcaaauac

SEQ ID NO: 4205009 - RNA, 12 nt, Yersinia pestis KIM
guaguuuugcau

SEQ ID NO: 4205010 - RNA, 14 nt, Yersinia pestis KIM
guauaaaaauagcc

SEQ ID NO: 4205011 - RNA, 23 nt, Yersinia pestis KIM
guauaaaaauagccuuccuuggc

SEQ ID NO: 4205012 - RNA, 16 nt, Yersinia pestis KIM
guauaaauagccugua

SEQ ID NO: 4205013 - RNA, 12 nt, Yersinia pestis KIM
guauaacucauc

SEQ ID NO: 4205014 - RNA, 16 nt, Yersinia pestis KIM
guauaacucaucagua

SEQ ID NO: 4205015 - RNA, 17 nt, Yersinia pestis KIM
guauaacucaucaguaa

SEQ ID NO: 4205016 - RNA, 18 nt, Yersinia pestis KIM
guauacaauugccugauu

SEQ ID NO: 4205017 - RNA, 14 nt, Yersinia pestis KIM
guauaccccugcuc

SEQ ID NO: 4205018 - RNA, 17 nt, Yersinia pestis KIM
guauacggucaaaagcu

SEQ ID NO: 4205019 - RNA, 18 nt, Yersinia pestis KIM
guauacuggcuagccugc

SEQ ID NO: 4205020 - RNA, 13 nt, Yersinia pestis KIM
guauagcggcggg

SEQ ID NO: 4205021 - RNA, 17 nt, Yersinia pestis KIM
guauaucacuauuucag

SEQ ID NO: 4205022 - RNA, 15 nt, Yersinia pestis KIM
guauaugaagauaac

SEQ ID NO: 4205023 - RNA, 21 nt, Yersinia pestis KIM
guauauugguacgguuagccu

SEQ ID NO: 4205024 - RNA, 23 nt, Yersinia pestis KIM
guaucaaaacgccagauaugauc

SEQ ID NO: 4205025 - RNA, 12 nt, Yersinia pestis KIM
guaucacagcaa

SEQ ID NO: 4205026 - RNA, 22 nt, Yersinia pestis KIM
guaucagccccuaaauccugca

SEQ ID NO: 4205027 - RNA, 15 nt, Yersinia pestis KIM
guaucagcgauuuua

SEQ ID NO: 4205028 - RNA, 17 nt, Yersinia pestis KIM
guaucagcgauuuuaaa

SEQ ID NO: 4205029 - RNA, 23 nt, Yersinia pestis KIM
guaucagcgauuuuaaaaaauca

SEQ ID NO: 4205030 - RNA, 19 nt, Yersinia pestis KIM
guauccagugucaugcgca

SEQ ID NO: 4205031 - RNA, 12 nt, Yersinia pestis KIM
guaucccacugg

SEQ ID NO: 4205032 - RNA, 19 nt, Yersinia pestis KIM
guaucccuggcucaucaaa

SEQ ID NO: 4205033 - RNA, 22 nt, Yersinia pestis KIM
guaucccuggcucaucaaagga

SEQ ID NO: 4205034 - RNA, 21 nt, Yersinia pestis KIM
guauccgcgccagacuggccg

SEQ ID NO: 4205035 - RNA, 21 nt, Yersinia pestis KIM
guauccuuacuuugcgaucaa

SEQ ID NO: 4205036 - RNA, 14 nt, Yersinia pestis KIM
guauccuuagccaa

SEQ ID NO: 4205037 - RNA, 22 nt, Yersinia pestis KIM
guaucgcccuggcuaauuuuau

SEQ ID NO: 4205038 - RNA, 19 nt, Yersinia pestis KIM
guaucggccaauucagcaa

SEQ ID NO: 4205039 - RNA, 20 nt, Yersinia pestis KIM
guaucuauaaacuucacgag

SEQ ID NO: 4205040 - RNA, 21 nt, Yersinia pestis KIM
guaucuguuuuuuaucccuac

SEQ ID NO: 4205041 - RNA, 23 nt, Yersinia pestis KIM
guaugaauggaaguuaaaaaaau

SEQ ID NO: 4205042 - RNA, 18 nt, Yersinia pestis KIM
guaugaccgguuuauaca

SEQ ID NO: 4205043 - RNA, 19 nt, Yersinia pestis KIM
guaugagcgcagaguccuc

SEQ ID NO: 4205044 - RNA, 16 nt, Yersinia pestis KIM
guaugccaaacccauu

SEQ ID NO: 4205045 - RNA, 15 nt, Yersinia pestis KIM
guaugcuuucaucuu

SEQ ID NO: 4205046 - RNA, 21 nt, Yersinia pestis KIM
guauggcgcuuaacugcacga

SEQ ID NO: 4205047 - RNA, 22 nt, Yersinia pestis KIM
guauggcuugcucaauaccauu

SEQ ID NO: 4205048 - RNA, 13 nt, Yersinia pestis KIM
guaugggggaugg

SEQ ID NO: 4205049 - RNA, 14 nt, Yersinia pestis KIM
guaugggugacucu

SEQ ID NO: 4205050 - RNA, 15 nt, Yersinia pestis KIM
guauguaaugccaca

SEQ ID NO: 4205051 - RNA, 17 nt, Yersinia pestis KIM
guauuacaggccccuuc

SEQ ID NO: 4205052 - RNA, 11 nt, Yersinia pestis KIM
guauuacccac

SEQ ID NO: 4205053 - RNA, 16 nt, Yersinia pestis KIM
guauuaccucaucauu

SEQ ID NO: 4205054 - RNA, 17 nt, Yersinia pestis KIM
guauucagccgccagcc

SEQ ID NO: 4205055 - RNA, 13 nt, Yersinia pestis KIM
guauucagguaau

SEQ ID NO: 4205056 - RNA, 17 nt, Yersinia pestis KIM
guauucagguaauuaca

SEQ ID NO: 4205057 - RNA, 16 nt, Yersinia pestis KIM
guauucaguaaaaacu

SEQ ID NO: 4205058 - RNA, 17 nt, Yersinia pestis KIM
guauucauaucgcuaaa

SEQ ID NO: 4205059 - RNA, 20 nt, Yersinia pestis KIM
guauucauaucgcuaaaaca

SEQ ID NO: 4205060 - RNA, 12 nt, Yersinia pestis KIM
guauucccgcua

SEQ ID NO: 4205061 - RNA, 17 nt, Yersinia pestis KIM
guauucugccggacuca

SEQ ID NO: 4205062 - RNA, 12 nt, Yersinia pestis KIM
guauucuuauca

SEQ ID NO: 4205063 - RNA, 18 nt, Yersinia pestis KIM
guauucuuaucaaucaaa

SEQ ID NO: 4205064 - RNA, 13 nt, Yersinia pestis KIM
guauucuugauuc

SEQ ID NO: 4205065 - RNA, 13 nt, Yersinia pestis KIM
guauugaagauac

SEQ ID NO: 4205066 - RNA, 22 nt, Yersinia pestis KIM
guauugacacaauagaugcagu

SEQ ID NO: 4205067 - RNA, 20 nt, Yersinia pestis KIM
guauugagcgcgguaacuaa

SEQ ID NO: 4205068 - RNA, 19 nt, Yersinia pestis KIM
guauugcagagcaaaacug

SEQ ID NO: 4205069 - RNA, 18 nt, Yersinia pestis KIM
guauugcuuuuaagcuca

SEQ ID NO: 4205070 - RNA, 17 nt, Yersinia pestis KIM
guauuggaaaaaucagu

SEQ ID NO: 4205071 - RNA, 19 nt, Yersinia pestis KIM
guauugguaacgcagaaau

SEQ ID NO: 4205072 - RNA, 20 nt, Yersinia pestis KIM
guauuguugccaaaaaugua

SEQ ID NO: 4205073 - RNA, 18 nt, Yersinia pestis KIM
guauuuaacauuagccgg

SEQ ID NO: 4205074 - RNA, 19 nt, Yersinia pestis KIM
guauuuaagcgggcuuuaa

SEQ ID NO: 4205075 - RNA, 13 nt, Yersinia pestis KIM
guauuuacggcgu

SEQ ID NO: 4205076 - RNA, 17 nt, Yersinia pestis KIM
guauuucaaauaagugu

SEQ ID NO: 4205077 - RNA, 22 nt, Yersinia pestis KIM
guauuugcuucgcugggcugcc

SEQ ID NO: 4205078 - RNA, 14 nt, Yersinia pestis KIM
guauuugguuauau

SEQ ID NO: 4205079 - RNA, 13 nt, Yersinia pestis KIM
guauuuguauuua

SEQ ID NO: 4205080 - RNA, 15 nt, Yersinia pestis KIM
guauuuucaaucgcu

SEQ ID NO: 4205081 - RNA, 19 nt, Yersinia pestis KIM
guauuuucuauaccaauug

SEQ ID NO: 4205082 - RNA, 23 nt, Yersinia pestis KIM
guauuuugcacaaagcuuacugu

SEQ ID NO: 4205083 - RNA, 16 nt, Yersinia pestis KIM
guauuuuucgcaguaa

SEQ ID NO: 4205084 - RNA, 19 nt, Yersinia pestis KIM
gucaaaaacccauuaaaaa

SEQ ID NO: 4205085 - RNA, 23 nt, Yersinia pestis KIM
gucaaaaacccauuaaaaacaaa

SEQ ID NO: 4205086 - RNA, 19 nt, Yersinia pestis KIM
gucaaaacuauuuauuuua

SEQ ID NO: 4205087 - RNA, 23 nt, Yersinia pestis KIM
gucaaaagaaacugccagcuaaa

SEQ ID NO: 4205088 - RNA, 18 nt, Yersinia pestis KIM
gucaaagaagcgcaggau

SEQ ID NO: 4205089 - RNA, 14 nt, Yersinia pestis KIM
gucaacuaaacaga

SEQ ID NO: 4205090 - RNA, 16 nt, Yersinia pestis KIM
gucaacugugccaacc

SEQ ID NO: 4205091 - RNA, 14 nt, Yersinia pestis KIM
gucaagacaacaaa

SEQ ID NO: 4205092 - RNA, 17 nt, Yersinia pestis KIM
gucaagacaacaaacag

SEQ ID NO: 4205093 - RNA, 15 nt, Yersinia pestis KIM
gucaagaugcauauu

SEQ ID NO: 4205094 - RNA, 15 nt, Yersinia pestis KIM
gucaagccaaccccc

SEQ ID NO: 4205095 - RNA, 18 nt, Yersinia pestis KIM
gucaagguacccauuauu

SEQ ID NO: 4205096 - RNA, 18 nt, Yersinia pestis KIM
gucaauaaccucagaggc

SEQ ID NO: 4205097 - RNA, 21 nt, Yersinia pestis KIM
gucaauaaccucagaggcgcu

SEQ ID NO: 4205098 - RNA, 19 nt, Yersinia pestis KIM
gucaauaaccucagccuca

SEQ ID NO: 4205099 - RNA, 21 nt, Yersinia pestis KIM
gucaauaaccucaggcccgcu

SEQ ID NO: 4205100 - RNA, 21 nt, Yersinia pestis KIM
gucaauaaccucagggagcca

SEQ ID NO: 4205101 - RNA, 21 nt, Yersinia pestis KIM
gucaauaauaaaaucugcuuc

SEQ ID NO: 4205102 - RNA, 17 nt, Yersinia pestis KIM
gucaauaucaucaucuu

SEQ ID NO: 4205103 - RNA, 22 nt, Yersinia pestis KIM
gucaaucacuggcaauaauuca

SEQ ID NO: 4205104 - RNA, 18 nt, Yersinia pestis KIM
gucaauccaaucauucug

SEQ ID NO: 4205105 - RNA, 22 nt, Yersinia pestis KIM
gucaaucgaugagcuggugaga

SEQ ID NO: 4205106 - RNA, 18 nt, Yersinia pestis KIM
gucaaucguuaguuguua

SEQ ID NO: 4205107 - RNA, 20 nt, Yersinia pestis KIM
gucaaucuagaacuauuggu

SEQ ID NO: 4205108 - RNA, 18 nt, Yersinia pestis KIM
gucaaugguucacuauaa

SEQ ID NO: 4205109 - RNA, 21 nt, Yersinia pestis KIM
gucaauguguugaauauccaa

SEQ ID NO: 4205110 - RNA, 16 nt, Yersinia pestis KIM
gucaauguucucuggg

SEQ ID NO: 4205111 - RNA, 22 nt, Yersinia pestis KIM
gucaauuuuugccuuucugggc

SEQ ID NO: 4205112 - RNA, 23 nt, Yersinia pestis KIM
gucaauuuuugccuuucugggcu

SEQ ID NO: 4205113 - RNA, 19 nt, Yersinia pestis KIM
gucacaaugcuguuuuguc

SEQ ID NO: 4205114 - RNA, 21 nt, Yersinia pestis KIM
gucacaaugcuguuuugucau

SEQ ID NO: 4205115 - RNA, 10 nt, Yersinia pestis KIM
gucacagcau

SEQ ID NO: 4205116 - RNA, 22 nt, Yersinia pestis KIM
gucacauuucagcguagcagga

SEQ ID NO: 4205117 - RNA, 13 nt, Yersinia pestis KIM
gucacauuuuuaa

SEQ ID NO: 4205118 - RNA, 12 nt, Yersinia pestis KIM
gucaccaucuug

SEQ ID NO: 4205119 - RNA, 13 nt, Yersinia pestis KIM
gucacccacuaau

SEQ ID NO: 4205120 - RNA, 19 nt, Yersinia pestis KIM
gucacccgcacguagcaca

SEQ ID NO: 4205121 - RNA, 19 nt, Yersinia pestis KIM
gucaccuagauaaucaagu

SEQ ID NO: 4205122 - RNA, 23 nt, Yersinia pestis KIM
gucaccugaaugccauucaagcc

SEQ ID NO: 4205123 - RNA, 20 nt, Yersinia pestis KIM
gucaccuugaacugagccag

SEQ ID NO: 4205124 - RNA, 12 nt, Yersinia pestis KIM
gucacggaaagc

SEQ ID NO: 4205125 - RNA, 17 nt, Yersinia pestis KIM
gucacuaaaacugaagc

SEQ ID NO: 4205126 - RNA, 21 nt, Yersinia pestis KIM
gucacuaaaccauucagccac

SEQ ID NO: 4205127 - RNA, 14 nt, Yersinia pestis KIM
gucacucagaaaac

SEQ ID NO: 4205128 - RNA, 22 nt, Yersinia pestis KIM
gucacuggcaccauuugcccug

SEQ ID NO: 4205129 - RNA, 17 nt, Yersinia pestis KIM
gucacuuugggcugauc

SEQ ID NO: 4205130 - RNA, 13 nt, Yersinia pestis KIM
gucagaaauaaau

SEQ ID NO: 4205131 - RNA, 13 nt, Yersinia pestis KIM
gucagaaccuguu

SEQ ID NO: 4205132 - RNA, 16 nt, Yersinia pestis KIM
gucagaaccuguuaca

SEQ ID NO: 4205133 - RNA, 15 nt, Yersinia pestis KIM
gucagauaucugcuc

SEQ ID NO: 4205134 - RNA, 14 nt, Yersinia pestis KIM
gucagcaaaucaaa

SEQ ID NO: 4205135 - RNA, 17 nt, Yersinia pestis KIM
gucagcaaaucaaacaa

SEQ ID NO: 4205136 - RNA, 22 nt, Yersinia pestis KIM
gucagcacaaacagcuuuuuaa

SEQ ID NO: 4205137 - RNA, 13 nt, Yersinia pestis KIM
gucagcacuucca

SEQ ID NO: 4205138 - RNA, 15 nt, Yersinia pestis KIM
gucagcagucugaua

SEQ ID NO: 4205139 - RNA, 15 nt, Yersinia pestis KIM
gucagcaugaauggc

SEQ ID NO: 4205140 - RNA, 15 nt, Yersinia pestis KIM
gucagccccugccag

SEQ ID NO: 4205141 - RNA, 16 nt, Yersinia pestis KIM
gucagcguuggaugag

SEQ ID NO: 4205142 - RNA, 20 nt, Yersinia pestis KIM
gucagcuggaacaagagauc

SEQ ID NO: 4205143 - RNA, 15 nt, Yersinia pestis KIM
gucagggugaaagcc

SEQ ID NO: 4205144 - RNA, 16 nt, Yersinia pestis KIM
gucagguaaguagaau

SEQ ID NO: 4205145 - RNA, 19 nt, Yersinia pestis KIM
gucagguuaauaccugcac

SEQ ID NO: 4205146 - RNA, 17 nt, Yersinia pestis KIM
gucaguaacuggauauu

SEQ ID NO: 4205147 - RNA, 21 nt, Yersinia pestis KIM
gucaguaacuggauauuuuua

SEQ ID NO: 4205148 - RNA, 22 nt, Yersinia pestis KIM
gucaguaacuggauauuuuuaa

SEQ ID NO: 4205149 - RNA, 14 nt, Yersinia pestis KIM
gucagucaaaagaa

SEQ ID NO: 4205150 - RNA, 12 nt, Yersinia pestis KIM
gucagucagggu

SEQ ID NO: 4205151 - RNA, 13 nt, Yersinia pestis KIM
gucaguccaaaau

SEQ ID NO: 4205152 - RNA, 23 nt, Yersinia pestis KIM
gucagugauucgggugagugagc

SEQ ID NO: 4205153 - RNA, 19 nt, Yersinia pestis KIM
gucagugcgguaaccagca

SEQ ID NO: 4205154 - RNA, 15 nt, Yersinia pestis KIM
gucagugcuccaucu

SEQ ID NO: 4205155 - RNA, 15 nt, Yersinia pestis KIM
gucagugguuuuaua

SEQ ID NO: 4205156 - RNA, 16 nt, Yersinia pestis KIM
gucagugguuuuauca

SEQ ID NO: 4205157 - RNA, 14 nt, Yersinia pestis KIM
gucaguucacgaau

SEQ ID NO: 4205158 - RNA, 16 nt, Yersinia pestis KIM
gucaguuguucaccua

SEQ ID NO: 4205159 - RNA, 15 nt, Yersinia pestis KIM
gucauaaucaucugc

SEQ ID NO: 4205160 - RNA, 15 nt, Yersinia pestis KIM
gucauaauugccaaa

SEQ ID NO: 4205161 - RNA, 20 nt, Yersinia pestis KIM
gucauacaaaaugagccugu

SEQ ID NO: 4205162 - RNA, 12 nt, Yersinia pestis KIM
gucauauuuauc

SEQ ID NO: 4205163 - RNA, 17 nt, Yersinia pestis KIM
gucaucacccagcaaaa

SEQ ID NO: 4205164 - RNA, 14 nt, Yersinia pestis KIM
gucaucagcauccg

SEQ ID NO: 4205165 - RNA, 13 nt, Yersinia pestis KIM
gucaucauauuca

SEQ ID NO: 4205166 - RNA, 15 nt, Yersinia pestis KIM
gucaucauauucaau

SEQ ID NO: 4205167 - RNA, 13 nt, Yersinia pestis KIM
gucaucaucuucu

SEQ ID NO: 4205168 - RNA, 14 nt, Yersinia pestis KIM
gucaucccagcaca

SEQ ID NO: 4205169 - RNA, 23 nt, Yersinia pestis KIM
gucaucgaacccgcuaacaugcc

SEQ ID NO: 4205170 - RNA, 23 nt, Yersinia pestis KIM
gucaucgccgcaaauuaacacau

SEQ ID NO: 4205171 - RNA, 20 nt, Yersinia pestis KIM
gucaucgccuucuggcaaac

SEQ ID NO: 4205172 - RNA, 23 nt, Yersinia pestis KIM
gucaucggggguugucugcagaa

SEQ ID NO: 4205173 - RNA, 17 nt, Yersinia pestis KIM
gucaucggguuuugucg

SEQ ID NO: 4205174 - RNA, 20 nt, Yersinia pestis KIM
gucaugauagacagcaaacg

SEQ ID NO: 4205175 - RNA, 19 nt, Yersinia pestis KIM
gucaugaugaauacgauaa

SEQ ID NO: 4205176 - RNA, 16 nt, Yersinia pestis KIM
gucaugcaauuacugc

SEQ ID NO: 4205177 - RNA, 15 nt, Yersinia pestis KIM
gucaugcucacaauc

SEQ ID NO: 4205178 - RNA, 21 nt, Yersinia pestis KIM
gucaugcuguagcagccugua

SEQ ID NO: 4205179 - RNA, 17 nt, Yersinia pestis KIM
gucauggagagcagggc

SEQ ID NO: 4205180 - RNA, 16 nt, Yersinia pestis KIM
gucaugguacaacugc

SEQ ID NO: 4205181 - RNA, 18 nt, Yersinia pestis KIM
gucauggucucacugcgg

SEQ ID NO: 4205182 - RNA, 22 nt, Yersinia pestis KIM
gucauuaacguuguuauuucug

SEQ ID NO: 4205183 - RNA, 17 nt, Yersinia pestis KIM
gucauuaacuguuaaaa

SEQ ID NO: 4205184 - RNA, 16 nt, Yersinia pestis KIM
gucauuaauuaagcua

SEQ ID NO: 4205185 - RNA, 14 nt, Yersinia pestis KIM
gucauuaauuucac

SEQ ID NO: 4205186 - RNA, 13 nt, Yersinia pestis KIM
gucauuauuaaac

SEQ ID NO: 4205187 - RNA, 13 nt, Yersinia pestis KIM
gucauucacugug

SEQ ID NO: 4205188 - RNA, 20 nt, Yersinia pestis KIM
gucauucccgagauaaccac

SEQ ID NO: 4205189 - RNA, 20 nt, Yersinia pestis KIM
gucauucuugguggagccug

SEQ ID NO: 4205190 - RNA, 18 nt, Yersinia pestis KIM
gucauugccugcucaccg

SEQ ID NO: 4205191 - RNA, 14 nt, Yersinia pestis KIM
gucauuggcguuac

SEQ ID NO: 4205192 - RNA, 21 nt, Yersinia pestis KIM
gucauuuccguuaacccaaag

SEQ ID NO: 4205193 - RNA, 19 nt, Yersinia pestis KIM
gucauuugcucgauuucac

SEQ ID NO: 4205194 - RNA, 20 nt, Yersinia pestis KIM
gucauuuuauuuaggcuaca

SEQ ID NO: 4205195 - RNA, 12 nt, Yersinia pestis KIM
guccagaugcca

SEQ ID NO: 4205196 - RNA, 15 nt, Yersinia pestis KIM
guccagcaucgcuga

SEQ ID NO: 4205197 - RNA, 20 nt, Yersinia pestis KIM
guccaugucgauugggccac

SEQ ID NO: 4205198 - RNA, 13 nt, Yersinia pestis KIM
gucccaagaaaag

SEQ ID NO: 4205199 - RNA, 14 nt, Yersinia pestis KIM
gucccaggccuccg

SEQ ID NO: 4205200 - RNA, 23 nt, Yersinia pestis KIM
gucccgaugauugcaucaucagu

SEQ ID NO: 4205201 - RNA, 14 nt, Yersinia pestis KIM
gucccuaaagagcg

SEQ ID NO: 4205202 - RNA, 18 nt, Yersinia pestis KIM
gucccuaaagccaucgcc

SEQ ID NO: 4205203 - RNA, 20 nt, Yersinia pestis KIM
gucccuacgguaccgcaggu

SEQ ID NO: 4205204 - RNA, 16 nt, Yersinia pestis KIM
gucccucuugaauaau

SEQ ID NO: 4205205 - RNA, 18 nt, Yersinia pestis KIM
guccgcauauucucgccc

SEQ ID NO: 4205206 - RNA, 17 nt, Yersinia pestis KIM
guccgcgccauaaaaga

SEQ ID NO: 4205207 - RNA, 16 nt, Yersinia pestis KIM
guccgucuuguauuua

SEQ ID NO: 4205208 - RNA, 13 nt, Yersinia pestis KIM
guccgugacgcuc

SEQ ID NO: 4205209 - RNA, 18 nt, Yersinia pestis KIM
guccucaggcaacccuuu

SEQ ID NO: 4205210 - RNA, 11 nt, Yersinia pestis KIM
guccuccugcc

SEQ ID NO: 4205211 - RNA, 18 nt, Yersinia pestis KIM
guccuucggacgcuccuc

SEQ ID NO: 4205212 - RNA, 20 nt, Yersinia pestis KIM
gucgaaggguaucagcgacc

SEQ ID NO: 4205213 - RNA, 16 nt, Yersinia pestis KIM
gucgacaaaaugugaa

SEQ ID NO: 4205214 - RNA, 15 nt, Yersinia pestis KIM
gucgaggaucaccac

SEQ ID NO: 4205215 - RNA, 22 nt, Yersinia pestis KIM
gucgauaaacaucaugacaaaa

SEQ ID NO: 4205216 - RNA, 20 nt, Yersinia pestis KIM
gucgauaagcacuccacugg

SEQ ID NO: 4205217 - RNA, 20 nt, Yersinia pestis KIM
gucgaucccaauauuaaaau

SEQ ID NO: 4205218 - RNA, 16 nt, Yersinia pestis KIM
gucgauggucauuugu

SEQ ID NO: 4205219 - RNA, 20 nt, Yersinia pestis KIM
gucgccaacauuuauuuauc

SEQ ID NO: 4205220 - RNA, 22 nt, Yersinia pestis KIM
gucgcccugaauuucaauaaca

SEQ ID NO: 4205221 - RNA, 14 nt, Yersinia pestis KIM
gucgccgguggcug

SEQ ID NO: 4205222 - RNA, 14 nt, Yersinia pestis KIM
gucgccucuggggc

SEQ ID NO: 4205223 - RNA, 14 nt, Yersinia pestis KIM
gucgcguuggcuaa

SEQ ID NO: 4205224 - RNA, 13 nt, Yersinia pestis KIM
gucgcucaagccu

SEQ ID NO: 4205225 - RNA, 15 nt, Yersinia pestis KIM
gucgcuccucagccu

SEQ ID NO: 4205226 - RNA, 12 nt, Yersinia pestis KIM
gucgcuguuacu

SEQ ID NO: 4205227 - RNA, 16 nt, Yersinia pestis KIM
gucggcauuaaaagca

SEQ ID NO: 4205228 - RNA, 14 nt, Yersinia pestis KIM
gucguaccggccca

SEQ ID NO: 4205229 - RNA, 14 nt, Yersinia pestis KIM
gucguacugccuga

SEQ ID NO: 4205230 - RNA, 18 nt, Yersinia pestis KIM
gucgucucuugcaaugaa

SEQ ID NO: 4205231 - RNA, 20 nt, Yersinia pestis KIM
gucguuauaaaccaaauggu

SEQ ID NO: 4205232 - RNA, 19 nt, Yersinia pestis KIM
gucguuauauaaauggcug

SEQ ID NO: 4205233 - RNA, 15 nt, Yersinia pestis KIM
gucguugagcgggug

SEQ ID NO: 4205234 - RNA, 20 nt, Yersinia pestis KIM
gucguugagcggguguagau

SEQ ID NO: 4205235 - RNA, 11 nt, Yersinia pestis KIM
gucuaaacgcc

SEQ ID NO: 4205236 - RNA, 18 nt, Yersinia pestis KIM
gucuaaauugcuuaaaaa

SEQ ID NO: 4205237 - RNA, 21 nt, Yersinia pestis KIM
gucuaaauugcuuaaaaaaag

SEQ ID NO: 4205238 - RNA, 14 nt, Yersinia pestis KIM
gucuaacaacuggu

SEQ ID NO: 4205239 - RNA, 14 nt, Yersinia pestis KIM
gucuaaugacagac

SEQ ID NO: 4205240 - RNA, 23 nt, Yersinia pestis KIM
gucuagcgacggagagucagcaa

SEQ ID NO: 4205241 - RNA, 22 nt, Yersinia pestis KIM
gucuagcgcaguacucaccgcc

SEQ ID NO: 4205242 - RNA, 22 nt, Yersinia pestis KIM
gucuauuuucgaacaacauacu

SEQ ID NO: 4205243 - RNA, 22 nt, Yersinia pestis KIM
gucucacccgcuugucuugaaa

SEQ ID NO: 4205244 - RNA, 22 nt, Yersinia pestis KIM
gucucuagaauuugaucagcca

SEQ ID NO: 4205245 - RNA, 14 nt, Yersinia pestis KIM
gucucuauucacua

SEQ ID NO: 4205246 - RNA, 15 nt, Yersinia pestis KIM
gucucuugcaaugaa

SEQ ID NO: 4205247 - RNA, 14 nt, Yersinia pestis KIM
gucucuuugccaag

SEQ ID NO: 4205248 - RNA, 16 nt, Yersinia pestis KIM
gucucuuuuucaucuu

SEQ ID NO: 4205249 - RNA, 20 nt, Yersinia pestis KIM
gucugacggguauaucacuu

SEQ ID NO: 4205250 - RNA, 16 nt, Yersinia pestis KIM
gucugaggcccgcuag

SEQ ID NO: 4205251 - RNA, 23 nt, Yersinia pestis KIM
gucugagguggcacccagugacc

SEQ ID NO: 4205252 - RNA, 18 nt, Yersinia pestis KIM
gucugcaacucagugaaa

SEQ ID NO: 4205253 - RNA, 16 nt, Yersinia pestis KIM
gucugcaauagcucau

SEQ ID NO: 4205254 - RNA, 15 nt, Yersinia pestis KIM
gucugccauugcuca

SEQ ID NO: 4205255 - RNA, 18 nt, Yersinia pestis KIM
gucugcgucauaccauuc

SEQ ID NO: 4205256 - RNA, 19 nt, Yersinia pestis KIM
gucugggacuuuaucugcc

SEQ ID NO: 4205257 - RNA, 21 nt, Yersinia pestis KIM
gucugguggugaacggccauc

SEQ ID NO: 4205258 - RNA, 15 nt, Yersinia pestis KIM
gucuguuaauccuaa

SEQ ID NO: 4205259 - RNA, 12 nt, Yersinia pestis KIM
gucuguuaucug

SEQ ID NO: 4205260 - RNA, 16 nt, Yersinia pestis KIM
gucuguuaugcccaac

SEQ ID NO: 4205261 - RNA, 14 nt, Yersinia pestis KIM
gucuuacggagaag

SEQ ID NO: 4205262 - RNA, 22 nt, Yersinia pestis KIM
gucuuacuauguccgcauauuc

SEQ ID NO: 4205263 - RNA, 19 nt, Yersinia pestis KIM
gucuuaucauaauccaacu

SEQ ID NO: 4205264 - RNA, 14 nt, Yersinia pestis KIM
gucuucaacuuuac

SEQ ID NO: 4205265 - RNA, 12 nt, Yersinia pestis KIM
gucuucagcuuc

SEQ ID NO: 4205266 - RNA, 23 nt, Yersinia pestis KIM
gucuucaguggcuggaaaggaau

SEQ ID NO: 4205267 - RNA, 13 nt, Yersinia pestis KIM
gucuucaucaucc

SEQ ID NO: 4205268 - RNA, 20 nt, Yersinia pestis KIM
gucuuccaugacaaaauacg

SEQ ID NO: 4205269 - RNA, 17 nt, Yersinia pestis KIM
gucuugcaccugaucgu

SEQ ID NO: 4205270 - RNA, 18 nt, Yersinia pestis KIM
gucuuguuggucaccacu

SEQ ID NO: 4205271 - RNA, 18 nt, Yersinia pestis KIM
gucuuuaauaaaaucaaa

SEQ ID NO: 4205272 - RNA, 16 nt, Yersinia pestis KIM
gucuuucgggcugaug

SEQ ID NO: 4205273 - RNA, 17 nt, Yersinia pestis KIM
gucuuucgggcugauga

SEQ ID NO: 4205274 - RNA, 18 nt, Yersinia pestis KIM
gucuuuuaaugaugcggg

SEQ ID NO: 4205275 - RNA, 23 nt, Yersinia pestis KIM
gucuuuucaaccaacacuccucu

SEQ ID NO: 4205276 - RNA, 23 nt, Yersinia pestis KIM
gucuuuuugggugacaacgucac

SEQ ID NO: 4205277 - RNA, 23 nt, Yersinia pestis KIM
gugaaaaaauaucuuuaaacccc

SEQ ID NO: 4205278 - RNA, 16 nt, Yersinia pestis KIM
gugaaagccugcacca

SEQ ID NO: 4205279 - RNA, 20 nt, Yersinia pestis KIM
gugaacaggccccaaaauag

SEQ ID NO: 4205280 - RNA, 16 nt, Yersinia pestis KIM
gugaaccguacagaua

SEQ ID NO: 4205281 - RNA, 14 nt, Yersinia pestis KIM
gugaagaacagcag

SEQ ID NO: 4205282 - RNA, 18 nt, Yersinia pestis KIM
gugaagaacagcaguggg

SEQ ID NO: 4205283 - RNA, 13 nt, Yersinia pestis KIM
gugaagacaucgc

SEQ ID NO: 4205284 - RNA, 20 nt, Yersinia pestis KIM
gugaagagcgauugacugaa

SEQ ID NO: 4205285 - RNA, 21 nt, Yersinia pestis KIM
gugaagcaauuugaucaccaa

SEQ ID NO: 4205286 - RNA, 14 nt, Yersinia pestis KIM
gugaagugagcuga

SEQ ID NO: 4205287 - RNA, 12 nt, Yersinia pestis KIM
gugaaguuuaua

SEQ ID NO: 4205288 - RNA, 11 nt, Yersinia pestis KIM
gugaauaacgc

SEQ ID NO: 4205289 - RNA, 17 nt, Yersinia pestis KIM
gugaauaacgcuggaua

SEQ ID NO: 4205290 - RNA, 14 nt, Yersinia pestis KIM
gugaaucagccaga

SEQ ID NO: 4205291 - RNA, 14 nt, Yersinia pestis KIM
gugaaucgccguua

SEQ ID NO: 4205292 - RNA, 13 nt, Yersinia pestis KIM
gugacaggcaaag

SEQ ID NO: 4205293 - RNA, 23 nt, Yersinia pestis KIM
gugacaguagaauaccucacugg

SEQ ID NO: 4205294 - RNA, 21 nt, Yersinia pestis KIM
gugaccaaagcaguaaacauu

SEQ ID NO: 4205295 - RNA, 18 nt, Yersinia pestis KIM
gugaccaccgcagcaacc

SEQ ID NO: 4205296 - RNA, 18 nt, Yersinia pestis KIM
gugacgcuggcacuggau

SEQ ID NO: 4205297 - RNA, 23 nt, Yersinia pestis KIM
gugacgcuugaauauagcguuca

SEQ ID NO: 4205298 - RNA, 21 nt, Yersinia pestis KIM
gugacggcuuuauaguccuuc

SEQ ID NO: 4205299 - RNA, 18 nt, Yersinia pestis KIM
gugacucaucaaaacaau

SEQ ID NO: 4205300 - RNA, 17 nt, Yersinia pestis KIM
gugacugaauggcuauu

SEQ ID NO: 4205301 - RNA, 22 nt, Yersinia pestis KIM
gugagcaauccaaccgaugguu

SEQ ID NO: 4205302 - RNA, 12 nt, Yersinia pestis KIM
gugagcgucauu

SEQ ID NO: 4205303 - RNA, 17 nt, Yersinia pestis KIM
gugaggcaaugaacggg

SEQ ID NO: 4205304 - RNA, 15 nt, Yersinia pestis KIM
gugagguggccgaga

SEQ ID NO: 4205305 - RNA, 23 nt, Yersinia pestis KIM
gugaguaaauaccuucagacuga

SEQ ID NO: 4205306 - RNA, 21 nt, Yersinia pestis KIM
gugaguaauucgcagacagau

SEQ ID NO: 4205307 - RNA, 13 nt, Yersinia pestis KIM
gugaguaucgaua

SEQ ID NO: 4205308 - RNA, 21 nt, Yersinia pestis KIM
gugagugaacauagcuaacac

SEQ ID NO: 4205309 - RNA, 15 nt, Yersinia pestis KIM
gugagugagcgcagg

SEQ ID NO: 4205310 - RNA, 14 nt, Yersinia pestis KIM
gugaguggcuggga

SEQ ID NO: 4205311 - RNA, 16 nt, Yersinia pestis KIM
gugaguggcugggaau

SEQ ID NO: 4205312 - RNA, 22 nt, Yersinia pestis KIM
gugauaaacucaguauauuggu

SEQ ID NO: 4205313 - RNA, 22 nt, Yersinia pestis KIM
gugauaaauacggucaacgauu

SEQ ID NO: 4205314 - RNA, 16 nt, Yersinia pestis KIM
gugauaaguuuuaaua

SEQ ID NO: 4205315 - RNA, 17 nt, Yersinia pestis KIM
gugauauaaauccaagg

SEQ ID NO: 4205316 - RNA, 21 nt, Yersinia pestis KIM
gugauaucagccagcuccugc

SEQ ID NO: 4205317 - RNA, 20 nt, Yersinia pestis KIM
gugauaugcaaaucaugcuc

SEQ ID NO: 4205318 - RNA, 17 nt, Yersinia pestis KIM
gugauauugggccggag

SEQ ID NO: 4205319 - RNA, 17 nt, Yersinia pestis KIM
gugaucaacugccuguu

SEQ ID NO: 4205320 - RNA, 19 nt, Yersinia pestis KIM
gugaucaguccuuagcaug

SEQ ID NO: 4205321 - RNA, 15 nt, Yersinia pestis KIM
gugaucaucuuuuuu

SEQ ID NO: 4205322 - RNA, 21 nt, Yersinia pestis KIM
gugaucgcguacagagcaaaa

SEQ ID NO: 4205323 - RNA, 15 nt, Yersinia pestis KIM
gugaucgcucaggcg

SEQ ID NO: 4205324 - RNA, 15 nt, Yersinia pestis KIM
gugaucgcugccgca

SEQ ID NO: 4205325 - RNA, 20 nt, Yersinia pestis KIM
gugaucguuuuauggcgaug

SEQ ID NO: 4205326 - RNA, 20 nt, Yersinia pestis KIM
gugaugaaacuaaaauaauc

SEQ ID NO: 4205327 - RNA, 21 nt, Yersinia pestis KIM
gugaugaauuugauacaguga

SEQ ID NO: 4205328 - RNA, 20 nt, Yersinia pestis KIM
gugaugcagagaugcagaga

SEQ ID NO: 4205329 - RNA, 14 nt, Yersinia pestis KIM
gugauggcggcugg

SEQ ID NO: 4205330 - RNA, 22 nt, Yersinia pestis KIM
gugauuaccugagagagguuga

SEQ ID NO: 4205331 - RNA, 15 nt, Yersinia pestis KIM
gugauuagcaguaau

SEQ ID NO: 4205332 - RNA, 22 nt, Yersinia pestis KIM
gugauuagcaucugcaacaccg

SEQ ID NO: 4205333 - RNA, 16 nt, Yersinia pestis KIM
gugauuauuuaaacaa

SEQ ID NO: 4205334 - RNA, 18 nt, Yersinia pestis KIM
gugauucgggugagugaa

SEQ ID NO: 4205335 - RNA, 15 nt, Yersinia pestis KIM
gugauuucagccagg

SEQ ID NO: 4205336 - RNA, 16 nt, Yersinia pestis KIM
gugauuuccaucuagc

SEQ ID NO: 4205337 - RNA, 19 nt, Yersinia pestis KIM
gugauuugcacguagagau

SEQ ID NO: 4205338 - RNA, 12 nt, Yersinia pestis KIM
gugauuuuuaua

SEQ ID NO: 4205339 - RNA, 23 nt, Yersinia pestis KIM
gugauuuuuuucacccauguauc

SEQ ID NO: 4205340 - RNA, 16 nt, Yersinia pestis KIM
gugcaaacuuaaaaau

SEQ ID NO: 4205341 - RNA, 20 nt, Yersinia pestis KIM
gugcaacaucaggccuucuu

SEQ ID NO: 4205342 - RNA, 16 nt, Yersinia pestis KIM
gugcaacauuaaaaau

SEQ ID NO: 4205343 - RNA, 18 nt, Yersinia pestis KIM
gugcaauaaauucaaaau

SEQ ID NO: 4205344 - RNA, 18 nt, Yersinia pestis KIM
gugcaaucaagggcgaua

SEQ ID NO: 4205345 - RNA, 14 nt, Yersinia pestis KIM
gugcaaucuaaagg

SEQ ID NO: 4205346 - RNA, 20 nt, Yersinia pestis KIM
gugcaaucuguuauaaaaaa

SEQ ID NO: 4205347 - RNA, 17 nt, Yersinia pestis KIM
gugcagccaacgcccug

SEQ ID NO: 4205348 - RNA, 20 nt, Yersinia pestis KIM
gugcaguaauggaaauagcu

SEQ ID NO: 4205349 - RNA, 18 nt, Yersinia pestis KIM
gugcauaaaacgauuuuc

SEQ ID NO: 4205350 - RNA, 18 nt, Yersinia pestis KIM
gugcaucuuccaauucau

SEQ ID NO: 4205351 - RNA, 20 nt, Yersinia pestis KIM
gugcauuaucuuuaauuuuu

SEQ ID NO: 4205352 - RNA, 13 nt, Yersinia pestis KIM
gugccaaaaaaag

SEQ ID NO: 4205353 - RNA, 17 nt, Yersinia pestis KIM
gugccaaaauaucuucc

SEQ ID NO: 4205354 - RNA, 11 nt, Yersinia pestis KIM
gugccaacauc

SEQ ID NO: 4205355 - RNA, 16 nt, Yersinia pestis KIM
gugccaacccuugaua

SEQ ID NO: 4205356 - RNA, 14 nt, Yersinia pestis KIM
gugccacaacaagc

SEQ ID NO: 4205357 - RNA, 21 nt, Yersinia pestis KIM
gugccacaacaagccucgcug

SEQ ID NO: 4205358 - RNA, 22 nt, Yersinia pestis KIM
gugccagcaaagacaauaacgg

SEQ ID NO: 4205359 - RNA, 14 nt, Yersinia pestis KIM
gugccauggucagu

SEQ ID NO: 4205360 - RNA, 13 nt, Yersinia pestis KIM
gugccccaagaag

SEQ ID NO: 4205361 - RNA, 14 nt, Yersinia pestis KIM
gugcccgcgggggc

SEQ ID NO: 4205362 - RNA, 20 nt, Yersinia pestis KIM
gugccgaagugcauauuauc

SEQ ID NO: 4205363 - RNA, 12 nt, Yersinia pestis KIM
gugccgggaaua

SEQ ID NO: 4205364 - RNA, 14 nt, Yersinia pestis KIM
gugccguucuccag

SEQ ID NO: 4205365 - RNA, 22 nt, Yersinia pestis KIM
gugccguucuccaguugccagc

SEQ ID NO: 4205366 - RNA, 13 nt, Yersinia pestis KIM
gugccuaucugaa

SEQ ID NO: 4205367 - RNA, 14 nt, Yersinia pestis KIM
gugccuuauugacc

SEQ ID NO: 4205368 - RNA, 18 nt, Yersinia pestis KIM
gugcgaaauaccccucac

SEQ ID NO: 4205369 - RNA, 12 nt, Yersinia pestis KIM
gugcgcaaaaau

SEQ ID NO: 4205370 - RNA, 21 nt, Yersinia pestis KIM
gugcgcaaaaauuagaggccu

SEQ ID NO: 4205371 - RNA, 17 nt, Yersinia pestis KIM
gugcgcaucagccagcc

SEQ ID NO: 4205372 - RNA, 18 nt, Yersinia pestis KIM
gugcgcccgguaauaaug

SEQ ID NO: 4205373 - RNA, 17 nt, Yersinia pestis KIM
gugcgcggcuagccacc

SEQ ID NO: 4205374 - RNA, 14 nt, Yersinia pestis KIM
gugcgcuccauuuc

SEQ ID NO: 4205375 - RNA, 15 nt, Yersinia pestis KIM
gugcggauggcugcu

SEQ ID NO: 4205376 - RNA, 15 nt, Yersinia pestis KIM
gugcggcagugaacc

SEQ ID NO: 4205377 - RNA, 19 nt, Yersinia pestis KIM
gugcgggaaucuugauuag

SEQ ID NO: 4205378 - RNA, 13 nt, Yersinia pestis KIM
gugcguaaagaaa

SEQ ID NO: 4205379 - RNA, 13 nt, Yersinia pestis KIM
gugcuacuccugc

SEQ ID NO: 4205380 - RNA, 14 nt, Yersinia pestis KIM
gugcuacuccugcu

SEQ ID NO: 4205381 - RNA, 19 nt, Yersinia pestis KIM
gugcuaucugcugcgguau

SEQ ID NO: 4205382 - RNA, 21 nt, Yersinia pestis KIM
gugcucacaaucuucuucagu

SEQ ID NO: 4205383 - RNA, 15 nt, Yersinia pestis KIM
gugcucacgucacca

SEQ ID NO: 4205384 - RNA, 19 nt, Yersinia pestis KIM
gugcucauuaaaaccacgc

SEQ ID NO: 4205385 - RNA, 16 nt, Yersinia pestis KIM
gugcucauuaucgcag

SEQ ID NO: 4205386 - RNA, 13 nt, Yersinia pestis KIM
gugcuccagcacu

SEQ ID NO: 4205387 - RNA, 20 nt, Yersinia pestis KIM
gugcuccgcacuuggcccca

SEQ ID NO: 4205388 - RNA, 21 nt, Yersinia pestis KIM
gugcucgggugccucacguau

SEQ ID NO: 4205389 - RNA, 23 nt, Yersinia pestis KIM
gugcugaauuggaagagccugaa

SEQ ID NO: 4205390 - RNA, 15 nt, Yersinia pestis KIM
gugcugccgcaacgg

SEQ ID NO: 4205391 - RNA, 12 nt, Yersinia pestis KIM
gugcuguauuua

SEQ ID NO: 4205392 - RNA, 18 nt, Yersinia pestis KIM
gugcuuacauuucaucuu

SEQ ID NO: 4205393 - RNA, 15 nt, Yersinia pestis KIM
gugcuucagacagua

SEQ ID NO: 4205394 - RNA, 15 nt, Yersinia pestis KIM
gugcuucucugccgc

SEQ ID NO: 4205395 - RNA, 19 nt, Yersinia pestis KIM
gugcuuuauccaauggcuc

SEQ ID NO: 4205396 - RNA, 23 nt, Yersinia pestis KIM
gugcuuuauccaauggcucaccu

SEQ ID NO: 4205397 - RNA, 22 nt, Yersinia pestis KIM
guggagagaaaggcuuugccug

SEQ ID NO: 4205398 - RNA, 13 nt, Yersinia pestis KIM
guggauaaacaaa

SEQ ID NO: 4205399 - RNA, 19 nt, Yersinia pestis KIM
guggauaauuucagcagca

SEQ ID NO: 4205400 - RNA, 20 nt, Yersinia pestis KIM
guggauagggauuguuuuca

SEQ ID NO: 4205401 - RNA, 13 nt, Yersinia pestis KIM
guggauccagcac

SEQ ID NO: 4205402 - RNA, 14 nt, Yersinia pestis KIM
guggauugccaaau

SEQ ID NO: 4205403 - RNA, 22 nt, Yersinia pestis KIM
guggcaacucuagcgccagcaa

SEQ ID NO: 4205404 - RNA, 14 nt, Yersinia pestis KIM
guggcagagaacau

SEQ ID NO: 4205405 - RNA, 16 nt, Yersinia pestis KIM
guggcagauuggcuug

SEQ ID NO: 4205406 - RNA, 23 nt, Yersinia pestis KIM
guggcagauuggcuugcuugaug

SEQ ID NO: 4205407 - RNA, 19 nt, Yersinia pestis KIM
guggcagccugcggcggcu

SEQ ID NO: 4205408 - RNA, 15 nt, Yersinia pestis KIM
guggcauguucagca

SEQ ID NO: 4205409 - RNA, 15 nt, Yersinia pestis KIM
guggccacucaccuc

SEQ ID NO: 4205410 - RNA, 16 nt, Yersinia pestis KIM
guggccgccgcgguga

SEQ ID NO: 4205411 - RNA, 22 nt, Yersinia pestis KIM
guggcgguucgagcggcauauc

SEQ ID NO: 4205412 - RNA, 14 nt, Yersinia pestis KIM
guggcuaccaauua

SEQ ID NO: 4205413 - RNA, 14 nt, Yersinia pestis KIM
guggcuaucugaaa

SEQ ID NO: 4205414 - RNA, 23 nt, Yersinia pestis KIM
guggcuaucugaaacugagauuu

SEQ ID NO: 4205415 - RNA, 22 nt, Yersinia pestis KIM
guggcucaauccaaaugacacu

SEQ ID NO: 4205416 - RNA, 22 nt, Yersinia pestis KIM
guggcucauuaaagguacguaa

SEQ ID NO: 4205417 - RNA, 23 nt, Yersinia pestis KIM
guggcugaaaucgaucauaaucu

SEQ ID NO: 4205418 - RNA, 15 nt, Yersinia pestis KIM
gugggcagggcagcu

SEQ ID NO: 4205419 - RNA, 22 nt, Yersinia pestis KIM
gugggccugccaugucacuguu

SEQ ID NO: 4205420 - RNA, 20 nt, Yersinia pestis KIM
gugggccuguuugcagcgaa

SEQ ID NO: 4205421 - RNA, 11 nt, Yersinia pestis KIM
gugggcgcaga

SEQ ID NO: 4205422 - RNA, 16 nt, Yersinia pestis KIM
gugggcgggggaagca

SEQ ID NO: 4205423 - RNA, 23 nt, Yersinia pestis KIM
guggguucuucaaagugguggca

SEQ ID NO: 4205424 - RNA, 16 nt, Yersinia pestis KIM
gugguaauuucuggcu

SEQ ID NO: 4205425 - RNA, 16 nt, Yersinia pestis KIM
gugguauggauauuuu

SEQ ID NO: 4205426 - RNA, 20 nt, Yersinia pestis KIM
guggucagcaucucauucug

SEQ ID NO: 4205427 - RNA, 20 nt, Yersinia pestis KIM
guggucaugcucacaaucau

SEQ ID NO: 4205428 - RNA, 12 nt, Yersinia pestis KIM
gugguguuaucc

SEQ ID NO: 4205429 - RNA, 14 nt, Yersinia pestis KIM
gugguuaacagcgu

SEQ ID NO: 4205430 - RNA, 19 nt, Yersinia pestis KIM
guguaaaaacuuaucuaaa

SEQ ID NO: 4205431 - RNA, 15 nt, Yersinia pestis KIM
guguaaaugcccguc

SEQ ID NO: 4205432 - RNA, 15 nt, Yersinia pestis KIM
guguaacugccaccg

SEQ ID NO: 4205433 - RNA, 15 nt, Yersinia pestis KIM
guguacucauauugu

SEQ ID NO: 4205434 - RNA, 16 nt, Yersinia pestis KIM
guguagauagccuugc

SEQ ID NO: 4205435 - RNA, 18 nt, Yersinia pestis KIM
guguauucgcaucuucca

SEQ ID NO: 4205436 - RNA, 15 nt, Yersinia pestis KIM
guguauuuaaaagau

SEQ ID NO: 4205437 - RNA, 22 nt, Yersinia pestis KIM
gugucaaaccaauuucucggcc

SEQ ID NO: 4205438 - RNA, 20 nt, Yersinia pestis KIM
gugucacaaucucuggcaac

SEQ ID NO: 4205439 - RNA, 23 nt, Yersinia pestis KIM
gugucaccgagagauucaugggc

SEQ ID NO: 4205440 - RNA, 19 nt, Yersinia pestis KIM
gugucagggcaauaacaaa

SEQ ID NO: 4205441 - RNA, 21 nt, Yersinia pestis KIM
gugucagggcaauaacaaaca

SEQ ID NO: 4205442 - RNA, 17 nt, Yersinia pestis KIM
gugucaguacgcuggcc

SEQ ID NO: 4205443 - RNA, 20 nt, Yersinia pestis KIM
gugucaguucgacaccuuca

SEQ ID NO: 4205444 - RNA, 18 nt, Yersinia pestis KIM
gugucaugcgcagaaaac

SEQ ID NO: 4205445 - RNA, 19 nt, Yersinia pestis KIM
guguccgcgccauaaaaga

SEQ ID NO: 4205446 - RNA, 23 nt, Yersinia pestis KIM
guguccgcgccauaaaagauaac

SEQ ID NO: 4205447 - RNA, 17 nt, Yersinia pestis KIM
gugugaaauugcccgcc

SEQ ID NO: 4205448 - RNA, 22 nt, Yersinia pestis KIM
gugugaacagugaugagaaucu

SEQ ID NO: 4205449 - RNA, 20 nt, Yersinia pestis KIM
gugugaccgcugaaguggcc

SEQ ID NO: 4205450 - RNA, 14 nt, Yersinia pestis KIM
gugugauuuccauc

SEQ ID NO: 4205451 - RNA, 15 nt, Yersinia pestis KIM
gugugauuuccaucu

SEQ ID NO: 4205452 - RNA, 16 nt, Yersinia pestis KIM
gugugcucacaaucuu

SEQ ID NO: 4205453 - RNA, 23 nt, Yersinia pestis KIM
gugugcugcgaagaucacucaug

SEQ ID NO: 4205454 - RNA, 13 nt, Yersinia pestis KIM
gugugcugggugu

SEQ ID NO: 4205455 - RNA, 14 nt, Yersinia pestis KIM
guguggcagucacu

SEQ ID NO: 4205456 - RNA, 24 nt, Yersinia pestis KIM
gugugggauucguuaguauacuau

SEQ ID NO: 4205457 - RNA, 16 nt, Yersinia pestis KIM
gugugggcuggugcgg

SEQ ID NO: 4205458 - RNA, 21 nt, Yersinia pestis KIM
gugugucuucagaaugaaagg

SEQ ID NO: 4205459 - RNA, 18 nt, Yersinia pestis KIM
guguuaaccgccccaaca

SEQ ID NO: 4205460 - RNA, 13 nt, Yersinia pestis KIM
guguugaaugacg

SEQ ID NO: 4205461 - RNA, 12 nt, Yersinia pestis KIM
guguuggcaaaa

SEQ ID NO: 4205462 - RNA, 12 nt, Yersinia pestis KIM
guguugggcagu

SEQ ID NO: 4205463 - RNA, 17 nt, Yersinia pestis KIM
guguuuuggcuaaacca

SEQ ID NO: 4205464 - RNA, 14 nt, Yersinia pestis KIM
guguuuuucaucug

SEQ ID NO: 4205465 - RNA, 17 nt, Yersinia pestis KIM
guguuuuucccuaccgu

SEQ ID NO: 4205466 - RNA, 11 nt, Yersinia pestis KIM
guuaaaaaaau

SEQ ID NO: 4205467 - RNA, 17 nt, Yersinia pestis KIM
guuaaaaacugugccug

SEQ ID NO: 4205468 - RNA, 17 nt, Yersinia pestis KIM
guuaaaacagauaaaaa

SEQ ID NO: 4205469 - RNA, 17 nt, Yersinia pestis KIM
guuaaaguuaucaccaa

SEQ ID NO: 4205470 - RNA, 16 nt, Yersinia pestis KIM
guuaaauacagcacca

SEQ ID NO: 4205471 - RNA, 11 nt, Yersinia pestis KIM
guuaaaugaag

SEQ ID NO: 4205472 - RNA, 11 nt, Yersinia pestis KIM
guuaacccaaa

SEQ ID NO: 4205473 - RNA, 12 nt, Yersinia pestis KIM
guuaacccaaag

SEQ ID NO: 4205474 - RNA, 15 nt, Yersinia pestis KIM
guuaacgacgcauua

SEQ ID NO: 4205475 - RNA, 18 nt, Yersinia pestis KIM
guuaacugcaguaaaaau

SEQ ID NO: 4205476 - RNA, 20 nt, Yersinia pestis KIM
guuaacugcaguaaaaauau

SEQ ID NO: 4205477 - RNA, 21 nt, Yersinia pestis KIM
guuaacuggcuccgcacggcu

SEQ ID NO: 4205478 - RNA, 14 nt, Yersinia pestis KIM
guuaacuuuuucua

SEQ ID NO: 4205479 - RNA, 13 nt, Yersinia pestis KIM
guuaagacaauua

SEQ ID NO: 4205480 - RNA, 16 nt, Yersinia pestis KIM
guuaagagugcuggca

SEQ ID NO: 4205481 - RNA, 18 nt, Yersinia pestis KIM
guuaagcagguagcuguu

SEQ ID NO: 4205482 - RNA, 12 nt, Yersinia pestis KIM
guuaaguuucau

SEQ ID NO: 4205483 - RNA, 16 nt, Yersinia pestis KIM
guuaaucaagcgccau

SEQ ID NO: 4205484 - RNA, 23 nt, Yersinia pestis KIM
guuaaucaguggcugaaggggcu

SEQ ID NO: 4205485 - RNA, 19 nt, Yersinia pestis KIM
guuaauccguaugucacug

SEQ ID NO: 4205486 - RNA, 16 nt, Yersinia pestis KIM
guuaaugccaccccca

SEQ ID NO: 4205487 - RNA, 17 nt, Yersinia pestis KIM
guuaaugggcguauuug

SEQ ID NO: 4205488 - RNA, 19 nt, Yersinia pestis KIM
guuaauuaagauuaagcca

SEQ ID NO: 4205489 - RNA, 23 nt, Yersinia pestis KIM
guuaauugccgcgucuguuaucu

SEQ ID NO: 4205490 - RNA, 21 nt, Yersinia pestis KIM
guuaauugguuaauugccgcg

SEQ ID NO: 4205491 - RNA, 23 nt, Yersinia pestis KIM
guuacaacgagggcucaaucucu

SEQ ID NO: 4205492 - RNA, 22 nt, Yersinia pestis KIM
guuacacacauagguacccgca

SEQ ID NO: 4205493 - RNA, 15 nt, Yersinia pestis KIM
guuacacaucaggcu

SEQ ID NO: 4205494 - RNA, 20 nt, Yersinia pestis KIM
guuacagcaaggcagaaaau

SEQ ID NO: 4205495 - RNA, 17 nt, Yersinia pestis KIM
guuacagcaaggcggca

SEQ ID NO: 4205496 - RNA, 17 nt, Yersinia pestis KIM
guuacaguaaggcagca

SEQ ID NO: 4205497 - RNA, 19 nt, Yersinia pestis KIM
guuaccgaugauugguauu

SEQ ID NO: 4205498 - RNA, 21 nt, Yersinia pestis KIM
guuacgauacguugcagguca

SEQ ID NO: 4205499 - RNA, 13 nt, Yersinia pestis KIM
guuacuauauaaa

SEQ ID NO: 4205500 - RNA, 23 nt, Yersinia pestis KIM
guuacugaccgugcagggcgaua

SEQ ID NO: 4205501 - RNA, 19 nt, Yersinia pestis KIM
guuacugccgacaggguuu

SEQ ID NO: 4205502 - RNA, 15 nt, Yersinia pestis KIM
guuacuguaagauaa

SEQ ID NO: 4205503 - RNA, 18 nt, Yersinia pestis KIM
guuacuuccauaaacgga

SEQ ID NO: 4205504 - RNA, 17 nt, Yersinia pestis KIM
guuagcauuaaacggug

SEQ ID NO: 4205505 - RNA, 22 nt, Yersinia pestis KIM
guuagccacucaacugauguuu

SEQ ID NO: 4205506 - RNA, 15 nt, Yersinia pestis KIM
guuagccuacuggcg

SEQ ID NO: 4205507 - RNA, 21 nt, Yersinia pestis KIM
guuagcgacgucuaauuguua

SEQ ID NO: 4205508 - RNA, 15 nt, Yersinia pestis KIM
guuagcgaugacuga

SEQ ID NO: 4205509 - RNA, 15 nt, Yersinia pestis KIM
guuagguaauaccaa

SEQ ID NO: 4205510 - RNA, 12 nt, Yersinia pestis KIM
guuagugaguua

SEQ ID NO: 4205511 - RNA, 14 nt, Yersinia pestis KIM
guuaguggcuuuaa

SEQ ID NO: 4205512 - RNA, 18 nt, Yersinia pestis KIM
guuagugguucaccacuu

SEQ ID NO: 4205513 - RNA, 17 nt, Yersinia pestis KIM
guuauaacagcuuaccg

SEQ ID NO: 4205514 - RNA, 20 nt, Yersinia pestis KIM
guuauaaccaugaugacaau

SEQ ID NO: 4205515 - RNA, 17 nt, Yersinia pestis KIM
guuauaggccuaaaccc

SEQ ID NO: 4205516 - RNA, 21 nt, Yersinia pestis KIM
guuauauaaauggcuguuaua

SEQ ID NO: 4205517 - RNA, 22 nt, Yersinia pestis KIM
guuaucaaauacgaccgucacc

SEQ ID NO: 4205518 - RNA, 17 nt, Yersinia pestis KIM
guuaucaauacugcaaa

SEQ ID NO: 4205519 - RNA, 15 nt, Yersinia pestis KIM
guuaucacagcaaau

SEQ ID NO: 4205520 - RNA, 20 nt, Yersinia pestis KIM
guuaucauugcuccuguaua

SEQ ID NO: 4205521 - RNA, 22 nt, Yersinia pestis KIM
guuaucauugcuccuguauauu

SEQ ID NO: 4205522 - RNA, 17 nt, Yersinia pestis KIM
guuauccgauugaagag

SEQ ID NO: 4205523 - RNA, 14 nt, Yersinia pestis KIM
guuauccuaagaau

SEQ ID NO: 4205524 - RNA, 16 nt, Yersinia pestis KIM
guuaucgaacaucucc

SEQ ID NO: 4205525 - RNA, 22 nt, Yersinia pestis KIM
guuaucgaacaucuccugguuc

SEQ ID NO: 4205526 - RNA, 14 nt, Yersinia pestis KIM
guuaucgcucuuga

SEQ ID NO: 4205527 - RNA, 20 nt, Yersinia pestis KIM
guuaucggccauauuaccgc

SEQ ID NO: 4205528 - RNA, 19 nt, Yersinia pestis KIM
guuaucgguauuuuugucg

SEQ ID NO: 4205529 - RNA, 13 nt, Yersinia pestis KIM
guuaucggugcug

SEQ ID NO: 4205530 - RNA, 18 nt, Yersinia pestis KIM
guuaucuguaaucaccag

SEQ ID NO: 4205531 - RNA, 15 nt, Yersinia pestis KIM
guuaugccaaccgga

SEQ ID NO: 4205532 - RNA, 13 nt, Yersinia pestis KIM
guuauggcuuuac

SEQ ID NO: 4205533 - RNA, 18 nt, Yersinia pestis KIM
guuauggcuuuacggcuc

SEQ ID NO: 4205534 - RNA, 14 nt, Yersinia pestis KIM
guuauuaacuucaa

SEQ ID NO: 4205535 - RNA, 17 nt, Yersinia pestis KIM
guuauuacugucacugu

SEQ ID NO: 4205536 - RNA, 20 nt, Yersinia pestis KIM
guuauuacugucauugcugu

SEQ ID NO: 4205537 - RNA, 14 nt, Yersinia pestis KIM
guuauuauuaaauu

SEQ ID NO: 4205538 - RNA, 13 nt, Yersinia pestis KIM
guuauugacaaag

SEQ ID NO: 4205539 - RNA, 22 nt, Yersinia pestis KIM
guuauuucugaccguuguaugu

SEQ ID NO: 4205540 - RNA, 14 nt, Yersinia pestis KIM
guuauuugaauaaa

SEQ ID NO: 4205541 - RNA, 15 nt, Yersinia pestis KIM
guuauuugaauaaga

SEQ ID NO: 4205542 - RNA, 13 nt, Yersinia pestis KIM
guuauuugcuauc

SEQ ID NO: 4205543 - RNA, 12 nt, Yersinia pestis KIM
guuauuuuaauu

SEQ ID NO: 4205544 - RNA, 13 nt, Yersinia pestis KIM
guucaaaaggugc

SEQ ID NO: 4205545 - RNA, 21 nt, Yersinia pestis KIM
guucaaaucaguuccugauuc

SEQ ID NO: 4205546 - RNA, 14 nt, Yersinia pestis KIM
guucaaaugauuca

SEQ ID NO: 4205547 - RNA, 22 nt, Yersinia pestis KIM
guucaacaccacaacauacaac

SEQ ID NO: 4205548 - RNA, 20 nt, Yersinia pestis KIM
guucaaccuuuuccgccaug

SEQ ID NO: 4205549 - RNA, 13 nt, Yersinia pestis KIM
guucaagaaccga

SEQ ID NO: 4205550 - RNA, 22 nt, Yersinia pestis KIM
guucaagagcgauagaucgaua

SEQ ID NO: 4205551 - RNA, 19 nt, Yersinia pestis KIM
guucaagauaaaguucuuc

SEQ ID NO: 4205552 - RNA, 21 nt, Yersinia pestis KIM
guucaagcagcuuuucacgag

SEQ ID NO: 4205553 - RNA, 17 nt, Yersinia pestis KIM
guucaauaucauagcca

SEQ ID NO: 4205554 - RNA, 18 nt, Yersinia pestis KIM
guucaaucggcagugcca

SEQ ID NO: 4205555 - RNA, 19 nt, Yersinia pestis KIM
guucaaucggcagugccau

SEQ ID NO: 4205556 - RNA, 18 nt, Yersinia pestis KIM
guucacaugaugaaugcg

SEQ ID NO: 4205557 - RNA, 16 nt, Yersinia pestis KIM
guucaccaaagcaaug

SEQ ID NO: 4205558 - RNA, 16 nt, Yersinia pestis KIM
guucaccagcuugggu

SEQ ID NO: 4205559 - RNA, 15 nt, Yersinia pestis KIM
guucaccccucaccc

SEQ ID NO: 4205560 - RNA, 15 nt, Yersinia pestis KIM
guucaccgcaucgcc

SEQ ID NO: 4205561 - RNA, 16 nt, Yersinia pestis KIM
guucacgaucucuauc

SEQ ID NO: 4205562 - RNA, 20 nt, Yersinia pestis KIM
guucacgauggaaaaaauac

SEQ ID NO: 4205563 - RNA, 20 nt, Yersinia pestis KIM
guucacuugagagaaacuuu

SEQ ID NO: 4205564 - RNA, 15 nt, Yersinia pestis KIM
guucagcaauaugaa

SEQ ID NO: 4205565 - RNA, 13 nt, Yersinia pestis KIM
guucagcaccagu

SEQ ID NO: 4205566 - RNA, 17 nt, Yersinia pestis KIM
guucagcauaaauauuc

SEQ ID NO: 4205567 - RNA, 16 nt, Yersinia pestis KIM
guucaggcagauaaau

SEQ ID NO: 4205568 - RNA, 20 nt, Yersinia pestis KIM
guucaggcagauaaauccac

SEQ ID NO: 4205569 - RNA, 16 nt, Yersinia pestis KIM
guucagguuguuaucg

SEQ ID NO: 4205570 - RNA, 14 nt, Yersinia pestis KIM
guucaguaguggcu

SEQ ID NO: 4205571 - RNA, 15 nt, Yersinia pestis KIM
guucauaaauuaaaa

SEQ ID NO: 4205572 - RNA, 14 nt, Yersinia pestis KIM
guucauauuggcca

SEQ ID NO: 4205573 - RNA, 16 nt, Yersinia pestis KIM
guucauauuggccagu

SEQ ID NO: 4205574 - RNA, 19 nt, Yersinia pestis KIM
guucaucaauaccgugacu

SEQ ID NO: 4205575 - RNA, 21 nt, Yersinia pestis KIM
guucaucaugcucauguugca

SEQ ID NO: 4205576 - RNA, 18 nt, Yersinia pestis KIM
guucaucauuuuuuaucu

SEQ ID NO: 4205577 - RNA, 11 nt, Yersinia pestis KIM
guucaucuucg

SEQ ID NO: 4205578 - RNA, 23 nt, Yersinia pestis KIM
guucauggugaugaucaugcuca

SEQ ID NO: 4205579 - RNA, 17 nt, Yersinia pestis KIM
guucauuuuguauuuug

SEQ ID NO: 4205580 - RNA, 21 nt, Yersinia pestis KIM
guuccaacgcacacccccauu

SEQ ID NO: 4205581 - RNA, 22 nt, Yersinia pestis KIM
guuccacaauguugauacucca

SEQ ID NO: 4205582 - RNA, 18 nt, Yersinia pestis KIM
guuccaguucgacauaaa

SEQ ID NO: 4205583 - RNA, 13 nt, Yersinia pestis KIM
guucccacuucca

SEQ ID NO: 4205584 - RNA, 12 nt, Yersinia pestis KIM
guucccaucccu

SEQ ID NO: 4205585 - RNA, 15 nt, Yersinia pestis KIM
guucccaucccuuug

SEQ ID NO: 4205586 - RNA, 17 nt, Yersinia pestis KIM
guucgcguggcagauug

SEQ ID NO: 4205587 - RNA, 22 nt, Yersinia pestis KIM
guucggcagcggagaaucgcug

SEQ ID NO: 4205588 - RNA, 22 nt, Yersinia pestis KIM
guucgucgcgaauagccaagcc

SEQ ID NO: 4205589 - RNA, 17 nt, Yersinia pestis KIM
guucuacagggaaaaac

SEQ ID NO: 4205590 - RNA, 20 nt, Yersinia pestis KIM
guucuacagggaaaaacgca

SEQ ID NO: 4205591 - RNA, 18 nt, Yersinia pestis KIM
guucuacugcguccuuug

SEQ ID NO: 4205592 - RNA, 15 nt, Yersinia pestis KIM
guucuaucucaucuu

SEQ ID NO: 4205593 - RNA, 16 nt, Yersinia pestis KIM
guucuaucucaucuua

SEQ ID NO: 4205594 - RNA, 18 nt, Yersinia pestis KIM
guucucaaccaaauagcg

SEQ ID NO: 4205595 - RNA, 15 nt, Yersinia pestis KIM
guucucacgaauaaa

SEQ ID NO: 4205596 - RNA, 21 nt, Yersinia pestis KIM
guucuccggcggcuucaucag

SEQ ID NO: 4205597 - RNA, 19 nt, Yersinia pestis KIM
guucugccaauuuggggcu

SEQ ID NO: 4205598 - RNA, 23 nt, Yersinia pestis KIM
guucugccaauuuggggcugcuu

SEQ ID NO: 4205599 - RNA, 11 nt, Yersinia pestis KIM
guucugcgccc

SEQ ID NO: 4205600 - RNA, 16 nt, Yersinia pestis KIM
guucugcucaauagcc

SEQ ID NO: 4205601 - RNA, 18 nt, Yersinia pestis KIM
guucugcucaauagccgc

SEQ ID NO: 4205602 - RNA, 13 nt, Yersinia pestis KIM
guucugcugccag

SEQ ID NO: 4205603 - RNA, 22 nt, Yersinia pestis KIM
guucuggaucggcauacuccau

SEQ ID NO: 4205604 - RNA, 19 nt, Yersinia pestis KIM
guucugguagcugcucacg

SEQ ID NO: 4205605 - RNA, 16 nt, Yersinia pestis KIM
guucuguagcugacac

SEQ ID NO: 4205606 - RNA, 14 nt, Yersinia pestis KIM
guucugucacaauc

SEQ ID NO: 4205607 - RNA, 23 nt, Yersinia pestis KIM
guucuucacgaagaauugcaugu

SEQ ID NO: 4205608 - RNA, 20 nt, Yersinia pestis KIM
guucuuccugugcgccacgc

SEQ ID NO: 4205609 - RNA, 15 nt, Yersinia pestis KIM
guucuucgcaaugau

SEQ ID NO: 4205610 - RNA, 19 nt, Yersinia pestis KIM
guucuucugauaaaacagu

SEQ ID NO: 4205611 - RNA, 17 nt, Yersinia pestis KIM
guugaaaccucaucauc

SEQ ID NO: 4205612 - RNA, 19 nt, Yersinia pestis KIM
guugaaauaaauaaguuca

SEQ ID NO: 4205613 - RNA, 17 nt, Yersinia pestis KIM
guugaaucaauugcugu

SEQ ID NO: 4205614 - RNA, 16 nt, Yersinia pestis KIM
guugaauuuuuauaau

SEQ ID NO: 4205615 - RNA, 15 nt, Yersinia pestis KIM
guugagguacggcuc

SEQ ID NO: 4205616 - RNA, 20 nt, Yersinia pestis KIM
guugaguaauuuucgcccua

SEQ ID NO: 4205617 - RNA, 14 nt, Yersinia pestis KIM
guugaguauacuaa

SEQ ID NO: 4205618 - RNA, 20 nt, Yersinia pestis KIM
guugauaaaacacucuuuuu

SEQ ID NO: 4205619 - RNA, 22 nt, Yersinia pestis KIM
guugauacuccauuugaacugu

SEQ ID NO: 4205620 - RNA, 19 nt, Yersinia pestis KIM
guugauaguuaccauggca

SEQ ID NO: 4205621 - RNA, 17 nt, Yersinia pestis KIM
guugauccgauaaacuu

SEQ ID NO: 4205622 - RNA, 15 nt, Yersinia pestis KIM
guugaugaguaaaca

SEQ ID NO: 4205623 - RNA, 16 nt, Yersinia pestis KIM
guugaugaguaaacag

SEQ ID NO: 4205624 - RNA, 14 nt, Yersinia pestis KIM
guugaugcaaaacc

SEQ ID NO: 4205625 - RNA, 19 nt, Yersinia pestis KIM
guugaugcucauuuaaaau

SEQ ID NO: 4205626 - RNA, 20 nt, Yersinia pestis KIM
guugaugcucauuuaaaaua

SEQ ID NO: 4205627 - RNA, 22 nt, Yersinia pestis KIM
guugcaaacggauaauguugca

SEQ ID NO: 4205628 - RNA, 15 nt, Yersinia pestis KIM
guugcaaauuuccag

SEQ ID NO: 4205629 - RNA, 23 nt, Yersinia pestis KIM
guugcacgugaggauucaagaac

SEQ ID NO: 4205630 - RNA, 15 nt, Yersinia pestis KIM
guugcagcacgccag

SEQ ID NO: 4205631 - RNA, 21 nt, Yersinia pestis KIM
guugcaggaauccaaguucaa

SEQ ID NO: 4205632 - RNA, 21 nt, Yersinia pestis KIM
guugcaggggguuagcugcaa

SEQ ID NO: 4205633 - RNA, 16 nt, Yersinia pestis KIM
guugcauuuuucuguu

SEQ ID NO: 4205634 - RNA, 18 nt, Yersinia pestis KIM
guugcccccaccauggca

SEQ ID NO: 4205635 - RNA, 23 nt, Yersinia pestis KIM
guugcccccugcuccaaagcuuc

SEQ ID NO: 4205636 - RNA, 18 nt, Yersinia pestis KIM
guugcccguuaauauuaa

SEQ ID NO: 4205637 - RNA, 21 nt, Yersinia pestis KIM
guugccgugccgaagugcaua

SEQ ID NO: 4205638 - RNA, 14 nt, Yersinia pestis KIM
guugcgaaauaaau

SEQ ID NO: 4205639 - RNA, 22 nt, Yersinia pestis KIM
guugcuaggcgcagcagggcuu

SEQ ID NO: 4205640 - RNA, 18 nt, Yersinia pestis KIM
guugcuauuuccccgccg

SEQ ID NO: 4205641 - RNA, 16 nt, Yersinia pestis KIM
guugcucacccauuuu

SEQ ID NO: 4205642 - RNA, 22 nt, Yersinia pestis KIM
guugcuucacggacagcaacca

SEQ ID NO: 4205643 - RNA, 15 nt, Yersinia pestis KIM
guugcuuuuaacucc

SEQ ID NO: 4205644 - RNA, 14 nt, Yersinia pestis KIM
guuggauaaccccc

SEQ ID NO: 4205645 - RNA, 13 nt, Yersinia pestis KIM
guuggcaaauaau

SEQ ID NO: 4205646 - RNA, 21 nt, Yersinia pestis KIM
guuggcaauaaauauccuccg

SEQ ID NO: 4205647 - RNA, 15 nt, Yersinia pestis KIM
guugggaaaaguggc

SEQ ID NO: 4205648 - RNA, 17 nt, Yersinia pestis KIM
guugggccuugcuucug

SEQ ID NO: 4205649 - RNA, 12 nt, Yersinia pestis KIM
guuggggaugcc

SEQ ID NO: 4205650 - RNA, 13 nt, Yersinia pestis KIM
guuggguuagggc

SEQ ID NO: 4205651 - RNA, 13 nt, Yersinia pestis KIM
guuggucagcacu

SEQ ID NO: 4205652 - RNA, 15 nt, Yersinia pestis KIM
guuggucagugcgcu

SEQ ID NO: 4205653 - RNA, 22 nt, Yersinia pestis KIM
guuggugaucuggcuuucucaa

SEQ ID NO: 4205654 - RNA, 15 nt, Yersinia pestis KIM
guugguuagagcacg

SEQ ID NO: 4205655 - RNA, 18 nt, Yersinia pestis KIM
guuguaccuguuuuuguu

SEQ ID NO: 4205656 - RNA, 20 nt, Yersinia pestis KIM
guugucaugcuguagcagcc

SEQ ID NO: 4205657 - RNA, 14 nt, Yersinia pestis KIM
guugugccaguaga

SEQ ID NO: 4205658 - RNA, 23 nt, Yersinia pestis KIM
guuguuagccacucaacugaugu

SEQ ID NO: 4205659 - RNA, 17 nt, Yersinia pestis KIM
guuguuauuucuguucc

SEQ ID NO: 4205660 - RNA, 18 nt, Yersinia pestis KIM
guuguucaacgccauagc

SEQ ID NO: 4205661 - RNA, 17 nt, Yersinia pestis KIM
guuguucugauagagac

SEQ ID NO: 4205662 - RNA, 14 nt, Yersinia pestis KIM
guuguugccacaga

SEQ ID NO: 4205663 - RNA, 20 nt, Yersinia pestis KIM
guuguuggguaugauuuuua

SEQ ID NO: 4205664 - RNA, 13 nt, Yersinia pestis KIM
guuuaaaaaauau

SEQ ID NO: 4205665 - RNA, 19 nt, Yersinia pestis KIM
guuuaaaguaaaucagacc

SEQ ID NO: 4205666 - RNA, 20 nt, Yersinia pestis KIM
guuuaaaucuuucuccagua

SEQ ID NO: 4205667 - RNA, 23 nt, Yersinia pestis KIM
guuuaaaucuuucuccaguaaaa

SEQ ID NO: 4205668 - RNA, 20 nt, Yersinia pestis KIM
guuuaacucaaauaaaccaa

SEQ ID NO: 4205669 - RNA, 16 nt, Yersinia pestis KIM
guuuaauucaggccaa

SEQ ID NO: 4205670 - RNA, 12 nt, Yersinia pestis KIM
guuuaauuucac

SEQ ID NO: 4205671 - RNA, 15 nt, Yersinia pestis KIM
guuuaauuucacuuc

SEQ ID NO: 4205672 - RNA, 19 nt, Yersinia pestis KIM
guuuacaugauugaaaaac

SEQ ID NO: 4205673 - RNA, 13 nt, Yersinia pestis KIM
guuuacguaaaua

SEQ ID NO: 4205674 - RNA, 14 nt, Yersinia pestis KIM
guuuacucgcuccg

SEQ ID NO: 4205675 - RNA, 14 nt, Yersinia pestis KIM
guuuagcucucaga

SEQ ID NO: 4205676 - RNA, 17 nt, Yersinia pestis KIM
guuuagcuuccaacuga

SEQ ID NO: 4205677 - RNA, 13 nt, Yersinia pestis KIM
guuuaggauugcg

SEQ ID NO: 4205678 - RNA, 21 nt, Yersinia pestis KIM
guuuauacuauuuauggcgug

SEQ ID NO: 4205679 - RNA, 16 nt, Yersinia pestis KIM
guuuaucaaacagcac

SEQ ID NO: 4205680 - RNA, 18 nt, Yersinia pestis KIM
guuuaucucgcugugccc

SEQ ID NO: 4205681 - RNA, 17 nt, Yersinia pestis KIM
guuuauuuaacacauuc

SEQ ID NO: 4205682 - RNA, 17 nt, Yersinia pestis KIM
guuucaacaucgcaccg

SEQ ID NO: 4205683 - RNA, 13 nt, Yersinia pestis KIM
guuucaccaaaca

SEQ ID NO: 4205684 - RNA, 20 nt, Yersinia pestis KIM
guuucaguaaaaccagcagc

SEQ ID NO: 4205685 - RNA, 18 nt, Yersinia pestis KIM
guuucaguggcuucucuu

SEQ ID NO: 4205686 - RNA, 19 nt, Yersinia pestis KIM
guuucaguuggccaccauu

SEQ ID NO: 4205687 - RNA, 19 nt, Yersinia pestis KIM
guuuccacucggccagagc

SEQ ID NO: 4205688 - RNA, 21 nt, Yersinia pestis KIM
guuucgccaaaucuucggcuu

SEQ ID NO: 4205689 - RNA, 18 nt, Yersinia pestis KIM
guuucgccuucccacaaa

SEQ ID NO: 4205690 - RNA, 16 nt, Yersinia pestis KIM
guuucguuuacugccu

SEQ ID NO: 4205691 - RNA, 20 nt, Yersinia pestis KIM
guuucucugccgccagauuu

SEQ ID NO: 4205692 - RNA, 21 nt, Yersinia pestis KIM
guuucuggaaugagaugaaca

SEQ ID NO: 4205693 - RNA, 15 nt, Yersinia pestis KIM
guuucuguuuugugc

SEQ ID NO: 4205694 - RNA, 16 nt, Yersinia pestis KIM
guuucuuacuaaaaua

SEQ ID NO: 4205695 - RNA, 12 nt, Yersinia pestis KIM
guuugacgcugu

SEQ ID NO: 4205696 - RNA, 18 nt, Yersinia pestis KIM
guuugaucccacugcccg

SEQ ID NO: 4205697 - RNA, 23 nt, Yersinia pestis KIM
guuugcggucuggcaacugcaaa

SEQ ID NO: 4205698 - RNA, 16 nt, Yersinia pestis KIM
guuugcuacuggccug

SEQ ID NO: 4205699 - RNA, 14 nt, Yersinia pestis KIM
guuuguaaauuuua

SEQ ID NO: 4205700 - RNA, 22 nt, Yersinia pestis KIM
guuuguaaccgacuugcccaau

SEQ ID NO: 4205701 - RNA, 22 nt, Yersinia pestis KIM
guuuguaccuguucaaucaccc

SEQ ID NO: 4205702 - RNA, 15 nt, Yersinia pestis KIM
guuuguuuggauaaa

SEQ ID NO: 4205703 - RNA, 17 nt, Yersinia pestis KIM
guuuuaaaaaaaaagaa

SEQ ID NO: 4205704 - RNA, 12 nt, Yersinia pestis KIM
guuuuaaauaca

SEQ ID NO: 4205705 - RNA, 13 nt, Yersinia pestis KIM
guuuuaaauuacg

SEQ ID NO: 4205706 - RNA, 20 nt, Yersinia pestis KIM
guuuuaacguacccucccag

SEQ ID NO: 4205707 - RNA, 14 nt, Yersinia pestis KIM
guuuuaauaaccau

SEQ ID NO: 4205708 - RNA, 18 nt, Yersinia pestis KIM
guuuuauucaagugcuca

SEQ ID NO: 4205709 - RNA, 20 nt, Yersinia pestis KIM
guuuuauugaugauuugacc

SEQ ID NO: 4205710 - RNA, 21 nt, Yersinia pestis KIM
guuuucccgacagaacugauu

SEQ ID NO: 4205711 - RNA, 20 nt, Yersinia pestis KIM
guuuucuuguauauaaaaaa

SEQ ID NO: 4205712 - RNA, 21 nt, Yersinia pestis KIM
guuuugcaaugcuuauuucac

SEQ ID NO: 4205713 - RNA, 18 nt, Yersinia pestis KIM
guuuugcagaucaaucgc

SEQ ID NO: 4205714 - RNA, 17 nt, Yersinia pestis KIM
guuuugcaucaagcucu

SEQ ID NO: 4205715 - RNA, 18 nt, Yersinia pestis KIM
guuuugcuaacugugcca

SEQ ID NO: 4205716 - RNA, 21 nt, Yersinia pestis KIM
guuuugucauaaagcccauac

SEQ ID NO: 4205717 - RNA, 18 nt, Yersinia pestis KIM
guuuuguuuccccuaauu

SEQ ID NO: 4205718 - RNA, 16 nt, Yersinia pestis KIM
guuuuuagcuuaacau

SEQ ID NO: 4205719 - RNA, 21 nt, Yersinia pestis KIM
guuuuuauauauccaaaauaa

SEQ ID NO: 4205720 - RNA, 20 nt, Yersinia pestis KIM
guuuuucaucugugccugca

SEQ ID NO: 4205721 - RNA, 16 nt, Yersinia pestis KIM
guuuuucauuuacuug

SEQ ID NO: 4205722 - RNA, 12 nt, Yersinia pestis KIM
guuuuuccagcc

SEQ ID NO: 4205723 - RNA, 19 nt, Yersinia pestis KIM
guuuuuuacgguggcacug

SEQ ID NO: 4205724 - RNA, 15 nt, Yersinia pestis KIM
guuuuuucaacuggc

SEQ ID NO: 4205725 - RNA, 14 nt, Yersinia pestis KIM
guuuuuucuuucuu

SEQ ID NO: 4205726 - RNA, 21 nt, Yersinia pestis KIM
guuuuuuuacauauaauccaa

SEQ ID NO: 4205727 - RNA, 12 nt, Yersinia pestis KIM
guuuuuuugcca

SEQ ID NO: 4205728 - RNA, 13 nt, Yersinia pestis KIM
uaaaaaaaaauaa

SEQ ID NO: 4205729 - RNA, 16 nt, Yersinia pestis KIM
uaaaaaaaaauaaaau

SEQ ID NO: 4205730 - RNA, 17 nt, Yersinia pestis KIM
uaaaaaaaaauaaaauu

SEQ ID NO: 4205731 - RNA, 11 nt, Yersinia pestis KIM
uaaaaaaaacc

SEQ ID NO: 4205732 - RNA, 14 nt, Yersinia pestis KIM
uaaaaaaaaccugg

SEQ ID NO: 4205733 - RNA, 12 nt, Yersinia pestis KIM
uaaaaaaauagc

SEQ ID NO: 4205734 - RNA, 13 nt, Yersinia pestis KIM
uaaaaaaauuaaa

SEQ ID NO: 4205735 - RNA, 18 nt, Yersinia pestis KIM
uaaaaaaauuaaaauaau

SEQ ID NO: 4205736 - RNA, 14 nt, Yersinia pestis KIM
uaaaaaaauucauu

SEQ ID NO: 4205737 - RNA, 21 nt, Yersinia pestis KIM
uaaaaaaauucauucuuuuau

SEQ ID NO: 4205738 - RNA, 18 nt, Yersinia pestis KIM
uaaaaaacgcgacgguca

SEQ ID NO: 4205739 - RNA, 20 nt, Yersinia pestis KIM
uaaaaaagugcuauccucuu

SEQ ID NO: 4205740 - RNA, 16 nt, Yersinia pestis KIM
uaaaaaaucaguauua

SEQ ID NO: 4205741 - RNA, 17 nt, Yersinia pestis KIM
uaaaaaaucuauugauu

SEQ ID NO: 4205742 - RNA, 22 nt, Yersinia pestis KIM
uaaaaaaucuauugauugcuua

SEQ ID NO: 4205743 - RNA, 15 nt, Yersinia pestis KIM
uaaaaaauuauuaaa

SEQ ID NO: 4205744 - RNA, 17 nt, Yersinia pestis KIM
uaaaaaauuauuaaaua

SEQ ID NO: 4205745 - RNA, 17 nt, Yersinia pestis KIM
uaaaaacauuuaaauau

SEQ ID NO: 4205746 - RNA, 15 nt, Yersinia pestis KIM
uaaaaaccauuuuua

SEQ ID NO: 4205747 - RNA, 18 nt, Yersinia pestis KIM
uaaaaacuaaggggccaa

SEQ ID NO: 4205748 - RNA, 20 nt, Yersinia pestis KIM
uaaaaacuaccguauaauca

SEQ ID NO: 4205749 - RNA, 17 nt, Yersinia pestis KIM
uaaaaacucacuguuca

SEQ ID NO: 4205750 - RNA, 19 nt, Yersinia pestis KIM
uaaaaacuuaucuaaaaaa

SEQ ID NO: 4205751 - RNA, 23 nt, Yersinia pestis KIM
uaaaaacuuaucuaaaaaaccag

SEQ ID NO: 4205752 - RNA, 17 nt, Yersinia pestis KIM
uaaaaagaaaaagacau

SEQ ID NO: 4205753 - RNA, 22 nt, Yersinia pestis KIM
uaaaaagaaaaagacauaaaga

SEQ ID NO: 4205754 - RNA, 23 nt, Yersinia pestis KIM
uaaaaagaucugcauugauuaaa

SEQ ID NO: 4205755 - RNA, 19 nt, Yersinia pestis KIM
uaaaaagcagcaaacgaac

SEQ ID NO: 4205756 - RNA, 15 nt, Yersinia pestis KIM
uaaaaagccagucag

SEQ ID NO: 4205757 - RNA, 14 nt, Yersinia pestis KIM
uaaaaauaaucaau

SEQ ID NO: 4205758 - RNA, 16 nt, Yersinia pestis KIM
uaaaaauacauaucaa

SEQ ID NO: 4205759 - RNA, 13 nt, Yersinia pestis KIM
uaaaaauauuaac

SEQ ID NO: 4205760 - RNA, 22 nt, Yersinia pestis KIM
uaaaaaucugcaauaucaucag

SEQ ID NO: 4205761 - RNA, 12 nt, Yersinia pestis KIM
uaaaaauuaauu

SEQ ID NO: 4205762 - RNA, 15 nt, Yersinia pestis KIM
uaaaaauucacaaca

SEQ ID NO: 4205763 - RNA, 21 nt, Yersinia pestis KIM
uaaaacagcagccaccaaaaa

SEQ ID NO: 4205764 - RNA, 14 nt, Yersinia pestis KIM
uaaaacagccacga

SEQ ID NO: 4205765 - RNA, 16 nt, Yersinia pestis KIM
uaaaacagcuaacacu

SEQ ID NO: 4205766 - RNA, 17 nt, Yersinia pestis KIM
uaaaacaucucuuccca

SEQ ID NO: 4205767 - RNA, 12 nt, Yersinia pestis KIM
uaaaacauuuca

SEQ ID NO: 4205768 - RNA, 19 nt, Yersinia pestis KIM
uaaaacauuucauuccaga

SEQ ID NO: 4205769 - RNA, 18 nt, Yersinia pestis KIM
uaaaaccaagaagacuaa

SEQ ID NO: 4205770 - RNA, 16 nt, Yersinia pestis KIM
uaaaaccacugaccua

SEQ ID NO: 4205771 - RNA, 22 nt, Yersinia pestis KIM
uaaaaccagcagcgcauaaaaa

SEQ ID NO: 4205772 - RNA, 15 nt, Yersinia pestis KIM
uaaaacgaguaaaua

SEQ ID NO: 4205773 - RNA, 18 nt, Yersinia pestis KIM
uaaaacgaguaaauacaa

SEQ ID NO: 4205774 - RNA, 14 nt, Yersinia pestis KIM
uaaaacugaagcau

SEQ ID NO: 4205775 - RNA, 15 nt, Yersinia pestis KIM
uaaaacugaagcauc

SEQ ID NO: 4205776 - RNA, 18 nt, Yersinia pestis KIM
uaaaacugaagcaucaau

SEQ ID NO: 4205777 - RNA, 23 nt, Yersinia pestis KIM
uaaaacuggcacgaacaaucgcc

SEQ ID NO: 4205778 - RNA, 18 nt, Yersinia pestis KIM
uaaaacuuuggcugaggg

SEQ ID NO: 4205779 - RNA, 17 nt, Yersinia pestis KIM
uaaaagaaaaccuugac

SEQ ID NO: 4205780 - RNA, 14 nt, Yersinia pestis KIM
uaaaagaaagggca

SEQ ID NO: 4205781 - RNA, 19 nt, Yersinia pestis KIM
uaaaagaauaaaugucacu

SEQ ID NO: 4205782 - RNA, 19 nt, Yersinia pestis KIM
uaaaagauucauaaaaaaa

SEQ ID NO: 4205783 - RNA, 17 nt, Yersinia pestis KIM
uaaaagcacagacaaac

SEQ ID NO: 4205784 - RNA, 19 nt, Yersinia pestis KIM
uaaaagcaucucgauacau

SEQ ID NO: 4205785 - RNA, 23 nt, Yersinia pestis KIM
uaaaagcaucucgauacauacca

SEQ ID NO: 4205786 - RNA, 14 nt, Yersinia pestis KIM
uaaaagccagucag

SEQ ID NO: 4205787 - RNA, 13 nt, Yersinia pestis KIM
uaaaaggauaggg

SEQ ID NO: 4205788 - RNA, 18 nt, Yersinia pestis KIM
uaaaaggauagggagcca

SEQ ID NO: 4205789 - RNA, 19 nt, Yersinia pestis KIM
uaaaaggauagggagccaa

SEQ ID NO: 4205790 - RNA, 23 nt, Yersinia pestis KIM
uaaaaggauagggagccaauaga

SEQ ID NO: 4205791 - RNA, 18 nt, Yersinia pestis KIM
uaaaaggauggcccaagc

SEQ ID NO: 4205792 - RNA, 19 nt, Yersinia pestis KIM
uaaaaggauggcccaagcc

SEQ ID NO: 4205793 - RNA, 12 nt, Yersinia pestis KIM
uaaaaggcccgc

SEQ ID NO: 4205794 - RNA, 15 nt, Yersinia pestis KIM
uaaaaggcuauuuaa

SEQ ID NO: 4205795 - RNA, 19 nt, Yersinia pestis KIM
uaaaaggcuauuuaaauuu

SEQ ID NO: 4205796 - RNA, 16 nt, Yersinia pestis KIM
uaaaagucuauauaga

SEQ ID NO: 4205797 - RNA, 18 nt, Yersinia pestis KIM
uaaaagugaccacacuca

SEQ ID NO: 4205798 - RNA, 22 nt, Yersinia pestis KIM
uaaaauaagcaggcaguaaaau

SEQ ID NO: 4205799 - RNA, 13 nt, Yersinia pestis KIM
uaaaauaaugagu

SEQ ID NO: 4205800 - RNA, 21 nt, Yersinia pestis KIM
uaaaauaaugaguuaaugaga

SEQ ID NO: 4205801 - RNA, 18 nt, Yersinia pestis KIM
uaaaauaccaauuaauaa

SEQ ID NO: 4205802 - RNA, 14 nt, Yersinia pestis KIM
uaaaauagcccagu

SEQ ID NO: 4205803 - RNA, 20 nt, Yersinia pestis KIM
uaaaauagcguaacgggaag

SEQ ID NO: 4205804 - RNA, 19 nt, Yersinia pestis KIM
uaaaauagguguuuuucgu

SEQ ID NO: 4205805 - RNA, 14 nt, Yersinia pestis KIM
uaaaaucaaaacag

SEQ ID NO: 4205806 - RNA, 19 nt, Yersinia pestis KIM
uaaaaucacccgcaagaau

SEQ ID NO: 4205807 - RNA, 23 nt, Yersinia pestis KIM
uaaaaucacguuuccaaaacuca

SEQ ID NO: 4205808 - RNA, 12 nt, Yersinia pestis KIM
uaaaauccccau

SEQ ID NO: 4205809 - RNA, 16 nt, Yersinia pestis KIM
uaaaauccccauucca

SEQ ID NO: 4205810 - RNA, 20 nt, Yersinia pestis KIM
uaaaaucugcuucuccugua

SEQ ID NO: 4205811 - RNA, 23 nt, Yersinia pestis KIM
uaaaaucuguaauuaauuauaag

SEQ ID NO: 4205812 - RNA, 16 nt, Yersinia pestis KIM
uaaaaucuugugccgc

SEQ ID NO: 4205813 - RNA, 21 nt, Yersinia pestis KIM
uaaaaugauaugcuuauaaac

SEQ ID NO: 4205814 - RNA, 16 nt, Yersinia pestis KIM
uaaaauuaauaaauua

SEQ ID NO: 4205815 - RNA, 12 nt, Yersinia pestis KIM
uaaaauuaauua

SEQ ID NO: 4205816 - RNA, 18 nt, Yersinia pestis KIM
uaaaauuacccagcaucu

SEQ ID NO: 4205817 - RNA, 14 nt, Yersinia pestis KIM
uaaacaaauaugac

SEQ ID NO: 4205818 - RNA, 18 nt, Yersinia pestis KIM
uaaacaaccaaaaaucuu

SEQ ID NO: 4205819 - RNA, 20 nt, Yersinia pestis KIM
uaaacaaccaaaaaucuugu

SEQ ID NO: 4205820 - RNA, 13 nt, Yersinia pestis KIM
uaaacaagcuuau

SEQ ID NO: 4205821 - RNA, 18 nt, Yersinia pestis KIM
uaaacaagcuuauauuau

SEQ ID NO: 4205822 - RNA, 15 nt, Yersinia pestis KIM
uaaacacucaauaag

SEQ ID NO: 4205823 - RNA, 18 nt, Yersinia pestis KIM
uaaacacucaauaaguag

SEQ ID NO: 4205824 - RNA, 22 nt, Yersinia pestis KIM
uaaacagacaaaaaauaguugu

SEQ ID NO: 4205825 - RNA, 19 nt, Yersinia pestis KIM
uaaacagacacagcaacaa

SEQ ID NO: 4205826 - RNA, 15 nt, Yersinia pestis KIM
uaaacagacuaaaaa

SEQ ID NO: 4205827 - RNA, 18 nt, Yersinia pestis KIM
uaaacagacuaaaaaccg

SEQ ID NO: 4205828 - RNA, 14 nt, Yersinia pestis KIM
uaaacagccagcau

SEQ ID NO: 4205829 - RNA, 19 nt, Yersinia pestis KIM
uaaacagccguauaucuua

SEQ ID NO: 4205830 - RNA, 22 nt, Yersinia pestis KIM
uaaacagccguauaucuuaccu

SEQ ID NO: 4205831 - RNA, 15 nt, Yersinia pestis KIM
uaaacagcuuaucag

SEQ ID NO: 4205832 - RNA, 17 nt, Yersinia pestis KIM
uaaacaggguugagcca

SEQ ID NO: 4205833 - RNA, 18 nt, Yersinia pestis KIM
uaaacagucuuauuacuc

SEQ ID NO: 4205834 - RNA, 23 nt, Yersinia pestis KIM
uaaacaucaugagauaaauauuu

SEQ ID NO: 4205835 - RNA, 17 nt, Yersinia pestis KIM
uaaacauugacgaugga

SEQ ID NO: 4205836 - RNA, 17 nt, Yersinia pestis KIM
uaaacauuguuauauua

SEQ ID NO: 4205837 - RNA, 15 nt, Yersinia pestis KIM
uaaacauuuacuuau

SEQ ID NO: 4205838 - RNA, 13 nt, Yersinia pestis KIM
uaaacauuuugac

SEQ ID NO: 4205839 - RNA, 16 nt, Yersinia pestis KIM
uaaaccaaucaagcau

SEQ ID NO: 4205840 - RNA, 15 nt, Yersinia pestis KIM
uaaaccagccaguga

SEQ ID NO: 4205841 - RNA, 16 nt, Yersinia pestis KIM
uaaaccagccagugau

SEQ ID NO: 4205842 - RNA, 13 nt, Yersinia pestis KIM
uaaaccaucagag

SEQ ID NO: 4205843 - RNA, 20 nt, Yersinia pestis KIM
uaaacccaaccccaucagca

SEQ ID NO: 4205844 - RNA, 21 nt, Yersinia pestis KIM
uaaacccccuguaaccgcaag

SEQ ID NO: 4205845 - RNA, 20 nt, Yersinia pestis KIM
uaaacccgcuaauauuuuca

SEQ ID NO: 4205846 - RNA, 14 nt, Yersinia pestis KIM
uaaacccggcauca

SEQ ID NO: 4205847 - RNA, 18 nt, Yersinia pestis KIM
uaaacccggcaucaacca

SEQ ID NO: 4205848 - RNA, 16 nt, Yersinia pestis KIM
uaaaccgcaccacaaa

SEQ ID NO: 4205849 - RNA, 23 nt, Yersinia pestis KIM
uaaaccgcuauaucaucagcaga

SEQ ID NO: 4205850 - RNA, 22 nt, Yersinia pestis KIM
uaaaccgcucucaccuaagccu

SEQ ID NO: 4205851 - RNA, 21 nt, Yersinia pestis KIM
uaaaccgggccuaauuuaacu

SEQ ID NO: 4205852 - RNA, 16 nt, Yersinia pestis KIM
uaaaccguacauuaaa

SEQ ID NO: 4205853 - RNA, 16 nt, Yersinia pestis KIM
uaaaccgugauugguu

SEQ ID NO: 4205854 - RNA, 15 nt, Yersinia pestis KIM
uaaaccucagaaaaa

SEQ ID NO: 4205855 - RNA, 16 nt, Yersinia pestis KIM
uaaaccucagaaaaau

SEQ ID NO: 4205856 - RNA, 20 nt, Yersinia pestis KIM
uaaaccucagaaaaaugccu

SEQ ID NO: 4205857 - RNA, 15 nt, Yersinia pestis KIM
uaaaccugacugguu

SEQ ID NO: 4205858 - RNA, 23 nt, Yersinia pestis KIM
uaaaccugcaauaaccagaauaa

SEQ ID NO: 4205859 - RNA, 22 nt, Yersinia pestis KIM
uaaacgaauggucugcaacuca

SEQ ID NO: 4205860 - RNA, 17 nt, Yersinia pestis KIM
uaaacgaccauuucucu

SEQ ID NO: 4205861 - RNA, 21 nt, Yersinia pestis KIM
uaaacgaccauuucucugaug

SEQ ID NO: 4205862 - RNA, 21 nt, Yersinia pestis KIM
uaaacgcacaucaauccgcau

SEQ ID NO: 4205863 - RNA, 13 nt, Yersinia pestis KIM
uaaacgccaacaa

SEQ ID NO: 4205864 - RNA, 17 nt, Yersinia pestis KIM
uaaacgccaaucaccuu

SEQ ID NO: 4205865 - RNA, 16 nt, Yersinia pestis KIM
uaaacgccagucagcu

SEQ ID NO: 4205866 - RNA, 13 nt, Yersinia pestis KIM
uaaacgggccgcg

SEQ ID NO: 4205867 - RNA, 21 nt, Yersinia pestis KIM
uaaacgggcuuccaucaggaa

SEQ ID NO: 4205868 - RNA, 14 nt, Yersinia pestis KIM
uaaacgguaaccau

SEQ ID NO: 4205869 - RNA, 18 nt, Yersinia pestis KIM
uaaacgguaaccauccau

SEQ ID NO: 4205870 - RNA, 23 nt, Yersinia pestis KIM
uaaacgguaaccauccauauuug

SEQ ID NO: 4205871 - RNA, 15 nt, Yersinia pestis KIM
uaaacgguugcugua

SEQ ID NO: 4205872 - RNA, 13 nt, Yersinia pestis KIM
uaaacgucagauu

SEQ ID NO: 4205873 - RNA, 22 nt, Yersinia pestis KIM
uaaacgucuuaugccauaacau

SEQ ID NO: 4205874 - RNA, 19 nt, Yersinia pestis KIM
uaaacguggcccuuucgca

SEQ ID NO: 4205875 - RNA, 23 nt, Yersinia pestis KIM
uaaacuaccgaucaucaggcagg

SEQ ID NO: 4205876 - RNA, 18 nt, Yersinia pestis KIM
uaaacugaauaucccccu

SEQ ID NO: 4205877 - RNA, 15 nt, Yersinia pestis KIM
uaaacugaucaucaa

SEQ ID NO: 4205878 - RNA, 17 nt, Yersinia pestis KIM
uaaacugccguaaacaa

SEQ ID NO: 4205879 - RNA, 18 nt, Yersinia pestis KIM
uaaacuugauucaccaga

SEQ ID NO: 4205880 - RNA, 17 nt, Yersinia pestis KIM
uaaacuuguaucaaaac

SEQ ID NO: 4205881 - RNA, 15 nt, Yersinia pestis KIM
uaaagaaaaaacguu

SEQ ID NO: 4205882 - RNA, 14 nt, Yersinia pestis KIM
uaaagaaaaacccg

SEQ ID NO: 4205883 - RNA, 23 nt, Yersinia pestis KIM
uaaagaaauaccccccaccaauu

SEQ ID NO: 4205884 - RNA, 17 nt, Yersinia pestis KIM
uaaagaaugcaaccagu

SEQ ID NO: 4205885 - RNA, 13 nt, Yersinia pestis KIM
uaaagacccaaua

SEQ ID NO: 4205886 - RNA, 19 nt, Yersinia pestis KIM
uaaagacgccggcuucccu

SEQ ID NO: 4205887 - RNA, 20 nt, Yersinia pestis KIM
uaaagacgccggcuucccug

SEQ ID NO: 4205888 - RNA, 20 nt, Yersinia pestis KIM
uaaagacgccguaaauacau

SEQ ID NO: 4205889 - RNA, 13 nt, Yersinia pestis KIM
uaaagacuucagc

SEQ ID NO: 4205890 - RNA, 17 nt, Yersinia pestis KIM
uaaagagugaaauauac

SEQ ID NO: 4205891 - RNA, 16 nt, Yersinia pestis KIM
uaaagauuucaucauu

SEQ ID NO: 4205892 - RNA, 21 nt, Yersinia pestis KIM
uaaagauuucaucauucaaua

SEQ ID NO: 4205893 - RNA, 20 nt, Yersinia pestis KIM
uaaagcaaagaucucucgaa

SEQ ID NO: 4205894 - RNA, 17 nt, Yersinia pestis KIM
uaaagcagcaucuggcg

SEQ ID NO: 4205895 - RNA, 20 nt, Yersinia pestis KIM
uaaagcaggccuucuaacuc

SEQ ID NO: 4205896 - RNA, 21 nt, Yersinia pestis KIM
uaaagcagguaguuacagcaa

SEQ ID NO: 4205897 - RNA, 14 nt, Yersinia pestis KIM
uaaagcaucagacu

SEQ ID NO: 4205898 - RNA, 16 nt, Yersinia pestis KIM
uaaagcauuuaucaua

SEQ ID NO: 4205899 - RNA, 20 nt, Yersinia pestis KIM
uaaagcauuuaucauauuaa

SEQ ID NO: 4205900 - RNA, 15 nt, Yersinia pestis KIM
uaaagccaucgccau

SEQ ID NO: 4205901 - RNA, 11 nt, Yersinia pestis KIM
uaaagcccagg

SEQ ID NO: 4205902 - RNA, 13 nt, Yersinia pestis KIM
uaaagccuugucc

SEQ ID NO: 4205903 - RNA, 16 nt, Yersinia pestis KIM
uaaagcgguaaauggc

SEQ ID NO: 4205904 - RNA, 23 nt, Yersinia pestis KIM
uaaagcguccgcgccaaggaagg

SEQ ID NO: 4205905 - RNA, 14 nt, Yersinia pestis KIM
uaaagcugucaguc

SEQ ID NO: 4205906 - RNA, 16 nt, Yersinia pestis KIM
uaaagcugucagucca

SEQ ID NO: 4205907 - RNA, 19 nt, Yersinia pestis KIM
uaaaggcaagauuucucuu

SEQ ID NO: 4205908 - RNA, 22 nt, Yersinia pestis KIM
uaaaggcuaaaccggcacaggc

SEQ ID NO: 4205909 - RNA, 19 nt, Yersinia pestis KIM
uaaagguacguaauuuacg

SEQ ID NO: 4205910 - RNA, 20 nt, Yersinia pestis KIM
uaaaggugaucgcucaggcg

SEQ ID NO: 4205911 - RNA, 15 nt, Yersinia pestis KIM
uaaagucaucccgca

SEQ ID NO: 4205912 - RNA, 21 nt, Yersinia pestis KIM
uaaaguguacuguuaacucau

SEQ ID NO: 4205913 - RNA, 17 nt, Yersinia pestis KIM
uaaaguuagcuacgcug

SEQ ID NO: 4205914 - RNA, 14 nt, Yersinia pestis KIM
uaaauaaaauaaua

SEQ ID NO: 4205915 - RNA, 18 nt, Yersinia pestis KIM
uaaauaaaauaauaaugg

SEQ ID NO: 4205916 - RNA, 14 nt, Yersinia pestis KIM
uaaauaaaauagcg

SEQ ID NO: 4205917 - RNA, 16 nt, Yersinia pestis KIM
uaaauaaauaaucauu

SEQ ID NO: 4205918 - RNA, 15 nt, Yersinia pestis KIM
uaaauaaauagaaaa

SEQ ID NO: 4205919 - RNA, 14 nt, Yersinia pestis KIM
uaaauaaauuuaau

SEQ ID NO: 4205920 - RNA, 15 nt, Yersinia pestis KIM
uaaauaacagcuaaa

SEQ ID NO: 4205921 - RNA, 22 nt, Yersinia pestis KIM
uaaauaaccgagcgugaagagc

SEQ ID NO: 4205922 - RNA, 19 nt, Yersinia pestis KIM
uaaauaacgcaaaaaucac

SEQ ID NO: 4205923 - RNA, 20 nt, Yersinia pestis KIM
uaaauaaguaggcaucugcc

SEQ ID NO: 4205924 - RNA, 20 nt, Yersinia pestis KIM
uaaauaauuacuuauaaacc

SEQ ID NO: 4205925 - RNA, 13 nt, Yersinia pestis KIM
uaaauaauugggg

SEQ ID NO: 4205926 - RNA, 12 nt, Yersinia pestis KIM
uaaauacaaaaa

SEQ ID NO: 4205927 - RNA, 16 nt, Yersinia pestis KIM
uaaauacagcaccauu

SEQ ID NO: 4205928 - RNA, 23 nt, Yersinia pestis KIM
uaaauacagcaccauucaaugua

SEQ ID NO: 4205929 - RNA, 14 nt, Yersinia pestis KIM
uaaauacauccaug

SEQ ID NO: 4205930 - RNA, 17 nt, Yersinia pestis KIM
uaaauaccaauuucaua

SEQ ID NO: 4205931 - RNA, 22 nt, Yersinia pestis KIM
uaaauaccaauuucauacaggc

SEQ ID NO: 4205932 - RNA, 22 nt, Yersinia pestis KIM
uaaauacccagcuucuuuuaaa

SEQ ID NO: 4205933 - RNA, 18 nt, Yersinia pestis KIM
uaaauacccgguuuccag

SEQ ID NO: 4205934 - RNA, 16 nt, Yersinia pestis KIM
uaaauacugaaaucau

SEQ ID NO: 4205935 - RNA, 21 nt, Yersinia pestis KIM
uaaauagagugaaguaucacc

SEQ ID NO: 4205936 - RNA, 14 nt, Yersinia pestis KIM
uaaauagauaaaaa

SEQ ID NO: 4205937 - RNA, 14 nt, Yersinia pestis KIM
uaaauagauaucga

SEQ ID NO: 4205938 - RNA, 14 nt, Yersinia pestis KIM
uaaauagcggccau

SEQ ID NO: 4205939 - RNA, 16 nt, Yersinia pestis KIM
uaaauagucauauauu

SEQ ID NO: 4205940 - RNA, 20 nt, Yersinia pestis KIM
uaaauaguuagugaguuauu

SEQ ID NO: 4205941 - RNA, 17 nt, Yersinia pestis KIM
uaaauaguucuucgcaa

SEQ ID NO: 4205942 - RNA, 14 nt, Yersinia pestis KIM
uaaauauaaaauaa

SEQ ID NO: 4205943 - RNA, 16 nt, Yersinia pestis KIM
uaaauauaaaauaaua

SEQ ID NO: 4205944 - RNA, 21 nt, Yersinia pestis KIM
uaaauauccugcucagcuaaa

SEQ ID NO: 4205945 - RNA, 18 nt, Yersinia pestis KIM
uaaauauggcggcaucag

SEQ ID NO: 4205946 - RNA, 15 nt, Yersinia pestis KIM
uaaauauuaacauuc

SEQ ID NO: 4205947 - RNA, 23 nt, Yersinia pestis KIM
uaaaucagacgagucuauugaaa

SEQ ID NO: 4205948 - RNA, 11 nt, Yersinia pestis KIM
uaaaucaucaa

SEQ ID NO: 4205949 - RNA, 12 nt, Yersinia pestis KIM
uaaaucaucauu

SEQ ID NO: 4205950 - RNA, 20 nt, Yersinia pestis KIM
uaaauccgcuaguuaacccu

SEQ ID NO: 4205951 - RNA, 19 nt, Yersinia pestis KIM
uaaauccugggauuuugcc

SEQ ID NO: 4205952 - RNA, 13 nt, Yersinia pestis KIM
uaaauccuucugg

SEQ ID NO: 4205953 - RNA, 14 nt, Yersinia pestis KIM
uaaaucgcaggcuu

SEQ ID NO: 4205954 - RNA, 14 nt, Yersinia pestis KIM
uaaaucuuucucca

SEQ ID NO: 4205955 - RNA, 23 nt, Yersinia pestis KIM
uaaaugaaauugggggucagggc

SEQ ID NO: 4205956 - RNA, 21 nt, Yersinia pestis KIM
uaaaugacauauugugcuauc

SEQ ID NO: 4205957 - RNA, 21 nt, Yersinia pestis KIM
uaaaugacuaucccuucaauc

SEQ ID NO: 4205958 - RNA, 22 nt, Yersinia pestis KIM
uaaaugacuaucccuucaauca

SEQ ID NO: 4205959 - RNA, 15 nt, Yersinia pestis KIM
uaaaugauugcuaua

SEQ ID NO: 4205960 - RNA, 21 nt, Yersinia pestis KIM
uaaaugcaauuuuugcagugc

SEQ ID NO: 4205961 - RNA, 16 nt, Yersinia pestis KIM
uaaaugcuguaagaau

SEQ ID NO: 4205962 - RNA, 23 nt, Yersinia pestis KIM
uaaauggagggcagcuugacgac

SEQ ID NO: 4205963 - RNA, 15 nt, Yersinia pestis KIM
uaaauggcauuuuuu

SEQ ID NO: 4205964 - RNA, 18 nt, Yersinia pestis KIM
uaaauggcgaaaggaaca

SEQ ID NO: 4205965 - RNA, 23 nt, Yersinia pestis KIM
uaaauggcgugcacugacccauu

SEQ ID NO: 4205966 - RNA, 22 nt, Yersinia pestis KIM
uaaauggcuguuauauaaaugg

SEQ ID NO: 4205967 - RNA, 18 nt, Yersinia pestis KIM
uaaaugguuuauuuaagc

SEQ ID NO: 4205968 - RNA, 20 nt, Yersinia pestis KIM
uaaauguacagucauuuacu

SEQ ID NO: 4205969 - RNA, 14 nt, Yersinia pestis KIM
uaaauguuagcuca

SEQ ID NO: 4205970 - RNA, 14 nt, Yersinia pestis KIM
uaaauuaaaacuga

SEQ ID NO: 4205971 - RNA, 20 nt, Yersinia pestis KIM
uaaauuacucguauaaaaaa

SEQ ID NO: 4205972 - RNA, 19 nt, Yersinia pestis KIM
uaaauuaucccguucaaua

SEQ ID NO: 4205973 - RNA, 22 nt, Yersinia pestis KIM
uaaauuaucgccuaccaucaaa

SEQ ID NO: 4205974 - RNA, 14 nt, Yersinia pestis KIM
uaaauucaaaauag

SEQ ID NO: 4205975 - RNA, 15 nt, Yersinia pestis KIM
uaaauucaaaauaga

SEQ ID NO: 4205976 - RNA, 23 nt, Yersinia pestis KIM
uaaauucaaaauagaggaaauaa

SEQ ID NO: 4205977 - RNA, 15 nt, Yersinia pestis KIM
uaaauucaaauauca

SEQ ID NO: 4205978 - RNA, 20 nt, Yersinia pestis KIM
uaaauucagguugaggcagg

SEQ ID NO: 4205979 - RNA, 17 nt, Yersinia pestis KIM
uaaauuccguaccaguu

SEQ ID NO: 4205980 - RNA, 21 nt, Yersinia pestis KIM
uaaauuccuauaaauuuuaag

SEQ ID NO: 4205981 - RNA, 15 nt, Yersinia pestis KIM
uaaauucuagcaaca

SEQ ID NO: 4205982 - RNA, 19 nt, Yersinia pestis KIM
uaaauucuccuugagcggc

SEQ ID NO: 4205983 - RNA, 11 nt, Yersinia pestis KIM
uaaauugcuca

SEQ ID NO: 4205984 - RNA, 14 nt, Yersinia pestis KIM
uaaauuuaauauga

SEQ ID NO: 4205985 - RNA, 17 nt, Yersinia pestis KIM
uaaauuucuucaauaau

SEQ ID NO: 4205986 - RNA, 12 nt, Yersinia pestis KIM
uaaauuuuaaac

SEQ ID NO: 4205987 - RNA, 15 nt, Yersinia pestis KIM
uaaauuuuacggcaa

SEQ ID NO: 4205988 - RNA, 16 nt, Yersinia pestis KIM
uaaauuuucaguucau

SEQ ID NO: 4205989 - RNA, 18 nt, Yersinia pestis KIM
uaaauuuucuaagcugcc

SEQ ID NO: 4205990 - RNA, 19 nt, Yersinia pestis KIM
uaaauuuucuaagcugccu

SEQ ID NO: 4205991 - RNA, 19 nt, Yersinia pestis KIM
uaaauuuuguacaacuucu

SEQ ID NO: 4205992 - RNA, 22 nt, Yersinia pestis KIM
uaaauuuuguacaacuucuuca

SEQ ID NO: 4205993 - RNA, 12 nt, Yersinia pestis KIM
uaacaaaaccgg

SEQ ID NO: 4205994 - RNA, 22 nt, Yersinia pestis KIM
uaacaaaaugcgguggcacuga

SEQ ID NO: 4205995 - RNA, 15 nt, Yersinia pestis KIM
uaacaaacacaucca

SEQ ID NO: 4205996 - RNA, 16 nt, Yersinia pestis KIM
uaacaacccuaacacc

SEQ ID NO: 4205997 - RNA, 16 nt, Yersinia pestis KIM
uaacaacuuccacaca

SEQ ID NO: 4205998 - RNA, 17 nt, Yersinia pestis KIM
uaacaacuuccacacaa

SEQ ID NO: 4205999 - RNA, 21 nt, Yersinia pestis KIM
uaacaagcgaccaucaugaau

SEQ ID NO: 4206000 - RNA, 15 nt, Yersinia pestis KIM
uaacaaguuacauuu

SEQ ID NO: 4206001 - RNA, 22 nt, Yersinia pestis KIM
uaacaauaaguugaacaguggu

SEQ ID NO: 4206002 - RNA, 16 nt, Yersinia pestis KIM
uaacaauccgaacaaa

SEQ ID NO: 4206003 - RNA, 20 nt, Yersinia pestis KIM
uaacaauggccggacucauu

SEQ ID NO: 4206004 - RNA, 17 nt, Yersinia pestis KIM
uaacaauuuuauuguuu

SEQ ID NO: 4206005 - RNA, 13 nt, Yersinia pestis KIM
uaacacauuaauu

SEQ ID NO: 4206006 - RNA, 20 nt, Yersinia pestis KIM
uaacacauuccaguaaaaaa

SEQ ID NO: 4206007 - RNA, 22 nt, Yersinia pestis KIM
uaacacauuccaguaaaaaaau

SEQ ID NO: 4206008 - RNA, 21 nt, Yersinia pestis KIM
uaacaccaaccggauuacaua

SEQ ID NO: 4206009 - RNA, 18 nt, Yersinia pestis KIM
uaacaccagcauccugca

SEQ ID NO: 4206010 - RNA, 15 nt, Yersinia pestis KIM
uaacaccaucaacau

SEQ ID NO: 4206011 - RNA, 20 nt, Yersinia pestis KIM
uaacacccaauaauaaaaaa

SEQ ID NO: 4206012 - RNA, 13 nt, Yersinia pestis KIM
uaacaccccuuca

SEQ ID NO: 4206013 - RNA, 17 nt, Yersinia pestis KIM
uaacaccgcuguagcgu

SEQ ID NO: 4206014 - RNA, 18 nt, Yersinia pestis KIM
uaacacgaaaagcagcag

SEQ ID NO: 4206015 - RNA, 21 nt, Yersinia pestis KIM
uaacacgaaccuucucugcac

SEQ ID NO: 4206016 - RNA, 18 nt, Yersinia pestis KIM
uaacacgaggcgcuacug

SEQ ID NO: 4206017 - RNA, 20 nt, Yersinia pestis KIM
uaacacggccuauugaauaa

SEQ ID NO: 4206018 - RNA, 23 nt, Yersinia pestis KIM
uaacacggccuauugaauaacag

SEQ ID NO: 4206019 - RNA, 21 nt, Yersinia pestis KIM
uaacacguuaaauuucuucaa

SEQ ID NO: 4206020 - RNA, 21 nt, Yersinia pestis KIM
uaacacuucagacugaaagua

SEQ ID NO: 4206021 - RNA, 17 nt, Yersinia pestis KIM
uaacacuucaugacagg

SEQ ID NO: 4206022 - RNA, 17 nt, Yersinia pestis KIM
uaacacuugaccaaccu

SEQ ID NO: 4206023 - RNA, 21 nt, Yersinia pestis KIM
uaacacuugaccaaccuguuu

SEQ ID NO: 4206024 - RNA, 16 nt, Yersinia pestis KIM
uaacagagcagaaagc

SEQ ID NO: 4206025 - RNA, 13 nt, Yersinia pestis KIM
uaacagcaucacu

SEQ ID NO: 4206026 - RNA, 19 nt, Yersinia pestis KIM
uaacagcaucacugucuau

SEQ ID NO: 4206027 - RNA, 16 nt, Yersinia pestis KIM
uaacagccggccauuc

SEQ ID NO: 4206028 - RNA, 19 nt, Yersinia pestis KIM
uaacagcgugcgcuccauu

SEQ ID NO: 4206029 - RNA, 15 nt, Yersinia pestis KIM
uaacauaaggcuaga

SEQ ID NO: 4206030 - RNA, 12 nt, Yersinia pestis KIM
uaacauacucag

SEQ ID NO: 4206031 - RNA, 18 nt, Yersinia pestis KIM
uaacauaucaauaagugc

SEQ ID NO: 4206032 - RNA, 20 nt, Yersinia pestis KIM
uaacauauccugugccaaca

SEQ ID NO: 4206033 - RNA, 12 nt, Yersinia pestis KIM
uaacaugccaca

SEQ ID NO: 4206034 - RNA, 16 nt, Yersinia pestis KIM
uaacaugccacauagc

SEQ ID NO: 4206035 - RNA, 16 nt, Yersinia pestis KIM
uaacaugcugauagca

SEQ ID NO: 4206036 - RNA, 15 nt, Yersinia pestis KIM
uaacaugguaugcca

SEQ ID NO: 4206037 - RNA, 17 nt, Yersinia pestis KIM
uaacaugguaugccacu

SEQ ID NO: 4206038 - RNA, 14 nt, Yersinia pestis KIM
uaacauguagcaca

SEQ ID NO: 4206039 - RNA, 15 nt, Yersinia pestis KIM
uaacauuauugaacg

SEQ ID NO: 4206040 - RNA, 11 nt, Yersinia pestis KIM
uaacauuuuuu

SEQ ID NO: 4206041 - RNA, 24 nt, Yersinia pestis KIM
uaaccaaagaacggccugccagaa

SEQ ID NO: 4206042 - RNA, 22 nt, Yersinia pestis KIM
uaaccaacaguuauuuuaauug

SEQ ID NO: 4206043 - RNA, 20 nt, Yersinia pestis KIM
uaaccaagccagugcgggag

SEQ ID NO: 4206044 - RNA, 21 nt, Yersinia pestis KIM
uaaccaauguugggguagcca

SEQ ID NO: 4206045 - RNA, 15 nt, Yersinia pestis KIM
uaaccaauucuuagg

SEQ ID NO: 4206046 - RNA, 17 nt, Yersinia pestis KIM
uaaccacacuuggugcu

SEQ ID NO: 4206047 - RNA, 20 nt, Yersinia pestis KIM
uaaccagacgcaaccaaaac

SEQ ID NO: 4206048 - RNA, 23 nt, Yersinia pestis KIM
uaaccagagcggagccucaguuc

SEQ ID NO: 4206049 - RNA, 13 nt, Yersinia pestis KIM
uaaccauaaaaua

SEQ ID NO: 4206050 - RNA, 17 nt, Yersinia pestis KIM
uaaccauaaaauaaaua

SEQ ID NO: 4206051 - RNA, 14 nt, Yersinia pestis KIM
uaaccaucaaauac

SEQ ID NO: 4206052 - RNA, 16 nt, Yersinia pestis KIM
uaaccaucaaauacac

SEQ ID NO: 4206053 - RNA, 20 nt, Yersinia pestis KIM
uaaccauccauauuuggcau

SEQ ID NO: 4206054 - RNA, 15 nt, Yersinia pestis KIM
uaaccaugaugacaa

SEQ ID NO: 4206055 - RNA, 12 nt, Yersinia pestis KIM
uaaccauugguu

SEQ ID NO: 4206056 - RNA, 16 nt, Yersinia pestis KIM
uaaccauugguuaccc

SEQ ID NO: 4206057 - RNA, 13 nt, Yersinia pestis KIM
uaaccauuuuaau

SEQ ID NO: 4206058 - RNA, 13 nt, Yersinia pestis KIM
uaacccaaagcca

SEQ ID NO: 4206059 - RNA, 12 nt, Yersinia pestis KIM
uaacccaaagug

SEQ ID NO: 4206060 - RNA, 15 nt, Yersinia pestis KIM
uaacccaaugccaua

SEQ ID NO: 4206061 - RNA, 18 nt, Yersinia pestis KIM
uaacccaaugcuccgcaa

SEQ ID NO: 4206062 - RNA, 13 nt, Yersinia pestis KIM
uaacccauugguu

SEQ ID NO: 4206063 - RNA, 21 nt, Yersinia pestis KIM
uaaccccacucgguuagcugu

SEQ ID NO: 4206064 - RNA, 19 nt, Yersinia pestis KIM
uaaccccguagcacacaca

SEQ ID NO: 4206065 - RNA, 16 nt, Yersinia pestis KIM
uaacccgauaaugccc

SEQ ID NO: 4206066 - RNA, 21 nt, Yersinia pestis KIM
uaacccuaccuaggccagcac

SEQ ID NO: 4206067 - RNA, 16 nt, Yersinia pestis KIM
uaaccgaauaaaaccu

SEQ ID NO: 4206068 - RNA, 21 nt, Yersinia pestis KIM
uaaccgacuugcccaauggca

SEQ ID NO: 4206069 - RNA, 20 nt, Yersinia pestis KIM
uaaccgauguagccuaugga

SEQ ID NO: 4206070 - RNA, 15 nt, Yersinia pestis KIM
uaaccgcagcaggca

SEQ ID NO: 4206071 - RNA, 23 nt, Yersinia pestis KIM
uaaccgccgauauucaagcagug

SEQ ID NO: 4206072 - RNA, 20 nt, Yersinia pestis KIM
uaaccgggcuugauuaaaug

SEQ ID NO: 4206073 - RNA, 21 nt, Yersinia pestis KIM
uaaccgggcuugauuaaauga

SEQ ID NO: 4206074 - RNA, 19 nt, Yersinia pestis KIM
uaaccggguaaauuccgua

SEQ ID NO: 4206075 - RNA, 15 nt, Yersinia pestis KIM
uaaccggguggccca

SEQ ID NO: 4206076 - RNA, 16 nt, Yersinia pestis KIM
uaaccuaaaaacguca

SEQ ID NO: 4206077 - RNA, 18 nt, Yersinia pestis KIM
uaaccucacgggcuucca

SEQ ID NO: 4206078 - RNA, 14 nt, Yersinia pestis KIM
uaaccucagccuca

SEQ ID NO: 4206079 - RNA, 20 nt, Yersinia pestis KIM
uaaccucagccucauucaug

SEQ ID NO: 4206080 - RNA, 15 nt, Yersinia pestis KIM
uaaccucagggagcc

SEQ ID NO: 4206081 - RNA, 21 nt, Yersinia pestis KIM
uaaccucagggagccaauaga

SEQ ID NO: 4206082 - RNA, 18 nt, Yersinia pestis KIM
uaaccucuaauaaaccug

SEQ ID NO: 4206083 - RNA, 22 nt, Yersinia pestis KIM
uaaccugcuggcgcaacuguag

SEQ ID NO: 4206084 - RNA, 14 nt, Yersinia pestis KIM
uaaccuuaacugca

SEQ ID NO: 4206085 - RNA, 20 nt, Yersinia pestis KIM
uaacgaauauucaagagauu

SEQ ID NO: 4206086 - RNA, 14 nt, Yersinia pestis KIM
uaacgaauuucauu

SEQ ID NO: 4206087 - RNA, 22 nt, Yersinia pestis KIM
uaacgaucgcuuaacgaggcgc

SEQ ID NO: 4206088 - RNA, 14 nt, Yersinia pestis KIM
uaacgcaaaaauca

SEQ ID NO: 4206089 - RNA, 13 nt, Yersinia pestis KIM
uaacgcagaaaua

SEQ ID NO: 4206090 - RNA, 20 nt, Yersinia pestis KIM
uaacgccgaguaagucaaua

SEQ ID NO: 4206091 - RNA, 21 nt, Yersinia pestis KIM
uaacgccgcuaaaucaucaaa

SEQ ID NO: 4206092 - RNA, 21 nt, Yersinia pestis KIM
uaacgccggauaaauuaauaa

SEQ ID NO: 4206093 - RNA, 18 nt, Yersinia pestis KIM
uaacgccggcgccauugc

SEQ ID NO: 4206094 - RNA, 17 nt, Yersinia pestis KIM
uaacgcucuacaacguc

SEQ ID NO: 4206095 - RNA, 14 nt, Yersinia pestis KIM
uaacgcugaauaag

SEQ ID NO: 4206096 - RNA, 19 nt, Yersinia pestis KIM
uaacgcuggauaagugaau

SEQ ID NO: 4206097 - RNA, 19 nt, Yersinia pestis KIM
uaacgcuucaucauggaua

SEQ ID NO: 4206098 - RNA, 14 nt, Yersinia pestis KIM
uaacggaaaaucau

SEQ ID NO: 4206099 - RNA, 19 nt, Yersinia pestis KIM
uaacggaaaaucaucgcuc

SEQ ID NO: 4206100 - RNA, 17 nt, Yersinia pestis KIM
uaacggaaggggaauau

SEQ ID NO: 4206101 - RNA, 17 nt, Yersinia pestis KIM
uaacggaauucagaacg

SEQ ID NO: 4206102 - RNA, 17 nt, Yersinia pestis KIM
uaacggcagcuuccugu

SEQ ID NO: 4206103 - RNA, 13 nt, Yersinia pestis KIM
uaacggccagcgu

SEQ ID NO: 4206104 - RNA, 23 nt, Yersinia pestis KIM
uaacggccggaacggucagggaa

SEQ ID NO: 4206105 - RNA, 15 nt, Yersinia pestis KIM
uaacggcucugccaa

SEQ ID NO: 4206106 - RNA, 13 nt, Yersinia pestis KIM
uaacgggcggcug

SEQ ID NO: 4206107 - RNA, 18 nt, Yersinia pestis KIM
uaacggucauaaucaggg

SEQ ID NO: 4206108 - RNA, 21 nt, Yersinia pestis KIM
uaacgguuuaccggggcgauc

SEQ ID NO: 4206109 - RNA, 19 nt, Yersinia pestis KIM
uaacgucaacagaacuaau

SEQ ID NO: 4206110 - RNA, 21 nt, Yersinia pestis KIM
uaacgucgcugaaaugcuaug

SEQ ID NO: 4206111 - RNA, 23 nt, Yersinia pestis KIM
uaacguguccccgagaggcuauu

SEQ ID NO: 4206112 - RNA, 21 nt, Yersinia pestis KIM
uaacguuuuaacgcuuugacu

SEQ ID NO: 4206113 - RNA, 15 nt, Yersinia pestis KIM
uaacuaaagccgauu

SEQ ID NO: 4206114 - RNA, 23 nt, Yersinia pestis KIM
uaacuaacaucagcgauucauug

SEQ ID NO: 4206115 - RNA, 16 nt, Yersinia pestis KIM
uaacuaacguuuugua

SEQ ID NO: 4206116 - RNA, 13 nt, Yersinia pestis KIM
uaacuaagcugcc

SEQ ID NO: 4206117 - RNA, 14 nt, Yersinia pestis KIM
uaacuaauaauaau

SEQ ID NO: 4206118 - RNA, 19 nt, Yersinia pestis KIM
uaacuacacuucguaaucu

SEQ ID NO: 4206119 - RNA, 14 nt, Yersinia pestis KIM
uaacucaaauuauu

SEQ ID NO: 4206120 - RNA, 12 nt, Yersinia pestis KIM
uaacucaauaau

SEQ ID NO: 4206121 - RNA, 13 nt, Yersinia pestis KIM
uaacucagccaca

SEQ ID NO: 4206122 - RNA, 18 nt, Yersinia pestis KIM
uaacucaggauccucguc

SEQ ID NO: 4206123 - RNA, 13 nt, Yersinia pestis KIM
uaacucaguaccg

SEQ ID NO: 4206124 - RNA, 13 nt, Yersinia pestis KIM
uaacucaucagua

SEQ ID NO: 4206125 - RNA, 19 nt, Yersinia pestis KIM
uaacuccacuucuuccauu

SEQ ID NO: 4206126 - RNA, 16 nt, Yersinia pestis KIM
uaacucuucuggcaaa

SEQ ID NO: 4206127 - RNA, 12 nt, Yersinia pestis KIM
uaacugaaagcc

SEQ ID NO: 4206128 - RNA, 18 nt, Yersinia pestis KIM
uaacugaccgcagccuuc

SEQ ID NO: 4206129 - RNA, 24 nt, Yersinia pestis KIM
uaacugacgaauagcaucaggggu

SEQ ID NO: 4206130 - RNA, 21 nt, Yersinia pestis KIM
uaacugaguuggaaaugacaa

SEQ ID NO: 4206131 - RNA, 16 nt, Yersinia pestis KIM
uaacugcugcuuuaau

SEQ ID NO: 4206132 - RNA, 15 nt, Yersinia pestis KIM
uaacuggccaauuaa

SEQ ID NO: 4206133 - RNA, 15 nt, Yersinia pestis KIM
uaacugggaagacau

SEQ ID NO: 4206134 - RNA, 10 nt, Yersinia pestis KIM
uaacuggucu

SEQ ID NO: 4206135 - RNA, 15 nt, Yersinia pestis KIM
uaacugguggcaggc

SEQ ID NO: 4206136 - RNA, 16 nt, Yersinia pestis KIM
uaacugguggcaggcc

SEQ ID NO: 4206137 - RNA, 16 nt, Yersinia pestis KIM
uaacugugcagcccau

SEQ ID NO: 4206138 - RNA, 15 nt, Yersinia pestis KIM
uaacuguuaaaacag

SEQ ID NO: 4206139 - RNA, 14 nt, Yersinia pestis KIM
uaacuguuuuauau

SEQ ID NO: 4206140 - RNA, 15 nt, Yersinia pestis KIM
uaacuuaauggcacc

SEQ ID NO: 4206141 - RNA, 23 nt, Yersinia pestis KIM
uaacuuauuacaccuuaaaacag

SEQ ID NO: 4206142 - RNA, 18 nt, Yersinia pestis KIM
uaacuucagguucaccuu

SEQ ID NO: 4206143 - RNA, 15 nt, Yersinia pestis KIM
uaacuuuaucagucu

SEQ ID NO: 4206144 - RNA, 17 nt, Yersinia pestis KIM
uaacuuuccauccagaa

SEQ ID NO: 4206145 - RNA, 21 nt, Yersinia pestis KIM
uaacuuuggguauaugacugu

SEQ ID NO: 4206146 - RNA, 21 nt, Yersinia pestis KIM
uaacuuuucuucauugcugcu

SEQ ID NO: 4206147 - RNA, 19 nt, Yersinia pestis KIM
uaacuuuuggcagcaccag

SEQ ID NO: 4206148 - RNA, 17 nt, Yersinia pestis KIM
uaacuuuuuauuucuuu

SEQ ID NO: 4206149 - RNA, 19 nt, Yersinia pestis KIM
uaagaaagagaugacccaa

SEQ ID NO: 4206150 - RNA, 16 nt, Yersinia pestis KIM
uaagaagccucaugaa

SEQ ID NO: 4206151 - RNA, 15 nt, Yersinia pestis KIM
uaagaauaaauaaua

SEQ ID NO: 4206152 - RNA, 22 nt, Yersinia pestis KIM
uaagaauaaggguagguucaau

SEQ ID NO: 4206153 - RNA, 12 nt, Yersinia pestis KIM
uaagacaacgcc

SEQ ID NO: 4206154 - RNA, 23 nt, Yersinia pestis KIM
uaagacauugcgcaagccccuau

SEQ ID NO: 4206155 - RNA, 18 nt, Yersinia pestis KIM
uaagacguuauuauugau

SEQ ID NO: 4206156 - RNA, 13 nt, Yersinia pestis KIM
uaagacuguuuua

SEQ ID NO: 4206157 - RNA, 15 nt, Yersinia pestis KIM
uaagagucacagcau

SEQ ID NO: 4206158 - RNA, 23 nt, Yersinia pestis KIM
uaagauaacccaaugccauagcu

SEQ ID NO: 4206159 - RNA, 14 nt, Yersinia pestis KIM
uaagauaccagcga

SEQ ID NO: 4206160 - RNA, 14 nt, Yersinia pestis KIM
uaagauccaccaca

SEQ ID NO: 4206161 - RNA, 17 nt, Yersinia pestis KIM
uaagauccaccacauca

SEQ ID NO: 4206162 - RNA, 15 nt, Yersinia pestis KIM
uaagauccagucggu

SEQ ID NO: 4206163 - RNA, 20 nt, Yersinia pestis KIM
uaagauccaguucaguccag

SEQ ID NO: 4206164 - RNA, 17 nt, Yersinia pestis KIM
uaagauccauguauauu

SEQ ID NO: 4206165 - RNA, 13 nt, Yersinia pestis KIM
uaagaucucagca

SEQ ID NO: 4206166 - RNA, 24 nt, Yersinia pestis KIM
uaagaugcaucccacgcagauacu

SEQ ID NO: 4206167 - RNA, 13 nt, Yersinia pestis KIM
uaagauuaagcca

SEQ ID NO: 4206168 - RNA, 13 nt, Yersinia pestis KIM
uaagauucgccgc

SEQ ID NO: 4206169 - RNA, 21 nt, Yersinia pestis KIM
uaagauucgccgcaaggcaaa

SEQ ID NO: 4206170 - RNA, 13 nt, Yersinia pestis KIM
uaagcaauaccga

SEQ ID NO: 4206171 - RNA, 18 nt, Yersinia pestis KIM
uaagcaauaccgacauca

SEQ ID NO: 4206172 - RNA, 19 nt, Yersinia pestis KIM
uaagcaauuuagacagcuu

SEQ ID NO: 4206173 - RNA, 16 nt, Yersinia pestis KIM
uaagcaggcaguaaaa

SEQ ID NO: 4206174 - RNA, 20 nt, Yersinia pestis KIM
uaagcaggcaguaaaauauu

SEQ ID NO: 4206175 - RNA, 19 nt, Yersinia pestis KIM
uaagcagggcgaucaggaa

SEQ ID NO: 4206176 - RNA, 17 nt, Yersinia pestis KIM
uaagcaucggcaacguc

SEQ ID NO: 4206177 - RNA, 19 nt, Yersinia pestis KIM
uaagcaugccauccugcca

SEQ ID NO: 4206178 - RNA, 21 nt, Yersinia pestis KIM
uaagcauuuaauguucgcuga

SEQ ID NO: 4206179 - RNA, 17 nt, Yersinia pestis KIM
uaagccaauaauauaau

SEQ ID NO: 4206180 - RNA, 20 nt, Yersinia pestis KIM
uaagccaugggucauuaauu

SEQ ID NO: 4206181 - RNA, 23 nt, Yersinia pestis KIM
uaagccaugggucauuaauuaag

SEQ ID NO: 4206182 - RNA, 22 nt, Yersinia pestis KIM
uaagccgcaggcaaacaaugug

SEQ ID NO: 4206183 - RNA, 22 nt, Yersinia pestis KIM
uaagccggucuuuuuacaagca

SEQ ID NO: 4206184 - RNA, 15 nt, Yersinia pestis KIM
uaagccgucagcuua

SEQ ID NO: 4206185 - RNA, 19 nt, Yersinia pestis KIM
uaagccucgcguaucauga

SEQ ID NO: 4206186 - RNA, 19 nt, Yersinia pestis KIM
uaagccucggucacugccu

SEQ ID NO: 4206187 - RNA, 20 nt, Yersinia pestis KIM
uaagcggaguuggcuagcau

SEQ ID NO: 4206188 - RNA, 14 nt, Yersinia pestis KIM
uaagcgguuucaug

SEQ ID NO: 4206189 - RNA, 20 nt, Yersinia pestis KIM
uaagcgguuuguuaaaaagc

SEQ ID NO: 4206190 - RNA, 14 nt, Yersinia pestis KIM
uaagcguauuuugu

SEQ ID NO: 4206191 - RNA, 16 nt, Yersinia pestis KIM
uaagcuaucauuaaau

SEQ ID NO: 4206192 - RNA, 18 nt, Yersinia pestis KIM
uaagcucaucuaacucau

SEQ ID NO: 4206193 - RNA, 15 nt, Yersinia pestis KIM
uaagcugccugugcg

SEQ ID NO: 4206194 - RNA, 18 nt, Yersinia pestis KIM
uaagcugccugugcggca

SEQ ID NO: 4206195 - RNA, 17 nt, Yersinia pestis KIM
uaagcugucuaaauugc

SEQ ID NO: 4206196 - RNA, 20 nt, Yersinia pestis KIM
uaagcuguuggcuuuaucuc

SEQ ID NO: 4206197 - RNA, 14 nt, Yersinia pestis KIM
uaaggaaaauaccc

SEQ ID NO: 4206198 - RNA, 13 nt, Yersinia pestis KIM
uaaggaaacucau

SEQ ID NO: 4206199 - RNA, 17 nt, Yersinia pestis KIM
uaaggaucguucagugc

SEQ ID NO: 4206200 - RNA, 13 nt, Yersinia pestis KIM
uaaggaucugaag

SEQ ID NO: 4206201 - RNA, 14 nt, Yersinia pestis KIM
uaaggaucugaaga

SEQ ID NO: 4206202 - RNA, 18 nt, Yersinia pestis KIM
uaaggcauauacaaccuc

SEQ ID NO: 4206203 - RNA, 13 nt, Yersinia pestis KIM
uaaggcaucaacc

SEQ ID NO: 4206204 - RNA, 14 nt, Yersinia pestis KIM
uaaggcaucaacca

SEQ ID NO: 4206205 - RNA, 18 nt, Yersinia pestis KIM
uaaggcaucaaccaguuc

SEQ ID NO: 4206206 - RNA, 22 nt, Yersinia pestis KIM
uaaggcccauuugucgcgccug

SEQ ID NO: 4206207 - RNA, 22 nt, Yersinia pestis KIM
uaaggcccgcaguaauauguaa

SEQ ID NO: 4206208 - RNA, 14 nt, Yersinia pestis KIM
uaaggccgcaauug

SEQ ID NO: 4206209 - RNA, 23 nt, Yersinia pestis KIM
uaaggccgcgauaaaaaauaaag

SEQ ID NO: 4206210 - RNA, 21 nt, Yersinia pestis KIM
uaaggccucggcgauugaaca

SEQ ID NO: 4206211 - RNA, 13 nt, Yersinia pestis KIM
uaagggggacccc

SEQ ID NO: 4206212 - RNA, 20 nt, Yersinia pestis KIM
uaaggucacuguuucgccuu

SEQ ID NO: 4206213 - RNA, 14 nt, Yersinia pestis KIM
uaaggugccacaca

SEQ ID NO: 4206214 - RNA, 17 nt, Yersinia pestis KIM
uaagguucuuucauuca

SEQ ID NO: 4206215 - RNA, 13 nt, Yersinia pestis KIM
uaaguaacuaaca

SEQ ID NO: 4206216 - RNA, 16 nt, Yersinia pestis KIM
uaaguauuucaaauaa

SEQ ID NO: 4206217 - RNA, 18 nt, Yersinia pestis KIM
uaagugaauuaauaacag

SEQ ID NO: 4206218 - RNA, 22 nt, Yersinia pestis KIM
uaagugauucgggugagugaac

SEQ ID NO: 4206219 - RNA, 22 nt, Yersinia pestis KIM
uaagugauucgggugagugagc

SEQ ID NO: 4206220 - RNA, 17 nt, Yersinia pestis KIM
uaagugcaaacuuaaaa

SEQ ID NO: 4206221 - RNA, 16 nt, Yersinia pestis KIM
uaagugccgggaauau

SEQ ID NO: 4206222 - RNA, 16 nt, Yersinia pestis KIM
uaagugcgggaaagua

SEQ ID NO: 4206223 - RNA, 14 nt, Yersinia pestis KIM
uaagugcuaaucau

SEQ ID NO: 4206224 - RNA, 22 nt, Yersinia pestis KIM
uaaguguauucgcaucuuccaa

SEQ ID NO: 4206225 - RNA, 16 nt, Yersinia pestis KIM
uaagugucaauaacag

SEQ ID NO: 4206226 - RNA, 17 nt, Yersinia pestis KIM
uaaguguguguauuuaa

SEQ ID NO: 4206227 - RNA, 19 nt, Yersinia pestis KIM
uaaguguguguauuuaaaa

SEQ ID NO: 4206228 - RNA, 13 nt, Yersinia pestis KIM
uaaguuaaaaaga

SEQ ID NO: 4206229 - RNA, 14 nt, Yersinia pestis KIM
uaaguuaaaaagaa

SEQ ID NO: 4206230 - RNA, 16 nt, Yersinia pestis KIM
uaaguuaacaccauca

SEQ ID NO: 4206231 - RNA, 13 nt, Yersinia pestis KIM
uaaguuaguggug

SEQ ID NO: 4206232 - RNA, 22 nt, Yersinia pestis KIM
uaaguuaucgucacuggcacca

SEQ ID NO: 4206233 - RNA, 23 nt, Yersinia pestis KIM
uaaguucagguugaaauaaauaa

SEQ ID NO: 4206234 - RNA, 15 nt, Yersinia pestis KIM
uaaguugaugcagua

SEQ ID NO: 4206235 - RNA, 17 nt, Yersinia pestis KIM
uaaguugaugcagugag

SEQ ID NO: 4206236 - RNA, 14 nt, Yersinia pestis KIM
uaauaaaaaacuga

SEQ ID NO: 4206237 - RNA, 16 nt, Yersinia pestis KIM
uaauaaaaaacugacu

SEQ ID NO: 4206238 - RNA, 20 nt, Yersinia pestis KIM
uaauaaaaccuuuacaauua

SEQ ID NO: 4206239 - RNA, 21 nt, Yersinia pestis KIM
uaauaaacagacaaaaaauag

SEQ ID NO: 4206240 - RNA, 21 nt, Yersinia pestis KIM
uaauaaagcgaugcucaauac

SEQ ID NO: 4206241 - RNA, 14 nt, Yersinia pestis KIM
uaauaaauuauaau

SEQ ID NO: 4206242 - RNA, 17 nt, Yersinia pestis KIM
uaauaaauuuucuaagc

SEQ ID NO: 4206243 - RNA, 12 nt, Yersinia pestis KIM
uaauaaccauug

SEQ ID NO: 4206244 - RNA, 17 nt, Yersinia pestis KIM
uaauaaccauugguuac

SEQ ID NO: 4206245 - RNA, 17 nt, Yersinia pestis KIM
uaauaaccguuucagga

SEQ ID NO: 4206246 - RNA, 23 nt, Yersinia pestis KIM
uaauaagccgcaggcaaacaaug

SEQ ID NO: 4206247 - RNA, 22 nt, Yersinia pestis KIM
uaauaagugaucagcuaacaaa

SEQ ID NO: 4206248 - RNA, 14 nt, Yersinia pestis KIM
uaauaauaaauugc

SEQ ID NO: 4206249 - RNA, 19 nt, Yersinia pestis KIM
uaauaauaugcacgucauu

SEQ ID NO: 4206250 - RNA, 16 nt, Yersinia pestis KIM
uaauaaucuuaaguaa

SEQ ID NO: 4206251 - RNA, 17 nt, Yersinia pestis KIM
uaauaaugaacaaauau

SEQ ID NO: 4206252 - RNA, 16 nt, Yersinia pestis KIM
uaauaaugaugaacua

SEQ ID NO: 4206253 - RNA, 19 nt, Yersinia pestis KIM
uaauaaugaugaacuacag

SEQ ID NO: 4206254 - RNA, 16 nt, Yersinia pestis KIM
uaauaaugauuauuga

SEQ ID NO: 4206255 - RNA, 22 nt, Yersinia pestis KIM
uaauaaugccguuaauugugau

SEQ ID NO: 4206256 - RNA, 12 nt, Yersinia pestis KIM
uaauaauuauuu

SEQ ID NO: 4206257 - RNA, 20 nt, Yersinia pestis KIM
uaauaauucagguugagcau

SEQ ID NO: 4206258 - RNA, 22 nt, Yersinia pestis KIM
uaauaauuuauacauaucagaa

SEQ ID NO: 4206259 - RNA, 15 nt, Yersinia pestis KIM
uaauacaauagagaa

SEQ ID NO: 4206260 - RNA, 18 nt, Yersinia pestis KIM
uaauacauaaaaucaaua

SEQ ID NO: 4206261 - RNA, 13 nt, Yersinia pestis KIM
uaauacaucauca

SEQ ID NO: 4206262 - RNA, 20 nt, Yersinia pestis KIM
uaauacccucgacaccaaaa

SEQ ID NO: 4206263 - RNA, 11 nt, Yersinia pestis KIM
uaauaccgaua

SEQ ID NO: 4206264 - RNA, 13 nt, Yersinia pestis KIM
uaauacgccaucc

SEQ ID NO: 4206265 - RNA, 16 nt, Yersinia pestis KIM
uaauacgccauccgca

SEQ ID NO: 4206266 - RNA, 22 nt, Yersinia pestis KIM
uaauacggcuugcaauuggggu

SEQ ID NO: 4206267 - RNA, 16 nt, Yersinia pestis KIM
uaauacguuggcggcu

SEQ ID NO: 4206268 - RNA, 16 nt, Yersinia pestis KIM
uaauacugucaaaauc

SEQ ID NO: 4206269 - RNA, 20 nt, Yersinia pestis KIM
uaauacuuucccauagcugg

SEQ ID NO: 4206270 - RNA, 14 nt, Yersinia pestis KIM
uaauagauaguacu

SEQ ID NO: 4206271 - RNA, 19 nt, Yersinia pestis KIM
uaauagauuguaaguaacu

SEQ ID NO: 4206272 - RNA, 15 nt, Yersinia pestis KIM
uaauagccucugucu

SEQ ID NO: 4206273 - RNA, 21 nt, Yersinia pestis KIM
uaauaguuaaucgcagcagag

SEQ ID NO: 4206274 - RNA, 20 nt, Yersinia pestis KIM
uaauaguucauuuuguauuu

SEQ ID NO: 4206275 - RNA, 15 nt, Yersinia pestis KIM
uaauauaauucaaua

SEQ ID NO: 4206276 - RNA, 18 nt, Yersinia pestis KIM
uaauauaauucaauauau

SEQ ID NO: 4206277 - RNA, 11 nt, Yersinia pestis KIM
uaauauaucuc

SEQ ID NO: 4206278 - RNA, 14 nt, Yersinia pestis KIM
uaauauauuuaauu

SEQ ID NO: 4206279 - RNA, 12 nt, Yersinia pestis KIM
uaauaucaccau

SEQ ID NO: 4206280 - RNA, 16 nt, Yersinia pestis KIM
uaauaucgacuccuuu

SEQ ID NO: 4206281 - RNA, 15 nt, Yersinia pestis KIM
uaauaugccaaaucu

SEQ ID NO: 4206282 - RNA, 12 nt, Yersinia pestis KIM
uaauauuauuca

SEQ ID NO: 4206283 - RNA, 22 nt, Yersinia pestis KIM
uaauauucaauaggguaauacc

SEQ ID NO: 4206284 - RNA, 14 nt, Yersinia pestis KIM
uaauauuuauaaaa

SEQ ID NO: 4206285 - RNA, 16 nt, Yersinia pestis KIM
uaauauuuauaaaaaa

SEQ ID NO: 4206286 - RNA, 17 nt, Yersinia pestis KIM
uaauauuuccguggguu

SEQ ID NO: 4206287 - RNA, 20 nt, Yersinia pestis KIM
uaauauuuuacugccacuga

SEQ ID NO: 4206288 - RNA, 16 nt, Yersinia pestis KIM
uaaucaagccuucauu

SEQ ID NO: 4206289 - RNA, 20 nt, Yersinia pestis KIM
uaaucaccagacaaccaaua

SEQ ID NO: 4206290 - RNA, 16 nt, Yersinia pestis KIM
uaaucaccauuaauaa

SEQ ID NO: 4206291 - RNA, 19 nt, Yersinia pestis KIM
uaaucaccauuaauaauau

SEQ ID NO: 4206292 - RNA, 22 nt, Yersinia pestis KIM
uaaucaccucaccagcaucuug

SEQ ID NO: 4206293 - RNA, 23 nt, Yersinia pestis KIM
uaaucacucucaugaauacgcua

SEQ ID NO: 4206294 - RNA, 12 nt, Yersinia pestis KIM
uaaucacuuauu

SEQ ID NO: 4206295 - RNA, 15 nt, Yersinia pestis KIM
uaaucagacugcuga

SEQ ID NO: 4206296 - RNA, 16 nt, Yersinia pestis KIM
uaaucagacugcugac

SEQ ID NO: 4206297 - RNA, 18 nt, Yersinia pestis KIM
uaaucagacugcugacaa

SEQ ID NO: 4206298 - RNA, 21 nt, Yersinia pestis KIM
uaaucagaggugaaaaaauau

SEQ ID NO: 4206299 - RNA, 14 nt, Yersinia pestis KIM
uaaucaguggcuga

SEQ ID NO: 4206300 - RNA, 15 nt, Yersinia pestis KIM
uaaucauaggccacu

SEQ ID NO: 4206301 - RNA, 15 nt, Yersinia pestis KIM
uaaucauaucaaaau

SEQ ID NO: 4206302 - RNA, 17 nt, Yersinia pestis KIM
uaaucauaucaaaauaa

SEQ ID NO: 4206303 - RNA, 16 nt, Yersinia pestis KIM
uaaucaucaguuuauu

SEQ ID NO: 4206304 - RNA, 17 nt, Yersinia pestis KIM
uaaucaucuacaacauc

SEQ ID NO: 4206305 - RNA, 18 nt, Yersinia pestis KIM
uaaucaucuacaacauca

SEQ ID NO: 4206306 - RNA, 11 nt, Yersinia pestis KIM
uaaucaugggg

SEQ ID NO: 4206307 - RNA, 23 nt, Yersinia pestis KIM
uaaucaugggguuuauugguuau

SEQ ID NO: 4206308 - RNA, 22 nt, Yersinia pestis KIM
uaaucauuggcaacuuaagcau

SEQ ID NO: 4206309 - RNA, 23 nt, Yersinia pestis KIM
uaaucauuggcaacuuaagcauu

SEQ ID NO: 4206310 - RNA, 19 nt, Yersinia pestis KIM
uaaucauuuauuuuuccag

SEQ ID NO: 4206311 - RNA, 20 nt, Yersinia pestis KIM
uaaucauuuguuucucaccg

SEQ ID NO: 4206312 - RNA, 18 nt, Yersinia pestis KIM
uaauccaaaauaauauaa

SEQ ID NO: 4206313 - RNA, 13 nt, Yersinia pestis KIM
uaauccacccggc

SEQ ID NO: 4206314 - RNA, 14 nt, Yersinia pestis KIM
uaauccauacagaa

SEQ ID NO: 4206315 - RNA, 15 nt, Yersinia pestis KIM
uaauccauacagaac

SEQ ID NO: 4206316 - RNA, 23 nt, Yersinia pestis KIM
uaaucccccgcgccgacugcuga

SEQ ID NO: 4206317 - RNA, 21 nt, Yersinia pestis KIM
uaauccgaccaccacugcauc

SEQ ID NO: 4206318 - RNA, 19 nt, Yersinia pestis KIM
uaauccuaaugaacacuua

SEQ ID NO: 4206319 - RNA, 14 nt, Yersinia pestis KIM
uaaucgauaaugga

SEQ ID NO: 4206320 - RNA, 21 nt, Yersinia pestis KIM
uaaucgccagcaaaucacauu

SEQ ID NO: 4206321 - RNA, 21 nt, Yersinia pestis KIM
uaaucgccaggcgcuacgcaa

SEQ ID NO: 4206322 - RNA, 22 nt, Yersinia pestis KIM
uaaucgccgccuccgauucaua

SEQ ID NO: 4206323 - RNA, 23 nt, Yersinia pestis KIM
uaaucgccguggugccaucgcuu

SEQ ID NO: 4206324 - RNA, 22 nt, Yersinia pestis KIM
uaaucgccucgaccuuaaccgc

SEQ ID NO: 4206325 - RNA, 21 nt, Yersinia pestis KIM
uaaucgccugcugagccaaau

SEQ ID NO: 4206326 - RNA, 23 nt, Yersinia pestis KIM
uaaucgccugcugagccaaauaa

SEQ ID NO: 4206327 - RNA, 22 nt, Yersinia pestis KIM
uaaucgcgcauuucuucucuca

SEQ ID NO: 4206328 - RNA, 18 nt, Yersinia pestis KIM
uaaucgggaaauugugau

SEQ ID NO: 4206329 - RNA, 17 nt, Yersinia pestis KIM
uaaucguggcuguaaau

SEQ ID NO: 4206330 - RNA, 13 nt, Yersinia pestis KIM
uaaucuccaucau

SEQ ID NO: 4206331 - RNA, 15 nt, Yersinia pestis KIM
uaaucuuguaguaca

SEQ ID NO: 4206332 - RNA, 13 nt, Yersinia pestis KIM
uaaugaaaaggca

SEQ ID NO: 4206333 - RNA, 20 nt, Yersinia pestis KIM
uaaugaaaauagccaaccag

SEQ ID NO: 4206334 - RNA, 14 nt, Yersinia pestis KIM
uaaugaaauaguaa

SEQ ID NO: 4206335 - RNA, 13 nt, Yersinia pestis KIM
uaaugaaaucuaa

SEQ ID NO: 4206336 - RNA, 19 nt, Yersinia pestis KIM
uaaugaaaucuaaguucag

SEQ ID NO: 4206337 - RNA, 14 nt, Yersinia pestis KIM
uaaugacauaauca

SEQ ID NO: 4206338 - RNA, 15 nt, Yersinia pestis KIM
uaaugacauaaucag

SEQ ID NO: 4206339 - RNA, 17 nt, Yersinia pestis KIM
uaaugagaaucaaucaa

SEQ ID NO: 4206340 - RNA, 17 nt, Yersinia pestis KIM
uaaugagauuaauucaa

SEQ ID NO: 4206341 - RNA, 18 nt, Yersinia pestis KIM
uaaugagccgcauugauc

SEQ ID NO: 4206342 - RNA, 17 nt, Yersinia pestis KIM
uaaugagcguuauuauu

SEQ ID NO: 4206343 - RNA, 21 nt, Yersinia pestis KIM
uaaugauguaguguguuuucu

SEQ ID NO: 4206344 - RNA, 14 nt, Yersinia pestis KIM
uaaugauuauugac

SEQ ID NO: 4206345 - RNA, 19 nt, Yersinia pestis KIM
uaaugauuauugaccagau

SEQ ID NO: 4206346 - RNA, 20 nt, Yersinia pestis KIM
uaaugauugccguagcguca

SEQ ID NO: 4206347 - RNA, 23 nt, Yersinia pestis KIM
uaaugcaauuuuggaauagcugu

SEQ ID NO: 4206348 - RNA, 16 nt, Yersinia pestis KIM
uaaugcaccuguuaaa

SEQ ID NO: 4206349 - RNA, 24 nt, Yersinia pestis KIM
uaaugcacgucaguuaaauaugac

SEQ ID NO: 4206350 - RNA, 20 nt, Yersinia pestis KIM
uaaugcagguucauuacaca

SEQ ID NO: 4206351 - RNA, 17 nt, Yersinia pestis KIM
uaaugcagguuuugcca

SEQ ID NO: 4206352 - RNA, 13 nt, Yersinia pestis KIM
uaaugccaauuga

SEQ ID NO: 4206353 - RNA, 12 nt, Yersinia pestis KIM
uaaugccacacu

SEQ ID NO: 4206354 - RNA, 21 nt, Yersinia pestis KIM
uaaugccgaaugauucauuga

SEQ ID NO: 4206355 - RNA, 20 nt, Yersinia pestis KIM
uaaugccgcugaucaggaag

SEQ ID NO: 4206356 - RNA, 21 nt, Yersinia pestis KIM
uaaugccggcggcccauaucc

SEQ ID NO: 4206357 - RNA, 18 nt, Yersinia pestis KIM
uaaugccuggugcaaccg

SEQ ID NO: 4206358 - RNA, 21 nt, Yersinia pestis KIM
uaaugcgcgcagcaagcugag

SEQ ID NO: 4206359 - RNA, 14 nt, Yersinia pestis KIM
uaauggauaaugcu

SEQ ID NO: 4206360 - RNA, 12 nt, Yersinia pestis KIM
uaauggauagcu

SEQ ID NO: 4206361 - RNA, 15 nt, Yersinia pestis KIM
uaauggcacgccagu

SEQ ID NO: 4206362 - RNA, 16 nt, Yersinia pestis KIM
uaauggcauuuuucgc

SEQ ID NO: 4206363 - RNA, 23 nt, Yersinia pestis KIM
uaauggcgguauagaccaauuca

SEQ ID NO: 4206364 - RNA, 21 nt, Yersinia pestis KIM
uaauggucaaggugauuucaa

SEQ ID NO: 4206365 - RNA, 16 nt, Yersinia pestis KIM
uaauggugaaccagau

SEQ ID NO: 4206366 - RNA, 15 nt, Yersinia pestis KIM
uaaugguuuauuuaa

SEQ ID NO: 4206367 - RNA, 13 nt, Yersinia pestis KIM
uaauguauuuauu

SEQ ID NO: 4206368 - RNA, 22 nt, Yersinia pestis KIM
uaauguauuuauucaaaaaauu

SEQ ID NO: 4206369 - RNA, 15 nt, Yersinia pestis KIM
uaauguccuauuuaa

SEQ ID NO: 4206370 - RNA, 17 nt, Yersinia pestis KIM
uaaugucgccauaacgc

SEQ ID NO: 4206371 - RNA, 17 nt, Yersinia pestis KIM
uaaugucuuuacuaaau

SEQ ID NO: 4206372 - RNA, 14 nt, Yersinia pestis KIM
uaauguuaauauuu

SEQ ID NO: 4206373 - RNA, 12 nt, Yersinia pestis KIM
uaauguugaucu

SEQ ID NO: 4206374 - RNA, 22 nt, Yersinia pestis KIM
uaauguugcaaacggauaaugu

SEQ ID NO: 4206375 - RNA, 15 nt, Yersinia pestis KIM
uaauguuuauauuga

SEQ ID NO: 4206376 - RNA, 18 nt, Yersinia pestis KIM
uaauguuucuauccgaaa

SEQ ID NO: 4206377 - RNA, 20 nt, Yersinia pestis KIM
uaauuaaacgcucaucaacc

SEQ ID NO: 4206378 - RNA, 19 nt, Yersinia pestis KIM
uaauuaacacccaauaaua

SEQ ID NO: 4206379 - RNA, 13 nt, Yersinia pestis KIM
uaauuaaugcacc

SEQ ID NO: 4206380 - RNA, 14 nt, Yersinia pestis KIM
uaauuaauuauaag

SEQ ID NO: 4206381 - RNA, 15 nt, Yersinia pestis KIM
uaauuaauuaugaua

SEQ ID NO: 4206382 - RNA, 14 nt, Yersinia pestis KIM
uaauuaauuauuca

SEQ ID NO: 4206383 - RNA, 17 nt, Yersinia pestis KIM
uaauuaauucaaucggc

SEQ ID NO: 4206384 - RNA, 13 nt, Yersinia pestis KIM
uaauuaauuuaaa

SEQ ID NO: 4206385 - RNA, 23 nt, Yersinia pestis KIM
uaauuacaguugauauuauuauu

SEQ ID NO: 4206386 - RNA, 15 nt, Yersinia pestis KIM
uaauuacuuauaaac

SEQ ID NO: 4206387 - RNA, 20 nt, Yersinia pestis KIM
uaauuaggcuucuaacaaua

SEQ ID NO: 4206388 - RNA, 14 nt, Yersinia pestis KIM
uaauuagugacagu

SEQ ID NO: 4206389 - RNA, 16 nt, Yersinia pestis KIM
uaauuaguuuuaauaa

SEQ ID NO: 4206390 - RNA, 17 nt, Yersinia pestis KIM
uaauuauaccuacccuu

SEQ ID NO: 4206391 - RNA, 15 nt, Yersinia pestis KIM
uaauuauagugaaaa

SEQ ID NO: 4206392 - RNA, 16 nt, Yersinia pestis KIM
uaauuaugauaaaugg

SEQ ID NO: 4206393 - RNA, 22 nt, Yersinia pestis KIM
uaauuauuguggcuaccaauua

SEQ ID NO: 4206394 - RNA, 14 nt, Yersinia pestis KIM
uaauuauuuauaau

SEQ ID NO: 4206395 - RNA, 13 nt, Yersinia pestis KIM
uaauuauuucucu

SEQ ID NO: 4206396 - RNA, 15 nt, Yersinia pestis KIM
uaauucaccuaaucu

SEQ ID NO: 4206397 - RNA, 23 nt, Yersinia pestis KIM
uaauucacgucgccgguggcuga

SEQ ID NO: 4206398 - RNA, 17 nt, Yersinia pestis KIM
uaauucacugcuuaauc

SEQ ID NO: 4206399 - RNA, 14 nt, Yersinia pestis KIM
uaauucagauguua

SEQ ID NO: 4206400 - RNA, 19 nt, Yersinia pestis KIM
uaauucagcaucaaauuau

SEQ ID NO: 4206401 - RNA, 21 nt, Yersinia pestis KIM
uaauucagcaucaaauuauuu

SEQ ID NO: 4206402 - RNA, 16 nt, Yersinia pestis KIM
uaauucaggcaaauuc

SEQ ID NO: 4206403 - RNA, 19 nt, Yersinia pestis KIM
uaauucaguuaauagggcu

SEQ ID NO: 4206404 - RNA, 16 nt, Yersinia pestis KIM
uaauucauuauuacuc

SEQ ID NO: 4206405 - RNA, 22 nt, Yersinia pestis KIM
uaauucgugggcauuuuuugcc

SEQ ID NO: 4206406 - RNA, 13 nt, Yersinia pestis KIM
uaauucuccuuuc

SEQ ID NO: 4206407 - RNA, 14 nt, Yersinia pestis KIM
uaauucucucuuuu

SEQ ID NO: 4206408 - RNA, 15 nt, Yersinia pestis KIM
uaauugaagauuuaa

SEQ ID NO: 4206409 - RNA, 18 nt, Yersinia pestis KIM
uaauugauauuauuuaua

SEQ ID NO: 4206410 - RNA, 14 nt, Yersinia pestis KIM
uaauugcaccccac

SEQ ID NO: 4206411 - RNA, 21 nt, Yersinia pestis KIM
uaauugcggucaguuggcuua

SEQ ID NO: 4206412 - RNA, 20 nt, Yersinia pestis KIM
uaauuggcaauaaugucacc

SEQ ID NO: 4206413 - RNA, 15 nt, Yersinia pestis KIM
uaauugguuuauaac

SEQ ID NO: 4206414 - RNA, 14 nt, Yersinia pestis KIM
uaauugguuuuaau

SEQ ID NO: 4206415 - RNA, 16 nt, Yersinia pestis KIM
uaauugguuuuaauaa

SEQ ID NO: 4206416 - RNA, 16 nt, Yersinia pestis KIM
uaauuuaaacucuuua

SEQ ID NO: 4206417 - RNA, 17 nt, Yersinia pestis KIM
uaauuuaaauaagaucc

SEQ ID NO: 4206418 - RNA, 21 nt, Yersinia pestis KIM
uaauuuaaauaagauccagaa

SEQ ID NO: 4206419 - RNA, 14 nt, Yersinia pestis KIM
uaauuuauaaacaa

SEQ ID NO: 4206420 - RNA, 13 nt, Yersinia pestis KIM
uaauuuauacaua

SEQ ID NO: 4206421 - RNA, 18 nt, Yersinia pestis KIM
uaauuuaucaguagucaa

SEQ ID NO: 4206422 - RNA, 18 nt, Yersinia pestis KIM
uaauuucaccacaucuug

SEQ ID NO: 4206423 - RNA, 13 nt, Yersinia pestis KIM
uaauuucacgcug

SEQ ID NO: 4206424 - RNA, 13 nt, Yersinia pestis KIM
uaccaugccauca

SEQ ID NO: 4206425 - RNA, 16 nt, Yersinia pestis KIM
uaccaugcucauguuc

SEQ ID NO: 4206426 - RNA, 20 nt, Yersinia pestis KIM
uaccauuuucagacugaaau

SEQ ID NO: 4206427 - RNA, 22 nt, Yersinia pestis KIM
uaccauuuucagacugaaauga

SEQ ID NO: 4206428 - RNA, 14 nt, Yersinia pestis KIM
uacccaaaccaaca

SEQ ID NO: 4206429 - RNA, 15 nt, Yersinia pestis KIM
uacccaaagucauug

SEQ ID NO: 4206430 - RNA, 17 nt, Yersinia pestis KIM
uacccacauucaggccg

SEQ ID NO: 4206431 - RNA, 21 nt, Yersinia pestis KIM
uacccaccagagaccacagau

SEQ ID NO: 4206432 - RNA, 21 nt, Yersinia pestis KIM
uacccauaacuugagcacaua

SEQ ID NO: 4206433 - RNA, 14 nt, Yersinia pestis KIM
uacccauuauaaau

SEQ ID NO: 4206434 - RNA, 23 nt, Yersinia pestis KIM
uacccuaagaauugguuauccua

SEQ ID NO: 4206435 - RNA, 15 nt, Yersinia pestis KIM
uacccucgacaccaa

SEQ ID NO: 4206436 - RNA, 20 nt, Yersinia pestis KIM
uacccucuauuaucuucuau

SEQ ID NO: 4206437 - RNA, 13 nt, Yersinia pestis KIM
uacccugcaccau

SEQ ID NO: 4206438 - RNA, 17 nt, Yersinia pestis KIM
uacccugcaccauaucc

SEQ ID NO: 4206439 - RNA, 19 nt, Yersinia pestis KIM
uacccuguuuuaaaugcca

SEQ ID NO: 4206440 - RNA, 20 nt, Yersinia pestis KIM
uacccuuaacggucagaucc

SEQ ID NO: 4206441 - RNA, 16 nt, Yersinia pestis KIM
uaccgacaccaauacc

SEQ ID NO: 4206442 - RNA, 19 nt, Yersinia pestis KIM
uaccgacagcaucuagcag

SEQ ID NO: 4206443 - RNA, 17 nt, Yersinia pestis KIM
uaccgaguucucaccaa

SEQ ID NO: 4206444 - RNA, 13 nt, Yersinia pestis KIM
uaccgauuucagg

SEQ ID NO: 4206445 - RNA, 17 nt, Yersinia pestis KIM
uaccgauuucaggucgc

SEQ ID NO: 4206446 - RNA, 12 nt, Yersinia pestis KIM
uaccgcaaccac

SEQ ID NO: 4206447 - RNA, 15 nt, Yersinia pestis KIM
uaccgcaaccaccuu

SEQ ID NO: 4206448 - RNA, 22 nt, Yersinia pestis KIM
uaccgcagaaccuuguuuuacc

SEQ ID NO: 4206449 - RNA, 22 nt, Yersinia pestis KIM
uaccgcauaagacaccacauca

SEQ ID NO: 4206450 - RNA, 18 nt, Yersinia pestis KIM
uaccgccaaucucuccua

SEQ ID NO: 4206451 - RNA, 14 nt, Yersinia pestis KIM
uaccgccagaauaa

SEQ ID NO: 4206452 - RNA, 22 nt, Yersinia pestis KIM
uaccgccccuguuugcgcagca

SEQ ID NO: 4206453 - RNA, 13 nt, Yersinia pestis KIM
uaccgcccguuga

SEQ ID NO: 4206454 - RNA, 19 nt, Yersinia pestis KIM
uaccgccgucaugcugaau

SEQ ID NO: 4206455 - RNA, 15 nt, Yersinia pestis KIM
uaccgcugccggguu

SEQ ID NO: 4206456 - RNA, 21 nt, Yersinia pestis KIM
uaccgcuuaaggcaucaacca

SEQ ID NO: 4206457 - RNA, 13 nt, Yersinia pestis KIM
uaccgcuuuuacc

SEQ ID NO: 4206458 - RNA, 17 nt, Yersinia pestis KIM
uaccgggcgaacagaaa

SEQ ID NO: 4206459 - RNA, 17 nt, Yersinia pestis KIM
uaccggucauauuuauc

SEQ ID NO: 4206460 - RNA, 16 nt, Yersinia pestis KIM
uaccguuuuauuuccc

SEQ ID NO: 4206461 - RNA, 23 nt, Yersinia pestis KIM
uaccuaaccaaacauugucaccu

SEQ ID NO: 4206462 - RNA, 18 nt, Yersinia pestis KIM
uaccuauggcgaagagaa

SEQ ID NO: 4206463 - RNA, 12 nt, Yersinia pestis KIM
uaccuauuuauu

SEQ ID NO: 4206464 - RNA, 20 nt, Yersinia pestis KIM
uaccucacuggcuuuauuau

SEQ ID NO: 4206465 - RNA, 23 nt, Yersinia pestis KIM
uaccuccggugguuucgccgcca

SEQ ID NO: 4206466 - RNA, 19 nt, Yersinia pestis KIM
uaccugacacugcaucucu

SEQ ID NO: 4206467 - RNA, 22 nt, Yersinia pestis KIM
uaccugagaaaaaguggucauu

SEQ ID NO: 4206468 - RNA, 20 nt, Yersinia pestis KIM
uaccugaguagcauaaaaau

SEQ ID NO: 4206469 - RNA, 20 nt, Yersinia pestis KIM
uaccugauuccuaagcaaau

SEQ ID NO: 4206470 - RNA, 20 nt, Yersinia pestis KIM
uaccugcaucaagccgcuua

SEQ ID NO: 4206471 - RNA, 14 nt, Yersinia pestis KIM
uaccugcuaaccga

SEQ ID NO: 4206472 - RNA, 22 nt, Yersinia pestis KIM
uaccuggacgcuggcagccuuu

SEQ ID NO: 4206473 - RNA, 21 nt, Yersinia pestis KIM
uaccugucccguuccaaccgg

SEQ ID NO: 4206474 - RNA, 12 nt, Yersinia pestis KIM
uaccuguucaau

SEQ ID NO: 4206475 - RNA, 13 nt, Yersinia pestis KIM
uaccuuaggcuug

SEQ ID NO: 4206476 - RNA, 18 nt, Yersinia pestis KIM
uaccuucacauuuucucc

SEQ ID NO: 4206477 - RNA, 13 nt, Yersinia pestis KIM
uaccuucccaucc

SEQ ID NO: 4206478 - RNA, 17 nt, Yersinia pestis KIM
uaccuucgguaaucaau

SEQ ID NO: 4206479 - RNA, 15 nt, Yersinia pestis KIM
uaccuugauccgcca

SEQ ID NO: 4206480 - RNA, 23 nt, Yersinia pestis KIM
uaccuuggugagaacucgguauc

SEQ ID NO: 4206481 - RNA, 16 nt, Yersinia pestis KIM
uaccuuguuacucaua

SEQ ID NO: 4206482 - RNA, 18 nt, Yersinia pestis KIM
uaccuuuaaaacugguca

SEQ ID NO: 4206483 - RNA, 19 nt, Yersinia pestis KIM
uaccuuuaaaacuggucag

SEQ ID NO: 4206484 - RNA, 19 nt, Yersinia pestis KIM
uaccuuuaacuguuuuaua

SEQ ID NO: 4206485 - RNA, 23 nt, Yersinia pestis KIM
uaccuuucagguaagcagagaau

SEQ ID NO: 4206486 - RNA, 18 nt, Yersinia pestis KIM
uaccuuuugcauauuucu

SEQ ID NO: 4206487 - RNA, 13 nt, Yersinia pestis KIM
uacgaacaguagc

SEQ ID NO: 4206488 - RNA, 18 nt, Yersinia pestis KIM
uacgaauuuuucccugcu

SEQ ID NO: 4206489 - RNA, 14 nt, Yersinia pestis KIM
uacgaccgucacca

SEQ ID NO: 4206490 - RNA, 13 nt, Yersinia pestis KIM
uacgaucagcaag

SEQ ID NO: 4206491 - RNA, 17 nt, Yersinia pestis KIM
uacgaucgauaguaaca

SEQ ID NO: 4206492 - RNA, 19 nt, Yersinia pestis KIM
uacgaucuuauuaauuggu

SEQ ID NO: 4206493 - RNA, 14 nt, Yersinia pestis KIM
uacgcaaaaucagu

SEQ ID NO: 4206494 - RNA, 13 nt, Yersinia pestis KIM
uacgcaacaagcc

SEQ ID NO: 4206495 - RNA, 13 nt, Yersinia pestis KIM
uacgcaaguaaaa

SEQ ID NO: 4206496 - RNA, 13 nt, Yersinia pestis KIM
uacgcaauaccga

SEQ ID NO: 4206497 - RNA, 23 nt, Yersinia pestis KIM
uacgcaugaucccugguuugcca

SEQ ID NO: 4206498 - RNA, 16 nt, Yersinia pestis KIM
uacgcaugaugcugcc

SEQ ID NO: 4206499 - RNA, 22 nt, Yersinia pestis KIM
uacgcauuacccuguuuuaaau

SEQ ID NO: 4206500 - RNA, 13 nt, Yersinia pestis KIM
uacgccaagaggg

SEQ ID NO: 4206501 - RNA, 15 nt, Yersinia pestis KIM
uacgccaugcagcua

SEQ ID NO: 4206502 - RNA, 14 nt, Yersinia pestis KIM
uacgccauuaaaag

SEQ ID NO: 4206503 - RNA, 16 nt, Yersinia pestis KIM
uacgcccgccccagca

SEQ ID NO: 4206504 - RNA, 16 nt, Yersinia pestis KIM
uacgccuggcuaacgu

SEQ ID NO: 4206505 - RNA, 16 nt, Yersinia pestis KIM
uacgcgccgcagcagu

SEQ ID NO: 4206506 - RNA, 19 nt, Yersinia pestis KIM
uacgcuaugaauaagcauu

SEQ ID NO: 4206507 - RNA, 23 nt, Yersinia pestis KIM
uacgcucgguuguucagcaccag

SEQ ID NO: 4206508 - RNA, 19 nt, Yersinia pestis KIM
uacgcucuccucuccccua

SEQ ID NO: 4206509 - RNA, 22 nt, Yersinia pestis KIM
uacgcuggccaguuucgguacc

SEQ ID NO: 4206510 - RNA, 18 nt, Yersinia pestis KIM
uacgcuuuuuggccgcua

SEQ ID NO: 4206511 - RNA, 15 nt, Yersinia pestis KIM
uacggaaaauagggg

SEQ ID NO: 4206512 - RNA, 22 nt, Yersinia pestis KIM
uacggcagacauuccgucagca

SEQ ID NO: 4206513 - RNA, 15 nt, Yersinia pestis KIM
uacggcauuagugaa

SEQ ID NO: 4206514 - RNA, 15 nt, Yersinia pestis KIM
uacggccagucaaaa

SEQ ID NO: 4206515 - RNA, 16 nt, Yersinia pestis KIM
uacggcgauauuuauu

SEQ ID NO: 4206516 - RNA, 16 nt, Yersinia pestis KIM
uacggguauagcggcg

SEQ ID NO: 4206517 - RNA, 19 nt, Yersinia pestis KIM
uacgggugaacaugcguug

SEQ ID NO: 4206518 - RNA, 13 nt, Yersinia pestis KIM
uacggucaaaagc

SEQ ID NO: 4206519 - RNA, 15 nt, Yersinia pestis KIM
uacgguguuugguga

SEQ ID NO: 4206520 - RNA, 22 nt, Yersinia pestis KIM
uacgguuuugccaauauugccu

SEQ ID NO: 4206521 - RNA, 20 nt, Yersinia pestis KIM
uacguaaacgaguuuccagu

SEQ ID NO: 4206522 - RNA, 17 nt, Yersinia pestis KIM
uacguaaauagguuuua

SEQ ID NO: 4206523 - RNA, 18 nt, Yersinia pestis KIM
uacguaaauuuauuuagu

SEQ ID NO: 4206524 - RNA, 19 nt, Yersinia pestis KIM
uacguaaucccagaaacgg

SEQ ID NO: 4206525 - RNA, 16 nt, Yersinia pestis KIM
uacguauggcaugacu

SEQ ID NO: 4206526 - RNA, 16 nt, Yersinia pestis KIM
uacgucaggaauaaag

SEQ ID NO: 4206527 - RNA, 14 nt, Yersinia pestis KIM
uacguugcagguca

SEQ ID NO: 4206528 - RNA, 11 nt, Yersinia pestis KIM
uacuaaaacag

SEQ ID NO: 4206529 - RNA, 18 nt, Yersinia pestis KIM
uacuaaauuagaaaacaa

SEQ ID NO: 4206530 - RNA, 20 nt, Yersinia pestis KIM
uacuaaauuuagugccaaca

SEQ ID NO: 4206531 - RNA, 17 nt, Yersinia pestis KIM
uacuaacgucaacagaa

SEQ ID NO: 4206532 - RNA, 15 nt, Yersinia pestis KIM
uacuaauuucuaauu

SEQ ID NO: 4206533 - RNA, 16 nt, Yersinia pestis KIM
uacuaccuuuugcaua

SEQ ID NO: 4206534 - RNA, 18 nt, Yersinia pestis KIM
uacuaucuuuauugcucc

SEQ ID NO: 4206535 - RNA, 16 nt, Yersinia pestis KIM
uacuaugggauaaacu

SEQ ID NO: 4206536 - RNA, 19 nt, Yersinia pestis KIM
uacuauguccgcauauucu

SEQ ID NO: 4206537 - RNA, 20 nt, Yersinia pestis KIM
uacuauguccgcauauucuc

SEQ ID NO: 4206538 - RNA, 20 nt, Yersinia pestis KIM
uacuauuuuuuauauugcuc

SEQ ID NO: 4206539 - RNA, 18 nt, Yersinia pestis KIM
uagcaaacccaccugaau

SEQ ID NO: 4206540 - RNA, 22 nt, Yersinia pestis KIM
uagcaaagcgauaucguuauca

SEQ ID NO: 4206541 - RNA, 15 nt, Yersinia pestis KIM
uagcaacacaucggu

SEQ ID NO: 4206542 - RNA, 13 nt, Yersinia pestis KIM
uagcaacugccaa

SEQ ID NO: 4206543 - RNA, 16 nt, Yersinia pestis KIM
uagcaagcacggcagg

SEQ ID NO: 4206544 - RNA, 19 nt, Yersinia pestis KIM
uagcaagccaaaacagccu

SEQ ID NO: 4206545 - RNA, 21 nt, Yersinia pestis KIM
uagcaauaccagccgauaauc

SEQ ID NO: 4206546 - RNA, 15 nt, Yersinia pestis KIM
uagcaauauaauaau

SEQ ID NO: 4206547 - RNA, 23 nt, Yersinia pestis KIM
uagcaaucucugcaguacagaua

SEQ ID NO: 4206548 - RNA, 12 nt, Yersinia pestis KIM
uagcaauuugag

SEQ ID NO: 4206549 - RNA, 13 nt, Yersinia pestis KIM
uagcaauuugagg

SEQ ID NO: 4206550 - RNA, 20 nt, Yersinia pestis KIM
uagcagggcaguaaaaugcc

SEQ ID NO: 4206551 - RNA, 12 nt, Yersinia pestis KIM
uagcagggccgc

SEQ ID NO: 4206552 - RNA, 13 nt, Yersinia pestis KIM
uagcaucauccag

SEQ ID NO: 4206553 - RNA, 20 nt, Yersinia pestis KIM
uagcauugcagauuucuucu

SEQ ID NO: 4206554 - RNA, 21 nt, Yersinia pestis KIM
uagccaaauacccuaauucag

SEQ ID NO: 4206555 - RNA, 20 nt, Yersinia pestis KIM
uagccaacacaugcugcuug

SEQ ID NO: 4206556 - RNA, 14 nt, Yersinia pestis KIM
uagccaauucuaac

SEQ ID NO: 4206557 - RNA, 23 nt, Yersinia pestis KIM
uagccaccaguuuauuuucccuu

SEQ ID NO: 4206558 - RNA, 15 nt, Yersinia pestis KIM
uagccaccucacuca

SEQ ID NO: 4206559 - RNA, 14 nt, Yersinia pestis KIM
uagccacuaacuaa

SEQ ID NO: 4206560 - RNA, 19 nt, Yersinia pestis KIM
uagccagaaauagcaccau

SEQ ID NO: 4206561 - RNA, 16 nt, Yersinia pestis KIM
uagccagccaauggcc

SEQ ID NO: 4206562 - RNA, 19 nt, Yersinia pestis KIM
uagccagccaccgcacacu

SEQ ID NO: 4206563 - RNA, 22 nt, Yersinia pestis KIM
uagccagcgugguguuggcugu

SEQ ID NO: 4206564 - RNA, 12 nt, Yersinia pestis KIM
uagccaugucau

SEQ ID NO: 4206565 - RNA, 14 nt, Yersinia pestis KIM
uagcccaaaauaga

SEQ ID NO: 4206566 - RNA, 17 nt, Yersinia pestis KIM
uagcccaguaccgcugg

SEQ ID NO: 4206567 - RNA, 17 nt, Yersinia pestis KIM
uagccccaaaugccagc

SEQ ID NO: 4206568 - RNA, 19 nt, Yersinia pestis KIM
uagccccaacacuggggcg

SEQ ID NO: 4206569 - RNA, 20 nt, Yersinia pestis KIM
uagcccggcucauccgccaa

SEQ ID NO: 4206570 - RNA, 16 nt, Yersinia pestis KIM
uagcccguugagugaa

SEQ ID NO: 4206571 - RNA, 22 nt, Yersinia pestis KIM
uagcccguugagugaaagccug

SEQ ID NO: 4206572 - RNA, 16 nt, Yersinia pestis KIM
uagcccuaacugcuca

SEQ ID NO: 4206573 - RNA, 13 nt, Yersinia pestis KIM
uagcccuucagca

SEQ ID NO: 4206574 - RNA, 21 nt, Yersinia pestis KIM
uagcccuucccccaaguaaaa

SEQ ID NO: 4206575 - RNA, 18 nt, Yersinia pestis KIM
uagccgaaccccuagcca

SEQ ID NO: 4206576 - RNA, 21 nt, Yersinia pestis KIM
uagccuucguuugucaaugga

SEQ ID NO: 4206577 - RNA, 20 nt, Yersinia pestis KIM
uagccuuuuugcaucaccau

SEQ ID NO: 4206578 - RNA, 10 nt, Yersinia pestis KIM
uagcgauaaa

SEQ ID NO: 4206579 - RNA, 16 nt, Yersinia pestis KIM
uagcgauaaacguuca

SEQ ID NO: 4206580 - RNA, 23 nt, Yersinia pestis KIM
uagcgauaaacguucaacaccac

SEQ ID NO: 4206581 - RNA, 14 nt, Yersinia pestis KIM
uagcgauauccuua

SEQ ID NO: 4206582 - RNA, 14 nt, Yersinia pestis KIM
uagcgaugacugag

SEQ ID NO: 4206583 - RNA, 13 nt, Yersinia pestis KIM
uagcgccuccggc

SEQ ID NO: 4206584 - RNA, 20 nt, Yersinia pestis KIM
uagcgcgcguuuaaucgaua

SEQ ID NO: 4206585 - RNA, 17 nt, Yersinia pestis KIM
uagcgcugcagcaucaa

SEQ ID NO: 4206586 - RNA, 23 nt, Yersinia pestis KIM
uagcgcugcaucuggucaucaug

SEQ ID NO: 4206587 - RNA, 19 nt, Yersinia pestis KIM
uagcgcuucagugauuuua

SEQ ID NO: 4206588 - RNA, 18 nt, Yersinia pestis KIM
uagcggaaggguuuugug

SEQ ID NO: 4206589 - RNA, 21 nt, Yersinia pestis KIM
uagcggauuuauaaggaaaug

SEQ ID NO: 4206590 - RNA, 22 nt, Yersinia pestis KIM
uagcgguaaccgacaucaaccg

SEQ ID NO: 4206591 - RNA, 14 nt, Yersinia pestis KIM
uagcguacaagaca

SEQ ID NO: 4206592 - RNA, 15 nt, Yersinia pestis KIM
uagcguacaagacaa

SEQ ID NO: 4206593 - RNA, 12 nt, Yersinia pestis KIM
uagcgucaagga

SEQ ID NO: 4206594 - RNA, 17 nt, Yersinia pestis KIM
uagcgugauuuuuauau

SEQ ID NO: 4206595 - RNA, 13 nt, Yersinia pestis KIM
uagcgugccgcag

SEQ ID NO: 4206596 - RNA, 22 nt, Yersinia pestis KIM
uagcguucaucgcccuguaacu

SEQ ID NO: 4206597 - RNA, 22 nt, Yersinia pestis KIM
uagcguugccgccgggcagcaa

SEQ ID NO: 4206598 - RNA, 14 nt, Yersinia pestis KIM
uagcguuuggcugc

SEQ ID NO: 4206599 - RNA, 20 nt, Yersinia pestis KIM
uagcguuuuuucguuuacuu

SEQ ID NO: 4206600 - RNA, 14 nt, Yersinia pestis KIM
uagcuaaaugacau

SEQ ID NO: 4206601 - RNA, 22 nt, Yersinia pestis KIM
uagcuaaaugacauauugugcu

SEQ ID NO: 4206602 - RNA, 13 nt, Yersinia pestis KIM
uagcuaaauuuaa

SEQ ID NO: 4206603 - RNA, 17 nt, Yersinia pestis KIM
uagcuaacaccgcugua

SEQ ID NO: 4206604 - RNA, 20 nt, Yersinia pestis KIM
uagcuacagcaccauuaucu

SEQ ID NO: 4206605 - RNA, 12 nt, Yersinia pestis KIM
uagcuacugaug

SEQ ID NO: 4206606 - RNA, 19 nt, Yersinia pestis KIM
uagcuauuggcugauucaa

SEQ ID NO: 4206607 - RNA, 15 nt, Yersinia pestis KIM
uagcucagaaaauaa

SEQ ID NO: 4206608 - RNA, 17 nt, Yersinia pestis KIM
uagcucgccuucauuau

SEQ ID NO: 4206609 - RNA, 21 nt, Yersinia pestis KIM
uagcucgcucaacaugccaga

SEQ ID NO: 4206610 - RNA, 23 nt, Yersinia pestis KIM
uagcucugaggcuuggguaucug

SEQ ID NO: 4206611 - RNA, 16 nt, Yersinia pestis KIM
uagcuuauccagaucc

SEQ ID NO: 4206612 - RNA, 17 nt, Yersinia pestis KIM
uagcuucagcauugauu

SEQ ID NO: 4206613 - RNA, 20 nt, Yersinia pestis KIM
uagcuucagcauugauuuca

SEQ ID NO: 4206614 - RNA, 17 nt, Yersinia pestis KIM
uagcuuucuccuuugau

SEQ ID NO: 4206615 - RNA, 13 nt, Yersinia pestis KIM
uagcuuuuuaaau

SEQ ID NO: 4206616 - RNA, 14 nt, Yersinia pestis KIM
uagcuuuuuaaaua

SEQ ID NO: 4206617 - RNA, 23 nt, Yersinia pestis KIM
uaggaggguguuuuuuugucuuu

SEQ ID NO: 4206618 - RNA, 23 nt, Yersinia pestis KIM
uaggaucgaaugaucagaggcug

SEQ ID NO: 4206619 - RNA, 16 nt, Yersinia pestis KIM
uaggauguuauggauu

SEQ ID NO: 4206620 - RNA, 16 nt, Yersinia pestis KIM
uaggauuuauuucucu

SEQ ID NO: 4206621 - RNA, 14 nt, Yersinia pestis KIM
uaggcaacuaagcu

SEQ ID NO: 4206622 - RNA, 16 nt, Yersinia pestis KIM
uaggcaauccaaacau

SEQ ID NO: 4206623 - RNA, 20 nt, Yersinia pestis KIM
uaggcaggcccgcuucccua

SEQ ID NO: 4206624 - RNA, 16 nt, Yersinia pestis KIM
uaggcauaaauaauaa

SEQ ID NO: 4206625 - RNA, 13 nt, Yersinia pestis KIM
uaggcaucucuga

SEQ ID NO: 4206626 - RNA, 13 nt, Yersinia pestis KIM
uaggcaucugcca

SEQ ID NO: 4206627 - RNA, 14 nt, Yersinia pestis KIM
uaggccacuuaaca

SEQ ID NO: 4206628 - RNA, 17 nt, Yersinia pestis KIM
uaggccggggagccaag

SEQ ID NO: 4206629 - RNA, 23 nt, Yersinia pestis KIM
uaggcgaauuggcaaguuaauca

SEQ ID NO: 4206630 - RNA, 23 nt, Yersinia pestis KIM
uaggcgcugaggauucuguuacc

SEQ ID NO: 4206631 - RNA, 20 nt, Yersinia pestis KIM
uaggcgcugucggcgcagca

SEQ ID NO: 4206632 - RNA, 16 nt, Yersinia pestis KIM
uaggcgggugaaauau

SEQ ID NO: 4206633 - RNA, 14 nt, Yersinia pestis KIM
uaggcuacagcuac

SEQ ID NO: 4206634 - RNA, 17 nt, Yersinia pestis KIM
uaggcuauugacaaagu

SEQ ID NO: 4206635 - RNA, 22 nt, Yersinia pestis KIM
uaggcuauugacaaaguaccua

SEQ ID NO: 4206636 - RNA, 16 nt, Yersinia pestis KIM
uaggcuugagguuauu

SEQ ID NO: 4206637 - RNA, 14 nt, Yersinia pestis KIM
uaggcuuuuuacuu

SEQ ID NO: 4206638 - RNA, 16 nt, Yersinia pestis KIM
uagggaacgccagcgg

SEQ ID NO: 4206639 - RNA, 15 nt, Yersinia pestis KIM
uagggagauuucaaa

SEQ ID NO: 4206640 - RNA, 13 nt, Yersinia pestis KIM
uagggagccaaua

SEQ ID NO: 4206641 - RNA, 22 nt, Yersinia pestis KIM
uagggagccaauagaggcuccc

SEQ ID NO: 4206642 - RNA, 13 nt, Yersinia pestis KIM
uagggauauuucu

SEQ ID NO: 4206643 - RNA, 14 nt, Yersinia pestis KIM
uagggaugaguguu

SEQ ID NO: 4206644 - RNA, 20 nt, Yersinia pestis KIM
uagggauuuaugcaaauaau

SEQ ID NO: 4206645 - RNA, 18 nt, Yersinia pestis KIM
uagggauuuuaagcagcc

SEQ ID NO: 4206646 - RNA, 18 nt, Yersinia pestis KIM
uagggccguuuaccuugu

SEQ ID NO: 4206647 - RNA, 13 nt, Yersinia pestis KIM
uagggcuggcaag

SEQ ID NO: 4206648 - RNA, 18 nt, Yersinia pestis KIM
uagggcuggcaagcagac

SEQ ID NO: 4206649 - RNA, 16 nt, Yersinia pestis KIM
uagggucauacccaaa

SEQ ID NO: 4206650 - RNA, 14 nt, Yersinia pestis KIM
uagguaacuaagcu

SEQ ID NO: 4206651 - RNA, 17 nt, Yersinia pestis KIM
uagguaacuaagcugcc

SEQ ID NO: 4206652 - RNA, 16 nt, Yersinia pestis KIM
uaggucagugguuuua

SEQ ID NO: 4206653 - RNA, 20 nt, Yersinia pestis KIM
uaggucagugguuuuauaaa

SEQ ID NO: 4206654 - RNA, 14 nt, Yersinia pestis KIM
uauacugccaccgg

SEQ ID NO: 4206655 - RNA, 21 nt, Yersinia pestis KIM
uauacuguuuauuaauggaua

SEQ ID NO: 4206656 - RNA, 23 nt, Yersinia pestis KIM
uauagacucaucuaauuuucuca

SEQ ID NO: 4206657 - RNA, 22 nt, Yersinia pestis KIM
uauagcagggccgguuaauuga

SEQ ID NO: 4206658 - RNA, 22 nt, Yersinia pestis KIM
uauagcgugcuacauagaaaau

SEQ ID NO: 4206659 - RNA, 14 nt, Yersinia pestis KIM
uauaguaucacugc

SEQ ID NO: 4206660 - RNA, 13 nt, Yersinia pestis KIM
uauaguuaaaacu

SEQ ID NO: 4206661 - RNA, 14 nt, Yersinia pestis KIM
uauaguuaaacuga

SEQ ID NO: 4206662 - RNA, 21 nt, Yersinia pestis KIM
uauaguuuauuuuauuuaauc

SEQ ID NO: 4206663 - RNA, 23 nt, Yersinia pestis KIM
uauauaagagaugaaauuuuauu

SEQ ID NO: 4206664 - RNA, 23 nt, Yersinia pestis KIM
uauauaauugaagauuuaaauaa

SEQ ID NO: 4206665 - RNA, 13 nt, Yersinia pestis KIM
uauauacagucaa

SEQ ID NO: 4206666 - RNA, 20 nt, Yersinia pestis KIM
uauauacagucaauugagaa

SEQ ID NO: 4206667 - RNA, 16 nt, Yersinia pestis KIM
uauauagagaaaucua

SEQ ID NO: 4206668 - RNA, 18 nt, Yersinia pestis KIM
uauauagagaaaucuaca

SEQ ID NO: 4206669 - RNA, 18 nt, Yersinia pestis KIM
uauauagcccagcguucu

SEQ ID NO: 4206670 - RNA, 17 nt, Yersinia pestis KIM
uauauauccaaaauaau

SEQ ID NO: 4206671 - RNA, 18 nt, Yersinia pestis KIM
uauauauuuugaauauuu

SEQ ID NO: 4206672 - RNA, 18 nt, Yersinia pestis KIM
uauaucaaggcggcagag

SEQ ID NO: 4206673 - RNA, 24 nt, Yersinia pestis KIM
uauaucaaggcggcagagccaauc

SEQ ID NO: 4206674 - RNA, 17 nt, Yersinia pestis KIM
uauaucacuauuucagg

SEQ ID NO: 4206675 - RNA, 15 nt, Yersinia pestis KIM
uauaucacuucugcu

SEQ ID NO: 4206676 - RNA, 14 nt, Yersinia pestis KIM
uauauccaaaauaa

SEQ ID NO: 4206677 - RNA, 20 nt, Yersinia pestis KIM
uauaucgaucugauaucucu

SEQ ID NO: 4206678 - RNA, 17 nt, Yersinia pestis KIM
uauaucguguuuaguug

SEQ ID NO: 4206679 - RNA, 13 nt, Yersinia pestis KIM
uauaucucuucuu

SEQ ID NO: 4206680 - RNA, 14 nt, Yersinia pestis KIM
uauaugauaauagu

SEQ ID NO: 4206681 - RNA, 20 nt, Yersinia pestis KIM
uauaugcgcuggcucuauuu

SEQ ID NO: 4206682 - RNA, 15 nt, Yersinia pestis KIM
uauaugcuguauaaa

SEQ ID NO: 4206683 - RNA, 16 nt, Yersinia pestis KIM
uauauggauuggcauu

SEQ ID NO: 4206684 - RNA, 23 nt, Yersinia pestis KIM
uauauggauuggcauuuaaaagg

SEQ ID NO: 4206685 - RNA, 17 nt, Yersinia pestis KIM
uauauuaguuaacccua

SEQ ID NO: 4206686 - RNA, 17 nt, Yersinia pestis KIM
uauauucauauuucacu

SEQ ID NO: 4206687 - RNA, 17 nt, Yersinia pestis KIM
uauauucuacaauguca

SEQ ID NO: 4206688 - RNA, 23 nt, Yersinia pestis KIM
uauauucuacaaugucacgcuuu

SEQ ID NO: 4206689 - RNA, 23 nt, Yersinia pestis KIM
uauauucuauugaggacaauuca

SEQ ID NO: 4206690 - RNA, 16 nt, Yersinia pestis KIM
uauauucuggcaccug

SEQ ID NO: 4206691 - RNA, 14 nt, Yersinia pestis KIM
uauauugauaaaag

SEQ ID NO: 4206692 - RNA, 17 nt, Yersinia pestis KIM
uauauugcauuuaugau

SEQ ID NO: 4206693 - RNA, 17 nt, Yersinia pestis KIM
uauauuggccugcacau

SEQ ID NO: 4206694 - RNA, 13 nt, Yersinia pestis KIM
uauauuuaauuga

SEQ ID NO: 4206695 - RNA, 11 nt, Yersinia pestis KIM
uauauuuacug

SEQ ID NO: 4206696 - RNA, 14 nt, Yersinia pestis KIM
uauauuuauggaua

SEQ ID NO: 4206697 - RNA, 18 nt, Yersinia pestis KIM
uauauuuuacuuccugcc

SEQ ID NO: 4206698 - RNA, 13 nt, Yersinia pestis KIM
uauauuuuucuuu

SEQ ID NO: 4206699 - RNA, 16 nt, Yersinia pestis KIM
uaucaaaacgccagau

SEQ ID NO: 4206700 - RNA, 19 nt, Yersinia pestis KIM
uaucaaaacugauuaauag

SEQ ID NO: 4206701 - RNA, 23 nt, Yersinia pestis KIM
uaucaaacagcacaucgccauua

SEQ ID NO: 4206702 - RNA, 17 nt, Yersinia pestis KIM
uaucaaagaauuccggc

SEQ ID NO: 4206703 - RNA, 12 nt, Yersinia pestis KIM
uaucaacagaac

SEQ ID NO: 4206704 - RNA, 21 nt, Yersinia pestis KIM
uaucaacgcccagcuuuagca

SEQ ID NO: 4206705 - RNA, 19 nt, Yersinia pestis KIM
uaucaacguagcugaauug

SEQ ID NO: 4206706 - RNA, 16 nt, Yersinia pestis KIM
uaucaaguuaaauacu

SEQ ID NO: 4206707 - RNA, 18 nt, Yersinia pestis KIM
uaucaauacugcaaaugg

SEQ ID NO: 4206708 - RNA, 20 nt, Yersinia pestis KIM
uaucaauaggauuuucauga

SEQ ID NO: 4206709 - RNA, 12 nt, Yersinia pestis KIM
uaucaauagguc

SEQ ID NO: 4206710 - RNA, 13 nt, Yersinia pestis KIM
uaucaauagguca

SEQ ID NO: 4206711 - RNA, 15 nt, Yersinia pestis KIM
uaucaauaggucagu

SEQ ID NO: 4206712 - RNA, 15 nt, Yersinia pestis KIM
uaucaaucaaaaaau

SEQ ID NO: 4206713 - RNA, 16 nt, Yersinia pestis KIM
uaucaaucaaaaaaua

SEQ ID NO: 4206714 - RNA, 17 nt, Yersinia pestis KIM
uaucaaucaaaaaauaa

SEQ ID NO: 4206715 - RNA, 21 nt, Yersinia pestis KIM
uaucaaucagcugauaugaaa

SEQ ID NO: 4206716 - RNA, 14 nt, Yersinia pestis KIM
uaucaaugagucuc

SEQ ID NO: 4206717 - RNA, 22 nt, Yersinia pestis KIM
uaucaauugcuggcuaucaucc

SEQ ID NO: 4206718 - RNA, 19 nt, Yersinia pestis KIM
uaucaauuguuugcuauca

SEQ ID NO: 4206719 - RNA, 14 nt, Yersinia pestis KIM
uaucacaucgcccu

SEQ ID NO: 4206720 - RNA, 12 nt, Yersinia pestis KIM
uaucaccagguu

SEQ ID NO: 4206721 - RNA, 22 nt, Yersinia pestis KIM
uaucacccgccaucgccccaaa

SEQ ID NO: 4206722 - RNA, 16 nt, Yersinia pestis KIM
uaucacgauaaucaau

SEQ ID NO: 4206723 - RNA, 15 nt, Yersinia pestis KIM
uaucacggccaaaaa

SEQ ID NO: 4206724 - RNA, 16 nt, Yersinia pestis KIM
uaucacggccaaaaau

SEQ ID NO: 4206725 - RNA, 19 nt, Yersinia pestis KIM
uaucacuauaauuauuucu

SEQ ID NO: 4206726 - RNA, 15 nt, Yersinia pestis KIM
uaucacuauuucaga

SEQ ID NO: 4206727 - RNA, 15 nt, Yersinia pestis KIM
uaucacuauuucagg

SEQ ID NO: 4206728 - RNA, 20 nt, Yersinia pestis KIM
uaucacucuguacguaaaua

SEQ ID NO: 4206729 - RNA, 17 nt, Yersinia pestis KIM
uaucacugagaaccgau

SEQ ID NO: 4206730 - RNA, 21 nt, Yersinia pestis KIM
uaucacuggaggcguuuuuau

SEQ ID NO: 4206731 - RNA, 22 nt, Yersinia pestis KIM
uaucacuguccaagaagccaag

SEQ ID NO: 4206732 - RNA, 16 nt, Yersinia pestis KIM
uaucacuugggcauga

SEQ ID NO: 4206733 - RNA, 18 nt, Yersinia pestis KIM
uaucagccccuaaauccu

SEQ ID NO: 4206734 - RNA, 15 nt, Yersinia pestis KIM
uaucagcgaaaaauu

SEQ ID NO: 4206735 - RNA, 20 nt, Yersinia pestis KIM
uaucagcgaccaaauggacg

SEQ ID NO: 4206736 - RNA, 16 nt, Yersinia pestis KIM
uaucagcgauuuuaaa

SEQ ID NO: 4206737 - RNA, 19 nt, Yersinia pestis KIM
uaucagcgauuuuaaaaaa

SEQ ID NO: 4206738 - RNA, 20 nt, Yersinia pestis KIM
uaucagcgcacccacuuccu

SEQ ID NO: 4206739 - RNA, 20 nt, Yersinia pestis KIM
uaucaggcuaauacaugcug

SEQ ID NO: 4206740 - RNA, 20 nt, Yersinia pestis KIM
uaucaguagcuagaauaagu

SEQ ID NO: 4206741 - RNA, 15 nt, Yersinia pestis KIM
uaucagucuuuucaa

SEQ ID NO: 4206742 - RNA, 19 nt, Yersinia pestis KIM
uaucaguguauuuaucaaa

SEQ ID NO: 4206743 - RNA, 15 nt, Yersinia pestis KIM
uaucauaauccaacu

SEQ ID NO: 4206744 - RNA, 14 nt, Yersinia pestis KIM
uaucauauuaacau

SEQ ID NO: 4206745 - RNA, 21 nt, Yersinia pestis KIM
uaucaucaccaagcuuaauau

SEQ ID NO: 4206746 - RNA, 12 nt, Yersinia pestis KIM
uaucaucaccac

SEQ ID NO: 4206747 - RNA, 12 nt, Yersinia pestis KIM
uaucaucaccau

SEQ ID NO: 4206748 - RNA, 17 nt, Yersinia pestis KIM
uaucauccccggcaaca

SEQ ID NO: 4206749 - RNA, 15 nt, Yersinia pestis KIM
uaucaucccuuaacc

SEQ ID NO: 4206750 - RNA, 17 nt, Yersinia pestis KIM
uaucaucuuuuucugcc

SEQ ID NO: 4206751 - RNA, 19 nt, Yersinia pestis KIM
uaucaucuuuuucugccug

SEQ ID NO: 4206752 - RNA, 22 nt, Yersinia pestis KIM
uaucauggccauggaaaccggc

SEQ ID NO: 4206753 - RNA, 16 nt, Yersinia pestis KIM
uaucauucaagaaaau

SEQ ID NO: 4206754 - RNA, 20 nt, Yersinia pestis KIM
uaucauuuaaauacagauca

SEQ ID NO: 4206755 - RNA, 23 nt, Yersinia pestis KIM
uaucauuuuccugcauauuauuu

SEQ ID NO: 4206756 - RNA, 13 nt, Yersinia pestis KIM
uauccaaaauaau

SEQ ID NO: 4206757 - RNA, 13 nt, Yersinia pestis KIM
uauccaacuucuu

SEQ ID NO: 4206758 - RNA, 21 nt, Yersinia pestis KIM
uauccaauaagcguauuuugu

SEQ ID NO: 4206759 - RNA, 15 nt, Yersinia pestis KIM
uauccaauccuuugg

SEQ ID NO: 4206760 - RNA, 15 nt, Yersinia pestis KIM
uauccaccugaucau

SEQ ID NO: 4206761 - RNA, 22 nt, Yersinia pestis KIM
uauccaccugaucaugccacga

SEQ ID NO: 4206762 - RNA, 14 nt, Yersinia pestis KIM
uauccacuuggcua

SEQ ID NO: 4206763 - RNA, 15 nt, Yersinia pestis KIM
uauccagcgccauca

SEQ ID NO: 4206764 - RNA, 14 nt, Yersinia pestis KIM
uauccaggcacugc

SEQ ID NO: 4206765 - RNA, 23 nt, Yersinia pestis KIM
uauccauauuaaaugcauuauaa

SEQ ID NO: 4206766 - RNA, 17 nt, Yersinia pestis KIM
uauccauccccgccuca

SEQ ID NO: 4206767 - RNA, 22 nt, Yersinia pestis KIM
uauccccuaucgaacuauugau

SEQ ID NO: 4206768 - RNA, 22 nt, Yersinia pestis KIM
uaucccguaacuuccggcugcg

SEQ ID NO: 4206769 - RNA, 21 nt, Yersinia pestis KIM
uauuaaacagauucaauauuu

SEQ ID NO: 4206770 - RNA, 18 nt, Yersinia pestis KIM
uauuaaacuugcucuuuc

SEQ ID NO: 4206771 - RNA, 11 nt, Yersinia pestis KIM
uauuaaauaag

SEQ ID NO: 4206772 - RNA, 18 nt, Yersinia pestis KIM
uauuaaaugcauuauaag

SEQ ID NO: 4206773 - RNA, 14 nt, Yersinia pestis KIM
uauuaacauaucaa

SEQ ID NO: 4206774 - RNA, 13 nt, Yersinia pestis KIM
uauuaacugcagu

SEQ ID NO: 4206775 - RNA, 16 nt, Yersinia pestis KIM
uauuaacugcagugaa

SEQ ID NO: 4206776 - RNA, 22 nt, Yersinia pestis KIM
uauuaauaucgagguucgacua

SEQ ID NO: 4206777 - RNA, 17 nt, Yersinia pestis KIM
uauuaaucaacagauau

SEQ ID NO: 4206778 - RNA, 19 nt, Yersinia pestis KIM
uauuacaccuuaaaacagc

SEQ ID NO: 4206779 - RNA, 18 nt, Yersinia pestis KIM
uauuaccugcuauuuuau

SEQ ID NO: 4206780 - RNA, 13 nt, Yersinia pestis KIM
uauuacggcccca

SEQ ID NO: 4206781 - RNA, 21 nt, Yersinia pestis KIM
uauuacucagcacauuuuuau

SEQ ID NO: 4206782 - RNA, 15 nt, Yersinia pestis KIM
uauuacugucacugu

SEQ ID NO: 4206783 - RNA, 16 nt, Yersinia pestis KIM
uauuacugucauugcu

SEQ ID NO: 4206784 - RNA, 13 nt, Yersinia pestis KIM
uauuacuuaugau

SEQ ID NO: 4206785 - RNA, 13 nt, Yersinia pestis KIM
uauuacuucuuuu

SEQ ID NO: 4206786 - RNA, 13 nt, Yersinia pestis KIM
uauuacuugauau

SEQ ID NO: 4206787 - RNA, 14 nt, Yersinia pestis KIM
uauuagccaaauac

SEQ ID NO: 4206788 - RNA, 22 nt, Yersinia pestis KIM
uauuagcgauagccugaugaga

SEQ ID NO: 4206789 - RNA, 13 nt, Yersinia pestis KIM
uauuaggccgcga

SEQ ID NO: 4206790 - RNA, 14 nt, Yersinia pestis KIM
uauuaggcuuuguu

SEQ ID NO: 4206791 - RNA, 16 nt, Yersinia pestis KIM
uauuagggcugacaga

SEQ ID NO: 4206792 - RNA, 20 nt, Yersinia pestis KIM
uauuaggugcuuguucuguu

SEQ ID NO: 4206793 - RNA, 16 nt, Yersinia pestis KIM
uauuagugacagccac

SEQ ID NO: 4206794 - RNA, 16 nt, Yersinia pestis KIM
uauuauaaaauucgcu

SEQ ID NO: 4206795 - RNA, 19 nt, Yersinia pestis KIM
uauuauaaugaaauaguaa

SEQ ID NO: 4206796 - RNA, 13 nt, Yersinia pestis KIM
uauuaucauucaa

SEQ ID NO: 4206797 - RNA, 19 nt, Yersinia pestis KIM
uauuaucccaguuuuuaau

SEQ ID NO: 4206798 - RNA, 15 nt, Yersinia pestis KIM
uauuaucuuuuaaaa

SEQ ID NO: 4206799 - RNA, 16 nt, Yersinia pestis KIM
uauuauguaaauaguu

SEQ ID NO: 4206800 - RNA, 13 nt, Yersinia pestis KIM
uauuauuacuaga

SEQ ID NO: 4206801 - RNA, 14 nt, Yersinia pestis KIM
uauuauuauuuaua

SEQ ID NO: 4206802 - RNA, 16 nt, Yersinia pestis KIM
uauucaaaaucugaua

SEQ ID NO: 4206803 - RNA, 17 nt, Yersinia pestis KIM
uauucaaagaauaacug

SEQ ID NO: 4206804 - RNA, 20 nt, Yersinia pestis KIM
uauucaacauuuaagugcua

SEQ ID NO: 4206805 - RNA, 18 nt, Yersinia pestis KIM
uauucaaccgccagugcc

SEQ ID NO: 4206806 - RNA, 16 nt, Yersinia pestis KIM
uauucaacgccaauac

SEQ ID NO: 4206807 - RNA, 20 nt, Yersinia pestis KIM
uauucaacgccaauaccggu

SEQ ID NO: 4206808 - RNA, 13 nt, Yersinia pestis KIM
uauucaagagauu

SEQ ID NO: 4206809 - RNA, 16 nt, Yersinia pestis KIM
uauucaauacuggcca

SEQ ID NO: 4206810 - RNA, 13 nt, Yersinia pestis KIM
uauucaauaucac

SEQ ID NO: 4206811 - RNA, 18 nt, Yersinia pestis KIM
uauucaaugacuccugaa

SEQ ID NO: 4206812 - RNA, 16 nt, Yersinia pestis KIM
uauucacguuuuucca

SEQ ID NO: 4206813 - RNA, 17 nt, Yersinia pestis KIM
uauucacguuuuuccau

SEQ ID NO: 4206814 - RNA, 18 nt, Yersinia pestis KIM
uauucacuauuuauuaau

SEQ ID NO: 4206815 - RNA, 20 nt, Yersinia pestis KIM
uauucagacgguugcuagag

SEQ ID NO: 4206816 - RNA, 16 nt, Yersinia pestis KIM
uauucagcaacucggu

SEQ ID NO: 4206817 - RNA, 11 nt, Yersinia pestis KIM
uauucagcaag

SEQ ID NO: 4206818 - RNA, 12 nt, Yersinia pestis KIM
uauucagcaagc

SEQ ID NO: 4206819 - RNA, 16 nt, Yersinia pestis KIM
uauucaguaacaacau

SEQ ID NO: 4206820 - RNA, 17 nt, Yersinia pestis KIM
uauucauagguagaaua

SEQ ID NO: 4206821 - RNA, 20 nt, Yersinia pestis KIM
uauucauaucgcuaaaacac

SEQ ID NO: 4206822 - RNA, 17 nt, Yersinia pestis KIM
uauucauaucgcucauc

SEQ ID NO: 4206823 - RNA, 13 nt, Yersinia pestis KIM
uauucauauugaa

SEQ ID NO: 4206824 - RNA, 16 nt, Yersinia pestis KIM
uauucaugguuucaaa

SEQ ID NO: 4206825 - RNA, 13 nt, Yersinia pestis KIM
uauucauuaaaaa

SEQ ID NO: 4206826 - RNA, 21 nt, Yersinia pestis KIM
uauucauuaaaaaauaauuuu

SEQ ID NO: 4206827 - RNA, 12 nt, Yersinia pestis KIM
uauucauucuua

SEQ ID NO: 4206828 - RNA, 18 nt, Yersinia pestis KIM
uauuccauagccaggcag

SEQ ID NO: 4206829 - RNA, 18 nt, Yersinia pestis KIM
uauuccccaccauugcaa

SEQ ID NO: 4206830 - RNA, 17 nt, Yersinia pestis KIM
uauuccgcaccuuuguc

SEQ ID NO: 4206831 - RNA, 14 nt, Yersinia pestis KIM
uauuccucugccua

SEQ ID NO: 4206832 - RNA, 15 nt, Yersinia pestis KIM
uauuccuuucguuca

SEQ ID NO: 4206833 - RNA, 21 nt, Yersinia pestis KIM
uauucgccagauugccaauca

SEQ ID NO: 4206834 - RNA, 15 nt, Yersinia pestis KIM
uauucgcgcuuuaac

SEQ ID NO: 4206835 - RNA, 17 nt, Yersinia pestis KIM
uauucgcggccugcugu

SEQ ID NO: 4206836 - RNA, 23 nt, Yersinia pestis KIM
uauucgggcaacuaauucuuagg

SEQ ID NO: 4206837 - RNA, 22 nt, Yersinia pestis KIM
uauucuaauugauauuauuuau

SEQ ID NO: 4206838 - RNA, 18 nt, Yersinia pestis KIM
uauucuacaaugucacgc

SEQ ID NO: 4206839 - RNA, 15 nt, Yersinia pestis KIM
uauucugauaccugc

SEQ ID NO: 4206840 - RNA, 16 nt, Yersinia pestis KIM
uauucugcuuuuugcu

SEQ ID NO: 4206841 - RNA, 14 nt, Yersinia pestis KIM
uauucuggcggcuu

SEQ ID NO: 4206842 - RNA, 18 nt, Yersinia pestis KIM
uauucuggcggcuuuaau

SEQ ID NO: 4206843 - RNA, 16 nt, Yersinia pestis KIM
uauucuuaucaaucaa

SEQ ID NO: 4206844 - RNA, 15 nt, Yersinia pestis KIM
uauugaacgcuugca

SEQ ID NO: 4206845 - RNA, 19 nt, Yersinia pestis KIM
uauugaacgcuugcaacaa

SEQ ID NO: 4206846 - RNA, 16 nt, Yersinia pestis KIM
uauugaauuaaauuuu

SEQ ID NO: 4206847 - RNA, 20 nt, Yersinia pestis KIM
uauugaauuaaauuuuauau

SEQ ID NO: 4206848 - RNA, 15 nt, Yersinia pestis KIM
uauugacaggaucag

SEQ ID NO: 4206849 - RNA, 15 nt, Yersinia pestis KIM
uauugaccaauauaa

SEQ ID NO: 4206850 - RNA, 15 nt, Yersinia pestis KIM
uauugagaagaaauc

SEQ ID NO: 4206851 - RNA, 22 nt, Yersinia pestis KIM
uauugagcauauucaguaacaa

SEQ ID NO: 4206852 - RNA, 22 nt, Yersinia pestis KIM
uauugagcguuauaacaaccuc

SEQ ID NO: 4206853 - RNA, 12 nt, Yersinia pestis KIM
uauugauaaaac

SEQ ID NO: 4206854 - RNA, 15 nt, Yersinia pestis KIM
uauugauaaaaccac

SEQ ID NO: 4206855 - RNA, 20 nt, Yersinia pestis KIM
uauugauaaaaccgcuuauc

SEQ ID NO: 4206856 - RNA, 14 nt, Yersinia pestis KIM
uauugauagccaca

SEQ ID NO: 4206857 - RNA, 20 nt, Yersinia pestis KIM
uauugauauagcgguaaccg

SEQ ID NO: 4206858 - RNA, 17 nt, Yersinia pestis KIM
uauugauccaaauggcu

SEQ ID NO: 4206859 - RNA, 16 nt, Yersinia pestis KIM
uauugauccaccguuu

SEQ ID NO: 4206860 - RNA, 16 nt, Yersinia pestis KIM
uauugaucuuuaauau

SEQ ID NO: 4206861 - RNA, 18 nt, Yersinia pestis KIM
uauugauggauuuacguu

SEQ ID NO: 4206862 - RNA, 23 nt, Yersinia pestis KIM
uauugauguuaacucagccacaa

SEQ ID NO: 4206863 - RNA, 22 nt, Yersinia pestis KIM
uauugauuaagcggcaauaaca

SEQ ID NO: 4206864 - RNA, 14 nt, Yersinia pestis KIM
uauugcaacgcuug

SEQ ID NO: 4206865 - RNA, 17 nt, Yersinia pestis KIM
uauugcaaggucaacga

SEQ ID NO: 4206866 - RNA, 16 nt, Yersinia pestis KIM
uauugcaucuuuaauu

SEQ ID NO: 4206867 - RNA, 22 nt, Yersinia pestis KIM
uauugccgcaguccaaaaaacu

SEQ ID NO: 4206868 - RNA, 16 nt, Yersinia pestis KIM
uauugcucagggccac

SEQ ID NO: 4206869 - RNA, 13 nt, Yersinia pestis KIM
uauugcuccagag

SEQ ID NO: 4206870 - RNA, 16 nt, Yersinia pestis KIM
uauugcucugccgcag

SEQ ID NO: 4206871 - RNA, 12 nt, Yersinia pestis KIM
uauugcuuuuau

SEQ ID NO: 4206872 - RNA, 22 nt, Yersinia pestis KIM
uauuggaaaaaucaguauuaua

SEQ ID NO: 4206873 - RNA, 19 nt, Yersinia pestis KIM
uauuggagcugaaaauagu

SEQ ID NO: 4206874 - RNA, 17 nt, Yersinia pestis KIM
uauuggccgucagcaga

SEQ ID NO: 4206875 - RNA, 15 nt, Yersinia pestis KIM
uauugggcugccugu

SEQ ID NO: 4206876 - RNA, 16 nt, Yersinia pestis KIM
uauugggcugccugug

SEQ ID NO: 4206877 - RNA, 18 nt, Yersinia pestis KIM
uauugggcugccugugcg

SEQ ID NO: 4206878 - RNA, 15 nt, Yersinia pestis KIM
uauuggguuauuaac

SEQ ID NO: 4206879 - RNA, 17 nt, Yersinia pestis KIM
uauuggucaauaaaauu

SEQ ID NO: 4206880 - RNA, 18 nt, Yersinia pestis KIM
uauuggucguaccaaugg

SEQ ID NO: 4206881 - RNA, 15 nt, Yersinia pestis KIM
uauugguuauugauu

SEQ ID NO: 4206882 - RNA, 17 nt, Yersinia pestis KIM
uauuguaaggucaacga

SEQ ID NO: 4206883 - RNA, 19 nt, Yersinia pestis KIM
uauugucuuuaauaaaauc

SEQ ID NO: 4206884 - RNA, 19 nt, Yersinia pestis KIM
uauugugcuccugaugacu

SEQ ID NO: 4206885 - RNA, 16 nt, Yersinia pestis KIM
ucaaccugaucaucaa

SEQ ID NO: 4206886 - RNA, 23 nt, Yersinia pestis KIM
ucaaccuggcaccggacaaacca

SEQ ID NO: 4206887 - RNA, 15 nt, Yersinia pestis KIM
ucaacgacagcagca

SEQ ID NO: 4206888 - RNA, 14 nt, Yersinia pestis KIM
ucaacgacggauga

SEQ ID NO: 4206889 - RNA, 20 nt, Yersinia pestis KIM
ucaacgcaccauccagcaaa

SEQ ID NO: 4206890 - RNA, 19 nt, Yersinia pestis KIM
ucaacgcaccccacaaccu

SEQ ID NO: 4206891 - RNA, 19 nt, Yersinia pestis KIM
ucaacgcccagcuuuagca

SEQ ID NO: 4206892 - RNA, 21 nt, Yersinia pestis KIM
ucaacgcccgcggccaauagc

SEQ ID NO: 4206893 - RNA, 22 nt, Yersinia pestis KIM
ucaacgcuccgguuuucacccc

SEQ ID NO: 4206894 - RNA, 14 nt, Yersinia pestis KIM
ucaacggcaccaca

SEQ ID NO: 4206895 - RNA, 21 nt, Yersinia pestis KIM
ucaacuauugcaucuuuaauu

SEQ ID NO: 4206896 - RNA, 17 nt, Yersinia pestis KIM
ucaacuucacuuugacu

SEQ ID NO: 4206897 - RNA, 14 nt, Yersinia pestis KIM
ucaacuuccgcguu

SEQ ID NO: 4206898 - RNA, 14 nt, Yersinia pestis KIM
ucaacuucugcaaa

SEQ ID NO: 4206899 - RNA, 16 nt, Yersinia pestis KIM
ucaacuugccugaaau

SEQ ID NO: 4206900 - RNA, 16 nt, Yersinia pestis KIM
ucaacuuuaauaugca

SEQ ID NO: 4206901 - RNA, 16 nt, Yersinia pestis KIM
ucaacuuucucuggca

SEQ ID NO: 4206902 - RNA, 19 nt, Yersinia pestis KIM
ucaagaauugugccccaag

SEQ ID NO: 4206903 - RNA, 15 nt, Yersinia pestis KIM
ucaagacaacaaaca

SEQ ID NO: 4206904 - RNA, 22 nt, Yersinia pestis KIM
ucaagaccgauuuguaagcgga

SEQ ID NO: 4206905 - RNA, 22 nt, Yersinia pestis KIM
ucaagagggcgguuaaauacag

SEQ ID NO: 4206906 - RNA, 16 nt, Yersinia pestis KIM
ucaagaucaaaagcag

SEQ ID NO: 4206907 - RNA, 18 nt, Yersinia pestis KIM
ucaagaucaaaagcagag

SEQ ID NO: 4206908 - RNA, 13 nt, Yersinia pestis KIM
ucaagaugcaggg

SEQ ID NO: 4206909 - RNA, 12 nt, Yersinia pestis KIM
ucaagaugcaua

SEQ ID NO: 4206910 - RNA, 18 nt, Yersinia pestis KIM
ucaagauggucauaaaua

SEQ ID NO: 4206911 - RNA, 13 nt, Yersinia pestis KIM
ucaagcaauaauu

SEQ ID NO: 4206912 - RNA, 19 nt, Yersinia pestis KIM
ucaagcagcuuuucacgag

SEQ ID NO: 4206913 - RNA, 15 nt, Yersinia pestis KIM
ucaagccguguaaau

SEQ ID NO: 4206914 - RNA, 20 nt, Yersinia pestis KIM
ucaagcgcaucggaaaucug

SEQ ID NO: 4206915 - RNA, 16 nt, Yersinia pestis KIM
ucaaggccuucugggc

SEQ ID NO: 4206916 - RNA, 16 nt, Yersinia pestis KIM
ucaaggcggcagagcc

SEQ ID NO: 4206917 - RNA, 20 nt, Yersinia pestis KIM
ucaaggcggcagagccaauc

SEQ ID NO: 4206918 - RNA, 15 nt, Yersinia pestis KIM
ucaagucaauaaaua

SEQ ID NO: 4206919 - RNA, 20 nt, Yersinia pestis KIM
ucaauaaacauugaucaggu

SEQ ID NO: 4206920 - RNA, 14 nt, Yersinia pestis KIM
ucaauaaacgcuuu

SEQ ID NO: 4206921 - RNA, 15 nt, Yersinia pestis KIM
ucaauaaagaacgcg

SEQ ID NO: 4206922 - RNA, 14 nt, Yersinia pestis KIM
ucaauaaauaaaaa

SEQ ID NO: 4206923 - RNA, 17 nt, Yersinia pestis KIM
ucaauaacauuaccacc

SEQ ID NO: 4206924 - RNA, 12 nt, Yersinia pestis KIM
ucaauaaccuca

SEQ ID NO: 4206925 - RNA, 13 nt, Yersinia pestis KIM
ucaauaaccucag

SEQ ID NO: 4206926 - RNA, 16 nt, Yersinia pestis KIM
ucaauaaccucagccu

SEQ ID NO: 4206927 - RNA, 21 nt, Yersinia pestis KIM
ucaauaaccucagggagccaa

SEQ ID NO: 4206928 - RNA, 20 nt, Yersinia pestis KIM
ucaauaaccucaggggccaa

SEQ ID NO: 4206929 - RNA, 15 nt, Yersinia pestis KIM
ucaauaagaaugacu

SEQ ID NO: 4206930 - RNA, 16 nt, Yersinia pestis KIM
ucaauaagaaugacuu

SEQ ID NO: 4206931 - RNA, 19 nt, Yersinia pestis KIM
ucaauaagugcaaacuuaa

SEQ ID NO: 4206932 - RNA, 22 nt, Yersinia pestis KIM
ucaauaagugcaaacuuaaaaa

SEQ ID NO: 4206933 - RNA, 23 nt, Yersinia pestis KIM
ucaauaauauuugacagucauaa

SEQ ID NO: 4206934 - RNA, 22 nt, Yersinia pestis KIM
ucaauaauuucacuaucguuag

SEQ ID NO: 4206935 - RNA, 18 nt, Yersinia pestis KIM
ucaauacccugccaccuu

SEQ ID NO: 4206936 - RNA, 17 nt, Yersinia pestis KIM
ucaauaccuuacugcau

SEQ ID NO: 4206937 - RNA, 19 nt, Yersinia pestis KIM
ucaauacuguuaucacuga

SEQ ID NO: 4206938 - RNA, 23 nt, Yersinia pestis KIM
ucaauagaaaagcgaaucuggua

SEQ ID NO: 4206939 - RNA, 21 nt, Yersinia pestis KIM
ucaauaggauuuucaugaucc

SEQ ID NO: 4206940 - RNA, 18 nt, Yersinia pestis KIM
ucaauaggguaauaccac

SEQ ID NO: 4206941 - RNA, 16 nt, Yersinia pestis KIM
ucaauaggucaguggu

SEQ ID NO: 4206942 - RNA, 15 nt, Yersinia pestis KIM
ucaauauaagagaaa

SEQ ID NO: 4206943 - RNA, 16 nt, Yersinia pestis KIM
ucaauauaagagaaau

SEQ ID NO: 4206944 - RNA, 19 nt, Yersinia pestis KIM
ucaauaucgauuuuuaagu

SEQ ID NO: 4206945 - RNA, 15 nt, Yersinia pestis KIM
ucaauauuaauaaug

SEQ ID NO: 4206946 - RNA, 16 nt, Yersinia pestis KIM
ucaauauuaauaaugc

SEQ ID NO: 4206947 - RNA, 15 nt, Yersinia pestis KIM
ucaaucaauugcccc

SEQ ID NO: 4206948 - RNA, 22 nt, Yersinia pestis KIM
ucaaucaauugcccccaucacu

SEQ ID NO: 4206949 - RNA, 15 nt, Yersinia pestis KIM
ucaaucacuggcaau

SEQ ID NO: 4206950 - RNA, 23 nt, Yersinia pestis KIM
ucaaucacuggcaauaauucaga

SEQ ID NO: 4206951 - RNA, 22 nt, Yersinia pestis KIM
ucaaucagcugauaugaaaaau

SEQ ID NO: 4206952 - RNA, 20 nt, Yersinia pestis KIM
ucaauccgggcaaacgccag

SEQ ID NO: 4206953 - RNA, 15 nt, Yersinia pestis KIM
ucaaucgcuuucugu

SEQ ID NO: 4206954 - RNA, 18 nt, Yersinia pestis KIM
ucaaucggcggcaucuau

SEQ ID NO: 4206955 - RNA, 15 nt, Yersinia pestis KIM
ucaaucggcugguaa

SEQ ID NO: 4206956 - RNA, 19 nt, Yersinia pestis KIM
ucaaucgucaauccaauca

SEQ ID NO: 4206957 - RNA, 13 nt, Yersinia pestis KIM
ucaaucgugcacc

SEQ ID NO: 4206958 - RNA, 20 nt, Yersinia pestis KIM
ucaaucuaaugguuguuaau

SEQ ID NO: 4206959 - RNA, 22 nt, Yersinia pestis KIM
ucaaucuauucuuuuuagcgga

SEQ ID NO: 4206960 - RNA, 16 nt, Yersinia pestis KIM
ucaaucucaucaaucg

SEQ ID NO: 4206961 - RNA, 20 nt, Yersinia pestis KIM
ucaaucucuucauggcgcuu

SEQ ID NO: 4206962 - RNA, 21 nt, Yersinia pestis KIM
ucaaucucuugcggcgcaccc

SEQ ID NO: 4206963 - RNA, 17 nt, Yersinia pestis KIM
ucaaucugcaaugcgau

SEQ ID NO: 4206964 - RNA, 18 nt, Yersinia pestis KIM
ucaaugacuccugaaaua

SEQ ID NO: 4206965 - RNA, 23 nt, Yersinia pestis KIM
ucaaugacuccugaaauaaagaa

SEQ ID NO: 4206966 - RNA, 18 nt, Yersinia pestis KIM
ucaaugagcauaccgguu

SEQ ID NO: 4206967 - RNA, 16 nt, Yersinia pestis KIM
ucaaugauaaaauccu

SEQ ID NO: 4206968 - RNA, 23 nt, Yersinia pestis KIM
ucaauggauucuugcugcaaccg

SEQ ID NO: 4206969 - RNA, 21 nt, Yersinia pestis KIM
ucaaugggauccgcgauaacg

SEQ ID NO: 4206970 - RNA, 21 nt, Yersinia pestis KIM
ucaauggucaugcacaguugu

SEQ ID NO: 4206971 - RNA, 20 nt, Yersinia pestis KIM
ucaauguauugcuccagagg

SEQ ID NO: 4206972 - RNA, 20 nt, Yersinia pestis KIM
ucaaugugguaacccgcaag

SEQ ID NO: 4206973 - RNA, 18 nt, Yersinia pestis KIM
ucaauguuggcccaagau

SEQ ID NO: 4206974 - RNA, 14 nt, Yersinia pestis KIM
ucaauucucccauu

SEQ ID NO: 4206975 - RNA, 15 nt, Yersinia pestis KIM
ucaauugagaauaac

SEQ ID NO: 4206976 - RNA, 19 nt, Yersinia pestis KIM
ucaauuggcccuuuacuau

SEQ ID NO: 4206977 - RNA, 22 nt, Yersinia pestis KIM
ucaauuggcucuggaaaucacg

SEQ ID NO: 4206978 - RNA, 23 nt, Yersinia pestis KIM
ucaauugugcaaaaucagcauaa

SEQ ID NO: 4206979 - RNA, 13 nt, Yersinia pestis KIM
ucaauuuggcaug

SEQ ID NO: 4206980 - RNA, 15 nt, Yersinia pestis KIM
ucacaaccccaccuc

SEQ ID NO: 4206981 - RNA, 22 nt, Yersinia pestis KIM
ucacaacuuucccagucauaaa

SEQ ID NO: 4206982 - RNA, 13 nt, Yersinia pestis KIM
ucacaacuuuuau

SEQ ID NO: 4206983 - RNA, 15 nt, Yersinia pestis KIM
ucacaacuuuuauug

SEQ ID NO: 4206984 - RNA, 21 nt, Yersinia pestis KIM
ucacaauacagcaaauagguu

SEQ ID NO: 4206985 - RNA, 22 nt, Yersinia pestis KIM
ucacaauacagcaaauagguuu

SEQ ID NO: 4206986 - RNA, 16 nt, Yersinia pestis KIM
ucacaaucucuggcaa

SEQ ID NO: 4206987 - RNA, 12 nt, Yersinia pestis KIM
ucacaaugcugu

SEQ ID NO: 4206988 - RNA, 20 nt, Yersinia pestis KIM
ucacaaugcuguuuugucau

SEQ ID NO: 4206989 - RNA, 17 nt, Yersinia pestis KIM
ucacacagccagccuua

SEQ ID NO: 4206990 - RNA, 20 nt, Yersinia pestis KIM
ucacaccauagcgguuuauu

SEQ ID NO: 4206991 - RNA, 14 nt, Yersinia pestis KIM
ucacacgcccaggc

SEQ ID NO: 4206992 - RNA, 18 nt, Yersinia pestis KIM
ucacacguuaaacccugu

SEQ ID NO: 4206993 - RNA, 21 nt, Yersinia pestis KIM
ucacacuggcggacaucuuac

SEQ ID NO: 4206994 - RNA, 17 nt, Yersinia pestis KIM
ucacacuggugcucacu

SEQ ID NO: 4206995 - RNA, 17 nt, Yersinia pestis KIM
ucacacuguuuaguuca

SEQ ID NO: 4206996 - RNA, 18 nt, Yersinia pestis KIM
ucacagacguuuaaauaa

SEQ ID NO: 4206997 - RNA, 18 nt, Yersinia pestis KIM
ucacagauaaacaaggca

SEQ ID NO: 4206998 - RNA, 18 nt, Yersinia pestis KIM
ucacagcagaacaaaaca

SEQ ID NO: 4206999 - RNA, 16 nt, Yersinia pestis KIM
ucacuauccuuugaua

SEQ ID NO: 4207000 - RNA, 20 nt, Yersinia pestis KIM
ucacuauuucaggcauauca

SEQ ID NO: 4207001 - RNA, 23 nt, Yersinia pestis KIM
ucacucaagccaguaacuacuau

SEQ ID NO: 4207002 - RNA, 13 nt, Yersinia pestis KIM
ucacucaccgcca

SEQ ID NO: 4207003 - RNA, 14 nt, Yersinia pestis KIM
ucacucucaucuga

SEQ ID NO: 4207004 - RNA, 13 nt, Yersinia pestis KIM
ucacugaauccca

SEQ ID NO: 4207005 - RNA, 15 nt, Yersinia pestis KIM
ucacugaccugacgu

SEQ ID NO: 4207006 - RNA, 14 nt, Yersinia pestis KIM
ucacugcuccagcc

SEQ ID NO: 4207007 - RNA, 17 nt, Yersinia pestis KIM
ucacugcuccagccaac

SEQ ID NO: 4207008 - RNA, 19 nt, Yersinia pestis KIM
ucacugcuuuaucaccagu

SEQ ID NO: 4207009 - RNA, 22 nt, Yersinia pestis KIM
ucacuggaguuaaaucccugug

SEQ ID NO: 4207010 - RNA, 15 nt, Yersinia pestis KIM
ucacuggcaccauuu

SEQ ID NO: 4207011 - RNA, 15 nt, Yersinia pestis KIM
ucacuggcaccgcuu

SEQ ID NO: 4207012 - RNA, 14 nt, Yersinia pestis KIM
ucacuggcuuuauu

SEQ ID NO: 4207013 - RNA, 19 nt, Yersinia pestis KIM
ucacugucaaaaagcaccu

SEQ ID NO: 4207014 - RNA, 22 nt, Yersinia pestis KIM
ucacugucuauuuuuauaauca

SEQ ID NO: 4207015 - RNA, 19 nt, Yersinia pestis KIM
ucacuguggcggccagugc

SEQ ID NO: 4207016 - RNA, 13 nt, Yersinia pestis KIM
ucacuguuagcua

SEQ ID NO: 4207017 - RNA, 13 nt, Yersinia pestis KIM
ucacuuaaauaac

SEQ ID NO: 4207018 - RNA, 14 nt, Yersinia pestis KIM
ucacuuaaauaacu

SEQ ID NO: 4207019 - RNA, 22 nt, Yersinia pestis KIM
ucacuuagaagcgauaacccac

SEQ ID NO: 4207020 - RNA, 16 nt, Yersinia pestis KIM
ucacuuauucccacuu

SEQ ID NO: 4207021 - RNA, 21 nt, Yersinia pestis KIM
ucacuucugcuguucagauga

SEQ ID NO: 4207022 - RNA, 18 nt, Yersinia pestis KIM
ucacuuggguagcagccc

SEQ ID NO: 4207023 - RNA, 15 nt, Yersinia pestis KIM
ucacuuugacuuaaa

SEQ ID NO: 4207024 - RNA, 13 nt, Yersinia pestis KIM
ucacuuugucaau

SEQ ID NO: 4207025 - RNA, 18 nt, Yersinia pestis KIM
ucacuuuuaagauccugu

SEQ ID NO: 4207026 - RNA, 18 nt, Yersinia pestis KIM
ucacuuuuauauccgcca

SEQ ID NO: 4207027 - RNA, 15 nt, Yersinia pestis KIM
ucacuuuuugucaau

SEQ ID NO: 4207028 - RNA, 17 nt, Yersinia pestis KIM
ucagaaaacccccugcu

SEQ ID NO: 4207029 - RNA, 15 nt, Yersinia pestis KIM
ucagaaaauucauac

SEQ ID NO: 4207030 - RNA, 16 nt, Yersinia pestis KIM
ucagaaacaucuucau

SEQ ID NO: 4207031 - RNA, 20 nt, Yersinia pestis KIM
ucagaaauaaauucaucuca

SEQ ID NO: 4207032 - RNA, 19 nt, Yersinia pestis KIM
ucagaacguuaauuuagcg

SEQ ID NO: 4207033 - RNA, 15 nt, Yersinia pestis KIM
ucagacagcacgggc

SEQ ID NO: 4207034 - RNA, 14 nt, Yersinia pestis KIM
ucagacagccauca

SEQ ID NO: 4207035 - RNA, 13 nt, Yersinia pestis KIM
ucagacauuuuuc

SEQ ID NO: 4207036 - RNA, 23 nt, Yersinia pestis KIM
ucagacauuuuucuauuucuggu

SEQ ID NO: 4207037 - RNA, 17 nt, Yersinia pestis KIM
ucagaccuuuacaggac

SEQ ID NO: 4207038 - RNA, 22 nt, Yersinia pestis KIM
ucagacgagucuauugaaaaaa

SEQ ID NO: 4207039 - RNA, 17 nt, Yersinia pestis KIM
ucagacggcagcaacga

SEQ ID NO: 4207040 - RNA, 17 nt, Yersinia pestis KIM
ucagacugaaaguagaa

SEQ ID NO: 4207041 - RNA, 15 nt, Yersinia pestis KIM
ucagacugcugacaa

SEQ ID NO: 4207042 - RNA, 21 nt, Yersinia pestis KIM
ucagacugcugacaacccuca

SEQ ID NO: 4207043 - RNA, 23 nt, Yersinia pestis KIM
ucagaggaaagagagccauaauu

SEQ ID NO: 4207044 - RNA, 18 nt, Yersinia pestis KIM
ucagaggcucauccugcg

SEQ ID NO: 4207045 - RNA, 16 nt, Yersinia pestis KIM
ucagauaaaaagccag

SEQ ID NO: 4207046 - RNA, 21 nt, Yersinia pestis KIM
ucagauaaaaauaaucaauga

SEQ ID NO: 4207047 - RNA, 20 nt, Yersinia pestis KIM
ucagauaaauucaacuucuc

SEQ ID NO: 4207048 - RNA, 13 nt, Yersinia pestis KIM
ucagauaagaucu

SEQ ID NO: 4207049 - RNA, 13 nt, Yersinia pestis KIM
ucagauaaggcau

SEQ ID NO: 4207050 - RNA, 15 nt, Yersinia pestis KIM
ucagauacggcucca

SEQ ID NO: 4207051 - RNA, 16 nt, Yersinia pestis KIM
ucagauacggcuccag

SEQ ID NO: 4207052 - RNA, 18 nt, Yersinia pestis KIM
ucagauacggcuccagaa

SEQ ID NO: 4207053 - RNA, 13 nt, Yersinia pestis KIM
ucagauaucugcu

SEQ ID NO: 4207054 - RNA, 20 nt, Yersinia pestis KIM
ucagauauuagugacagcca

SEQ ID NO: 4207055 - RNA, 22 nt, Yersinia pestis KIM
ucagauauuagugacagccaca

SEQ ID NO: 4207056 - RNA, 17 nt, Yersinia pestis KIM
ucagaugaauccagcca

SEQ ID NO: 4207057 - RNA, 17 nt, Yersinia pestis KIM
ucagaugaucaaauuau

SEQ ID NO: 4207058 - RNA, 17 nt, Yersinia pestis KIM
ucagaugccgcuuuagu

SEQ ID NO: 4207059 - RNA, 16 nt, Yersinia pestis KIM
ucagaugcugacgggc

SEQ ID NO: 4207060 - RNA, 19 nt, Yersinia pestis KIM
ucagauuagucuuagacgu

SEQ ID NO: 4207061 - RNA, 19 nt, Yersinia pestis KIM
ucagauuaguuuuagacgu

SEQ ID NO: 4207062 - RNA, 17 nt, Yersinia pestis KIM
ucagauugucagacacg

SEQ ID NO: 4207063 - RNA, 22 nt, Yersinia pestis KIM
ucagauuguuuauaaauuaaaa

SEQ ID NO: 4207064 - RNA, 22 nt, Yersinia pestis KIM
ucagauuuagcgauauaacuca

SEQ ID NO: 4207065 - RNA, 19 nt, Yersinia pestis KIM
ucagcaacccgcccaagcc

SEQ ID NO: 4207066 - RNA, 22 nt, Yersinia pestis KIM
ucagcaacgguuucaacuucaa

SEQ ID NO: 4207067 - RNA, 14 nt, Yersinia pestis KIM
ucagcaacuuggua

SEQ ID NO: 4207068 - RNA, 20 nt, Yersinia pestis KIM
ucagcaacuugguaccaguc

SEQ ID NO: 4207069 - RNA, 13 nt, Yersinia pestis KIM
ucagcaauaugaa

SEQ ID NO: 4207070 - RNA, 21 nt, Yersinia pestis KIM
ucagcagacgaaccgcuuuga

SEQ ID NO: 4207071 - RNA, 17 nt, Yersinia pestis KIM
ucagcagacucaagcau

SEQ ID NO: 4207072 - RNA, 16 nt, Yersinia pestis KIM
ucagcaggggcaaccu

SEQ ID NO: 4207073 - RNA, 12 nt, Yersinia pestis KIM
ucagcagucuga

SEQ ID NO: 4207074 - RNA, 21 nt, Yersinia pestis KIM
ucagcagucugaaaucuccuc

SEQ ID NO: 4207075 - RNA, 22 nt, Yersinia pestis KIM
ucagcagucugagccucaugaa

SEQ ID NO: 4207076 - RNA, 17 nt, Yersinia pestis KIM
ucagcagucugaggccc

SEQ ID NO: 4207077 - RNA, 19 nt, Yersinia pestis KIM
ucagcagucugaggcccgc

SEQ ID NO: 4207078 - RNA, 22 nt, Yersinia pestis KIM
ucagcagucugaggcccgcuag

SEQ ID NO: 4207079 - RNA, 13 nt, Yersinia pestis KIM
ucagcauaucccu

SEQ ID NO: 4207080 - RNA, 20 nt, Yersinia pestis KIM
ucagcaucuuuaauaaauuu

SEQ ID NO: 4207081 - RNA, 14 nt, Yersinia pestis KIM
ucagcauggaagau

SEQ ID NO: 4207082 - RNA, 13 nt, Yersinia pestis KIM
ucagcauuaauac

SEQ ID NO: 4207083 - RNA, 21 nt, Yersinia pestis KIM
ucagccaaagcauucgcgguu

SEQ ID NO: 4207084 - RNA, 23 nt, Yersinia pestis KIM
ucagccaacaagcggacuucacu

SEQ ID NO: 4207085 - RNA, 18 nt, Yersinia pestis KIM
ucagccacaaaaguucac

SEQ ID NO: 4207086 - RNA, 15 nt, Yersinia pestis KIM
ucagcccauggcuga

SEQ ID NO: 4207087 - RNA, 20 nt, Yersinia pestis KIM
ucagcccccucaauaccggu

SEQ ID NO: 4207088 - RNA, 20 nt, Yersinia pestis KIM
ucagccccgccaggaaaacg

SEQ ID NO: 4207089 - RNA, 17 nt, Yersinia pestis KIM
ucagcccgauccccugc

SEQ ID NO: 4207090 - RNA, 22 nt, Yersinia pestis KIM
ucagcccuacauccgcuuguuc

SEQ ID NO: 4207091 - RNA, 18 nt, Yersinia pestis KIM
ucagccgcgaaaaaccau

SEQ ID NO: 4207092 - RNA, 19 nt, Yersinia pestis KIM
ucagccgcgaaaaaccaug

SEQ ID NO: 4207093 - RNA, 23 nt, Yersinia pestis KIM
ucagccguaucuucugccagccc

SEQ ID NO: 4207094 - RNA, 13 nt, Yersinia pestis KIM
ucagccuauccuc

SEQ ID NO: 4207095 - RNA, 19 nt, Yersinia pestis KIM
ucagccuauccucaccguu

SEQ ID NO: 4207096 - RNA, 13 nt, Yersinia pestis KIM
ucagccuucaggg

SEQ ID NO: 4207097 - RNA, 22 nt, Yersinia pestis KIM
ucagcgacgucccuaaagccau

SEQ ID NO: 4207098 - RNA, 17 nt, Yersinia pestis KIM
ucagcgacuccuggcaa

SEQ ID NO: 4207099 - RNA, 18 nt, Yersinia pestis KIM
ucagcgacuccuggcaau

SEQ ID NO: 4207100 - RNA, 16 nt, Yersinia pestis KIM
ucagcgauuuuaaaaa

SEQ ID NO: 4207101 - RNA, 14 nt, Yersinia pestis KIM
ucagcgcacugcau

SEQ ID NO: 4207102 - RNA, 17 nt, Yersinia pestis KIM
ucagcgccuuugccccg

SEQ ID NO: 4207103 - RNA, 14 nt, Yersinia pestis KIM
ucagcgcuggcuuu

SEQ ID NO: 4207104 - RNA, 14 nt, Yersinia pestis KIM
ucagcgcuuggcuc

SEQ ID NO: 4207105 - RNA, 20 nt, Yersinia pestis KIM
ucagcgcuuggcucuggagc

SEQ ID NO: 4207106 - RNA, 21 nt, Yersinia pestis KIM
ucagcgcuuggcucuggagcu

SEQ ID NO: 4207107 - RNA, 23 nt, Yersinia pestis KIM
ucagcgcuuuuucgggaaaaaau

SEQ ID NO: 4207108 - RNA, 23 nt, Yersinia pestis KIM
ucagcggagcugacgucagaucg

SEQ ID NO: 4207109 - RNA, 16 nt, Yersinia pestis KIM
ucagcgggaaagcgua

SEQ ID NO: 4207110 - RNA, 14 nt, Yersinia pestis KIM
ucagcgguugaaaa

SEQ ID NO: 4207111 - RNA, 21 nt, Yersinia pestis KIM
ucagcguagccguuaaauauc

SEQ ID NO: 4207112 - RNA, 18 nt, Yersinia pestis KIM
ucagcguggaauuaauau

SEQ ID NO: 4207113 - RNA, 24 nt, Yersinia pestis KIM
ucaucagcguuacccagauaguag

SEQ ID NO: 4207114 - RNA, 14 nt, Yersinia pestis KIM
ucaucauaaaaaua

SEQ ID NO: 4207115 - RNA, 13 nt, Yersinia pestis KIM
ucaucauauucaa

SEQ ID NO: 4207116 - RNA, 14 nt, Yersinia pestis KIM
ucaucaucaaugga

SEQ ID NO: 4207117 - RNA, 13 nt, Yersinia pestis KIM
ucaucauccauca

SEQ ID NO: 4207118 - RNA, 14 nt, Yersinia pestis KIM
ucaucaucuucuuc

SEQ ID NO: 4207119 - RNA, 18 nt, Yersinia pestis KIM
ucaucauggauaaagccu

SEQ ID NO: 4207120 - RNA, 23 nt, Yersinia pestis KIM
ucaucaugguucugcucaauagc

SEQ ID NO: 4207121 - RNA, 18 nt, Yersinia pestis KIM
ucaucaugguuucgcagg

SEQ ID NO: 4207122 - RNA, 23 nt, Yersinia pestis KIM
ucauccaacuuaccuugauccgc

SEQ ID NO: 4207123 - RNA, 20 nt, Yersinia pestis KIM
ucauccagcaacucaagcca

SEQ ID NO: 4207124 - RNA, 22 nt, Yersinia pestis KIM
ucauccaucacaaaaccuuuaa

SEQ ID NO: 4207125 - RNA, 18 nt, Yersinia pestis KIM
ucaucccaaucaucaucc

SEQ ID NO: 4207126 - RNA, 23 nt, Yersinia pestis KIM
ucaucccaaucaucaucccaguc

SEQ ID NO: 4207127 - RNA, 18 nt, Yersinia pestis KIM
ucaucccagucgucuuca

SEQ ID NO: 4207128 - RNA, 20 nt, Yersinia pestis KIM
ucaucccagucgucuucagc

SEQ ID NO: 4207129 - RNA, 23 nt, Yersinia pestis KIM
ucaucccgguugcgauacagcgc

SEQ ID NO: 4207130 - RNA, 15 nt, Yersinia pestis KIM
ucaucccuaaaauca

SEQ ID NO: 4207131 - RNA, 21 nt, Yersinia pestis KIM
ucauccuaccgccagcugacc

SEQ ID NO: 4207132 - RNA, 14 nt, Yersinia pestis KIM
ucauccucauugag

SEQ ID NO: 4207133 - RNA, 16 nt, Yersinia pestis KIM
ucaucgacucuuuuug

SEQ ID NO: 4207134 - RNA, 16 nt, Yersinia pestis KIM
ucaucgacuugaugaa

SEQ ID NO: 4207135 - RNA, 18 nt, Yersinia pestis KIM
ucaucgauugcuggcgcu

SEQ ID NO: 4207136 - RNA, 23 nt, Yersinia pestis KIM
ucaucgauugcuggcgcugauca

SEQ ID NO: 4207137 - RNA, 14 nt, Yersinia pestis KIM
ucaucgcaccauaa

SEQ ID NO: 4207138 - RNA, 22 nt, Yersinia pestis KIM
ucaucgcaccauaaccaaucca

SEQ ID NO: 4207139 - RNA, 21 nt, Yersinia pestis KIM
ucaucgccgcaaauuaacaca

SEQ ID NO: 4207140 - RNA, 16 nt, Yersinia pestis KIM
ucaucgcggaugccuu

SEQ ID NO: 4207141 - RNA, 17 nt, Yersinia pestis KIM
ucaucgcggaugccuuu

SEQ ID NO: 4207142 - RNA, 20 nt, Yersinia pestis KIM
ucaucgcggguuuuuaacuu

SEQ ID NO: 4207143 - RNA, 17 nt, Yersinia pestis KIM
ucaucgcucaucgccaa

SEQ ID NO: 4207144 - RNA, 23 nt, Yersinia pestis KIM
ucaucgcugagggccaugccuaa

SEQ ID NO: 4207145 - RNA, 17 nt, Yersinia pestis KIM
ucaucgcuugaucacga

SEQ ID NO: 4207146 - RNA, 22 nt, Yersinia pestis KIM
ucaucggggguugucugcagaa

SEQ ID NO: 4207147 - RNA, 16 nt, Yersinia pestis KIM
ucaucgggguuuguca

SEQ ID NO: 4207148 - RNA, 18 nt, Yersinia pestis KIM
ucaucgggguuugucagc

SEQ ID NO: 4207149 - RNA, 20 nt, Yersinia pestis KIM
ucaucgggguuugucagcag

SEQ ID NO: 4207150 - RNA, 21 nt, Yersinia pestis KIM
ucaucgucggcccggccaggc

SEQ ID NO: 4207151 - RNA, 20 nt, Yersinia pestis KIM
ucaucuaauuuucucagaaa

SEQ ID NO: 4207152 - RNA, 19 nt, Yersinia pestis KIM
ucaucuacaacaucaucgu

SEQ ID NO: 4207153 - RNA, 22 nt, Yersinia pestis KIM
ucaucuacaacaucaucgucaa

SEQ ID NO: 4207154 - RNA, 14 nt, Yersinia pestis KIM
ucaucucauccuca

SEQ ID NO: 4207155 - RNA, 16 nt, Yersinia pestis KIM
ucaucugaccaaacau

SEQ ID NO: 4207156 - RNA, 22 nt, Yersinia pestis KIM
ucaucugcgguaaccaauaaca

SEQ ID NO: 4207157 - RNA, 23 nt, Yersinia pestis KIM
ucaucugguuuuuuuauaaauua

SEQ ID NO: 4207158 - RNA, 20 nt, Yersinia pestis KIM
ucaucuuauuucaccgguaa

SEQ ID NO: 4207159 - RNA, 20 nt, Yersinia pestis KIM
ucaucuugggcgggaucucc

SEQ ID NO: 4207160 - RNA, 16 nt, Yersinia pestis KIM
ucaucuuuaacaacaa

SEQ ID NO: 4207161 - RNA, 18 nt, Yersinia pestis KIM
ucaucuuucucauuagcg

SEQ ID NO: 4207162 - RNA, 15 nt, Yersinia pestis KIM
ucaucuuuugcuauu

SEQ ID NO: 4207163 - RNA, 22 nt, Yersinia pestis KIM
ucaucuuuuuuuuuauuaucau

SEQ ID NO: 4207164 - RNA, 15 nt, Yersinia pestis KIM
ucaugaaugaggcug

SEQ ID NO: 4207165 - RNA, 16 nt, Yersinia pestis KIM
ucaugaaugaggcuga

SEQ ID NO: 4207166 - RNA, 12 nt, Yersinia pestis KIM
ucaugaggcagu

SEQ ID NO: 4207167 - RNA, 21 nt, Yersinia pestis KIM
ucaugauaaaacuauucugcu

SEQ ID NO: 4207168 - RNA, 14 nt, Yersinia pestis KIM
ucaugauucucuau

SEQ ID NO: 4207169 - RNA, 14 nt, Yersinia pestis KIM
ucaugcgcagaaaa

SEQ ID NO: 4207170 - RNA, 20 nt, Yersinia pestis KIM
ucaugcucugcuaauacgcu

SEQ ID NO: 4207171 - RNA, 18 nt, Yersinia pestis KIM
ucaugcugcggguagcau

SEQ ID NO: 4207172 - RNA, 17 nt, Yersinia pestis KIM
ucaugcuguagcagccu

SEQ ID NO: 4207173 - RNA, 17 nt, Yersinia pestis KIM
ucaugggaaacaagggc

SEQ ID NO: 4207174 - RNA, 16 nt, Yersinia pestis KIM
ucaugguacaacugcg

SEQ ID NO: 4207175 - RNA, 15 nt, Yersinia pestis KIM
ucaugguagagcugu

SEQ ID NO: 4207176 - RNA, 12 nt, Yersinia pestis KIM
ucauguaacaca

SEQ ID NO: 4207177 - RNA, 15 nt, Yersinia pestis KIM
ucauguaaggcaaua

SEQ ID NO: 4207178 - RNA, 14 nt, Yersinia pestis KIM
ucauguagccauug

SEQ ID NO: 4207179 - RNA, 21 nt, Yersinia pestis KIM
ucauguggaacggcauugagc

SEQ ID NO: 4207180 - RNA, 17 nt, Yersinia pestis KIM
ucauuaaaaaauaauuu

SEQ ID NO: 4207181 - RNA, 13 nt, Yersinia pestis KIM
ucauuaaaaccac

SEQ ID NO: 4207182 - RNA, 19 nt, Yersinia pestis KIM
ucauuaaaugcuuuuugcg

SEQ ID NO: 4207183 - RNA, 19 nt, Yersinia pestis KIM
ucauuaacacaucuauuuu

SEQ ID NO: 4207184 - RNA, 13 nt, Yersinia pestis KIM
ucauuaacuguua

SEQ ID NO: 4207185 - RNA, 23 nt, Yersinia pestis KIM
ucauuaagaauccucugaauaaa

SEQ ID NO: 4207186 - RNA, 14 nt, Yersinia pestis KIM
ucauuaauggcaaa

SEQ ID NO: 4207187 - RNA, 21 nt, Yersinia pestis KIM
ucauuaauuucaccacaucuu

SEQ ID NO: 4207188 - RNA, 14 nt, Yersinia pestis KIM
ucauuacacugaau

SEQ ID NO: 4207189 - RNA, 16 nt, Yersinia pestis KIM
ucauuaccgcacacua

SEQ ID NO: 4207190 - RNA, 21 nt, Yersinia pestis KIM
ucauuagccagccaauggcca

SEQ ID NO: 4207191 - RNA, 19 nt, Yersinia pestis KIM
ucauuauagaauucauuca

SEQ ID NO: 4207192 - RNA, 21 nt, Yersinia pestis KIM
ucauuaucccccuaugcuaac

SEQ ID NO: 4207193 - RNA, 18 nt, Yersinia pestis KIM
ucauuauggauaauuuaa

SEQ ID NO: 4207194 - RNA, 21 nt, Yersinia pestis KIM
ucauuauuaaacugauuuaac

SEQ ID NO: 4207195 - RNA, 20 nt, Yersinia pestis KIM
ucauuauuaaacuugcucuu

SEQ ID NO: 4207196 - RNA, 12 nt, Yersinia pestis KIM
ucauuauuuuca

SEQ ID NO: 4207197 - RNA, 16 nt, Yersinia pestis KIM
ucauuauuuucaacca

SEQ ID NO: 4207198 - RNA, 19 nt, Yersinia pestis KIM
ucauucaucaccuuaucca

SEQ ID NO: 4207199 - RNA, 15 nt, Yersinia pestis KIM
ucauucaugaggcuc

SEQ ID NO: 4207200 - RNA, 16 nt, Yersinia pestis KIM
ucauucauuuuaaaaa

SEQ ID NO: 4207201 - RNA, 17 nt, Yersinia pestis KIM
ucauuccccaucgccaa

SEQ ID NO: 4207202 - RNA, 17 nt, Yersinia pestis KIM
ucauucccgagauaacc

SEQ ID NO: 4207203 - RNA, 17 nt, Yersinia pestis KIM
ucauuccgccuguuuuc

SEQ ID NO: 4207204 - RNA, 21 nt, Yersinia pestis KIM
ucauucugaucgaguucagug

SEQ ID NO: 4207205 - RNA, 16 nt, Yersinia pestis KIM
ucauucugucaucaag

SEQ ID NO: 4207206 - RNA, 13 nt, Yersinia pestis KIM
ucauugacgugca

SEQ ID NO: 4207207 - RNA, 22 nt, Yersinia pestis KIM
ucauugagaucaguucaguauu

SEQ ID NO: 4207208 - RNA, 18 nt, Yersinia pestis KIM
ucauugagcauaucaauc

SEQ ID NO: 4207209 - RNA, 23 nt, Yersinia pestis KIM
ucauugaggagcgauaacauuuu

SEQ ID NO: 4207210 - RNA, 20 nt, Yersinia pestis KIM
ucauugaggguugucagcag

SEQ ID NO: 4207211 - RNA, 21 nt, Yersinia pestis KIM
ucauugaggguugucagcagu

SEQ ID NO: 4207212 - RNA, 18 nt, Yersinia pestis KIM
ucauugcuguuguuauua

SEQ ID NO: 4207213 - RNA, 14 nt, Yersinia pestis KIM
ucauugguaauuuc

SEQ ID NO: 4207214 - RNA, 12 nt, Yersinia pestis KIM
ucauuuaaaaua

SEQ ID NO: 4207215 - RNA, 12 nt, Yersinia pestis KIM
ucauuuaaauac

SEQ ID NO: 4207216 - RNA, 19 nt, Yersinia pestis KIM
ucauuuaauuuauccaacu

SEQ ID NO: 4207217 - RNA, 15 nt, Yersinia pestis KIM
ucauuuaucuaaaac

SEQ ID NO: 4207218 - RNA, 17 nt, Yersinia pestis KIM
ucauuuaucuaaaacug

SEQ ID NO: 4207219 - RNA, 18 nt, Yersinia pestis KIM
ucauuucccccaccugau

SEQ ID NO: 4207220 - RNA, 17 nt, Yersinia pestis KIM
ucauuuccguuaaccca

SEQ ID NO: 4207221 - RNA, 22 nt, Yersinia pestis KIM
ucauuuccguuaacccaaagcc

SEQ ID NO: 4207222 - RNA, 22 nt, Yersinia pestis KIM
ucauuuccucugggaaaccauu

SEQ ID NO: 4207223 - RNA, 20 nt, Yersinia pestis KIM
ucauuugaccuccguaggcc

SEQ ID NO: 4207224 - RNA, 22 nt, Yersinia pestis KIM
ucauuugaccuccguaggccaa

SEQ ID NO: 4207225 - RNA, 22 nt, Yersinia pestis KIM
ucauuuguugcugaugcgccca

SEQ ID NO: 4207226 - RNA, 15 nt, Yersinia pestis KIM
ucauuuguuucucac

SEQ ID NO: 4207227 - RNA, 20 nt, Yersinia pestis KIM
uccauuagcguauuaaacca

SEQ ID NO: 4207228 - RNA, 13 nt, Yersinia pestis KIM
uccauucugcaga

SEQ ID NO: 4207229 - RNA, 20 nt, Yersinia pestis KIM
uccauuguauugcucagggc

SEQ ID NO: 4207230 - RNA, 23 nt, Yersinia pestis KIM
uccauuguauugcucagggccac

SEQ ID NO: 4207231 - RNA, 19 nt, Yersinia pestis KIM
uccauuuaagccaauaaua

SEQ ID NO: 4207232 - RNA, 20 nt, Yersinia pestis KIM
uccauuuaagccaauaauau

SEQ ID NO: 4207233 - RNA, 17 nt, Yersinia pestis KIM
uccauuucaaucacugc

SEQ ID NO: 4207234 - RNA, 13 nt, Yersinia pestis KIM
uccauuucugguu

SEQ ID NO: 4207235 - RNA, 16 nt, Yersinia pestis KIM
ucccaaaggugcgcca

SEQ ID NO: 4207236 - RNA, 12 nt, Yersinia pestis KIM
ucccaaagugac

SEQ ID NO: 4207237 - RNA, 15 nt, Yersinia pestis KIM
ucccaacggcagaag

SEQ ID NO: 4207238 - RNA, 14 nt, Yersinia pestis KIM
ucccaacugaaacg

SEQ ID NO: 4207239 - RNA, 21 nt, Yersinia pestis KIM
ucccaagaaaagcaccgcagu

SEQ ID NO: 4207240 - RNA, 23 nt, Yersinia pestis KIM
ucccaagcaggaaacaugcugaa

SEQ ID NO: 4207241 - RNA, 18 nt, Yersinia pestis KIM
ucccaaucgauaauauua

SEQ ID NO: 4207242 - RNA, 14 nt, Yersinia pestis KIM
ucccaaugaauauu

SEQ ID NO: 4207243 - RNA, 19 nt, Yersinia pestis KIM
ucccagaauaauaagccgu

SEQ ID NO: 4207244 - RNA, 14 nt, Yersinia pestis KIM
ucccagacugcuga

SEQ ID NO: 4207245 - RNA, 14 nt, Yersinia pestis KIM
ucccaggccuccgc

SEQ ID NO: 4207246 - RNA, 17 nt, Yersinia pestis KIM
ucccagucauaaauauc

SEQ ID NO: 4207247 - RNA, 14 nt, Yersinia pestis KIM
ucccagucgucuuc

SEQ ID NO: 4207248 - RNA, 14 nt, Yersinia pestis KIM
ucccaguuuuuaau

SEQ ID NO: 4207249 - RNA, 16 nt, Yersinia pestis KIM
ucccaguuuuuaauuu

SEQ ID NO: 4207250 - RNA, 13 nt, Yersinia pestis KIM
ucccauacccacu

SEQ ID NO: 4207251 - RNA, 16 nt, Yersinia pestis KIM
ucccaucccuuugauc

SEQ ID NO: 4207252 - RNA, 14 nt, Yersinia pestis KIM
ucccauuaauuaau

SEQ ID NO: 4207253 - RNA, 15 nt, Yersinia pestis KIM
ucccauuauuauaag

SEQ ID NO: 4207254 - RNA, 13 nt, Yersinia pestis KIM
uccccaacucuuu

SEQ ID NO: 4207255 - RNA, 16 nt, Yersinia pestis KIM
uccccaacucuuucaa

SEQ ID NO: 4207256 - RNA, 21 nt, Yersinia pestis KIM
uccccaacucuuucaacuucc

SEQ ID NO: 4207257 - RNA, 17 nt, Yersinia pestis KIM
uccccaauucacgcaag

SEQ ID NO: 4207258 - RNA, 16 nt, Yersinia pestis KIM
uccccaccagguaauu

SEQ ID NO: 4207259 - RNA, 20 nt, Yersinia pestis KIM
uccccaccauugcaaacauc

SEQ ID NO: 4207260 - RNA, 21 nt, Yersinia pestis KIM
uccccaccauugcaaacauca

SEQ ID NO: 4207261 - RNA, 12 nt, Yersinia pestis KIM
uccccacuucau

SEQ ID NO: 4207262 - RNA, 16 nt, Yersinia pestis KIM
uccccagaugaauggu

SEQ ID NO: 4207263 - RNA, 12 nt, Yersinia pestis KIM
ucccccaccuga

SEQ ID NO: 4207264 - RNA, 20 nt, Yersinia pestis KIM
uccccccccacuugaccuuc

SEQ ID NO: 4207265 - RNA, 20 nt, Yersinia pestis KIM
uccccccgugauaugcaaau

SEQ ID NO: 4207266 - RNA, 19 nt, Yersinia pestis KIM
ucccccuccggcgcccuuc

SEQ ID NO: 4207267 - RNA, 22 nt, Yersinia pestis KIM
ucccccucuaaucacuuauucc

SEQ ID NO: 4207268 - RNA, 20 nt, Yersinia pestis KIM
uccccggcaucccaccuuca

SEQ ID NO: 4207269 - RNA, 18 nt, Yersinia pestis KIM
uccccggcccagaagccu

SEQ ID NO: 4207270 - RNA, 16 nt, Yersinia pestis KIM
uccccuaauucuccuu

SEQ ID NO: 4207271 - RNA, 18 nt, Yersinia pestis KIM
uccccugaaccauggcuu

SEQ ID NO: 4207272 - RNA, 22 nt, Yersinia pestis KIM
uccccuucgauauuacaguuua

SEQ ID NO: 4207273 - RNA, 18 nt, Yersinia pestis KIM
uccccuuugacagcaucu

SEQ ID NO: 4207274 - RNA, 20 nt, Yersinia pestis KIM
ucccgacaaauacugcugug

SEQ ID NO: 4207275 - RNA, 13 nt, Yersinia pestis KIM
ucccgagauaacc

SEQ ID NO: 4207276 - RNA, 14 nt, Yersinia pestis KIM
ucccgagauaacca

SEQ ID NO: 4207277 - RNA, 22 nt, Yersinia pestis KIM
ucccgauaaaaaccauuuuuau

SEQ ID NO: 4207278 - RNA, 19 nt, Yersinia pestis KIM
ucccgauacccauuuuaau

SEQ ID NO: 4207279 - RNA, 19 nt, Yersinia pestis KIM
ucccgauauaaauaaaaua

SEQ ID NO: 4207280 - RNA, 17 nt, Yersinia pestis KIM
ucccgaugagucuauuu

SEQ ID NO: 4207281 - RNA, 17 nt, Yersinia pestis KIM
ucccgaugauugcauca

SEQ ID NO: 4207282 - RNA, 19 nt, Yersinia pestis KIM
ucccgaugauugcaucauc

SEQ ID NO: 4207283 - RNA, 16 nt, Yersinia pestis KIM
ucccgcaaagccugcc

SEQ ID NO: 4207284 - RNA, 15 nt, Yersinia pestis KIM
ucccgcuuggguaaa

SEQ ID NO: 4207285 - RNA, 16 nt, Yersinia pestis KIM
ucccgguugcgauaca

SEQ ID NO: 4207286 - RNA, 17 nt, Yersinia pestis KIM
ucccguaggccuuaacc

SEQ ID NO: 4207287 - RNA, 14 nt, Yersinia pestis KIM
ucccguauagauua

SEQ ID NO: 4207288 - RNA, 18 nt, Yersinia pestis KIM
ucccgugccagauccucu

SEQ ID NO: 4207289 - RNA, 20 nt, Yersinia pestis KIM
ucccgugccagauccucuuu

SEQ ID NO: 4207290 - RNA, 23 nt, Yersinia pestis KIM
ucccgugugauuuccaucuagcu

SEQ ID NO: 4207291 - RNA, 17 nt, Yersinia pestis KIM
ucccuaaagagcgauua

SEQ ID NO: 4207292 - RNA, 14 nt, Yersinia pestis KIM
ucccuaaagccauc

SEQ ID NO: 4207293 - RNA, 20 nt, Yersinia pestis KIM
ucccucaauagcuaauaauu

SEQ ID NO: 4207294 - RNA, 19 nt, Yersinia pestis KIM
ucccucaccgccauuuacu

SEQ ID NO: 4207295 - RNA, 20 nt, Yersinia pestis KIM
ucccucauuuauauucuuag

SEQ ID NO: 4207296 - RNA, 15 nt, Yersinia pestis KIM
ucccucuugaauaau

SEQ ID NO: 4207297 - RNA, 15 nt, Yersinia pestis KIM
ucccugacucccuga

SEQ ID NO: 4207298 - RNA, 20 nt, Yersinia pestis KIM
ucccugacucccugacuccc

SEQ ID NO: 4207299 - RNA, 19 nt, Yersinia pestis KIM
ucccuucgcccuguaaagc

SEQ ID NO: 4207300 - RNA, 15 nt, Yersinia pestis KIM
ucccuuucucaguga

SEQ ID NO: 4207301 - RNA, 16 nt, Yersinia pestis KIM
uccgaaaaauauucuc

SEQ ID NO: 4207302 - RNA, 19 nt, Yersinia pestis KIM
uccgaccaccacugcauca

SEQ ID NO: 4207303 - RNA, 20 nt, Yersinia pestis KIM
uccgacugauagcaaacaaa

SEQ ID NO: 4207304 - RNA, 15 nt, Yersinia pestis KIM
uccgaguuauugaua

SEQ ID NO: 4207305 - RNA, 18 nt, Yersinia pestis KIM
uccgauaaacuucacaau

SEQ ID NO: 4207306 - RNA, 16 nt, Yersinia pestis KIM
uccgcaccgcuagcgg

SEQ ID NO: 4207307 - RNA, 16 nt, Yersinia pestis KIM
uccgcacggcuacugc

SEQ ID NO: 4207308 - RNA, 13 nt, Yersinia pestis KIM
uccgcaggaagca

SEQ ID NO: 4207309 - RNA, 18 nt, Yersinia pestis KIM
uccgcaucguaacccaga

SEQ ID NO: 4207310 - RNA, 20 nt, Yersinia pestis KIM
uccgccaguugcucacggug

SEQ ID NO: 4207311 - RNA, 15 nt, Yersinia pestis KIM
uccgccauccuucaa

SEQ ID NO: 4207312 - RNA, 14 nt, Yersinia pestis KIM
uccgccccggugac

SEQ ID NO: 4207313 - RNA, 17 nt, Yersinia pestis KIM
uccgccgccaacaguga

SEQ ID NO: 4207314 - RNA, 22 nt, Yersinia pestis KIM
uccgccucuuuuuccacacccu

SEQ ID NO: 4207315 - RNA, 18 nt, Yersinia pestis KIM
uccgcgcaaccuggccaa

SEQ ID NO: 4207316 - RNA, 14 nt, Yersinia pestis KIM
uccgcgccagggag

SEQ ID NO: 4207317 - RNA, 19 nt, Yersinia pestis KIM
uccgcuccugauuuaaccu

SEQ ID NO: 4207318 - RNA, 20 nt, Yersinia pestis KIM
uccgcuguggcccuugcagc

SEQ ID NO: 4207319 - RNA, 19 nt, Yersinia pestis KIM
uccgcuuagcaggcccuuu

SEQ ID NO: 4207320 - RNA, 14 nt, Yersinia pestis KIM
uccgcuuccaucac

SEQ ID NO: 4207321 - RNA, 19 nt, Yersinia pestis KIM
uccgcuucucagucgcgau

SEQ ID NO: 4207322 - RNA, 22 nt, Yersinia pestis KIM
uccgcuucucagucgcgaugcg

SEQ ID NO: 4207323 - RNA, 15 nt, Yersinia pestis KIM
uccggacuucauaaa

SEQ ID NO: 4207324 - RNA, 23 nt, Yersinia pestis KIM
uccggcaaaaacgccaucaauaa

SEQ ID NO: 4207325 - RNA, 22 nt, Yersinia pestis KIM
uccggcugcgccauaugccaug

SEQ ID NO: 4207326 - RNA, 13 nt, Yersinia pestis KIM
uccgggacgcgcc

SEQ ID NO: 4207327 - RNA, 18 nt, Yersinia pestis KIM
uccgggcagugaaucacc

SEQ ID NO: 4207328 - RNA, 20 nt, Yersinia pestis KIM
uccgguaaagaagcauagaa

SEQ ID NO: 4207329 - RNA, 15 nt, Yersinia pestis KIM
uccggucugaagaga

SEQ ID NO: 4207330 - RNA, 14 nt, Yersinia pestis KIM
uccggugaagaauu

SEQ ID NO: 4207331 - RNA, 22 nt, Yersinia pestis KIM
uccggugguuucgccgccaauc

SEQ ID NO: 4207332 - RNA, 16 nt, Yersinia pestis KIM
uccgguuguucuacua

SEQ ID NO: 4207333 - RNA, 15 nt, Yersinia pestis KIM
uccguacuuuucgcc

SEQ ID NO: 4207334 - RNA, 19 nt, Yersinia pestis KIM
uccgucaucgaacccgcua

SEQ ID NO: 4207335 - RNA, 21 nt, Yersinia pestis KIM
uccgucccaagaaaagcaccg

SEQ ID NO: 4207336 - RNA, 12 nt, Yersinia pestis KIM
uccgucgccaac

SEQ ID NO: 4207337 - RNA, 20 nt, Yersinia pestis KIM
uccgucgcgggcacuuuguc

SEQ ID NO: 4207338 - RNA, 14 nt, Yersinia pestis KIM
uccgugauuaaccu

SEQ ID NO: 4207339 - RNA, 14 nt, Yersinia pestis KIM
uccgugcugguccu

SEQ ID NO: 4207340 - RNA, 17 nt, Yersinia pestis KIM
uccguguaguuauugau

SEQ ID NO: 4207341 - RNA, 19 nt, Yersinia pestis KIM
uccguguuggcaaaaauaa

SEQ ID NO: 4207342 - RNA, 20 nt, Yersinia pestis KIM
ucgauaguaaacaguuucag

SEQ ID NO: 4207343 - RNA, 17 nt, Yersinia pestis KIM
ucgaucaaaacaauaaa

SEQ ID NO: 4207344 - RNA, 20 nt, Yersinia pestis KIM
ucgaucaaaacaauaaaaag

SEQ ID NO: 4207345 - RNA, 16 nt, Yersinia pestis KIM
ucgaucccaauauuaa

SEQ ID NO: 4207346 - RNA, 17 nt, Yersinia pestis KIM
ucgauccgaauauguca

SEQ ID NO: 4207347 - RNA, 22 nt, Yersinia pestis KIM
ucgauggauaaauucagccgcu

SEQ ID NO: 4207348 - RNA, 18 nt, Yersinia pestis KIM
ucgauugauauauagaaa

SEQ ID NO: 4207349 - RNA, 17 nt, Yersinia pestis KIM
ucgauuuaauggguaaa

SEQ ID NO: 4207350 - RNA, 16 nt, Yersinia pestis KIM
ucgauuugcugcugcu

SEQ ID NO: 4207351 - RNA, 14 nt, Yersinia pestis KIM
ucgauuuuagcuuu

SEQ ID NO: 4207352 - RNA, 13 nt, Yersinia pestis KIM
ucgauuuuuauuu

SEQ ID NO: 4207353 - RNA, 21 nt, Yersinia pestis KIM
ucgauuuuuauuuucgaccaa

SEQ ID NO: 4207354 - RNA, 19 nt, Yersinia pestis KIM
ucgcaaaauuuauauucau

SEQ ID NO: 4207355 - RNA, 22 nt, Yersinia pestis KIM
ucgcaaagcgggccagcaacca

SEQ ID NO: 4207356 - RNA, 12 nt, Yersinia pestis KIM
ucgcaagcaaua

SEQ ID NO: 4207357 - RNA, 15 nt, Yersinia pestis KIM
ucgcacaguuuucuu

SEQ ID NO: 4207358 - RNA, 16 nt, Yersinia pestis KIM
ucgcacugaguucugc

SEQ ID NO: 4207359 - RNA, 15 nt, Yersinia pestis KIM
ucgcacugcucugcc

SEQ ID NO: 4207360 - RNA, 22 nt, Yersinia pestis KIM
ucgcacugugagcggcauccag

SEQ ID NO: 4207361 - RNA, 18 nt, Yersinia pestis KIM
ucgcacuuuaaauaccca

SEQ ID NO: 4207362 - RNA, 21 nt, Yersinia pestis KIM
ucgcagacagauuuggccacg

SEQ ID NO: 4207363 - RNA, 17 nt, Yersinia pestis KIM
ucgcagccaaaauaauc

SEQ ID NO: 4207364 - RNA, 19 nt, Yersinia pestis KIM
ucgcagccaaaauaaucac

SEQ ID NO: 4207365 - RNA, 15 nt, Yersinia pestis KIM
ucgcaggcuucaacu

SEQ ID NO: 4207366 - RNA, 23 nt, Yersinia pestis KIM
ucgcaguggguaacauaugagua

SEQ ID NO: 4207367 - RNA, 16 nt, Yersinia pestis KIM
ucgcauaggccaauag

SEQ ID NO: 4207368 - RNA, 19 nt, Yersinia pestis KIM
ucgcaucgucgcuguuacc

SEQ ID NO: 4207369 - RNA, 20 nt, Yersinia pestis KIM
ucgccaacaggccuaaugcc

SEQ ID NO: 4207370 - RNA, 21 nt, Yersinia pestis KIM
ucgccaacaggccuaaugccg

SEQ ID NO: 4207371 - RNA, 19 nt, Yersinia pestis KIM
ucgccaauacaaucgucaa

SEQ ID NO: 4207372 - RNA, 19 nt, Yersinia pestis KIM
ucgccaauucguuuuucau

SEQ ID NO: 4207373 - RNA, 17 nt, Yersinia pestis KIM
ucgccaucgucucugca

SEQ ID NO: 4207374 - RNA, 17 nt, Yersinia pestis KIM
ucgcccgcugauucugg

SEQ ID NO: 4207375 - RNA, 19 nt, Yersinia pestis KIM
ucgccgcaaauuaacacau

SEQ ID NO: 4207376 - RNA, 16 nt, Yersinia pestis KIM
ucgccgccgccagccc

SEQ ID NO: 4207377 - RNA, 14 nt, Yersinia pestis KIM
ucgccgccuccgau

SEQ ID NO: 4207378 - RNA, 16 nt, Yersinia pestis KIM
ucgccgguaauaccga

SEQ ID NO: 4207379 - RNA, 24 nt, Yersinia pestis KIM
ucgccguauuuguauuuacucguu

SEQ ID NO: 4207380 - RNA, 23 nt, Yersinia pestis KIM
ucgccguuacccccuucaccaau

SEQ ID NO: 4207381 - RNA, 20 nt, Yersinia pestis KIM
ucgccuaccaucaaaauaug

SEQ ID NO: 4207382 - RNA, 13 nt, Yersinia pestis KIM
ucgccuauaaaaa

SEQ ID NO: 4207383 - RNA, 14 nt, Yersinia pestis KIM
ucgccugcugagcc

SEQ ID NO: 4207384 - RNA, 22 nt, Yersinia pestis KIM
ucgccuuaucagcgaaaaauuu

SEQ ID NO: 4207385 - RNA, 13 nt, Yersinia pestis KIM
ucgccuucuggca

SEQ ID NO: 4207386 - RNA, 14 nt, Yersinia pestis KIM
ucgccuucuggcaa

SEQ ID NO: 4207387 - RNA, 22 nt, Yersinia pestis KIM
ucgccuuucacgcguucaaucu

SEQ ID NO: 4207388 - RNA, 22 nt, Yersinia pestis KIM
ucgcgaccaauucaucagcgcu

SEQ ID NO: 4207389 - RNA, 15 nt, Yersinia pestis KIM
ucgcgaccagcagaa

SEQ ID NO: 4207390 - RNA, 16 nt, Yersinia pestis KIM
ucgcgaccagcagaag

SEQ ID NO: 4207391 - RNA, 23 nt, Yersinia pestis KIM
ucgcgacgaaaaccuaauacuuu

SEQ ID NO: 4207392 - RNA, 17 nt, Yersinia pestis KIM
ucgcgacuacagaaaac

SEQ ID NO: 4207393 - RNA, 18 nt, Yersinia pestis KIM
ucgcgacucaagccucua

SEQ ID NO: 4207394 - RNA, 21 nt, Yersinia pestis KIM
ucgcgauaaaauucagccacu

SEQ ID NO: 4207395 - RNA, 16 nt, Yersinia pestis KIM
ucgcgcccauccgcag

SEQ ID NO: 4207396 - RNA, 18 nt, Yersinia pestis KIM
ucgcgccugaaaucauuu

SEQ ID NO: 4207397 - RNA, 13 nt, Yersinia pestis KIM
ucgcgcuucaggu

SEQ ID NO: 4207398 - RNA, 20 nt, Yersinia pestis KIM
ucgcgggcgcgcugcugcuc

SEQ ID NO: 4207399 - RNA, 16 nt, Yersinia pestis KIM
ucgcguuggcuaaaau

SEQ ID NO: 4207400 - RNA, 16 nt, Yersinia pestis KIM
ucgcuaucugugucag

SEQ ID NO: 4207401 - RNA, 21 nt, Yersinia pestis KIM
ucgcuaucugugucaguaccu

SEQ ID NO: 4207402 - RNA, 12 nt, Yersinia pestis KIM
ucgcuauuuccg

SEQ ID NO: 4207403 - RNA, 19 nt, Yersinia pestis KIM
ucgcuauuucucucuacuu

SEQ ID NO: 4207404 - RNA, 20 nt, Yersinia pestis KIM
ucgcucccccggaucacugg

SEQ ID NO: 4207405 - RNA, 14 nt, Yersinia pestis KIM
ucgcuccucagccu

SEQ ID NO: 4207406 - RNA, 15 nt, Yersinia pestis KIM
ucgcuccucagccuu

SEQ ID NO: 4207407 - RNA, 18 nt, Yersinia pestis KIM
ucgcucgauacuaauuuc

SEQ ID NO: 4207408 - RNA, 18 nt, Yersinia pestis KIM
ucgcucggcucgaaccug

SEQ ID NO: 4207409 - RNA, 12 nt, Yersinia pestis KIM
ucgcucugcguu

SEQ ID NO: 4207410 - RNA, 13 nt, Yersinia pestis KIM
ucgcugaaaugcu

SEQ ID NO: 4207411 - RNA, 15 nt, Yersinia pestis KIM
ucgcugaaaugcuau

SEQ ID NO: 4207412 - RNA, 21 nt, Yersinia pestis KIM
ucgcugaacaauugccaggcc

SEQ ID NO: 4207413 - RNA, 22 nt, Yersinia pestis KIM
ucgcugagacccgauuucacgc

SEQ ID NO: 4207414 - RNA, 20 nt, Yersinia pestis KIM
ucgcuggacgcaucagaucg

SEQ ID NO: 4207415 - RNA, 20 nt, Yersinia pestis KIM
auucugagggacagagagau

SEQ ID NO: 4207416 - RNA, 14 nt, Yersinia pestis KIM
auucugauaccugc

SEQ ID NO: 4207417 - RNA, 18 nt, Yersinia pestis KIM
auucugauaccugcgcua

SEQ ID NO: 4207418 - RNA, 14 nt, Yersinia pestis KIM
auucugauagugau

SEQ ID NO: 4207419 - RNA, 22 nt, Yersinia pestis KIM
auucugauagugauuuuuuuca

SEQ ID NO: 4207420 - RNA, 23 nt, Yersinia pestis KIM
auucugauagugauuuuuuucac

SEQ ID NO: 4207421 - RNA, 14 nt, Yersinia pestis KIM
auucugaucgaguu

SEQ ID NO: 4207422 - RNA, 15 nt, Yersinia pestis KIM
auucugccuauccuc

SEQ ID NO: 4207423 - RNA, 18 nt, Yersinia pestis KIM
auucugccuauccucacc

SEQ ID NO: 4207424 - RNA, 14 nt, Yersinia pestis KIM
auucuggcuuuuca

SEQ ID NO: 4207425 - RNA, 13 nt, Yersinia pestis KIM
auucugucagagc

SEQ ID NO: 4207426 - RNA, 20 nt, Yersinia pestis KIM
auucugucagagcuauguuc

SEQ ID NO: 4207427 - RNA, 17 nt, Yersinia pestis KIM
auucuuaggucaucguc

SEQ ID NO: 4207428 - RNA, 19 nt, Yersinia pestis KIM
auucuuaucaaucaaaaaa

SEQ ID NO: 4207429 - RNA, 15 nt, Yersinia pestis KIM
auucuuuuuguuaaa

SEQ ID NO: 4207430 - RNA, 21 nt, Yersinia pestis KIM
auugaagauacccuucucuuu

SEQ ID NO: 4207431 - RNA, 19 nt, Yersinia pestis KIM
auugaagauuuaaauaaca

SEQ ID NO: 4207432 - RNA, 15 nt, Yersinia pestis KIM
auugaagugauauag

SEQ ID NO: 4207433 - RNA, 20 nt, Yersinia pestis KIM
auugaagugauauagaaagc

SEQ ID NO: 4207434 - RNA, 16 nt, Yersinia pestis KIM
auugacaaagugccug

SEQ ID NO: 4207435 - RNA, 16 nt, Yersinia pestis KIM
auugacaggugguucu

SEQ ID NO: 4207436 - RNA, 17 nt, Yersinia pestis KIM
auugaccaauaaaaugc

SEQ ID NO: 4207437 - RNA, 15 nt, Yersinia pestis KIM
auugaccaauauaaa

SEQ ID NO: 4207438 - RNA, 16 nt, Yersinia pestis KIM
auugaccagauagcug

SEQ ID NO: 4207439 - RNA, 17 nt, Yersinia pestis KIM
auugaccagauagcugu

SEQ ID NO: 4207440 - RNA, 19 nt, Yersinia pestis KIM
auugacccucuuaaugaau

SEQ ID NO: 4207441 - RNA, 13 nt, Yersinia pestis KIM
auugacuuuaaaa

SEQ ID NO: 4207442 - RNA, 22 nt, Yersinia pestis KIM
auugagaauuauaacuauuauc

SEQ ID NO: 4207443 - RNA, 13 nt, Yersinia pestis KIM
auugagcaaaauu

SEQ ID NO: 4207444 - RNA, 16 nt, Yersinia pestis KIM
auugagcauaucaauc

SEQ ID NO: 4207445 - RNA, 16 nt, Yersinia pestis KIM
auugagcauauucagu

SEQ ID NO: 4207446 - RNA, 17 nt, Yersinia pestis KIM
auugaguaacugauuaa

SEQ ID NO: 4207447 - RNA, 17 nt, Yersinia pestis KIM
auugagucguuauaaca

SEQ ID NO: 4207448 - RNA, 15 nt, Yersinia pestis KIM
auugagucucuggcc

SEQ ID NO: 4207449 - RNA, 18 nt, Yersinia pestis KIM
auugagugcggccacacg

SEQ ID NO: 4207450 - RNA, 18 nt, Yersinia pestis KIM
auugaguuucaaugccaa

SEQ ID NO: 4207451 - RNA, 13 nt, Yersinia pestis KIM
auugauaaaacca

SEQ ID NO: 4207452 - RNA, 14 nt, Yersinia pestis KIM
auugauaaaaccac

SEQ ID NO: 4207453 - RNA, 22 nt, Yersinia pestis KIM
auugauaaaaccacugaccuau

SEQ ID NO: 4207454 - RNA, 21 nt, Yersinia pestis KIM
auugauaaaaguaauuuauca

SEQ ID NO: 4207455 - RNA, 13 nt, Yersinia pestis KIM
auugauaccacaa

SEQ ID NO: 4207456 - RNA, 18 nt, Yersinia pestis KIM
auugauagccacaucauu

SEQ ID NO: 4207457 - RNA, 15 nt, Yersinia pestis KIM
auugaucacaguaaa

SEQ ID NO: 4207458 - RNA, 23 nt, Yersinia pestis KIM
auugauccucgcgggucaugaaa

SEQ ID NO: 4207459 - RNA, 18 nt, Yersinia pestis KIM
auugaugacgcuaaccac

SEQ ID NO: 4207460 - RNA, 16 nt, Yersinia pestis KIM
auugaugauuugaccg

SEQ ID NO: 4207461 - RNA, 17 nt, Yersinia pestis KIM
auugaugcuagcccaca

SEQ ID NO: 4207462 - RNA, 23 nt, Yersinia pestis KIM
auugauuaauuuuucauaauaau

SEQ ID NO: 4207463 - RNA, 18 nt, Yersinia pestis KIM
auugauuacaaaauauac

SEQ ID NO: 4207464 - RNA, 15 nt, Yersinia pestis KIM
auugauucaucaacu

SEQ ID NO: 4207465 - RNA, 15 nt, Yersinia pestis KIM
auugauugcuuacca

SEQ ID NO: 4207466 - RNA, 19 nt, Yersinia pestis KIM
auugauuuguaauaacgau

SEQ ID NO: 4207467 - RNA, 12 nt, Yersinia pestis KIM
auugcacaccca

SEQ ID NO: 4207468 - RNA, 23 nt, Yersinia pestis KIM
auugcacaugcagcauuucagga

SEQ ID NO: 4207469 - RNA, 15 nt, Yersinia pestis KIM
auugcagagcaaaac

SEQ ID NO: 4207470 - RNA, 19 nt, Yersinia pestis KIM
auugcagagcaaaacuggg

SEQ ID NO: 4207471 - RNA, 11 nt, Yersinia pestis KIM
auugcagauac

SEQ ID NO: 4207472 - RNA, 18 nt, Yersinia pestis KIM
auugcaggccgcuuuauu

SEQ ID NO: 4207473 - RNA, 21 nt, Yersinia pestis KIM
auugcaggccgcuuuauucag

SEQ ID NO: 4207474 - RNA, 13 nt, Yersinia pestis KIM
auugcauauugcu

SEQ ID NO: 4207475 - RNA, 23 nt, Yersinia pestis KIM
auugcauccgcuuucacauuacc

SEQ ID NO: 4207476 - RNA, 15 nt, Yersinia pestis KIM
auugcauuuuacagg

SEQ ID NO: 4207477 - RNA, 18 nt, Yersinia pestis KIM
auugccaaaugcaaacca

SEQ ID NO: 4207478 - RNA, 14 nt, Yersinia pestis KIM
auugccacggcauu

SEQ ID NO: 4207479 - RNA, 22 nt, Yersinia pestis KIM
auugccaucgggcaauugaaaa

SEQ ID NO: 4207480 - RNA, 14 nt, Yersinia pestis KIM
auugccauuuuaau

SEQ ID NO: 4207481 - RNA, 19 nt, Yersinia pestis KIM
auugccccacauuacuggc

SEQ ID NO: 4207482 - RNA, 23 nt, Yersinia pestis KIM
auugccccccaauauuggauaau

SEQ ID NO: 4207483 - RNA, 17 nt, Yersinia pestis KIM
auugccgcgucuguuau

SEQ ID NO: 4207484 - RNA, 20 nt, Yersinia pestis KIM
auugccggaaggucauuccc

SEQ ID NO: 4207485 - RNA, 18 nt, Yersinia pestis KIM
auugccggauuccaccug

SEQ ID NO: 4207486 - RNA, 20 nt, Yersinia pestis KIM
auugccggauuccaccugac

SEQ ID NO: 4207487 - RNA, 20 nt, Yersinia pestis KIM
auugccgugcaaucuguuau

SEQ ID NO: 4207488 - RNA, 21 nt, Yersinia pestis KIM
auugccugauuuuuaucauca

SEQ ID NO: 4207489 - RNA, 16 nt, Yersinia pestis KIM
auugccuggcccaucu

SEQ ID NO: 4207490 - RNA, 16 nt, Yersinia pestis KIM
auugccuucuccuuuc

SEQ ID NO: 4207491 - RNA, 21 nt, Yersinia pestis KIM
auugcgacgaggguaauaaug

SEQ ID NO: 4207492 - RNA, 19 nt, Yersinia pestis KIM
auugcggccaguauccaga

SEQ ID NO: 4207493 - RNA, 21 nt, Yersinia pestis KIM
auugcguaauuacccaagauc

SEQ ID NO: 4207494 - RNA, 14 nt, Yersinia pestis KIM
auugcguuauaucu

SEQ ID NO: 4207495 - RNA, 17 nt, Yersinia pestis KIM
auugcuaaauuuuguac

SEQ ID NO: 4207496 - RNA, 23 nt, Yersinia pestis KIM
auugcuacugaagguuauuacuu

SEQ ID NO: 4207497 - RNA, 15 nt, Yersinia pestis KIM
auugcuaucuguuau

SEQ ID NO: 4207498 - RNA, 22 nt, Yersinia pestis KIM
auugcucaaacucagcaucacc

SEQ ID NO: 4207499 - RNA, 14 nt, Yersinia pestis KIM
auugcucaguuccc

SEQ ID NO: 4207500 - RNA, 16 nt, Yersinia pestis KIM
auugcuccuguauauu

SEQ ID NO: 4207501 - RNA, 16 nt, Yersinia pestis KIM
auugcugaugucauuc

SEQ ID NO: 4207502 - RNA, 22 nt, Yersinia pestis KIM
auugcugcccggucgccauaau

SEQ ID NO: 4207503 - RNA, 23 nt, Yersinia pestis KIM
auugcugcuguuauuacugucau

SEQ ID NO: 4207504 - RNA, 14 nt, Yersinia pestis KIM
auugcugugguuga

SEQ ID NO: 4207505 - RNA, 15 nt, Yersinia pestis KIM
auugcuguuguuauu

SEQ ID NO: 4207506 - RNA, 22 nt, Yersinia pestis KIM
auugcuuaccacuggccuccca

SEQ ID NO: 4207507 - RNA, 19 nt, Yersinia pestis KIM
auugcuuugcgauacacca

SEQ ID NO: 4207508 - RNA, 16 nt, Yersinia pestis KIM
auuggacccgucacca

SEQ ID NO: 4207509 - RNA, 13 nt, Yersinia pestis KIM
auuggagucauga

SEQ ID NO: 4207510 - RNA, 16 nt, Yersinia pestis KIM
auuggcaaaggccagc

SEQ ID NO: 4207511 - RNA, 22 nt, Yersinia pestis KIM
auuggcaacaacagauaaagcu

SEQ ID NO: 4207512 - RNA, 16 nt, Yersinia pestis KIM
auuggcauuuaaaagg

SEQ ID NO: 4207513 - RNA, 17 nt, Yersinia pestis KIM
auuggccgcgcacagca

SEQ ID NO: 4207514 - RNA, 19 nt, Yersinia pestis KIM
auuggccugcacaucaaua

SEQ ID NO: 4207515 - RNA, 17 nt, Yersinia pestis KIM
auuggcgagcaugacac

SEQ ID NO: 4207516 - RNA, 19 nt, Yersinia pestis KIM
auuggcgaugcgcuccgcc

SEQ ID NO: 4207517 - RNA, 24 nt, Yersinia pestis KIM
auuggcggaagacuuccagcacca

SEQ ID NO: 4207518 - RNA, 20 nt, Yersinia pestis KIM
auuggcucauaacacuuaau

SEQ ID NO: 4207519 - RNA, 17 nt, Yersinia pestis KIM
auuggcuccuauagcuc

SEQ ID NO: 4207520 - RNA, 16 nt, Yersinia pestis KIM
auuggcugauucaaca

SEQ ID NO: 4207521 - RNA, 23 nt, Yersinia pestis KIM
auugggcucuucgccaguucauu

SEQ ID NO: 4207522 - RNA, 16 nt, Yersinia pestis KIM
auuggguaaucucuuu

SEQ ID NO: 4207523 - RNA, 19 nt, Yersinia pestis KIM
auugguacagaaaauacug

SEQ ID NO: 4207524 - RNA, 19 nt, Yersinia pestis KIM
auugguacgguuagccuug

SEQ ID NO: 4207525 - RNA, 15 nt, Yersinia pestis KIM
auuggucaauaaaau

SEQ ID NO: 4207526 - RNA, 21 nt, Yersinia pestis KIM
auuggucaugaugaauacgau

SEQ ID NO: 4207527 - RNA, 16 nt, Yersinia pestis KIM
auuggucgcuuuuuac

SEQ ID NO: 4207528 - RNA, 14 nt, Yersinia pestis KIM
auugguuaacuuau

SEQ ID NO: 4207529 - RNA, 15 nt, Yersinia pestis KIM
auuucgaaaacucaa

SEQ ID NO: 4207530 - RNA, 14 nt, Yersinia pestis KIM
auuucgaagcaguc

SEQ ID NO: 4207531 - RNA, 19 nt, Yersinia pestis KIM
auuucuacgccgucaucau

SEQ ID NO: 4207532 - RNA, 20 nt, Yersinia pestis KIM
auuucuccccacuucaucau

SEQ ID NO: 4207533 - RNA, 16 nt, Yersinia pestis KIM
auuucucuguauuuuc

SEQ ID NO: 4207534 - RNA, 21 nt, Yersinia pestis KIM
auuucugguagccugcacuuc

SEQ ID NO: 4207535 - RNA, 23 nt, Yersinia pestis KIM
auuucuguuaccagaaaaccuuc

SEQ ID NO: 4207536 - RNA, 13 nt, Yersinia pestis KIM
auuucuugauguc

SEQ ID NO: 4207537 - RNA, 22 nt, Yersinia pestis KIM
auuucuuuugcuguauuuuucg

SEQ ID NO: 4207538 - RNA, 14 nt, Yersinia pestis KIM
auuucuuuuuaugu

SEQ ID NO: 4207539 - RNA, 21 nt, Yersinia pestis KIM
auuugaacaacauugaugcua

SEQ ID NO: 4207540 - RNA, 21 nt, Yersinia pestis KIM
auuugaacgugccccaaugau

SEQ ID NO: 4207541 - RNA, 14 nt, Yersinia pestis KIM
auuugaacuucaaa

SEQ ID NO: 4207542 - RNA, 20 nt, Yersinia pestis KIM
auuugaagacaacucuucua

SEQ ID NO: 4207543 - RNA, 21 nt, Yersinia pestis KIM
auuugauauuaauaucagcga

SEQ ID NO: 4207544 - RNA, 15 nt, Yersinia pestis KIM
auuugaucaccaauc

SEQ ID NO: 4207545 - RNA, 15 nt, Yersinia pestis KIM
auuugcacauagccc

SEQ ID NO: 4207546 - RNA, 20 nt, Yersinia pestis KIM
auuugcaguggaugauaaau

SEQ ID NO: 4207547 - RNA, 13 nt, Yersinia pestis KIM
auuugccagagug

SEQ ID NO: 4207548 - RNA, 19 nt, Yersinia pestis KIM
auuugcccgauucaccuuc

SEQ ID NO: 4207549 - RNA, 18 nt, Yersinia pestis KIM
auuugcccucgaacgaag

SEQ ID NO: 4207550 - RNA, 19 nt, Yersinia pestis KIM
auuugccucugcuagcaaa

SEQ ID NO: 4207551 - RNA, 14 nt, Yersinia pestis KIM
auuugcgcccgcgc

SEQ ID NO: 4207552 - RNA, 21 nt, Yersinia pestis KIM
auuugcucagauacaucaaug

SEQ ID NO: 4207553 - RNA, 19 nt, Yersinia pestis KIM
auuugcugcugcugugggu

SEQ ID NO: 4207554 - RNA, 15 nt, Yersinia pestis KIM
auuugcuucguuucc

SEQ ID NO: 4207555 - RNA, 21 nt, Yersinia pestis KIM
auuugcuuuaaauaacgcaaa

SEQ ID NO: 4207556 - RNA, 22 nt, Yersinia pestis KIM
auuuggagguguauuuuuaugg

SEQ ID NO: 4207557 - RNA, 19 nt, Yersinia pestis KIM
auuugguauuggcuagaaa

SEQ ID NO: 4207558 - RNA, 22 nt, Yersinia pestis KIM
auuugguauuggcuagaaauca

SEQ ID NO: 4207559 - RNA, 21 nt, Yersinia pestis KIM
auuuggugguugaaauaacug

SEQ ID NO: 4207560 - RNA, 19 nt, Yersinia pestis KIM
auuugguuauaucccaaua

SEQ ID NO: 4207561 - RNA, 23 nt, Yersinia pestis KIM
auuugguucacggaaaguagcca

SEQ ID NO: 4207562 - RNA, 17 nt, Yersinia pestis KIM
auuugguuggcuuuaac

SEQ ID NO: 4207563 - RNA, 18 nt, Yersinia pestis KIM
auuuguagugaaugacag

SEQ ID NO: 4207564 - RNA, 19 nt, Yersinia pestis KIM
auuuguggugguugcagug

SEQ ID NO: 4207565 - RNA, 14 nt, Yersinia pestis KIM
auuugugucgggau

SEQ ID NO: 4207566 - RNA, 21 nt, Yersinia pestis KIM
auuugugucguacacuauuuu

SEQ ID NO: 4207567 - RNA, 14 nt, Yersinia pestis KIM
auuuguuaaaacag

SEQ ID NO: 4207568 - RNA, 23 nt, Yersinia pestis KIM
auuuguuuuugaaucauaauggu

SEQ ID NO: 4207569 - RNA, 14 nt, Yersinia pestis KIM
auuuuaaguuaaug

SEQ ID NO: 4207570 - RNA, 15 nt, Yersinia pestis KIM
auuuuaaucucucca

SEQ ID NO: 4207571 - RNA, 11 nt, Yersinia pestis KIM
auuuuaaugaa

SEQ ID NO: 4207572 - RNA, 15 nt, Yersinia pestis KIM
auuuuaccuauuuau

SEQ ID NO: 4207573 - RNA, 22 nt, Yersinia pestis KIM
auuuuacugccacugacugcuu

SEQ ID NO: 4207574 - RNA, 15 nt, Yersinia pestis KIM
auuuuacuuugaaau

SEQ ID NO: 4207575 - RNA, 19 nt, Yersinia pestis KIM
auuuuagcggccucuagcu

SEQ ID NO: 4207576 - RNA, 18 nt, Yersinia pestis KIM
auuuuagguccaggcgcu

SEQ ID NO: 4207577 - RNA, 13 nt, Yersinia pestis KIM
auuuuagugauga

SEQ ID NO: 4207578 - RNA, 19 nt, Yersinia pestis KIM
auuuuauauuaucucgauu

SEQ ID NO: 4207579 - RNA, 21 nt, Yersinia pestis KIM
auuuuauccucuuccaauugg

SEQ ID NO: 4207580 - RNA, 18 nt, Yersinia pestis KIM
auuuuaucuguuguauac

SEQ ID NO: 4207581 - RNA, 22 nt, Yersinia pestis KIM
auuuuauuaccaaggcaugaua

SEQ ID NO: 4207582 - RNA, 22 nt, Yersinia pestis KIM
auuuuauuguuuucguuuaaaa

SEQ ID NO: 4207583 - RNA, 16 nt, Yersinia pestis KIM
auuuucaugauccaca

SEQ ID NO: 4207584 - RNA, 19 nt, Yersinia pestis KIM
auuuucauugauacaaaua

SEQ ID NO: 4207585 - RNA, 15 nt, Yersinia pestis KIM
auuuucauuuuaaca

SEQ ID NO: 4207586 - RNA, 14 nt, Yersinia pestis KIM
auuuucccucugcc

SEQ ID NO: 4207587 - RNA, 15 nt, Yersinia pestis KIM
auuuucccugugcaa

SEQ ID NO: 4207588 - RNA, 19 nt, Yersinia pestis KIM
auuuucccugugcaaucaa

SEQ ID NO: 4207589 - RNA, 21 nt, Yersinia pestis KIM
auuuucccugugcaaucaagg

SEQ ID NO: 4207590 - RNA, 19 nt, Yersinia pestis KIM
auuuuccgcagcucaccua

SEQ ID NO: 4207591 - RNA, 13 nt, Yersinia pestis KIM
auuuuccugcaua

SEQ ID NO: 4207592 - RNA, 15 nt, Yersinia pestis KIM
auuuucgaacaacau

SEQ ID NO: 4207593 - RNA, 15 nt, Yersinia pestis KIM
auuuucgaacuuaac

SEQ ID NO: 4207594 - RNA, 22 nt, Yersinia pestis KIM
auuuucgaacuuaacuacugca

SEQ ID NO: 4207595 - RNA, 20 nt, Yersinia pestis KIM
auuuucgcccuaacauugag

SEQ ID NO: 4207596 - RNA, 19 nt, Yersinia pestis KIM
auuuucggucauacacaug

SEQ ID NO: 4207597 - RNA, 22 nt, Yersinia pestis KIM
auuuucguggaaaucgggugau

SEQ ID NO: 4207598 - RNA, 16 nt, Yersinia pestis KIM
auuuucuacugaauaa

SEQ ID NO: 4207599 - RNA, 13 nt, Yersinia pestis KIM
auuuucuauacca

SEQ ID NO: 4207600 - RNA, 19 nt, Yersinia pestis KIM
auuuucuauaccaauugau

SEQ ID NO: 4207601 - RNA, 23 nt, Yersinia pestis KIM
auuuucuaucucauccagcaacu

SEQ ID NO: 4207602 - RNA, 20 nt, Yersinia pestis KIM
auuuucuggugagcaucaac

SEQ ID NO: 4207603 - RNA, 19 nt, Yersinia pestis KIM
auuuugaggauauuagggc

SEQ ID NO: 4207604 - RNA, 16 nt, Yersinia pestis KIM
auuuugagucugggca

SEQ ID NO: 4207605 - RNA, 22 nt, Yersinia pestis KIM
auuuugcacacgauuaccugca

SEQ ID NO: 4207606 - RNA, 20 nt, Yersinia pestis KIM
auuuuggccgcuuugguugc

SEQ ID NO: 4207607 - RNA, 14 nt, Yersinia pestis KIM
auuuuggcuuucag

SEQ ID NO: 4207608 - RNA, 15 nt, Yersinia pestis KIM
auuuugggcaauuua

SEQ ID NO: 4207609 - RNA, 19 nt, Yersinia pestis KIM
auuuugggcaauuuaucaa

SEQ ID NO: 4207610 - RNA, 16 nt, Yersinia pestis KIM
auuuugggcuaaaacu

SEQ ID NO: 4207611 - RNA, 18 nt, Yersinia pestis KIM
auuuuguacaacuucuuc

SEQ ID NO: 4207612 - RNA, 12 nt, Yersinia pestis KIM
auuuugugggaa

SEQ ID NO: 4207613 - RNA, 22 nt, Yersinia pestis KIM
auuuuguuuguaaauuuuaaac

SEQ ID NO: 4207614 - RNA, 19 nt, Yersinia pestis KIM
auuuuuacggcuugccggu

SEQ ID NO: 4207615 - RNA, 18 nt, Yersinia pestis KIM
auuuuuauaaucaucuac

SEQ ID NO: 4207616 - RNA, 13 nt, Yersinia pestis KIM
auuuuuauauuuu

SEQ ID NO: 4207617 - RNA, 18 nt, Yersinia pestis KIM
auuuuuaucaauggggau

SEQ ID NO: 4207618 - RNA, 19 nt, Yersinia pestis KIM
auuuuuauguuuaucaccc

SEQ ID NO: 4207619 - RNA, 20 nt, Yersinia pestis KIM
auuuuucaccuugcgcaauu

SEQ ID NO: 4207620 - RNA, 15 nt, Yersinia pestis KIM
auuuuucccugcuga

SEQ ID NO: 4207621 - RNA, 22 nt, Yersinia pestis KIM
auuuuucccugcugaucgccaa

SEQ ID NO: 4207622 - RNA, 14 nt, Yersinia pestis KIM
auuuuucgcaguaa

SEQ ID NO: 4207623 - RNA, 21 nt, Yersinia pestis KIM
auuuuucggugaaccaucaac

SEQ ID NO: 4207624 - RNA, 15 nt, Yersinia pestis KIM
auuuuucguccacua

SEQ ID NO: 4207625 - RNA, 20 nt, Yersinia pestis KIM
auuuuucuguaucgaauuga

SEQ ID NO: 4207626 - RNA, 21 nt, Yersinia pestis KIM
auuuuucuguaucgaauugau

SEQ ID NO: 4207627 - RNA, 20 nt, Yersinia pestis KIM
auuuuucuguucagauuuac

SEQ ID NO: 4207628 - RNA, 18 nt, Yersinia pestis KIM
auuuuugcauauaaaaca

SEQ ID NO: 4207629 - RNA, 12 nt, Yersinia pestis KIM
auuuuuguugaa

SEQ ID NO: 4207630 - RNA, 21 nt, Yersinia pestis KIM
auuuuuuaugucagagauaaa

SEQ ID NO: 4207631 - RNA, 15 nt, Yersinia pestis KIM
auuuuuuugaugcau

SEQ ID NO: 4207632 - RNA, 18 nt, Yersinia pestis KIM
auuuuuuugaugcauccu

SEQ ID NO: 4207633 - RNA, 15 nt, Yersinia pestis KIM
caaaaaaaaagccug

SEQ ID NO: 4207634 - RNA, 19 nt, Yersinia pestis KIM
caaaaaaagggcgcugaca

SEQ ID NO: 4207635 - RNA, 12 nt, Yersinia pestis KIM
caaaaaacaaac

SEQ ID NO: 4207636 - RNA, 20 nt, Yersinia pestis KIM
caaaaaauauuaauccauag

SEQ ID NO: 4207637 - RNA, 18 nt, Yersinia pestis KIM
caaaaacccauuaaaaac

SEQ ID NO: 4207638 - RNA, 20 nt, Yersinia pestis KIM
caaaaacccauuaaaaacaa

SEQ ID NO: 4207639 - RNA, 21 nt, Yersinia pestis KIM
caaaaacccauuaaaaacaaa

SEQ ID NO: 4207640 - RNA, 20 nt, Yersinia pestis KIM
caaaaauaaacgggcuucca

SEQ ID NO: 4207641 - RNA, 17 nt, Yersinia pestis KIM
caaaaauacaaaaagcg

SEQ ID NO: 4207642 - RNA, 21 nt, Yersinia pestis KIM
caaaacaauaucuauuugagu

SEQ ID NO: 4207643 - RNA, 14 nt, Yersinia pestis KIM
caaauaauuacgua

SEQ ID NO: 4207644 - RNA, 20 nt, Yersinia pestis KIM
caaauaauucagacggcaga

SEQ ID NO: 4207645 - RNA, 13 nt, Yersinia pestis KIM
caaauacacauaa

SEQ ID NO: 4207646 - RNA, 23 nt, Yersinia pestis KIM
caaauacauauaaccaucaaaua

SEQ ID NO: 4207647 - RNA, 22 nt, Yersinia pestis KIM
caaauacccuaauucagauguu

SEQ ID NO: 4207648 - RNA, 19 nt, Yersinia pestis KIM
caaauaccgggacuaccaa

SEQ ID NO: 4207649 - RNA, 22 nt, Yersinia pestis KIM
caaauacgaccgucaccaaaua

SEQ ID NO: 4207650 - RNA, 22 nt, Yersinia pestis KIM
caaauacggcgaaauauaaaac

SEQ ID NO: 4207651 - RNA, 14 nt, Yersinia pestis KIM
caaauacugcugug

SEQ ID NO: 4207652 - RNA, 15 nt, Yersinia pestis KIM
caaauagagcaccaa

SEQ ID NO: 4207653 - RNA, 18 nt, Yersinia pestis KIM
caaauagauagcaaucaa

SEQ ID NO: 4207654 - RNA, 15 nt, Yersinia pestis KIM
caaauagauuuaacu

SEQ ID NO: 4207655 - RNA, 21 nt, Yersinia pestis KIM
caaauagcaagccaaaacagc

SEQ ID NO: 4207656 - RNA, 22 nt, Yersinia pestis KIM
caaauagcgcugcagcaucaag

SEQ ID NO: 4207657 - RNA, 15 nt, Yersinia pestis KIM
caaauagguuuuacu

SEQ ID NO: 4207658 - RNA, 16 nt, Yersinia pestis KIM
caaauagguuuuacuc

SEQ ID NO: 4207659 - RNA, 16 nt, Yersinia pestis KIM
caaauauaaugcugaa

SEQ ID NO: 4207660 - RNA, 18 nt, Yersinia pestis KIM
caaauaucauuauuuuga

SEQ ID NO: 4207661 - RNA, 20 nt, Yersinia pestis KIM
caaauauuaccguuaucaaa

SEQ ID NO: 4207662 - RNA, 17 nt, Yersinia pestis KIM
caaaucacauuucaaau

SEQ ID NO: 4207663 - RNA, 13 nt, Yersinia pestis KIM
caaaucaccuugg

SEQ ID NO: 4207664 - RNA, 18 nt, Yersinia pestis KIM
caaaucaucagacagcca

SEQ ID NO: 4207665 - RNA, 14 nt, Yersinia pestis KIM
caaaucauuuaauu

SEQ ID NO: 4207666 - RNA, 22 nt, Yersinia pestis KIM
caaaucccguuccgcuuccccu

SEQ ID NO: 4207667 - RNA, 23 nt, Yersinia pestis KIM
caaauccgacugauagcaaacaa

SEQ ID NO: 4207668 - RNA, 15 nt, Yersinia pestis KIM
caaaucgauacuuuu

SEQ ID NO: 4207669 - RNA, 22 nt, Yersinia pestis KIM
caaaucugacgguuauuuucug

SEQ ID NO: 4207670 - RNA, 20 nt, Yersinia pestis KIM
caaaucugcccccagcgugc

SEQ ID NO: 4207671 - RNA, 14 nt, Yersinia pestis KIM
caaaucugcucccg

SEQ ID NO: 4207672 - RNA, 20 nt, Yersinia pestis KIM
caaaucugcucccggcgcua

SEQ ID NO: 4207673 - RNA, 16 nt, Yersinia pestis KIM
caaaucuggauaaugu

SEQ ID NO: 4207674 - RNA, 14 nt, Yersinia pestis KIM
caaaugacacuuuu

SEQ ID NO: 4207675 - RNA, 21 nt, Yersinia pestis KIM
caaaugagagcgcagcaguga

SEQ ID NO: 4207676 - RNA, 22 nt, Yersinia pestis KIM
caaaugucaggggguuauccaa

SEQ ID NO: 4207677 - RNA, 19 nt, Yersinia pestis KIM
caaauuauauaagagauga

SEQ ID NO: 4207678 - RNA, 14 nt, Yersinia pestis KIM
caaauucaccagca

SEQ ID NO: 4207679 - RNA, 12 nt, Yersinia pestis KIM
caaauuccccag

SEQ ID NO: 4207680 - RNA, 15 nt, Yersinia pestis KIM
caaauugcuaacaaa

SEQ ID NO: 4207681 - RNA, 21 nt, Yersinia pestis KIM
caaauuguugcaagcugagau

SEQ ID NO: 4207682 - RNA, 19 nt, Yersinia pestis KIM
caaauuuagccgcaacuac

SEQ ID NO: 4207683 - RNA, 17 nt, Yersinia pestis KIM
caaauuugacauuuccu

SEQ ID NO: 4207684 - RNA, 18 nt, Yersinia pestis KIM
caaauuuggccuuucucg

SEQ ID NO: 4207685 - RNA, 15 nt, Yersinia pestis KIM
caaauuuuuccuuua

SEQ ID NO: 4207686 - RNA, 20 nt, Yersinia pestis KIM
caacaaacaguucauaucga

SEQ ID NO: 4207687 - RNA, 18 nt, Yersinia pestis KIM
caacaacgccucaucuuc

SEQ ID NO: 4207688 - RNA, 15 nt, Yersinia pestis KIM
caacaacggugaaca

SEQ ID NO: 4207689 - RNA, 17 nt, Yersinia pestis KIM
caacaacggugaacaga

SEQ ID NO: 4207690 - RNA, 20 nt, Yersinia pestis KIM
caacaacuccuucucgaugc

SEQ ID NO: 4207691 - RNA, 18 nt, Yersinia pestis KIM
caacaagaaaucaaaagg

SEQ ID NO: 4207692 - RNA, 22 nt, Yersinia pestis KIM
caacaauauucgcagccaaaau

SEQ ID NO: 4207693 - RNA, 23 nt, Yersinia pestis KIM
caacaauuuacgguccauaaaau

SEQ ID NO: 4207694 - RNA, 15 nt, Yersinia pestis KIM
caacaauuuccauau

SEQ ID NO: 4207695 - RNA, 13 nt, Yersinia pestis KIM
caacacaaaaacc

SEQ ID NO: 4207696 - RNA, 19 nt, Yersinia pestis KIM
caacacacuuagcuaagcu

SEQ ID NO: 4207697 - RNA, 23 nt, Yersinia pestis KIM
caacacagguucccaucccuuug

SEQ ID NO: 4207698 - RNA, 20 nt, Yersinia pestis KIM
caacaccacacugagcaccg

SEQ ID NO: 4207699 - RNA, 22 nt, Yersinia pestis KIM
caacaccggguaagguaaagaa

SEQ ID NO: 4207700 - RNA, 15 nt, Yersinia pestis KIM
caacaccguaacgcc

SEQ ID NO: 4207701 - RNA, 19 nt, Yersinia pestis KIM
caacacggugaauaaaccc

SEQ ID NO: 4207702 - RNA, 23 nt, Yersinia pestis KIM
caacacuccucuuucuuaauaau

SEQ ID NO: 4207703 - RNA, 20 nt, Yersinia pestis KIM
caacacuucuggccgcucuu

SEQ ID NO: 4207704 - RNA, 20 nt, Yersinia pestis KIM
caacagaacuaauaucaaca

SEQ ID NO: 4207705 - RNA, 22 nt, Yersinia pestis KIM
caacagaacuaauaucaacaga

SEQ ID NO: 4207706 - RNA, 16 nt, Yersinia pestis KIM
caacagacucacucuc

SEQ ID NO: 4207707 - RNA, 12 nt, Yersinia pestis KIM
caacagagaaau

SEQ ID NO: 4207708 - RNA, 14 nt, Yersinia pestis KIM
caacagauaaagcu

SEQ ID NO: 4207709 - RNA, 21 nt, Yersinia pestis KIM
caacagauaauuggcaauaau

SEQ ID NO: 4207710 - RNA, 22 nt, Yersinia pestis KIM
caacagauaauuggcaauaaug

SEQ ID NO: 4207711 - RNA, 17 nt, Yersinia pestis KIM
caacagcaucaucaaau

SEQ ID NO: 4207712 - RNA, 12 nt, Yersinia pestis KIM
caacagcauuac

SEQ ID NO: 4207713 - RNA, 15 nt, Yersinia pestis KIM
caacagcauuaccaa

SEQ ID NO: 4207714 - RNA, 16 nt, Yersinia pestis KIM
caacagccauauuuuu

SEQ ID NO: 4207715 - RNA, 17 nt, Yersinia pestis KIM
caacagcgcucauagca

SEQ ID NO: 4207716 - RNA, 18 nt, Yersinia pestis KIM
caacagcgcucauagcaa

SEQ ID NO: 4207717 - RNA, 13 nt, Yersinia pestis KIM
caacaggccaccu

SEQ ID NO: 4207718 - RNA, 19 nt, Yersinia pestis KIM
caacagucacaccaacacu

SEQ ID NO: 4207719 - RNA, 21 nt, Yersinia pestis KIM
caacagugcaacauuaaaaau

SEQ ID NO: 4207720 - RNA, 22 nt, Yersinia pestis KIM
caacaguuacgcgucugcuggc

SEQ ID NO: 4207721 - RNA, 22 nt, Yersinia pestis KIM
caacaguuauuuuaauugcuga

SEQ ID NO: 4207722 - RNA, 15 nt, Yersinia pestis KIM
caacauaaguaauaa

SEQ ID NO: 4207723 - RNA, 17 nt, Yersinia pestis KIM
caacauaaguaauaagu

SEQ ID NO: 4207724 - RNA, 23 nt, Yersinia pestis KIM
caacauacuggcuaauauaucuc

SEQ ID NO: 4207725 - RNA, 14 nt, Yersinia pestis KIM
caacaucaaaugaa

SEQ ID NO: 4207726 - RNA, 15 nt, Yersinia pestis KIM
caacaucauauauua

SEQ ID NO: 4207727 - RNA, 15 nt, Yersinia pestis KIM
caacaucucgccaaa

SEQ ID NO: 4207728 - RNA, 18 nt, Yersinia pestis KIM
caacaucucgccaaagua

SEQ ID NO: 4207729 - RNA, 12 nt, Yersinia pestis KIM
caacaucuucca

SEQ ID NO: 4207730 - RNA, 14 nt, Yersinia pestis KIM
caacaugguccaca

SEQ ID NO: 4207731 - RNA, 15 nt, Yersinia pestis KIM
caacaugguccacag

SEQ ID NO: 4207732 - RNA, 13 nt, Yersinia pestis KIM
caacauuaaaaau

SEQ ID NO: 4207733 - RNA, 23 nt, Yersinia pestis KIM
caacauuaaaaauacaaccaaca

SEQ ID NO: 4207734 - RNA, 15 nt, Yersinia pestis KIM
caacauuauccguuu

SEQ ID NO: 4207735 - RNA, 22 nt, Yersinia pestis KIM
caacauuguccugcaauccucc

SEQ ID NO: 4207736 - RNA, 15 nt, Yersinia pestis KIM
caacauuuguugcaa

SEQ ID NO: 4207737 - RNA, 16 nt, Yersinia pestis KIM
caacauuuuuagcuuc

SEQ ID NO: 4207738 - RNA, 13 nt, Yersinia pestis KIM
caaccaacaaaca

SEQ ID NO: 4207739 - RNA, 13 nt, Yersinia pestis KIM
caaccaacaccaa

SEQ ID NO: 4207740 - RNA, 21 nt, Yersinia pestis KIM
caaccaagacauaaugccggc

SEQ ID NO: 4207741 - RNA, 18 nt, Yersinia pestis KIM
caaccaaucguugcuggu

SEQ ID NO: 4207742 - RNA, 16 nt, Yersinia pestis KIM
caaccaccaaagauac

SEQ ID NO: 4207743 - RNA, 20 nt, Yersinia pestis KIM
caaccaccuuuaccaugcuc

SEQ ID NO: 4207744 - RNA, 15 nt, Yersinia pestis KIM
caaccacgacgugcu

SEQ ID NO: 4207745 - RNA, 21 nt, Yersinia pestis KIM
caaccacgguaauagcuuaau

SEQ ID NO: 4207746 - RNA, 14 nt, Yersinia pestis KIM
caaccaggccgcca

SEQ ID NO: 4207747 - RNA, 21 nt, Yersinia pestis KIM
caaccaggccgccaucaucau

SEQ ID NO: 4207748 - RNA, 15 nt, Yersinia pestis KIM
caaccagugcucgcu

SEQ ID NO: 4207749 - RNA, 22 nt, Yersinia pestis KIM
caaccaugcugcccgcacacug

SEQ ID NO: 4207750 - RNA, 17 nt, Yersinia pestis KIM
caaccauugacuagcca

SEQ ID NO: 4207751 - RNA, 18 nt, Yersinia pestis KIM
caacccaauaauaaucca

SEQ ID NO: 4207752 - RNA, 22 nt, Yersinia pestis KIM
caacccagacaagaaugccugc

SEQ ID NO: 4207753 - RNA, 16 nt, Yersinia pestis KIM
caaccccaucagcaua

SEQ ID NO: 4207754 - RNA, 17 nt, Yersinia pestis KIM
caaccccaucagcauau

SEQ ID NO: 4207755 - RNA, 17 nt, Yersinia pestis KIM
caacccccgaacacucg

SEQ ID NO: 4207756 - RNA, 18 nt, Yersinia pestis KIM
caaccccuucaagcaccc

SEQ ID NO: 4207757 - RNA, 15 nt, Yersinia pestis KIM
caagcaagcggcagc

SEQ ID NO: 4207758 - RNA, 19 nt, Yersinia pestis KIM
caagcaagcggcagcgcug

SEQ ID NO: 4207759 - RNA, 13 nt, Yersinia pestis KIM
caagcacacuggu

SEQ ID NO: 4207760 - RNA, 21 nt, Yersinia pestis KIM
caagcagacgcacccggcugg

SEQ ID NO: 4207761 - RNA, 19 nt, Yersinia pestis KIM
caagcagugucagggcaau

SEQ ID NO: 4207762 - RNA, 24 nt, Yersinia pestis KIM
caagcagugucagggcaauaacaa

SEQ ID NO: 4207763 - RNA, 19 nt, Yersinia pestis KIM
caagcauacguugccagcc

SEQ ID NO: 4207764 - RNA, 12 nt, Yersinia pestis KIM
caagcauagaag

SEQ ID NO: 4207765 - RNA, 13 nt, Yersinia pestis KIM
caagcauagaaga

SEQ ID NO: 4207766 - RNA, 16 nt, Yersinia pestis KIM
caagccaaacaaauga

SEQ ID NO: 4207767 - RNA, 19 nt, Yersinia pestis KIM
caagccaauauuacggccc

SEQ ID NO: 4207768 - RNA, 14 nt, Yersinia pestis KIM
caagccaccaccac

SEQ ID NO: 4207769 - RNA, 16 nt, Yersinia pestis KIM
caagccaccgcuggug

SEQ ID NO: 4207770 - RNA, 17 nt, Yersinia pestis KIM
caagccaccgcuggugg

SEQ ID NO: 4207771 - RNA, 23 nt, Yersinia pestis KIM
caagccagcgaggcuucucagca

SEQ ID NO: 4207772 - RNA, 14 nt, Yersinia pestis KIM
caagccaguaacua

SEQ ID NO: 4207773 - RNA, 21 nt, Yersinia pestis KIM
caagccccuauaauuuguuua

SEQ ID NO: 4207774 - RNA, 17 nt, Yersinia pestis KIM
caagcccgaaauucagu

SEQ ID NO: 4207775 - RNA, 17 nt, Yersinia pestis KIM
caagcccuuuggcaauc

SEQ ID NO: 4207776 - RNA, 19 nt, Yersinia pestis KIM
caagccgauaaucaauuug

SEQ ID NO: 4207777 - RNA, 22 nt, Yersinia pestis KIM
caagccgauaaucccugccaga

SEQ ID NO: 4207778 - RNA, 21 nt, Yersinia pestis KIM
caagccgcguucaaaucugcu

SEQ ID NO: 4207779 - RNA, 23 nt, Yersinia pestis KIM
caagccucuagcuaacagugacc

SEQ ID NO: 4207780 - RNA, 23 nt, Yersinia pestis KIM
caagccuucauucaauugaucua

SEQ ID NO: 4207781 - RNA, 18 nt, Yersinia pestis KIM
caagcgcgguuacuguua

SEQ ID NO: 4207782 - RNA, 19 nt, Yersinia pestis KIM
caagcgcgguuacuguuac

SEQ ID NO: 4207783 - RNA, 14 nt, Yersinia pestis KIM
caagcgcuguuaac

SEQ ID NO: 4207784 - RNA, 17 nt, Yersinia pestis KIM
caagcggcccaucauag

SEQ ID NO: 4207785 - RNA, 18 nt, Yersinia pestis KIM
caagcguacaagaauaac

SEQ ID NO: 4207786 - RNA, 15 nt, Yersinia pestis KIM
caagcguuaacagcg

SEQ ID NO: 4207787 - RNA, 20 nt, Yersinia pestis KIM
caagcguuaugacgccaacu

SEQ ID NO: 4207788 - RNA, 24 nt, Yersinia pestis KIM
caagcguucgaggauaucacucug

SEQ ID NO: 4207789 - RNA, 13 nt, Yersinia pestis KIM
caagcuacaugug

SEQ ID NO: 4207790 - RNA, 19 nt, Yersinia pestis KIM
caagcuacaugugcauuga

SEQ ID NO: 4207791 - RNA, 20 nt, Yersinia pestis KIM
caagcucgccaucgcaccaa

SEQ ID NO: 4207792 - RNA, 20 nt, Yersinia pestis KIM
caagcucucacccaauaaga

SEQ ID NO: 4207793 - RNA, 20 nt, Yersinia pestis KIM
caagcugagauaagccucgg

SEQ ID NO: 4207794 - RNA, 23 nt, Yersinia pestis KIM
caagcuuaguauccgcgccagac

SEQ ID NO: 4207795 - RNA, 22 nt, Yersinia pestis KIM
caagcuuuugccacauuucccu

SEQ ID NO: 4207796 - RNA, 23 nt, Yersinia pestis KIM
caaggaaaccaccuaauacagca

SEQ ID NO: 4207797 - RNA, 16 nt, Yersinia pestis KIM
caaggaaggcuauuuu

SEQ ID NO: 4207798 - RNA, 17 nt, Yersinia pestis KIM
caaggacgaaggguaaa

SEQ ID NO: 4207799 - RNA, 21 nt, Yersinia pestis KIM
caaggagaucgcucucacccu

SEQ ID NO: 4207800 - RNA, 21 nt, Yersinia pestis KIM
caaggauaagcaguucuggcu

SEQ ID NO: 4207801 - RNA, 17 nt, Yersinia pestis KIM
caaggauggggcugcca

SEQ ID NO: 4207802 - RNA, 19 nt, Yersinia pestis KIM
caaggcagcaagcaaacga

SEQ ID NO: 4207803 - RNA, 14 nt, Yersinia pestis KIM
caaggccagcgccc

SEQ ID NO: 4207804 - RNA, 17 nt, Yersinia pestis KIM
caaggcggaauagagga

SEQ ID NO: 4207805 - RNA, 16 nt, Yersinia pestis KIM
caaggcggcagagcca

SEQ ID NO: 4207806 - RNA, 12 nt, Yersinia pestis KIM
caaggcuaaccg

SEQ ID NO: 4207807 - RNA, 19 nt, Yersinia pestis KIM
caaggcucuggcaauggcu

SEQ ID NO: 4207808 - RNA, 21 nt, Yersinia pestis KIM
caaggcuuuaauaucuuuaaa

SEQ ID NO: 4207809 - RNA, 18 nt, Yersinia pestis KIM
caagggcaauguguuugc

SEQ ID NO: 4207810 - RNA, 17 nt, Yersinia pestis KIM
caaggguauaacucauc

SEQ ID NO: 4207811 - RNA, 16 nt, Yersinia pestis KIM
caagguaaugguaaaa

SEQ ID NO: 4207812 - RNA, 16 nt, Yersinia pestis KIM
caaggucgccucuggg

SEQ ID NO: 4207813 - RNA, 21 nt, Yersinia pestis KIM
caaggugccauaaauaccaau

SEQ ID NO: 4207814 - RNA, 24 nt, Yersinia pestis KIM
caagguucgaaaaaacaucacacu

SEQ ID NO: 4207815 - RNA, 12 nt, Yersinia pestis KIM
caaguaaaaaaa

SEQ ID NO: 4207816 - RNA, 17 nt, Yersinia pestis KIM
caaguaaaaaaaaccug

SEQ ID NO: 4207817 - RNA, 20 nt, Yersinia pestis KIM
caaguaaaaaaaaccuggcu

SEQ ID NO: 4207818 - RNA, 17 nt, Yersinia pestis KIM
caaguaaaagucagcaa

SEQ ID NO: 4207819 - RNA, 16 nt, Yersinia pestis KIM
caagucaauaaauaaa

SEQ ID NO: 4207820 - RNA, 23 nt, Yersinia pestis KIM
caaguccuccuugagauccucca

SEQ ID NO: 4207821 - RNA, 15 nt, Yersinia pestis KIM
caagucuugaagagu

SEQ ID NO: 4207822 - RNA, 17 nt, Yersinia pestis KIM
caagucuugaagaguga

SEQ ID NO: 4207823 - RNA, 18 nt, Yersinia pestis KIM
caagugcuuuuuucacac

SEQ ID NO: 4207824 - RNA, 23 nt, Yersinia pestis KIM
caaguuacuuuuuuauuuuacuu

SEQ ID NO: 4207825 - RNA, 12 nt, Yersinia pestis KIM
caaguucaagca

SEQ ID NO: 4207826 - RNA, 18 nt, Yersinia pestis KIM
caaguucgccuucagcgu

SEQ ID NO: 4207827 - RNA, 18 nt, Yersinia pestis KIM
caaguuguggauccagca

SEQ ID NO: 4207828 - RNA, 15 nt, Yersinia pestis KIM
caaguuucacuuuca

SEQ ID NO: 4207829 - RNA, 15 nt, Yersinia pestis KIM
caauaaaaacgccuc

SEQ ID NO: 4207830 - RNA, 19 nt, Yersinia pestis KIM
caauaaaagguaggccaga

SEQ ID NO: 4207831 - RNA, 16 nt, Yersinia pestis KIM
caauaaaauaagcagg

SEQ ID NO: 4207832 - RNA, 15 nt, Yersinia pestis KIM
caauaaaauuaccca

SEQ ID NO: 4207833 - RNA, 14 nt, Yersinia pestis KIM
caauaaaucgccac

SEQ ID NO: 4207834 - RNA, 22 nt, Yersinia pestis KIM
caauaacaccgucuuugaccga

SEQ ID NO: 4207835 - RNA, 20 nt, Yersinia pestis KIM
caauaaccucaaaaggaugg

SEQ ID NO: 4207836 - RNA, 15 nt, Yersinia pestis KIM
caauaaccucagagg

SEQ ID NO: 4207837 - RNA, 17 nt, Yersinia pestis KIM
caauaaccucagccuca

SEQ ID NO: 4207838 - RNA, 21 nt, Yersinia pestis KIM
caauaaccucagccucauuca

SEQ ID NO: 4207839 - RNA, 21 nt, Yersinia pestis KIM
caauaaccucaggggccaaca

SEQ ID NO: 4207840 - RNA, 18 nt, Yersinia pestis KIM
caauaacuccacuucuuc

SEQ ID NO: 4207841 - RNA, 12 nt, Yersinia pestis KIM
caauaagccaga

SEQ ID NO: 4207842 - RNA, 16 nt, Yersinia pestis KIM
caauaagcuguaaugc

SEQ ID NO: 4207843 - RNA, 19 nt, Yersinia pestis KIM
caauaagugaaacaaauac

SEQ ID NO: 4207844 - RNA, 24 nt, Yersinia pestis KIM
caauaagugcaaacuuaaaaauca

SEQ ID NO: 4207845 - RNA, 14 nt, Yersinia pestis KIM
caauaauaaaaaaa

SEQ ID NO: 4207846 - RNA, 17 nt, Yersinia pestis KIM
caauaauaaaaaaaaau

SEQ ID NO: 4207847 - RNA, 19 nt, Yersinia pestis KIM
caauaauaaaaaaaaauaa

SEQ ID NO: 4207848 - RNA, 20 nt, Yersinia pestis KIM
caauaauaaaaaaaaauaaa

SEQ ID NO: 4207849 - RNA, 13 nt, Yersinia pestis KIM
caauaauaagccg

SEQ ID NO: 4207850 - RNA, 14 nt, Yersinia pestis KIM
caauaauaagccgc

SEQ ID NO: 4207851 - RNA, 14 nt, Yersinia pestis KIM
caauaaucucagca

SEQ ID NO: 4207852 - RNA, 18 nt, Yersinia pestis KIM
caauaauuaauuucacug

SEQ ID NO: 4207853 - RNA, 12 nt, Yersinia pestis KIM
caauaauucaga

SEQ ID NO: 4207854 - RNA, 13 nt, Yersinia pestis KIM
caauaauucagau

SEQ ID NO: 4207855 - RNA, 18 nt, Yersinia pestis KIM
caauaauucagaugagaa

SEQ ID NO: 4207856 - RNA, 16 nt, Yersinia pestis KIM
caauaauugcacccca

SEQ ID NO: 4207857 - RNA, 13 nt, Yersinia pestis KIM
caauacaccagac

SEQ ID NO: 4207858 - RNA, 19 nt, Yersinia pestis KIM
caauacaccagacucugcu

SEQ ID NO: 4207859 - RNA, 12 nt, Yersinia pestis KIM
caauacagcaaa

SEQ ID NO: 4207860 - RNA, 13 nt, Yersinia pestis KIM
caauacauagaag

SEQ ID NO: 4207861 - RNA, 16 nt, Yersinia pestis KIM
caauaccauauaccca

SEQ ID NO: 4207862 - RNA, 14 nt, Yersinia pestis KIM
caauaccauuuugc

SEQ ID NO: 4207863 - RNA, 16 nt, Yersinia pestis KIM
caauaccgccaauauc

SEQ ID NO: 4207864 - RNA, 16 nt, Yersinia pestis KIM
caauaccgccacacaa

SEQ ID NO: 4207865 - RNA, 14 nt, Yersinia pestis KIM
caauacggcacuca

SEQ ID NO: 4207866 - RNA, 14 nt, Yersinia pestis KIM
caauacuacggcag

SEQ ID NO: 4207867 - RNA, 14 nt, Yersinia pestis KIM
caauacuacuuucu

SEQ ID NO: 4207868 - RNA, 14 nt, Yersinia pestis KIM
caauacugccuaac

SEQ ID NO: 4207869 - RNA, 19 nt, Yersinia pestis KIM
caauacuggccaugugugu

SEQ ID NO: 4207870 - RNA, 16 nt, Yersinia pestis KIM
caauagaaaagcgccu

SEQ ID NO: 4207871 - RNA, 15 nt, Yersinia pestis KIM
caauagacaaaagug

SEQ ID NO: 4207872 - RNA, 16 nt, Yersinia pestis KIM
caaugucaugcaauua

SEQ ID NO: 4207873 - RNA, 19 nt, Yersinia pestis KIM
caaugucaugcaauuacug

SEQ ID NO: 4207874 - RNA, 22 nt, Yersinia pestis KIM
caaugucuggccguaacuccag

SEQ ID NO: 4207875 - RNA, 18 nt, Yersinia pestis KIM
caaugugccgcgcaacca

SEQ ID NO: 4207876 - RNA, 23 nt, Yersinia pestis KIM
caauguguugaauauccaauggu

SEQ ID NO: 4207877 - RNA, 18 nt, Yersinia pestis KIM
caauguugcugaauaaau

SEQ ID NO: 4207878 - RNA, 19 nt, Yersinia pestis KIM
caauguugcugaauaaaua

SEQ ID NO: 4207879 - RNA, 16 nt, Yersinia pestis KIM
caauguuggcccaaga

SEQ ID NO: 4207880 - RNA, 19 nt, Yersinia pestis KIM
caauuaugacguucaguag

SEQ ID NO: 4207881 - RNA, 20 nt, Yersinia pestis KIM
caauuaugacguucaguagu

SEQ ID NO: 4207882 - RNA, 16 nt, Yersinia pestis KIM
caauuauuuagccugc

SEQ ID NO: 4207883 - RNA, 20 nt, Yersinia pestis KIM
caauuauuuagccugccaau

SEQ ID NO: 4207884 - RNA, 22 nt, Yersinia pestis KIM
caauucaaggccagcacguuuu

SEQ ID NO: 4207885 - RNA, 14 nt, Yersinia pestis KIM
caauucacccauac

SEQ ID NO: 4207886 - RNA, 17 nt, Yersinia pestis KIM
caauucagaagacaaua

SEQ ID NO: 4207887 - RNA, 11 nt, Yersinia pestis KIM
caauucaguuu

SEQ ID NO: 4207888 - RNA, 17 nt, Yersinia pestis KIM
caauucaucagcgcugg

SEQ ID NO: 4207889 - RNA, 19 nt, Yersinia pestis KIM
caauucaucagcgcuggcu

SEQ ID NO: 4207890 - RNA, 22 nt, Yersinia pestis KIM
caauucccaaagcgcagugcuc

SEQ ID NO: 4207891 - RNA, 22 nt, Yersinia pestis KIM
caauucccguuagguucaauuc

SEQ ID NO: 4207892 - RNA, 20 nt, Yersinia pestis KIM
caauucguuuuucauuuuuc

SEQ ID NO: 4207893 - RNA, 21 nt, Yersinia pestis KIM
caauucuugaaauuauauucu

SEQ ID NO: 4207894 - RNA, 18 nt, Yersinia pestis KIM
caauugacuuugccagca

SEQ ID NO: 4207895 - RNA, 20 nt, Yersinia pestis KIM
caauugaguaacugauuaau

SEQ ID NO: 4207896 - RNA, 22 nt, Yersinia pestis KIM
caauugccgucguauagaaaau

SEQ ID NO: 4207897 - RNA, 16 nt, Yersinia pestis KIM
caauugccugauuuuu

SEQ ID NO: 4207898 - RNA, 13 nt, Yersinia pestis KIM
caauuguauaagg

SEQ ID NO: 4207899 - RNA, 22 nt, Yersinia pestis KIM
caauuuagacaugggcagugca

SEQ ID NO: 4207900 - RNA, 20 nt, Yersinia pestis KIM
caauuucaccccgacauuca

SEQ ID NO: 4207901 - RNA, 23 nt, Yersinia pestis KIM
caauuucacgcucgcccaugacc

SEQ ID NO: 4207902 - RNA, 15 nt, Yersinia pestis KIM
caauuucagcuuuua

SEQ ID NO: 4207903 - RNA, 21 nt, Yersinia pestis KIM
caauuucaugcgaauacuuug

SEQ ID NO: 4207904 - RNA, 14 nt, Yersinia pestis KIM
caauuucauuuacg

SEQ ID NO: 4207905 - RNA, 20 nt, Yersinia pestis KIM
caauuuccccugcuucguag

SEQ ID NO: 4207906 - RNA, 16 nt, Yersinia pestis KIM
caauuucucggccaac

SEQ ID NO: 4207907 - RNA, 15 nt, Yersinia pestis KIM
caauuugcccaucuu

SEQ ID NO: 4207908 - RNA, 12 nt, Yersinia pestis KIM
caauuuggccaa

SEQ ID NO: 4207909 - RNA, 20 nt, Yersinia pestis KIM
caauuugucauguugaccaa

SEQ ID NO: 4207910 - RNA, 14 nt, Yersinia pestis KIM
caauuuuauggaua

SEQ ID NO: 4207911 - RNA, 14 nt, Yersinia pestis KIM
caauuuuugauacu

SEQ ID NO: 4207912 - RNA, 22 nt, Yersinia pestis KIM
caauuuuugccuuucugggcug

SEQ ID NO: 4207913 - RNA, 20 nt, Yersinia pestis KIM
caauuuuuugguguccccac

SEQ ID NO: 4207914 - RNA, 20 nt, Yersinia pestis KIM
cacaaagcgcccuucggacg

SEQ ID NO: 4207915 - RNA, 15 nt, Yersinia pestis KIM
cacaaaugcugugcc

SEQ ID NO: 4207916 - RNA, 15 nt, Yersinia pestis KIM
cacaacccgauccag

SEQ ID NO: 4207917 - RNA, 16 nt, Yersinia pestis KIM
cacaacccgcugaugc

SEQ ID NO: 4207918 - RNA, 18 nt, Yersinia pestis KIM
cacaacgcaucaguaaug

SEQ ID NO: 4207919 - RNA, 16 nt, Yersinia pestis KIM
cacaacgcauuacccc

SEQ ID NO: 4207920 - RNA, 20 nt, Yersinia pestis KIM
cacaacggaaggcccagccg

SEQ ID NO: 4207921 - RNA, 17 nt, Yersinia pestis KIM
cacaacugaaugucucu

SEQ ID NO: 4207922 - RNA, 12 nt, Yersinia pestis KIM
cacaauaagccc

SEQ ID NO: 4207923 - RNA, 15 nt, Yersinia pestis KIM
cacaauaauuaggaa

SEQ ID NO: 4207924 - RNA, 23 nt, Yersinia pestis KIM
cacaauagcuaccccuucaguca

SEQ ID NO: 4207925 - RNA, 15 nt, Yersinia pestis KIM
cacaaucaguaaaua

SEQ ID NO: 4207926 - RNA, 23 nt, Yersinia pestis KIM
cacaaucgcgcuguacaacaaga

SEQ ID NO: 4207927 - RNA, 20 nt, Yersinia pestis KIM
cacaaucucuggcaacggca

SEQ ID NO: 4207928 - RNA, 12 nt, Yersinia pestis KIM
cacaaucuucuu

SEQ ID NO: 4207929 - RNA, 19 nt, Yersinia pestis KIM
cacaaucuugcagcgauca

SEQ ID NO: 4207930 - RNA, 13 nt, Yersinia pestis KIM
cacaauguugaua

SEQ ID NO: 4207931 - RNA, 21 nt, Yersinia pestis KIM
cacaauuucaccccgacauuc

SEQ ID NO: 4207932 - RNA, 13 nt, Yersinia pestis KIM
cacacagaaucac

SEQ ID NO: 4207933 - RNA, 14 nt, Yersinia pestis KIM
cacacagaaucacc

SEQ ID NO: 4207934 - RNA, 14 nt, Yersinia pestis KIM
cacaccaacacuga

SEQ ID NO: 4207935 - RNA, 11 nt, Yersinia pestis KIM
cacaccaucag

SEQ ID NO: 4207936 - RNA, 20 nt, Yersinia pestis KIM
cacaccaucaguacgguuca

SEQ ID NO: 4207937 - RNA, 17 nt, Yersinia pestis KIM
cacacccucaacucaaa

SEQ ID NO: 4207938 - RNA, 13 nt, Yersinia pestis KIM
cacaccggcugca

SEQ ID NO: 4207939 - RNA, 18 nt, Yersinia pestis KIM
cacaccggucgccgugcu

SEQ ID NO: 4207940 - RNA, 23 nt, Yersinia pestis KIM
cacacgacugaguuccaaaaugc

SEQ ID NO: 4207941 - RNA, 20 nt, Yersinia pestis KIM
cacacgauuaccugcauauc

SEQ ID NO: 4207942 - RNA, 15 nt, Yersinia pestis KIM
cacacguuaaacccu

SEQ ID NO: 4207943 - RNA, 15 nt, Yersinia pestis KIM
cacacucagacaauc

SEQ ID NO: 4207944 - RNA, 14 nt, Yersinia pestis KIM
cacacugagcaccg

SEQ ID NO: 4207945 - RNA, 18 nt, Yersinia pestis KIM
cacacuggcggacaucuu

SEQ ID NO: 4207946 - RNA, 13 nt, Yersinia pestis KIM
cacagacaaacaa

SEQ ID NO: 4207947 - RNA, 12 nt, Yersinia pestis KIM
cacagacauuug

SEQ ID NO: 4207948 - RNA, 13 nt, Yersinia pestis KIM
cacagauaaacaa

SEQ ID NO: 4207949 - RNA, 15 nt, Yersinia pestis KIM
cacagauaaauaaaa

SEQ ID NO: 4207950 - RNA, 14 nt, Yersinia pestis KIM
cacagaugcuggcu

SEQ ID NO: 4207951 - RNA, 20 nt, Yersinia pestis KIM
cacagcaaaccucuggcgca

SEQ ID NO: 4207952 - RNA, 20 nt, Yersinia pestis KIM
cacagcaaauugcugaaaaa

SEQ ID NO: 4207953 - RNA, 19 nt, Yersinia pestis KIM
cacagcacggcaacaggcu

SEQ ID NO: 4207954 - RNA, 17 nt, Yersinia pestis KIM
cacagcacgguaaccuu

SEQ ID NO: 4207955 - RNA, 15 nt, Yersinia pestis KIM
cacagcauucugcuu

SEQ ID NO: 4207956 - RNA, 16 nt, Yersinia pestis KIM
cacagccuacgggguc

SEQ ID NO: 4207957 - RNA, 23 nt, Yersinia pestis KIM
cacagccugccgggaugacuuuu

SEQ ID NO: 4207958 - RNA, 19 nt, Yersinia pestis KIM
cacagcgaagcguaaauuu

SEQ ID NO: 4207959 - RNA, 21 nt, Yersinia pestis KIM
cacaggcgauagcuucagcau

SEQ ID NO: 4207960 - RNA, 19 nt, Yersinia pestis KIM
cacaggcuucgacaggcaa

SEQ ID NO: 4207961 - RNA, 20 nt, Yersinia pestis KIM
cacaggcuucgacaggcaau

SEQ ID NO: 4207962 - RNA, 19 nt, Yersinia pestis KIM
cacagguucccaucccuuu

SEQ ID NO: 4207963 - RNA, 21 nt, Yersinia pestis KIM
cacaguagaagcuaccagcac

SEQ ID NO: 4207964 - RNA, 18 nt, Yersinia pestis KIM
cacagucauuugaacgug

SEQ ID NO: 4207965 - RNA, 22 nt, Yersinia pestis KIM
cacagucugucguacuuuccuu

SEQ ID NO: 4207966 - RNA, 16 nt, Yersinia pestis KIM
cacagucuuuuuccca

SEQ ID NO: 4207967 - RNA, 22 nt, Yersinia pestis KIM
cacaguuuaucucgcugugccc

SEQ ID NO: 4207968 - RNA, 20 nt, Yersinia pestis KIM
cacaguuuucuuaaaauacu

SEQ ID NO: 4207969 - RNA, 19 nt, Yersinia pestis KIM
cacauaaaaagaaaaaaac

SEQ ID NO: 4207970 - RNA, 18 nt, Yersinia pestis KIM
cacauaaauaaguucagg

SEQ ID NO: 4207971 - RNA, 22 nt, Yersinia pestis KIM
cacauaccuucgguaaucaauu

SEQ ID NO: 4207972 - RNA, 23 nt, Yersinia pestis KIM
cacauaccuucgguaaucaauuu

SEQ ID NO: 4207973 - RNA, 20 nt, Yersinia pestis KIM
cacauagcauggucaucgcu

SEQ ID NO: 4207974 - RNA, 16 nt, Yersinia pestis KIM
cacauagccgucaaua

SEQ ID NO: 4207975 - RNA, 16 nt, Yersinia pestis KIM
cacauagcuguaaaua

SEQ ID NO: 4207976 - RNA, 13 nt, Yersinia pestis KIM
cacauaugcagcu

SEQ ID NO: 4207977 - RNA, 21 nt, Yersinia pestis KIM
cacaucaaccugaucaucaaa

SEQ ID NO: 4207978 - RNA, 11 nt, Yersinia pestis KIM
cacaucacagu

SEQ ID NO: 4207979 - RNA, 17 nt, Yersinia pestis KIM
cacaucaccgacagcau

SEQ ID NO: 4207980 - RNA, 12 nt, Yersinia pestis KIM
cacauccaaugg

SEQ ID NO: 4207981 - RNA, 22 nt, Yersinia pestis KIM
cacaucccggcagcaguuguca

SEQ ID NO: 4207982 - RNA, 22 nt, Yersinia pestis KIM
cacaucgcgcuuuuuaggaugu

SEQ ID NO: 4207983 - RNA, 21 nt, Yersinia pestis KIM
cacaucggucaauaccauauc

SEQ ID NO: 4207984 - RNA, 18 nt, Yersinia pestis KIM
cacaucucggcguaaaca

SEQ ID NO: 4207985 - RNA, 20 nt, Yersinia pestis KIM
cacaucugggucauguggaa

SEQ ID NO: 4207986 - RNA, 16 nt, Yersinia pestis KIM
caccguaacuucuucg

SEQ ID NO: 4207987 - RNA, 16 nt, Yersinia pestis KIM
caccguaucaucacca

SEQ ID NO: 4207988 - RNA, 12 nt, Yersinia pestis KIM
caccguaugaga

SEQ ID NO: 4207989 - RNA, 14 nt, Yersinia pestis KIM
caccgucaucucua

SEQ ID NO: 4207990 - RNA, 15 nt, Yersinia pestis KIM
caccguggcgcgcca

SEQ ID NO: 4207991 - RNA, 18 nt, Yersinia pestis KIM
caccguggcgcgccacuu

SEQ ID NO: 4207992 - RNA, 20 nt, Yersinia pestis KIM
caccgugguuugcucuuccc

SEQ ID NO: 4207993 - RNA, 15 nt, Yersinia pestis KIM
caccuaaccaaacau

SEQ ID NO: 4207994 - RNA, 17 nt, Yersinia pestis KIM
caccuaaccaaacauug

SEQ ID NO: 4207995 - RNA, 19 nt, Yersinia pestis KIM
caccuaaccaaacauuguu

SEQ ID NO: 4207996 - RNA, 23 nt, Yersinia pestis KIM
caccuaagccucucucacuuugg

SEQ ID NO: 4207997 - RNA, 14 nt, Yersinia pestis KIM
caccuaauacagca

SEQ ID NO: 4207998 - RNA, 17 nt, Yersinia pestis KIM
caccuaauacagcacca

SEQ ID NO: 4207999 - RNA, 16 nt, Yersinia pestis KIM
caccuaauccaaggcg

SEQ ID NO: 4208000 - RNA, 16 nt, Yersinia pestis KIM
caccucuugcauacuc

SEQ ID NO: 4208001 - RNA, 21 nt, Yersinia pestis KIM
caccucuugcauacucaggcc

SEQ ID NO: 4208002 - RNA, 23 nt, Yersinia pestis KIM
caccugaguaauauuauucaauu

SEQ ID NO: 4208003 - RNA, 21 nt, Yersinia pestis KIM
caccugauaagccgucagcuu

SEQ ID NO: 4208004 - RNA, 16 nt, Yersinia pestis KIM
caccugaucaugccac

SEQ ID NO: 4208005 - RNA, 22 nt, Yersinia pestis KIM
caccugcgggauagcauaaaua

SEQ ID NO: 4208006 - RNA, 15 nt, Yersinia pestis KIM
caccugcuggugcca

SEQ ID NO: 4208007 - RNA, 17 nt, Yersinia pestis KIM
caccuggcccuggaaca

SEQ ID NO: 4208008 - RNA, 14 nt, Yersinia pestis KIM
caccuguuaaaaga

SEQ ID NO: 4208009 - RNA, 14 nt, Yersinia pestis KIM
caccuuauccaaua

SEQ ID NO: 4208010 - RNA, 19 nt, Yersinia pestis KIM
caccuuggaaaacagcaac

SEQ ID NO: 4208011 - RNA, 15 nt, Yersinia pestis KIM
cacgaaaaaauggca

SEQ ID NO: 4208012 - RNA, 18 nt, Yersinia pestis KIM
cacgaacaaucgcccccu

SEQ ID NO: 4208013 - RNA, 22 nt, Yersinia pestis KIM
cacgaaccgaacgaacccgaua

SEQ ID NO: 4208014 - RNA, 17 nt, Yersinia pestis KIM
cacgaaccuucucugca

SEQ ID NO: 4208015 - RNA, 17 nt, Yersinia pestis KIM
cacgaauuuugaggaua

SEQ ID NO: 4208016 - RNA, 21 nt, Yersinia pestis KIM
cacgacaacaaagccgcugcu

SEQ ID NO: 4208017 - RNA, 16 nt, Yersinia pestis KIM
cacgacaugagcaugc

SEQ ID NO: 4208018 - RNA, 20 nt, Yersinia pestis KIM
cacgacaugagcaugccuga

SEQ ID NO: 4208019 - RNA, 13 nt, Yersinia pestis KIM
cacgaccugugca

SEQ ID NO: 4208020 - RNA, 16 nt, Yersinia pestis KIM
cacgacuuuuggcccc

SEQ ID NO: 4208021 - RNA, 21 nt, Yersinia pestis KIM
cacgaggaaaacgccagcaga

SEQ ID NO: 4208022 - RNA, 22 nt, Yersinia pestis KIM
cacgaggaaaacgccagcagac

SEQ ID NO: 4208023 - RNA, 13 nt, Yersinia pestis KIM
cacgaggacaggu

SEQ ID NO: 4208024 - RNA, 17 nt, Yersinia pestis KIM
cacgauacgacuucuua

SEQ ID NO: 4208025 - RNA, 12 nt, Yersinia pestis KIM
cacgaucagcuc

SEQ ID NO: 4208026 - RNA, 21 nt, Yersinia pestis KIM
cacgaucagugaagagauaac

SEQ ID NO: 4208027 - RNA, 23 nt, Yersinia pestis KIM
cacgauuaccugcauauccuccc

SEQ ID NO: 4208028 - RNA, 12 nt, Yersinia pestis KIM
cacgcaaauaaa

SEQ ID NO: 4208029 - RNA, 21 nt, Yersinia pestis KIM
cacgcaaauaaagggccugca

SEQ ID NO: 4208030 - RNA, 15 nt, Yersinia pestis KIM
cacgcagcuuuuucu

SEQ ID NO: 4208031 - RNA, 17 nt, Yersinia pestis KIM
cacgcagugcaucuucc

SEQ ID NO: 4208032 - RNA, 14 nt, Yersinia pestis KIM
cacgcaugacggug

SEQ ID NO: 4208033 - RNA, 20 nt, Yersinia pestis KIM
cacgcauuccaucagccaac

SEQ ID NO: 4208034 - RNA, 17 nt, Yersinia pestis KIM
cacgcauuucuugcucg

SEQ ID NO: 4208035 - RNA, 14 nt, Yersinia pestis KIM
cacgccaguguuca

SEQ ID NO: 4208036 - RNA, 12 nt, Yersinia pestis KIM
cacgcccaacuc

SEQ ID NO: 4208037 - RNA, 15 nt, Yersinia pestis KIM
cacgcccaacucuuu

SEQ ID NO: 4208038 - RNA, 13 nt, Yersinia pestis KIM
cacgcccaauucc

SEQ ID NO: 4208039 - RNA, 23 nt, Yersinia pestis KIM
cacgccccaacgguaacccgaua

SEQ ID NO: 4208040 - RNA, 15 nt, Yersinia pestis KIM
cacgcccuacugaga

SEQ ID NO: 4208041 - RNA, 22 nt, Yersinia pestis KIM
cacgccggcuuuuuucucuaca

SEQ ID NO: 4208042 - RNA, 18 nt, Yersinia pestis KIM
cacgcguggauagcggcu

SEQ ID NO: 4208043 - RNA, 16 nt, Yersinia pestis KIM
cacgcuccacacaaaa

SEQ ID NO: 4208044 - RNA, 21 nt, Yersinia pestis KIM
cacgcugaauaacaaaagccc

SEQ ID NO: 4208045 - RNA, 19 nt, Yersinia pestis KIM
cacgcuuaaagcauaacaa

SEQ ID NO: 4208046 - RNA, 14 nt, Yersinia pestis KIM
cacgcuuaaucuuu

SEQ ID NO: 4208047 - RNA, 19 nt, Yersinia pestis KIM
cacgcuuuaagcuaauucu

SEQ ID NO: 4208048 - RNA, 17 nt, Yersinia pestis KIM
cacggaaaguagccauu

SEQ ID NO: 4208049 - RNA, 22 nt, Yersinia pestis KIM
cacggaagguugcccccaccau

SEQ ID NO: 4208050 - RNA, 20 nt, Yersinia pestis KIM
cacggauuaacuuuucuuca

SEQ ID NO: 4208051 - RNA, 12 nt, Yersinia pestis KIM
cacggcaggcgg

SEQ ID NO: 4208052 - RNA, 20 nt, Yersinia pestis KIM
cacggccuaacaacacgcua

SEQ ID NO: 4208053 - RNA, 19 nt, Yersinia pestis KIM
cacggccuauugaauaaca

SEQ ID NO: 4208054 - RNA, 21 nt, Yersinia pestis KIM
cacggcgaguaggucucgccg

SEQ ID NO: 4208055 - RNA, 14 nt, Yersinia pestis KIM
cacggcgaucagug

SEQ ID NO: 4208056 - RNA, 15 nt, Yersinia pestis KIM
cacggcgcuccauca

SEQ ID NO: 4208057 - RNA, 18 nt, Yersinia pestis KIM
cacggcgggcaacagaga

SEQ ID NO: 4208058 - RNA, 16 nt, Yersinia pestis KIM
cacggcuuucaauaaa

SEQ ID NO: 4208059 - RNA, 18 nt, Yersinia pestis KIM
cacgggcgcaauggaaga

SEQ ID NO: 4208060 - RNA, 20 nt, Yersinia pestis KIM
cacgggcgguaaucugcggc

SEQ ID NO: 4208061 - RNA, 13 nt, Yersinia pestis KIM
cacggggaaacag

SEQ ID NO: 4208062 - RNA, 17 nt, Yersinia pestis KIM
cacggguauuugcaaug

SEQ ID NO: 4208063 - RNA, 17 nt, Yersinia pestis KIM
cacgguauugcucucga

SEQ ID NO: 4208064 - RNA, 22 nt, Yersinia pestis KIM
cacggugcgucaguucaagcag

SEQ ID NO: 4208065 - RNA, 19 nt, Yersinia pestis KIM
cacgguguguugaaauuug

SEQ ID NO: 4208066 - RNA, 22 nt, Yersinia pestis KIM
cacgguuaauucaugugagaua

SEQ ID NO: 4208067 - RNA, 13 nt, Yersinia pestis KIM
cacgguucacccc

SEQ ID NO: 4208068 - RNA, 14 nt, Yersinia pestis KIM
cacgguugaaaagu

SEQ ID NO: 4208069 - RNA, 19 nt, Yersinia pestis KIM
cacguacaacucguuaucu

SEQ ID NO: 4208070 - RNA, 18 nt, Yersinia pestis KIM
cacguagcacacgacuga

SEQ ID NO: 4208071 - RNA, 15 nt, Yersinia pestis KIM
cacgucaguuaaaua

SEQ ID NO: 4208072 - RNA, 17 nt, Yersinia pestis KIM
cacguggguauccagug

SEQ ID NO: 4208073 - RNA, 14 nt, Yersinia pestis KIM
cacguucccccgcc

SEQ ID NO: 4208074 - RNA, 20 nt, Yersinia pestis KIM
cacguucggcgucgccaccc

SEQ ID NO: 4208075 - RNA, 21 nt, Yersinia pestis KIM
cacguugagugaucaccugag

SEQ ID NO: 4208076 - RNA, 15 nt, Yersinia pestis KIM
cacuaaaacugaagc

SEQ ID NO: 4208077 - RNA, 12 nt, Yersinia pestis KIM
cacuaaaucaaa

SEQ ID NO: 4208078 - RNA, 16 nt, Yersinia pestis KIM
cacuaaaucaaaagga

SEQ ID NO: 4208079 - RNA, 23 nt, Yersinia pestis KIM
cacuaacgccgcguuagcuauau

SEQ ID NO: 4208080 - RNA, 21 nt, Yersinia pestis KIM
cacuaaggucaucaaggugcc

SEQ ID NO: 4208081 - RNA, 13 nt, Yersinia pestis KIM
cacuaagugcugg

SEQ ID NO: 4208082 - RNA, 14 nt, Yersinia pestis KIM
cacuacauucugau

SEQ ID NO: 4208083 - RNA, 21 nt, Yersinia pestis KIM
cacuaccgucuuggauauuug

SEQ ID NO: 4208084 - RNA, 18 nt, Yersinia pestis KIM
cacuagagcguuacacau

SEQ ID NO: 4208085 - RNA, 13 nt, Yersinia pestis KIM
cacuagcgggccu

SEQ ID NO: 4208086 - RNA, 15 nt, Yersinia pestis KIM
cacuauaauuauuuc

SEQ ID NO: 4208087 - RNA, 18 nt, Yersinia pestis KIM
cacuauaauuucucucaa

SEQ ID NO: 4208088 - RNA, 18 nt, Yersinia pestis KIM
cacuauucuccaacaacu

SEQ ID NO: 4208089 - RNA, 20 nt, Yersinia pestis KIM
cacuauucuccaacaacugc

SEQ ID NO: 4208090 - RNA, 17 nt, Yersinia pestis KIM
cacuauuucguguauau

SEQ ID NO: 4208091 - RNA, 23 nt, Yersinia pestis KIM
cacuauuucguguauaucacuau

SEQ ID NO: 4208092 - RNA, 12 nt, Yersinia pestis KIM
cacucaacugau

SEQ ID NO: 4208093 - RNA, 12 nt, Yersinia pestis KIM
cacucaagccag

SEQ ID NO: 4208094 - RNA, 22 nt, Yersinia pestis KIM
cacucaagccaguaacuacuau

SEQ ID NO: 4208095 - RNA, 19 nt, Yersinia pestis KIM
cacucaagcguacaucagg

SEQ ID NO: 4208096 - RNA, 19 nt, Yersinia pestis KIM
cacucaauaaguagccacu

SEQ ID NO: 4208097 - RNA, 13 nt, Yersinia pestis KIM
cacucaaugucau

SEQ ID NO: 4208098 - RNA, 16 nt, Yersinia pestis KIM
cacucacaacccgcug

SEQ ID NO: 4208099 - RNA, 14 nt, Yersinia pestis KIM
cacucacauaagaa

SEQ ID NO: 4208100 - RNA, 17 nt, Yersinia pestis KIM
cacucacauaagaaagu

SEQ ID NO: 4208101 - RNA, 16 nt, Yersinia pestis KIM
cagaauaguggguaaa

SEQ ID NO: 4208102 - RNA, 15 nt, Yersinia pestis KIM
cagaauauaaaagca

SEQ ID NO: 4208103 - RNA, 14 nt, Yersinia pestis KIM
cagaaucagcccca

SEQ ID NO: 4208104 - RNA, 18 nt, Yersinia pestis KIM
cagaaucgccguagauuu

SEQ ID NO: 4208105 - RNA, 19 nt, Yersinia pestis KIM
cagaaugaaaggcggugaa

SEQ ID NO: 4208106 - RNA, 15 nt, Yersinia pestis KIM
cagaauuaaccguua

SEQ ID NO: 4208107 - RNA, 20 nt, Yersinia pestis KIM
cagaauuucauuguggagga

SEQ ID NO: 4208108 - RNA, 23 nt, Yersinia pestis KIM
cagaauuuuuuuagauaucagaa

SEQ ID NO: 4208109 - RNA, 14 nt, Yersinia pestis KIM
cagacaaacaaccu

SEQ ID NO: 4208110 - RNA, 15 nt, Yersinia pestis KIM
cagacaacagucaca

SEQ ID NO: 4208111 - RNA, 19 nt, Yersinia pestis KIM
cagacaacagucacaccaa

SEQ ID NO: 4208112 - RNA, 21 nt, Yersinia pestis KIM
cagacaacagucacaccaaca

SEQ ID NO: 4208113 - RNA, 17 nt, Yersinia pestis KIM
cagacaaccaauacaca

SEQ ID NO: 4208114 - RNA, 12 nt, Yersinia pestis KIM
cagacaaccauu

SEQ ID NO: 4208115 - RNA, 15 nt, Yersinia pestis KIM
cagacaacugacaac

SEQ ID NO: 4208116 - RNA, 18 nt, Yersinia pestis KIM
cagacaagaaugccugcc

SEQ ID NO: 4208117 - RNA, 18 nt, Yersinia pestis KIM
cagacacaagauaaauac

SEQ ID NO: 4208118 - RNA, 21 nt, Yersinia pestis KIM
cagacacagcaacaaccccau

SEQ ID NO: 4208119 - RNA, 14 nt, Yersinia pestis KIM
cagacaccugauag

SEQ ID NO: 4208120 - RNA, 11 nt, Yersinia pestis KIM
cagacagccau

SEQ ID NO: 4208121 - RNA, 20 nt, Yersinia pestis KIM
cagacaguaaauccugauga

SEQ ID NO: 4208122 - RNA, 23 nt, Yersinia pestis KIM
cagacauauuggucauuuuuccc

SEQ ID NO: 4208123 - RNA, 19 nt, Yersinia pestis KIM
cagacauuuuucuauuucu

SEQ ID NO: 4208124 - RNA, 18 nt, Yersinia pestis KIM
cagaccaaauagcaagcc

SEQ ID NO: 4208125 - RNA, 14 nt, Yersinia pestis KIM
cagaccaaauuccc

SEQ ID NO: 4208126 - RNA, 16 nt, Yersinia pestis KIM
cagaccaaauucccca

SEQ ID NO: 4208127 - RNA, 12 nt, Yersinia pestis KIM
cagaccaaucaa

SEQ ID NO: 4208128 - RNA, 16 nt, Yersinia pestis KIM
cagaccauggccuugc

SEQ ID NO: 4208129 - RNA, 16 nt, Yersinia pestis KIM
cagacccggcaaauaa

SEQ ID NO: 4208130 - RNA, 17 nt, Yersinia pestis KIM
cagacccggcaaauaaa

SEQ ID NO: 4208131 - RNA, 21 nt, Yersinia pestis KIM
cagaccgacauuccagauauc

SEQ ID NO: 4208132 - RNA, 19 nt, Yersinia pestis KIM
cagaccgcguaagccgugc

SEQ ID NO: 4208133 - RNA, 17 nt, Yersinia pestis KIM
cagacgaaccgcuuuga

SEQ ID NO: 4208134 - RNA, 18 nt, Yersinia pestis KIM
cagacgacgugcagcgcg

SEQ ID NO: 4208135 - RNA, 19 nt, Yersinia pestis KIM
cagacgcacccggcuggca

SEQ ID NO: 4208136 - RNA, 18 nt, Yersinia pestis KIM
cagacgccccgaaccauu

SEQ ID NO: 4208137 - RNA, 13 nt, Yersinia pestis KIM
cagacggaaugag

SEQ ID NO: 4208138 - RNA, 17 nt, Yersinia pestis KIM
cagacggcagcaacgaa

SEQ ID NO: 4208139 - RNA, 19 nt, Yersinia pestis KIM
cagacggggaggacuuccg

SEQ ID NO: 4208140 - RNA, 21 nt, Yersinia pestis KIM
cagacguacauauaucacuau

SEQ ID NO: 4208141 - RNA, 19 nt, Yersinia pestis KIM
cagacguuggcucaucaaa

SEQ ID NO: 4208142 - RNA, 16 nt, Yersinia pestis KIM
cagacguuuaaauaag

SEQ ID NO: 4208143 - RNA, 16 nt, Yersinia pestis KIM
cagacuaaaaaccgcc

SEQ ID NO: 4208144 - RNA, 21 nt, Yersinia pestis KIM
cagacuaaaaaccgccacagc

SEQ ID NO: 4208145 - RNA, 15 nt, Yersinia pestis KIM
cagacucaaaauagc

SEQ ID NO: 4208146 - RNA, 18 nt, Yersinia pestis KIM
cagacucugcuaccagga

SEQ ID NO: 4208147 - RNA, 22 nt, Yersinia pestis KIM
cagacugaaaguagaaauaaaa

SEQ ID NO: 4208148 - RNA, 20 nt, Yersinia pestis KIM
cagacugaaaugacauugcg

SEQ ID NO: 4208149 - RNA, 22 nt, Yersinia pestis KIM
cagacugaaaugacauugcgaa

SEQ ID NO: 4208150 - RNA, 16 nt, Yersinia pestis KIM
cagacugcucuuuccc

SEQ ID NO: 4208151 - RNA, 13 nt, Yersinia pestis KIM
cagacugcugaca

SEQ ID NO: 4208152 - RNA, 21 nt, Yersinia pestis KIM
cagacuuggguaaccaaucac

SEQ ID NO: 4208153 - RNA, 16 nt, Yersinia pestis KIM
cagagaaugaguaaag

SEQ ID NO: 4208154 - RNA, 15 nt, Yersinia pestis KIM
cagagagaaaggcgg

SEQ ID NO: 4208155 - RNA, 22 nt, Yersinia pestis KIM
cagagauaauagauaacaaacu

SEQ ID NO: 4208156 - RNA, 14 nt, Yersinia pestis KIM
cagagauaaucaga

SEQ ID NO: 4208157 - RNA, 19 nt, Yersinia pestis KIM
cagagauccggugaagaau

SEQ ID NO: 4208158 - RNA, 21 nt, Yersinia pestis KIM
cagagaugcagagaugcagug

SEQ ID NO: 4208159 - RNA, 21 nt, Yersinia pestis KIM
cagagcacaacggaaggccca

SEQ ID NO: 4208160 - RNA, 22 nt, Yersinia pestis KIM
cagagcacugugcgccauuucc

SEQ ID NO: 4208161 - RNA, 15 nt, Yersinia pestis KIM
cagagcagaaagcag

SEQ ID NO: 4208162 - RNA, 16 nt, Yersinia pestis KIM
cagagcagaaagcagc

SEQ ID NO: 4208163 - RNA, 13 nt, Yersinia pestis KIM
cagagcucaauuu

SEQ ID NO: 4208164 - RNA, 18 nt, Yersinia pestis KIM
cagaggaaagagagccau

SEQ ID NO: 4208165 - RNA, 13 nt, Yersinia pestis KIM
cagaggaguaaag

SEQ ID NO: 4208166 - RNA, 15 nt, Yersinia pestis KIM
cagaggaguaaagcg

SEQ ID NO: 4208167 - RNA, 22 nt, Yersinia pestis KIM
cagaggcucauccugcgggcca

SEQ ID NO: 4208168 - RNA, 16 nt, Yersinia pestis KIM
cagaggggugccguuc

SEQ ID NO: 4208169 - RNA, 15 nt, Yersinia pestis KIM
cagaguccaauagcu

SEQ ID NO: 4208170 - RNA, 16 nt, Yersinia pestis KIM
cagaguccaauagcug

SEQ ID NO: 4208171 - RNA, 15 nt, Yersinia pestis KIM
cagaguccucucacc

SEQ ID NO: 4208172 - RNA, 16 nt, Yersinia pestis KIM
cagaguccucucacca

SEQ ID NO: 4208173 - RNA, 18 nt, Yersinia pestis KIM
cagaguccucucaccaag

SEQ ID NO: 4208174 - RNA, 17 nt, Yersinia pestis KIM
cagagucgcaaaaaaua

SEQ ID NO: 4208175 - RNA, 14 nt, Yersinia pestis KIM
cagagugugaaauc

SEQ ID NO: 4208176 - RNA, 16 nt, Yersinia pestis KIM
cagauaaaaaauaauu

SEQ ID NO: 4208177 - RNA, 14 nt, Yersinia pestis KIM
cagauaaacaucau

SEQ ID NO: 4208178 - RNA, 18 nt, Yersinia pestis KIM
cagauaaagaaaaacccg

SEQ ID NO: 4208179 - RNA, 19 nt, Yersinia pestis KIM
cagauaaagaaaaacccgu

SEQ ID NO: 4208180 - RNA, 15 nt, Yersinia pestis KIM
cagauaaauaaaaua

SEQ ID NO: 4208181 - RNA, 16 nt, Yersinia pestis KIM
cagauaaauaaaauaa

SEQ ID NO: 4208182 - RNA, 17 nt, Yersinia pestis KIM
cagauaaauaaaauaau

SEQ ID NO: 4208183 - RNA, 15 nt, Yersinia pestis KIM
cagauaacucagggc

SEQ ID NO: 4208184 - RNA, 14 nt, Yersinia pestis KIM
cagauaccacauca

SEQ ID NO: 4208185 - RNA, 16 nt, Yersinia pestis KIM
cagauaccacaucaaa

SEQ ID NO: 4208186 - RNA, 15 nt, Yersinia pestis KIM
cagauacggcuccag

SEQ ID NO: 4208187 - RNA, 18 nt, Yersinia pestis KIM
cagauacggcuccagaac

SEQ ID NO: 4208188 - RNA, 13 nt, Yersinia pestis KIM
cagauagucaucu

SEQ ID NO: 4208189 - RNA, 15 nt, Yersinia pestis KIM
cagauagucaucuuu

SEQ ID NO: 4208190 - RNA, 23 nt, Yersinia pestis KIM
cagauaucacucagcgucacgga

SEQ ID NO: 4208191 - RNA, 16 nt, Yersinia pestis KIM
cagauaucagccagug

SEQ ID NO: 4208192 - RNA, 17 nt, Yersinia pestis KIM
cagauauccuuuuucgu

SEQ ID NO: 4208193 - RNA, 22 nt, Yersinia pestis KIM
cagauaucugcucauuaccaau

SEQ ID NO: 4208194 - RNA, 14 nt, Yersinia pestis KIM
cagauaugcauuau

SEQ ID NO: 4208195 - RNA, 23 nt, Yersinia pestis KIM
cagauaugccaggcaucaucugc

SEQ ID NO: 4208196 - RNA, 12 nt, Yersinia pestis KIM
cagauauggcau

SEQ ID NO: 4208197 - RNA, 17 nt, Yersinia pestis KIM
cagauauuacgcagcca

SEQ ID NO: 4208198 - RNA, 23 nt, Yersinia pestis KIM
cagauauuacgcagccauaccca

SEQ ID NO: 4208199 - RNA, 18 nt, Yersinia pestis KIM
cagauauuccugcaaagu

SEQ ID NO: 4208200 - RNA, 22 nt, Yersinia pestis KIM
cagauauuccugcaaaguuugu

SEQ ID NO: 4208201 - RNA, 15 nt, Yersinia pestis KIM
cagauauuuuaccaa

SEQ ID NO: 4208202 - RNA, 18 nt, Yersinia pestis KIM
cagaucacccgcaaaacu

SEQ ID NO: 4208203 - RNA, 22 nt, Yersinia pestis KIM
cagauccgcacugggaucugau

SEQ ID NO: 4208204 - RNA, 20 nt, Yersinia pestis KIM
cagaucgcccugaauagccu

SEQ ID NO: 4208205 - RNA, 21 nt, Yersinia pestis KIM
cagaucgcccugaauagccug

SEQ ID NO: 4208206 - RNA, 18 nt, Yersinia pestis KIM
cagaucguaaagacgccg

SEQ ID NO: 4208207 - RNA, 21 nt, Yersinia pestis KIM
cagaugaaaaacugugcaaau

SEQ ID NO: 4208208 - RNA, 15 nt, Yersinia pestis KIM
cagaugaauauguuc

SEQ ID NO: 4208209 - RNA, 21 nt, Yersinia pestis KIM
cagaugaauauguuccaucag

SEQ ID NO: 4208210 - RNA, 22 nt, Yersinia pestis KIM
cagaugaauccagccaugcgac

SEQ ID NO: 4208211 - RNA, 18 nt, Yersinia pestis KIM
cagaugaaugagggagga

SEQ ID NO: 4208212 - RNA, 18 nt, Yersinia pestis KIM
cagaugacgggcgacccg

SEQ ID NO: 4208213 - RNA, 21 nt, Yersinia pestis KIM
cagaugacgggcgacccgcug

SEQ ID NO: 4208214 - RNA, 22 nt, Yersinia pestis KIM
cagaugaucaacgccaaaauaa

SEQ ID NO: 4208215 - RNA, 17 nt, Yersinia pestis KIM
cagccccgccaggaaaa

SEQ ID NO: 4208216 - RNA, 18 nt, Yersinia pestis KIM
cagccccuaacagcagug

SEQ ID NO: 4208217 - RNA, 16 nt, Yersinia pestis KIM
cagccccuagcaccgc

SEQ ID NO: 4208218 - RNA, 23 nt, Yersinia pestis KIM
cagcccuacuggcccgcccauaa

SEQ ID NO: 4208219 - RNA, 20 nt, Yersinia pestis KIM
cagcccugaucgcugugcaa

SEQ ID NO: 4208220 - RNA, 13 nt, Yersinia pestis KIM
cagcccuucuuua

SEQ ID NO: 4208221 - RNA, 15 nt, Yersinia pestis KIM
cagcccuuugaccau

SEQ ID NO: 4208222 - RNA, 19 nt, Yersinia pestis KIM
cagccgcgaaaaaccauga

SEQ ID NO: 4208223 - RNA, 16 nt, Yersinia pestis KIM
cagccgguuuuuucca

SEQ ID NO: 4208224 - RNA, 17 nt, Yersinia pestis KIM
cagccguaucuucugcc

SEQ ID NO: 4208225 - RNA, 20 nt, Yersinia pestis KIM
cagccgugucuuuucuggca

SEQ ID NO: 4208226 - RNA, 18 nt, Yersinia pestis KIM
cagccuaaaaugaauaac

SEQ ID NO: 4208227 - RNA, 21 nt, Yersinia pestis KIM
cagccuaaggccaucaauaaa

SEQ ID NO: 4208228 - RNA, 21 nt, Yersinia pestis KIM
cagccuauggcgguuccaaag

SEQ ID NO: 4208229 - RNA, 14 nt, Yersinia pestis KIM
cagccucauucaug

SEQ ID NO: 4208230 - RNA, 19 nt, Yersinia pestis KIM
cagccucauucaugaggcu

SEQ ID NO: 4208231 - RNA, 18 nt, Yersinia pestis KIM
cagccucuaacacucuuu

SEQ ID NO: 4208232 - RNA, 20 nt, Yersinia pestis KIM
cagccugguuuuuuaaaaaa

SEQ ID NO: 4208233 - RNA, 14 nt, Yersinia pestis KIM
cagccuguaggcca

SEQ ID NO: 4208234 - RNA, 17 nt, Yersinia pestis KIM
cagccuuuaaccacgag

SEQ ID NO: 4208235 - RNA, 23 nt, Yersinia pestis KIM
cagccuuuuuugcuuaaaacagg

SEQ ID NO: 4208236 - RNA, 16 nt, Yersinia pestis KIM
cagcgaagugccgcca

SEQ ID NO: 4208237 - RNA, 14 nt, Yersinia pestis KIM
cagcgaauaaauaa

SEQ ID NO: 4208238 - RNA, 17 nt, Yersinia pestis KIM
cagcgaauaguaucuac

SEQ ID NO: 4208239 - RNA, 13 nt, Yersinia pestis KIM
cagcgacaaccug

SEQ ID NO: 4208240 - RNA, 15 nt, Yersinia pestis KIM
cagcgacaaccugua

SEQ ID NO: 4208241 - RNA, 16 nt, Yersinia pestis KIM
cagcgacauaaaccgc

SEQ ID NO: 4208242 - RNA, 14 nt, Yersinia pestis KIM
cagcgaccaaaugg

SEQ ID NO: 4208243 - RNA, 15 nt, Yersinia pestis KIM
cagcgacgauaauuu

SEQ ID NO: 4208244 - RNA, 16 nt, Yersinia pestis KIM
cagcgacuccuggcaa

SEQ ID NO: 4208245 - RNA, 17 nt, Yersinia pestis KIM
cagcgagacgauuaucu

SEQ ID NO: 4208246 - RNA, 15 nt, Yersinia pestis KIM
cagcgagcacugccc

SEQ ID NO: 4208247 - RNA, 15 nt, Yersinia pestis KIM
cagcgaggcuucuca

SEQ ID NO: 4208248 - RNA, 18 nt, Yersinia pestis KIM
cagcgauauacaucacgu

SEQ ID NO: 4208249 - RNA, 17 nt, Yersinia pestis KIM
cagcgaucuauucucug

SEQ ID NO: 4208250 - RNA, 15 nt, Yersinia pestis KIM
cagcgauuaaaauaa

SEQ ID NO: 4208251 - RNA, 17 nt, Yersinia pestis KIM
cagcgauuaaaauaaag

SEQ ID NO: 4208252 - RNA, 18 nt, Yersinia pestis KIM
cagcgauuuuaaaaaauc

SEQ ID NO: 4208253 - RNA, 16 nt, Yersinia pestis KIM
cagcgcaaaaggcauc

SEQ ID NO: 4208254 - RNA, 20 nt, Yersinia pestis KIM
cagcgcacugaauaacgcgg

SEQ ID NO: 4208255 - RNA, 16 nt, Yersinia pestis KIM
cagcgcacugcaugcc

SEQ ID NO: 4208256 - RNA, 20 nt, Yersinia pestis KIM
cagcgcagguggauccguca

SEQ ID NO: 4208257 - RNA, 12 nt, Yersinia pestis KIM
cagcgccacagu

SEQ ID NO: 4208258 - RNA, 20 nt, Yersinia pestis KIM
cagcgccgauauacacccca

SEQ ID NO: 4208259 - RNA, 13 nt, Yersinia pestis KIM
cagcgcgcagcca

SEQ ID NO: 4208260 - RNA, 22 nt, Yersinia pestis KIM
cagcgcgucgccugggaaugca

SEQ ID NO: 4208261 - RNA, 15 nt, Yersinia pestis KIM
cagcgcuuccacugc

SEQ ID NO: 4208262 - RNA, 12 nt, Yersinia pestis KIM
cagcggcaaaua

SEQ ID NO: 4208263 - RNA, 13 nt, Yersinia pestis KIM
cagcggcaaauag

SEQ ID NO: 4208264 - RNA, 20 nt, Yersinia pestis KIM
cagcggcaaauagagcacca

SEQ ID NO: 4208265 - RNA, 14 nt, Yersinia pestis KIM
cagcggccaugacg

SEQ ID NO: 4208266 - RNA, 15 nt, Yersinia pestis KIM
cagcggcggcgcuga

SEQ ID NO: 4208267 - RNA, 21 nt, Yersinia pestis KIM
cagcggcguaacauauccugu

SEQ ID NO: 4208268 - RNA, 15 nt, Yersinia pestis KIM
cagcgggcgcagcca

SEQ ID NO: 4208269 - RNA, 22 nt, Yersinia pestis KIM
cagcgguaugaggaucccuucu

SEQ ID NO: 4208270 - RNA, 23 nt, Yersinia pestis KIM
cagcgguuuuuucuuucuucagc

SEQ ID NO: 4208271 - RNA, 13 nt, Yersinia pestis KIM
cagcguaaacagu

SEQ ID NO: 4208272 - RNA, 17 nt, Yersinia pestis KIM
cagcguaagcgguuugu

SEQ ID NO: 4208273 - RNA, 19 nt, Yersinia pestis KIM
cagcguagacaaugacugu

SEQ ID NO: 4208274 - RNA, 18 nt, Yersinia pestis KIM
cagcguagccguuaaaua

SEQ ID NO: 4208275 - RNA, 19 nt, Yersinia pestis KIM
cagcguagccguuaaauau

SEQ ID NO: 4208276 - RNA, 22 nt, Yersinia pestis KIM
cagcguaggcaacuaagcugcc

SEQ ID NO: 4208277 - RNA, 22 nt, Yersinia pestis KIM
cagcguagguaacuaagcugcc

SEQ ID NO: 4208278 - RNA, 16 nt, Yersinia pestis KIM
cagcguauucaguaaa

SEQ ID NO: 4208279 - RNA, 20 nt, Yersinia pestis KIM
cagcguauucaguaaaaacu

SEQ ID NO: 4208280 - RNA, 20 nt, Yersinia pestis KIM
cagcgucauggucucacugc

SEQ ID NO: 4208281 - RNA, 21 nt, Yersinia pestis KIM
cagcgucauggucucacugcg

SEQ ID NO: 4208282 - RNA, 17 nt, Yersinia pestis KIM
cagcgucucguguaaca

SEQ ID NO: 4208283 - RNA, 23 nt, Yersinia pestis KIM
cagcgucuuucgggcugaugaau

SEQ ID NO: 4208284 - RNA, 17 nt, Yersinia pestis KIM
cagcgugaguaucgaua

SEQ ID NO: 4208285 - RNA, 22 nt, Yersinia pestis KIM
cagcgugaguaucgauaagaaa

SEQ ID NO: 4208286 - RNA, 21 nt, Yersinia pestis KIM
cagcguggcccaggcaaucuc

SEQ ID NO: 4208287 - RNA, 16 nt, Yersinia pestis KIM
cagcguugacaccaga

SEQ ID NO: 4208288 - RNA, 23 nt, Yersinia pestis KIM
cagcuaaaaggggauaacaguuu

SEQ ID NO: 4208289 - RNA, 17 nt, Yersinia pestis KIM
cagcuaaucauugcaau

SEQ ID NO: 4208290 - RNA, 20 nt, Yersinia pestis KIM
cagcuacugcacgcauucuu

SEQ ID NO: 4208291 - RNA, 15 nt, Yersinia pestis KIM
cagcuagccugcccc

SEQ ID NO: 4208292 - RNA, 16 nt, Yersinia pestis KIM
cagcuaucuugaaaca

SEQ ID NO: 4208293 - RNA, 20 nt, Yersinia pestis KIM
cagcuaucuugaaacaaccc

SEQ ID NO: 4208294 - RNA, 22 nt, Yersinia pestis KIM
cagcuauguacgcaaguaucuu

SEQ ID NO: 4208295 - RNA, 19 nt, Yersinia pestis KIM
cagcuauugcuuuuauugc

SEQ ID NO: 4208296 - RNA, 18 nt, Yersinia pestis KIM
cagcucaaagaccacauc

SEQ ID NO: 4208297 - RNA, 18 nt, Yersinia pestis KIM
cagcucacucgguaauga

SEQ ID NO: 4208298 - RNA, 21 nt, Yersinia pestis KIM
cagcucacucgguaaugagcc

SEQ ID NO: 4208299 - RNA, 14 nt, Yersinia pestis KIM
cagcucucugagcc

SEQ ID NO: 4208300 - RNA, 16 nt, Yersinia pestis KIM
cagcucuucuaacacu

SEQ ID NO: 4208301 - RNA, 22 nt, Yersinia pestis KIM
cagcucuucuaacacuucauga

SEQ ID NO: 4208302 - RNA, 21 nt, Yersinia pestis KIM
cagcugauaugaaaaaucuga

SEQ ID NO: 4208303 - RNA, 17 nt, Yersinia pestis KIM
cagcuucuuuuaaagaa

SEQ ID NO: 4208304 - RNA, 20 nt, Yersinia pestis KIM
cagcuugauagggcugaaga

SEQ ID NO: 4208305 - RNA, 16 nt, Yersinia pestis KIM
cagcuuguugauauca

SEQ ID NO: 4208306 - RNA, 19 nt, Yersinia pestis KIM
cagcuuguugauaucaauc

SEQ ID NO: 4208307 - RNA, 13 nt, Yersinia pestis KIM
cagcuuuaacuua

SEQ ID NO: 4208308 - RNA, 10 nt, Yersinia pestis KIM
cagcuuugcu

SEQ ID NO: 4208309 - RNA, 20 nt, Yersinia pestis KIM
caggaaauuugcacugcagg

SEQ ID NO: 4208310 - RNA, 16 nt, Yersinia pestis KIM
caggaagagaaaagca

SEQ ID NO: 4208311 - RNA, 13 nt, Yersinia pestis KIM
caggaagcggcca

SEQ ID NO: 4208312 - RNA, 16 nt, Yersinia pestis KIM
caggaagcggccaggu

SEQ ID NO: 4208313 - RNA, 19 nt, Yersinia pestis KIM
caggaagcggccagguuca

SEQ ID NO: 4208314 - RNA, 22 nt, Yersinia pestis KIM
caggaagguaccugaucagcau

SEQ ID NO: 4208315 - RNA, 14 nt, Yersinia pestis KIM
caggauagccaacc

SEQ ID NO: 4208316 - RNA, 18 nt, Yersinia pestis KIM
caggaucaccagcaaagg

SEQ ID NO: 4208317 - RNA, 22 nt, Yersinia pestis KIM
caggaucaccagcaaaggccac

SEQ ID NO: 4208318 - RNA, 23 nt, Yersinia pestis KIM
caggaucaccagcaaaggccacc

SEQ ID NO: 4208319 - RNA, 22 nt, Yersinia pestis KIM
caggaucaggccagagacaccg

SEQ ID NO: 4208320 - RNA, 20 nt, Yersinia pestis KIM
caggauuaaauaaagauaau

SEQ ID NO: 4208321 - RNA, 13 nt, Yersinia pestis KIM
caggauuucaaua

SEQ ID NO: 4208322 - RNA, 20 nt, Yersinia pestis KIM
caggcaaagacuacacacag

SEQ ID NO: 4208323 - RNA, 19 nt, Yersinia pestis KIM
caggcaaaguguaauuugu

SEQ ID NO: 4208324 - RNA, 16 nt, Yersinia pestis KIM
caggcaaucagaaugu

SEQ ID NO: 4208325 - RNA, 19 nt, Yersinia pestis KIM
caggcaaugagugcagcca

SEQ ID NO: 4208326 - RNA, 15 nt, Yersinia pestis KIM
caggcacugcagaaa

SEQ ID NO: 4208327 - RNA, 13 nt, Yersinia pestis KIM
caggcagaaauaa

SEQ ID NO: 4208328 - RNA, 14 nt, Yersinia pestis KIM
caggcagaaauaau

SEQ ID NO: 4208329 - RNA, 15 nt, Yersinia pestis KIM
caguaccugcuaacc

SEQ ID NO: 4208330 - RNA, 20 nt, Yersinia pestis KIM
caguaccugcuaaccgaaga

SEQ ID NO: 4208331 - RNA, 19 nt, Yersinia pestis KIM
caguagaagcuaccagcac

SEQ ID NO: 4208332 - RNA, 20 nt, Yersinia pestis KIM
caguagaagcuaccagcacc

SEQ ID NO: 4208333 - RNA, 17 nt, Yersinia pestis KIM
caguagcauugguuuca

SEQ ID NO: 4208334 - RNA, 14 nt, Yersinia pestis KIM
caguaggcugaagg

SEQ ID NO: 4208335 - RNA, 19 nt, Yersinia pestis KIM
caguaggcugaaggccugc

SEQ ID NO: 4208336 - RNA, 20 nt, Yersinia pestis KIM
caguaggcugaaggccugcu

SEQ ID NO: 4208337 - RNA, 15 nt, Yersinia pestis KIM
caguaggggccacca

SEQ ID NO: 4208338 - RNA, 22 nt, Yersinia pestis KIM
caguagucaauacaauuauuuu

SEQ ID NO: 4208339 - RNA, 17 nt, Yersinia pestis KIM
caguaucgaagacaaac

SEQ ID NO: 4208340 - RNA, 20 nt, Yersinia pestis KIM
caguaucgaagacaaacacg

SEQ ID NO: 4208341 - RNA, 17 nt, Yersinia pestis KIM
caguaucuuuccagcca

SEQ ID NO: 4208342 - RNA, 19 nt, Yersinia pestis KIM
caguaucuuuccagccaau

SEQ ID NO: 4208343 - RNA, 23 nt, Yersinia pestis KIM
caguaucuuuccagccaauacag

SEQ ID NO: 4208344 - RNA, 14 nt, Yersinia pestis KIM
caguaugaaauuuu

SEQ ID NO: 4208345 - RNA, 17 nt, Yersinia pestis KIM
caguauucgccagauac

SEQ ID NO: 4208346 - RNA, 13 nt, Yersinia pestis KIM
caguauucugcuu

SEQ ID NO: 4208347 - RNA, 20 nt, Yersinia pestis KIM
caguauucugcuuccaggau

SEQ ID NO: 4208348 - RNA, 21 nt, Yersinia pestis KIM
caguauuuuaagaaaacugug

SEQ ID NO: 4208349 - RNA, 22 nt, Yersinia pestis KIM
cagucaaaagaaacugucaguc

SEQ ID NO: 4208350 - RNA, 14 nt, Yersinia pestis KIM
cagucaauaaacau

SEQ ID NO: 4208351 - RNA, 15 nt, Yersinia pestis KIM
cagucaauugagaau

SEQ ID NO: 4208352 - RNA, 19 nt, Yersinia pestis KIM
cagucacugcugcacuggc

SEQ ID NO: 4208353 - RNA, 20 nt, Yersinia pestis KIM
cagucacugcugcacuggcg

SEQ ID NO: 4208354 - RNA, 12 nt, Yersinia pestis KIM
cagucacuggcc

SEQ ID NO: 4208355 - RNA, 18 nt, Yersinia pestis KIM
cagucagccuuaauguuu

SEQ ID NO: 4208356 - RNA, 18 nt, Yersinia pestis KIM
cagucauccaaacggaau

SEQ ID NO: 4208357 - RNA, 19 nt, Yersinia pestis KIM
cagucauucaccugcccgu

SEQ ID NO: 4208358 - RNA, 13 nt, Yersinia pestis KIM
cagucauuuacug

SEQ ID NO: 4208359 - RNA, 18 nt, Yersinia pestis KIM
cagucccugugcgcccac

SEQ ID NO: 4208360 - RNA, 15 nt, Yersinia pestis KIM
cagucgacaguguaa

SEQ ID NO: 4208361 - RNA, 13 nt, Yersinia pestis KIM
cagucgauaaaca

SEQ ID NO: 4208362 - RNA, 13 nt, Yersinia pestis KIM
cagucgcgaugcg

SEQ ID NO: 4208363 - RNA, 22 nt, Yersinia pestis KIM
cagucuaaacgccgcgucaaua

SEQ ID NO: 4208364 - RNA, 17 nt, Yersinia pestis KIM
cagucugaaacgccagc

SEQ ID NO: 4208365 - RNA, 23 nt, Yersinia pestis KIM
cagucugaaggguauugaagaua

SEQ ID NO: 4208366 - RNA, 19 nt, Yersinia pestis KIM
cagucugagccucaugaau

SEQ ID NO: 4208367 - RNA, 23 nt, Yersinia pestis KIM
cagucugagccucaugaaugagg

SEQ ID NO: 4208368 - RNA, 16 nt, Yersinia pestis KIM
cagucugaggcccgcu

SEQ ID NO: 4208369 - RNA, 21 nt, Yersinia pestis KIM
cagucugaggcccgcuaguga

SEQ ID NO: 4208370 - RNA, 13 nt, Yersinia pestis KIM
cagucuuccauga

SEQ ID NO: 4208371 - RNA, 14 nt, Yersinia pestis KIM
cagugaagagauaa

SEQ ID NO: 4208372 - RNA, 20 nt, Yersinia pestis KIM
cagugaagagauaaccguua

SEQ ID NO: 4208373 - RNA, 21 nt, Yersinia pestis KIM
cagugaaggaugaauaaauga

SEQ ID NO: 4208374 - RNA, 21 nt, Yersinia pestis KIM
cagugaauaacugguccaacu

SEQ ID NO: 4208375 - RNA, 23 nt, Yersinia pestis KIM
cagugacccuuaucggauuacuu

SEQ ID NO: 4208376 - RNA, 14 nt, Yersinia pestis KIM
cagugacugaaugg

SEQ ID NO: 4208377 - RNA, 19 nt, Yersinia pestis KIM
cagugacugaauggcuauu

SEQ ID NO: 4208378 - RNA, 22 nt, Yersinia pestis KIM
cagugacugaauggcuauuuac

SEQ ID NO: 4208379 - RNA, 13 nt, Yersinia pestis KIM
cagugagcaaauu

SEQ ID NO: 4208380 - RNA, 15 nt, Yersinia pestis KIM
cagugagcaauccaa

SEQ ID NO: 4208381 - RNA, 16 nt, Yersinia pestis KIM
cagugaguccuuuacu

SEQ ID NO: 4208382 - RNA, 13 nt, Yersinia pestis KIM
cagugaucagucc

SEQ ID NO: 4208383 - RNA, 15 nt, Yersinia pestis KIM
cagugaucaugggaa

SEQ ID NO: 4208384 - RNA, 14 nt, Yersinia pestis KIM
cagugaugagaauc

SEQ ID NO: 4208385 - RNA, 16 nt, Yersinia pestis KIM
cagugaugagaaucuc

SEQ ID NO: 4208386 - RNA, 21 nt, Yersinia pestis KIM
cagugaugcugcacaucaacg

SEQ ID NO: 4208387 - RNA, 16 nt, Yersinia pestis KIM
cagugauuuuaaccac

SEQ ID NO: 4208388 - RNA, 15 nt, Yersinia pestis KIM
cagugcaaaaugcuc

SEQ ID NO: 4208389 - RNA, 23 nt, Yersinia pestis KIM
cagugcaaaaugcucuucaccaa

SEQ ID NO: 4208390 - RNA, 14 nt, Yersinia pestis KIM
cagugcaaauuuau

SEQ ID NO: 4208391 - RNA, 16 nt, Yersinia pestis KIM
cagugcaacauuaaaa

SEQ ID NO: 4208392 - RNA, 20 nt, Yersinia pestis KIM
cagugcaacauuaaaaauac

SEQ ID NO: 4208393 - RNA, 20 nt, Yersinia pestis KIM
cagugcaaccaacaccaaug

SEQ ID NO: 4208394 - RNA, 22 nt, Yersinia pestis KIM
cagugcacaucaauaccugucg

SEQ ID NO: 4208395 - RNA, 21 nt, Yersinia pestis KIM
cagugcauccccacugacauc

SEQ ID NO: 4208396 - RNA, 17 nt, Yersinia pestis KIM
cagugccaagguucgaa

SEQ ID NO: 4208397 - RNA, 18 nt, Yersinia pestis KIM
cagugccaauccccacca

SEQ ID NO: 4208398 - RNA, 19 nt, Yersinia pestis KIM
cagugccaauugaguaacu

SEQ ID NO: 4208399 - RNA, 13 nt, Yersinia pestis KIM
cagugccaguaau

SEQ ID NO: 4208400 - RNA, 15 nt, Yersinia pestis KIM
cagugcccgcggggg

SEQ ID NO: 4208401 - RNA, 23 nt, Yersinia pestis KIM
cagugcggccaccuaucuauuuu

SEQ ID NO: 4208402 - RNA, 23 nt, Yersinia pestis KIM
cagugcugcgcccaguggagcca

SEQ ID NO: 4208403 - RNA, 14 nt, Yersinia pestis KIM
cagugcuucaucac

SEQ ID NO: 4208404 - RNA, 16 nt, Yersinia pestis KIM
cagugcuucaucacug

SEQ ID NO: 4208405 - RNA, 16 nt, Yersinia pestis KIM
caguggaacauuuucg

SEQ ID NO: 4208406 - RNA, 14 nt, Yersinia pestis KIM
caguggagccauga

SEQ ID NO: 4208407 - RNA, 14 nt, Yersinia pestis KIM
caguggaugauaaa

SEQ ID NO: 4208408 - RNA, 18 nt, Yersinia pestis KIM
caguggccauugaacaua

SEQ ID NO: 4208409 - RNA, 20 nt, Yersinia pestis KIM
caguggcgcuacuuccccua

SEQ ID NO: 4208410 - RNA, 21 nt, Yersinia pestis KIM
caguggcgguucgagcggcau

SEQ ID NO: 4208411 - RNA, 19 nt, Yersinia pestis KIM
caguggcuuugcaccauca

SEQ ID NO: 4208412 - RNA, 14 nt, Yersinia pestis KIM
caguggguaacaua

SEQ ID NO: 4208413 - RNA, 22 nt, Yersinia pestis KIM
cagugguuuuauaaauaaauag

SEQ ID NO: 4208414 - RNA, 15 nt, Yersinia pestis KIM
caguguaaaaagcga

SEQ ID NO: 4208415 - RNA, 17 nt, Yersinia pestis KIM
caguguaucaauaggau

SEQ ID NO: 4208416 - RNA, 18 nt, Yersinia pestis KIM
cagugucacuuccgccgc

SEQ ID NO: 4208417 - RNA, 21 nt, Yersinia pestis KIM
cagugucagguaaaaagguaa

SEQ ID NO: 4208418 - RNA, 14 nt, Yersinia pestis KIM
cagugucaguucga

SEQ ID NO: 4208419 - RNA, 20 nt, Yersinia pestis KIM
cagugucaucccguaggcuu

SEQ ID NO: 4208420 - RNA, 20 nt, Yersinia pestis KIM
cagugugugugcgcugagug

SEQ ID NO: 4208421 - RNA, 13 nt, Yersinia pestis KIM
caguguugacccg

SEQ ID NO: 4208422 - RNA, 15 nt, Yersinia pestis KIM
caguguuuucuccac

SEQ ID NO: 4208423 - RNA, 22 nt, Yersinia pestis KIM
caguguuuucuccacaccaacg

SEQ ID NO: 4208424 - RNA, 22 nt, Yersinia pestis KIM
caguuaaacgguaaccauccau

SEQ ID NO: 4208425 - RNA, 22 nt, Yersinia pestis KIM
caguuaagguguuguuuaaaaa

SEQ ID NO: 4208426 - RNA, 14 nt, Yersinia pestis KIM
caguuaauagggcu

SEQ ID NO: 4208427 - RNA, 19 nt, Yersinia pestis KIM
caguuacgcgucugcuggc

SEQ ID NO: 4208428 - RNA, 18 nt, Yersinia pestis KIM
caguuacgucaggaauaa

SEQ ID NO: 4208429 - RNA, 12 nt, Yersinia pestis KIM
caguuagugccu

SEQ ID NO: 4208430 - RNA, 16 nt, Yersinia pestis KIM
caguuauaaaaacccc

SEQ ID NO: 4208431 - RNA, 14 nt, Yersinia pestis KIM
caguuauuacaccu

SEQ ID NO: 4208432 - RNA, 21 nt, Yersinia pestis KIM
caguuauuacaccuacaggcu

SEQ ID NO: 4208433 - RNA, 14 nt, Yersinia pestis KIM
caguuauuauuuuu

SEQ ID NO: 4208434 - RNA, 19 nt, Yersinia pestis KIM
caguuauuauuuuuaauga

SEQ ID NO: 4208435 - RNA, 23 nt, Yersinia pestis KIM
caguucaagauaaaguucuucga

SEQ ID NO: 4208436 - RNA, 21 nt, Yersinia pestis KIM
caguucacucuguuuuaaaaa

SEQ ID NO: 4208437 - RNA, 15 nt, Yersinia pestis KIM
caguucaguauuggu

SEQ ID NO: 4208438 - RNA, 17 nt, Yersinia pestis KIM
caguucaucagcccagc

SEQ ID NO: 4208439 - RNA, 20 nt, Yersinia pestis KIM
caguucaucagcccagcggu

SEQ ID NO: 4208440 - RNA, 15 nt, Yersinia pestis KIM
caguucauggccaug

SEQ ID NO: 4208441 - RNA, 17 nt, Yersinia pestis KIM
caguucauuacaggccc

SEQ ID NO: 4208442 - RNA, 13 nt, Yersinia pestis KIM
caguucauucccc

SEQ ID NO: 4208443 - RNA, 14 nt, Yersinia pestis KIM
cauagcuaaaauaa

SEQ ID NO: 4208444 - RNA, 13 nt, Yersinia pestis KIM
cauagcuaacacc

SEQ ID NO: 4208445 - RNA, 14 nt, Yersinia pestis KIM
cauagcuaaccuua

SEQ ID NO: 4208446 - RNA, 15 nt, Yersinia pestis KIM
cauagcuaaccuuaa

SEQ ID NO: 4208447 - RNA, 22 nt, Yersinia pestis KIM
cauagcuacgggcaaacuccuc

SEQ ID NO: 4208448 - RNA, 16 nt, Yersinia pestis KIM
cauagcuggcuucaaa

SEQ ID NO: 4208449 - RNA, 19 nt, Yersinia pestis KIM
cauagcuggcuucaaaauc

SEQ ID NO: 4208450 - RNA, 20 nt, Yersinia pestis KIM
cauagcuggcuuucgcuuua

SEQ ID NO: 4208451 - RNA, 22 nt, Yersinia pestis KIM
cauagguacggguauagcggcg

SEQ ID NO: 4208452 - RNA, 17 nt, Yersinia pestis KIM
cauagguagaauagcaa

SEQ ID NO: 4208453 - RNA, 17 nt, Yersinia pestis KIM
cauaggucuuuacgcag

SEQ ID NO: 4208454 - RNA, 20 nt, Yersinia pestis KIM
cauagguuggggaugccauu

SEQ ID NO: 4208455 - RNA, 13 nt, Yersinia pestis KIM
cauaguccaacgc

SEQ ID NO: 4208456 - RNA, 22 nt, Yersinia pestis KIM
cauaguccaacgcacugguugc

SEQ ID NO: 4208457 - RNA, 19 nt, Yersinia pestis KIM
cauagugauuauuuaaaca

SEQ ID NO: 4208458 - RNA, 21 nt, Yersinia pestis KIM
cauaguuucaauaugcucugc

SEQ ID NO: 4208459 - RNA, 15 nt, Yersinia pestis KIM
cauauaaaaaacuaa

SEQ ID NO: 4208460 - RNA, 20 nt, Yersinia pestis KIM
cauauaaaaaacuaauguuu

SEQ ID NO: 4208461 - RNA, 17 nt, Yersinia pestis KIM
cauauaaaacacgcaua

SEQ ID NO: 4208462 - RNA, 14 nt, Yersinia pestis KIM
cauauaaaccagcc

SEQ ID NO: 4208463 - RNA, 13 nt, Yersinia pestis KIM
cauauaaccaugc

SEQ ID NO: 4208464 - RNA, 14 nt, Yersinia pestis KIM
cauauaaucauacu

SEQ ID NO: 4208465 - RNA, 14 nt, Yersinia pestis KIM
cauauaauccaaaa

SEQ ID NO: 4208466 - RNA, 17 nt, Yersinia pestis KIM
cauauacaaccucaacg

SEQ ID NO: 4208467 - RNA, 23 nt, Yersinia pestis KIM
cauauagcggcguucagcaauau

SEQ ID NO: 4208468 - RNA, 24 nt, Yersinia pestis KIM
cauauagcggcguucagcaauaug

SEQ ID NO: 4208469 - RNA, 19 nt, Yersinia pestis KIM
cauauaucacuauuucagg

SEQ ID NO: 4208470 - RNA, 22 nt, Yersinia pestis KIM
cauauaucacuauuucaggcau

SEQ ID NO: 4208471 - RNA, 12 nt, Yersinia pestis KIM
cauauauugauc

SEQ ID NO: 4208472 - RNA, 14 nt, Yersinia pestis KIM
cauaucaaaauaaa

SEQ ID NO: 4208473 - RNA, 21 nt, Yersinia pestis KIM
cauaucaaaauaaaaauucac

SEQ ID NO: 4208474 - RNA, 14 nt, Yersinia pestis KIM
cauaucaaacagcu

SEQ ID NO: 4208475 - RNA, 21 nt, Yersinia pestis KIM
cauaucagaaccaagcaauag

SEQ ID NO: 4208476 - RNA, 12 nt, Yersinia pestis KIM
cauaucagcgcc

SEQ ID NO: 4208477 - RNA, 17 nt, Yersinia pestis KIM
cauauccguuuucaccc

SEQ ID NO: 4208478 - RNA, 18 nt, Yersinia pestis KIM
cauauccguuuucaccca

SEQ ID NO: 4208479 - RNA, 19 nt, Yersinia pestis KIM
cauauccguuuucacccaa

SEQ ID NO: 4208480 - RNA, 18 nt, Yersinia pestis KIM
cauauccucaagaccgau

SEQ ID NO: 4208481 - RNA, 13 nt, Yersinia pestis KIM
cauauccugugcc

SEQ ID NO: 4208482 - RNA, 14 nt, Yersinia pestis KIM
cauauccugugcca

SEQ ID NO: 4208483 - RNA, 14 nt, Yersinia pestis KIM
cauaucgaccauga

SEQ ID NO: 4208484 - RNA, 16 nt, Yersinia pestis KIM
cauaucgcuaaaacac

SEQ ID NO: 4208485 - RNA, 15 nt, Yersinia pestis KIM
cauaucgcucaucau

SEQ ID NO: 4208486 - RNA, 15 nt, Yersinia pestis KIM
cauaucuugaaccaa

SEQ ID NO: 4208487 - RNA, 19 nt, Yersinia pestis KIM
cauaucuuuaaaaacccgc

SEQ ID NO: 4208488 - RNA, 15 nt, Yersinia pestis KIM
cauaugaaugagcag

SEQ ID NO: 4208489 - RNA, 14 nt, Yersinia pestis KIM
cauaugcagcaucc

SEQ ID NO: 4208490 - RNA, 14 nt, Yersinia pestis KIM
cauaugcauggcau

SEQ ID NO: 4208491 - RNA, 23 nt, Yersinia pestis KIM
cauaugcauggcauauucaccag

SEQ ID NO: 4208492 - RNA, 19 nt, Yersinia pestis KIM
cauaugcgccuauaaggcu

SEQ ID NO: 4208493 - RNA, 18 nt, Yersinia pestis KIM
cauauggaugaugcacag

SEQ ID NO: 4208494 - RNA, 23 nt, Yersinia pestis KIM
cauaugggcaucucaauauguug

SEQ ID NO: 4208495 - RNA, 15 nt, Yersinia pestis KIM
cauauuaaaugcauu

SEQ ID NO: 4208496 - RNA, 23 nt, Yersinia pestis KIM
cauauuaaaugcauuauaaggaa

SEQ ID NO: 4208497 - RNA, 13 nt, Yersinia pestis KIM
cauauuacccagu

SEQ ID NO: 4208498 - RNA, 17 nt, Yersinia pestis KIM
cauauuaccgcugaaaa

SEQ ID NO: 4208499 - RNA, 14 nt, Yersinia pestis KIM
cauauuacucacac

SEQ ID NO: 4208500 - RNA, 15 nt, Yersinia pestis KIM
cauauuacucucuau

SEQ ID NO: 4208501 - RNA, 14 nt, Yersinia pestis KIM
cauauucaaccgcc

SEQ ID NO: 4208502 - RNA, 18 nt, Yersinia pestis KIM
cauauucaccguuuccag

SEQ ID NO: 4208503 - RNA, 12 nt, Yersinia pestis KIM
cauauucagccg

SEQ ID NO: 4208504 - RNA, 18 nt, Yersinia pestis KIM
cauauucaguaacaacau

SEQ ID NO: 4208505 - RNA, 15 nt, Yersinia pestis KIM
cauauucccagccaa

SEQ ID NO: 4208506 - RNA, 21 nt, Yersinia pestis KIM
cauauucgguaaguuggcauc

SEQ ID NO: 4208507 - RNA, 19 nt, Yersinia pestis KIM
cauauugcucugccgcagu

SEQ ID NO: 4208508 - RNA, 16 nt, Yersinia pestis KIM
cauauuggcaauauuc

SEQ ID NO: 4208509 - RNA, 12 nt, Yersinia pestis KIM
cauauuggccag

SEQ ID NO: 4208510 - RNA, 22 nt, Yersinia pestis KIM
cauauuggccaguugccacuca

SEQ ID NO: 4208511 - RNA, 14 nt, Yersinia pestis KIM
cauauugugcuauc

SEQ ID NO: 4208512 - RNA, 13 nt, Yersinia pestis KIM
cauauuucaggcu

SEQ ID NO: 4208513 - RNA, 12 nt, Yersinia pestis KIM
caucaaaacaau

SEQ ID NO: 4208514 - RNA, 13 nt, Yersinia pestis KIM
caucaaaaccgau

SEQ ID NO: 4208515 - RNA, 14 nt, Yersinia pestis KIM
caucaaaauauguu

SEQ ID NO: 4208516 - RNA, 11 nt, Yersinia pestis KIM
caucaaaggag

SEQ ID NO: 4208517 - RNA, 19 nt, Yersinia pestis KIM
caucaaaggagugcccggc

SEQ ID NO: 4208518 - RNA, 20 nt, Yersinia pestis KIM
caucaaaggagugcccggca

SEQ ID NO: 4208519 - RNA, 17 nt, Yersinia pestis KIM
caucaaaggcaauaccg

SEQ ID NO: 4208520 - RNA, 21 nt, Yersinia pestis KIM
caucaaauacacauaaccauc

SEQ ID NO: 4208521 - RNA, 14 nt, Yersinia pestis KIM
caucaacaaccagu

SEQ ID NO: 4208522 - RNA, 22 nt, Yersinia pestis KIM
caucaacagaggcauuuuuguu

SEQ ID NO: 4208523 - RNA, 20 nt, Yersinia pestis KIM
caucaacaugggcaagcucu

SEQ ID NO: 4208524 - RNA, 22 nt, Yersinia pestis KIM
caucaaccgggauaucaaauuc

SEQ ID NO: 4208525 - RNA, 22 nt, Yersinia pestis KIM
caucaaccucagccucauucau

SEQ ID NO: 4208526 - RNA, 15 nt, Yersinia pestis KIM
caucaacgacagcag

SEQ ID NO: 4208527 - RNA, 15 nt, Yersinia pestis KIM
caucaacuuugguuu

SEQ ID NO: 4208528 - RNA, 23 nt, Yersinia pestis KIM
caucaacuuugguuuuugaggaa

SEQ ID NO: 4208529 - RNA, 15 nt, Yersinia pestis KIM
caucaaggugccaua

SEQ ID NO: 4208530 - RNA, 14 nt, Yersinia pestis KIM
caucaauaaaauua

SEQ ID NO: 4208531 - RNA, 23 nt, Yersinia pestis KIM
caucaauaaaauuacccagcauc

SEQ ID NO: 4208532 - RNA, 22 nt, Yersinia pestis KIM
caucaauaaauagagugaagua

SEQ ID NO: 4208533 - RNA, 12 nt, Yersinia pestis KIM
caucaauaauaa

SEQ ID NO: 4208534 - RNA, 22 nt, Yersinia pestis KIM
caucaauaauaacgaauuucau

SEQ ID NO: 4208535 - RNA, 12 nt, Yersinia pestis KIM
caucaauaccaa

SEQ ID NO: 4208536 - RNA, 18 nt, Yersinia pestis KIM
caucaauacuguuaucac

SEQ ID NO: 4208537 - RNA, 17 nt, Yersinia pestis KIM
caucaauagguguugcc

SEQ ID NO: 4208538 - RNA, 17 nt, Yersinia pestis KIM
caucaaucgagaagaau

SEQ ID NO: 4208539 - RNA, 17 nt, Yersinia pestis KIM
caucaaugaaaauaucc

SEQ ID NO: 4208540 - RNA, 20 nt, Yersinia pestis KIM
caucaaugauucgcugaaca

SEQ ID NO: 4208541 - RNA, 21 nt, Yersinia pestis KIM
caucaauggauucuugcugca

SEQ ID NO: 4208542 - RNA, 17 nt, Yersinia pestis KIM
caucaauuggcagcggc

SEQ ID NO: 4208543 - RNA, 18 nt, Yersinia pestis KIM
caucacacuuguuugccc

SEQ ID NO: 4208544 - RNA, 13 nt, Yersinia pestis KIM
caucaccacccug

SEQ ID NO: 4208545 - RNA, 13 nt, Yersinia pestis KIM
caucacccagcaa

SEQ ID NO: 4208546 - RNA, 23 nt, Yersinia pestis KIM
caucacccgcgagcgaccuugau

SEQ ID NO: 4208547 - RNA, 18 nt, Yersinia pestis KIM
caucacgauagccaguga

SEQ ID NO: 4208548 - RNA, 23 nt, Yersinia pestis KIM
caucacgcagugcaucuuccaau

SEQ ID NO: 4208549 - RNA, 16 nt, Yersinia pestis KIM
caucacgcucaucggu

SEQ ID NO: 4208550 - RNA, 18 nt, Yersinia pestis KIM
caucacggcgaguucgau

SEQ ID NO: 4208551 - RNA, 19 nt, Yersinia pestis KIM
caucacugucuauuuuuau

SEQ ID NO: 4208552 - RNA, 18 nt, Yersinia pestis KIM
caucacuuccagcgcccg

SEQ ID NO: 4208553 - RNA, 22 nt, Yersinia pestis KIM
caucagacacguaaaacaggga

SEQ ID NO: 4208554 - RNA, 14 nt, Yersinia pestis KIM
caucagacagccau

SEQ ID NO: 4208555 - RNA, 15 nt, Yersinia pestis KIM
caucagacggaauga

SEQ ID NO: 4208556 - RNA, 21 nt, Yersinia pestis KIM
caucagacugcucuuucccuu

SEQ ID NO: 4208557 - RNA, 22 nt, Yersinia pestis KIM
caucagacugcucuuucccuuc

SEQ ID NO: 4208558 - RNA, 16 nt, Yersinia pestis KIM
caucuggcucagguaa

SEQ ID NO: 4208559 - RNA, 24 nt, Yersinia pestis KIM
caucuggugacccgucagcguccu

SEQ ID NO: 4208560 - RNA, 19 nt, Yersinia pestis KIM
caucuuacugauaucuuug

SEQ ID NO: 4208561 - RNA, 15 nt, Yersinia pestis KIM
caucuuccaaaggaa

SEQ ID NO: 4208562 - RNA, 16 nt, Yersinia pestis KIM
caucuuccaaaggaag

SEQ ID NO: 4208563 - RNA, 15 nt, Yersinia pestis KIM
caucuugcaacaacg

SEQ ID NO: 4208564 - RNA, 19 nt, Yersinia pestis KIM
caucuuguucuaauaauaa

SEQ ID NO: 4208565 - RNA, 15 nt, Yersinia pestis KIM
caucuuuaacaacaa

SEQ ID NO: 4208566 - RNA, 16 nt, Yersinia pestis KIM
caucuuuaauuaaugg

SEQ ID NO: 4208567 - RNA, 22 nt, Yersinia pestis KIM
caucuuuaccccauugcaccaa

SEQ ID NO: 4208568 - RNA, 19 nt, Yersinia pestis KIM
caucuuucggccuccccug

SEQ ID NO: 4208569 - RNA, 21 nt, Yersinia pestis KIM
caucuuucucauuagcgucuu

SEQ ID NO: 4208570 - RNA, 12 nt, Yersinia pestis KIM
caucuuuuucug

SEQ ID NO: 4208571 - RNA, 15 nt, Yersinia pestis KIM
caugaaaucagagag

SEQ ID NO: 4208572 - RNA, 17 nt, Yersinia pestis KIM
caugaacggauacccag

SEQ ID NO: 4208573 - RNA, 14 nt, Yersinia pestis KIM
caugaaugaggcug

SEQ ID NO: 4208574 - RNA, 23 nt, Yersinia pestis KIM
caugaaugaggcugagguuauug

SEQ ID NO: 4208575 - RNA, 23 nt, Yersinia pestis KIM
caugaaugaggcugagguugaug

SEQ ID NO: 4208576 - RNA, 14 nt, Yersinia pestis KIM
caugacagguuuca

SEQ ID NO: 4208577 - RNA, 14 nt, Yersinia pestis KIM
caugagauaaauau

SEQ ID NO: 4208578 - RNA, 14 nt, Yersinia pestis KIM
caugaguaaaagau

SEQ ID NO: 4208579 - RNA, 15 nt, Yersinia pestis KIM
caugagugaaaauau

SEQ ID NO: 4208580 - RNA, 17 nt, Yersinia pestis KIM
caugagugaaaauaugu

SEQ ID NO: 4208581 - RNA, 19 nt, Yersinia pestis KIM
caugauaaaacuauucugc

SEQ ID NO: 4208582 - RNA, 18 nt, Yersinia pestis KIM
caugauagcuugcccgau

SEQ ID NO: 4208583 - RNA, 18 nt, Yersinia pestis KIM
caugaugaauacggugua

SEQ ID NO: 4208584 - RNA, 18 nt, Yersinia pestis KIM
caugaugacaaugcguua

SEQ ID NO: 4208585 - RNA, 21 nt, Yersinia pestis KIM
caugauggcaccgugggcaaa

SEQ ID NO: 4208586 - RNA, 21 nt, Yersinia pestis KIM
caugaugucgcgacucaagcc

SEQ ID NO: 4208587 - RNA, 16 nt, Yersinia pestis KIM
caugauuucucgcuuu

SEQ ID NO: 4208588 - RNA, 20 nt, Yersinia pestis KIM
caugauuuguugaugaauga

SEQ ID NO: 4208589 - RNA, 21 nt, Yersinia pestis KIM
caugcagcauuucaggaucga

SEQ ID NO: 4208590 - RNA, 13 nt, Yersinia pestis KIM
caugcagcccgac

SEQ ID NO: 4208591 - RNA, 15 nt, Yersinia pestis KIM
caugcauuaaggcgc

SEQ ID NO: 4208592 - RNA, 15 nt, Yersinia pestis KIM
caugccacuucgcua

SEQ ID NO: 4208593 - RNA, 23 nt, Yersinia pestis KIM
caugccagaaacggcaucugcca

SEQ ID NO: 4208594 - RNA, 18 nt, Yersinia pestis KIM
caugcccagccucuggau

SEQ ID NO: 4208595 - RNA, 15 nt, Yersinia pestis KIM
caugcccagcguugg

SEQ ID NO: 4208596 - RNA, 18 nt, Yersinia pestis KIM
caugccccaauguagaca

SEQ ID NO: 4208597 - RNA, 17 nt, Yersinia pestis KIM
caugccuaauuugguac

SEQ ID NO: 4208598 - RNA, 23 nt, Yersinia pestis KIM
caugccucguuggaucaucggga

SEQ ID NO: 4208599 - RNA, 19 nt, Yersinia pestis KIM
caugcgauacgcccgcccc

SEQ ID NO: 4208600 - RNA, 20 nt, Yersinia pestis KIM
caugcggauugaacugcgcu

SEQ ID NO: 4208601 - RNA, 24 nt, Yersinia pestis KIM
caugcggcgugggcaaucuccagu

SEQ ID NO: 4208602 - RNA, 16 nt, Yersinia pestis KIM
caugcgguuggcggcu

SEQ ID NO: 4208603 - RNA, 23 nt, Yersinia pestis KIM
caugcguugaugcucuucuucac

SEQ ID NO: 4208604 - RNA, 19 nt, Yersinia pestis KIM
caugcuaacuuguucagaa

SEQ ID NO: 4208605 - RNA, 23 nt, Yersinia pestis KIM
caugcucagaaaccugugugacc

SEQ ID NO: 4208606 - RNA, 17 nt, Yersinia pestis KIM
caugcucaguuguauua

SEQ ID NO: 4208607 - RNA, 16 nt, Yersinia pestis KIM
caugcucccuccugcg

SEQ ID NO: 4208608 - RNA, 19 nt, Yersinia pestis KIM
caugcugaaucuguaaguc

SEQ ID NO: 4208609 - RNA, 14 nt, Yersinia pestis KIM
caugcuggcggaua

SEQ ID NO: 4208610 - RNA, 16 nt, Yersinia pestis KIM
caugcuguagcagccu

SEQ ID NO: 4208611 - RNA, 17 nt, Yersinia pestis KIM
caugcuguagcagccug

SEQ ID NO: 4208612 - RNA, 12 nt, Yersinia pestis KIM
caugcuguucac

SEQ ID NO: 4208613 - RNA, 16 nt, Yersinia pestis KIM
cauggaagaccagaua

SEQ ID NO: 4208614 - RNA, 22 nt, Yersinia pestis KIM
cauggaagggccgcuauauuuu

SEQ ID NO: 4208615 - RNA, 20 nt, Yersinia pestis KIM
cauggaucacccguugcaag

SEQ ID NO: 4208616 - RNA, 20 nt, Yersinia pestis KIM
cauggauggucauaaaaucg

SEQ ID NO: 4208617 - RNA, 15 nt, Yersinia pestis KIM
cauggauguauuuac

SEQ ID NO: 4208618 - RNA, 19 nt, Yersinia pestis KIM
cauggcaaccccuaaucca

SEQ ID NO: 4208619 - RNA, 21 nt, Yersinia pestis KIM
cauggcaaccccuaauccagc

SEQ ID NO: 4208620 - RNA, 13 nt, Yersinia pestis KIM
cauggcaugccau

SEQ ID NO: 4208621 - RNA, 16 nt, Yersinia pestis KIM
cauggccauggaaacc

SEQ ID NO: 4208622 - RNA, 21 nt, Yersinia pestis KIM
cauggcgaaaauccuucauuu

SEQ ID NO: 4208623 - RNA, 18 nt, Yersinia pestis KIM
cauggcggcagcacagag

SEQ ID NO: 4208624 - RNA, 15 nt, Yersinia pestis KIM
cauggcugaaauaac

SEQ ID NO: 4208625 - RNA, 16 nt, Yersinia pestis KIM
cauggcugaaauaacu

SEQ ID NO: 4208626 - RNA, 22 nt, Yersinia pestis KIM
caugggaaacaagggcaaugug

SEQ ID NO: 4208627 - RNA, 20 nt, Yersinia pestis KIM
caugggugccccauauuuuc

SEQ ID NO: 4208628 - RNA, 14 nt, Yersinia pestis KIM
caugguaagaauaa

SEQ ID NO: 4208629 - RNA, 15 nt, Yersinia pestis KIM
caugguaagaauaaa

SEQ ID NO: 4208630 - RNA, 16 nt, Yersinia pestis KIM
caugguaagaauaaau

SEQ ID NO: 4208631 - RNA, 19 nt, Yersinia pestis KIM
cauggucaucgcuucacac

SEQ ID NO: 4208632 - RNA, 23 nt, Yersinia pestis KIM
caugguuaagagaucccgugcca

SEQ ID NO: 4208633 - RNA, 20 nt, Yersinia pestis KIM
caugguucugcucaauagcc

SEQ ID NO: 4208634 - RNA, 15 nt, Yersinia pestis KIM
cauguaacggucaua

SEQ ID NO: 4208635 - RNA, 11 nt, Yersinia pestis KIM
cauguacaccg

SEQ ID NO: 4208636 - RNA, 23 nt, Yersinia pestis KIM
cauguacgcuccgguucuugcgc

SEQ ID NO: 4208637 - RNA, 20 nt, Yersinia pestis KIM
cauguacuagaucacagacg

SEQ ID NO: 4208638 - RNA, 14 nt, Yersinia pestis KIM
cauguagcacacua

SEQ ID NO: 4208639 - RNA, 16 nt, Yersinia pestis KIM
cauguagcacacuacc

SEQ ID NO: 4208640 - RNA, 17 nt, Yersinia pestis KIM
cauguagccauugcgca

SEQ ID NO: 4208641 - RNA, 21 nt, Yersinia pestis KIM
cauguaguacuuaccuuccca

SEQ ID NO: 4208642 - RNA, 16 nt, Yersinia pestis KIM
caugucacuguucuug

SEQ ID NO: 4208643 - RNA, 20 nt, Yersinia pestis KIM
caugucagacagcacgggcu

SEQ ID NO: 4208644 - RNA, 16 nt, Yersinia pestis KIM
caugucccucuguccc

SEQ ID NO: 4208645 - RNA, 18 nt, Yersinia pestis KIM
cauguccguguuggcaaa

SEQ ID NO: 4208646 - RNA, 20 nt, Yersinia pestis KIM
caugucggcagguaaugcau

SEQ ID NO: 4208647 - RNA, 11 nt, Yersinia pestis KIM
caugugguuac

SEQ ID NO: 4208648 - RNA, 14 nt, Yersinia pestis KIM
caugugguuaccau

SEQ ID NO: 4208649 - RNA, 23 nt, Yersinia pestis KIM
cauguguauuagguuuggccuaa

SEQ ID NO: 4208650 - RNA, 21 nt, Yersinia pestis KIM
cauguguuuguuuggauaaaa

SEQ ID NO: 4208651 - RNA, 19 nt, Yersinia pestis KIM
cauguucacccaguaacug

SEQ ID NO: 4208652 - RNA, 11 nt, Yersinia pestis KIM
cauguucaucu

SEQ ID NO: 4208653 - RNA, 17 nt, Yersinia pestis KIM
cauguucgcacugcucu

SEQ ID NO: 4208654 - RNA, 12 nt, Yersinia pestis KIM
cauguugaccaa

SEQ ID NO: 4208655 - RNA, 13 nt, Yersinia pestis KIM
cauguugcaacau

SEQ ID NO: 4208656 - RNA, 12 nt, Yersinia pestis KIM
cauguugcaucg

SEQ ID NO: 4208657 - RNA, 22 nt, Yersinia pestis KIM
cauguugugugugaagugugca

SEQ ID NO: 4208658 - RNA, 15 nt, Yersinia pestis KIM
cauguuuaucaaaca

SEQ ID NO: 4208659 - RNA, 13 nt, Yersinia pestis KIM
cauuaaaaacaaa

SEQ ID NO: 4208660 - RNA, 14 nt, Yersinia pestis KIM
cauuaaaagcaugc

SEQ ID NO: 4208661 - RNA, 15 nt, Yersinia pestis KIM
cauuaaacuguucuu

SEQ ID NO: 4208662 - RNA, 21 nt, Yersinia pestis KIM
cauuaaagauuucaucauuca

SEQ ID NO: 4208663 - RNA, 22 nt, Yersinia pestis KIM
cauuaaagauuucaucauucaa

SEQ ID NO: 4208664 - RNA, 19 nt, Yersinia pestis KIM
cauuaaagguacguaauuu

SEQ ID NO: 4208665 - RNA, 17 nt, Yersinia pestis KIM
cauuaaaugcuuuuugc

SEQ ID NO: 4208666 - RNA, 13 nt, Yersinia pestis KIM
cauuaacaaacug

SEQ ID NO: 4208667 - RNA, 21 nt, Yersinia pestis KIM
cauuaacacauuaauuuaucu

SEQ ID NO: 4208668 - RNA, 12 nt, Yersinia pestis KIM
cauuaagaugca

SEQ ID NO: 4208669 - RNA, 16 nt, Yersinia pestis KIM
cauuaauaauaugcac

SEQ ID NO: 4208670 - RNA, 15 nt, Yersinia pestis KIM
cauuaaucagcgaau

SEQ ID NO: 4208671 - RNA, 18 nt, Yersinia pestis KIM
cauuaaucagcgaaugcc

SEQ ID NO: 4208672 - RNA, 14 nt, Yersinia pestis KIM
cauuucauuaaaug

SEQ ID NO: 4208673 - RNA, 21 nt, Yersinia pestis KIM
cauuucccugcggccauccag

SEQ ID NO: 4208674 - RNA, 22 nt, Yersinia pestis KIM
cauuuccguuaacccaaagccc

SEQ ID NO: 4208675 - RNA, 23 nt, Yersinia pestis KIM
cauuuccuguguuuugagcauca

SEQ ID NO: 4208676 - RNA, 16 nt, Yersinia pestis KIM
cauuucgcuccaccag

SEQ ID NO: 4208677 - RNA, 19 nt, Yersinia pestis KIM
cauuucgcuccaccagccc

SEQ ID NO: 4208678 - RNA, 14 nt, Yersinia pestis KIM
cauuucguagccuu

SEQ ID NO: 4208679 - RNA, 19 nt, Yersinia pestis KIM
cauuucucaucgcuuuuuu

SEQ ID NO: 4208680 - RNA, 19 nt, Yersinia pestis KIM
cauuucuuuuuauguuaaa

SEQ ID NO: 4208681 - RNA, 23 nt, Yersinia pestis KIM
cauuucuuuuucaacucagcggc

SEQ ID NO: 4208682 - RNA, 15 nt, Yersinia pestis KIM
cauuugauacuaaau

SEQ ID NO: 4208683 - RNA, 17 nt, Yersinia pestis KIM
cauuugauacuaaauuu

SEQ ID NO: 4208684 - RNA, 17 nt, Yersinia pestis KIM
cauuugcacagcauuua

SEQ ID NO: 4208685 - RNA, 18 nt, Yersinia pestis KIM
cauuugcucgauuucacu

SEQ ID NO: 4208686 - RNA, 14 nt, Yersinia pestis KIM
cauuugggguguua

SEQ ID NO: 4208687 - RNA, 17 nt, Yersinia pestis KIM
cauuuguuaaucgcuga

SEQ ID NO: 4208688 - RNA, 13 nt, Yersinia pestis KIM
cauuuguuucuga

SEQ ID NO: 4208689 - RNA, 14 nt, Yersinia pestis KIM
cauuuuaaaaaaau

SEQ ID NO: 4208690 - RNA, 20 nt, Yersinia pestis KIM
cauuuuaacaacccauuucc

SEQ ID NO: 4208691 - RNA, 19 nt, Yersinia pestis KIM
cauuuuaaucucuccauga

SEQ ID NO: 4208692 - RNA, 20 nt, Yersinia pestis KIM
cauuuuacaggauuaaauaa

SEQ ID NO: 4208693 - RNA, 12 nt, Yersinia pestis KIM
cauuuuacgccu

SEQ ID NO: 4208694 - RNA, 17 nt, Yersinia pestis KIM
cauuuuauccucuucca

SEQ ID NO: 4208695 - RNA, 16 nt, Yersinia pestis KIM
cauuuuccugcauauu

SEQ ID NO: 4208696 - RNA, 17 nt, Yersinia pestis KIM
cauuuucuaagcugccu

SEQ ID NO: 4208697 - RNA, 20 nt, Yersinia pestis KIM
cauuuucuaagcugccugug

SEQ ID NO: 4208698 - RNA, 22 nt, Yersinia pestis KIM
cauuuucuaagcugccugugcg

SEQ ID NO: 4208699 - RNA, 19 nt, Yersinia pestis KIM
cauuuucuggugagcauca

SEQ ID NO: 4208700 - RNA, 13 nt, Yersinia pestis KIM
cauuuugcugcca

SEQ ID NO: 4208701 - RNA, 13 nt, Yersinia pestis KIM
cauuuuuaacauc

SEQ ID NO: 4208702 - RNA, 14 nt, Yersinia pestis KIM
cauuuuucuauuuc

SEQ ID NO: 4208703 - RNA, 17 nt, Yersinia pestis KIM
cauuuuuuaccauuacc

SEQ ID NO: 4208704 - RNA, 21 nt, Yersinia pestis KIM
cauuuuuuagcccuaacugcu

SEQ ID NO: 4208705 - RNA, 18 nt, Yersinia pestis KIM
cauuuuuuauaaacacuu

SEQ ID NO: 4208706 - RNA, 23 nt, Yersinia pestis KIM
cauuuuuuaucuuguaaauaguc

SEQ ID NO: 4208707 - RNA, 11 nt, Yersinia pestis KIM
cauuuuuucuu

SEQ ID NO: 4208708 - RNA, 14 nt, Yersinia pestis KIM
cauuuuuuguagug

SEQ ID NO: 4208709 - RNA, 15 nt, Yersinia pestis KIM
cauuuuuuguaguga

SEQ ID NO: 4208710 - RNA, 16 nt, Yersinia pestis KIM
cauuuuuuuuauuuuc

SEQ ID NO: 4208711 - RNA, 12 nt, Yersinia pestis KIM
ccaaaacagccu

SEQ ID NO: 4208712 - RNA, 19 nt, Yersinia pestis KIM
ccaaaacagccuaaggcca

SEQ ID NO: 4208713 - RNA, 18 nt, Yersinia pestis KIM
ccaaaacgaacaaaaugg

SEQ ID NO: 4208714 - RNA, 16 nt, Yersinia pestis KIM
ccaaaaguaucuuuca

SEQ ID NO: 4208715 - RNA, 13 nt, Yersinia pestis KIM
ccaaaauaauaua

SEQ ID NO: 4208716 - RNA, 20 nt, Yersinia pestis KIM
ccaaaauacggccagucaaa

SEQ ID NO: 4208717 - RNA, 22 nt, Yersinia pestis KIM
ccaaaauaugauaguguaaaaa

SEQ ID NO: 4208718 - RNA, 21 nt, Yersinia pestis KIM
ccaaaaucaccccacuagaaa

SEQ ID NO: 4208719 - RNA, 19 nt, Yersinia pestis KIM
ccaaaauuuagaagcccug

SEQ ID NO: 4208720 - RNA, 12 nt, Yersinia pestis KIM
ccaaaauuugcu

SEQ ID NO: 4208721 - RNA, 14 nt, Yersinia pestis KIM
ccaaacaaaugaac

SEQ ID NO: 4208722 - RNA, 11 nt, Yersinia pestis KIM
ccaaacagaau

SEQ ID NO: 4208723 - RNA, 19 nt, Yersinia pestis KIM
ccaaacauugucaccugaa

SEQ ID NO: 4208724 - RNA, 12 nt, Yersinia pestis KIM
ccaaacauuuuc

SEQ ID NO: 4208725 - RNA, 18 nt, Yersinia pestis KIM
ccaaacauuuucaucuga

SEQ ID NO: 4208726 - RNA, 14 nt, Yersinia pestis KIM
ccaaacggaauggu

SEQ ID NO: 4208727 - RNA, 15 nt, Yersinia pestis KIM
ccaaagacaauugag

SEQ ID NO: 4208728 - RNA, 22 nt, Yersinia pestis KIM
ccaaagauaauacauaaaauca

SEQ ID NO: 4208729 - RNA, 18 nt, Yersinia pestis KIM
ccaaagauauguucuucc

SEQ ID NO: 4208730 - RNA, 15 nt, Yersinia pestis KIM
ccaaagauggcgcgg

SEQ ID NO: 4208731 - RNA, 21 nt, Yersinia pestis KIM
ccaaagcaguaaacauuuuga

SEQ ID NO: 4208732 - RNA, 22 nt, Yersinia pestis KIM
ccaaagcccuuauccguuaacc

SEQ ID NO: 4208733 - RNA, 16 nt, Yersinia pestis KIM
ccaaaggcuauuuaag

SEQ ID NO: 4208734 - RNA, 19 nt, Yersinia pestis KIM
ccaaagggagccauugcaa

SEQ ID NO: 4208735 - RNA, 17 nt, Yersinia pestis KIM
ccaaagggcgacagggu

SEQ ID NO: 4208736 - RNA, 14 nt, Yersinia pestis KIM
ccaaagucauuggc

SEQ ID NO: 4208737 - RNA, 12 nt, Yersinia pestis KIM
ccaaauaaaaca

SEQ ID NO: 4208738 - RNA, 18 nt, Yersinia pestis KIM
ccaaauacauauaaccau

SEQ ID NO: 4208739 - RNA, 17 nt, Yersinia pestis KIM
ccaaauagugauuagca

SEQ ID NO: 4208740 - RNA, 15 nt, Yersinia pestis KIM
ccaaauccaacuggc

SEQ ID NO: 4208741 - RNA, 18 nt, Yersinia pestis KIM
ccaaaucucaucggcaua

SEQ ID NO: 4208742 - RNA, 17 nt, Yersinia pestis KIM
ccaaaucugccugauac

SEQ ID NO: 4208743 - RNA, 12 nt, Yersinia pestis KIM
ccaaaucuucca

SEQ ID NO: 4208744 - RNA, 14 nt, Yersinia pestis KIM
ccaaaucuuccagc

SEQ ID NO: 4208745 - RNA, 17 nt, Yersinia pestis KIM
ccaaaucuuccagcggc

SEQ ID NO: 4208746 - RNA, 16 nt, Yersinia pestis KIM
ccaaaugcaaaccagg

SEQ ID NO: 4208747 - RNA, 20 nt, Yersinia pestis KIM
ccaaaugcccauuaguaaug

SEQ ID NO: 4208748 - RNA, 19 nt, Yersinia pestis KIM
ccaaauggacgaacagccc

SEQ ID NO: 4208749 - RNA, 13 nt, Yersinia pestis KIM
ccaaaugguuagu

SEQ ID NO: 4208750 - RNA, 14 nt, Yersinia pestis KIM
ccaaauucagaaug

SEQ ID NO: 4208751 - RNA, 22 nt, Yersinia pestis KIM
ccaacaacugccaaauuuggcc

SEQ ID NO: 4208752 - RNA, 14 nt, Yersinia pestis KIM
ccaacaacugcccc

SEQ ID NO: 4208753 - RNA, 16 nt, Yersinia pestis KIM
ccaacaacugccccuc

SEQ ID NO: 4208754 - RNA, 23 nt, Yersinia pestis KIM
ccaacaacuucaccacugugaua

SEQ ID NO: 4208755 - RNA, 19 nt, Yersinia pestis KIM
ccaacaauauucgcagcca

SEQ ID NO: 4208756 - RNA, 15 nt, Yersinia pestis KIM
ccaacaaugaacugu

SEQ ID NO: 4208757 - RNA, 17 nt, Yersinia pestis KIM
ccaacaauugcuccagu

SEQ ID NO: 4208758 - RNA, 22 nt, Yersinia pestis KIM
ccaacaccacacugagcaccgc

SEQ ID NO: 4208759 - RNA, 12 nt, Yersinia pestis KIM
ccaacacgauau

SEQ ID NO: 4208760 - RNA, 23 nt, Yersinia pestis KIM
ccaacacguggguauccaguguc

SEQ ID NO: 4208761 - RNA, 21 nt, Yersinia pestis KIM
ccaacacuccucuuucuuaau

SEQ ID NO: 4208762 - RNA, 16 nt, Yersinia pestis KIM
ccaacacuggggcgca

SEQ ID NO: 4208763 - RNA, 16 nt, Yersinia pestis KIM
ccaacagcauuaccaa

SEQ ID NO: 4208764 - RNA, 17 nt, Yersinia pestis KIM
ccaacaguuauuuuaau

SEQ ID NO: 4208765 - RNA, 22 nt, Yersinia pestis KIM
ccaacaucgcuugugcuacauc

SEQ ID NO: 4208766 - RNA, 16 nt, Yersinia pestis KIM
ccaacauugauaagcc

SEQ ID NO: 4208767 - RNA, 13 nt, Yersinia pestis KIM
ccaaccgguauug

SEQ ID NO: 4208768 - RNA, 16 nt, Yersinia pestis KIM
ccaaccugcaaugccu

SEQ ID NO: 4208769 - RNA, 23 nt, Yersinia pestis KIM
ccaacgcacaugcaacuugaggu

SEQ ID NO: 4208770 - RNA, 21 nt, Yersinia pestis KIM
ccaacgcacugguugcuucau

SEQ ID NO: 4208771 - RNA, 21 nt, Yersinia pestis KIM
ccaacggcuaacgguaaauaa

SEQ ID NO: 4208772 - RNA, 23 nt, Yersinia pestis KIM
ccaacgguagggcguucugucac

SEQ ID NO: 4208773 - RNA, 21 nt, Yersinia pestis KIM
ccaacgguagguucaacccaa

SEQ ID NO: 4208774 - RNA, 20 nt, Yersinia pestis KIM
ccaacuaaacagggcagaaa

SEQ ID NO: 4208775 - RNA, 21 nt, Yersinia pestis KIM
ccaacucaccuuuaucgcgga

SEQ ID NO: 4208776 - RNA, 21 nt, Yersinia pestis KIM
ccaacuccaucgccacuucua

SEQ ID NO: 4208777 - RNA, 18 nt, Yersinia pestis KIM
ccaacuccugccuacgcu

SEQ ID NO: 4208778 - RNA, 12 nt, Yersinia pestis KIM
ccaacugaaacg

SEQ ID NO: 4208779 - RNA, 17 nt, Yersinia pestis KIM
ccaacugaggcagaaug

SEQ ID NO: 4208780 - RNA, 18 nt, Yersinia pestis KIM
ccaacugaggcagaaugg

SEQ ID NO: 4208781 - RNA, 16 nt, Yersinia pestis KIM
ccaacuggccgccauc

SEQ ID NO: 4208782 - RNA, 14 nt, Yersinia pestis KIM
ccaacuguaaaauc

SEQ ID NO: 4208783 - RNA, 23 nt, Yersinia pestis KIM
ccaacuucguuccaguggucauc

SEQ ID NO: 4208784 - RNA, 14 nt, Yersinia pestis KIM
ccaagaaaagcacc

SEQ ID NO: 4208785 - RNA, 16 nt, Yersinia pestis KIM
ccaagaaaagcaccgc

SEQ ID NO: 4208786 - RNA, 17 nt, Yersinia pestis KIM
ccaagaaaagcaccgca

SEQ ID NO: 4208787 - RNA, 14 nt, Yersinia pestis KIM
ccaccacugcauca

SEQ ID NO: 4208788 - RNA, 16 nt, Yersinia pestis KIM
ccaccaguaaacgcca

SEQ ID NO: 4208789 - RNA, 21 nt, Yersinia pestis KIM
ccaccaguaaacgccaaucac

SEQ ID NO: 4208790 - RNA, 16 nt, Yersinia pestis KIM
ccaccaucacuuccag

SEQ ID NO: 4208791 - RNA, 22 nt, Yersinia pestis KIM
ccaccauuugggguguuacccc

SEQ ID NO: 4208792 - RNA, 15 nt, Yersinia pestis KIM
ccacccccagugcug

SEQ ID NO: 4208793 - RNA, 14 nt, Yersinia pestis KIM
ccaccccccccuua

SEQ ID NO: 4208794 - RNA, 14 nt, Yersinia pestis KIM
ccaccccguggcag

SEQ ID NO: 4208795 - RNA, 20 nt, Yersinia pestis KIM
ccacccguugcauuuuucug

SEQ ID NO: 4208796 - RNA, 20 nt, Yersinia pestis KIM
ccacccugccaaaaaauaag

SEQ ID NO: 4208797 - RNA, 21 nt, Yersinia pestis KIM
ccaccgagguuaucagccucu

SEQ ID NO: 4208798 - RNA, 17 nt, Yersinia pestis KIM
ccaccgcagcaaccguc

SEQ ID NO: 4208799 - RNA, 16 nt, Yersinia pestis KIM
ccaccggcaguucauu

SEQ ID NO: 4208800 - RNA, 19 nt, Yersinia pestis KIM
ccaccggcaguucauuccc

SEQ ID NO: 4208801 - RNA, 21 nt, Yersinia pestis KIM
ccaccgucaagacaacaaaca

SEQ ID NO: 4208802 - RNA, 14 nt, Yersinia pestis KIM
ccaccgucaccaaa

SEQ ID NO: 4208803 - RNA, 15 nt, Yersinia pestis KIM
ccaccgucuguggug

SEQ ID NO: 4208804 - RNA, 17 nt, Yersinia pestis KIM
ccaccuaucuauuuuua

SEQ ID NO: 4208805 - RNA, 21 nt, Yersinia pestis KIM
ccaccugacuguggcugcucu

SEQ ID NO: 4208806 - RNA, 21 nt, Yersinia pestis KIM
ccaccugcccguuuauuaaug

SEQ ID NO: 4208807 - RNA, 21 nt, Yersinia pestis KIM
ccaccuuaaguaaguuuaaac

SEQ ID NO: 4208808 - RNA, 15 nt, Yersinia pestis KIM
ccaccuucggcugcc

SEQ ID NO: 4208809 - RNA, 16 nt, Yersinia pestis KIM
ccaccuuuaccaugcu

SEQ ID NO: 4208810 - RNA, 13 nt, Yersinia pestis KIM
ccacgaaaaaaug

SEQ ID NO: 4208811 - RNA, 13 nt, Yersinia pestis KIM
ccacgaggacagg

SEQ ID NO: 4208812 - RNA, 20 nt, Yersinia pestis KIM
ccacgaguuuucccugcgcc

SEQ ID NO: 4208813 - RNA, 16 nt, Yersinia pestis KIM
ccacgaugugaagcaa

SEQ ID NO: 4208814 - RNA, 17 nt, Yersinia pestis KIM
ccacgauuagcccguuc

SEQ ID NO: 4208815 - RNA, 19 nt, Yersinia pestis KIM
ccacgcaggcaaucagaau

SEQ ID NO: 4208816 - RNA, 16 nt, Yersinia pestis KIM
ccacgcauuccaucag

SEQ ID NO: 4208817 - RNA, 18 nt, Yersinia pestis KIM
ccacgccaacccucuucc

SEQ ID NO: 4208818 - RNA, 23 nt, Yersinia pestis KIM
ccacgccagccuguuaauaauuc

SEQ ID NO: 4208819 - RNA, 19 nt, Yersinia pestis KIM
ccacgccaguaaacagcca

SEQ ID NO: 4208820 - RNA, 22 nt, Yersinia pestis KIM
ccacgccaguaaacagccagca

SEQ ID NO: 4208821 - RNA, 14 nt, Yersinia pestis KIM
ccacgcugugucaa

SEQ ID NO: 4208822 - RNA, 12 nt, Yersinia pestis KIM
ccacgcuuuagc

SEQ ID NO: 4208823 - RNA, 16 nt, Yersinia pestis KIM
ccacggccaaguagau

SEQ ID NO: 4208824 - RNA, 18 nt, Yersinia pestis KIM
ccacggcgcugcagcgau

SEQ ID NO: 4208825 - RNA, 21 nt, Yersinia pestis KIM
ccacggcgggcaacagagaaa

SEQ ID NO: 4208826 - RNA, 18 nt, Yersinia pestis KIM
ccacggcguuacuggcga

SEQ ID NO: 4208827 - RNA, 15 nt, Yersinia pestis KIM
ccacggcucacacac

SEQ ID NO: 4208828 - RNA, 22 nt, Yersinia pestis KIM
ccacgggcauccgcuucgcugg

SEQ ID NO: 4208829 - RNA, 17 nt, Yersinia pestis KIM
ccacgucuaauugcugc

SEQ ID NO: 4208830 - RNA, 20 nt, Yersinia pestis KIM
ccacgucuaauugcugccca

SEQ ID NO: 4208831 - RNA, 16 nt, Yersinia pestis KIM
ccacguuuugacgcgu

SEQ ID NO: 4208832 - RNA, 12 nt, Yersinia pestis KIM
ccacuaauauuc

SEQ ID NO: 4208833 - RNA, 16 nt, Yersinia pestis KIM
ccacuaauauuccuga

SEQ ID NO: 4208834 - RNA, 15 nt, Yersinia pestis KIM
ccacuaauucaucuc

SEQ ID NO: 4208835 - RNA, 14 nt, Yersinia pestis KIM
ccacuacggcgacu

SEQ ID NO: 4208836 - RNA, 20 nt, Yersinia pestis KIM
ccacuacugaacgucauaau

SEQ ID NO: 4208837 - RNA, 22 nt, Yersinia pestis KIM
ccacuaugcccaguuuaccauc

SEQ ID NO: 4208838 - RNA, 20 nt, Yersinia pestis KIM
ccacucaacugauguuuuag

SEQ ID NO: 4208839 - RNA, 13 nt, Yersinia pestis KIM
ccacucuagcugu

SEQ ID NO: 4208840 - RNA, 13 nt, Yersinia pestis KIM
ccacucucccuca

SEQ ID NO: 4208841 - RNA, 17 nt, Yersinia pestis KIM
ccacucucccucaguga

SEQ ID NO: 4208842 - RNA, 21 nt, Yersinia pestis KIM
ccacucuggggcaaucaaugu

SEQ ID NO: 4208843 - RNA, 15 nt, Yersinia pestis KIM
ccacugaccuauuga

SEQ ID NO: 4208844 - RNA, 23 nt, Yersinia pestis KIM
ccacugaccuauugauaaaacca

SEQ ID NO: 4208845 - RNA, 20 nt, Yersinia pestis KIM
ccacugagcaaacagugcac

SEQ ID NO: 4208846 - RNA, 16 nt, Yersinia pestis KIM
ccacugauacccaguu

SEQ ID NO: 4208847 - RNA, 14 nt, Yersinia pestis KIM
ccacugcaucaucg

SEQ ID NO: 4208848 - RNA, 14 nt, Yersinia pestis KIM
ccacuggccugaga

SEQ ID NO: 4208849 - RNA, 16 nt, Yersinia pestis KIM
ccacuggccugagaac

SEQ ID NO: 4208850 - RNA, 20 nt, Yersinia pestis KIM
ccacuggguuacauccugaa

SEQ ID NO: 4208851 - RNA, 14 nt, Yersinia pestis KIM
ccacugguugaaag

SEQ ID NO: 4208852 - RNA, 14 nt, Yersinia pestis KIM
ccacuguuuuucau

SEQ ID NO: 4208853 - RNA, 16 nt, Yersinia pestis KIM
ccacuuaguggcauug

SEQ ID NO: 4208854 - RNA, 14 nt, Yersinia pestis KIM
ccacuugcaacauu

SEQ ID NO: 4208855 - RNA, 17 nt, Yersinia pestis KIM
ccacuuguaccugugcc

SEQ ID NO: 4208856 - RNA, 20 nt, Yersinia pestis KIM
ccacuuguaccugugccagu

SEQ ID NO: 4208857 - RNA, 15 nt, Yersinia pestis KIM
ccacuuugcugugag

SEQ ID NO: 4208858 - RNA, 19 nt, Yersinia pestis KIM
ccacuuuuaccgcaaccac

SEQ ID NO: 4208859 - RNA, 17 nt, Yersinia pestis KIM
ccagaaaacccccagcu

SEQ ID NO: 4208860 - RNA, 19 nt, Yersinia pestis KIM
ccagaaaaccuucagcaaa

SEQ ID NO: 4208861 - RNA, 18 nt, Yersinia pestis KIM
ccagaaacggcaucugcc

SEQ ID NO: 4208862 - RNA, 15 nt, Yersinia pestis KIM
ccagaaaggcaaaaa

SEQ ID NO: 4208863 - RNA, 21 nt, Yersinia pestis KIM
ccagaacaauaccgccaauau

SEQ ID NO: 4208864 - RNA, 20 nt, Yersinia pestis KIM
ccagaaccucaacauucuuu

SEQ ID NO: 4208865 - RNA, 17 nt, Yersinia pestis KIM
ccagaagaacagcccuc

SEQ ID NO: 4208866 - RNA, 16 nt, Yersinia pestis KIM
ccagaauauaaaagca

SEQ ID NO: 4208867 - RNA, 21 nt, Yersinia pestis KIM
ccagaauuucauuguggagga

SEQ ID NO: 4208868 - RNA, 14 nt, Yersinia pestis KIM
ccagacaacaguca

SEQ ID NO: 4208869 - RNA, 23 nt, Yersinia pestis KIM
ccagacacugacaucaucaccua

SEQ ID NO: 4208870 - RNA, 20 nt, Yersinia pestis KIM
ccagaccgcguaagccgugc

SEQ ID NO: 4208871 - RNA, 18 nt, Yersinia pestis KIM
ccagacgaguauucccca

SEQ ID NO: 4208872 - RNA, 15 nt, Yersinia pestis KIM
ccagacugcugacaa

SEQ ID NO: 4208873 - RNA, 20 nt, Yersinia pestis KIM
ccagagacauaaagcccgcu

SEQ ID NO: 4208874 - RNA, 15 nt, Yersinia pestis KIM
ccagagagcugagau

SEQ ID NO: 4208875 - RNA, 13 nt, Yersinia pestis KIM
ccagagcccgggu

SEQ ID NO: 4208876 - RNA, 15 nt, Yersinia pestis KIM
ccagagcgacuuaau

SEQ ID NO: 4208877 - RNA, 18 nt, Yersinia pestis KIM
ccagagcgcggcuucagc

SEQ ID NO: 4208878 - RNA, 14 nt, Yersinia pestis KIM
ccagagcuugcugg

SEQ ID NO: 4208879 - RNA, 23 nt, Yersinia pestis KIM
ccagagugacaacaaaaaauaag

SEQ ID NO: 4208880 - RNA, 19 nt, Yersinia pestis KIM
ccagauaucccaacugaaa

SEQ ID NO: 4208881 - RNA, 19 nt, Yersinia pestis KIM
ccagaucuuuuucauucug

SEQ ID NO: 4208882 - RNA, 20 nt, Yersinia pestis KIM
ccagaucuuuuucauucuga

SEQ ID NO: 4208883 - RNA, 20 nt, Yersinia pestis KIM
ccagaugccaaauaucuuuc

SEQ ID NO: 4208884 - RNA, 12 nt, Yersinia pestis KIM
ccagauggccag

SEQ ID NO: 4208885 - RNA, 20 nt, Yersinia pestis KIM
ccagauugccaaucagaacu

SEQ ID NO: 4208886 - RNA, 14 nt, Yersinia pestis KIM
ccagauuggcgugu

SEQ ID NO: 4208887 - RNA, 16 nt, Yersinia pestis KIM
ccagauugucaaucac

SEQ ID NO: 4208888 - RNA, 17 nt, Yersinia pestis KIM
ccagcaaaauagcacag

SEQ ID NO: 4208889 - RNA, 18 nt, Yersinia pestis KIM
ccagcaaagccucuacca

SEQ ID NO: 4208890 - RNA, 15 nt, Yersinia pestis KIM
ccagcaaaggccacc

SEQ ID NO: 4208891 - RNA, 18 nt, Yersinia pestis KIM
ccagcaacguaacaugca

SEQ ID NO: 4208892 - RNA, 19 nt, Yersinia pestis KIM
ccagcaacucaagccacuc

SEQ ID NO: 4208893 - RNA, 13 nt, Yersinia pestis KIM
ccagcaagagcag

SEQ ID NO: 4208894 - RNA, 18 nt, Yersinia pestis KIM
ccagcaauaaaccacugg

SEQ ID NO: 4208895 - RNA, 17 nt, Yersinia pestis KIM
ccagcaauaagccacgc

SEQ ID NO: 4208896 - RNA, 18 nt, Yersinia pestis KIM
ccagcaauaagccacgcu

SEQ ID NO: 4208897 - RNA, 19 nt, Yersinia pestis KIM
ccagcaauuggccuuccau

SEQ ID NO: 4208898 - RNA, 12 nt, Yersinia pestis KIM
ccagcacagccu

SEQ ID NO: 4208899 - RNA, 15 nt, Yersinia pestis KIM
ccagcagaaccaugg

SEQ ID NO: 4208900 - RNA, 17 nt, Yersinia pestis KIM
ccagcagaaguuguugc

SEQ ID NO: 4208901 - RNA, 23 nt, Yersinia pestis KIM
ccagcagaaguuguugcccuuca

SEQ ID NO: 4208902 - RNA, 14 nt, Yersinia pestis KIM
ccagcagaauaauc

SEQ ID NO: 4208903 - RNA, 23 nt, Yersinia pestis KIM
ccagcagcauaauacgaucagcg

SEQ ID NO: 4208904 - RNA, 20 nt, Yersinia pestis KIM
ccagcaggcgugcugcuucc

SEQ ID NO: 4208905 - RNA, 22 nt, Yersinia pestis KIM
ccagcaggcgugcugcuuccug

SEQ ID NO: 4208906 - RNA, 15 nt, Yersinia pestis KIM
ccagcauaguaagcu

SEQ ID NO: 4208907 - RNA, 13 nt, Yersinia pestis KIM
ccagcaucaguag

SEQ ID NO: 4208908 - RNA, 20 nt, Yersinia pestis KIM
ccagcaugugguuaccauca

SEQ ID NO: 4208909 - RNA, 22 nt, Yersinia pestis KIM
ccagcaugugguuaccaucaac

SEQ ID NO: 4208910 - RNA, 15 nt, Yersinia pestis KIM
ccagcauucaggcuu

SEQ ID NO: 4208911 - RNA, 15 nt, Yersinia pestis KIM
ccagccaacuccuug

SEQ ID NO: 4208912 - RNA, 14 nt, Yersinia pestis KIM
ccagccaacuggcg

SEQ ID NO: 4208913 - RNA, 19 nt, Yersinia pestis KIM
ccagccaguugaucggcca

SEQ ID NO: 4208914 - RNA, 18 nt, Yersinia pestis KIM
ccagccauaaugccccgc

SEQ ID NO: 4208915 - RNA, 16 nt, Yersinia pestis KIM
ccagccauuaaauugc

SEQ ID NO: 4208916 - RNA, 13 nt, Yersinia pestis KIM
ccagcccuacugg

SEQ ID NO: 4208917 - RNA, 20 nt, Yersinia pestis KIM
ccagccgauaauccaccuga

SEQ ID NO: 4208918 - RNA, 20 nt, Yersinia pestis KIM
ccagccugguuuuuuaaaaa

SEQ ID NO: 4208919 - RNA, 19 nt, Yersinia pestis KIM
ccagccuuaacugcauagc

SEQ ID NO: 4208920 - RNA, 16 nt, Yersinia pestis KIM
ccagcgaaucaaacag

SEQ ID NO: 4208921 - RNA, 22 nt, Yersinia pestis KIM
ccagcgaggcuucucagcaagg

SEQ ID NO: 4208922 - RNA, 11 nt, Yersinia pestis KIM
ccagcgcccgg

SEQ ID NO: 4208923 - RNA, 17 nt, Yersinia pestis KIM
ccagcgccgauauacac

SEQ ID NO: 4208924 - RNA, 13 nt, Yersinia pestis KIM
ccagcgcggcgaa

SEQ ID NO: 4208925 - RNA, 16 nt, Yersinia pestis KIM
ccagcgcuuuaggcaa

SEQ ID NO: 4208926 - RNA, 14 nt, Yersinia pestis KIM
ccagcggcaccgcc

SEQ ID NO: 4208927 - RNA, 15 nt, Yersinia pestis KIM
ccagcggcaccgccg

SEQ ID NO: 4208928 - RNA, 14 nt, Yersinia pestis KIM
ccagcggcguauca

SEQ ID NO: 4208929 - RNA, 15 nt, Yersinia pestis KIM
ccagcgggaaucaaa

SEQ ID NO: 4208930 - RNA, 17 nt, Yersinia pestis KIM
ccagcgggaaucaaacu

SEQ ID NO: 4208931 - RNA, 16 nt, Yersinia pestis KIM
ccagcgggcgcagcca

SEQ ID NO: 4208932 - RNA, 22 nt, Yersinia pestis KIM
ccagcgguaaauugcucacuca

SEQ ID NO: 4208933 - RNA, 21 nt, Yersinia pestis KIM
ccagcguagguacuucucugg

SEQ ID NO: 4208934 - RNA, 18 nt, Yersinia pestis KIM
ccagcguggcccaggcaa

SEQ ID NO: 4208935 - RNA, 23 nt, Yersinia pestis KIM
ccagcguucuaucaaugccuugg

SEQ ID NO: 4208936 - RNA, 23 nt, Yersinia pestis KIM
ccagcguuggcagaaagugaccc

SEQ ID NO: 4208937 - RNA, 14 nt, Yersinia pestis KIM
ccagcuaggcuggg

SEQ ID NO: 4208938 - RNA, 14 nt, Yersinia pestis KIM
ccagcucauauaau

SEQ ID NO: 4208939 - RNA, 14 nt, Yersinia pestis KIM
ccagcuugggugaa

SEQ ID NO: 4208940 - RNA, 24 nt, Yersinia pestis KIM
ccagcuuuagcauugcagauuucu

SEQ ID NO: 4208941 - RNA, 16 nt, Yersinia pestis KIM
ccaggacuuuguuagc

SEQ ID NO: 4208942 - RNA, 15 nt, Yersinia pestis KIM
ccaggcaacgacagc

SEQ ID NO: 4208943 - RNA, 17 nt, Yersinia pestis KIM
ccaggcaacgacagcaa

SEQ ID NO: 4208944 - RNA, 16 nt, Yersinia pestis KIM
ccaggcaagaaacuuc

SEQ ID NO: 4208945 - RNA, 20 nt, Yersinia pestis KIM
ccaggcaagaaacuucauuu

SEQ ID NO: 4208946 - RNA, 22 nt, Yersinia pestis KIM
ccaggcaagaaacuucauuuca

SEQ ID NO: 4208947 - RNA, 13 nt, Yersinia pestis KIM
ccaggcaucaucu

SEQ ID NO: 4208948 - RNA, 18 nt, Yersinia pestis KIM
ccaggcauuaaaaucacc

SEQ ID NO: 4208949 - RNA, 19 nt, Yersinia pestis KIM
ccaggccuccgcaaacuua

SEQ ID NO: 4208950 - RNA, 20 nt, Yersinia pestis KIM
ccaggcgaucucuucggccc

SEQ ID NO: 4208951 - RNA, 16 nt, Yersinia pestis KIM
ccaggcgcuguugcau

SEQ ID NO: 4208952 - RNA, 20 nt, Yersinia pestis KIM
ccaggcugaacgcacaaugg

SEQ ID NO: 4208953 - RNA, 12 nt, Yersinia pestis KIM
ccaggcuggcca

SEQ ID NO: 4208954 - RNA, 16 nt, Yersinia pestis KIM
ccaggcuuucacggug

SEQ ID NO: 4208955 - RNA, 22 nt, Yersinia pestis KIM
ccagggcguuuaccauccagug

SEQ ID NO: 4208956 - RNA, 20 nt, Yersinia pestis KIM
ccaggggucgacguucauau

SEQ ID NO: 4208957 - RNA, 14 nt, Yersinia pestis KIM
ccagguaagaaaga

SEQ ID NO: 4208958 - RNA, 21 nt, Yersinia pestis KIM
ccagguaagaaagagaugacc

SEQ ID NO: 4208959 - RNA, 17 nt, Yersinia pestis KIM
ccaggucaguuuuaccc

SEQ ID NO: 4208960 - RNA, 15 nt, Yersinia pestis KIM
ccagguucaauuuca

SEQ ID NO: 4208961 - RNA, 19 nt, Yersinia pestis KIM
ccagguucauuauuuauuc

SEQ ID NO: 4208962 - RNA, 16 nt, Yersinia pestis KIM
ccaguaaaaaaauagc

SEQ ID NO: 4208963 - RNA, 16 nt, Yersinia pestis KIM
ccaguaaacagccagc

SEQ ID NO: 4208964 - RNA, 23 nt, Yersinia pestis KIM
ccaguaagcuguugaccugaaga

SEQ ID NO: 4208965 - RNA, 22 nt, Yersinia pestis KIM
ccaguagaucucuguuuuccau

SEQ ID NO: 4208966 - RNA, 14 nt, Yersinia pestis KIM
ccaguagcccagcc

SEQ ID NO: 4208967 - RNA, 15 nt, Yersinia pestis KIM
ccaguaggggccacc

SEQ ID NO: 4208968 - RNA, 22 nt, Yersinia pestis KIM
ccaguaggggccaccaaauaaa

SEQ ID NO: 4208969 - RNA, 18 nt, Yersinia pestis KIM
ccaguauugcagagcaaa

SEQ ID NO: 4208970 - RNA, 21 nt, Yersinia pestis KIM
ccagucacuaccgcucagaua

SEQ ID NO: 4208971 - RNA, 15 nt, Yersinia pestis KIM
ccagucauaaauauc

SEQ ID NO: 4208972 - RNA, 19 nt, Yersinia pestis KIM
ccagucauccaaacggaau

SEQ ID NO: 4208973 - RNA, 18 nt, Yersinia pestis KIM
ccagucgucuucagcuuc

SEQ ID NO: 4208974 - RNA, 18 nt, Yersinia pestis KIM
ccagugacuccccuguaa

SEQ ID NO: 4208975 - RNA, 18 nt, Yersinia pestis KIM
ccagugagccauguguuu

SEQ ID NO: 4208976 - RNA, 15 nt, Yersinia pestis KIM
ccagugaguccuuua

SEQ ID NO: 4208977 - RNA, 17 nt, Yersinia pestis KIM
ccagugaguccuuuacu

SEQ ID NO: 4208978 - RNA, 19 nt, Yersinia pestis KIM
ccagugcaaaaugcucuuc

SEQ ID NO: 4208979 - RNA, 20 nt, Yersinia pestis KIM
ccagugcaaaaugcucuuca

SEQ ID NO: 4208980 - RNA, 14 nt, Yersinia pestis KIM
ccagugcaaauuua

SEQ ID NO: 4208981 - RNA, 17 nt, Yersinia pestis KIM
ccagugcaaauuuaugc

SEQ ID NO: 4208982 - RNA, 15 nt, Yersinia pestis KIM
ccagugcgcaaaaau

SEQ ID NO: 4208983 - RNA, 13 nt, Yersinia pestis KIM
ccagugcggaagc

SEQ ID NO: 4208984 - RNA, 19 nt, Yersinia pestis KIM
ccagugcuuuauccaaugg

SEQ ID NO: 4208985 - RNA, 20 nt, Yersinia pestis KIM
ccaguguuagcuguuuuagu

SEQ ID NO: 4208986 - RNA, 20 nt, Yersinia pestis KIM
ccaguguuuucuccacacca

SEQ ID NO: 4208987 - RNA, 21 nt, Yersinia pestis KIM
ccaguguuuucuccacaccaa

SEQ ID NO: 4208988 - RNA, 23 nt, Yersinia pestis KIM
ccaguuacuaccuuuugcauauu

SEQ ID NO: 4208989 - RNA, 14 nt, Yersinia pestis KIM
ccaguucaguccag

SEQ ID NO: 4208990 - RNA, 20 nt, Yersinia pestis KIM
ccaguucugguagcugcuca

SEQ ID NO: 4208991 - RNA, 20 nt, Yersinia pestis KIM
ccaguugccacucauauuca

SEQ ID NO: 4208992 - RNA, 22 nt, Yersinia pestis KIM
ccaguugggauguucagcucaa

SEQ ID NO: 4208993 - RNA, 23 nt, Yersinia pestis KIM
ccaguuuccacgaaggcacccau

SEQ ID NO: 4208994 - RNA, 20 nt, Yersinia pestis KIM
ccauaaaaacuucagagcca

SEQ ID NO: 4208995 - RNA, 17 nt, Yersinia pestis KIM
ccauaaaauaaauaauu

SEQ ID NO: 4208996 - RNA, 14 nt, Yersinia pestis KIM
ccauaaaguuacug

SEQ ID NO: 4208997 - RNA, 22 nt, Yersinia pestis KIM
ccauaaccauugaaaccacggc

SEQ ID NO: 4208998 - RNA, 20 nt, Yersinia pestis KIM
ccauaaccugagcaccagaa

SEQ ID NO: 4208999 - RNA, 23 nt, Yersinia pestis KIM
ccauaacgccgacaacccgcuac

SEQ ID NO: 4209000 - RNA, 21 nt, Yersinia pestis KIM
ccauaagcgggguauuuuacu

SEQ ID NO: 4209001 - RNA, 18 nt, Yersinia pestis KIM
ccauaaggccaggcaaua

SEQ ID NO: 4209002 - RNA, 22 nt, Yersinia pestis KIM
ccauaagugaacaugaugaaug

SEQ ID NO: 4209003 - RNA, 22 nt, Yersinia pestis KIM
ccauaagugcacugaaccccaa

SEQ ID NO: 4209004 - RNA, 14 nt, Yersinia pestis KIM
ccauaaugugccuc

SEQ ID NO: 4209005 - RNA, 18 nt, Yersinia pestis KIM
ccauaauuaauuauucaa

SEQ ID NO: 4209006 - RNA, 12 nt, Yersinia pestis KIM
ccauaauuccac

SEQ ID NO: 4209007 - RNA, 22 nt, Yersinia pestis KIM
ccauaauucugccgacuaauau

SEQ ID NO: 4209008 - RNA, 14 nt, Yersinia pestis KIM
ccauacagaacugg

SEQ ID NO: 4209009 - RNA, 18 nt, Yersinia pestis KIM
ccauacagugucaguaug

SEQ ID NO: 4209010 - RNA, 14 nt, Yersinia pestis KIM
ccauacccaaacca

SEQ ID NO: 4209011 - RNA, 21 nt, Yersinia pestis KIM
ccauacccuuuggucaauaaa

SEQ ID NO: 4209012 - RNA, 14 nt, Yersinia pestis KIM
ccauacuguugcua

SEQ ID NO: 4209013 - RNA, 21 nt, Yersinia pestis KIM
ccauagauuaagaaaacauua

SEQ ID NO: 4209014 - RNA, 12 nt, Yersinia pestis KIM
ccauagauuaau

SEQ ID NO: 4209015 - RNA, 21 nt, Yersinia pestis KIM
ccauagcgcauuauaaggaga

SEQ ID NO: 4209016 - RNA, 22 nt, Yersinia pestis KIM
ccauuucccugcggccauccag

SEQ ID NO: 4209017 - RNA, 12 nt, Yersinia pestis KIM
ccauuucucuga

SEQ ID NO: 4209018 - RNA, 20 nt, Yersinia pestis KIM
ccauuuuaaucucuccauga

SEQ ID NO: 4209019 - RNA, 11 nt, Yersinia pestis KIM
ccauuuugcug

SEQ ID NO: 4209020 - RNA, 18 nt, Yersinia pestis KIM
ccauuuuuauaucagauu

SEQ ID NO: 4209021 - RNA, 21 nt, Yersinia pestis KIM
cccaaaaccaccaccccagca

SEQ ID NO: 4209022 - RNA, 15 nt, Yersinia pestis KIM
cccaaaccaacaaua

SEQ ID NO: 4209023 - RNA, 18 nt, Yersinia pestis KIM
cccaaagccuacgagaga

SEQ ID NO: 4209024 - RNA, 21 nt, Yersinia pestis KIM
cccaaauagcuggcauccuca

SEQ ID NO: 4209025 - RNA, 16 nt, Yersinia pestis KIM
cccaagauacuggaag

SEQ ID NO: 4209026 - RNA, 18 nt, Yersinia pestis KIM
cccaaggcgacuuugaug

SEQ ID NO: 4209027 - RNA, 20 nt, Yersinia pestis KIM
cccaauaagugaaacaaaua

SEQ ID NO: 4209028 - RNA, 21 nt, Yersinia pestis KIM
cccaauaagugaaacaaauac

SEQ ID NO: 4209029 - RNA, 17 nt, Yersinia pestis KIM
cccaauaauaaaaaaaa

SEQ ID NO: 4209030 - RNA, 13 nt, Yersinia pestis KIM
cccaaucaucauc

SEQ ID NO: 4209031 - RNA, 21 nt, Yersinia pestis KIM
cccaaucgauaauauuauuau

SEQ ID NO: 4209032 - RNA, 14 nt, Yersinia pestis KIM
cccaaucuaugacc

SEQ ID NO: 4209033 - RNA, 13 nt, Yersinia pestis KIM
cccaaucuugcaa

SEQ ID NO: 4209034 - RNA, 20 nt, Yersinia pestis KIM
cccaaugccauagcugcugc

SEQ ID NO: 4209035 - RNA, 13 nt, Yersinia pestis KIM
cccaauggcaaca

SEQ ID NO: 4209036 - RNA, 15 nt, Yersinia pestis KIM
cccacaucggccccu

SEQ ID NO: 4209037 - RNA, 13 nt, Yersinia pestis KIM
cccacauguucga

SEQ ID NO: 4209038 - RNA, 12 nt, Yersinia pestis KIM
cccacauucagg

SEQ ID NO: 4209039 - RNA, 14 nt, Yersinia pestis KIM
cccacauucaguac

SEQ ID NO: 4209040 - RNA, 14 nt, Yersinia pestis KIM
cccaccaaaccauu

SEQ ID NO: 4209041 - RNA, 12 nt, Yersinia pestis KIM
cccaccauaaug

SEQ ID NO: 4209042 - RNA, 21 nt, Yersinia pestis KIM
cccaccauaaugugccucgaa

SEQ ID NO: 4209043 - RNA, 17 nt, Yersinia pestis KIM
cccaccucuuaagccag

SEQ ID NO: 4209044 - RNA, 15 nt, Yersinia pestis KIM
cccacggcacauaau

SEQ ID NO: 4209045 - RNA, 11 nt, Yersinia pestis KIM
cccacguucag

SEQ ID NO: 4209046 - RNA, 16 nt, Yersinia pestis KIM
cccacguucccccgcc

SEQ ID NO: 4209047 - RNA, 21 nt, Yersinia pestis KIM
cccacguuuugacgcguagag

SEQ ID NO: 4209048 - RNA, 12 nt, Yersinia pestis KIM
cccacuaauauu

SEQ ID NO: 4209049 - RNA, 16 nt, Yersinia pestis KIM
cccacuaauauuccug

SEQ ID NO: 4209050 - RNA, 18 nt, Yersinia pestis KIM
cccacuauucuccaacaa

SEQ ID NO: 4209051 - RNA, 16 nt, Yersinia pestis KIM
cccacucgccccacaa

SEQ ID NO: 4209052 - RNA, 14 nt, Yersinia pestis KIM
cccacuuccaucug

SEQ ID NO: 4209053 - RNA, 19 nt, Yersinia pestis KIM
cccacuugaccuucccucu

SEQ ID NO: 4209054 - RNA, 18 nt, Yersinia pestis KIM
cccacuuguaccugugcc

SEQ ID NO: 4209055 - RNA, 19 nt, Yersinia pestis KIM
cccacuuguaccugugcca

SEQ ID NO: 4209056 - RNA, 16 nt, Yersinia pestis KIM
cccacuuuuugaauaa

SEQ ID NO: 4209057 - RNA, 14 nt, Yersinia pestis KIM
cccagaaaaccccc

SEQ ID NO: 4209058 - RNA, 20 nt, Yersinia pestis KIM
cccagacugcugacaaaccc

SEQ ID NO: 4209059 - RNA, 21 nt, Yersinia pestis KIM
cccagagcgcaaaagaccaag

SEQ ID NO: 4209060 - RNA, 22 nt, Yersinia pestis KIM
cccagagcgcggcuucagcacc

SEQ ID NO: 4209061 - RNA, 23 nt, Yersinia pestis KIM
cccagagcgcggcuucagcaccu

SEQ ID NO: 4209062 - RNA, 15 nt, Yersinia pestis KIM
cccagaucauccaga

SEQ ID NO: 4209063 - RNA, 18 nt, Yersinia pestis KIM
cccagcacagccugccgg

SEQ ID NO: 4209064 - RNA, 13 nt, Yersinia pestis KIM
cccagcagugcug

SEQ ID NO: 4209065 - RNA, 14 nt, Yersinia pestis KIM
cccagcagugcugc

SEQ ID NO: 4209066 - RNA, 15 nt, Yersinia pestis KIM
cccagcaucauaaga

SEQ ID NO: 4209067 - RNA, 12 nt, Yersinia pestis KIM
cccagccucugg

SEQ ID NO: 4209068 - RNA, 15 nt, Yersinia pestis KIM
cccagcgguugaggc

SEQ ID NO: 4209069 - RNA, 20 nt, Yersinia pestis KIM
cccaggcaaucucuccccaa

SEQ ID NO: 4209070 - RNA, 14 nt, Yersinia pestis KIM
cccaggcguucugu

SEQ ID NO: 4209071 - RNA, 12 nt, Yersinia pestis KIM
cccaggcugugg

SEQ ID NO: 4209072 - RNA, 15 nt, Yersinia pestis KIM
cccagguuacugccc

SEQ ID NO: 4209073 - RNA, 18 nt, Yersinia pestis KIM
cccagguuacugcccugg

SEQ ID NO: 4209074 - RNA, 22 nt, Yersinia pestis KIM
cccaguaaagcaaauucccacc

SEQ ID NO: 4209075 - RNA, 22 nt, Yersinia pestis KIM
cccagugcggaagcgccgacac

SEQ ID NO: 4209076 - RNA, 22 nt, Yersinia pestis KIM
cccaguugauggcugucuauug

SEQ ID NO: 4209077 - RNA, 20 nt, Yersinia pestis KIM
cccauaagcgggguauuuua

SEQ ID NO: 4209078 - RNA, 16 nt, Yersinia pestis KIM
cccauagcuggcuuca

SEQ ID NO: 4209079 - RNA, 18 nt, Yersinia pestis KIM
cccauaucuuuaaaaacc

SEQ ID NO: 4209080 - RNA, 11 nt, Yersinia pestis KIM
cccaucacuag

SEQ ID NO: 4209081 - RNA, 13 nt, Yersinia pestis KIM
cccaucagcacuc

SEQ ID NO: 4209082 - RNA, 15 nt, Yersinia pestis KIM
cccaucagcacuccc

SEQ ID NO: 4209083 - RNA, 16 nt, Yersinia pestis KIM
cccauccgcaggaagc

SEQ ID NO: 4209084 - RNA, 14 nt, Yersinia pestis KIM
cccauccuguucaa

SEQ ID NO: 4209085 - RNA, 12 nt, Yersinia pestis KIM
cccaucgccaau

SEQ ID NO: 4209086 - RNA, 15 nt, Yersinia pestis KIM
cccaugaccacuugg

SEQ ID NO: 4209087 - RNA, 21 nt, Yersinia pestis KIM
cccauuagcaguaacguccaa

SEQ ID NO: 4209088 - RNA, 17 nt, Yersinia pestis KIM
cccauuauaaauaauua

SEQ ID NO: 4209089 - RNA, 14 nt, Yersinia pestis KIM
cccauucacaccau

SEQ ID NO: 4209090 - RNA, 12 nt, Yersinia pestis KIM
cccauucaucaa

SEQ ID NO: 4209091 - RNA, 15 nt, Yersinia pestis KIM
cccauucgcgcccca

SEQ ID NO: 4209092 - RNA, 17 nt, Yersinia pestis KIM
cccauucgcgccccaaa

SEQ ID NO: 4209093 - RNA, 18 nt, Yersinia pestis KIM
cccauucgcgccccaaau

SEQ ID NO: 4209094 - RNA, 14 nt, Yersinia pestis KIM
cccauuuaucgcca

SEQ ID NO: 4209095 - RNA, 15 nt, Yersinia pestis KIM
cccauuuaucgccaa

SEQ ID NO: 4209096 - RNA, 18 nt, Yersinia pestis KIM
cccauuugucgcgccuga

SEQ ID NO: 4209097 - RNA, 22 nt, Yersinia pestis KIM
ccccaaauaaucagcucauuaa

SEQ ID NO: 4209098 - RNA, 19 nt, Yersinia pestis KIM
ccccaaccgaccacaaaau

SEQ ID NO: 4209099 - RNA, 20 nt, Yersinia pestis KIM
ccccaacucuuucaacuucc

SEQ ID NO: 4209100 - RNA, 15 nt, Yersinia pestis KIM
ccccaagcauagaag

SEQ ID NO: 4209101 - RNA, 13 nt, Yersinia pestis KIM
ccccaagcuuuug

SEQ ID NO: 4209102 - RNA, 12 nt, Yersinia pestis KIM
ccccaaucaagc

SEQ ID NO: 4209103 - RNA, 14 nt, Yersinia pestis KIM
ccccaaugaugacu

SEQ ID NO: 4209104 - RNA, 20 nt, Yersinia pestis KIM
ccccaauucacgcaaggcca

SEQ ID NO: 4209105 - RNA, 22 nt, Yersinia pestis KIM
ccccaauucacgcaaggccagg

SEQ ID NO: 4209106 - RNA, 15 nt, Yersinia pestis KIM
ccccacccugugagc

SEQ ID NO: 4209107 - RNA, 14 nt, Yersinia pestis KIM
ccccagaugaaugg

SEQ ID NO: 4209108 - RNA, 19 nt, Yersinia pestis KIM
ccccaguagcacaaugccu

SEQ ID NO: 4209109 - RNA, 12 nt, Yersinia pestis KIM
ccccauccccaa

SEQ ID NO: 4209110 - RNA, 13 nt, Yersinia pestis KIM
ccccaucgccaau

SEQ ID NO: 4209111 - RNA, 23 nt, Yersinia pestis KIM
ccccaucgccaauacaaucguca

SEQ ID NO: 4209112 - RNA, 15 nt, Yersinia pestis KIM
cccccacucgcccca

SEQ ID NO: 4209113 - RNA, 19 nt, Yersinia pestis KIM
cccccacucgccccacaau

SEQ ID NO: 4209114 - RNA, 11 nt, Yersinia pestis KIM
cccccagugcu

SEQ ID NO: 4209115 - RNA, 14 nt, Yersinia pestis KIM
ccccccaagagaaa

SEQ ID NO: 4209116 - RNA, 14 nt, Yersinia pestis KIM
ccccgcauaaauac

SEQ ID NO: 4209117 - RNA, 18 nt, Yersinia pestis KIM
ccccgcgauguaaauauc

SEQ ID NO: 4209118 - RNA, 16 nt, Yersinia pestis KIM
ccccgcuaauugcugc

SEQ ID NO: 4209119 - RNA, 18 nt, Yersinia pestis KIM
ccccgcuaccaagcccag

SEQ ID NO: 4209120 - RNA, 17 nt, Yersinia pestis KIM
ccccgcucgacucucaa

SEQ ID NO: 4209121 - RNA, 21 nt, Yersinia pestis KIM
ccccgcuucguccagaugcca

SEQ ID NO: 4209122 - RNA, 18 nt, Yersinia pestis KIM
ccccggucacuuaaauaa

SEQ ID NO: 4209123 - RNA, 21 nt, Yersinia pestis KIM
ccccuaaacgauagcgggcgg

SEQ ID NO: 4209124 - RNA, 15 nt, Yersinia pestis KIM
ccccuaauucuccuu

SEQ ID NO: 4209125 - RNA, 13 nt, Yersinia pestis KIM
ccccuagccagcc

SEQ ID NO: 4209126 - RNA, 17 nt, Yersinia pestis KIM
ccccucacauuacugau

SEQ ID NO: 4209127 - RNA, 12 nt, Yersinia pestis KIM
ccccugcgggua

SEQ ID NO: 4209128 - RNA, 11 nt, Yersinia pestis KIM
ccccugucucc

SEQ ID NO: 4209129 - RNA, 16 nt, Yersinia pestis KIM
ccccuucgagcaccgc

SEQ ID NO: 4209130 - RNA, 19 nt, Yersinia pestis KIM
ccccuucgauauuacaguu

SEQ ID NO: 4209131 - RNA, 18 nt, Yersinia pestis KIM
cccgaagcucaagcuggc

SEQ ID NO: 4209132 - RNA, 17 nt, Yersinia pestis KIM
ccgaagcucaagcuggu

SEQ ID NO: 4209133 - RNA, 13 nt, Yersinia pestis KIM
ccgaauaaaaccu

SEQ ID NO: 4209134 - RNA, 14 nt, Yersinia pestis KIM
ccgacacccagcca

SEQ ID NO: 4209135 - RNA, 14 nt, Yersinia pestis KIM
ccgaccaccacugc

SEQ ID NO: 4209136 - RNA, 19 nt, Yersinia pestis KIM
ccgacgugugcuguaagaa

SEQ ID NO: 4209137 - RNA, 19 nt, Yersinia pestis KIM
ccgacugagauuauuauua

SEQ ID NO: 4209138 - RNA, 15 nt, Yersinia pestis KIM
ccgacuugcccaaug

SEQ ID NO: 4209139 - RNA, 19 nt, Yersinia pestis KIM
ccgacuugcccaauggcaa

SEQ ID NO: 4209140 - RNA, 14 nt, Yersinia pestis KIM
ccgagaaacaaaac

SEQ ID NO: 4209141 - RNA, 16 nt, Yersinia pestis KIM
ccgagccgcaccaucu

SEQ ID NO: 4209142 - RNA, 18 nt, Yersinia pestis KIM
ccgagccgcaccaucuuc

SEQ ID NO: 4209143 - RNA, 16 nt, Yersinia pestis KIM
ccgaggugaagacacc

SEQ ID NO: 4209144 - RNA, 20 nt, Yersinia pestis KIM
ccgauaaaaacuauccgccc

SEQ ID NO: 4209145 - RNA, 16 nt, Yersinia pestis KIM
ccgauaaaccaacuga

SEQ ID NO: 4209146 - RNA, 14 nt, Yersinia pestis KIM
ccgauaaacgccag

SEQ ID NO: 4209147 - RNA, 19 nt, Yersinia pestis KIM
ccgauaacgcgaucugaag

SEQ ID NO: 4209148 - RNA, 20 nt, Yersinia pestis KIM
ccgauaauaaauauccuccg

SEQ ID NO: 4209149 - RNA, 16 nt, Yersinia pestis KIM
ccgauaaucaauuugu

SEQ ID NO: 4209150 - RNA, 15 nt, Yersinia pestis KIM
ccgauacuuuugcua

SEQ ID NO: 4209151 - RNA, 18 nt, Yersinia pestis KIM
ccgaucaacaggccaccu

SEQ ID NO: 4209152 - RNA, 13 nt, Yersinia pestis KIM
ccgaucaccgcaa

SEQ ID NO: 4209153 - RNA, 19 nt, Yersinia pestis KIM
ccgaugaaccaaccgccaa

SEQ ID NO: 4209154 - RNA, 18 nt, Yersinia pestis KIM
ccgaugacgcgaucugaa

SEQ ID NO: 4209155 - RNA, 19 nt, Yersinia pestis KIM
ccgaugacgcgaucugaaa

SEQ ID NO: 4209156 - RNA, 15 nt, Yersinia pestis KIM
ccgaugacucgaacu

SEQ ID NO: 4209157 - RNA, 20 nt, Yersinia pestis KIM
ccgaugacucgaucuugaac

SEQ ID NO: 4209158 - RNA, 14 nt, Yersinia pestis KIM
ccgaugagugaaau

SEQ ID NO: 4209159 - RNA, 17 nt, Yersinia pestis KIM
ccgaugcgacaauuucc

SEQ ID NO: 4209160 - RNA, 17 nt, Yersinia pestis KIM
ccgauggugugcagcaa

SEQ ID NO: 4209161 - RNA, 15 nt, Yersinia pestis KIM
ccgauuauaugaauc

SEQ ID NO: 4209162 - RNA, 16 nt, Yersinia pestis KIM
ccgauucggauaaccg

SEQ ID NO: 4209163 - RNA, 22 nt, Yersinia pestis KIM
ccgcaaaauggguauauuuacc

SEQ ID NO: 4209164 - RNA, 17 nt, Yersinia pestis KIM
ccgcaagaauaacuggg

SEQ ID NO: 4209165 - RNA, 21 nt, Yersinia pestis KIM
ccgcaauaaauggcauuuuuu

SEQ ID NO: 4209166 - RNA, 19 nt, Yersinia pestis KIM
ccgcaaucucuugacgccg

SEQ ID NO: 4209167 - RNA, 23 nt, Yersinia pestis KIM
ccgcaccaaugccgguccagacc

SEQ ID NO: 4209168 - RNA, 13 nt, Yersinia pestis KIM
ccgcaccacaaag

SEQ ID NO: 4209169 - RNA, 15 nt, Yersinia pestis KIM
ccgcaccacaaaggc

SEQ ID NO: 4209170 - RNA, 17 nt, Yersinia pestis KIM
ccgcaccacaaaggcaa

SEQ ID NO: 4209171 - RNA, 18 nt, Yersinia pestis KIM
ccgcacgaaccguggcgc

SEQ ID NO: 4209172 - RNA, 20 nt, Yersinia pestis KIM
ccgcacugggucaucaccca

SEQ ID NO: 4209173 - RNA, 18 nt, Yersinia pestis KIM
ccgcagacugcugacaaa

SEQ ID NO: 4209174 - RNA, 21 nt, Yersinia pestis KIM
ccgcagcaaccgucaccgugu

SEQ ID NO: 4209175 - RNA, 22 nt, Yersinia pestis KIM
ccgcagcggcuagcagcagguu

SEQ ID NO: 4209176 - RNA, 17 nt, Yersinia pestis KIM
ccgcaggucccucuuga

SEQ ID NO: 4209177 - RNA, 21 nt, Yersinia pestis KIM
ccgcaguccaaaaaacugcgg

SEQ ID NO: 4209178 - RNA, 16 nt, Yersinia pestis KIM
ccgcaucgugcuccgc

SEQ ID NO: 4209179 - RNA, 16 nt, Yersinia pestis KIM
ccgcaugcaacagaua

SEQ ID NO: 4209180 - RNA, 18 nt, Yersinia pestis KIM
ccgcauucaccaccauau

SEQ ID NO: 4209181 - RNA, 20 nt, Yersinia pestis KIM
ccgcauugaccgcuguuuga

SEQ ID NO: 4209182 - RNA, 20 nt, Yersinia pestis KIM
ccgcauuuucaaagguacgc

SEQ ID NO: 4209183 - RNA, 17 nt, Yersinia pestis KIM
ccgccaaauccaagcca

SEQ ID NO: 4209184 - RNA, 21 nt, Yersinia pestis KIM
ccgccacacaauacauagaag

SEQ ID NO: 4209185 - RNA, 16 nt, Yersinia pestis KIM
ccgccagaauaaacga

SEQ ID NO: 4209186 - RNA, 19 nt, Yersinia pestis KIM
ccgccagauuauccagccc

SEQ ID NO: 4209187 - RNA, 14 nt, Yersinia pestis KIM
ccgccagccccgcu

SEQ ID NO: 4209188 - RNA, 20 nt, Yersinia pestis KIM
ccgccagcugacccccgccg

SEQ ID NO: 4209189 - RNA, 22 nt, Yersinia pestis KIM
ccgccaggaaauuugcacugca

SEQ ID NO: 4209190 - RNA, 15 nt, Yersinia pestis KIM
ccgccaguaaaccug

SEQ ID NO: 4209191 - RNA, 22 nt, Yersinia pestis KIM
ccgccagugccaccguaaaaaa

SEQ ID NO: 4209192 - RNA, 21 nt, Yersinia pestis KIM
ccgccaguggcuuugcaccau

SEQ ID NO: 4209193 - RNA, 13 nt, Yersinia pestis KIM
ccgccauugccag

SEQ ID NO: 4209194 - RNA, 12 nt, Yersinia pestis KIM
ccgccccgggca

SEQ ID NO: 4209195 - RNA, 13 nt, Yersinia pestis KIM
ccgcccguagaaa

SEQ ID NO: 4209196 - RNA, 18 nt, Yersinia pestis KIM
ccgcccuugaccucauua

SEQ ID NO: 4209197 - RNA, 19 nt, Yersinia pestis KIM
ccgcccuuuagccagcggc

SEQ ID NO: 4209198 - RNA, 23 nt, Yersinia pestis KIM
ccgccgccaacagugaauaacug

SEQ ID NO: 4209199 - RNA, 15 nt, Yersinia pestis KIM
ccgccgccagccccg

SEQ ID NO: 4209200 - RNA, 19 nt, Yersinia pestis KIM
ccgccggauuucaauccga

SEQ ID NO: 4209201 - RNA, 21 nt, Yersinia pestis KIM
ccgccggguuuugcaucaagc

SEQ ID NO: 4209202 - RNA, 16 nt, Yersinia pestis KIM
ccgccgguuuuugccc

SEQ ID NO: 4209203 - RNA, 15 nt, Yersinia pestis KIM
ccgccgucaaaccaa

SEQ ID NO: 4209204 - RNA, 19 nt, Yersinia pestis KIM
ccgccgucaaaccaagccc

SEQ ID NO: 4209205 - RNA, 14 nt, Yersinia pestis KIM
ccgccugcguauug

SEQ ID NO: 4209206 - RNA, 13 nt, Yersinia pestis KIM
ccgcgaaaaacca

SEQ ID NO: 4209207 - RNA, 15 nt, Yersinia pestis KIM
ccgcgcaaccauccg

SEQ ID NO: 4209208 - RNA, 15 nt, Yersinia pestis KIM
ccgcgcaaccuggcc

SEQ ID NO: 4209209 - RNA, 12 nt, Yersinia pestis KIM
ccgcgcacagca

SEQ ID NO: 4209210 - RNA, 13 nt, Yersinia pestis KIM
ccgcgcacagcac

SEQ ID NO: 4209211 - RNA, 17 nt, Yersinia pestis KIM
ccgcgcauauaggcgaa

SEQ ID NO: 4209212 - RNA, 21 nt, Yersinia pestis KIM
ccgcgccaaggauggcgcggc

SEQ ID NO: 4209213 - RNA, 16 nt, Yersinia pestis KIM
ccgcgccauaaaagau

SEQ ID NO: 4209214 - RNA, 18 nt, Yersinia pestis KIM
ccgcgccauccuugccuu

SEQ ID NO: 4209215 - RNA, 16 nt, Yersinia pestis KIM
ccgcgcuuccaggcug

SEQ ID NO: 4209216 - RNA, 24 nt, Yersinia pestis KIM
ccgcggucaucaugguucugcuca

SEQ ID NO: 4209217 - RNA, 14 nt, Yersinia pestis KIM
ccgcgucuguuauc

SEQ ID NO: 4209218 - RNA, 15 nt, Yersinia pestis KIM
ccgcguucaaaucug

SEQ ID NO: 4209219 - RNA, 18 nt, Yersinia pestis KIM
ccgcguugucagccaugc

SEQ ID NO: 4209220 - RNA, 16 nt, Yersinia pestis KIM
ccgcuaaaucaucaaa

SEQ ID NO: 4209221 - RNA, 13 nt, Yersinia pestis KIM
ccgcuaaccuuaa

SEQ ID NO: 4209222 - RNA, 17 nt, Yersinia pestis KIM
ccgcuaaggccaaugga

SEQ ID NO: 4209223 - RNA, 19 nt, Yersinia pestis KIM
ccgcuaauauuuucagccc

SEQ ID NO: 4209224 - RNA, 16 nt, Yersinia pestis KIM
ccgcuaccacuccuua

SEQ ID NO: 4209225 - RNA, 19 nt, Yersinia pestis KIM
ccgcuagugauagcgggcc

SEQ ID NO: 4209226 - RNA, 20 nt, Yersinia pestis KIM
ccgcuagugauagcgggccu

SEQ ID NO: 4209227 - RNA, 13 nt, Yersinia pestis KIM
ccgcuaguuugac

SEQ ID NO: 4209228 - RNA, 15 nt, Yersinia pestis KIM
ccgcuauauuuuuac

SEQ ID NO: 4209229 - RNA, 18 nt, Yersinia pestis KIM
ccgcuaucacuagcgggc

SEQ ID NO: 4209230 - RNA, 20 nt, Yersinia pestis KIM
ccgcuaucacuagcgggccu

SEQ ID NO: 4209231 - RNA, 14 nt, Yersinia pestis KIM
ccgcucaacuuugc

SEQ ID NO: 4209232 - RNA, 11 nt, Yersinia pestis KIM
ccgcuccagca

SEQ ID NO: 4209233 - RNA, 16 nt, Yersinia pestis KIM
ccgcucgucacacugg

SEQ ID NO: 4209234 - RNA, 16 nt, Yersinia pestis KIM
ccgcucuucaccaauc

SEQ ID NO: 4209235 - RNA, 17 nt, Yersinia pestis KIM
ccgcugaucaggaaggu

SEQ ID NO: 4209236 - RNA, 12 nt, Yersinia pestis KIM
ccgcugcccggc

SEQ ID NO: 4209237 - RNA, 13 nt, Yersinia pestis KIM
ccgcugcccggcu

SEQ ID NO: 4209238 - RNA, 12 nt, Yersinia pestis KIM
ccgcuggcaaua

SEQ ID NO: 4209239 - RNA, 21 nt, Yersinia pestis KIM
ccgcuggcgaccacuuccugu

SEQ ID NO: 4209240 - RNA, 14 nt, Yersinia pestis KIM
ccgcugggccgucu

SEQ ID NO: 4209241 - RNA, 17 nt, Yersinia pestis KIM
ccgcuggucgauaagca

SEQ ID NO: 4209242 - RNA, 17 nt, Yersinia pestis KIM
ccgcuguaggugucacc

SEQ ID NO: 4209243 - RNA, 18 nt, Yersinia pestis KIM
ccgcuguaggugucacca

SEQ ID NO: 4209244 - RNA, 17 nt, Yersinia pestis KIM
ccgcuuaucccuccauc

SEQ ID NO: 4209245 - RNA, 19 nt, Yersinia pestis KIM
ccgcuuauggggacucuuu

SEQ ID NO: 4209246 - RNA, 17 nt, Yersinia pestis KIM
ccgcuuccaucacaaau

SEQ ID NO: 4209247 - RNA, 21 nt, Yersinia pestis KIM
ccuaagccggucuuuuuacaa

SEQ ID NO: 4209248 - RNA, 22 nt, Yersinia pestis KIM
ccuaagguagugagaugauuuu

SEQ ID NO: 4209249 - RNA, 20 nt, Yersinia pestis KIM
ccuaauauccucaaaauucg

SEQ ID NO: 4209250 - RNA, 22 nt, Yersinia pestis KIM
ccuaaugaacacuuaauuccau

SEQ ID NO: 4209251 - RNA, 14 nt, Yersinia pestis KIM
ccuaaugccgcgcc

SEQ ID NO: 4209252 - RNA, 18 nt, Yersinia pestis KIM
ccuaauguacuaccaaaa

SEQ ID NO: 4209253 - RNA, 21 nt, Yersinia pestis KIM
ccuacacagucuuuuucccaa

SEQ ID NO: 4209254 - RNA, 13 nt, Yersinia pestis KIM
ccuacauggaugu

SEQ ID NO: 4209255 - RNA, 14 nt, Yersinia pestis KIM
ccuaccaaauguug

SEQ ID NO: 4209256 - RNA, 18 nt, Yersinia pestis KIM
ccuaccaucaaaauaugu

SEQ ID NO: 4209257 - RNA, 18 nt, Yersinia pestis KIM
ccuacccauuauaaauaa

SEQ ID NO: 4209258 - RNA, 17 nt, Yersinia pestis KIM
ccuaccgcaccaaugcc

SEQ ID NO: 4209259 - RNA, 15 nt, Yersinia pestis KIM
ccuaccggccauuga

SEQ ID NO: 4209260 - RNA, 21 nt, Yersinia pestis KIM
ccuacgcuggcgcauccccac

SEQ ID NO: 4209261 - RNA, 20 nt, Yersinia pestis KIM
ccuacgguaccgcaggucag

SEQ ID NO: 4209262 - RNA, 16 nt, Yersinia pestis KIM
ccuacguucaggcccc

SEQ ID NO: 4209263 - RNA, 11 nt, Yersinia pestis KIM
ccuacuggcgg

SEQ ID NO: 4209264 - RNA, 16 nt, Yersinia pestis KIM
ccuacuggcugaaguu

SEQ ID NO: 4209265 - RNA, 12 nt, Yersinia pestis KIM
ccuacugucaac

SEQ ID NO: 4209266 - RNA, 17 nt, Yersinia pestis KIM
ccuagcaucauaaauac

SEQ ID NO: 4209267 - RNA, 20 nt, Yersinia pestis KIM
ccuaggcggugagggaguca

SEQ ID NO: 4209268 - RNA, 18 nt, Yersinia pestis KIM
ccuaggcuauugacaaag

SEQ ID NO: 4209269 - RNA, 13 nt, Yersinia pestis KIM
ccuauaaauuuua

SEQ ID NO: 4209270 - RNA, 23 nt, Yersinia pestis KIM
ccuauaauuaacagcaucacugu

SEQ ID NO: 4209271 - RNA, 14 nt, Yersinia pestis KIM
ccuauacgcucuau

SEQ ID NO: 4209272 - RNA, 22 nt, Yersinia pestis KIM
ccuaucgguaucucccgcaaag

SEQ ID NO: 4209273 - RNA, 22 nt, Yersinia pestis KIM
ccuaucgucagugcgguaacca

SEQ ID NO: 4209274 - RNA, 16 nt, Yersinia pestis KIM
ccuaucugaaugcugu

SEQ ID NO: 4209275 - RNA, 21 nt, Yersinia pestis KIM
ccuaucuucucguaauuauug

SEQ ID NO: 4209276 - RNA, 23 nt, Yersinia pestis KIM
ccuauuagauguguuuaaaucuu

SEQ ID NO: 4209277 - RNA, 18 nt, Yersinia pestis KIM
ccuauucagcagcauuuc

SEQ ID NO: 4209278 - RNA, 16 nt, Yersinia pestis KIM
ccuauugaauaacagc

SEQ ID NO: 4209279 - RNA, 15 nt, Yersinia pestis KIM
ccuauugauaaaacc

SEQ ID NO: 4209280 - RNA, 19 nt, Yersinia pestis KIM
ccuauuuaauagugccaau

SEQ ID NO: 4209281 - RNA, 22 nt, Yersinia pestis KIM
ccuauuuauugccauuuuaauc

SEQ ID NO: 4209282 - RNA, 14 nt, Yersinia pestis KIM
ccuauuucaccgcu

SEQ ID NO: 4209283 - RNA, 12 nt, Yersinia pestis KIM
ccucaaaaggau

SEQ ID NO: 4209284 - RNA, 19 nt, Yersinia pestis KIM
ccucaaaaggauggcccaa

SEQ ID NO: 4209285 - RNA, 14 nt, Yersinia pestis KIM
ccucaacgcacccc

SEQ ID NO: 4209286 - RNA, 16 nt, Yersinia pestis KIM
ccucaacgcaccccac

SEQ ID NO: 4209287 - RNA, 17 nt, Yersinia pestis KIM
ccucaacucaaaacaau

SEQ ID NO: 4209288 - RNA, 18 nt, Yersinia pestis KIM
ccucaaugacgcgaucug

SEQ ID NO: 4209289 - RNA, 15 nt, Yersinia pestis KIM
ccucaccguauacgc

SEQ ID NO: 4209290 - RNA, 13 nt, Yersinia pestis KIM
ccucacgcagcgu

SEQ ID NO: 4209291 - RNA, 12 nt, Yersinia pestis KIM
ccucacgggcuu

SEQ ID NO: 4209292 - RNA, 16 nt, Yersinia pestis KIM
ccucacgggcuuccau

SEQ ID NO: 4209293 - RNA, 13 nt, Yersinia pestis KIM
ccucacucuguga

SEQ ID NO: 4209294 - RNA, 19 nt, Yersinia pestis KIM
ccucacuuugcauuuucug

SEQ ID NO: 4209295 - RNA, 13 nt, Yersinia pestis KIM
ccucagccucauu

SEQ ID NO: 4209296 - RNA, 20 nt, Yersinia pestis KIM
ccucaggcccgcuaucacua

SEQ ID NO: 4209297 - RNA, 16 nt, Yersinia pestis KIM
ccucaggggccaacag

SEQ ID NO: 4209298 - RNA, 19 nt, Yersinia pestis KIM
ccucaguaaaacgcuccag

SEQ ID NO: 4209299 - RNA, 22 nt, Yersinia pestis KIM
ccucaguaucuuuccagccaau

SEQ ID NO: 4209300 - RNA, 13 nt, Yersinia pestis KIM
ccucaguuaucag

SEQ ID NO: 4209301 - RNA, 20 nt, Yersinia pestis KIM
ccucaguucuuggaacccgu

SEQ ID NO: 4209302 - RNA, 18 nt, Yersinia pestis KIM
ccucaugauuuguugaug

SEQ ID NO: 4209303 - RNA, 19 nt, Yersinia pestis KIM
ccucauuaaucagcauuaa

SEQ ID NO: 4209304 - RNA, 13 nt, Yersinia pestis KIM
ccucauucaugag

SEQ ID NO: 4209305 - RNA, 17 nt, Yersinia pestis KIM
ccucauucaugaggcuc

SEQ ID NO: 4209306 - RNA, 20 nt, Yersinia pestis KIM
ccucauucaugaggcucaga

SEQ ID NO: 4209307 - RNA, 17 nt, Yersinia pestis KIM
ccucauucaugaggcuu

SEQ ID NO: 4209308 - RNA, 15 nt, Yersinia pestis KIM
ccucccgcuaacgca

SEQ ID NO: 4209309 - RNA, 21 nt, Yersinia pestis KIM
ccucccuggcgcggacgcuuu

SEQ ID NO: 4209310 - RNA, 11 nt, Yersinia pestis KIM
ccuccggcaua

SEQ ID NO: 4209311 - RNA, 19 nt, Yersinia pestis KIM
ccuccggcgcccuucccau

SEQ ID NO: 4209312 - RNA, 20 nt, Yersinia pestis KIM
ccuccuagccgggacuuugc

SEQ ID NO: 4209313 - RNA, 16 nt, Yersinia pestis KIM
ccucgaacgaagccac

SEQ ID NO: 4209314 - RNA, 23 nt, Yersinia pestis KIM
ccucgacaccaaaacucccuguu

SEQ ID NO: 4209315 - RNA, 21 nt, Yersinia pestis KIM
ccucgacuaaacgcccagcua

SEQ ID NO: 4209316 - RNA, 14 nt, Yersinia pestis KIM
ccucgcagauccag

SEQ ID NO: 4209317 - RNA, 22 nt, Yersinia pestis KIM
ccucgcccuucgggucaacgcu

SEQ ID NO: 4209318 - RNA, 12 nt, Yersinia pestis KIM
ccucgccguuau

SEQ ID NO: 4209319 - RNA, 14 nt, Yersinia pestis KIM
ccucgcucaggcgg

SEQ ID NO: 4209320 - RNA, 15 nt, Yersinia pestis KIM
ccucggucacugccu

SEQ ID NO: 4209321 - RNA, 19 nt, Yersinia pestis KIM
ccucgguggcucaauccaa

SEQ ID NO: 4209322 - RNA, 21 nt, Yersinia pestis KIM
ccucggugucaguacgcuggc

SEQ ID NO: 4209323 - RNA, 20 nt, Yersinia pestis KIM
ccucguuguuguaugacaag

SEQ ID NO: 4209324 - RNA, 17 nt, Yersinia pestis KIM
ccucuaaggggcgagaa

SEQ ID NO: 4209325 - RNA, 14 nt, Yersinia pestis KIM
ccucuaaucacuua

SEQ ID NO: 4209326 - RNA, 15 nt, Yersinia pestis KIM
ccucuaaucuccucu

SEQ ID NO: 4209327 - RNA, 12 nt, Yersinia pestis KIM
ccucuaccacga

SEQ ID NO: 4209328 - RNA, 19 nt, Yersinia pestis KIM
ccucuagcuguauugcccg

SEQ ID NO: 4209329 - RNA, 21 nt, Yersinia pestis KIM
ccucuagcuguauugcccgau

SEQ ID NO: 4209330 - RNA, 23 nt, Yersinia pestis KIM
ccucuagcuguauugcccgauca

SEQ ID NO: 4209331 - RNA, 12 nt, Yersinia pestis KIM
ccucucaccaag

SEQ ID NO: 4209332 - RNA, 23 nt, Yersinia pestis KIM
ccucucuggucuugcaccugauc

SEQ ID NO: 4209333 - RNA, 18 nt, Yersinia pestis KIM
ccucugauuguaacaauc

SEQ ID NO: 4209334 - RNA, 17 nt, Yersinia pestis KIM
ccucugcaaugcccaga

SEQ ID NO: 4209335 - RNA, 17 nt, Yersinia pestis KIM
ccucugccgauuuaaac

SEQ ID NO: 4209336 - RNA, 20 nt, Yersinia pestis KIM
ccucugccgauuuaaacccu

SEQ ID NO: 4209337 - RNA, 19 nt, Yersinia pestis KIM
ccucugccuauccucaccg

SEQ ID NO: 4209338 - RNA, 20 nt, Yersinia pestis KIM
ccucugcgcuggcguuuuug

SEQ ID NO: 4209339 - RNA, 21 nt, Yersinia pestis KIM
ccucugcgcuggcguuuuugu

SEQ ID NO: 4209340 - RNA, 11 nt, Yersinia pestis KIM
ccucugcugcu

SEQ ID NO: 4209341 - RNA, 15 nt, Yersinia pestis KIM
ccucugcugcugccc

SEQ ID NO: 4209342 - RNA, 20 nt, Yersinia pestis KIM
ccucuggauaaacaauaauc

SEQ ID NO: 4209343 - RNA, 16 nt, Yersinia pestis KIM
ccucuguccccgcuau

SEQ ID NO: 4209344 - RNA, 21 nt, Yersinia pestis KIM
ccucuuauuaaauggagggca

SEQ ID NO: 4209345 - RNA, 11 nt, Yersinia pestis KIM
ccucuucaggu

SEQ ID NO: 4209346 - RNA, 18 nt, Yersinia pestis KIM
ccucuuccgguuguucua

SEQ ID NO: 4209347 - RNA, 14 nt, Yersinia pestis KIM
ccucuuguaaacca

SEQ ID NO: 4209348 - RNA, 17 nt, Yersinia pestis KIM
ccucuuuagguacuuug

SEQ ID NO: 4209349 - RNA, 14 nt, Yersinia pestis KIM
ccucuuucuuaaua

SEQ ID NO: 4209350 - RNA, 20 nt, Yersinia pestis KIM
ccugaaaugauuaaacgccu

SEQ ID NO: 4209351 - RNA, 19 nt, Yersinia pestis KIM
ccugaacgccuugcccugc

SEQ ID NO: 4209352 - RNA, 16 nt, Yersinia pestis KIM
ccugaaucgauaaacc

SEQ ID NO: 4209353 - RNA, 18 nt, Yersinia pestis KIM
ccugaaucucgcgcccug

SEQ ID NO: 4209354 - RNA, 19 nt, Yersinia pestis KIM
ccugaaucucgcgcccugc

SEQ ID NO: 4209355 - RNA, 19 nt, Yersinia pestis KIM
ccugaauggaaaaauuagc

SEQ ID NO: 4209356 - RNA, 14 nt, Yersinia pestis KIM
ccugacaaacggcg

SEQ ID NO: 4209357 - RNA, 15 nt, Yersinia pestis KIM
ccugacacugcaucu

SEQ ID NO: 4209358 - RNA, 21 nt, Yersinia pestis KIM
ccugacacugcaucucugcau

SEQ ID NO: 4209359 - RNA, 17 nt, Yersinia pestis KIM
ccugacagccugugccc

SEQ ID NO: 4209360 - RNA, 15 nt, Yersinia pestis KIM
ccugacgcacagcac

SEQ ID NO: 4209361 - RNA, 15 nt, Yersinia pestis KIM
ccugacucccugacu

SEQ ID NO: 4209362 - RNA, 21 nt, Yersinia pestis KIM
ccuugaucgccaaauaaacaa

SEQ ID NO: 4209363 - RNA, 14 nt, Yersinia pestis KIM
ccuugauucacuga

SEQ ID NO: 4209364 - RNA, 21 nt, Yersinia pestis KIM
ccuugcauccggucaagcgca

SEQ ID NO: 4209365 - RNA, 15 nt, Yersinia pestis KIM
ccuugcgaucaauug

SEQ ID NO: 4209366 - RNA, 12 nt, Yersinia pestis KIM
ccuugcgcaauu

SEQ ID NO: 4209367 - RNA, 15 nt, Yersinia pestis KIM
ccuugcgccaagucc

SEQ ID NO: 4209368 - RNA, 22 nt, Yersinia pestis KIM
ccuugcuugcggaucagcgcua

SEQ ID NO: 4209369 - RNA, 19 nt, Yersinia pestis KIM
ccuuggcauugucugcugg

SEQ ID NO: 4209370 - RNA, 24 nt, Yersinia pestis KIM
ccuuggcgcggacgcuuuacuccu

SEQ ID NO: 4209371 - RNA, 15 nt, Yersinia pestis KIM
ccuuggcguuucuga

SEQ ID NO: 4209372 - RNA, 13 nt, Yersinia pestis KIM
ccuuguggaucca

SEQ ID NO: 4209373 - RNA, 15 nt, Yersinia pestis KIM
ccuuguugccuuucu

SEQ ID NO: 4209374 - RNA, 17 nt, Yersinia pestis KIM
ccuuuaaaucuagcccu

SEQ ID NO: 4209375 - RNA, 22 nt, Yersinia pestis KIM
ccuuuaauggcauacuccgcug

SEQ ID NO: 4209376 - RNA, 20 nt, Yersinia pestis KIM
ccuuuacgggcggcauaauc

SEQ ID NO: 4209377 - RNA, 15 nt, Yersinia pestis KIM
ccuuuacuaucacua

SEQ ID NO: 4209378 - RNA, 13 nt, Yersinia pestis KIM
ccuuuauuaccuu

SEQ ID NO: 4209379 - RNA, 15 nt, Yersinia pestis KIM
ccuuucgaguugaac

SEQ ID NO: 4209380 - RNA, 20 nt, Yersinia pestis KIM
ccuuucgaguuuauauugcc

SEQ ID NO: 4209381 - RNA, 16 nt, Yersinia pestis KIM
ccuuucgguugcauca

SEQ ID NO: 4209382 - RNA, 14 nt, Yersinia pestis KIM
ccuuucguucacuu

SEQ ID NO: 4209383 - RNA, 21 nt, Yersinia pestis KIM
ccuuucguucacuuaucccuu

SEQ ID NO: 4209384 - RNA, 11 nt, Yersinia pestis KIM
ccuuucugggc

SEQ ID NO: 4209385 - RNA, 18 nt, Yersinia pestis KIM
ccuuugacagcaucugca

SEQ ID NO: 4209386 - RNA, 15 nt, Yersinia pestis KIM
ccuuugcuuucagga

SEQ ID NO: 4209387 - RNA, 19 nt, Yersinia pestis KIM
ccuuuggauuuaaugcugu

SEQ ID NO: 4209388 - RNA, 20 nt, Yersinia pestis KIM
ccuuuuacaccacuaguuaa

SEQ ID NO: 4209389 - RNA, 18 nt, Yersinia pestis KIM
ccuuuuagauuacugcuc

SEQ ID NO: 4209390 - RNA, 13 nt, Yersinia pestis KIM
ccuuuuauuuaga

SEQ ID NO: 4209391 - RNA, 18 nt, Yersinia pestis KIM
ccuuuugaauucaccaaa

SEQ ID NO: 4209392 - RNA, 13 nt, Yersinia pestis KIM
ccuuuugacuggu

SEQ ID NO: 4209393 - RNA, 23 nt, Yersinia pestis KIM
ccuuuuuaccugacacugcaucu

SEQ ID NO: 4209394 - RNA, 20 nt, Yersinia pestis KIM
cgaaaaaccaugagaauacu

SEQ ID NO: 4209395 - RNA, 12 nt, Yersinia pestis KIM
cgaaaacucaaa

SEQ ID NO: 4209396 - RNA, 13 nt, Yersinia pestis KIM
cgaaaagcagcag

SEQ ID NO: 4209397 - RNA, 17 nt, Yersinia pestis KIM
cgaaacacacuucgccg

SEQ ID NO: 4209398 - RNA, 17 nt, Yersinia pestis KIM
cgaaacacauacaaaua

SEQ ID NO: 4209399 - RNA, 10 nt, Yersinia pestis KIM
cgaaacacca

SEQ ID NO: 4209400 - RNA, 18 nt, Yersinia pestis KIM
cgaaagaaauaaaagaaa

SEQ ID NO: 4209401 - RNA, 22 nt, Yersinia pestis KIM
cgaaagccaagcaagcggcagc

SEQ ID NO: 4209402 - RNA, 15 nt, Yersinia pestis KIM
cgaaagcgccugugg

SEQ ID NO: 4209403 - RNA, 15 nt, Yersinia pestis KIM
cgaaaggaacaaaag

SEQ ID NO: 4209404 - RNA, 22 nt, Yersinia pestis KIM
cgaaauaaaugcgacagguagu

SEQ ID NO: 4209405 - RNA, 14 nt, Yersinia pestis KIM
cgaaauauaaaaca

SEQ ID NO: 4209406 - RNA, 23 nt, Yersinia pestis KIM
cgaaauaucaggaugaaccggcg

SEQ ID NO: 4209407 - RNA, 19 nt, Yersinia pestis KIM
cgaaauauucgucucauca

SEQ ID NO: 4209408 - RNA, 19 nt, Yersinia pestis KIM
cgaacacaguccuguuuau

SEQ ID NO: 4209409 - RNA, 16 nt, Yersinia pestis KIM
cgaacaguagccccug

SEQ ID NO: 4209410 - RNA, 14 nt, Yersinia pestis KIM
cgaacagugccaac

SEQ ID NO: 4209411 - RNA, 16 nt, Yersinia pestis KIM
cgaacaucuccugguu

SEQ ID NO: 4209412 - RNA, 14 nt, Yersinia pestis KIM
cgaacuaucuuuuc

SEQ ID NO: 4209413 - RNA, 21 nt, Yersinia pestis KIM
cgaacugaaacggugaggaua

SEQ ID NO: 4209414 - RNA, 13 nt, Yersinia pestis KIM
cgaagaucacuca

SEQ ID NO: 4209415 - RNA, 15 nt, Yersinia pestis KIM
cgaagcauuacacca

SEQ ID NO: 4209416 - RNA, 15 nt, Yersinia pestis KIM
cgaagcccuguuuca

SEQ ID NO: 4209417 - RNA, 17 nt, Yersinia pestis KIM
cgaaggcacccaugcuc

SEQ ID NO: 4209418 - RNA, 12 nt, Yersinia pestis KIM
cgaauaaaaccu

SEQ ID NO: 4209419 - RNA, 15 nt, Yersinia pestis KIM
cgaauaaauaauugg

SEQ ID NO: 4209420 - RNA, 17 nt, Yersinia pestis KIM
cgaauaaauauccuccg

SEQ ID NO: 4209421 - RNA, 18 nt, Yersinia pestis KIM
cgaauaacucucaucuau

SEQ ID NO: 4209422 - RNA, 23 nt, Yersinia pestis KIM
cgaauaagcucugggacgugcau

SEQ ID NO: 4209423 - RNA, 15 nt, Yersinia pestis KIM
cgaauaccauaacgc

SEQ ID NO: 4209424 - RNA, 20 nt, Yersinia pestis KIM
cgaauaccauaacgcugcuc

SEQ ID NO: 4209425 - RNA, 22 nt, Yersinia pestis KIM
cgaauagcaucagggguaaucu

SEQ ID NO: 4209426 - RNA, 17 nt, Yersinia pestis KIM
cgaaucacuuacugguc

SEQ ID NO: 4209427 - RNA, 19 nt, Yersinia pestis KIM
cgaaucugguacuccugcu

SEQ ID NO: 4209428 - RNA, 20 nt, Yersinia pestis KIM
cgaaucugguacuccugcuc

SEQ ID NO: 4209429 - RNA, 21 nt, Yersinia pestis KIM
cgaaucugguacuccugcuca

SEQ ID NO: 4209430 - RNA, 23 nt, Yersinia pestis KIM
cgaaucugguacuccugcucaaa

SEQ ID NO: 4209431 - RNA, 16 nt, Yersinia pestis KIM
cgaaugagcaguaaua

SEQ ID NO: 4209432 - RNA, 17 nt, Yersinia pestis KIM
cgaaugaguuuuguccu

SEQ ID NO: 4209433 - RNA, 17 nt, Yersinia pestis KIM
cgaaugaucagaggcug

SEQ ID NO: 4209434 - RNA, 17 nt, Yersinia pestis KIM
cgaauggaaaaacguga

SEQ ID NO: 4209435 - RNA, 17 nt, Yersinia pestis KIM
cgaauggccgcugcagg

SEQ ID NO: 4209436 - RNA, 16 nt, Yersinia pestis KIM
cgaauuaauaaaaccu

SEQ ID NO: 4209437 - RNA, 14 nt, Yersinia pestis KIM
cgaauuauuuagag

SEQ ID NO: 4209438 - RNA, 14 nt, Yersinia pestis KIM
cgaauuugcugcuc

SEQ ID NO: 4209439 - RNA, 18 nt, Yersinia pestis KIM
cgaauuugcugcucgacu

SEQ ID NO: 4209440 - RNA, 17 nt, Yersinia pestis KIM
cgacaaauuuuuccuuu

SEQ ID NO: 4209441 - RNA, 18 nt, Yersinia pestis KIM
cgacaacuucaauaccaa

SEQ ID NO: 4209442 - RNA, 20 nt, Yersinia pestis KIM
cgacaauaccgccacacaau

SEQ ID NO: 4209443 - RNA, 16 nt, Yersinia pestis KIM
cgacaauauaauaaug

SEQ ID NO: 4209444 - RNA, 17 nt, Yersinia pestis KIM
cgacaauauaauaaugc

SEQ ID NO: 4209445 - RNA, 17 nt, Yersinia pestis KIM
cgacaauauuccaaaaa

SEQ ID NO: 4209446 - RNA, 13 nt, Yersinia pestis KIM
cgacacccagcca

SEQ ID NO: 4209447 - RNA, 17 nt, Yersinia pestis KIM
cgacaccguugauugau

SEQ ID NO: 4209448 - RNA, 17 nt, Yersinia pestis KIM
cgacaccuucaaucauu

SEQ ID NO: 4209449 - RNA, 15 nt, Yersinia pestis KIM
cgacacgcucaucca

SEQ ID NO: 4209450 - RNA, 13 nt, Yersinia pestis KIM
cgacagggacucc

SEQ ID NO: 4209451 - RNA, 18 nt, Yersinia pestis KIM
cgacaggguuuaacgggc

SEQ ID NO: 4209452 - RNA, 20 nt, Yersinia pestis KIM
cgacauaaagcaaacgccgc

SEQ ID NO: 4209453 - RNA, 20 nt, Yersinia pestis KIM
cgacaucagcgccacagucg

SEQ ID NO: 4209454 - RNA, 13 nt, Yersinia pestis KIM
cgacauccaacaa

SEQ ID NO: 4209455 - RNA, 22 nt, Yersinia pestis KIM
cgacauuaagcauauccaacgc

SEQ ID NO: 4209456 - RNA, 22 nt, Yersinia pestis KIM
cgacauuccagauaucccaacu

SEQ ID NO: 4209457 - RNA, 22 nt, Yersinia pestis KIM
cgaccaaauggacgaacagccc

SEQ ID NO: 4209458 - RNA, 15 nt, Yersinia pestis KIM
cgaccaacuggcaau

SEQ ID NO: 4209459 - RNA, 17 nt, Yersinia pestis KIM
cgaccaauucacgcagg

SEQ ID NO: 4209460 - RNA, 16 nt, Yersinia pestis KIM
cgaccaauucaucagc

SEQ ID NO: 4209461 - RNA, 17 nt, Yersinia pestis KIM
cgaccaccacugcauca

SEQ ID NO: 4209462 - RNA, 12 nt, Yersinia pestis KIM
cgaccagcagaa

SEQ ID NO: 4209463 - RNA, 23 nt, Yersinia pestis KIM
cgacccgcugaacuucugggauc

SEQ ID NO: 4209464 - RNA, 16 nt, Yersinia pestis KIM
cgaccgcugauaucau

SEQ ID NO: 4209465 - RNA, 17 nt, Yersinia pestis KIM
cgaccggcugauguucu

SEQ ID NO: 4209466 - RNA, 18 nt, Yersinia pestis KIM
cgaccggggaucaauaaa

SEQ ID NO: 4209467 - RNA, 14 nt, Yersinia pestis KIM
cgaccgucaccaaa

SEQ ID NO: 4209468 - RNA, 16 nt, Yersinia pestis KIM
cgacgaggguaauaau

SEQ ID NO: 4209469 - RNA, 15 nt, Yersinia pestis KIM
cgacgauaaaggcgg

SEQ ID NO: 4209470 - RNA, 22 nt, Yersinia pestis KIM
cgacgauggaguggucaugcuc

SEQ ID NO: 4209471 - RNA, 13 nt, Yersinia pestis KIM
cgacgccccacua

SEQ ID NO: 4209472 - RNA, 20 nt, Yersinia pestis KIM
cgacggacaugcaccguaac

SEQ ID NO: 4209473 - RNA, 16 nt, Yersinia pestis KIM
cgacggagagaacagg

SEQ ID NO: 4209474 - RNA, 21 nt, Yersinia pestis KIM
cgacggaugaaaagugaucca

SEQ ID NO: 4209475 - RNA, 16 nt, Yersinia pestis KIM
cgacgguuucugucuu

SEQ ID NO: 4209476 - RNA, 20 nt, Yersinia pestis KIM
cgacgucccuaaagccaucg

SEQ ID NO: 4209477 - RNA, 19 nt, Yersinia pestis KIM
cgccaguaaacagccagca

SEQ ID NO: 4209478 - RNA, 19 nt, Yersinia pestis KIM
cgccaguaaaccuggcggg

SEQ ID NO: 4209479 - RNA, 22 nt, Yersinia pestis KIM
cgccagucagcuagccugcccc

SEQ ID NO: 4209480 - RNA, 18 nt, Yersinia pestis KIM
cgccagugccgcggcggc

SEQ ID NO: 4209481 - RNA, 17 nt, Yersinia pestis KIM
cgccaguggcaucaaua

SEQ ID NO: 4209482 - RNA, 13 nt, Yersinia pestis KIM
cgccaguguugcc

SEQ ID NO: 4209483 - RNA, 19 nt, Yersinia pestis KIM
cgccaguguugccauggcc

SEQ ID NO: 4209484 - RNA, 20 nt, Yersinia pestis KIM
cgccauaaugcggcucucuu

SEQ ID NO: 4209485 - RNA, 15 nt, Yersinia pestis KIM
cgccauauauugauc

SEQ ID NO: 4209486 - RNA, 23 nt, Yersinia pestis KIM
cgccauauauugauccaaauggc

SEQ ID NO: 4209487 - RNA, 14 nt, Yersinia pestis KIM
cgccaucaauaauu

SEQ ID NO: 4209488 - RNA, 21 nt, Yersinia pestis KIM
cgccaucagcgccgccucuuc

SEQ ID NO: 4209489 - RNA, 13 nt, Yersinia pestis KIM
cgccauccuuggc

SEQ ID NO: 4209490 - RNA, 18 nt, Yersinia pestis KIM
cgccaucguauauccacc

SEQ ID NO: 4209491 - RNA, 19 nt, Yersinia pestis KIM
cgccaucgucagccccugc

SEQ ID NO: 4209492 - RNA, 21 nt, Yersinia pestis KIM
cgccaugagaaccaguucugg

SEQ ID NO: 4209493 - RNA, 19 nt, Yersinia pestis KIM
cgccauggcaugccaugca

SEQ ID NO: 4209494 - RNA, 14 nt, Yersinia pestis KIM
cgccauuaaaaggu

SEQ ID NO: 4209495 - RNA, 19 nt, Yersinia pestis KIM
cgccauugagucguuauaa

SEQ ID NO: 4209496 - RNA, 23 nt, Yersinia pestis KIM
cgccauuuuuauguuuaucaccc

SEQ ID NO: 4209497 - RNA, 16 nt, Yersinia pestis KIM
cgcccagacgccggcc

SEQ ID NO: 4209498 - RNA, 13 nt, Yersinia pestis KIM
cgcccauucgaau

SEQ ID NO: 4209499 - RNA, 13 nt, Yersinia pestis KIM
cgcccccgccagg

SEQ ID NO: 4209500 - RNA, 14 nt, Yersinia pestis KIM
cgccccgauaaaug

SEQ ID NO: 4209501 - RNA, 19 nt, Yersinia pestis KIM
cgccccgauaaaugucgcu

SEQ ID NO: 4209502 - RNA, 18 nt, Yersinia pestis KIM
cgccccuaacucgcgcuu

SEQ ID NO: 4209503 - RNA, 20 nt, Yersinia pestis KIM
cgccccugaauucgauaaca

SEQ ID NO: 4209504 - RNA, 13 nt, Yersinia pestis KIM
cgcccgcgccaga

SEQ ID NO: 4209505 - RNA, 13 nt, Yersinia pestis KIM
cgcccggcugacc

SEQ ID NO: 4209506 - RNA, 13 nt, Yersinia pestis KIM
cgcccguugccca

SEQ ID NO: 4209507 - RNA, 16 nt, Yersinia pestis KIM
cgcccguuggccggcc

SEQ ID NO: 4209508 - RNA, 21 nt, Yersinia pestis KIM
cgcccguuggccggccaacau

SEQ ID NO: 4209509 - RNA, 12 nt, Yersinia pestis KIM
cgcccuccugcg

SEQ ID NO: 4209510 - RNA, 13 nt, Yersinia pestis KIM
cgcccuguuucaa

SEQ ID NO: 4209511 - RNA, 23 nt, Yersinia pestis KIM
cgccgaacgacaaauuuuuccuu

SEQ ID NO: 4209512 - RNA, 23 nt, Yersinia pestis KIM
cgccgacaaaaucccccaccagu

SEQ ID NO: 4209513 - RNA, 15 nt, Yersinia pestis KIM
cgccgccgcaccgcu

SEQ ID NO: 4209514 - RNA, 13 nt, Yersinia pestis KIM
cgccgccgccagc

SEQ ID NO: 4209515 - RNA, 22 nt, Yersinia pestis KIM
cgccgcgugacuauucugccua

SEQ ID NO: 4209516 - RNA, 17 nt, Yersinia pestis KIM
cgccgcuaaaucaucaa

SEQ ID NO: 4209517 - RNA, 13 nt, Yersinia pestis KIM
cgccgcucaauua

SEQ ID NO: 4209518 - RNA, 13 nt, Yersinia pestis KIM
cgccgguaauacc

SEQ ID NO: 4209519 - RNA, 15 nt, Yersinia pestis KIM
cgccguaaacugccg

SEQ ID NO: 4209520 - RNA, 15 nt, Yersinia pestis KIM
cgccguagauuuaac

SEQ ID NO: 4209521 - RNA, 17 nt, Yersinia pestis KIM
cgccguauuuguauuua

SEQ ID NO: 4209522 - RNA, 13 nt, Yersinia pestis KIM
cgccgucaugcug

SEQ ID NO: 4209523 - RNA, 15 nt, Yersinia pestis KIM
cgccgugagaaaaaa

SEQ ID NO: 4209524 - RNA, 17 nt, Yersinia pestis KIM
cgccgugagcaaucugg

SEQ ID NO: 4209525 - RNA, 23 nt, Yersinia pestis KIM
cgccguggcgacagcuauuuauu

SEQ ID NO: 4209526 - RNA, 12 nt, Yersinia pestis KIM
cgccuaccauca

SEQ ID NO: 4209527 - RNA, 12 nt, Yersinia pestis KIM
cgccuagcauca

SEQ ID NO: 4209528 - RNA, 20 nt, Yersinia pestis KIM
cgccucaguaucuuuccagc

SEQ ID NO: 4209529 - RNA, 21 nt, Yersinia pestis KIM
cgccucaguaucuuuccagcc

SEQ ID NO: 4209530 - RNA, 13 nt, Yersinia pestis KIM
cgccuccgauuca

SEQ ID NO: 4209531 - RNA, 12 nt, Yersinia pestis KIM
cgccucucuggc

SEQ ID NO: 4209532 - RNA, 13 nt, Yersinia pestis KIM
cgccucugcuccg

SEQ ID NO: 4209533 - RNA, 15 nt, Yersinia pestis KIM
cgccucugcuccggu

SEQ ID NO: 4209534 - RNA, 17 nt, Yersinia pestis KIM
cgccucuucugucggag

SEQ ID NO: 4209535 - RNA, 20 nt, Yersinia pestis KIM
cgccugacugcccgccugcu

SEQ ID NO: 4209536 - RNA, 22 nt, Yersinia pestis KIM
cgccugacugcccgccugcuug

SEQ ID NO: 4209537 - RNA, 21 nt, Yersinia pestis KIM
cgccugauagcgcacugucug

SEQ ID NO: 4209538 - RNA, 15 nt, Yersinia pestis KIM
cgccugaucgauaac

SEQ ID NO: 4209539 - RNA, 17 nt, Yersinia pestis KIM
cgccugaucgauaaccc

SEQ ID NO: 4209540 - RNA, 15 nt, Yersinia pestis KIM
cgccugcgcuaauac

SEQ ID NO: 4209541 - RNA, 13 nt, Yersinia pestis KIM
cgccugcucaaca

SEQ ID NO: 4209542 - RNA, 22 nt, Yersinia pestis KIM
cgccuguuucggcaggcagaaa

SEQ ID NO: 4209543 - RNA, 16 nt, Yersinia pestis KIM
cgccuuaucagcgaaa

SEQ ID NO: 4209544 - RNA, 19 nt, Yersinia pestis KIM
cgccuuccuuuuauuuaga

SEQ ID NO: 4209545 - RNA, 23 nt, Yersinia pestis KIM
cgccuugcccugcaauaccgccg

SEQ ID NO: 4209546 - RNA, 20 nt, Yersinia pestis KIM
cgcgaauaucaggcacugua

SEQ ID NO: 4209547 - RNA, 12 nt, Yersinia pestis KIM
cgcgaccagcag

SEQ ID NO: 4209548 - RNA, 17 nt, Yersinia pestis KIM
cgcgacucaagccucua

SEQ ID NO: 4209549 - RNA, 16 nt, Yersinia pestis KIM
cgcgagucacauuuuu

SEQ ID NO: 4209550 - RNA, 16 nt, Yersinia pestis KIM
cgcgaucacaauacag

SEQ ID NO: 4209551 - RNA, 17 nt, Yersinia pestis KIM
cgcgaucagacauuuuu

SEQ ID NO: 4209552 - RNA, 21 nt, Yersinia pestis KIM
cgcgauugaucagccaacaag

SEQ ID NO: 4209553 - RNA, 23 nt, Yersinia pestis KIM
cgcgcagugccgucaauuaucaa

SEQ ID NO: 4209554 - RNA, 23 nt, Yersinia pestis KIM
cgcgcauauaggcgaaaggcgca

SEQ ID NO: 4209555 - RNA, 16 nt, Yersinia pestis KIM
cgcgccaaccaucgga

SEQ ID NO: 4209556 - RNA, 16 nt, Yersinia pestis KIM
cgcgccacucuagcug

SEQ ID NO: 4209557 - RNA, 14 nt, Yersinia pestis KIM
cgcgccagggaggg

SEQ ID NO: 4209558 - RNA, 15 nt, Yersinia pestis KIM
cgcgccauccuugcc

SEQ ID NO: 4209559 - RNA, 16 nt, Yersinia pestis KIM
cgcgccauccuugccu

SEQ ID NO: 4209560 - RNA, 15 nt, Yersinia pestis KIM
cgcgcccucccuggc

SEQ ID NO: 4209561 - RNA, 15 nt, Yersinia pestis KIM
cgcgccgacugcuga

SEQ ID NO: 4209562 - RNA, 12 nt, Yersinia pestis KIM
cgcgccgcggcu

SEQ ID NO: 4209563 - RNA, 21 nt, Yersinia pestis KIM
cgcgccuguuacugaccgugc

SEQ ID NO: 4209564 - RNA, 22 nt, Yersinia pestis KIM
cgcgcgcccagacgccggccgg

SEQ ID NO: 4209565 - RNA, 11 nt, Yersinia pestis KIM
cgcgcuaacca

SEQ ID NO: 4209566 - RNA, 13 nt, Yersinia pestis KIM
cgcgcugcugcuc

SEQ ID NO: 4209567 - RNA, 14 nt, Yersinia pestis KIM
cgcgcuuccaggcu

SEQ ID NO: 4209568 - RNA, 17 nt, Yersinia pestis KIM
cgcgcuuuugauuuucu

SEQ ID NO: 4209569 - RNA, 16 nt, Yersinia pestis KIM
cgcggaaaucagcuuc

SEQ ID NO: 4209570 - RNA, 19 nt, Yersinia pestis KIM
cgcggacgcuuuacuccuc

SEQ ID NO: 4209571 - RNA, 18 nt, Yersinia pestis KIM
cgcggacguuuuacucuu

SEQ ID NO: 4209572 - RNA, 14 nt, Yersinia pestis KIM
cgcggauccguaac

SEQ ID NO: 4209573 - RNA, 18 nt, Yersinia pestis KIM
cgcggcuagcccccaggg

SEQ ID NO: 4209574 - RNA, 18 nt, Yersinia pestis KIM
cgcgggcgcgcugcugcu

SEQ ID NO: 4209575 - RNA, 22 nt, Yersinia pestis KIM
cgcggguuaucacauaaauaag

SEQ ID NO: 4209576 - RNA, 19 nt, Yersinia pestis KIM
cgcgguaacgaaucugcac

SEQ ID NO: 4209577 - RNA, 23 nt, Yersinia pestis KIM
cgcgguaacuaacaucagcgauu

SEQ ID NO: 4209578 - RNA, 14 nt, Yersinia pestis KIM
cgcgguuacaccaa

SEQ ID NO: 4209579 - RNA, 16 nt, Yersinia pestis KIM
cgcgguucgcagcuuc

SEQ ID NO: 4209580 - RNA, 17 nt, Yersinia pestis KIM
cgcgguucgcagcuucc

SEQ ID NO: 4209581 - RNA, 15 nt, Yersinia pestis KIM
cgcguuaauaccuug

SEQ ID NO: 4209582 - RNA, 16 nt, Yersinia pestis KIM
cgcguuaaucugcugc

SEQ ID NO: 4209583 - RNA, 19 nt, Yersinia pestis KIM
cgcguugcgcugaccaugg

SEQ ID NO: 4209584 - RNA, 15 nt, Yersinia pestis KIM
cgcuaaaucaucaaa

SEQ ID NO: 4209585 - RNA, 14 nt, Yersinia pestis KIM
cgcuaacaugccac

SEQ ID NO: 4209586 - RNA, 12 nt, Yersinia pestis KIM
cgcuaaccgcca

SEQ ID NO: 4209587 - RNA, 14 nt, Yersinia pestis KIM
cgcuaacguuuauu

SEQ ID NO: 4209588 - RNA, 18 nt, Yersinia pestis KIM
cgcuaauacggcuugcaa

SEQ ID NO: 4209589 - RNA, 17 nt, Yersinia pestis KIM
cgcuaaucaagccuuca

SEQ ID NO: 4209590 - RNA, 14 nt, Yersinia pestis KIM
cgcuagaccaguua

SEQ ID NO: 4209591 - RNA, 22 nt, Yersinia pestis KIM
cgcuauaaaacagcuugauagg

SEQ ID NO: 4209592 - RNA, 20 nt, Yersinia pestis KIM
cggauugcaacaacgccaga

SEQ ID NO: 4209593 - RNA, 15 nt, Yersinia pestis KIM
cggcaaauagagcac

SEQ ID NO: 4209594 - RNA, 17 nt, Yersinia pestis KIM
cggcaaauagagcacca

SEQ ID NO: 4209595 - RNA, 18 nt, Yersinia pestis KIM
cggcaaauagagcaccaa

SEQ ID NO: 4209596 - RNA, 19 nt, Yersinia pestis KIM
cggcaaauagagcaccaaa

SEQ ID NO: 4209597 - RNA, 22 nt, Yersinia pestis KIM
cggcaaauagagcaccaaaucu

SEQ ID NO: 4209598 - RNA, 14 nt, Yersinia pestis KIM
cggcaacgaucaga

SEQ ID NO: 4209599 - RNA, 17 nt, Yersinia pestis KIM
cggcaaguugaucaccc

SEQ ID NO: 4209600 - RNA, 15 nt, Yersinia pestis KIM
cggcaauagcgauca

SEQ ID NO: 4209601 - RNA, 15 nt, Yersinia pestis KIM
cggcaaucccggcca

SEQ ID NO: 4209602 - RNA, 23 nt, Yersinia pestis KIM
cggcaauuaagcaaaaaggcugc

SEQ ID NO: 4209603 - RNA, 16 nt, Yersinia pestis KIM
cggcacaggcgcuggc

SEQ ID NO: 4209604 - RNA, 14 nt, Yersinia pestis KIM
cggcacccacggcg

SEQ ID NO: 4209605 - RNA, 16 nt, Yersinia pestis KIM
cggcaccugcccgccc

SEQ ID NO: 4209606 - RNA, 20 nt, Yersinia pestis KIM
cggcaccugcccgccccggc

SEQ ID NO: 4209607 - RNA, 19 nt, Yersinia pestis KIM
cggcagauuggauugaaau

SEQ ID NO: 4209608 - RNA, 17 nt, Yersinia pestis KIM
cggcagcgagcacugcc

SEQ ID NO: 4209609 - RNA, 20 nt, Yersinia pestis KIM
cggcagggcgguaacgcaga

SEQ ID NO: 4209610 - RNA, 20 nt, Yersinia pestis KIM
cggcagugaucgcacuucaa

SEQ ID NO: 4209611 - RNA, 23 nt, Yersinia pestis KIM
cggcaguuugaguguggugagcc

SEQ ID NO: 4209612 - RNA, 17 nt, Yersinia pestis KIM
cggcauaacaggugcag

SEQ ID NO: 4209613 - RNA, 18 nt, Yersinia pestis KIM
cggcauaauuucaggucg

SEQ ID NO: 4209614 - RNA, 17 nt, Yersinia pestis KIM
cggcauacuccauuuuu

SEQ ID NO: 4209615 - RNA, 18 nt, Yersinia pestis KIM
cggcauacuccauuuuuu

SEQ ID NO: 4209616 - RNA, 22 nt, Yersinia pestis KIM
cggcaucgaguccguuaaaaaa

SEQ ID NO: 4209617 - RNA, 12 nt, Yersinia pestis KIM
cggcaucugcca

SEQ ID NO: 4209618 - RNA, 15 nt, Yersinia pestis KIM
cggcaucuuuugcua

SEQ ID NO: 4209619 - RNA, 15 nt, Yersinia pestis KIM
cggcaugcaacuugg

SEQ ID NO: 4209620 - RNA, 14 nt, Yersinia pestis KIM
cggcauuagugaau

SEQ ID NO: 4209621 - RNA, 14 nt, Yersinia pestis KIM
cggcauugagcgga

SEQ ID NO: 4209622 - RNA, 15 nt, Yersinia pestis KIM
cggccacccgccauc

SEQ ID NO: 4209623 - RNA, 17 nt, Yersinia pestis KIM
cggccaggcucccaagg

SEQ ID NO: 4209624 - RNA, 14 nt, Yersinia pestis KIM
cggccauguugguc

SEQ ID NO: 4209625 - RNA, 12 nt, Yersinia pestis KIM
cggccccagccc

SEQ ID NO: 4209626 - RNA, 23 nt, Yersinia pestis KIM
cggcccgcagauaauccccuugu

SEQ ID NO: 4209627 - RNA, 16 nt, Yersinia pestis KIM
cggcccggccaggcuc

SEQ ID NO: 4209628 - RNA, 18 nt, Yersinia pestis KIM
cggcccguaaacgggcua

SEQ ID NO: 4209629 - RNA, 22 nt, Yersinia pestis KIM
cggcccugagguugcucagcgg

SEQ ID NO: 4209630 - RNA, 22 nt, Yersinia pestis KIM
cggccgguuucaccgcuuagca

SEQ ID NO: 4209631 - RNA, 15 nt, Yersinia pestis KIM
cggccucugcugcug

SEQ ID NO: 4209632 - RNA, 12 nt, Yersinia pestis KIM
cggcgaaacuga

SEQ ID NO: 4209633 - RNA, 16 nt, Yersinia pestis KIM
cggcgaaauauaaaac

SEQ ID NO: 4209634 - RNA, 21 nt, Yersinia pestis KIM
cggcgaaggcuucguggugcu

SEQ ID NO: 4209635 - RNA, 16 nt, Yersinia pestis KIM
cggcgauuucaucagc

SEQ ID NO: 4209636 - RNA, 14 nt, Yersinia pestis KIM
cggcgcaagcgaua

SEQ ID NO: 4209637 - RNA, 24 nt, Yersinia pestis KIM
cggcgcuccaguucgacuaacuga

SEQ ID NO: 4209638 - RNA, 15 nt, Yersinia pestis KIM
cggcggaucaagcgc

SEQ ID NO: 4209639 - RNA, 14 nt, Yersinia pestis KIM
cggcguaaauaaaa

SEQ ID NO: 4209640 - RNA, 14 nt, Yersinia pestis KIM
cggcgucugauaac

SEQ ID NO: 4209641 - RNA, 19 nt, Yersinia pestis KIM
cggcgugaguuccagcccc

SEQ ID NO: 4209642 - RNA, 22 nt, Yersinia pestis KIM
cggcguuaauauaacaauguuu

SEQ ID NO: 4209643 - RNA, 21 nt, Yersinia pestis KIM
cggcguuaaugccacccccag

SEQ ID NO: 4209644 - RNA, 22 nt, Yersinia pestis KIM
cggcguuaaugccacccccagu

SEQ ID NO: 4209645 - RNA, 20 nt, Yersinia pestis KIM
cggcguuacaguaaggcagc

SEQ ID NO: 4209646 - RNA, 18 nt, Yersinia pestis KIM
cggcguuacuggcgaccg

SEQ ID NO: 4209647 - RNA, 15 nt, Yersinia pestis KIM
cggcguucagcaaua

SEQ ID NO: 4209648 - RNA, 16 nt, Yersinia pestis KIM
cggcuaaccacagcaa

SEQ ID NO: 4209649 - RNA, 12 nt, Yersinia pestis KIM
cggcuaaugagc

SEQ ID NO: 4209650 - RNA, 19 nt, Yersinia pestis KIM
cggcuacugcgcuuaccgu

SEQ ID NO: 4209651 - RNA, 13 nt, Yersinia pestis KIM
cggcuaggcucag

SEQ ID NO: 4209652 - RNA, 15 nt, Yersinia pestis KIM
cggcuaugugaaugc

SEQ ID NO: 4209653 - RNA, 23 nt, Yersinia pestis KIM
cggcucaucacaccgcgaucaca

SEQ ID NO: 4209654 - RNA, 17 nt, Yersinia pestis KIM
cggcuccaggcauuaaa

SEQ ID NO: 4209655 - RNA, 18 nt, Yersinia pestis KIM
cggcucgcccacggcaca

SEQ ID NO: 4209656 - RNA, 20 nt, Yersinia pestis KIM
cggcucuaucgauaaaguca

SEQ ID NO: 4209657 - RNA, 18 nt, Yersinia pestis KIM
cggcucuauuucaugauu

SEQ ID NO: 4209658 - RNA, 20 nt, Yersinia pestis KIM
cggcucuauuucaugauucu

SEQ ID NO: 4209659 - RNA, 17 nt, Yersinia pestis KIM
cggcucucuuucuccaa

SEQ ID NO: 4209660 - RNA, 22 nt, Yersinia pestis KIM
cggcuggaaauauuggcaacaa

SEQ ID NO: 4209661 - RNA, 16 nt, Yersinia pestis KIM
cggcuguaaccgccug

SEQ ID NO: 4209662 - RNA, 14 nt, Yersinia pestis KIM
cggcuucagcaccu

SEQ ID NO: 4209663 - RNA, 23 nt, Yersinia pestis KIM
cggcuugggagucagaugccgcu

SEQ ID NO: 4209664 - RNA, 15 nt, Yersinia pestis KIM
cggcuuuacuggcug

SEQ ID NO: 4209665 - RNA, 20 nt, Yersinia pestis KIM
cggcuuuauuugcugccugu

SEQ ID NO: 4209666 - RNA, 18 nt, Yersinia pestis KIM
cggcuuucaggugacuga

SEQ ID NO: 4209667 - RNA, 22 nt, Yersinia pestis KIM
cggcuuuuuaaacuuguaucaa

SEQ ID NO: 4209668 - RNA, 23 nt, Yersinia pestis KIM
cgggaauucuuuggcaaauuuag

SEQ ID NO: 4209669 - RNA, 22 nt, Yersinia pestis KIM
cgggaggauaaguuccggcaga

SEQ ID NO: 4209670 - RNA, 12 nt, Yersinia pestis KIM
cgggauaauaga

SEQ ID NO: 4209671 - RNA, 20 nt, Yersinia pestis KIM
cgggauaugacuaaacugau

SEQ ID NO: 4209672 - RNA, 21 nt, Yersinia pestis KIM
cgggaucgagaguugcucacc

SEQ ID NO: 4209673 - RNA, 23 nt, Yersinia pestis KIM
cgggaucugaugaugguuaaccc

SEQ ID NO: 4209674 - RNA, 22 nt, Yersinia pestis KIM
cgggauggaaauugaacgguuu

SEQ ID NO: 4209675 - RNA, 22 nt, Yersinia pestis KIM
cgggcaaauggguguuauuuac

SEQ ID NO: 4209676 - RNA, 14 nt, Yersinia pestis KIM
cgggcacaggcgau

SEQ ID NO: 4209677 - RNA, 17 nt, Yersinia pestis KIM
cgggcacuaucaccgcg

SEQ ID NO: 4209678 - RNA, 19 nt, Yersinia pestis KIM
cgggcacuuugucaauaac

SEQ ID NO: 4209679 - RNA, 15 nt, Yersinia pestis KIM
cgggcauucacugcu

SEQ ID NO: 4209680 - RNA, 22 nt, Yersinia pestis KIM
cgggccgagucacgaaggcaac

SEQ ID NO: 4209681 - RNA, 14 nt, Yersinia pestis KIM
cgggccuaauuuaa

SEQ ID NO: 4209682 - RNA, 22 nt, Yersinia pestis KIM
cgggccuuugcuuuucugccua

SEQ ID NO: 4209683 - RNA, 19 nt, Yersinia pestis KIM
cgggccuuuuaccuuuaac

SEQ ID NO: 4209684 - RNA, 23 nt, Yersinia pestis KIM
cgggcgaaggucaauugcggcca

SEQ ID NO: 4209685 - RNA, 22 nt, Yersinia pestis KIM
cgggcgcagccacaugauuacc

SEQ ID NO: 4209686 - RNA, 12 nt, Yersinia pestis KIM
cgggcgcaggcg

SEQ ID NO: 4209687 - RNA, 15 nt, Yersinia pestis KIM
cgggcggauccccug

SEQ ID NO: 4209688 - RNA, 15 nt, Yersinia pestis KIM
cgggcucaugcagca

SEQ ID NO: 4209689 - RNA, 17 nt, Yersinia pestis KIM
cgggcugaguaaagccc

SEQ ID NO: 4209690 - RNA, 23 nt, Yersinia pestis KIM
cgggcugcugcagccgggaugau

SEQ ID NO: 4209691 - RNA, 21 nt, Yersinia pestis KIM
cgggcugucggcgaugaaaaa

SEQ ID NO: 4209692 - RNA, 18 nt, Yersinia pestis KIM
cgggcuuauucgaguagg

SEQ ID NO: 4209693 - RNA, 17 nt, Yersinia pestis KIM
cgggcuuccaucaggaa

SEQ ID NO: 4209694 - RNA, 18 nt, Yersinia pestis KIM
cgggcuuccaucaggaag

SEQ ID NO: 4209695 - RNA, 22 nt, Yersinia pestis KIM
cgggcuuuuuuucggcaucuua

SEQ ID NO: 4209696 - RNA, 18 nt, Yersinia pestis KIM
cgggggccccugauugca

SEQ ID NO: 4209697 - RNA, 16 nt, Yersinia pestis KIM
cggggguugucagcag

SEQ ID NO: 4209698 - RNA, 22 nt, Yersinia pestis KIM
cggggguugucagcagucugau

SEQ ID NO: 4209699 - RNA, 15 nt, Yersinia pestis KIM
cgggguuugucagca

SEQ ID NO: 4209700 - RNA, 14 nt, Yersinia pestis KIM
cggguaacaacuca

SEQ ID NO: 4209701 - RNA, 14 nt, Yersinia pestis KIM
cggguauaucacuu

SEQ ID NO: 4209702 - RNA, 20 nt, Yersinia pestis KIM
cgggucgucucuugcaauga

SEQ ID NO: 4209703 - RNA, 13 nt, Yersinia pestis KIM
cgggugagugaac

SEQ ID NO: 4209704 - RNA, 14 nt, Yersinia pestis KIM
cgggugagugagcg

SEQ ID NO: 4209705 - RNA, 23 nt, Yersinia pestis KIM
cgggugcgccaaucgccaccggc

SEQ ID NO: 4209706 - RNA, 15 nt, Yersinia pestis KIM
cguaggcaaacaugg

SEQ ID NO: 4209707 - RNA, 21 nt, Yersinia pestis KIM
cguaggccacccccauaacca

SEQ ID NO: 4209708 - RNA, 14 nt, Yersinia pestis KIM
cguaggcugaccac

SEQ ID NO: 4209709 - RNA, 17 nt, Yersinia pestis KIM
cguaggcuuggcgggcu

SEQ ID NO: 4209710 - RNA, 17 nt, Yersinia pestis KIM
cguagguaacuaagcug

SEQ ID NO: 4209711 - RNA, 19 nt, Yersinia pestis KIM
cguagguaacuaagcugcc

SEQ ID NO: 4209712 - RNA, 20 nt, Yersinia pestis KIM
cguagguaauuaaacgcuca

SEQ ID NO: 4209713 - RNA, 18 nt, Yersinia pestis KIM
cguagguuucagccucug

SEQ ID NO: 4209714 - RNA, 19 nt, Yersinia pestis KIM
cguagguuucagccucuga

SEQ ID NO: 4209715 - RNA, 15 nt, Yersinia pestis KIM
cguauaacauaauaa

SEQ ID NO: 4209716 - RNA, 16 nt, Yersinia pestis KIM
cguauaacgcagcccc

SEQ ID NO: 4209717 - RNA, 15 nt, Yersinia pestis KIM
cguauauuggccugc

SEQ ID NO: 4209718 - RNA, 13 nt, Yersinia pestis KIM
cguaucagccccu

SEQ ID NO: 4209719 - RNA, 21 nt, Yersinia pestis KIM
cguaucagccccuaaauccug

SEQ ID NO: 4209720 - RNA, 18 nt, Yersinia pestis KIM
cguauccuuacuuugcga

SEQ ID NO: 4209721 - RNA, 15 nt, Yersinia pestis KIM
cguaucuucugccag

SEQ ID NO: 4209722 - RNA, 20 nt, Yersinia pestis KIM
cguaucuuguaguaaccaca

SEQ ID NO: 4209723 - RNA, 21 nt, Yersinia pestis KIM
cguauuaucaguaacgccgua

SEQ ID NO: 4209724 - RNA, 12 nt, Yersinia pestis KIM
cguauuaucugc

SEQ ID NO: 4209725 - RNA, 18 nt, Yersinia pestis KIM
cguauuuucauuuuaaca

SEQ ID NO: 4209726 - RNA, 20 nt, Yersinia pestis KIM
cgucaaacgggugcgccaau

SEQ ID NO: 4209727 - RNA, 14 nt, Yersinia pestis KIM
cgucaacagaacua

SEQ ID NO: 4209728 - RNA, 20 nt, Yersinia pestis KIM
cgucaagguacccauuauuc

SEQ ID NO: 4209729 - RNA, 14 nt, Yersinia pestis KIM
cgucaaguucauau

SEQ ID NO: 4209730 - RNA, 12 nt, Yersinia pestis KIM
cgucacacuggu

SEQ ID NO: 4209731 - RNA, 23 nt, Yersinia pestis KIM
cgucacggguuccgcguuuaucg

SEQ ID NO: 4209732 - RNA, 17 nt, Yersinia pestis KIM
cgucacuaaauccaaau

SEQ ID NO: 4209733 - RNA, 18 nt, Yersinia pestis KIM
cgucagaucgcgcccauc

SEQ ID NO: 4209734 - RNA, 13 nt, Yersinia pestis KIM
cgucagaugcuga

SEQ ID NO: 4209735 - RNA, 14 nt, Yersinia pestis KIM
cgucauaaauaaag

SEQ ID NO: 4209736 - RNA, 19 nt, Yersinia pestis KIM
cgucauaccauucucuguc

SEQ ID NO: 4209737 - RNA, 16 nt, Yersinia pestis KIM
cgucaucaucuucuuc

SEQ ID NO: 4209738 - RNA, 19 nt, Yersinia pestis KIM
cgucaugaaguugauaaaa

SEQ ID NO: 4209739 - RNA, 18 nt, Yersinia pestis KIM
cgucauggucucacugcg

SEQ ID NO: 4209740 - RNA, 22 nt, Yersinia pestis KIM
cgucauuuccguuaacccaaag

SEQ ID NO: 4209741 - RNA, 22 nt, Yersinia pestis KIM
cguccagaacaauaccgccaau

SEQ ID NO: 4209742 - RNA, 14 nt, Yersinia pestis KIM
cgucccaagaaaag

SEQ ID NO: 4209743 - RNA, 22 nt, Yersinia pestis KIM
cgucccaagaaaagcaccgcag

SEQ ID NO: 4209744 - RNA, 21 nt, Yersinia pestis KIM
cgucccauuccguuuaaacuc

SEQ ID NO: 4209745 - RNA, 15 nt, Yersinia pestis KIM
cgucccuaaagccau

SEQ ID NO: 4209746 - RNA, 21 nt, Yersinia pestis KIM
cgucccuaaagccaucgccau

SEQ ID NO: 4209747 - RNA, 17 nt, Yersinia pestis KIM
cguccgcgccagggagg

SEQ ID NO: 4209748 - RNA, 18 nt, Yersinia pestis KIM
cguccgucauccaaugac

SEQ ID NO: 4209749 - RNA, 20 nt, Yersinia pestis KIM
cguccugaugaugaagcauu

SEQ ID NO: 4209750 - RNA, 16 nt, Yersinia pestis KIM
cgucgaggaucaccac

SEQ ID NO: 4209751 - RNA, 15 nt, Yersinia pestis KIM
cgucgccgcagaaga

SEQ ID NO: 4209752 - RNA, 17 nt, Yersinia pestis KIM
cgucgguuuuuguauuc

SEQ ID NO: 4209753 - RNA, 19 nt, Yersinia pestis KIM
cgucguuauuuaccguaac

SEQ ID NO: 4209754 - RNA, 18 nt, Yersinia pestis KIM
cgucuacgcucuccucuc

SEQ ID NO: 4209755 - RNA, 16 nt, Yersinia pestis KIM
cgucucuacgacgccc

SEQ ID NO: 4209756 - RNA, 13 nt, Yersinia pestis KIM
cgucucuuuuuca

SEQ ID NO: 4209757 - RNA, 19 nt, Yersinia pestis KIM
cgucugagguggcacccag

SEQ ID NO: 4209758 - RNA, 13 nt, Yersinia pestis KIM
cgucugauaaccg

SEQ ID NO: 4209759 - RNA, 14 nt, Yersinia pestis KIM
cgucuucagcuucc

SEQ ID NO: 4209760 - RNA, 14 nt, Yersinia pestis KIM
cgucuucgacagca

SEQ ID NO: 4209761 - RNA, 13 nt, Yersinia pestis KIM
cgucuugaucaac

SEQ ID NO: 4209762 - RNA, 16 nt, Yersinia pestis KIM
cgucuugaucaacuca

SEQ ID NO: 4209763 - RNA, 17 nt, Yersinia pestis KIM
cgucuuuuaccaaugaa

SEQ ID NO: 4209764 - RNA, 22 nt, Yersinia pestis KIM
cgugaaacgauaugcuccagau

SEQ ID NO: 4209765 - RNA, 22 nt, Yersinia pestis KIM
cgugaacccgauuugaacgcga

SEQ ID NO: 4209766 - RNA, 13 nt, Yersinia pestis KIM
cgugaagauaacg

SEQ ID NO: 4209767 - RNA, 18 nt, Yersinia pestis KIM
cgugaagugagcugaacu

SEQ ID NO: 4209768 - RNA, 15 nt, Yersinia pestis KIM
cgugacauacuuugc

SEQ ID NO: 4209769 - RNA, 19 nt, Yersinia pestis KIM
cgugacguuaucucaacca

SEQ ID NO: 4209770 - RNA, 16 nt, Yersinia pestis KIM
cgugagaaaaaagucg

SEQ ID NO: 4209771 - RNA, 20 nt, Yersinia pestis KIM
cgugagucagguggcuauuc

SEQ ID NO: 4209772 - RNA, 13 nt, Yersinia pestis KIM
cgugauaucccca

SEQ ID NO: 4209773 - RNA, 21 nt, Yersinia pestis KIM
cgugauaugaauauccgccgc

SEQ ID NO: 4209774 - RNA, 17 nt, Yersinia pestis KIM
cgugauaugccugaagu

SEQ ID NO: 4209775 - RNA, 18 nt, Yersinia pestis KIM
cgugaugccaguaauuca

SEQ ID NO: 4209776 - RNA, 16 nt, Yersinia pestis KIM
cgugauugguuuaucc

SEQ ID NO: 4209777 - RNA, 16 nt, Yersinia pestis KIM
cgugauuuuuauauuu

SEQ ID NO: 4209778 - RNA, 14 nt, Yersinia pestis KIM
cgugcaauaaagcg

SEQ ID NO: 4209779 - RNA, 16 nt, Yersinia pestis KIM
cgugcagcgcgcagcc

SEQ ID NO: 4209780 - RNA, 16 nt, Yersinia pestis KIM
cgugcauaaaacgauu

SEQ ID NO: 4209781 - RNA, 17 nt, Yersinia pestis KIM
cgugcauaaaacgauuu

SEQ ID NO: 4209782 - RNA, 16 nt, Yersinia pestis KIM
cgugccagauccucuu

SEQ ID NO: 4209783 - RNA, 14 nt, Yersinia pestis KIM
cgugccccaaugau

SEQ ID NO: 4209784 - RNA, 13 nt, Yersinia pestis KIM
cgugccguucagg

SEQ ID NO: 4209785 - RNA, 22 nt, Yersinia pestis KIM
cgugcgcuccauuucugguugu

SEQ ID NO: 4209786 - RNA, 21 nt, Yersinia pestis KIM
cgugcucaucaaccucagccu

SEQ ID NO: 4209787 - RNA, 17 nt, Yersinia pestis KIM
cgugcugucagccagcg

SEQ ID NO: 4209788 - RNA, 18 nt, Yersinia pestis KIM
cguggaguagagcuucca

SEQ ID NO: 4209789 - RNA, 21 nt, Yersinia pestis KIM
cguggaguagagcuuccagug

SEQ ID NO: 4209790 - RNA, 21 nt, Yersinia pestis KIM
cguggccccaagcauagaaga

SEQ ID NO: 4209791 - RNA, 21 nt, Yersinia pestis KIM
cguggcccuuucgcagcccaa

SEQ ID NO: 4209792 - RNA, 21 nt, Yersinia pestis KIM
cguggccgugaccaccgcagc

SEQ ID NO: 4209793 - RNA, 22 nt, Yersinia pestis KIM
cguggccgugacuacgguguuu

SEQ ID NO: 4209794 - RNA, 21 nt, Yersinia pestis KIM
cguggcgcgccacuucuuuca

SEQ ID NO: 4209795 - RNA, 13 nt, Yersinia pestis KIM
cguggcugaaauc

SEQ ID NO: 4209796 - RNA, 21 nt, Yersinia pestis KIM
cgugggcgcagaagaauaucu

SEQ ID NO: 4209797 - RNA, 15 nt, Yersinia pestis KIM
cgugggcgcagguaa

SEQ ID NO: 4209798 - RNA, 19 nt, Yersinia pestis KIM
cguggguauccagugucau

SEQ ID NO: 4209799 - RNA, 13 nt, Yersinia pestis KIM
cguggguucuuca

SEQ ID NO: 4209800 - RNA, 15 nt, Yersinia pestis KIM
cguggguucuucaaa

SEQ ID NO: 4209801 - RNA, 20 nt, Yersinia pestis KIM
cgugguaccuacuuuauuuu

SEQ ID NO: 4209802 - RNA, 12 nt, Yersinia pestis KIM
cguggugaugau

SEQ ID NO: 4209803 - RNA, 14 nt, Yersinia pestis KIM
cguggugaugauga

SEQ ID NO: 4209804 - RNA, 19 nt, Yersinia pestis KIM
cguguaguuauugauuaau

SEQ ID NO: 4209805 - RNA, 16 nt, Yersinia pestis KIM
cgugucaaugguucac

SEQ ID NO: 4209806 - RNA, 13 nt, Yersinia pestis KIM
cgugugauaaacu

SEQ ID NO: 4209807 - RNA, 14 nt, Yersinia pestis KIM
cgugugauuuccau

SEQ ID NO: 4209808 - RNA, 17 nt, Yersinia pestis KIM
cguguggagaacucauu

SEQ ID NO: 4209809 - RNA, 21 nt, Yersinia pestis KIM
cguguggagaacucauuuuuu

SEQ ID NO: 4209810 - RNA, 21 nt, Yersinia pestis KIM
cguguugcaucauuggcuuca

SEQ ID NO: 4209811 - RNA, 18 nt, Yersinia pestis KIM
cguuaaaaggcaccucaa

SEQ ID NO: 4209812 - RNA, 13 nt, Yersinia pestis KIM
cguuaacccaaag

SEQ ID NO: 4209813 - RNA, 17 nt, Yersinia pestis KIM
cguuaaguucaagaacc

SEQ ID NO: 4209814 - RNA, 19 nt, Yersinia pestis KIM
cguuaauuauagugaaaac

SEQ ID NO: 4209815 - RNA, 19 nt, Yersinia pestis KIM
cguuaauuuagcguuuacu

SEQ ID NO: 4209816 - RNA, 18 nt, Yersinia pestis KIM
cguuacaacgagggcuca

SEQ ID NO: 4209817 - RNA, 22 nt, Yersinia pestis KIM
cguuacaacgagggcucaaucu

SEQ ID NO: 4209818 - RNA, 13 nt, Yersinia pestis KIM
cguuacagcaagg

SEQ ID NO: 4209819 - RNA, 18 nt, Yersinia pestis KIM
cguuacagcaaggcagaa

SEQ ID NO: 4209820 - RNA, 18 nt, Yersinia pestis KIM
cguuacagcaaggcagca

SEQ ID NO: 4209821 - RNA, 17 nt, Yersinia pestis KIM
cuaacucuucuggcaaa

SEQ ID NO: 4209822 - RNA, 20 nt, Yersinia pestis KIM
cuaacuggcccucuuuuuug

SEQ ID NO: 4209823 - RNA, 22 nt, Yersinia pestis KIM
cuaagaauugguuauccuaaga

SEQ ID NO: 4209824 - RNA, 20 nt, Yersinia pestis KIM
cuaagccucucucacuuugg

SEQ ID NO: 4209825 - RNA, 18 nt, Yersinia pestis KIM
cuaagcgaagauacaaua

SEQ ID NO: 4209826 - RNA, 20 nt, Yersinia pestis KIM
cuaagcggaguuggcuagca

SEQ ID NO: 4209827 - RNA, 16 nt, Yersinia pestis KIM
cuaaggccaucaauaa

SEQ ID NO: 4209828 - RNA, 15 nt, Yersinia pestis KIM
cuaaggggccaauag

SEQ ID NO: 4209829 - RNA, 21 nt, Yersinia pestis KIM
cuaaguucagcgcuuaauauu

SEQ ID NO: 4209830 - RNA, 13 nt, Yersinia pestis KIM
cuaauaaaccugc

SEQ ID NO: 4209831 - RNA, 16 nt, Yersinia pestis KIM
cuaauaauaaucuuaa

SEQ ID NO: 4209832 - RNA, 22 nt, Yersinia pestis KIM
cuaauaauaauuaaucuuaaug

SEQ ID NO: 4209833 - RNA, 17 nt, Yersinia pestis KIM
cuaauacagcaccaccg

SEQ ID NO: 4209834 - RNA, 16 nt, Yersinia pestis KIM
cuaauacgcuaucaac

SEQ ID NO: 4209835 - RNA, 15 nt, Yersinia pestis KIM
cuaauacggcuugca

SEQ ID NO: 4209836 - RNA, 18 nt, Yersinia pestis KIM
cuaauacggguuucugcu

SEQ ID NO: 4209837 - RNA, 15 nt, Yersinia pestis KIM
cuaauagcauuuuuc

SEQ ID NO: 4209838 - RNA, 15 nt, Yersinia pestis KIM
cuaauaucaacagaa

SEQ ID NO: 4209839 - RNA, 14 nt, Yersinia pestis KIM
cuaauauuuucagc

SEQ ID NO: 4209840 - RNA, 16 nt, Yersinia pestis KIM
cuaauauuuucagccc

SEQ ID NO: 4209841 - RNA, 19 nt, Yersinia pestis KIM
cuaauauuuucagcccuac

SEQ ID NO: 4209842 - RNA, 15 nt, Yersinia pestis KIM
cuaaucaugcgggau

SEQ ID NO: 4209843 - RNA, 11 nt, Yersinia pestis KIM
cuaauccaagg

SEQ ID NO: 4209844 - RNA, 12 nt, Yersinia pestis KIM
cuaauccaaggc

SEQ ID NO: 4209845 - RNA, 14 nt, Yersinia pestis KIM
cuaaucuccucucc

SEQ ID NO: 4209846 - RNA, 16 nt, Yersinia pestis KIM
cuaaucuccucuccgg

SEQ ID NO: 4209847 - RNA, 16 nt, Yersinia pestis KIM
cuaaugacagacgcgg

SEQ ID NO: 4209848 - RNA, 14 nt, Yersinia pestis KIM
cuaaugauuacucu

SEQ ID NO: 4209849 - RNA, 18 nt, Yersinia pestis KIM
cuaaugccagacacaaga

SEQ ID NO: 4209850 - RNA, 22 nt, Yersinia pestis KIM
cuaaugccgcgcccccagccau

SEQ ID NO: 4209851 - RNA, 14 nt, Yersinia pestis KIM
cuaaugcgagugcc

SEQ ID NO: 4209852 - RNA, 17 nt, Yersinia pestis KIM
cuaauggugcuauuucu

SEQ ID NO: 4209853 - RNA, 18 nt, Yersinia pestis KIM
cuaauggugcuauuucug

SEQ ID NO: 4209854 - RNA, 21 nt, Yersinia pestis KIM
cuaauguauuuauucaaaaaa

SEQ ID NO: 4209855 - RNA, 18 nt, Yersinia pestis KIM
cuaaugugaugaaacuaa

SEQ ID NO: 4209856 - RNA, 16 nt, Yersinia pestis KIM
cuaauguuuguuucuc

SEQ ID NO: 4209857 - RNA, 18 nt, Yersinia pestis KIM
cuaauguuuguuucucug

SEQ ID NO: 4209858 - RNA, 13 nt, Yersinia pestis KIM
cuaauuaauuuaa

SEQ ID NO: 4209859 - RNA, 20 nt, Yersinia pestis KIM
cuaauuaauuuaaacaacca

SEQ ID NO: 4209860 - RNA, 20 nt, Yersinia pestis KIM
cuaauuagugacaguagaau

SEQ ID NO: 4209861 - RNA, 22 nt, Yersinia pestis KIM
cuaauuccgccaguggcuuugc

SEQ ID NO: 4209862 - RNA, 21 nt, Yersinia pestis KIM
cuaauucgugggcauuuuuug

SEQ ID NO: 4209863 - RNA, 12 nt, Yersinia pestis KIM
cuaauucuccuu

SEQ ID NO: 4209864 - RNA, 19 nt, Yersinia pestis KIM
cuaauucuccuuucuuuuc

SEQ ID NO: 4209865 - RNA, 20 nt, Yersinia pestis KIM
cuaauucuccuuucuuuucg

SEQ ID NO: 4209866 - RNA, 15 nt, Yersinia pestis KIM
cuaauucuuaggaua

SEQ ID NO: 4209867 - RNA, 19 nt, Yersinia pestis KIM
cuaauuuauaaccuuuuuc

SEQ ID NO: 4209868 - RNA, 15 nt, Yersinia pestis KIM
cuaauuugacgccgc

SEQ ID NO: 4209869 - RNA, 14 nt, Yersinia pestis KIM
cuaauuuucccugu

SEQ ID NO: 4209870 - RNA, 13 nt, Yersinia pestis KIM
cuacaaagucuga

SEQ ID NO: 4209871 - RNA, 11 nt, Yersinia pestis KIM
cuacaaccugg

SEQ ID NO: 4209872 - RNA, 16 nt, Yersinia pestis KIM
cuacaagcaugugaug

SEQ ID NO: 4209873 - RNA, 14 nt, Yersinia pestis KIM
cuacaaucaucggc

SEQ ID NO: 4209874 - RNA, 16 nt, Yersinia pestis KIM
cuacacagucuuuuuc

SEQ ID NO: 4209875 - RNA, 15 nt, Yersinia pestis KIM
cuacaccgcuaaccu

SEQ ID NO: 4209876 - RNA, 18 nt, Yersinia pestis KIM
cuacacgcuuuacuguca

SEQ ID NO: 4209877 - RNA, 22 nt, Yersinia pestis KIM
cuacagaaaaauaacauccaug

SEQ ID NO: 4209878 - RNA, 13 nt, Yersinia pestis KIM
cuacagaaaaccc

SEQ ID NO: 4209879 - RNA, 18 nt, Yersinia pestis KIM
cuacaggcgcaacugcca

SEQ ID NO: 4209880 - RNA, 14 nt, Yersinia pestis KIM
cuacagggaaaaac

SEQ ID NO: 4209881 - RNA, 16 nt, Yersinia pestis KIM
cuacauagaaaauaau

SEQ ID NO: 4209882 - RNA, 23 nt, Yersinia pestis KIM
cuacauagcgcauccaaccugca

SEQ ID NO: 4209883 - RNA, 20 nt, Yersinia pestis KIM
cuacaucauaacgaaugagc

SEQ ID NO: 4209884 - RNA, 19 nt, Yersinia pestis KIM
cuaccaaccgcuuuaucgc

SEQ ID NO: 4209885 - RNA, 22 nt, Yersinia pestis KIM
cuaccacguuuaucugacacaa

SEQ ID NO: 4209886 - RNA, 18 nt, Yersinia pestis KIM
cuaccagcagugcagcca

SEQ ID NO: 4209887 - RNA, 15 nt, Yersinia pestis KIM
cuaccaggaagcggc

SEQ ID NO: 4209888 - RNA, 15 nt, Yersinia pestis KIM
cuaccaucaaaauau

SEQ ID NO: 4209889 - RNA, 21 nt, Yersinia pestis KIM
cuaccaugagugaaaauaugu

SEQ ID NO: 4209890 - RNA, 22 nt, Yersinia pestis KIM
cuacccauuauaaauaauuaau

SEQ ID NO: 4209891 - RNA, 17 nt, Yersinia pestis KIM
cuaccccaacauugguu

SEQ ID NO: 4209892 - RNA, 19 nt, Yersinia pestis KIM
cuacccgacaccggcugau

SEQ ID NO: 4209893 - RNA, 17 nt, Yersinia pestis KIM
cuaccgagucuauuuuc

SEQ ID NO: 4209894 - RNA, 14 nt, Yersinia pestis KIM
cuaccgccagcuga

SEQ ID NO: 4209895 - RNA, 13 nt, Yersinia pestis KIM
cuaccgcucagau

SEQ ID NO: 4209896 - RNA, 23 nt, Yersinia pestis KIM
cuaccggauaacguuucagggug

SEQ ID NO: 4209897 - RNA, 14 nt, Yersinia pestis KIM
cuaccguaucagcc

SEQ ID NO: 4209898 - RNA, 21 nt, Yersinia pestis KIM
cuaccugcaccaaucauuaca

SEQ ID NO: 4209899 - RNA, 20 nt, Yersinia pestis KIM
cuaccuuuugcauauuucuc

SEQ ID NO: 4209900 - RNA, 16 nt, Yersinia pestis KIM
cuacgccauuaaaagg

SEQ ID NO: 4209901 - RNA, 20 nt, Yersinia pestis KIM
cuacgccccaugcaccuucc

SEQ ID NO: 4209902 - RNA, 19 nt, Yersinia pestis KIM
cuacgcuggcgcaucccca

SEQ ID NO: 4209903 - RNA, 13 nt, Yersinia pestis KIM
cuacgcuuucagg

SEQ ID NO: 4209904 - RNA, 14 nt, Yersinia pestis KIM
cuacggcuucccau

SEQ ID NO: 4209905 - RNA, 18 nt, Yersinia pestis KIM
cuacgggcgcuuuucuuu

SEQ ID NO: 4209906 - RNA, 21 nt, Yersinia pestis KIM
cuacguuguuaucaucaccac

SEQ ID NO: 4209907 - RNA, 21 nt, Yersinia pestis KIM
cuacuauaagcgcucaaauac

SEQ ID NO: 4209908 - RNA, 13 nt, Yersinia pestis KIM
cuacuccaacaac

SEQ ID NO: 4209909 - RNA, 16 nt, Yersinia pestis KIM
cuacuccauccccaac

SEQ ID NO: 4209910 - RNA, 19 nt, Yersinia pestis KIM
cuacuccauccccaacucu

SEQ ID NO: 4209911 - RNA, 21 nt, Yersinia pestis KIM
cuacucguaacgacgaaauag

SEQ ID NO: 4209912 - RNA, 19 nt, Yersinia pestis KIM
cuacugaugugcaugugga

SEQ ID NO: 4209913 - RNA, 20 nt, Yersinia pestis KIM
cuacugcuuuuuauugucuc

SEQ ID NO: 4209914 - RNA, 16 nt, Yersinia pestis KIM
cuacuggaauauucca

SEQ ID NO: 4209915 - RNA, 14 nt, Yersinia pestis KIM
cuacuggcugaagu

SEQ ID NO: 4209916 - RNA, 15 nt, Yersinia pestis KIM
cuacuggcugaaguu

SEQ ID NO: 4209917 - RNA, 15 nt, Yersinia pestis KIM
cuacugucuuuuuug

SEQ ID NO: 4209918 - RNA, 15 nt, Yersinia pestis KIM
cuacuguuuugguuu

SEQ ID NO: 4209919 - RNA, 12 nt, Yersinia pestis KIM
cuacuuccccua

SEQ ID NO: 4209920 - RNA, 17 nt, Yersinia pestis KIM
cuagaaaucacacuggc

SEQ ID NO: 4209921 - RNA, 16 nt, Yersinia pestis KIM
cuagagcauaacuggu

SEQ ID NO: 4209922 - RNA, 22 nt, Yersinia pestis KIM
cuagaucacagacguuuaaaua

SEQ ID NO: 4209923 - RNA, 12 nt, Yersinia pestis KIM
cuagaugcggca

SEQ ID NO: 4209924 - RNA, 18 nt, Yersinia pestis KIM
cuagaugcggcaacuuuu

SEQ ID NO: 4209925 - RNA, 15 nt, Yersinia pestis KIM
cuagauggaaaucac

SEQ ID NO: 4209926 - RNA, 21 nt, Yersinia pestis KIM
cuagauuaaccuuaucaccaa

SEQ ID NO: 4209927 - RNA, 14 nt, Yersinia pestis KIM
cuagauuuucuuuc

SEQ ID NO: 4209928 - RNA, 15 nt, Yersinia pestis KIM
cuagauuuucuuuca

SEQ ID NO: 4209929 - RNA, 18 nt, Yersinia pestis KIM
cuagcaacacaucgguau

SEQ ID NO: 4209930 - RNA, 19 nt, Yersinia pestis KIM
cuagcagugauuucagugu

SEQ ID NO: 4209931 - RNA, 16 nt, Yersinia pestis KIM
cuagccaccucacuca

SEQ ID NO: 4209932 - RNA, 14 nt, Yersinia pestis KIM
cuagccagccaccg

SEQ ID NO: 4209933 - RNA, 20 nt, Yersinia pestis KIM
cuagcccaguaccgcuggug

SEQ ID NO: 4209934 - RNA, 15 nt, Yersinia pestis KIM
cuagcgagcucugag

SEQ ID NO: 4209935 - RNA, 16 nt, Yersinia pestis KIM
cuagcgccagcaauug

SEQ ID NO: 4209936 - RNA, 14 nt, Yersinia pestis KIM
cucaccgcuggaag

SEQ ID NO: 4209937 - RNA, 16 nt, Yersinia pestis KIM
cucaccgcuggaagcc

SEQ ID NO: 4209938 - RNA, 18 nt, Yersinia pestis KIM
cucaccguauacgcugaa

SEQ ID NO: 4209939 - RNA, 22 nt, Yersinia pestis KIM
cucaccguucaagagugaguca

SEQ ID NO: 4209940 - RNA, 14 nt, Yersinia pestis KIM
cucacguauuuuca

SEQ ID NO: 4209941 - RNA, 22 nt, Yersinia pestis KIM
cucacgucaguaaugaggguaa

SEQ ID NO: 4209942 - RNA, 13 nt, Yersinia pestis KIM
cucacuaaaucaa

SEQ ID NO: 4209943 - RNA, 19 nt, Yersinia pestis KIM
cucacucaccgccagcaau

SEQ ID NO: 4209944 - RNA, 14 nt, Yersinia pestis KIM
cucacucagcgacu

SEQ ID NO: 4209945 - RNA, 13 nt, Yersinia pestis KIM
cucacucugugaa

SEQ ID NO: 4209946 - RNA, 19 nt, Yersinia pestis KIM
cucacugcuccagccaacu

SEQ ID NO: 4209947 - RNA, 13 nt, Yersinia pestis KIM
cucacugucuuug

SEQ ID NO: 4209948 - RNA, 23 nt, Yersinia pestis KIM
cucacugucuuugacaucuaucg

SEQ ID NO: 4209949 - RNA, 20 nt, Yersinia pestis KIM
cucacuuguguaaacuccuu

SEQ ID NO: 4209950 - RNA, 23 nt, Yersinia pestis KIM
cucacuuguguaaacuccuugga

SEQ ID NO: 4209951 - RNA, 14 nt, Yersinia pestis KIM
cucacuuuuaucca

SEQ ID NO: 4209952 - RNA, 17 nt, Yersinia pestis KIM
cucacuuuuauccagcc

SEQ ID NO: 4209953 - RNA, 13 nt, Yersinia pestis KIM
cucacuuuuauug

SEQ ID NO: 4209954 - RNA, 21 nt, Yersinia pestis KIM
cucacuuuuugucaauaaaau

SEQ ID NO: 4209955 - RNA, 21 nt, Yersinia pestis KIM
cucagaaaaaugccugagauc

SEQ ID NO: 4209956 - RNA, 19 nt, Yersinia pestis KIM
cucagcaagguucucgcug

SEQ ID NO: 4209957 - RNA, 17 nt, Yersinia pestis KIM
cucagcacaaacauggc

SEQ ID NO: 4209958 - RNA, 13 nt, Yersinia pestis KIM
cucagcaucaccg

SEQ ID NO: 4209959 - RNA, 14 nt, Yersinia pestis KIM
cucagcauccuccu

SEQ ID NO: 4209960 - RNA, 18 nt, Yersinia pestis KIM
cucagccucauucaugag

SEQ ID NO: 4209961 - RNA, 23 nt, Yersinia pestis KIM
cucagcgcuggcgagguaccgcu

SEQ ID NO: 4209962 - RNA, 18 nt, Yersinia pestis KIM
cucagcgggcuaaaugcu

SEQ ID NO: 4209963 - RNA, 20 nt, Yersinia pestis KIM
cucagcgggcuaaaugcucg

SEQ ID NO: 4209964 - RNA, 15 nt, Yersinia pestis KIM
cucagcgucacggaa

SEQ ID NO: 4209965 - RNA, 20 nt, Yersinia pestis KIM
cucagcugguuagagcacag

SEQ ID NO: 4209966 - RNA, 14 nt, Yersinia pestis KIM
cucaggaaucuuca

SEQ ID NO: 4209967 - RNA, 14 nt, Yersinia pestis KIM
cucagggagccaau

SEQ ID NO: 4209968 - RNA, 21 nt, Yersinia pestis KIM
cucagggagccaauagaggcu

SEQ ID NO: 4209969 - RNA, 13 nt, Yersinia pestis KIM
cucagggccacuu

SEQ ID NO: 4209970 - RNA, 20 nt, Yersinia pestis KIM
cucaguacagucccugugcg

SEQ ID NO: 4209971 - RNA, 16 nt, Yersinia pestis KIM
cucaguagcaggcgca

SEQ ID NO: 4209972 - RNA, 17 nt, Yersinia pestis KIM
cucaguaucuuuccagc

SEQ ID NO: 4209973 - RNA, 20 nt, Yersinia pestis KIM
cucaguaucuuuccagccaa

SEQ ID NO: 4209974 - RNA, 14 nt, Yersinia pestis KIM
cucagucaucgccu

SEQ ID NO: 4209975 - RNA, 21 nt, Yersinia pestis KIM
cucagugacugggggugagca

SEQ ID NO: 4209976 - RNA, 16 nt, Yersinia pestis KIM
cucaguguggaauaca

SEQ ID NO: 4209977 - RNA, 21 nt, Yersinia pestis KIM
cucaguucgguugccaaaauu

SEQ ID NO: 4209978 - RNA, 12 nt, Yersinia pestis KIM
cucaguuuugcu

SEQ ID NO: 4209979 - RNA, 13 nt, Yersinia pestis KIM
cucauacucaguc

SEQ ID NO: 4209980 - RNA, 17 nt, Yersinia pestis KIM
cucauagcccugcugcu

SEQ ID NO: 4209981 - RNA, 13 nt, Yersinia pestis KIM
cucaucaaacacc

SEQ ID NO: 4209982 - RNA, 17 nt, Yersinia pestis KIM
cucaucaaaggagugcc

SEQ ID NO: 4209983 - RNA, 19 nt, Yersinia pestis KIM
cucaucaaccucagccuca

SEQ ID NO: 4209984 - RNA, 11 nt, Yersinia pestis KIM
cucaucacccg

SEQ ID NO: 4209985 - RNA, 13 nt, Yersinia pestis KIM
cucaucaccuucc

SEQ ID NO: 4209986 - RNA, 18 nt, Yersinia pestis KIM
cucaucagaggcucaucc

SEQ ID NO: 4209987 - RNA, 15 nt, Yersinia pestis KIM
cucaucaguaacgcc

SEQ ID NO: 4209988 - RNA, 21 nt, Yersinia pestis KIM
cucaucaguuggucuuuaauc

SEQ ID NO: 4209989 - RNA, 15 nt, Yersinia pestis KIM
cucaucauaaaaaua

SEQ ID NO: 4209990 - RNA, 17 nt, Yersinia pestis KIM
cucaucauccaucacaa

SEQ ID NO: 4209991 - RNA, 24 nt, Yersinia pestis KIM
cucaucauuauagaauucauucag

SEQ ID NO: 4209992 - RNA, 19 nt, Yersinia pestis KIM
cucauccaacguaaacauu

SEQ ID NO: 4209993 - RNA, 12 nt, Yersinia pestis KIM
cucauccagauu

SEQ ID NO: 4209994 - RNA, 17 nt, Yersinia pestis KIM
cucauccagcaacucaa

SEQ ID NO: 4209995 - RNA, 20 nt, Yersinia pestis KIM
cucaucgccaaagccgucag

SEQ ID NO: 4209996 - RNA, 17 nt, Yersinia pestis KIM
cucaucggguaaaauca

SEQ ID NO: 4209997 - RNA, 14 nt, Yersinia pestis KIM
cucaucugaacuau

SEQ ID NO: 4209998 - RNA, 23 nt, Yersinia pestis KIM
cucaucuggcguucuacugcguc

SEQ ID NO: 4209999 - RNA, 15 nt, Yersinia pestis KIM
cucaucuuauuucac

SEQ ID NO: 4210000 - RNA, 22 nt, Yersinia pestis KIM
cucaucuugggcgggaucucca

SEQ ID NO: 4210001 - RNA, 13 nt, Yersinia pestis KIM
cucaugaaugagg

SEQ ID NO: 4210002 - RNA, 21 nt, Yersinia pestis KIM
cucauguucauguucaugguc

SEQ ID NO: 4210003 - RNA, 18 nt, Yersinia pestis KIM
cucauguucgcacugcuc

SEQ ID NO: 4210004 - RNA, 19 nt, Yersinia pestis KIM
cucauguucgcacugcucu

SEQ ID NO: 4210005 - RNA, 13 nt, Yersinia pestis KIM
cucauuaaaucca

SEQ ID NO: 4210006 - RNA, 16 nt, Yersinia pestis KIM
cucauuauggauaauu

SEQ ID NO: 4210007 - RNA, 17 nt, Yersinia pestis KIM
cucauuauuaaacugau

SEQ ID NO: 4210008 - RNA, 16 nt, Yersinia pestis KIM
cucauucagacccgau

SEQ ID NO: 4210009 - RNA, 19 nt, Yersinia pestis KIM
cucauugagcauaucaauc

SEQ ID NO: 4210010 - RNA, 17 nt, Yersinia pestis KIM
cucauugcgucagguaa

SEQ ID NO: 4210011 - RNA, 13 nt, Yersinia pestis KIM
cucauuuaaaaua

SEQ ID NO: 4210012 - RNA, 11 nt, Yersinia pestis KIM
cucauuuuuug

SEQ ID NO: 4210013 - RNA, 19 nt, Yersinia pestis KIM
cucauuuuuugcguauuau

SEQ ID NO: 4210014 - RNA, 22 nt, Yersinia pestis KIM
cuccaaagcuuccaauauugag

SEQ ID NO: 4210015 - RNA, 13 nt, Yersinia pestis KIM
cuccaacaaccau

SEQ ID NO: 4210016 - RNA, 22 nt, Yersinia pestis KIM
cuccaagcacacugguugaaac

SEQ ID NO: 4210017 - RNA, 17 nt, Yersinia pestis KIM
cuccaauaauucgugaa

SEQ ID NO: 4210018 - RNA, 23 nt, Yersinia pestis KIM
cuccacaccuccgcccucuugcu

SEQ ID NO: 4210019 - RNA, 14 nt, Yersinia pestis KIM
cuccacauauugug

SEQ ID NO: 4210020 - RNA, 15 nt, Yersinia pestis KIM
cuccaccaacggccc

SEQ ID NO: 4210021 - RNA, 15 nt, Yersinia pestis KIM
cuccacgccccaacg

SEQ ID NO: 4210022 - RNA, 16 nt, Yersinia pestis KIM
cuccacuaugcccagu

SEQ ID NO: 4210023 - RNA, 16 nt, Yersinia pestis KIM
cuccacugauuaucga

SEQ ID NO: 4210024 - RNA, 18 nt, Yersinia pestis KIM
cuccagaauauaaaagca

SEQ ID NO: 4210025 - RNA, 16 nt, Yersinia pestis KIM
cuccagaggguaugac

SEQ ID NO: 4210026 - RNA, 20 nt, Yersinia pestis KIM
cuccagccgguuuuuuccac

SEQ ID NO: 4210027 - RNA, 24 nt, Yersinia pestis KIM
cuccaggguaauaagugaucagcu

SEQ ID NO: 4210028 - RNA, 20 nt, Yersinia pestis KIM
cuccaguaaaucuacuuuau

SEQ ID NO: 4210029 - RNA, 14 nt, Yersinia pestis KIM
cuccaguaagccug

SEQ ID NO: 4210030 - RNA, 16 nt, Yersinia pestis KIM
cuccagugcaaauuua

SEQ ID NO: 4210031 - RNA, 16 nt, Yersinia pestis KIM
cuccagugccugacgc

SEQ ID NO: 4210032 - RNA, 12 nt, Yersinia pestis KIM
cuccaguugagu

SEQ ID NO: 4210033 - RNA, 20 nt, Yersinia pestis KIM
cuccaguugcacaccaucag

SEQ ID NO: 4210034 - RNA, 18 nt, Yersinia pestis KIM
cuccaguuggcgcacguu

SEQ ID NO: 4210035 - RNA, 20 nt, Yersinia pestis KIM
cuccaguuggcgcacguucc

SEQ ID NO: 4210036 - RNA, 13 nt, Yersinia pestis KIM
cuccauauagccc

SEQ ID NO: 4210037 - RNA, 24 nt, Yersinia pestis KIM
cuccauauuuuagcggccucuagc

SEQ ID NO: 4210038 - RNA, 22 nt, Yersinia pestis KIM
cuccaucaagccaccgcuggug

SEQ ID NO: 4210039 - RNA, 18 nt, Yersinia pestis KIM
cuccauccccaacucuuu

SEQ ID NO: 4210040 - RNA, 22 nt, Yersinia pestis KIM
cuccaucgccacuucuaacaag

SEQ ID NO: 4210041 - RNA, 15 nt, Yersinia pestis KIM
cucccauuaauuaau

SEQ ID NO: 4210042 - RNA, 17 nt, Yersinia pestis KIM
cucccauucgcgcccca

SEQ ID NO: 4210043 - RNA, 20 nt, Yersinia pestis KIM
cucccauucgcgccccaaau

SEQ ID NO: 4210044 - RNA, 23 nt, Yersinia pestis KIM
cuccccaaagccuacgagagauc

SEQ ID NO: 4210045 - RNA, 22 nt, Yersinia pestis KIM
cucccuauaaugcgccuccacu

SEQ ID NO: 4210046 - RNA, 11 nt, Yersinia pestis KIM
cucccugacuc

SEQ ID NO: 4210047 - RNA, 15 nt, Yersinia pestis KIM
cucccugacucccug

SEQ ID NO: 4210048 - RNA, 19 nt, Yersinia pestis KIM
cucccugacucccugacuc

SEQ ID NO: 4210049 - RNA, 24 nt, Yersinia pestis KIM
cucccuguuuggcccccaguugau

SEQ ID NO: 4210050 - RNA, 23 nt, Yersinia pestis KIM
cucccuuuccagcgguuuuuucu

SEQ ID NO: 4210051 - RNA, 20 nt, Yersinia pestis KIM
cucuguauuguaauaaugga

SEQ ID NO: 4210052 - RNA, 23 nt, Yersinia pestis KIM
cucugucagcccuaauauccuca

SEQ ID NO: 4210053 - RNA, 12 nt, Yersinia pestis KIM
cucugugacucu

SEQ ID NO: 4210054 - RNA, 16 nt, Yersinia pestis KIM
cucuguggauugccaa

SEQ ID NO: 4210055 - RNA, 12 nt, Yersinia pestis KIM
cucuguucuuuu

SEQ ID NO: 4210056 - RNA, 13 nt, Yersinia pestis KIM
cucuguuuuaaaa

SEQ ID NO: 4210057 - RNA, 17 nt, Yersinia pestis KIM
cucuuaaugucuuuacu

SEQ ID NO: 4210058 - RNA, 15 nt, Yersinia pestis KIM
cucuuaguuucuacg

SEQ ID NO: 4210059 - RNA, 12 nt, Yersinia pestis KIM
cucuuauauaaa

SEQ ID NO: 4210060 - RNA, 20 nt, Yersinia pestis KIM
cucuuauauaaauccagccc

SEQ ID NO: 4210061 - RNA, 11 nt, Yersinia pestis KIM
cucuucaccaa

SEQ ID NO: 4210062 - RNA, 17 nt, Yersinia pestis KIM
cucuucagccuauccuc

SEQ ID NO: 4210063 - RNA, 18 nt, Yersinia pestis KIM
cucuucagccuauccuca

SEQ ID NO: 4210064 - RNA, 22 nt, Yersinia pestis KIM
cucuucagggcggcguuagccg

SEQ ID NO: 4210065 - RNA, 20 nt, Yersinia pestis KIM
cucuucagguaagccuuucu

SEQ ID NO: 4210066 - RNA, 13 nt, Yersinia pestis KIM
cucuucaucaguc

SEQ ID NO: 4210067 - RNA, 16 nt, Yersinia pestis KIM
cucuuccaauagcagu

SEQ ID NO: 4210068 - RNA, 11 nt, Yersinia pestis KIM
cucuuccugua

SEQ ID NO: 4210069 - RNA, 20 nt, Yersinia pestis KIM
cucuucuaaaaucgcacuga

SEQ ID NO: 4210070 - RNA, 11 nt, Yersinia pestis KIM
cucuucugcca

SEQ ID NO: 4210071 - RNA, 18 nt, Yersinia pestis KIM
cucuucugccuauccuca

SEQ ID NO: 4210072 - RNA, 22 nt, Yersinia pestis KIM
cucuucuggcgcuaaugagauu

SEQ ID NO: 4210073 - RNA, 13 nt, Yersinia pestis KIM
cucuucugggcug

SEQ ID NO: 4210074 - RNA, 23 nt, Yersinia pestis KIM
cucuucuucgauuuuagcuuuga

SEQ ID NO: 4210075 - RNA, 11 nt, Yersinia pestis KIM
cucuucuuuua

SEQ ID NO: 4210076 - RNA, 17 nt, Yersinia pestis KIM
cucuugaacggugagga

SEQ ID NO: 4210077 - RNA, 22 nt, Yersinia pestis KIM
cucuugacgccgacaaacccac

SEQ ID NO: 4210078 - RNA, 23 nt, Yersinia pestis KIM
cucuugacgccgacaaacccaca

SEQ ID NO: 4210079 - RNA, 17 nt, Yersinia pestis KIM
cucuugcgcuccacgcc

SEQ ID NO: 4210080 - RNA, 19 nt, Yersinia pestis KIM
cucuugcgcuccacgcccc

SEQ ID NO: 4210081 - RNA, 13 nt, Yersinia pestis KIM
cucuuguaaacca

SEQ ID NO: 4210082 - RNA, 20 nt, Yersinia pestis KIM
cucuuuaacaauuuaucaga

SEQ ID NO: 4210083 - RNA, 18 nt, Yersinia pestis KIM
cucuuuaacaccccuuca

SEQ ID NO: 4210084 - RNA, 15 nt, Yersinia pestis KIM
cucuuuaaguucacu

SEQ ID NO: 4210085 - RNA, 21 nt, Yersinia pestis KIM
cucuuuauacauauguugagu

SEQ ID NO: 4210086 - RNA, 12 nt, Yersinia pestis KIM
cucuuucaacuu

SEQ ID NO: 4210087 - RNA, 16 nt, Yersinia pestis KIM
cucuuuccagcaaaag

SEQ ID NO: 4210088 - RNA, 22 nt, Yersinia pestis KIM
cucuuugauuccucugugacuc

SEQ ID NO: 4210089 - RNA, 16 nt, Yersinia pestis KIM
cucuuuuuccacaccc

SEQ ID NO: 4210090 - RNA, 17 nt, Yersinia pestis KIM
cugaaaaaggcaccagc

SEQ ID NO: 4210091 - RNA, 23 nt, Yersinia pestis KIM
cugaaaaaugagucauuaucuga

SEQ ID NO: 4210092 - RNA, 19 nt, Yersinia pestis KIM
cugaaaacaauauaauaac

SEQ ID NO: 4210093 - RNA, 18 nt, Yersinia pestis KIM
cugaaaccuacgccuaaa

SEQ ID NO: 4210094 - RNA, 16 nt, Yersinia pestis KIM
cugaaacguucuucca

SEQ ID NO: 4210095 - RNA, 20 nt, Yersinia pestis KIM
cugaaacguucuuccaugcu

SEQ ID NO: 4210096 - RNA, 17 nt, Yersinia pestis KIM
cugaaacuucaaaauca

SEQ ID NO: 4210097 - RNA, 12 nt, Yersinia pestis KIM
cugaaagauccu

SEQ ID NO: 4210098 - RNA, 16 nt, Yersinia pestis KIM
cugaaagugcccccug

SEQ ID NO: 4210099 - RNA, 20 nt, Yersinia pestis KIM
cugaaaguguauuucucaaa

SEQ ID NO: 4210100 - RNA, 20 nt, Yersinia pestis KIM
cugaaaucauagcuaaauga

SEQ ID NO: 4210101 - RNA, 13 nt, Yersinia pestis KIM
cugaaaugcuaug

SEQ ID NO: 4210102 - RNA, 22 nt, Yersinia pestis KIM
cugaaauuuauuucgauucauu

SEQ ID NO: 4210103 - RNA, 14 nt, Yersinia pestis KIM
cugaaauuuuuuaa

SEQ ID NO: 4210104 - RNA, 17 nt, Yersinia pestis KIM
cugaacaccauacuuuu

SEQ ID NO: 4210105 - RNA, 16 nt, Yersinia pestis KIM
cugaaccacgcauugu

SEQ ID NO: 4210106 - RNA, 11 nt, Yersinia pestis KIM
cugaaccaugg

SEQ ID NO: 4210107 - RNA, 14 nt, Yersinia pestis KIM
cugaaccauuuuuu

SEQ ID NO: 4210108 - RNA, 19 nt, Yersinia pestis KIM
cugaacccugacggccagc

SEQ ID NO: 4210109 - RNA, 19 nt, Yersinia pestis KIM
cugaaccuuggcauugucu

SEQ ID NO: 4210110 - RNA, 20 nt, Yersinia pestis KIM
cugaacgaggacuuccugcc

SEQ ID NO: 4210111 - RNA, 15 nt, Yersinia pestis KIM
cugaagaugccaauc

SEQ ID NO: 4210112 - RNA, 21 nt, Yersinia pestis KIM
cugaagaugccaaucaaaaaa

SEQ ID NO: 4210113 - RNA, 14 nt, Yersinia pestis KIM
cugaagcaucaaua

SEQ ID NO: 4210114 - RNA, 17 nt, Yersinia pestis KIM
cugaagccuacgagaga

SEQ ID NO: 4210115 - RNA, 15 nt, Yersinia pestis KIM
cugaaggccugcugu

SEQ ID NO: 4210116 - RNA, 16 nt, Yersinia pestis KIM
cugaaggcugauuaau

SEQ ID NO: 4210117 - RNA, 22 nt, Yersinia pestis KIM
cugaagggcaaauugccgcuuu

SEQ ID NO: 4210118 - RNA, 20 nt, Yersinia pestis KIM
cugaaguuuaccgcaugaau

SEQ ID NO: 4210119 - RNA, 14 nt, Yersinia pestis KIM
cugaauaaacacca

SEQ ID NO: 4210120 - RNA, 17 nt, Yersinia pestis KIM
cugaauaaacaccauag

SEQ ID NO: 4210121 - RNA, 16 nt, Yersinia pestis KIM
cugaauaaacggcaag

SEQ ID NO: 4210122 - RNA, 20 nt, Yersinia pestis KIM
cugaauacaacgguuuaugc

SEQ ID NO: 4210123 - RNA, 22 nt, Yersinia pestis KIM
cugaauacaacgguuuaugccc

SEQ ID NO: 4210124 - RNA, 14 nt, Yersinia pestis KIM
cugaauaccauaac

SEQ ID NO: 4210125 - RNA, 18 nt, Yersinia pestis KIM
cugaauaucaucuuuuuc

SEQ ID NO: 4210126 - RNA, 19 nt, Yersinia pestis KIM
cugaaucccagaaccucaa

SEQ ID NO: 4210127 - RNA, 23 nt, Yersinia pestis KIM
cugaaucccagaaccucaacauu

SEQ ID NO: 4210128 - RNA, 15 nt, Yersinia pestis KIM
cugaaucgauaaacc

SEQ ID NO: 4210129 - RNA, 21 nt, Yersinia pestis KIM
cugaaucgcugccauaugcau

SEQ ID NO: 4210130 - RNA, 15 nt, Yersinia pestis KIM
cugaauggaaaaauu

SEQ ID NO: 4210131 - RNA, 20 nt, Yersinia pestis KIM
cugaauggcaacgcgcagug

SEQ ID NO: 4210132 - RNA, 17 nt, Yersinia pestis KIM
cugaauggcuauuuacu

SEQ ID NO: 4210133 - RNA, 22 nt, Yersinia pestis KIM
cugaauggcuauuuacucucuu

SEQ ID NO: 4210134 - RNA, 18 nt, Yersinia pestis KIM
cugaaugguuuuagucau

SEQ ID NO: 4210135 - RNA, 15 nt, Yersinia pestis KIM
cugaaugucucuggc

SEQ ID NO: 4210136 - RNA, 18 nt, Yersinia pestis KIM
cugaauugaugcacagua

SEQ ID NO: 4210137 - RNA, 15 nt, Yersinia pestis KIM
cugaauuggaagagc

SEQ ID NO: 4210138 - RNA, 19 nt, Yersinia pestis KIM
cugaauuggaagagccuga

SEQ ID NO: 4210139 - RNA, 15 nt, Yersinia pestis KIM
cugaauuucaauaac

SEQ ID NO: 4210140 - RNA, 21 nt, Yersinia pestis KIM
cugaauuuuugugcuagcuca

SEQ ID NO: 4210141 - RNA, 17 nt, Yersinia pestis KIM
cugaauuuuuuaccuag

SEQ ID NO: 4210142 - RNA, 14 nt, Yersinia pestis KIM
cugacacacaccag

SEQ ID NO: 4210143 - RNA, 15 nt, Yersinia pestis KIM
cugacaccggauaug

SEQ ID NO: 4210144 - RNA, 18 nt, Yersinia pestis KIM
cugacacugacauuuaug

SEQ ID NO: 4210145 - RNA, 14 nt, Yersinia pestis KIM
cugacacugcaucu

SEQ ID NO: 4210146 - RNA, 15 nt, Yersinia pestis KIM
cugacacugcaucuc

SEQ ID NO: 4210147 - RNA, 16 nt, Yersinia pestis KIM
cugacacugcaucucu

SEQ ID NO: 4210148 - RNA, 17 nt, Yersinia pestis KIM
cugacacugcaucucug

SEQ ID NO: 4210149 - RNA, 20 nt, Yersinia pestis KIM
cugacacugcaucucugcau

SEQ ID NO: 4210150 - RNA, 13 nt, Yersinia pestis KIM
cugacacuuucga

SEQ ID NO: 4210151 - RNA, 16 nt, Yersinia pestis KIM
cugacagaacgcaauc

SEQ ID NO: 4210152 - RNA, 16 nt, Yersinia pestis KIM
cugacagagcggguuu

SEQ ID NO: 4210153 - RNA, 14 nt, Yersinia pestis KIM
cugacagccugugc

SEQ ID NO: 4210154 - RNA, 16 nt, Yersinia pestis KIM
cugacagccugugccc

SEQ ID NO: 4210155 - RNA, 15 nt, Yersinia pestis KIM
cugacauaagguuuc

SEQ ID NO: 4210156 - RNA, 12 nt, Yersinia pestis KIM
cugacaucauca

SEQ ID NO: 4210157 - RNA, 14 nt, Yersinia pestis KIM
cugacaucaucacc

SEQ ID NO: 4210158 - RNA, 22 nt, Yersinia pestis KIM
cugacauuugcaucuauggauu

SEQ ID NO: 4210159 - RNA, 17 nt, Yersinia pestis KIM
cugacauuuucuaucuc

SEQ ID NO: 4210160 - RNA, 22 nt, Yersinia pestis KIM
cugacauuuucuaucucaucca

SEQ ID NO: 4210161 - RNA, 21 nt, Yersinia pestis KIM
cugaccagcggugccuugcca

SEQ ID NO: 4210162 - RNA, 16 nt, Yersinia pestis KIM
cugaccccaaauuuga

SEQ ID NO: 4210163 - RNA, 21 nt, Yersinia pestis KIM
cugacccccaauuucauuuac

SEQ ID NO: 4210164 - RNA, 18 nt, Yersinia pestis KIM
cugacccccgccgcuucu

SEQ ID NO: 4210165 - RNA, 22 nt, Yersinia pestis KIM
cugaccgauaaacgccagucag

SEQ ID NO: 4210166 - RNA, 18 nt, Yersinia pestis KIM
cugcacaccacacuggau

SEQ ID NO: 4210167 - RNA, 16 nt, Yersinia pestis KIM
cugcacaguagaagcu

SEQ ID NO: 4210168 - RNA, 18 nt, Yersinia pestis KIM
cugcaccucaucaacgac

SEQ ID NO: 4210169 - RNA, 20 nt, Yersinia pestis KIM
cugcaccucugcugauguca

SEQ ID NO: 4210170 - RNA, 17 nt, Yersinia pestis KIM
cugcacgccuacggcuu

SEQ ID NO: 4210171 - RNA, 21 nt, Yersinia pestis KIM
cugcacggaucacgcuguuca

SEQ ID NO: 4210172 - RNA, 22 nt, Yersinia pestis KIM
cugcacggaucacgcuguucac

SEQ ID NO: 4210173 - RNA, 21 nt, Yersinia pestis KIM
cugcagaaaaugcggcggcug

SEQ ID NO: 4210174 - RNA, 19 nt, Yersinia pestis KIM
cugcagauguauuagcgcu

SEQ ID NO: 4210175 - RNA, 15 nt, Yersinia pestis KIM
cugcaguacagauaa

SEQ ID NO: 4210176 - RNA, 12 nt, Yersinia pestis KIM
cugcagugaaaa

SEQ ID NO: 4210177 - RNA, 13 nt, Yersinia pestis KIM
cugcagugaaaag

SEQ ID NO: 4210178 - RNA, 23 nt, Yersinia pestis KIM
cugcagugaaaagguuaacugca

SEQ ID NO: 4210179 - RNA, 21 nt, Yersinia pestis KIM
cugcauaagcaucaguaauuu

SEQ ID NO: 4210180 - RNA, 22 nt, Yersinia pestis KIM
cugcaucacguauuagcgguga

SEQ ID NO: 4210181 - RNA, 20 nt, Yersinia pestis KIM
cugcaucagcagugacguca

SEQ ID NO: 4210182 - RNA, 13 nt, Yersinia pestis KIM
cugcaucaucaca

SEQ ID NO: 4210183 - RNA, 14 nt, Yersinia pestis KIM
cugcaucucugcau

SEQ ID NO: 4210184 - RNA, 20 nt, Yersinia pestis KIM
cugcaucuggucaucaugua

SEQ ID NO: 4210185 - RNA, 15 nt, Yersinia pestis KIM
cugcauuaccuuuaa

SEQ ID NO: 4210186 - RNA, 13 nt, Yersinia pestis KIM
cugcauucacaua

SEQ ID NO: 4210187 - RNA, 14 nt, Yersinia pestis KIM
cugcauugauuaaa

SEQ ID NO: 4210188 - RNA, 17 nt, Yersinia pestis KIM
cugcauugauuaaauca

SEQ ID NO: 4210189 - RNA, 23 nt, Yersinia pestis KIM
cugccaaaaaauaagggccacca

SEQ ID NO: 4210190 - RNA, 22 nt, Yersinia pestis KIM
cugccaaauauugcacaauagc

SEQ ID NO: 4210191 - RNA, 16 nt, Yersinia pestis KIM
cugccaaauuaaauaa

SEQ ID NO: 4210192 - RNA, 12 nt, Yersinia pestis KIM
cugccaaauuug

SEQ ID NO: 4210193 - RNA, 19 nt, Yersinia pestis KIM
cugccaacaacuuaauucc

SEQ ID NO: 4210194 - RNA, 20 nt, Yersinia pestis KIM
cugccaacaacuuaauuccc

SEQ ID NO: 4210195 - RNA, 13 nt, Yersinia pestis KIM
cugccaauaucca

SEQ ID NO: 4210196 - RNA, 20 nt, Yersinia pestis KIM
cugccaauauccauauuaaa

SEQ ID NO: 4210197 - RNA, 23 nt, Yersinia pestis KIM
cugccacacuuuugcugguguca

SEQ ID NO: 4210198 - RNA, 21 nt, Yersinia pestis KIM
cugccacagacuuucuuuaau

SEQ ID NO: 4210199 - RNA, 12 nt, Yersinia pestis KIM
cugccacugacu

SEQ ID NO: 4210200 - RNA, 16 nt, Yersinia pestis KIM
cugccagaaucagccc

SEQ ID NO: 4210201 - RNA, 22 nt, Yersinia pestis KIM
cugccagaaucagccccaagcu

SEQ ID NO: 4210202 - RNA, 19 nt, Yersinia pestis KIM
cugccagcguugcagaguu

SEQ ID NO: 4210203 - RNA, 22 nt, Yersinia pestis KIM
cugccaguaaaaucaucagccu

SEQ ID NO: 4210204 - RNA, 21 nt, Yersinia pestis KIM
cugccaguucaucagcccagc

SEQ ID NO: 4210205 - RNA, 22 nt, Yersinia pestis KIM
cugccauaaccgcuaaggccaa

SEQ ID NO: 4210206 - RNA, 22 nt, Yersinia pestis KIM
cugccauaauccagaagccauu

SEQ ID NO: 4210207 - RNA, 13 nt, Yersinia pestis KIM
cugccauugcuca

SEQ ID NO: 4210208 - RNA, 18 nt, Yersinia pestis KIM
cugcccaaaauaauguuu

SEQ ID NO: 4210209 - RNA, 12 nt, Yersinia pestis KIM
cugcccaauucg

SEQ ID NO: 4210210 - RNA, 23 nt, Yersinia pestis KIM
cugcccacagggugagucucagg

SEQ ID NO: 4210211 - RNA, 22 nt, Yersinia pestis KIM
cugcccagucacuaccgcucag

SEQ ID NO: 4210212 - RNA, 18 nt, Yersinia pestis KIM
cugccccgaagcucaagc

SEQ ID NO: 4210213 - RNA, 20 nt, Yersinia pestis KIM
cugccccgaagcucaagcug

SEQ ID NO: 4210214 - RNA, 21 nt, Yersinia pestis KIM
cugccccgaagcucaagcugg

SEQ ID NO: 4210215 - RNA, 16 nt, Yersinia pestis KIM
cugccccucuuuucuu

SEQ ID NO: 4210216 - RNA, 17 nt, Yersinia pestis KIM
cugccgcaaacgcucag

SEQ ID NO: 4210217 - RNA, 15 nt, Yersinia pestis KIM
cugccgccccuucca

SEQ ID NO: 4210218 - RNA, 17 nt, Yersinia pestis KIM
cugccgccccuuccaau

SEQ ID NO: 4210219 - RNA, 17 nt, Yersinia pestis KIM
cugccggcgaagcucuu

SEQ ID NO: 4210220 - RNA, 20 nt, Yersinia pestis KIM
cugccggcguuaaugccacc

SEQ ID NO: 4210221 - RNA, 22 nt, Yersinia pestis KIM
cugccggcguuaaugccacccc

SEQ ID NO: 4210222 - RNA, 18 nt, Yersinia pestis KIM
cugccuauuuaucguuac

SEQ ID NO: 4210223 - RNA, 20 nt, Yersinia pestis KIM
cugccugaacaaucugcucg

SEQ ID NO: 4210224 - RNA, 13 nt, Yersinia pestis KIM
cugccugaguaau

SEQ ID NO: 4210225 - RNA, 14 nt, Yersinia pestis KIM
cugccugccugagg

SEQ ID NO: 4210226 - RNA, 19 nt, Yersinia pestis KIM
cugccugugcggcagugaa

SEQ ID NO: 4210227 - RNA, 15 nt, Yersinia pestis KIM
cugccuuaucaaucu

SEQ ID NO: 4210228 - RNA, 23 nt, Yersinia pestis KIM
cugcgaauuagucucuuauucuc

SEQ ID NO: 4210229 - RNA, 21 nt, Yersinia pestis KIM
cugcgaccaaggcucuggcaa

SEQ ID NO: 4210230 - RNA, 22 nt, Yersinia pestis KIM
cugcgaccaaggcucuggcaau

SEQ ID NO: 4210231 - RNA, 20 nt, Yersinia pestis KIM
cugcgagcguuuaaauaccc

SEQ ID NO: 4210232 - RNA, 12 nt, Yersinia pestis KIM
cugcgauaaucu

SEQ ID NO: 4210233 - RNA, 15 nt, Yersinia pestis KIM
cugcgccaaauguca

SEQ ID NO: 4210234 - RNA, 20 nt, Yersinia pestis KIM
cugcgccacccauugcucaa

SEQ ID NO: 4210235 - RNA, 17 nt, Yersinia pestis KIM
cugcgccacgcuuuagc

SEQ ID NO: 4210236 - RNA, 21 nt, Yersinia pestis KIM
cugcgcuaauacggcuugcaa

SEQ ID NO: 4210237 - RNA, 14 nt, Yersinia pestis KIM
cugcgcuagaccag

SEQ ID NO: 4210238 - RNA, 22 nt, Yersinia pestis KIM
cugcgcugaccuaaaccgcucu

SEQ ID NO: 4210239 - RNA, 14 nt, Yersinia pestis KIM
cugcggauaaacac

SEQ ID NO: 4210240 - RNA, 13 nt, Yersinia pestis KIM
cugcggcaauaag

SEQ ID NO: 4210241 - RNA, 16 nt, Yersinia pestis KIM
cugcgguggccagagc

SEQ ID NO: 4210242 - RNA, 12 nt, Yersinia pestis KIM
cugcguaaacaa

SEQ ID NO: 4210243 - RNA, 17 nt, Yersinia pestis KIM
cugcguacggacgguaa

SEQ ID NO: 4210244 - RNA, 16 nt, Yersinia pestis KIM
cugcgucuuuaucgcc

SEQ ID NO: 4210245 - RNA, 24 nt, Yersinia pestis KIM
cugcuaauacgcuaucaacguagc

SEQ ID NO: 4210246 - RNA, 15 nt, Yersinia pestis KIM
cugcuacauaacgaa

SEQ ID NO: 4210247 - RNA, 22 nt, Yersinia pestis KIM
cugcuaccaggaagcggccagg

SEQ ID NO: 4210248 - RNA, 17 nt, Yersinia pestis KIM
cugcuaguauuaucgcu

SEQ ID NO: 4210249 - RNA, 22 nt, Yersinia pestis KIM
cugcuaucaugauaaauaauaa

SEQ ID NO: 4210250 - RNA, 12 nt, Yersinia pestis KIM
cugcucaacugc

SEQ ID NO: 4210251 - RNA, 15 nt, Yersinia pestis KIM
cugcucaacugcuca

SEQ ID NO: 4210252 - RNA, 20 nt, Yersinia pestis KIM
cugcucaacugcucaacugc

SEQ ID NO: 4210253 - RNA, 17 nt, Yersinia pestis KIM
cugcucacgcaaauaaa

SEQ ID NO: 4210254 - RNA, 23 nt, Yersinia pestis KIM
cugcucacgguagguuucugggc

SEQ ID NO: 4210255 - RNA, 16 nt, Yersinia pestis KIM
cugcucauaagauacc

SEQ ID NO: 4210256 - RNA, 19 nt, Yersinia pestis KIM
cugcuccaaagcuuccaau

SEQ ID NO: 4210257 - RNA, 20 nt, Yersinia pestis KIM
cugcuccccccgugauaugc

SEQ ID NO: 4210258 - RNA, 22 nt, Yersinia pestis KIM
cugcucccguaaacguucugcc

SEQ ID NO: 4210259 - RNA, 19 nt, Yersinia pestis KIM
cugcuccgguaauccuugu

SEQ ID NO: 4210260 - RNA, 13 nt, Yersinia pestis KIM
cugcucgcccaag

SEQ ID NO: 4210261 - RNA, 15 nt, Yersinia pestis KIM
cugcucgcccaagcg

SEQ ID NO: 4210262 - RNA, 19 nt, Yersinia pestis KIM
cugcucggugauaaacuca

SEQ ID NO: 4210263 - RNA, 12 nt, Yersinia pestis KIM
cugcugacaaac

SEQ ID NO: 4210264 - RNA, 15 nt, Yersinia pestis KIM
cugcugacaaacccc

SEQ ID NO: 4210265 - RNA, 19 nt, Yersinia pestis KIM
cugcugacaaaccccgaug

SEQ ID NO: 4210266 - RNA, 11 nt, Yersinia pestis KIM
cugcugacaac

SEQ ID NO: 4210267 - RNA, 19 nt, Yersinia pestis KIM
cugcugcuuggguggucag

SEQ ID NO: 4210268 - RNA, 13 nt, Yersinia pestis KIM
cugcugcuuuagg

SEQ ID NO: 4210269 - RNA, 15 nt, Yersinia pestis KIM
cugcuggcaggguau

SEQ ID NO: 4210270 - RNA, 23 nt, Yersinia pestis KIM
cugcuggugccacuguuuuucca

SEQ ID NO: 4210271 - RNA, 15 nt, Yersinia pestis KIM
cugcugguuuuacug

SEQ ID NO: 4210272 - RNA, 16 nt, Yersinia pestis KIM
cugcugguuuuacuga

SEQ ID NO: 4210273 - RNA, 18 nt, Yersinia pestis KIM
cugcuguggguucaucaa

SEQ ID NO: 4210274 - RNA, 19 nt, Yersinia pestis KIM
cugcuguggguucaucaac

SEQ ID NO: 4210275 - RNA, 20 nt, Yersinia pestis KIM
cugcugugucgcuauuuccg

SEQ ID NO: 4210276 - RNA, 21 nt, Yersinia pestis KIM
cugcugugucgcuauuuccga

SEQ ID NO: 4210277 - RNA, 14 nt, Yersinia pestis KIM
cugcugugugggcg

SEQ ID NO: 4210278 - RNA, 15 nt, Yersinia pestis KIM
cugcuguucuggcag

SEQ ID NO: 4210279 - RNA, 16 nt, Yersinia pestis KIM
cugcuguucuggcagg

SEQ ID NO: 4210280 - RNA, 14 nt, Yersinia pestis KIM
cuguaauaaaggcu

SEQ ID NO: 4210281 - RNA, 13 nt, Yersinia pestis KIM
cuguaaucaccag

SEQ ID NO: 4210282 - RNA, 13 nt, Yersinia pestis KIM
cuguaauccggca

SEQ ID NO: 4210283 - RNA, 19 nt, Yersinia pestis KIM
cuguaaugccccacuucac

SEQ ID NO: 4210284 - RNA, 20 nt, Yersinia pestis KIM
cuguaaugccccacuucacg

SEQ ID NO: 4210285 - RNA, 13 nt, Yersinia pestis KIM
cuguaauuaauua

SEQ ID NO: 4210286 - RNA, 18 nt, Yersinia pestis KIM
cuguaauuaauuauaagc

SEQ ID NO: 4210287 - RNA, 17 nt, Yersinia pestis KIM
cuguacauaaauuugug

SEQ ID NO: 4210288 - RNA, 21 nt, Yersinia pestis KIM
cuguacccccguaucaacgau

SEQ ID NO: 4210289 - RNA, 18 nt, Yersinia pestis KIM
cuguacccguucaaugug

SEQ ID NO: 4210290 - RNA, 19 nt, Yersinia pestis KIM
cuguacugcugcaacucau

SEQ ID NO: 4210291 - RNA, 20 nt, Yersinia pestis KIM
cuguacugcugcaacucauu

SEQ ID NO: 4210292 - RNA, 23 nt, Yersinia pestis KIM
cuguacugcugcaacucauuaac

SEQ ID NO: 4210293 - RNA, 16 nt, Yersinia pestis KIM
cuguacugggaugaag

SEQ ID NO: 4210294 - RNA, 14 nt, Yersinia pestis KIM
cuguagaacaccug

SEQ ID NO: 4210295 - RNA, 19 nt, Yersinia pestis KIM
cuguagaacuuguucauau

SEQ ID NO: 4210296 - RNA, 23 nt, Yersinia pestis KIM
cuguagaagugcaggcuaccaga

SEQ ID NO: 4210297 - RNA, 15 nt, Yersinia pestis KIM
cuguagcucauacuc

SEQ ID NO: 4210298 - RNA, 14 nt, Yersinia pestis KIM
cuguagcuuuuuaa

SEQ ID NO: 4210299 - RNA, 17 nt, Yersinia pestis KIM
cuguagcuuuuuaaaua

SEQ ID NO: 4210300 - RNA, 13 nt, Yersinia pestis KIM
cuguaguucauca

SEQ ID NO: 4210301 - RNA, 20 nt, Yersinia pestis KIM
cuguauaaaaauagccuucc

SEQ ID NO: 4210302 - RNA, 14 nt, Yersinia pestis KIM
cuguauaaaagaau

SEQ ID NO: 4210303 - RNA, 10 nt, Yersinia pestis KIM
cuguaugccu

SEQ ID NO: 4210304 - RNA, 21 nt, Yersinia pestis KIM
cuguauugauacuccguuggc

SEQ ID NO: 4210305 - RNA, 16 nt, Yersinia pestis KIM
cugucaaucgaugagc

SEQ ID NO: 4210306 - RNA, 17 nt, Yersinia pestis KIM
cugucagucaaaagaaa

SEQ ID NO: 4210307 - RNA, 18 nt, Yersinia pestis KIM
cuguccaagaagccaaga

SEQ ID NO: 4210308 - RNA, 17 nt, Yersinia pestis KIM
cuguccaguugcuggaa

SEQ ID NO: 4210309 - RNA, 19 nt, Yersinia pestis KIM
cugucgauaauaaauugcg

SEQ ID NO: 4210310 - RNA, 18 nt, Yersinia pestis KIM
cugucggaagagauagag

SEQ ID NO: 4210311 - RNA, 18 nt, Yersinia pestis KIM
cugucggcgaugaaaaac

SEQ ID NO: 4210312 - RNA, 15 nt, Yersinia pestis KIM
cugucggcgcagcaa

SEQ ID NO: 4210313 - RNA, 21 nt, Yersinia pestis KIM
cugucgggaacacuuugcgcu

SEQ ID NO: 4210314 - RNA, 20 nt, Yersinia pestis KIM
cugucuaaauugcuuaaaaa

SEQ ID NO: 4210315 - RNA, 16 nt, Yersinia pestis KIM
cugucugcuguugcca

SEQ ID NO: 4210316 - RNA, 17 nt, Yersinia pestis KIM
cugucugcuguugccac

SEQ ID NO: 4210317 - RNA, 16 nt, Yersinia pestis KIM
cugucuggguggcuga

SEQ ID NO: 4210318 - RNA, 21 nt, Yersinia pestis KIM
cugucuuaggugacaggcaaa

SEQ ID NO: 4210319 - RNA, 13 nt, Yersinia pestis KIM
cugucuuauuuuu

SEQ ID NO: 4210320 - RNA, 17 nt, Yersinia pestis KIM
cugucuuuuaaugaugc

SEQ ID NO: 4210321 - RNA, 22 nt, Yersinia pestis KIM
cugugaauuuaucaggcuaaua

SEQ ID NO: 4210322 - RNA, 12 nt, Yersinia pestis KIM
cugugauaacca

SEQ ID NO: 4210323 - RNA, 21 nt, Yersinia pestis KIM
cugugauaaccaacaguuauu

SEQ ID NO: 4210324 - RNA, 23 nt, Yersinia pestis KIM
cugugauaaccaacaguuauuuu

SEQ ID NO: 4210325 - RNA, 17 nt, Yersinia pestis KIM
cugugaucgcugccgca

SEQ ID NO: 4210326 - RNA, 17 nt, Yersinia pestis KIM
cugugauuucagccagg

SEQ ID NO: 4210327 - RNA, 20 nt, Yersinia pestis KIM
cugugauuucagccaggcga

SEQ ID NO: 4210328 - RNA, 23 nt, Yersinia pestis KIM
cugugccugcagguaagaaggca

SEQ ID NO: 4210329 - RNA, 21 nt, Yersinia pestis KIM
cugugcgauuucacggauauc

SEQ ID NO: 4210330 - RNA, 19 nt, Yersinia pestis KIM
cugugcgcggcuagccacc

SEQ ID NO: 4210331 - RNA, 14 nt, Yersinia pestis KIM
cugugcggcaguga

SEQ ID NO: 4210332 - RNA, 21 nt, Yersinia pestis KIM
cugugcggcagugaaccugaa

SEQ ID NO: 4210333 - RNA, 19 nt, Yersinia pestis KIM
cugugcggcagugaacguu

SEQ ID NO: 4210334 - RNA, 20 nt, Yersinia pestis KIM
cugugcggcagugaacuuaa

SEQ ID NO: 4210335 - RNA, 14 nt, Yersinia pestis KIM
cugugcuuugccau

SEQ ID NO: 4210336 - RNA, 15 nt, Yersinia pestis KIM
cuguggcaugacuga

SEQ ID NO: 4210337 - RNA, 14 nt, Yersinia pestis KIM
cugugguuggcagc

SEQ ID NO: 4210338 - RNA, 18 nt, Yersinia pestis KIM
cugugguuggcagcucag

SEQ ID NO: 4210339 - RNA, 20 nt, Yersinia pestis KIM
cugugguuggcagcucagca

SEQ ID NO: 4210340 - RNA, 21 nt, Yersinia pestis KIM
cuguguaacugccaccguauu

SEQ ID NO: 4210341 - RNA, 14 nt, Yersinia pestis KIM
cuguguauuuaacc

SEQ ID NO: 4210342 - RNA, 17 nt, Yersinia pestis KIM
cugugucgcuauuuccg

SEQ ID NO: 4210343 - RNA, 15 nt, Yersinia pestis KIM
cugugugauguguac

SEQ ID NO: 4210344 - RNA, 23 nt, Yersinia pestis KIM
cugugugggcacucgcaagacga

SEQ ID NO: 4210345 - RNA, 13 nt, Yersinia pestis KIM
cuguguuuauacc

SEQ ID NO: 4210346 - RNA, 19 nt, Yersinia pestis KIM
cuguguuuugagcaucacu

SEQ ID NO: 4210347 - RNA, 20 nt, Yersinia pestis KIM
cuguguuuugagcaucacuu

SEQ ID NO: 4210348 - RNA, 21 nt, Yersinia pestis KIM
cuguguuuugcuaaccgccuu

SEQ ID NO: 4210349 - RNA, 21 nt, Yersinia pestis KIM
cuguuaacuaacgucccauuc

SEQ ID NO: 4210350 - RNA, 15 nt, Yersinia pestis KIM
cuguuaccaaacauu

SEQ ID NO: 4210351 - RNA, 16 nt, Yersinia pestis KIM
cuguuaccaaacauuu

SEQ ID NO: 4210352 - RNA, 13 nt, Yersinia pestis KIM
cuguuaccaaugg

SEQ ID NO: 4210353 - RNA, 20 nt, Yersinia pestis KIM
cuguuacgguauuugaacuu

SEQ ID NO: 4210354 - RNA, 15 nt, Yersinia pestis KIM
cuguuaguucagacg

SEQ ID NO: 4210355 - RNA, 13 nt, Yersinia pestis KIM
cuguucaccgauu

SEQ ID NO: 4210356 - RNA, 14 nt, Yersinia pestis KIM
cuguucagaugauc

SEQ ID NO: 4210357 - RNA, 15 nt, Yersinia pestis KIM
cuguucagauuuacc

SEQ ID NO: 4210358 - RNA, 12 nt, Yersinia pestis KIM
cuguuccaggca

SEQ ID NO: 4210359 - RNA, 16 nt, Yersinia pestis KIM
cuguucucucccguug

SEQ ID NO: 4210360 - RNA, 12 nt, Yersinia pestis KIM
cuguucucuccg

SEQ ID NO: 4210361 - RNA, 16 nt, Yersinia pestis KIM
cuguucucuguuucca

SEQ ID NO: 4210362 - RNA, 13 nt, Yersinia pestis KIM
cuguucuggcagg

SEQ ID NO: 4210363 - RNA, 19 nt, Yersinia pestis KIM
cuguucuuggaacaggcca

SEQ ID NO: 4210364 - RNA, 17 nt, Yersinia pestis KIM
cuguucuuuuggcgauc

SEQ ID NO: 4210365 - RNA, 23 nt, Yersinia pestis KIM
cuguugagguacggcucuauuuc

SEQ ID NO: 4210366 - RNA, 15 nt, Yersinia pestis KIM
cuguugaucugaguu

SEQ ID NO: 4210367 - RNA, 15 nt, Yersinia pestis KIM
cuguugaugaguaaa

SEQ ID NO: 4210368 - RNA, 11 nt, Yersinia pestis KIM
cuguugccccc

SEQ ID NO: 4210369 - RNA, 12 nt, Yersinia pestis KIM
cuguugcuucac

SEQ ID NO: 4210370 - RNA, 21 nt, Yersinia pestis KIM
cuguuggcgggauccaucuga

SEQ ID NO: 4210371 - RNA, 20 nt, Yersinia pestis KIM
cuguuggugauauaaaucca

SEQ ID NO: 4210372 - RNA, 18 nt, Yersinia pestis KIM
cuguuuaccuaucucagu

SEQ ID NO: 4210373 - RNA, 21 nt, Yersinia pestis KIM
cuguuuaguucacgauggaaa

SEQ ID NO: 4210374 - RNA, 14 nt, Yersinia pestis KIM
cuguuucaaauaag

SEQ ID NO: 4210375 - RNA, 22 nt, Yersinia pestis KIM
cuguuucaaauaaguauuucaa

SEQ ID NO: 4210376 - RNA, 16 nt, Yersinia pestis KIM
cuguuugcaacauuau

SEQ ID NO: 4210377 - RNA, 14 nt, Yersinia pestis KIM
cuguuugcaccuuu

SEQ ID NO: 4210378 - RNA, 16 nt, Yersinia pestis KIM
cuguuugcuguaaaca

SEQ ID NO: 4210379 - RNA, 22 nt, Yersinia pestis KIM
cuguuuuaaaaaaaaagaaaau

SEQ ID NO: 4210380 - RNA, 16 nt, Yersinia pestis KIM
cuguuuucauuauuuu

SEQ ID NO: 4210381 - RNA, 23 nt, Yersinia pestis KIM
cuguuuugucauaaagcccauac

SEQ ID NO: 4210382 - RNA, 18 nt, Yersinia pestis KIM
cuguuuuucauuuacuug

SEQ ID NO: 4210383 - RNA, 16 nt, Yersinia pestis KIM
cuguuuuugaagauuc

SEQ ID NO: 4210384 - RNA, 13 nt, Yersinia pestis KIM
cuuaaaaaaagca

SEQ ID NO: 4210385 - RNA, 15 nt, Yersinia pestis KIM
cuuaaaaaacgauua

SEQ ID NO: 4210386 - RNA, 16 nt, Yersinia pestis KIM
cuuaaaaaucaaaagu

SEQ ID NO: 4210387 - RNA, 17 nt, Yersinia pestis KIM
cuuaaaauacugccaau

SEQ ID NO: 4210388 - RNA, 17 nt, Yersinia pestis KIM
cuuaaaauauggcaggu

SEQ ID NO: 4210389 - RNA, 20 nt, Yersinia pestis KIM
cuuaaaaucuguaauuaauu

SEQ ID NO: 4210390 - RNA, 15 nt, Yersinia pestis KIM
cuuaaagcccagguu

SEQ ID NO: 4210391 - RNA, 15 nt, Yersinia pestis KIM
cuuaaauaauuuucu

SEQ ID NO: 4210392 - RNA, 14 nt, Yersinia pestis KIM
cuuaaauaguucuu

SEQ ID NO: 4210393 - RNA, 16 nt, Yersinia pestis KIM
cuuaacaaucagugca

SEQ ID NO: 4210394 - RNA, 21 nt, Yersinia pestis KIM
cuuaacacgaaccuucucugc

SEQ ID NO: 4210395 - RNA, 15 nt, Yersinia pestis KIM
cuuccaaaggaaggg

SEQ ID NO: 4210396 - RNA, 19 nt, Yersinia pestis KIM
cuuccaacgcuucaccauu

SEQ ID NO: 4210397 - RNA, 16 nt, Yersinia pestis KIM
cuuccaacucaccuaa

SEQ ID NO: 4210398 - RNA, 15 nt, Yersinia pestis KIM
cuuccaacuugccgc

SEQ ID NO: 4210399 - RNA, 14 nt, Yersinia pestis KIM
cuuccaauagcagu

SEQ ID NO: 4210400 - RNA, 14 nt, Yersinia pestis KIM
cuuccaauucauaa

SEQ ID NO: 4210401 - RNA, 22 nt, Yersinia pestis KIM
cuuccaauuggugcuuuaugua

SEQ ID NO: 4210402 - RNA, 23 nt, Yersinia pestis KIM
cuuccacacaaacgcauucauau

SEQ ID NO: 4210403 - RNA, 23 nt, Yersinia pestis KIM
cuuccagcgcccggcugaccugu

SEQ ID NO: 4210404 - RNA, 22 nt, Yersinia pestis KIM
cuuccaguggcucgacggccaa

SEQ ID NO: 4210405 - RNA, 23 nt, Yersinia pestis KIM
cuuccauaaacggaacucaucuu

SEQ ID NO: 4210406 - RNA, 10 nt, Yersinia pestis KIM
cuuccaucag

SEQ ID NO: 4210407 - RNA, 13 nt, Yersinia pestis KIM
cuuccaucaggaa

SEQ ID NO: 4210408 - RNA, 23 nt, Yersinia pestis KIM
cuuccaugacacauauuucaggc

SEQ ID NO: 4210409 - RNA, 13 nt, Yersinia pestis KIM
cuuccauuaccug

SEQ ID NO: 4210410 - RNA, 22 nt, Yersinia pestis KIM
cuuccauugauggccuugaauc

SEQ ID NO: 4210411 - RNA, 14 nt, Yersinia pestis KIM
cuuccauuucugcc

SEQ ID NO: 4210412 - RNA, 20 nt, Yersinia pestis KIM
cuucccauagacggcgaacu

SEQ ID NO: 4210413 - RNA, 12 nt, Yersinia pestis KIM
cuucccauccua

SEQ ID NO: 4210414 - RNA, 20 nt, Yersinia pestis KIM
cuucccccaaguaaaaaaaa

SEQ ID NO: 4210415 - RNA, 22 nt, Yersinia pestis KIM
cuucccccaaguaaaaaaaacc

SEQ ID NO: 4210416 - RNA, 19 nt, Yersinia pestis KIM
cuucccgaguaauaccaaa

SEQ ID NO: 4210417 - RNA, 13 nt, Yersinia pestis KIM
cuuccgccagcag

SEQ ID NO: 4210418 - RNA, 13 nt, Yersinia pestis KIM
cuuccgccgccaa

SEQ ID NO: 4210419 - RNA, 22 nt, Yersinia pestis KIM
cuuccgccucuuuuuccacacc

SEQ ID NO: 4210420 - RNA, 23 nt, Yersinia pestis KIM
cuuccgccucuuuuuccacaccc

SEQ ID NO: 4210421 - RNA, 16 nt, Yersinia pestis KIM
cuuccggcguaccaca

SEQ ID NO: 4210422 - RNA, 13 nt, Yersinia pestis KIM
cuuccgguuguuc

SEQ ID NO: 4210423 - RNA, 19 nt, Yersinia pestis KIM
cuuccuugauuuucauuuc

SEQ ID NO: 4210424 - RNA, 20 nt, Yersinia pestis KIM
cuuccuugauuuucauuuca

SEQ ID NO: 4210425 - RNA, 19 nt, Yersinia pestis KIM
cuuccuuugcccuuacuau

SEQ ID NO: 4210426 - RNA, 16 nt, Yersinia pestis KIM
cuucgaaagaaauaaa

SEQ ID NO: 4210427 - RNA, 16 nt, Yersinia pestis KIM
cuucgacuaaauggcu

SEQ ID NO: 4210428 - RNA, 22 nt, Yersinia pestis KIM
cuucgagcaggcuuugugccaa

SEQ ID NO: 4210429 - RNA, 16 nt, Yersinia pestis KIM
cuucgcaaaauuuaua

SEQ ID NO: 4210430 - RNA, 22 nt, Yersinia pestis KIM
cuucgcaaugauuacaucacuu

SEQ ID NO: 4210431 - RNA, 20 nt, Yersinia pestis KIM
cuucgccaaucucaaagcaa

SEQ ID NO: 4210432 - RNA, 22 nt, Yersinia pestis KIM
cuucgccauagguacuuuguca

SEQ ID NO: 4210433 - RNA, 19 nt, Yersinia pestis KIM
cuucgcccuguaaagccag

SEQ ID NO: 4210434 - RNA, 17 nt, Yersinia pestis KIM
cuucgcgaacacaauug

SEQ ID NO: 4210435 - RNA, 20 nt, Yersinia pestis KIM
cuucgcgagucacauuuuua

SEQ ID NO: 4210436 - RNA, 13 nt, Yersinia pestis KIM
cuucgcgaucaug

SEQ ID NO: 4210437 - RNA, 15 nt, Yersinia pestis KIM
cuucgcgaucauggu

SEQ ID NO: 4210438 - RNA, 20 nt, Yersinia pestis KIM
cuucgcggugauuccaauga

SEQ ID NO: 4210439 - RNA, 14 nt, Yersinia pestis KIM
cuucgcucacaacc

SEQ ID NO: 4210440 - RNA, 18 nt, Yersinia pestis KIM
cuucgcuccggucaacgu

SEQ ID NO: 4210441 - RNA, 14 nt, Yersinia pestis KIM
cuucgcugacauuu

SEQ ID NO: 4210442 - RNA, 15 nt, Yersinia pestis KIM
cuucgcuggccgcaa

SEQ ID NO: 4210443 - RNA, 19 nt, Yersinia pestis KIM
cuucgcuuucaucuucuuc

SEQ ID NO: 4210444 - RNA, 15 nt, Yersinia pestis KIM
cuucggacgcuccuc

SEQ ID NO: 4210445 - RNA, 21 nt, Yersinia pestis KIM
cuucgggauagggaaaaguua

SEQ ID NO: 4210446 - RNA, 17 nt, Yersinia pestis KIM
cuucguagggcacuuuc

SEQ ID NO: 4210447 - RNA, 14 nt, Yersinia pestis KIM
cuucuaacacuuca

SEQ ID NO: 4210448 - RNA, 18 nt, Yersinia pestis KIM
cuucuaccguaucagccc

SEQ ID NO: 4210449 - RNA, 19 nt, Yersinia pestis KIM
cuucuaggugcucugccuu

SEQ ID NO: 4210450 - RNA, 14 nt, Yersinia pestis KIM
cuucuauuacccuu

SEQ ID NO: 4210451 - RNA, 18 nt, Yersinia pestis KIM
cuucuccuuucuguucca

SEQ ID NO: 4210452 - RNA, 21 nt, Yersinia pestis KIM
cuucucgaugccuucuuucaa

SEQ ID NO: 4210453 - RNA, 16 nt, Yersinia pestis KIM
cuucucguaauuauug

SEQ ID NO: 4210454 - RNA, 16 nt, Yersinia pestis KIM
cuucucguauccccug

SEQ ID NO: 4210455 - RNA, 16 nt, Yersinia pestis KIM
cuucucgugucacagu

SEQ ID NO: 4210456 - RNA, 19 nt, Yersinia pestis KIM
cuucugaaacuucaaaauc

SEQ ID NO: 4210457 - RNA, 17 nt, Yersinia pestis KIM
cuucugaacgaccagaa

SEQ ID NO: 4210458 - RNA, 16 nt, Yersinia pestis KIM
cuucuguaccacugau

SEQ ID NO: 4210459 - RNA, 18 nt, Yersinia pestis KIM
cuucuguauaugaagaua

SEQ ID NO: 4210460 - RNA, 22 nt, Yersinia pestis KIM
cuucugucggagccugauacac

SEQ ID NO: 4210461 - RNA, 19 nt, Yersinia pestis KIM
cuucuguugcccccugcuc

SEQ ID NO: 4210462 - RNA, 20 nt, Yersinia pestis KIM
cuucuuaauucccagccacu

SEQ ID NO: 4210463 - RNA, 13 nt, Yersinia pestis KIM
cuucuuaucuuuu

SEQ ID NO: 4210464 - RNA, 16 nt, Yersinia pestis KIM
cuucuuaucuuuucug

SEQ ID NO: 4210465 - RNA, 18 nt, Yersinia pestis KIM
cuucuucaaugaccggau

SEQ ID NO: 4210466 - RNA, 15 nt, Yersinia pestis KIM
cuucuuggguggcaa

SEQ ID NO: 4210467 - RNA, 22 nt, Yersinia pestis KIM
cuucuuguggcaguucacccaa

SEQ ID NO: 4210468 - RNA, 16 nt, Yersinia pestis KIM
cuucuuuauuguuuug

SEQ ID NO: 4210469 - RNA, 20 nt, Yersinia pestis KIM
cuugaaacaacccaaagggg

SEQ ID NO: 4210470 - RNA, 14 nt, Yersinia pestis KIM
cuugaaccaauuuu

SEQ ID NO: 4210471 - RNA, 16 nt, Yersinia pestis KIM
cuugaaccaauuuuuc

SEQ ID NO: 4210472 - RNA, 22 nt, Yersinia pestis KIM
cuugaagugcgaagcgcaccca

SEQ ID NO: 4210473 - RNA, 13 nt, Yersinia pestis KIM
cuugaccaaccug

SEQ ID NO: 4210474 - RNA, 15 nt, Yersinia pestis KIM
cuugaccaaccuguu

SEQ ID NO: 4210475 - RNA, 16 nt, Yersinia pestis KIM
cuugaccuucccucuu

SEQ ID NO: 4210476 - RNA, 16 nt, Yersinia pestis KIM
cuugacuaacacgacu

SEQ ID NO: 4210477 - RNA, 15 nt, Yersinia pestis KIM
cuugacucuucagcg

SEQ ID NO: 4210478 - RNA, 14 nt, Yersinia pestis KIM
cuugacugaccaua

SEQ ID NO: 4210479 - RNA, 21 nt, Yersinia pestis KIM
cuugacugaccauaaaaggau

SEQ ID NO: 4210480 - RNA, 16 nt, Yersinia pestis KIM
cuugacugcguucugc

SEQ ID NO: 4210481 - RNA, 14 nt, Yersinia pestis KIM
cuugagauccucca

SEQ ID NO: 4210482 - RNA, 20 nt, Yersinia pestis KIM
cuugagauccuccauauccu

SEQ ID NO: 4210483 - RNA, 17 nt, Yersinia pestis KIM
cuugagcuagauggaaa

SEQ ID NO: 4210484 - RNA, 18 nt, Yersinia pestis KIM
cuugaguccaaccaccaa

SEQ ID NO: 4210485 - RNA, 21 nt, Yersinia pestis KIM
cuugauagggcugaagaccca

SEQ ID NO: 4210486 - RNA, 13 nt, Yersinia pestis KIM
cuugaucaacuca

SEQ ID NO: 4210487 - RNA, 19 nt, Yersinia pestis KIM
cuugaucgcauccucaaca

SEQ ID NO: 4210488 - RNA, 21 nt, Yersinia pestis KIM
cuugaucggauaguuaucugg

SEQ ID NO: 4210489 - RNA, 19 nt, Yersinia pestis KIM
cuugaugaaagcuauuuuu

SEQ ID NO: 4210490 - RNA, 19 nt, Yersinia pestis KIM
cuugauggaaauacgcuua

SEQ ID NO: 4210491 - RNA, 13 nt, Yersinia pestis KIM
cuugauggcauca

SEQ ID NO: 4210492 - RNA, 10 nt, Yersinia pestis KIM
cuugauggcu

SEQ ID NO: 4210493 - RNA, 21 nt, Yersinia pestis KIM
cuugauucguuuucggugcau

SEQ ID NO: 4210494 - RNA, 13 nt, Yersinia pestis KIM
cuugauucucaaa

SEQ ID NO: 4210495 - RNA, 18 nt, Yersinia pestis KIM
cuugcaacaaaauggccu

SEQ ID NO: 4210496 - RNA, 23 nt, Yersinia pestis KIM
cuugcaacaacucgaacaaccgg

SEQ ID NO: 4210497 - RNA, 15 nt, Yersinia pestis KIM
cuugcaacauuaucc

SEQ ID NO: 4210498 - RNA, 20 nt, Yersinia pestis KIM
cuugcaauucauguugccaa

SEQ ID NO: 4210499 - RNA, 21 nt, Yersinia pestis KIM
cuugcagcgaucacagauaaa

SEQ ID NO: 4210500 - RNA, 17 nt, Yersinia pestis KIM
cuugcagcgucaugguc

SEQ ID NO: 4210501 - RNA, 19 nt, Yersinia pestis KIM
cuugccacgccaguaaaca

SEQ ID NO: 4210502 - RNA, 21 nt, Yersinia pestis KIM
cuugccacgccaguaaacagc

SEQ ID NO: 4210503 - RNA, 18 nt, Yersinia pestis KIM
cuugccauaagugaacau

SEQ ID NO: 4210504 - RNA, 22 nt, Yersinia pestis KIM
cuugcccaccgacgccacacca

SEQ ID NO: 4210505 - RNA, 17 nt, Yersinia pestis KIM
cuugcccuuuuuugugu

SEQ ID NO: 4210506 - RNA, 16 nt, Yersinia pestis KIM
cuugccugacagccug

SEQ ID NO: 4210507 - RNA, 21 nt, Yersinia pestis KIM
cuugcgccgaaauaaaaccau

SEQ ID NO: 4210508 - RNA, 15 nt, Yersinia pestis KIM
cuugcgcgaaauauu

SEQ ID NO: 4210509 - RNA, 17 nt, Yersinia pestis KIM
cuuugaugccuaauaau

SEQ ID NO: 4210510 - RNA, 23 nt, Yersinia pestis KIM
cuuugauuugaacgacaugugag

SEQ ID NO: 4210511 - RNA, 14 nt, Yersinia pestis KIM
cuuugcauuuucug

SEQ ID NO: 4210512 - RNA, 15 nt, Yersinia pestis KIM
cuuugcauuuucugg

SEQ ID NO: 4210513 - RNA, 21 nt, Yersinia pestis KIM
cuuugcauuuucuggugagca

SEQ ID NO: 4210514 - RNA, 18 nt, Yersinia pestis KIM
cuuugcccuuacuauuuu

SEQ ID NO: 4210515 - RNA, 17 nt, Yersinia pestis KIM
cuuugcgcugauaacuu

SEQ ID NO: 4210516 - RNA, 12 nt, Yersinia pestis KIM
cuuugcuaguga

SEQ ID NO: 4210517 - RNA, 16 nt, Yersinia pestis KIM
cuuugcuuuucugccu

SEQ ID NO: 4210518 - RNA, 17 nt, Yersinia pestis KIM
cuuugcuuuucugccua

SEQ ID NO: 4210519 - RNA, 21 nt, Yersinia pestis KIM
cuuuggcaaauuuagccgcaa

SEQ ID NO: 4210520 - RNA, 17 nt, Yersinia pestis KIM
cuuuggcaaucacaacc

SEQ ID NO: 4210521 - RNA, 13 nt, Yersinia pestis KIM
cuuuggcaucaau

SEQ ID NO: 4210522 - RNA, 15 nt, Yersinia pestis KIM
cuuuggugaucauga

SEQ ID NO: 4210523 - RNA, 17 nt, Yersinia pestis KIM
cuuuguauuuugcacaa

SEQ ID NO: 4210524 - RNA, 20 nt, Yersinia pestis KIM
cuuugucaauaaccucagcc

SEQ ID NO: 4210525 - RNA, 21 nt, Yersinia pestis KIM
cuuugucaauaaccucagccu

SEQ ID NO: 4210526 - RNA, 22 nt, Yersinia pestis KIM
cuuuuacaaauuugacauuucc

SEQ ID NO: 4210527 - RNA, 16 nt, Yersinia pestis KIM
cuuuuaccgcaaccac

SEQ ID NO: 4210528 - RNA, 14 nt, Yersinia pestis KIM
cuuuuacggacugc

SEQ ID NO: 4210529 - RNA, 19 nt, Yersinia pestis KIM
cuuuuacgggccuuuuaau

SEQ ID NO: 4210530 - RNA, 22 nt, Yersinia pestis KIM
cuuuuauuggcauuaaacugaa

SEQ ID NO: 4210531 - RNA, 21 nt, Yersinia pestis KIM
cuuuuauugucuuuaauaaaa

SEQ ID NO: 4210532 - RNA, 13 nt, Yersinia pestis KIM
cuuuuauuuuuua

SEQ ID NO: 4210533 - RNA, 20 nt, Yersinia pestis KIM
cuuuucacuccggcaucauc

SEQ ID NO: 4210534 - RNA, 19 nt, Yersinia pestis KIM
cuuuucaguuuuaauuuau

SEQ ID NO: 4210535 - RNA, 20 nt, Yersinia pestis KIM
cuuuucaucgcauaggccaa

SEQ ID NO: 4210536 - RNA, 17 nt, Yersinia pestis KIM
cuuuucauuuccucugg

SEQ ID NO: 4210537 - RNA, 18 nt, Yersinia pestis KIM
cuuuuccgccaugagaac

SEQ ID NO: 4210538 - RNA, 18 nt, Yersinia pestis KIM
cuuuuccuccguuuuuuc

SEQ ID NO: 4210539 - RNA, 15 nt, Yersinia pestis KIM
cuuuucugauuuuuu

SEQ ID NO: 4210540 - RNA, 13 nt, Yersinia pestis KIM
cuuuucugccuau

SEQ ID NO: 4210541 - RNA, 15 nt, Yersinia pestis KIM
cuuuucugccuaucu

SEQ ID NO: 4210542 - RNA, 21 nt, Yersinia pestis KIM
cuuuucugccuaucuuaaaaa

SEQ ID NO: 4210543 - RNA, 15 nt, Yersinia pestis KIM
cuuuucuucauugcu

SEQ ID NO: 4210544 - RNA, 22 nt, Yersinia pestis KIM
cuuuucuuuaugucuuuuucuu

SEQ ID NO: 4210545 - RNA, 16 nt, Yersinia pestis KIM
cuuuucuuuuuuugug

SEQ ID NO: 4210546 - RNA, 20 nt, Yersinia pestis KIM
cuuuucuuuuuuuguguauc

SEQ ID NO: 4210547 - RNA, 21 nt, Yersinia pestis KIM
cuuuugacuggucacucgaug

SEQ ID NO: 4210548 - RNA, 17 nt, Yersinia pestis KIM
cuuuugauuuguuaaaa

SEQ ID NO: 4210549 - RNA, 22 nt, Yersinia pestis KIM
cuuuugcuguucacgaucucua

SEQ ID NO: 4210550 - RNA, 16 nt, Yersinia pestis KIM
cuuuuggcagcaccag

SEQ ID NO: 4210551 - RNA, 14 nt, Yersinia pestis KIM
cuuuuguuaauuca

SEQ ID NO: 4210552 - RNA, 13 nt, Yersinia pestis KIM
cuuuuuaaauacc

SEQ ID NO: 4210553 - RNA, 14 nt, Yersinia pestis KIM
cuuuuuaauuuaua

SEQ ID NO: 4210554 - RNA, 16 nt, Yersinia pestis KIM
cuuuuuacgccuaucc

SEQ ID NO: 4210555 - RNA, 13 nt, Yersinia pestis KIM
cuuuuuauuuaag

SEQ ID NO: 4210556 - RNA, 13 nt, Yersinia pestis KIM
cuuuuuauuucuu

SEQ ID NO: 4210557 - RNA, 15 nt, Yersinia pestis KIM
cuuuuuccacacccu

SEQ ID NO: 4210558 - RNA, 17 nt, Yersinia pestis KIM
cuuuuuccuuauuucuu

SEQ ID NO: 4210559 - RNA, 10 nt, Yersinia pestis KIM
cuuuuugcuu

SEQ ID NO: 4210560 - RNA, 17 nt, Yersinia pestis KIM
cuuuuuggcaaacucag

SEQ ID NO: 4210561 - RNA, 20 nt, Yersinia pestis KIM
cuuuuugguugaacauuucc

SEQ ID NO: 4210562 - RNA, 20 nt, Yersinia pestis KIM
cuuuuuuaacguccauuggc

SEQ ID NO: 4210563 - RNA, 21 nt, Yersinia pestis KIM
cuuuuuuaacguccauuggcg

SEQ ID NO: 4210564 - RNA, 14 nt, Yersinia pestis KIM
cuuuuuuauaauaa

SEQ ID NO: 4210565 - RNA, 17 nt, Yersinia pestis KIM
cuuuuuuguugccacuc

SEQ ID NO: 4210566 - RNA, 18 nt, Yersinia pestis KIM
cuuuuuuguuguuuuuuu

SEQ ID NO: 4210567 - RNA, 12 nt, Yersinia pestis KIM
cuuuuuuguuuu

SEQ ID NO: 4210568 - RNA, 20 nt, Yersinia pestis KIM
cuuuuuuuauggugugggcg

SEQ ID NO: 4210569 - RNA, 12 nt, Yersinia pestis KIM
cuuuuuuugugu

SEQ ID NO: 4210570 - RNA, 15 nt, Yersinia pestis KIM
gaaaaaacaucacac

SEQ ID NO: 4210571 - RNA, 14 nt, Yersinia pestis KIM
gaaaaaacguuacu

SEQ ID NO: 4210572 - RNA, 21 nt, Yersinia pestis KIM
gaaaaaaggauuuuauuaaau

SEQ ID NO: 4210573 - RNA, 18 nt, Yersinia pestis KIM
gaaaaaauaauggccaag

SEQ ID NO: 4210574 - RNA, 13 nt, Yersinia pestis KIM
gaaaaaauaaugu

SEQ ID NO: 4210575 - RNA, 14 nt, Yersinia pestis KIM
gaaaaaauaauguc

SEQ ID NO: 4210576 - RNA, 16 nt, Yersinia pestis KIM
gaaaaaaucuuccuuu

SEQ ID NO: 4210577 - RNA, 20 nt, Yersinia pestis KIM
gaaaaacgugaauauccugg

SEQ ID NO: 4210578 - RNA, 18 nt, Yersinia pestis KIM
gaaaaaggccgacugaga

SEQ ID NO: 4210579 - RNA, 22 nt, Yersinia pestis KIM
gaaaaagggccaugccuguuga

SEQ ID NO: 4210580 - RNA, 15 nt, Yersinia pestis KIM
gaaaaauacaaauau

SEQ ID NO: 4210581 - RNA, 17 nt, Yersinia pestis KIM
gaaaaaucacauacugg

SEQ ID NO: 4210582 - RNA, 17 nt, Yersinia pestis KIM
gaaaaaugagcaauuca

SEQ ID NO: 4210583 - RNA, 17 nt, Yersinia pestis KIM
gaaaaauuucacuggca

SEQ ID NO: 4210584 - RNA, 14 nt, Yersinia pestis KIM
gaaaacaagccagc

SEQ ID NO: 4210585 - RNA, 21 nt, Yersinia pestis KIM
gaaaacaaguuucacuuucaa

SEQ ID NO: 4210586 - RNA, 22 nt, Yersinia pestis KIM
gaaaacaaguuucacuuucaac

SEQ ID NO: 4210587 - RNA, 16 nt, Yersinia pestis KIM
gaaaacagcaacacca

SEQ ID NO: 4210588 - RNA, 15 nt, Yersinia pestis KIM
gaaaacagguaaugc

SEQ ID NO: 4210589 - RNA, 21 nt, Yersinia pestis KIM
gaaaacauuaaggcgauauua

SEQ ID NO: 4210590 - RNA, 23 nt, Yersinia pestis KIM
gaaaaccaauucaguuuuucccg

SEQ ID NO: 4210591 - RNA, 20 nt, Yersinia pestis KIM
gaaaacccuguugcaccagg

SEQ ID NO: 4210592 - RNA, 14 nt, Yersinia pestis KIM
gaaaaccuaauacu

SEQ ID NO: 4210593 - RNA, 18 nt, Yersinia pestis KIM
gaaaaccuucagcaaaga

SEQ ID NO: 4210594 - RNA, 19 nt, Yersinia pestis KIM
gaaaaccuucagcaaagag

SEQ ID NO: 4210595 - RNA, 15 nt, Yersinia pestis KIM
gaaaacgccagcaga

SEQ ID NO: 4210596 - RNA, 24 nt, Yersinia pestis KIM
gaaaacguuaacugcaguaaaaau

SEQ ID NO: 4210597 - RNA, 12 nt, Yersinia pestis KIM
gaaaagaggggc

SEQ ID NO: 4210598 - RNA, 13 nt, Yersinia pestis KIM
gaaaagcagacuu

SEQ ID NO: 4210599 - RNA, 13 nt, Yersinia pestis KIM
gaaaagcagcagu

SEQ ID NO: 4210600 - RNA, 20 nt, Yersinia pestis KIM
gaaaagcagucgacagugua

SEQ ID NO: 4210601 - RNA, 16 nt, Yersinia pestis KIM
gaaaagguaaacagac

SEQ ID NO: 4210602 - RNA, 14 nt, Yersinia pestis KIM
gaaaagguauauuu

SEQ ID NO: 4210603 - RNA, 17 nt, Yersinia pestis KIM
gaaaagguuaacugcag

SEQ ID NO: 4210604 - RNA, 15 nt, Yersinia pestis KIM
gaaaaguagccaaua

SEQ ID NO: 4210605 - RNA, 15 nt, Yersinia pestis KIM
gaaaagugauccacu

SEQ ID NO: 4210606 - RNA, 19 nt, Yersinia pestis KIM
gaaaaguggcuaucugaaa

SEQ ID NO: 4210607 - RNA, 16 nt, Yersinia pestis KIM
gaaaauaccgcgauca

SEQ ID NO: 4210608 - RNA, 21 nt, Yersinia pestis KIM
gaaaauagagcauaccaauac

SEQ ID NO: 4210609 - RNA, 14 nt, Yersinia pestis KIM
gaaaauagccaacc

SEQ ID NO: 4210610 - RNA, 21 nt, Yersinia pestis KIM
gaaaauauucuaaguaaaaca

SEQ ID NO: 4210611 - RNA, 14 nt, Yersinia pestis KIM
gaaaaucaugaaau

SEQ ID NO: 4210612 - RNA, 14 nt, Yersinia pestis KIM
gaaaaugcggcggc

SEQ ID NO: 4210613 - RNA, 20 nt, Yersinia pestis KIM
gaaacaaaaccuaacgccaa

SEQ ID NO: 4210614 - RNA, 13 nt, Yersinia pestis KIM
gaaacaacccaaa

SEQ ID NO: 4210615 - RNA, 20 nt, Yersinia pestis KIM
gaaacaacccaaaggggagc

SEQ ID NO: 4210616 - RNA, 19 nt, Yersinia pestis KIM
gaaacaccacgcccaauuc

SEQ ID NO: 4210617 - RNA, 15 nt, Yersinia pestis KIM
gaaacaucuucauuu

SEQ ID NO: 4210618 - RNA, 19 nt, Yersinia pestis KIM
gaaacaugcugaagccagc

SEQ ID NO: 4210619 - RNA, 21 nt, Yersinia pestis KIM
gaaacaugcugaagccagcac

SEQ ID NO: 4210620 - RNA, 16 nt, Yersinia pestis KIM
gaaaccauugguaaua

SEQ ID NO: 4210621 - RNA, 20 nt, Yersinia pestis KIM
gaaaccauugguaauaaugc

SEQ ID NO: 4210622 - RNA, 24 nt, Yersinia pestis KIM
gaaaccgcuguuuuaaucgguggc

SEQ ID NO: 4210623 - RNA, 14 nt, Yersinia pestis KIM
gaaaccuaaugcca

SEQ ID NO: 4210624 - RNA, 22 nt, Yersinia pestis KIM
gaacugaaucacaggccacugc

SEQ ID NO: 4210625 - RNA, 22 nt, Yersinia pestis KIM
gaacuuacaugaguaagugauu

SEQ ID NO: 4210626 - RNA, 12 nt, Yersinia pestis KIM
gaacuuacuccc

SEQ ID NO: 4210627 - RNA, 16 nt, Yersinia pestis KIM
gaacuucgaaagaaau

SEQ ID NO: 4210628 - RNA, 19 nt, Yersinia pestis KIM
gaacuucgaaagaaauaaa

SEQ ID NO: 4210629 - RNA, 21 nt, Yersinia pestis KIM
gaagaauccacauaaaaagaa

SEQ ID NO: 4210630 - RNA, 21 nt, Yersinia pestis KIM
gaagacacuuugguuugcagc

SEQ ID NO: 4210631 - RNA, 15 nt, Yersinia pestis KIM
gaagacaucgccaga

SEQ ID NO: 4210632 - RNA, 16 nt, Yersinia pestis KIM
gaagaccagauaaucg

SEQ ID NO: 4210633 - RNA, 21 nt, Yersinia pestis KIM
gaagacuuccagcaccacuaa

SEQ ID NO: 4210634 - RNA, 15 nt, Yersinia pestis KIM
gaagagaaaagcaga

SEQ ID NO: 4210635 - RNA, 18 nt, Yersinia pestis KIM
gaagagccugaaucugaa

SEQ ID NO: 4210636 - RNA, 17 nt, Yersinia pestis KIM
gaagaguaaagcguccg

SEQ ID NO: 4210637 - RNA, 21 nt, Yersinia pestis KIM
gaagaguugauccgauaaacu

SEQ ID NO: 4210638 - RNA, 22 nt, Yersinia pestis KIM
gaagaguugauccgauaaacuu

SEQ ID NO: 4210639 - RNA, 22 nt, Yersinia pestis KIM
gaagaugccaaucaaaaaaccg

SEQ ID NO: 4210640 - RNA, 22 nt, Yersinia pestis KIM
gaagauuuaaauaacagcuaaa

SEQ ID NO: 4210641 - RNA, 13 nt, Yersinia pestis KIM
gaagcaagaaacu

SEQ ID NO: 4210642 - RNA, 21 nt, Yersinia pestis KIM
gaagcaaggggcggaaaugcc

SEQ ID NO: 4210643 - RNA, 19 nt, Yersinia pestis KIM
gaagcaauuugaucaccaa

SEQ ID NO: 4210644 - RNA, 18 nt, Yersinia pestis KIM
gaagcccguuauggcaag

SEQ ID NO: 4210645 - RNA, 17 nt, Yersinia pestis KIM
gaagccgacgaucuugc

SEQ ID NO: 4210646 - RNA, 22 nt, Yersinia pestis KIM
gaagccucaugaaugaggcuga

SEQ ID NO: 4210647 - RNA, 15 nt, Yersinia pestis KIM
gaagcggccagguuc

SEQ ID NO: 4210648 - RNA, 14 nt, Yersinia pestis KIM
gaagcguaaagcac

SEQ ID NO: 4210649 - RNA, 19 nt, Yersinia pestis KIM
gaagcguggaguuuacgca

SEQ ID NO: 4210650 - RNA, 18 nt, Yersinia pestis KIM
gaagcucauuaauccccg

SEQ ID NO: 4210651 - RNA, 23 nt, Yersinia pestis KIM
gaagcugauggcgaucaaaauca

SEQ ID NO: 4210652 - RNA, 21 nt, Yersinia pestis KIM
gaagcuguuuccugagucugu

SEQ ID NO: 4210653 - RNA, 14 nt, Yersinia pestis KIM
gaaggauugaccaa

SEQ ID NO: 4210654 - RNA, 15 nt, Yersinia pestis KIM
gaaggcacccaugcu

SEQ ID NO: 4210655 - RNA, 18 nt, Yersinia pestis KIM
gaaggcacccaugcuccc

SEQ ID NO: 4210656 - RNA, 21 nt, Yersinia pestis KIM
gaaggcacccaugcucccucc

SEQ ID NO: 4210657 - RNA, 11 nt, Yersinia pestis KIM
gaaggcacggc

SEQ ID NO: 4210658 - RNA, 13 nt, Yersinia pestis KIM
gaaggccauaauc

SEQ ID NO: 4210659 - RNA, 18 nt, Yersinia pestis KIM
gaaggccauaaucugcug

SEQ ID NO: 4210660 - RNA, 14 nt, Yersinia pestis KIM
gaaggccugcugug

SEQ ID NO: 4210661 - RNA, 17 nt, Yersinia pestis KIM
gaaggcgguuaucugga

SEQ ID NO: 4210662 - RNA, 16 nt, Yersinia pestis KIM
gaaggcuauuuuuaua

SEQ ID NO: 4210663 - RNA, 20 nt, Yersinia pestis KIM
gaagggccgcuauauuuuua

SEQ ID NO: 4210664 - RNA, 19 nt, Yersinia pestis KIM
gaaggguauugaagauacc

SEQ ID NO: 4210665 - RNA, 22 nt, Yersinia pestis KIM
gaagguaaucagacugcugaca

SEQ ID NO: 4210666 - RNA, 22 nt, Yersinia pestis KIM
gaaggucauucccgagauaacc

SEQ ID NO: 4210667 - RNA, 19 nt, Yersinia pestis KIM
gaagguguuuaaaauuaau

SEQ ID NO: 4210668 - RNA, 21 nt, Yersinia pestis KIM
gaagguguuuaaaauuaauaa

SEQ ID NO: 4210669 - RNA, 14 nt, Yersinia pestis KIM
gaagguugccccca

SEQ ID NO: 4210670 - RNA, 13 nt, Yersinia pestis KIM
gaagugagcugaa

SEQ ID NO: 4210671 - RNA, 12 nt, Yersinia pestis KIM
gaaguggacacg

SEQ ID NO: 4210672 - RNA, 23 nt, Yersinia pestis KIM
gaagugguagccggacucaaaau

SEQ ID NO: 4210673 - RNA, 14 nt, Yersinia pestis KIM
gaaguuaaaaaaau

SEQ ID NO: 4210674 - RNA, 15 nt, Yersinia pestis KIM
gaaguucucaucaaa

SEQ ID NO: 4210675 - RNA, 21 nt, Yersinia pestis KIM
gaaguugauaaaagucuauau

SEQ ID NO: 4210676 - RNA, 15 nt, Yersinia pestis KIM
gaaguuggcuuuugc

SEQ ID NO: 4210677 - RNA, 17 nt, Yersinia pestis KIM
gaauaaaaaagcccggu

SEQ ID NO: 4210678 - RNA, 13 nt, Yersinia pestis KIM
gaauaaacagcag

SEQ ID NO: 4210679 - RNA, 17 nt, Yersinia pestis KIM
gaauaaaggggguuuuc

SEQ ID NO: 4210680 - RNA, 17 nt, Yersinia pestis KIM
gaauaaauauccuccgg

SEQ ID NO: 4210681 - RNA, 12 nt, Yersinia pestis KIM
gaauaaaucaaa

SEQ ID NO: 4210682 - RNA, 17 nt, Yersinia pestis KIM
gaauaacaaaagcccgu

SEQ ID NO: 4210683 - RNA, 15 nt, Yersinia pestis KIM
gaauaaccuacaaaa

SEQ ID NO: 4210684 - RNA, 17 nt, Yersinia pestis KIM
gaauaacggcaguaacc

SEQ ID NO: 4210685 - RNA, 21 nt, Yersinia pestis KIM
gaauaacggcaguaaccuuga

SEQ ID NO: 4210686 - RNA, 20 nt, Yersinia pestis KIM
gaauaacguggaaaaaacgg

SEQ ID NO: 4210687 - RNA, 11 nt, Yersinia pestis KIM
gaauaauacug

SEQ ID NO: 4210688 - RNA, 19 nt, Yersinia pestis KIM
gaauaauaggcugaucaac

SEQ ID NO: 4210689 - RNA, 18 nt, Yersinia pestis KIM
gaauaauccaagccaugg

SEQ ID NO: 4210690 - RNA, 21 nt, Yersinia pestis KIM
gaauaaugguauuugaaauau

SEQ ID NO: 4210691 - RNA, 17 nt, Yersinia pestis KIM
gaauaauuacagcuggg

SEQ ID NO: 4210692 - RNA, 20 nt, Yersinia pestis KIM
gaauacacagcgagaaucuu

SEQ ID NO: 4210693 - RNA, 21 nt, Yersinia pestis KIM
gaauaccggccugauuuacug

SEQ ID NO: 4210694 - RNA, 19 nt, Yersinia pestis KIM
gaauacggcggugaguacu

SEQ ID NO: 4210695 - RNA, 14 nt, Yersinia pestis KIM
gaauagagccucua

SEQ ID NO: 4210696 - RNA, 20 nt, Yersinia pestis KIM
gaauagagccucuauuaccu

SEQ ID NO: 4210697 - RNA, 19 nt, Yersinia pestis KIM
gaauagcgcugcaucagca

SEQ ID NO: 4210698 - RNA, 22 nt, Yersinia pestis KIM
gaauagcuguaaaauaccaauu

SEQ ID NO: 4210699 - RNA, 16 nt, Yersinia pestis KIM
gaauaggcaggggagu

SEQ ID NO: 4210700 - RNA, 17 nt, Yersinia pestis KIM
gaauauaaacauaaaaa

SEQ ID NO: 4210701 - RNA, 19 nt, Yersinia pestis KIM
gaauauaaugauauucaua

SEQ ID NO: 4210702 - RNA, 18 nt, Yersinia pestis KIM
gaauauacuuuacauaua

SEQ ID NO: 4210703 - RNA, 19 nt, Yersinia pestis KIM
gaauaucaucuuuuucugc

SEQ ID NO: 4210704 - RNA, 24 nt, Yersinia pestis KIM
gaauauccuggaagcagaauacug

SEQ ID NO: 4210705 - RNA, 17 nt, Yersinia pestis KIM
gaauaugucauuaccgc

SEQ ID NO: 4210706 - RNA, 12 nt, Yersinia pestis KIM
gaauauuuacac

SEQ ID NO: 4210707 - RNA, 18 nt, Yersinia pestis KIM
gaaucaccaacaccacca

SEQ ID NO: 4210708 - RNA, 15 nt, Yersinia pestis KIM
gaaucaccacccgcu

SEQ ID NO: 4210709 - RNA, 18 nt, Yersinia pestis KIM
gaaucaccgaaagaagac

SEQ ID NO: 4210710 - RNA, 13 nt, Yersinia pestis KIM
gaaucacgcguuc

SEQ ID NO: 4210711 - RNA, 12 nt, Yersinia pestis KIM
gaaucacuuauu

SEQ ID NO: 4210712 - RNA, 22 nt, Yersinia pestis KIM
gaaucacuuauuggaaguacuu

SEQ ID NO: 4210713 - RNA, 24 nt, Yersinia pestis KIM
gaaucacuuuauuugccuacugaa

SEQ ID NO: 4210714 - RNA, 20 nt, Yersinia pestis KIM
gaaucagauacggcuccaga

SEQ ID NO: 4210715 - RNA, 19 nt, Yersinia pestis KIM
gaaucagccccaagcuuag

SEQ ID NO: 4210716 - RNA, 22 nt, Yersinia pestis KIM
gaaucagcggcggcgcugauuc

SEQ ID NO: 4210717 - RNA, 20 nt, Yersinia pestis KIM
gaaucaguggucuuccgccu

SEQ ID NO: 4210718 - RNA, 15 nt, Yersinia pestis KIM
gaaucaucagacgca

SEQ ID NO: 4210719 - RNA, 23 nt, Yersinia pestis KIM
gaauccagcgcggcgaaacugac

SEQ ID NO: 4210720 - RNA, 13 nt, Yersinia pestis KIM
gaauccgcuggcg

SEQ ID NO: 4210721 - RNA, 22 nt, Yersinia pestis KIM
gaaucgccguagauuuaacccc

SEQ ID NO: 4210722 - RNA, 18 nt, Yersinia pestis KIM
gaaucgcugccauaugca

SEQ ID NO: 4210723 - RNA, 19 nt, Yersinia pestis KIM
gaaucuaccgcagaaccuu

SEQ ID NO: 4210724 - RNA, 21 nt, Yersinia pestis KIM
gaaucuucaaugguguuaucu

SEQ ID NO: 4210725 - RNA, 14 nt, Yersinia pestis KIM
gaaugaauucuaua

SEQ ID NO: 4210726 - RNA, 14 nt, Yersinia pestis KIM
gaaugaggcugagg

SEQ ID NO: 4210727 - RNA, 19 nt, Yersinia pestis KIM
gaaugaguugcccuaaaca

SEQ ID NO: 4210728 - RNA, 15 nt, Yersinia pestis KIM
gaaugaguuucaagu

SEQ ID NO: 4210729 - RNA, 16 nt, Yersinia pestis KIM
gaaugaucagaggcug

SEQ ID NO: 4210730 - RNA, 21 nt, Yersinia pestis KIM
gaaugcgguucuguaucauau

SEQ ID NO: 4210731 - RNA, 19 nt, Yersinia pestis KIM
gaaugcguugccgaaagcc

SEQ ID NO: 4210732 - RNA, 21 nt, Yersinia pestis KIM
gaaugcuauauuuggcuuuca

SEQ ID NO: 4210733 - RNA, 21 nt, Yersinia pestis KIM
gaaugcucuuuuuaugcaggg

SEQ ID NO: 4210734 - RNA, 16 nt, Yersinia pestis KIM
gaauggaaguuaaaaa

SEQ ID NO: 4210735 - RNA, 21 nt, Yersinia pestis KIM
gaauggcuauuuacucucuuu

SEQ ID NO: 4210736 - RNA, 18 nt, Yersinia pestis KIM
gaaugguacuugacgcug

SEQ ID NO: 4210737 - RNA, 17 nt, Yersinia pestis KIM
gaauggucugcaacuca

SEQ ID NO: 4210738 - RNA, 14 nt, Yersinia pestis KIM
gaaugguuuuucag

SEQ ID NO: 4210739 - RNA, 12 nt, Yersinia pestis KIM
gaaugugagugu

SEQ ID NO: 4210740 - RNA, 13 nt, Yersinia pestis KIM
gaauguuaaaccc

SEQ ID NO: 4210741 - RNA, 21 nt, Yersinia pestis KIM
gaauuaaauuuuauauuaucu

SEQ ID NO: 4210742 - RNA, 17 nt, Yersinia pestis KIM
gaauuaacaauucucuc

SEQ ID NO: 4210743 - RNA, 18 nt, Yersinia pestis KIM
gaauuaacgcucuacaac

SEQ ID NO: 4210744 - RNA, 14 nt, Yersinia pestis KIM
gaauuaagaagccu

SEQ ID NO: 4210745 - RNA, 19 nt, Yersinia pestis KIM
gaauuaagaagccucauga

SEQ ID NO: 4210746 - RNA, 16 nt, Yersinia pestis KIM
gaauuaaggaaacuca

SEQ ID NO: 4210747 - RNA, 15 nt, Yersinia pestis KIM
gaauuaauaaaaccu

SEQ ID NO: 4210748 - RNA, 16 nt, Yersinia pestis KIM
gaauuaauaacaguau

SEQ ID NO: 4210749 - RNA, 18 nt, Yersinia pestis KIM
gaauuauaacuauuaucu

SEQ ID NO: 4210750 - RNA, 18 nt, Yersinia pestis KIM
gaauuaucauccagauuc

SEQ ID NO: 4210751 - RNA, 12 nt, Yersinia pestis KIM
gaauucaccaaa

SEQ ID NO: 4210752 - RNA, 19 nt, Yersinia pestis KIM
gaauuuaugcaccaaauuc

SEQ ID NO: 4210753 - RNA, 21 nt, Yersinia pestis KIM
gaauuucgucuucgcccagau

SEQ ID NO: 4210754 - RNA, 14 nt, Yersinia pestis KIM
gaauuugcugcucg

SEQ ID NO: 4210755 - RNA, 16 nt, Yersinia pestis KIM
gaauuuuauucagcaa

SEQ ID NO: 4210756 - RNA, 20 nt, Yersinia pestis KIM
gaauuuucucauuaauaaug

SEQ ID NO: 4210757 - RNA, 21 nt, Yersinia pestis KIM
gaauuuucucauuaauaauga

SEQ ID NO: 4210758 - RNA, 12 nt, Yersinia pestis KIM
gaauuuuuauaa

SEQ ID NO: 4210759 - RNA, 18 nt, Yersinia pestis KIM
gaauuuuucccugcugau

SEQ ID NO: 4210760 - RNA, 16 nt, Yersinia pestis KIM
gacaaaaauaagcgua

SEQ ID NO: 4210761 - RNA, 14 nt, Yersinia pestis KIM
gacaaaaucaguac

SEQ ID NO: 4210762 - RNA, 22 nt, Yersinia pestis KIM
gacaaaaucccccaccaguaaa

SEQ ID NO: 4210763 - RNA, 23 nt, Yersinia pestis KIM
gacaaacaaccuaaaaaaaacaa

SEQ ID NO: 4210764 - RNA, 13 nt, Yersinia pestis KIM
gacaaacagauac

SEQ ID NO: 4210765 - RNA, 18 nt, Yersinia pestis KIM
gacaaaccccgaugacgc

SEQ ID NO: 4210766 - RNA, 14 nt, Yersinia pestis KIM
gacaaagagcccgc

SEQ ID NO: 4210767 - RNA, 18 nt, Yersinia pestis KIM
gacaaauaaaacagaacc

SEQ ID NO: 4210768 - RNA, 21 nt, Yersinia pestis KIM
gacaaauaaaacagaaccccc

SEQ ID NO: 4210769 - RNA, 17 nt, Yersinia pestis KIM
gacaaauccuuuuaaaa

SEQ ID NO: 4210770 - RNA, 16 nt, Yersinia pestis KIM
gacaacaaacaguaac

SEQ ID NO: 4210771 - RNA, 21 nt, Yersinia pestis KIM
gacaacccgcuacugaauaag

SEQ ID NO: 4210772 - RNA, 17 nt, Yersinia pestis KIM
gacaacgucacuuccau

SEQ ID NO: 4210773 - RNA, 16 nt, Yersinia pestis KIM
gacaacucuucuaucu

SEQ ID NO: 4210774 - RNA, 12 nt, Yersinia pestis KIM
gacaagcccgau

SEQ ID NO: 4210775 - RNA, 20 nt, Yersinia pestis KIM
gacaagcgcaguagcggcuc

SEQ ID NO: 4210776 - RNA, 15 nt, Yersinia pestis KIM
gacaauaguguugcu

SEQ ID NO: 4210777 - RNA, 14 nt, Yersinia pestis KIM
gacaauauaauaau

SEQ ID NO: 4210778 - RNA, 11 nt, Yersinia pestis KIM
gacaauauccg

SEQ ID NO: 4210779 - RNA, 18 nt, Yersinia pestis KIM
gacaaugccaucccccuu

SEQ ID NO: 4210780 - RNA, 21 nt, Yersinia pestis KIM
gacaauuauagccaaaucugg

SEQ ID NO: 4210781 - RNA, 15 nt, Yersinia pestis KIM
gacaauuuacaccca

SEQ ID NO: 4210782 - RNA, 18 nt, Yersinia pestis KIM
gacaauuuccccugcuuc

SEQ ID NO: 4210783 - RNA, 14 nt, Yersinia pestis KIM
gacacaacacauua

SEQ ID NO: 4210784 - RNA, 22 nt, Yersinia pestis KIM
gacacaauucccguuagguuca

SEQ ID NO: 4210785 - RNA, 17 nt, Yersinia pestis KIM
gacaccaagacugaagu

SEQ ID NO: 4210786 - RNA, 17 nt, Yersinia pestis KIM
gacaccaagaggcugcg

SEQ ID NO: 4210787 - RNA, 17 nt, Yersinia pestis KIM
gacacccguacgaauuu

SEQ ID NO: 4210788 - RNA, 18 nt, Yersinia pestis KIM
gacacccguuccuucagc

SEQ ID NO: 4210789 - RNA, 16 nt, Yersinia pestis KIM
gacacccucagaggcc

SEQ ID NO: 4210790 - RNA, 18 nt, Yersinia pestis KIM
gacaccgccagcaacagc

SEQ ID NO: 4210791 - RNA, 15 nt, Yersinia pestis KIM
gacacgaucauuaua

SEQ ID NO: 4210792 - RNA, 23 nt, Yersinia pestis KIM
gacacguaaaacagggagccgcc

SEQ ID NO: 4210793 - RNA, 23 nt, Yersinia pestis KIM
gacacucggcgguuugagccacc

SEQ ID NO: 4210794 - RNA, 20 nt, Yersinia pestis KIM
gacacuuauuggucgcuuuu

SEQ ID NO: 4210795 - RNA, 20 nt, Yersinia pestis KIM
gacacuuugguuugcagcga

SEQ ID NO: 4210796 - RNA, 18 nt, Yersinia pestis KIM
gacagaaaaaucacaugc

SEQ ID NO: 4210797 - RNA, 16 nt, Yersinia pestis KIM
gacagaacugauuuca

SEQ ID NO: 4210798 - RNA, 18 nt, Yersinia pestis KIM
gacagaacugauuucagg

SEQ ID NO: 4210799 - RNA, 19 nt, Yersinia pestis KIM
gacagcaaccacuucaacg

SEQ ID NO: 4210800 - RNA, 23 nt, Yersinia pestis KIM
gacagcuaucuugaaacaaccca

SEQ ID NO: 4210801 - RNA, 17 nt, Yersinia pestis KIM
gacaggauaagcagggc

SEQ ID NO: 4210802 - RNA, 17 nt, Yersinia pestis KIM
gacaggauaaucaucag

SEQ ID NO: 4210803 - RNA, 14 nt, Yersinia pestis KIM
gacaggcaaagacu

SEQ ID NO: 4210804 - RNA, 17 nt, Yersinia pestis KIM
gacaggcaaagacuaca

SEQ ID NO: 4210805 - RNA, 19 nt, Yersinia pestis KIM
gacaggcaauuauccaucc

SEQ ID NO: 4210806 - RNA, 16 nt, Yersinia pestis KIM
gacaggcucagcacaa

SEQ ID NO: 4210807 - RNA, 18 nt, Yersinia pestis KIM
gacaggcucagcacaaac

SEQ ID NO: 4210808 - RNA, 14 nt, Yersinia pestis KIM
gacaggcuccuccu

SEQ ID NO: 4210809 - RNA, 21 nt, Yersinia pestis KIM
gacaguaaccgggcuugauua

SEQ ID NO: 4210810 - RNA, 14 nt, Yersinia pestis KIM
gacaguaacuaaag

SEQ ID NO: 4210811 - RNA, 17 nt, Yersinia pestis KIM
gacaguaaguugaugac

SEQ ID NO: 4210812 - RNA, 16 nt, Yersinia pestis KIM
gacaguauuugcagug

SEQ ID NO: 4210813 - RNA, 21 nt, Yersinia pestis KIM
gacauaaacacgcaaucagau

SEQ ID NO: 4210814 - RNA, 12 nt, Yersinia pestis KIM
gacauaaaccgc

SEQ ID NO: 4210815 - RNA, 14 nt, Yersinia pestis KIM
gacauaaaccgcau

SEQ ID NO: 4210816 - RNA, 13 nt, Yersinia pestis KIM
gacauaagaugac

SEQ ID NO: 4210817 - RNA, 20 nt, Yersinia pestis KIM
gacauagccggagguuuuuc

SEQ ID NO: 4210818 - RNA, 20 nt, Yersinia pestis KIM
gacauaucuugaaccaauuu

SEQ ID NO: 4210819 - RNA, 16 nt, Yersinia pestis KIM
gacauauucaaccgcc

SEQ ID NO: 4210820 - RNA, 12 nt, Yersinia pestis KIM
gacauccaauuc

SEQ ID NO: 4210821 - RNA, 15 nt, Yersinia pestis KIM
gacauccaauucagu

SEQ ID NO: 4210822 - RNA, 22 nt, Yersinia pestis KIM
gacauccgcuugcagcaacagg

SEQ ID NO: 4210823 - RNA, 15 nt, Yersinia pestis KIM
gacaucgccagauuc

SEQ ID NO: 4210824 - RNA, 19 nt, Yersinia pestis KIM
gacaugggcagugcacagu

SEQ ID NO: 4210825 - RNA, 20 nt, Yersinia pestis KIM
gacaugugagugguguaaga

SEQ ID NO: 4210826 - RNA, 23 nt, Yersinia pestis KIM
gacauguuccagugcuuuaucca

SEQ ID NO: 4210827 - RNA, 12 nt, Yersinia pestis KIM
gacauuaagcau

SEQ ID NO: 4210828 - RNA, 21 nt, Yersinia pestis KIM
gacauucaaauacggcaccaa

SEQ ID NO: 4210829 - RNA, 22 nt, Yersinia pestis KIM
gacauugcgcaagccccuauaa

SEQ ID NO: 4210830 - RNA, 17 nt, Yersinia pestis KIM
gacauuuagcacuguuc

SEQ ID NO: 4210831 - RNA, 22 nt, Yersinia pestis KIM
gacauuugcaacuuccuugauu

SEQ ID NO: 4210832 - RNA, 16 nt, Yersinia pestis KIM
gacauuuuacucccug

SEQ ID NO: 4210833 - RNA, 12 nt, Yersinia pestis KIM
gacauuuucuau

SEQ ID NO: 4210834 - RNA, 12 nt, Yersinia pestis KIM
gacauuuuucua

SEQ ID NO: 4210835 - RNA, 18 nt, Yersinia pestis KIM
gacauuuuucuauuucug

SEQ ID NO: 4210836 - RNA, 18 nt, Yersinia pestis KIM
gaccaaaacccaucagac

SEQ ID NO: 4210837 - RNA, 14 nt, Yersinia pestis KIM
gaccaaacauuguc

SEQ ID NO: 4210838 - RNA, 17 nt, Yersinia pestis KIM
gaccaaaggcuauuuaa

SEQ ID NO: 4210839 - RNA, 17 nt, Yersinia pestis KIM
gaccaaauagcaagcca

SEQ ID NO: 4210840 - RNA, 21 nt, Yersinia pestis KIM
gaccaauacuacggcagaaac

SEQ ID NO: 4210841 - RNA, 16 nt, Yersinia pestis KIM
gaccaauuucaauaau

SEQ ID NO: 4210842 - RNA, 14 nt, Yersinia pestis KIM
gaccacagauaaau

SEQ ID NO: 4210843 - RNA, 20 nt, Yersinia pestis KIM
gaccacaucaaccugaucau

SEQ ID NO: 4210844 - RNA, 11 nt, Yersinia pestis KIM
gaccaccaacu

SEQ ID NO: 4210845 - RNA, 20 nt, Yersinia pestis KIM
gaccaccgauacgcgcaccg

SEQ ID NO: 4210846 - RNA, 13 nt, Yersinia pestis KIM
gaccaccgcagca

SEQ ID NO: 4210847 - RNA, 17 nt, Yersinia pestis KIM
gaccacgcaucaauaau

SEQ ID NO: 4210848 - RNA, 16 nt, Yersinia pestis KIM
gaccacugacaaaaac

SEQ ID NO: 4210849 - RNA, 13 nt, Yersinia pestis KIM
gaccacuuccugu

SEQ ID NO: 4210850 - RNA, 20 nt, Yersinia pestis KIM
gaccacuugcugaugcccau

SEQ ID NO: 4210851 - RNA, 14 nt, Yersinia pestis KIM
gaccagauaaucgc

SEQ ID NO: 4210852 - RNA, 21 nt, Yersinia pestis KIM
gaccagauaaucgccaauaac

SEQ ID NO: 4210853 - RNA, 19 nt, Yersinia pestis KIM
gacuguaaauauucugacg

SEQ ID NO: 4210854 - RNA, 15 nt, Yersinia pestis KIM
gacugucuucaacuu

SEQ ID NO: 4210855 - RNA, 12 nt, Yersinia pestis KIM
gacuguggcugc

SEQ ID NO: 4210856 - RNA, 15 nt, Yersinia pestis KIM
gacuguugaaguaca

SEQ ID NO: 4210857 - RNA, 13 nt, Yersinia pestis KIM
gacuguuuugcua

SEQ ID NO: 4210858 - RNA, 18 nt, Yersinia pestis KIM
gacuuccugcccagcggc

SEQ ID NO: 4210859 - RNA, 12 nt, Yersinia pestis KIM
gacuucuuaucu

SEQ ID NO: 4210860 - RNA, 17 nt, Yersinia pestis KIM
gacuucuuauuaaucaa

SEQ ID NO: 4210861 - RNA, 21 nt, Yersinia pestis KIM
gacuugaacuucgaaagaaau

SEQ ID NO: 4210862 - RNA, 20 nt, Yersinia pestis KIM
gacuugauuaacaucgccac

SEQ ID NO: 4210863 - RNA, 15 nt, Yersinia pestis KIM
gacuuuaucugccaa

SEQ ID NO: 4210864 - RNA, 18 nt, Yersinia pestis KIM
gacuuuauguacauccaa

SEQ ID NO: 4210865 - RNA, 13 nt, Yersinia pestis KIM
gacuuuccccaga

SEQ ID NO: 4210866 - RNA, 21 nt, Yersinia pestis KIM
gacuuucuaagcugccugugc

SEQ ID NO: 4210867 - RNA, 19 nt, Yersinia pestis KIM
gagaaacugaugccgguau

SEQ ID NO: 4210868 - RNA, 21 nt, Yersinia pestis KIM
gagaacacaaaagacgccuuc

SEQ ID NO: 4210869 - RNA, 13 nt, Yersinia pestis KIM
gagaacaggcaga

SEQ ID NO: 4210870 - RNA, 15 nt, Yersinia pestis KIM
gagaacgggcaaccu

SEQ ID NO: 4210871 - RNA, 18 nt, Yersinia pestis KIM
gagaauaaauauucggua

SEQ ID NO: 4210872 - RNA, 17 nt, Yersinia pestis KIM
gagaauauagagccguu

SEQ ID NO: 4210873 - RNA, 14 nt, Yersinia pestis KIM
gagaauaucuauau

SEQ ID NO: 4210874 - RNA, 20 nt, Yersinia pestis KIM
gagaaucucuccagugcaaa

SEQ ID NO: 4210875 - RNA, 23 nt, Yersinia pestis KIM
gagaaugguacuugacgcugcag

SEQ ID NO: 4210876 - RNA, 14 nt, Yersinia pestis KIM
gagacauaaagccc

SEQ ID NO: 4210877 - RNA, 16 nt, Yersinia pestis KIM
gagaccacagauaaau

SEQ ID NO: 4210878 - RNA, 15 nt, Yersinia pestis KIM
gagacccgauuucac

SEQ ID NO: 4210879 - RNA, 14 nt, Yersinia pestis KIM
gagacggaaagagc

SEQ ID NO: 4210880 - RNA, 16 nt, Yersinia pestis KIM
gagacuccucuucuuc

SEQ ID NO: 4210881 - RNA, 17 nt, Yersinia pestis KIM
gagacuucgguauggcg

SEQ ID NO: 4210882 - RNA, 13 nt, Yersinia pestis KIM
gagagaacaggca

SEQ ID NO: 4210883 - RNA, 22 nt, Yersinia pestis KIM
gagagaggccagacacaaugcu

SEQ ID NO: 4210884 - RNA, 19 nt, Yersinia pestis KIM
gagagccaaaauggcguug

SEQ ID NO: 4210885 - RNA, 14 nt, Yersinia pestis KIM
gagaggagauuaga

SEQ ID NO: 4210886 - RNA, 22 nt, Yersinia pestis KIM
gagaggcugaaggcgcuccccu

SEQ ID NO: 4210887 - RNA, 13 nt, Yersinia pestis KIM
gagagguugcaaa

SEQ ID NO: 4210888 - RNA, 20 nt, Yersinia pestis KIM
gagagucuauuauauucaau

SEQ ID NO: 4210889 - RNA, 15 nt, Yersinia pestis KIM
gagaguucacuuauu

SEQ ID NO: 4210890 - RNA, 13 nt, Yersinia pestis KIM
gagauaacgcuga

SEQ ID NO: 4210891 - RNA, 19 nt, Yersinia pestis KIM
gagauaacgcugauguagg

SEQ ID NO: 4210892 - RNA, 16 nt, Yersinia pestis KIM
gagauauaaacuaaua

SEQ ID NO: 4210893 - RNA, 20 nt, Yersinia pestis KIM
gagauauuugucgcauuuau

SEQ ID NO: 4210894 - RNA, 15 nt, Yersinia pestis KIM
gagaucguaggcuuu

SEQ ID NO: 4210895 - RNA, 14 nt, Yersinia pestis KIM
gagauguauccaag

SEQ ID NO: 4210896 - RNA, 16 nt, Yersinia pestis KIM
gagauguauccaaggc

SEQ ID NO: 4210897 - RNA, 21 nt, Yersinia pestis KIM
gagauuauuggcgauuuaaug

SEQ ID NO: 4210898 - RNA, 22 nt, Yersinia pestis KIM
gagauucaccgauagcccaucu

SEQ ID NO: 4210899 - RNA, 14 nt, Yersinia pestis KIM
gagauugaugggau

SEQ ID NO: 4210900 - RNA, 18 nt, Yersinia pestis KIM
gagauugcguuauaucua

SEQ ID NO: 4210901 - RNA, 19 nt, Yersinia pestis KIM
gagauuucagacugcugac

SEQ ID NO: 4210902 - RNA, 19 nt, Yersinia pestis KIM
gagcaaacggguggccaca

SEQ ID NO: 4210903 - RNA, 21 nt, Yersinia pestis KIM
gagcaauaccaaaaaucucuu

SEQ ID NO: 4210904 - RNA, 15 nt, Yersinia pestis KIM
gagcaccaaaucuuc

SEQ ID NO: 4210905 - RNA, 16 nt, Yersinia pestis KIM
gagcaccaaaucuucc

SEQ ID NO: 4210906 - RNA, 17 nt, Yersinia pestis KIM
gagcaccaaaucuucca

SEQ ID NO: 4210907 - RNA, 21 nt, Yersinia pestis KIM
gagcaccaaaucuuccagcgg

SEQ ID NO: 4210908 - RNA, 11 nt, Yersinia pestis KIM
gagcaccagaa

SEQ ID NO: 4210909 - RNA, 13 nt, Yersinia pestis KIM
gagcaccgcagga

SEQ ID NO: 4210910 - RNA, 22 nt, Yersinia pestis KIM
gagcaccgcugcuuuuacgcaa

SEQ ID NO: 4210911 - RNA, 16 nt, Yersinia pestis KIM
gagcacgauuaccauu

SEQ ID NO: 4210912 - RNA, 12 nt, Yersinia pestis KIM
gagcacugcccc

SEQ ID NO: 4210913 - RNA, 20 nt, Yersinia pestis KIM
gagcagccaacacaccugca

SEQ ID NO: 4210914 - RNA, 22 nt, Yersinia pestis KIM
gagcauaacugguggcaggccc

SEQ ID NO: 4210915 - RNA, 14 nt, Yersinia pestis KIM
gagcauauacagcc

SEQ ID NO: 4210916 - RNA, 19 nt, Yersinia pestis KIM
gagcauuuuagugaugaua

SEQ ID NO: 4210917 - RNA, 18 nt, Yersinia pestis KIM
gagcauuuuguuacccac

SEQ ID NO: 4210918 - RNA, 21 nt, Yersinia pestis KIM
gagccaaacgugcuacuuaau

SEQ ID NO: 4210919 - RNA, 18 nt, Yersinia pestis KIM
gagccaauagaggcuccc

SEQ ID NO: 4210920 - RNA, 12 nt, Yersinia pestis KIM
gagccacacauu

SEQ ID NO: 4210921 - RNA, 22 nt, Yersinia pestis KIM
gagccagagacauaaagcccgc

SEQ ID NO: 4210922 - RNA, 17 nt, Yersinia pestis KIM
gagccagccauucugaa

SEQ ID NO: 4210923 - RNA, 17 nt, Yersinia pestis KIM
gagccauccaggcaagc

SEQ ID NO: 4210924 - RNA, 19 nt, Yersinia pestis KIM
gagccauugauuggcuccu

SEQ ID NO: 4210925 - RNA, 20 nt, Yersinia pestis KIM
gagccgcuagcgcaggugua

SEQ ID NO: 4210926 - RNA, 21 nt, Yersinia pestis KIM
gagccguuagauuuaaaggca

SEQ ID NO: 4210927 - RNA, 21 nt, Yersinia pestis KIM
gagccuacauggauguauuua

SEQ ID NO: 4210928 - RNA, 17 nt, Yersinia pestis KIM
gagccuguaucggguga

SEQ ID NO: 4210929 - RNA, 16 nt, Yersinia pestis KIM
gagccuguccauaauu

SEQ ID NO: 4210930 - RNA, 19 nt, Yersinia pestis KIM
gagcgacucaauaauaugg

SEQ ID NO: 4210931 - RNA, 21 nt, Yersinia pestis KIM
gagcgacuuaauggucuucuu

SEQ ID NO: 4210932 - RNA, 13 nt, Yersinia pestis KIM
gagcgcagacguu

SEQ ID NO: 4210933 - RNA, 18 nt, Yersinia pestis KIM
gagcgcuuuaaccaaaga

SEQ ID NO: 4210934 - RNA, 15 nt, Yersinia pestis KIM
gagcggggcaaaaau

SEQ ID NO: 4210935 - RNA, 13 nt, Yersinia pestis KIM
gagcgucaagcca

SEQ ID NO: 4210936 - RNA, 14 nt, Yersinia pestis KIM
gagcgucaagccaa

SEQ ID NO: 4210937 - RNA, 15 nt, Yersinia pestis KIM
gagcgugaagagcga

SEQ ID NO: 4210938 - RNA, 16 nt, Yersinia pestis KIM
gagcucagccaggcag

SEQ ID NO: 4210939 - RNA, 21 nt, Yersinia pestis KIM
gagcucucacugcuccagcca

SEQ ID NO: 4210940 - RNA, 23 nt, Yersinia pestis KIM
gagcucucacugcuccagccaac

SEQ ID NO: 4210941 - RNA, 17 nt, Yersinia pestis KIM
gagcugaauagccuuga

SEQ ID NO: 4210942 - RNA, 15 nt, Yersinia pestis KIM
gagcugacgucagau

SEQ ID NO: 4210943 - RNA, 22 nt, Yersinia pestis KIM
gagcuguagaacuuguucauau

SEQ ID NO: 4210944 - RNA, 13 nt, Yersinia pestis KIM
gagcuguuauagc

SEQ ID NO: 4210945 - RNA, 14 nt, Yersinia pestis KIM
gagcuuauaucaau

SEQ ID NO: 4210946 - RNA, 16 nt, Yersinia pestis KIM
gagcuucuucaaaagc

SEQ ID NO: 4210947 - RNA, 16 nt, Yersinia pestis KIM
gagcuugcuggcggcg

SEQ ID NO: 4210948 - RNA, 17 nt, Yersinia pestis KIM
gagcuuugcuagugaac

SEQ ID NO: 4210949 - RNA, 19 nt, Yersinia pestis KIM
gaggaaaacgccagcagac

SEQ ID NO: 4210950 - RNA, 13 nt, Yersinia pestis KIM
gaggaaacugccg

SEQ ID NO: 4210951 - RNA, 12 nt, Yersinia pestis KIM
gaggaaauaaau

SEQ ID NO: 4210952 - RNA, 22 nt, Yersinia pestis KIM
gaggaaggcgguuaucuggaau

SEQ ID NO: 4210953 - RNA, 21 nt, Yersinia pestis KIM
gaggaauagccagcguggugu

SEQ ID NO: 4210954 - RNA, 15 nt, Yersinia pestis KIM
gaggacagguggguu

SEQ ID NO: 4210955 - RNA, 19 nt, Yersinia pestis KIM
gaggagauuucagacugcu

SEQ ID NO: 4210956 - RNA, 12 nt, Yersinia pestis KIM
gaggaucaccac

SEQ ID NO: 4210957 - RNA, 21 nt, Yersinia pestis KIM
gaggaucccuucugaaacuuc

SEQ ID NO: 4210958 - RNA, 17 nt, Yersinia pestis KIM
gaggauuuuccgcagcu

SEQ ID NO: 4210959 - RNA, 14 nt, Yersinia pestis KIM
gaggcacccgagca

SEQ ID NO: 4210960 - RNA, 23 nt, Yersinia pestis KIM
gaggcacuuguuuugccaguuuc

SEQ ID NO: 4210961 - RNA, 13 nt, Yersinia pestis KIM
gaggccaggacuu

SEQ ID NO: 4210962 - RNA, 19 nt, Yersinia pestis KIM
gaggcgcuacugcuuuuua

SEQ ID NO: 4210963 - RNA, 14 nt, Yersinia pestis KIM
gaggcguggcacac

SEQ ID NO: 4210964 - RNA, 23 nt, Yersinia pestis KIM
gaggcucuggucacuaaaacuga

SEQ ID NO: 4210965 - RNA, 15 nt, Yersinia pestis KIM
gaggcucuucugggc

SEQ ID NO: 4210966 - RNA, 16 nt, Yersinia pestis KIM
gaggcucuucugggcu

SEQ ID NO: 4210967 - RNA, 12 nt, Yersinia pestis KIM
gagggacagaga

SEQ ID NO: 4210968 - RNA, 18 nt, Yersinia pestis KIM
gauaaggugcgggaugca

SEQ ID NO: 4210969 - RNA, 17 nt, Yersinia pestis KIM
gauaagugaauaaauca

SEQ ID NO: 4210970 - RNA, 19 nt, Yersinia pestis KIM
gauaaguugagaucaacuc

SEQ ID NO: 4210971 - RNA, 19 nt, Yersinia pestis KIM
gauaaguuuuaauaucugc

SEQ ID NO: 4210972 - RNA, 18 nt, Yersinia pestis KIM
gauaaguuuuuuuauccc

SEQ ID NO: 4210973 - RNA, 20 nt, Yersinia pestis KIM
gauaauaaauacccugcacc

SEQ ID NO: 4210974 - RNA, 21 nt, Yersinia pestis KIM
gauaauaaauacccugcacca

SEQ ID NO: 4210975 - RNA, 21 nt, Yersinia pestis KIM
gauaauagcuaaacauccguu

SEQ ID NO: 4210976 - RNA, 20 nt, Yersinia pestis KIM
gauaaucaauuugucauguu

SEQ ID NO: 4210977 - RNA, 12 nt, Yersinia pestis KIM
gauaaucaucag

SEQ ID NO: 4210978 - RNA, 21 nt, Yersinia pestis KIM
gauaauccgaccaccacugca

SEQ ID NO: 4210979 - RNA, 15 nt, Yersinia pestis KIM
gauaaugcugaugca

SEQ ID NO: 4210980 - RNA, 19 nt, Yersinia pestis KIM
gauaauuaaugcaccuaca

SEQ ID NO: 4210981 - RNA, 14 nt, Yersinia pestis KIM
gauaauuaauucaa

SEQ ID NO: 4210982 - RNA, 23 nt, Yersinia pestis KIM
gauaauuauccauuuucugccaa

SEQ ID NO: 4210983 - RNA, 23 nt, Yersinia pestis KIM
gauacaaagugaaacccgcgcag

SEQ ID NO: 4210984 - RNA, 13 nt, Yersinia pestis KIM
gauacaauuuuug

SEQ ID NO: 4210985 - RNA, 13 nt, Yersinia pestis KIM
gauaccagcgacu

SEQ ID NO: 4210986 - RNA, 13 nt, Yersinia pestis KIM
gauacccacuuua

SEQ ID NO: 4210987 - RNA, 16 nt, Yersinia pestis KIM
gauaccggaaaaugcg

SEQ ID NO: 4210988 - RNA, 22 nt, Yersinia pestis KIM
gauaccugagcgcugaguugua

SEQ ID NO: 4210989 - RNA, 13 nt, Yersinia pestis KIM
gauacgacuucuu

SEQ ID NO: 4210990 - RNA, 19 nt, Yersinia pestis KIM
gauacgcauugaggucagc

SEQ ID NO: 4210991 - RNA, 16 nt, Yersinia pestis KIM
gauacgcgccgcagca

SEQ ID NO: 4210992 - RNA, 18 nt, Yersinia pestis KIM
gauacgcgccgcagcagu

SEQ ID NO: 4210993 - RNA, 17 nt, Yersinia pestis KIM
gauacggucaucgccgc

SEQ ID NO: 4210994 - RNA, 14 nt, Yersinia pestis KIM
gauacuggaagaaa

SEQ ID NO: 4210995 - RNA, 20 nt, Yersinia pestis KIM
gauacuuucggguaucuguu

SEQ ID NO: 4210996 - RNA, 15 nt, Yersinia pestis KIM
gauacuuuugcuaac

SEQ ID NO: 4210997 - RNA, 13 nt, Yersinia pestis KIM
gauagcaaucaau

SEQ ID NO: 4210998 - RNA, 16 nt, Yersinia pestis KIM
gauagcaaucaauaag

SEQ ID NO: 4210999 - RNA, 23 nt, Yersinia pestis KIM
gauagccaaccccucugguguga

SEQ ID NO: 4211000 - RNA, 13 nt, Yersinia pestis KIM
gauagccaauaac

SEQ ID NO: 4211001 - RNA, 13 nt, Yersinia pestis KIM
gauagccagugac

SEQ ID NO: 4211002 - RNA, 22 nt, Yersinia pestis KIM
gauagcccaucuuaugcauguu

SEQ ID NO: 4211003 - RNA, 18 nt, Yersinia pestis KIM
gauagccuauuucaccgc

SEQ ID NO: 4211004 - RNA, 14 nt, Yersinia pestis KIM
gauaggcagaggag

SEQ ID NO: 4211005 - RNA, 21 nt, Yersinia pestis KIM
gauagggagccaauagaggcu

SEQ ID NO: 4211006 - RNA, 22 nt, Yersinia pestis KIM
gauagggagccaauagaggcuc

SEQ ID NO: 4211007 - RNA, 23 nt, Yersinia pestis KIM
gauaguaacaccagcauccugca

SEQ ID NO: 4211008 - RNA, 21 nt, Yersinia pestis KIM
gauagucauuuuauuuaggcu

SEQ ID NO: 4211009 - RNA, 22 nt, Yersinia pestis KIM
gauagugacuucgcugcuaaac

SEQ ID NO: 4211010 - RNA, 17 nt, Yersinia pestis KIM
gauaguuaaauuauccc

SEQ ID NO: 4211011 - RNA, 16 nt, Yersinia pestis KIM
gauaguuaucucccau

SEQ ID NO: 4211012 - RNA, 13 nt, Yersinia pestis KIM
gauaguuaucugg

SEQ ID NO: 4211013 - RNA, 12 nt, Yersinia pestis KIM
gauauaaauaaa

SEQ ID NO: 4211014 - RNA, 13 nt, Yersinia pestis KIM
gauauaacucaac

SEQ ID NO: 4211015 - RNA, 14 nt, Yersinia pestis KIM
gauauagagcucag

SEQ ID NO: 4211016 - RNA, 15 nt, Yersinia pestis KIM
gauauaugccauauu

SEQ ID NO: 4211017 - RNA, 17 nt, Yersinia pestis KIM
gauaucaauaaccugac

SEQ ID NO: 4211018 - RNA, 16 nt, Yersinia pestis KIM
gauaucagccagugcu

SEQ ID NO: 4211019 - RNA, 21 nt, Yersinia pestis KIM
gauaucuaaguccaagacaga

SEQ ID NO: 4211020 - RNA, 12 nt, Yersinia pestis KIM
gauaucucuuua

SEQ ID NO: 4211021 - RNA, 13 nt, Yersinia pestis KIM
gauaucugaauca

SEQ ID NO: 4211022 - RNA, 20 nt, Yersinia pestis KIM
gauaucuucggcggcuaaag

SEQ ID NO: 4211023 - RNA, 14 nt, Yersinia pestis KIM
gauaugaauauccg

SEQ ID NO: 4211024 - RNA, 20 nt, Yersinia pestis KIM
gauaugacagaaaaaucaca

SEQ ID NO: 4211025 - RNA, 16 nt, Yersinia pestis KIM
gauaugacuaaacuga

SEQ ID NO: 4211026 - RNA, 19 nt, Yersinia pestis KIM
gauaugacuaaacugauca

SEQ ID NO: 4211027 - RNA, 20 nt, Yersinia pestis KIM
gauaugcauuauugauguua

SEQ ID NO: 4211028 - RNA, 16 nt, Yersinia pestis KIM
gauauguaccggugcg

SEQ ID NO: 4211029 - RNA, 22 nt, Yersinia pestis KIM
gauauuaccgagcgucaagcca

SEQ ID NO: 4211030 - RNA, 21 nt, Yersinia pestis KIM
gauauuagggcugacagagcg

SEQ ID NO: 4211031 - RNA, 15 nt, Yersinia pestis KIM
gauauuauucucuac

SEQ ID NO: 4211032 - RNA, 18 nt, Yersinia pestis KIM
gauauucacguuuuucca

SEQ ID NO: 4211033 - RNA, 16 nt, Yersinia pestis KIM
gauauucgcgcccaaa

SEQ ID NO: 4211034 - RNA, 18 nt, Yersinia pestis KIM
gauauucucaccugcuua

SEQ ID NO: 4211035 - RNA, 16 nt, Yersinia pestis KIM
gauauugauagccaca

SEQ ID NO: 4211036 - RNA, 13 nt, Yersinia pestis KIM
gauauugaugacg

SEQ ID NO: 4211037 - RNA, 14 nt, Yersinia pestis KIM
gauauugaugacgc

SEQ ID NO: 4211038 - RNA, 20 nt, Yersinia pestis KIM
gauauuuuaccaaugcacgu

SEQ ID NO: 4211039 - RNA, 21 nt, Yersinia pestis KIM
gauauuuucgacaaaaucagu

SEQ ID NO: 4211040 - RNA, 16 nt, Yersinia pestis KIM
gauauuuuuuugucug

SEQ ID NO: 4211041 - RNA, 19 nt, Yersinia pestis KIM
gauauuuuuuugucugacg

SEQ ID NO: 4211042 - RNA, 15 nt, Yersinia pestis KIM
gaucaaaagcagaga

SEQ ID NO: 4211043 - RNA, 18 nt, Yersinia pestis KIM
gaucaaacggauaaucgc

SEQ ID NO: 4211044 - RNA, 20 nt, Yersinia pestis KIM
gaucaacaggccaccuaaca

SEQ ID NO: 4211045 - RNA, 14 nt, Yersinia pestis KIM
gaucaacagugagg

SEQ ID NO: 4211046 - RNA, 14 nt, Yersinia pestis KIM
gaucaacauuaucu

SEQ ID NO: 4211047 - RNA, 18 nt, Yersinia pestis KIM
gaucaacgccucacaacu

SEQ ID NO: 4211048 - RNA, 21 nt, Yersinia pestis KIM
gaucaauaucccgagaaacaa

SEQ ID NO: 4211049 - RNA, 15 nt, Yersinia pestis KIM
gaucaaucucaucaa

SEQ ID NO: 4211050 - RNA, 17 nt, Yersinia pestis KIM
gaucaccagcaaaggcc

SEQ ID NO: 4211051 - RNA, 18 nt, Yersinia pestis KIM
gaucaccagcaaaggcca

SEQ ID NO: 4211052 - RNA, 16 nt, Yersinia pestis KIM
gaucacggauaucaau

SEQ ID NO: 4211053 - RNA, 17 nt, Yersinia pestis KIM
gaucagccaucagcgcc

SEQ ID NO: 4211054 - RNA, 17 nt, Yersinia pestis KIM
gaucagcgccugcuguu

SEQ ID NO: 4211055 - RNA, 16 nt, Yersinia pestis KIM
gaucaguaaacgguug

SEQ ID NO: 4211056 - RNA, 13 nt, Yersinia pestis KIM
gaucaguggcuua

SEQ ID NO: 4211057 - RNA, 13 nt, Yersinia pestis KIM
gaucaguggggua

SEQ ID NO: 4211058 - RNA, 14 nt, Yersinia pestis KIM
gaucaguucaguau

SEQ ID NO: 4211059 - RNA, 16 nt, Yersinia pestis KIM
gaucauaagccgcaga

SEQ ID NO: 4211060 - RNA, 14 nt, Yersinia pestis KIM
gaucaucagcagca

SEQ ID NO: 4211061 - RNA, 15 nt, Yersinia pestis KIM
gaucaucagcagcag

SEQ ID NO: 4211062 - RNA, 16 nt, Yersinia pestis KIM
gaucaucagcagcagg

SEQ ID NO: 4211063 - RNA, 20 nt, Yersinia pestis KIM
gaucaucgggcauucacugc

SEQ ID NO: 4211064 - RNA, 22 nt, Yersinia pestis KIM
gaucaucgggcauucacugcua

SEQ ID NO: 4211065 - RNA, 22 nt, Yersinia pestis KIM
gaucaucugguuuuuuuauaaa

SEQ ID NO: 4211066 - RNA, 19 nt, Yersinia pestis KIM
gaucaugaaaaaugagcaa

SEQ ID NO: 4211067 - RNA, 19 nt, Yersinia pestis KIM
gaucaugcucaccauguac

SEQ ID NO: 4211068 - RNA, 22 nt, Yersinia pestis KIM
gaucauggcuugugcagcaaua

SEQ ID NO: 4211069 - RNA, 12 nt, Yersinia pestis KIM
gaucaugggaaa

SEQ ID NO: 4211070 - RNA, 20 nt, Yersinia pestis KIM
gaucauuucccccaccugau

SEQ ID NO: 4211071 - RNA, 16 nt, Yersinia pestis KIM
gauccacauucugugu

SEQ ID NO: 4211072 - RNA, 14 nt, Yersinia pestis KIM
gauccaccacauca

SEQ ID NO: 4211073 - RNA, 18 nt, Yersinia pestis KIM
gauccacuuauaucucca

SEQ ID NO: 4211074 - RNA, 20 nt, Yersinia pestis KIM
gauccaguuucaguggcuuc

SEQ ID NO: 4211075 - RNA, 16 nt, Yersinia pestis KIM
gaucccaaaagaaaau

SEQ ID NO: 4211076 - RNA, 16 nt, Yersinia pestis KIM
gaucccaagcaggaaa

SEQ ID NO: 4211077 - RNA, 16 nt, Yersinia pestis KIM
gaucccacugcccgaa

SEQ ID NO: 4211078 - RNA, 21 nt, Yersinia pestis KIM
gauccgauaaacuucacaaug

SEQ ID NO: 4211079 - RNA, 22 nt, Yersinia pestis KIM
gauccgcgauaacguuguuucu

SEQ ID NO: 4211080 - RNA, 15 nt, Yersinia pestis KIM
gauccgggaaaaaau

SEQ ID NO: 4211081 - RNA, 17 nt, Yersinia pestis KIM
gauccgggaaaaaauac

SEQ ID NO: 4211082 - RNA, 20 nt, Yersinia pestis KIM
gauccucaucacugccguca

SEQ ID NO: 4211083 - RNA, 18 nt, Yersinia pestis KIM
gauuccgguacugugcug

SEQ ID NO: 4211084 - RNA, 22 nt, Yersinia pestis KIM
gauuccuguugaccaauccggu

SEQ ID NO: 4211085 - RNA, 19 nt, Yersinia pestis KIM
gauucgcaaagcgggccag

SEQ ID NO: 4211086 - RNA, 21 nt, Yersinia pestis KIM
gauucgcggcagagaucaugu

SEQ ID NO: 4211087 - RNA, 19 nt, Yersinia pestis KIM
gauucggauaaccgcauuc

SEQ ID NO: 4211088 - RNA, 12 nt, Yersinia pestis KIM
gauucgggugag

SEQ ID NO: 4211089 - RNA, 17 nt, Yersinia pestis KIM
gauucgggugagugaac

SEQ ID NO: 4211090 - RNA, 19 nt, Yersinia pestis KIM
gauucguagaaacaucgcc

SEQ ID NO: 4211091 - RNA, 14 nt, Yersinia pestis KIM
gauucucggcaugc

SEQ ID NO: 4211092 - RNA, 15 nt, Yersinia pestis KIM
gauucucggcgggga

SEQ ID NO: 4211093 - RNA, 18 nt, Yersinia pestis KIM
gauugaccaucaaccgug

SEQ ID NO: 4211094 - RNA, 19 nt, Yersinia pestis KIM
gauugacugaaugugaaga

SEQ ID NO: 4211095 - RNA, 15 nt, Yersinia pestis KIM
gauugcaaauccguc

SEQ ID NO: 4211096 - RNA, 20 nt, Yersinia pestis KIM
gauugcaacaacgccagaua

SEQ ID NO: 4211097 - RNA, 21 nt, Yersinia pestis KIM
gauugcagaccaaucaauaca

SEQ ID NO: 4211098 - RNA, 22 nt, Yersinia pestis KIM
gauugccgcaaggccauagaau

SEQ ID NO: 4211099 - RNA, 14 nt, Yersinia pestis KIM
gauugcugccaacg

SEQ ID NO: 4211100 - RNA, 22 nt, Yersinia pestis KIM
gauugcuggcgcugaucaucau

SEQ ID NO: 4211101 - RNA, 19 nt, Yersinia pestis KIM
gauugguacgggugugcug

SEQ ID NO: 4211102 - RNA, 14 nt, Yersinia pestis KIM
gauugguuauccua

SEQ ID NO: 4211103 - RNA, 18 nt, Yersinia pestis KIM
gauugugcuccagcacuu

SEQ ID NO: 4211104 - RNA, 18 nt, Yersinia pestis KIM
gauuguuacgccuucagc

SEQ ID NO: 4211105 - RNA, 17 nt, Yersinia pestis KIM
gauuuaauguucauuca

SEQ ID NO: 4211106 - RNA, 19 nt, Yersinia pestis KIM
gauuuacguguucuuaauu

SEQ ID NO: 4211107 - RNA, 19 nt, Yersinia pestis KIM
gauuuacguuuuuuuaaau

SEQ ID NO: 4211108 - RNA, 15 nt, Yersinia pestis KIM
gauuuauuagagaua

SEQ ID NO: 4211109 - RNA, 21 nt, Yersinia pestis KIM
gauuucaccuauaauuaacag

SEQ ID NO: 4211110 - RNA, 20 nt, Yersinia pestis KIM
gauuucacggauaucaacau

SEQ ID NO: 4211111 - RNA, 17 nt, Yersinia pestis KIM
gauuucagacugcugac

SEQ ID NO: 4211112 - RNA, 13 nt, Yersinia pestis KIM
gauuucaucagcg

SEQ ID NO: 4211113 - RNA, 14 nt, Yersinia pestis KIM
gauuucuucauuua

SEQ ID NO: 4211114 - RNA, 13 nt, Yersinia pestis KIM
gauuugaaccgcu

SEQ ID NO: 4211115 - RNA, 21 nt, Yersinia pestis KIM
gauuugaaccgcuaucugcug

SEQ ID NO: 4211116 - RNA, 19 nt, Yersinia pestis KIM
gauuugcgggcuaaaacug

SEQ ID NO: 4211117 - RNA, 12 nt, Yersinia pestis KIM
gauuugcucaga

SEQ ID NO: 4211118 - RNA, 16 nt, Yersinia pestis KIM
gauuugugcaaauaag

SEQ ID NO: 4211119 - RNA, 14 nt, Yersinia pestis KIM
gauuuguggauaac

SEQ ID NO: 4211120 - RNA, 15 nt, Yersinia pestis KIM
gauuuguuaaaacag

SEQ ID NO: 4211121 - RNA, 16 nt, Yersinia pestis KIM
gauuuguuaaaacagu

SEQ ID NO: 4211122 - RNA, 15 nt, Yersinia pestis KIM
gauuuguugaugaau

SEQ ID NO: 4211123 - RNA, 22 nt, Yersinia pestis KIM
gauuuguugaugaaugauggua

SEQ ID NO: 4211124 - RNA, 15 nt, Yersinia pestis KIM
gauuuuaagcacugc

SEQ ID NO: 4211125 - RNA, 18 nt, Yersinia pestis KIM
gauuuuuuaccugagaaa

SEQ ID NO: 4211126 - RNA, 20 nt, Yersinia pestis KIM
gauuuuuuacuuuuuccuua

SEQ ID NO: 4211127 - RNA, 23 nt, Yersinia pestis KIM
gauuuuuuaugucagagauaaac

SEQ ID NO: 4211128 - RNA, 12 nt, Yersinia pestis KIM
gauuuuuuguuc

SEQ ID NO: 4211129 - RNA, 17 nt, Yersinia pestis KIM
gcaaaaaaagacacuaa

SEQ ID NO: 4211130 - RNA, 21 nt, Yersinia pestis KIM
gcaaaaacagucauuaacaca

SEQ ID NO: 4211131 - RNA, 18 nt, Yersinia pestis KIM
gcaaaaacgccaucaaua

SEQ ID NO: 4211132 - RNA, 15 nt, Yersinia pestis KIM
gcaaaaagccagcga

SEQ ID NO: 4211133 - RNA, 14 nt, Yersinia pestis KIM
gcaaaaauuacagu

SEQ ID NO: 4211134 - RNA, 17 nt, Yersinia pestis KIM
gcaaaacacucagauca

SEQ ID NO: 4211135 - RNA, 21 nt, Yersinia pestis KIM
gcaaaacagauauuugcugcc

SEQ ID NO: 4211136 - RNA, 23 nt, Yersinia pestis KIM
gcaaaacggccaguaaucaaaca

SEQ ID NO: 4211137 - RNA, 17 nt, Yersinia pestis KIM
gcaaaacguauaaaagc

SEQ ID NO: 4211138 - RNA, 20 nt, Yersinia pestis KIM
gcaaaacugggcuugagagu

SEQ ID NO: 4211139 - RNA, 18 nt, Yersinia pestis KIM
gcaaaauaccgguggcau

SEQ ID NO: 4211140 - RNA, 21 nt, Yersinia pestis KIM
gcaaaauguguuuucugugcu

SEQ ID NO: 4211141 - RNA, 20 nt, Yersinia pestis KIM
gcaaacaggcccacugcaac

SEQ ID NO: 4211142 - RNA, 16 nt, Yersinia pestis KIM
gcaaacauccguuccc

SEQ ID NO: 4211143 - RNA, 16 nt, Yersinia pestis KIM
gcaaaccccgaaccaa

SEQ ID NO: 4211144 - RNA, 24 nt, Yersinia pestis KIM
gcaaaccgaauaccauaacgcugc

SEQ ID NO: 4211145 - RNA, 15 nt, Yersinia pestis KIM
gcaaacgaacgaaua

SEQ ID NO: 4211146 - RNA, 18 nt, Yersinia pestis KIM
gcaaacgaacgaauaauu

SEQ ID NO: 4211147 - RNA, 23 nt, Yersinia pestis KIM
gcaaacgccgcucuucagcauca

SEQ ID NO: 4211148 - RNA, 13 nt, Yersinia pestis KIM
gcaaacucagcca

SEQ ID NO: 4211149 - RNA, 13 nt, Yersinia pestis KIM
gcaaacuccucca

SEQ ID NO: 4211150 - RNA, 15 nt, Yersinia pestis KIM
gcaaagaagaauaag

SEQ ID NO: 4211151 - RNA, 22 nt, Yersinia pestis KIM
gcaaagacuacacacagcaaua

SEQ ID NO: 4211152 - RNA, 23 nt, Yersinia pestis KIM
gcaaagagaacgggcaaccugua

SEQ ID NO: 4211153 - RNA, 13 nt, Yersinia pestis KIM
gcaaagagucgca

SEQ ID NO: 4211154 - RNA, 15 nt, Yersinia pestis KIM
gcaaagcaucaauca

SEQ ID NO: 4211155 - RNA, 17 nt, Yersinia pestis KIM
gcaaagcgggccagcaa

SEQ ID NO: 4211156 - RNA, 22 nt, Yersinia pestis KIM
gcaaaguauuuauacauaccac

SEQ ID NO: 4211157 - RNA, 15 nt, Yersinia pestis KIM
gcaaaguuauugacc

SEQ ID NO: 4211158 - RNA, 24 nt, Yersinia pestis KIM
gcaaaguuauugaccaauauaaaa

SEQ ID NO: 4211159 - RNA, 15 nt, Yersinia pestis KIM
gcaaauaaacaaaau

SEQ ID NO: 4211160 - RNA, 14 nt, Yersinia pestis KIM
gcaaaucaaacaaa

SEQ ID NO: 4211161 - RNA, 18 nt, Yersinia pestis KIM
gcaaaucauaaaucaagg

SEQ ID NO: 4211162 - RNA, 13 nt, Yersinia pestis KIM
gcaaaucaucgcu

SEQ ID NO: 4211163 - RNA, 16 nt, Yersinia pestis KIM
gcaaauucccaccaua

SEQ ID NO: 4211164 - RNA, 17 nt, Yersinia pestis KIM
gcaaauugcugaaaaaa

SEQ ID NO: 4211165 - RNA, 12 nt, Yersinia pestis KIM
gcaaauuuagcc

SEQ ID NO: 4211166 - RNA, 19 nt, Yersinia pestis KIM
gcaaauuuagccgcaacua

SEQ ID NO: 4211167 - RNA, 14 nt, Yersinia pestis KIM
gcaaauuuauccaa

SEQ ID NO: 4211168 - RNA, 18 nt, Yersinia pestis KIM
gcaacaaaaucgcgacca

SEQ ID NO: 4211169 - RNA, 13 nt, Yersinia pestis KIM
gcaacaacacccg

SEQ ID NO: 4211170 - RNA, 24 nt, Yersinia pestis KIM
gcaacaacagauaaagcuugauca

SEQ ID NO: 4211171 - RNA, 15 nt, Yersinia pestis KIM
gcaacaaccccauga

SEQ ID NO: 4211172 - RNA, 15 nt, Yersinia pestis KIM
gcaacaauaaagcgg

SEQ ID NO: 4211173 - RNA, 16 nt, Yersinia pestis KIM
gcaacaauaaagcggu

SEQ ID NO: 4211174 - RNA, 14 nt, Yersinia pestis KIM
gcaacacccugugu

SEQ ID NO: 4211175 - RNA, 19 nt, Yersinia pestis KIM
gcaacagcgcucauagcaa

SEQ ID NO: 4211176 - RNA, 16 nt, Yersinia pestis KIM
gcaacauuaaaaauac

SEQ ID NO: 4211177 - RNA, 21 nt, Yersinia pestis KIM
gcaacauuauccguuugcaac

SEQ ID NO: 4211178 - RNA, 15 nt, Yersinia pestis KIM
gcaaccauauuaaac

SEQ ID NO: 4211179 - RNA, 15 nt, Yersinia pestis KIM
gcaaccgagaagucg

SEQ ID NO: 4211180 - RNA, 23 nt, Yersinia pestis KIM
gcaaccuggaauggcgcaauagc

SEQ ID NO: 4211181 - RNA, 21 nt, Yersinia pestis KIM
gcaacgaaaugucgaaagaua

SEQ ID NO: 4211182 - RNA, 18 nt, Yersinia pestis KIM
gcaacgacguuaucaaua

SEQ ID NO: 4211183 - RNA, 23 nt, Yersinia pestis KIM
gcaacgcacgauccgcccauugc

SEQ ID NO: 4211184 - RNA, 21 nt, Yersinia pestis KIM
gcaacguaauaucugccaccg

SEQ ID NO: 4211185 - RNA, 22 nt, Yersinia pestis KIM
gcaacguuuuaccugcacaggu

SEQ ID NO: 4211186 - RNA, 18 nt, Yersinia pestis KIM
gcaacuccuuaccacugc

SEQ ID NO: 4211187 - RNA, 21 nt, Yersinia pestis KIM
gcaacucuagcgccagcaauu

SEQ ID NO: 4211188 - RNA, 23 nt, Yersinia pestis KIM
gcaacucuucuucuguugcuuca

SEQ ID NO: 4211189 - RNA, 22 nt, Yersinia pestis KIM
gcaacugaguaguggagccacu

SEQ ID NO: 4211190 - RNA, 16 nt, Yersinia pestis KIM
gcaacugcaaauguuc

SEQ ID NO: 4211191 - RNA, 23 nt, Yersinia pestis KIM
gcaacuguaaugccccacuucac

SEQ ID NO: 4211192 - RNA, 14 nt, Yersinia pestis KIM
gcaacuucagccac

SEQ ID NO: 4211193 - RNA, 22 nt, Yersinia pestis KIM
gcaacuucagccaccagauuac

SEQ ID NO: 4211194 - RNA, 17 nt, Yersinia pestis KIM
gcaagaaacuucauuuc

SEQ ID NO: 4211195 - RNA, 17 nt, Yersinia pestis KIM
gcaagaaagaaaaauag

SEQ ID NO: 4211196 - RNA, 14 nt, Yersinia pestis KIM
gcaagaacaaucca

SEQ ID NO: 4211197 - RNA, 21 nt, Yersinia pestis KIM
gcacgacaacaaagccgcugc

SEQ ID NO: 4211198 - RNA, 19 nt, Yersinia pestis KIM
gcacgauccgcccauugcg

SEQ ID NO: 4211199 - RNA, 15 nt, Yersinia pestis KIM
gcacgcuuucugcaa

SEQ ID NO: 4211200 - RNA, 15 nt, Yersinia pestis KIM
gcacggcaacaggcu

SEQ ID NO: 4211201 - RNA, 15 nt, Yersinia pestis KIM
gcacggcaucgcugc

SEQ ID NO: 4211202 - RNA, 17 nt, Yersinia pestis KIM
gcacggccgggugcagc

SEQ ID NO: 4211203 - RNA, 12 nt, Yersinia pestis KIM
gcacgggcuauc

SEQ ID NO: 4211204 - RNA, 19 nt, Yersinia pestis KIM
gcacgguaguucaaguucu

SEQ ID NO: 4211205 - RNA, 14 nt, Yersinia pestis KIM
gcacgugccgcugg

SEQ ID NO: 4211206 - RNA, 16 nt, Yersinia pestis KIM
gcacguuuaauuucac

SEQ ID NO: 4211207 - RNA, 18 nt, Yersinia pestis KIM
gcacguuuuucagcuucu

SEQ ID NO: 4211208 - RNA, 15 nt, Yersinia pestis KIM
gcacuaaaccaucag

SEQ ID NO: 4211209 - RNA, 16 nt, Yersinia pestis KIM
gcacucagcauauugu

SEQ ID NO: 4211210 - RNA, 17 nt, Yersinia pestis KIM
gcacucgaaucacuuau

SEQ ID NO: 4211211 - RNA, 16 nt, Yersinia pestis KIM
gcacucgcaagacgau

SEQ ID NO: 4211212 - RNA, 17 nt, Yersinia pestis KIM
gcacugagccgaagaac

SEQ ID NO: 4211213 - RNA, 18 nt, Yersinia pestis KIM
gcacugagccgaagaaca

SEQ ID NO: 4211214 - RNA, 17 nt, Yersinia pestis KIM
gcacugauagccaacac

SEQ ID NO: 4211215 - RNA, 17 nt, Yersinia pestis KIM
gcacugauucucuucac

SEQ ID NO: 4211216 - RNA, 18 nt, Yersinia pestis KIM
gcacugauucucuucacc

SEQ ID NO: 4211217 - RNA, 21 nt, Yersinia pestis KIM
gcacugauuuuuucgaguagu

SEQ ID NO: 4211218 - RNA, 15 nt, Yersinia pestis KIM
gcacugcagaaaaug

SEQ ID NO: 4211219 - RNA, 17 nt, Yersinia pestis KIM
gcacugcagaaaaugcg

SEQ ID NO: 4211220 - RNA, 22 nt, Yersinia pestis KIM
gcacugcagaaaaugcggcggc

SEQ ID NO: 4211221 - RNA, 17 nt, Yersinia pestis KIM
gcacuggcguuggcaau

SEQ ID NO: 4211222 - RNA, 22 nt, Yersinia pestis KIM
gcacugggaucugaucaaucuc

SEQ ID NO: 4211223 - RNA, 23 nt, Yersinia pestis KIM
gcacugggucaucacccagcaaa

SEQ ID NO: 4211224 - RNA, 18 nt, Yersinia pestis KIM
gcacugucugagcaaaag

SEQ ID NO: 4211225 - RNA, 22 nt, Yersinia pestis KIM
gcacuguugaccgacucauuaa

SEQ ID NO: 4211226 - RNA, 14 nt, Yersinia pestis KIM
gcacuucaaccuga

SEQ ID NO: 4211227 - RNA, 16 nt, Yersinia pestis KIM
gcacuucaaccugauc

SEQ ID NO: 4211228 - RNA, 20 nt, Yersinia pestis KIM
gcacuuggccccaucaucuc

SEQ ID NO: 4211229 - RNA, 21 nt, Yersinia pestis KIM
gcacuuggccccaucaucucu

SEQ ID NO: 4211230 - RNA, 19 nt, Yersinia pestis KIM
gcacuuguuuugccaguuu

SEQ ID NO: 4211231 - RNA, 22 nt, Yersinia pestis KIM
gcacuuuuauacauucgagcua

SEQ ID NO: 4211232 - RNA, 14 nt, Yersinia pestis KIM
gcagaaagcagcag

SEQ ID NO: 4211233 - RNA, 13 nt, Yersinia pestis KIM
gcagaaagugacc

SEQ ID NO: 4211234 - RNA, 16 nt, Yersinia pestis KIM
gcagaagaauaucugc

SEQ ID NO: 4211235 - RNA, 17 nt, Yersinia pestis KIM
gcagaagaguaaagcgu

SEQ ID NO: 4211236 - RNA, 13 nt, Yersinia pestis KIM
gcagacagcgagc

SEQ ID NO: 4211237 - RNA, 16 nt, Yersinia pestis KIM
gcagaccgacauucca

SEQ ID NO: 4211238 - RNA, 20 nt, Yersinia pestis KIM
gcagacggcguaagccuuca

SEQ ID NO: 4211239 - RNA, 16 nt, Yersinia pestis KIM
gcagacucuuauauaa

SEQ ID NO: 4211240 - RNA, 21 nt, Yersinia pestis KIM
gcagacucuuauauaaaucca

SEQ ID NO: 4211241 - RNA, 23 nt, Yersinia pestis KIM
gcagagaugcagagaugcagaga

SEQ ID NO: 4211242 - RNA, 12 nt, Yersinia pestis KIM
gcagaggaguaa

SEQ ID NO: 4211243 - RNA, 19 nt, Yersinia pestis KIM
gcagagucgcaaaaaauau

SEQ ID NO: 4211244 - RNA, 21 nt, Yersinia pestis KIM
gcagaguucggucauaaaaac

SEQ ID NO: 4211245 - RNA, 18 nt, Yersinia pestis KIM
gcagauaauccccuugug

SEQ ID NO: 4211246 - RNA, 21 nt, Yersinia pestis KIM
gcagauacuggaagccgacga

SEQ ID NO: 4211247 - RNA, 19 nt, Yersinia pestis KIM
gcagauaugaugcggaaga

SEQ ID NO: 4211248 - RNA, 15 nt, Yersinia pestis KIM
gcagaucguaaagac

SEQ ID NO: 4211249 - RNA, 21 nt, Yersinia pestis KIM
gcagaucguaaagacgccgua

SEQ ID NO: 4211250 - RNA, 20 nt, Yersinia pestis KIM
gcagaugaggcccauggacg

SEQ ID NO: 4211251 - RNA, 20 nt, Yersinia pestis KIM
gcagauggugggcaucaaaa

SEQ ID NO: 4211252 - RNA, 12 nt, Yersinia pestis KIM
gcagauuucacc

SEQ ID NO: 4211253 - RNA, 18 nt, Yersinia pestis KIM
gcagauuuguacgugacu

SEQ ID NO: 4211254 - RNA, 14 nt, Yersinia pestis KIM
gcagcaagaacaau

SEQ ID NO: 4211255 - RNA, 22 nt, Yersinia pestis KIM
gcagcaaguuagcgauaucugc

SEQ ID NO: 4211256 - RNA, 15 nt, Yersinia pestis KIM
gcagcacaccggcca

SEQ ID NO: 4211257 - RNA, 17 nt, Yersinia pestis KIM
gcagcagacaacugaca

SEQ ID NO: 4211258 - RNA, 13 nt, Yersinia pestis KIM
gcagcagagaaug

SEQ ID NO: 4211259 - RNA, 18 nt, Yersinia pestis KIM
gcagcagggcuuucacau

SEQ ID NO: 4211260 - RNA, 22 nt, Yersinia pestis KIM
gcagcagugccugguuuuacgc

SEQ ID NO: 4211261 - RNA, 18 nt, Yersinia pestis KIM
gcagcaucccaaugaaua

SEQ ID NO: 4211262 - RNA, 20 nt, Yersinia pestis KIM
gcagcaugacggagcuauca

SEQ ID NO: 4211263 - RNA, 14 nt, Yersinia pestis KIM
gcagccaaaauaau

SEQ ID NO: 4211264 - RNA, 15 nt, Yersinia pestis KIM
gcagcccuuauucaa

SEQ ID NO: 4211265 - RNA, 20 nt, Yersinia pestis KIM
gcagcccuuauucaaagaau

SEQ ID NO: 4211266 - RNA, 10 nt, Yersinia pestis KIM
gcagccgccg

SEQ ID NO: 4211267 - RNA, 14 nt, Yersinia pestis KIM
gcagccgccgcugg

SEQ ID NO: 4211268 - RNA, 15 nt, Yersinia pestis KIM
gcagccugcggcggc

SEQ ID NO: 4211269 - RNA, 18 nt, Yersinia pestis KIM
gcagccuuuauccagcca

SEQ ID NO: 4211270 - RNA, 22 nt, Yersinia pestis KIM
gcagccuuuauccagccaccuu

SEQ ID NO: 4211271 - RNA, 15 nt, Yersinia pestis KIM
gcagcgagcacugcc

SEQ ID NO: 4211272 - RNA, 17 nt, Yersinia pestis KIM
gcagcgcgcagccaacg

SEQ ID NO: 4211273 - RNA, 21 nt, Yersinia pestis KIM
gcagcgcuggugcuggugaau

SEQ ID NO: 4211274 - RNA, 18 nt, Yersinia pestis KIM
gcagcguaggcaacuaag

SEQ ID NO: 4211275 - RNA, 20 nt, Yersinia pestis KIM
gcagcguaggcaacuaagcu

SEQ ID NO: 4211276 - RNA, 20 nt, Yersinia pestis KIM
gcagcguagguaacuaagcu

SEQ ID NO: 4211277 - RNA, 17 nt, Yersinia pestis KIM
gcagcguauucaguaaa

SEQ ID NO: 4211278 - RNA, 15 nt, Yersinia pestis KIM
gcagcgucaaggucg

SEQ ID NO: 4211279 - RNA, 17 nt, Yersinia pestis KIM
gcagcgucauggucuca

SEQ ID NO: 4211280 - RNA, 16 nt, Yersinia pestis KIM
gcagcucaaaaucuuc

SEQ ID NO: 4211281 - RNA, 17 nt, Yersinia pestis KIM
gcagcuuggcgucugac

SEQ ID NO: 4211282 - RNA, 13 nt, Yersinia pestis KIM
gcagcuuggggau

SEQ ID NO: 4211283 - RNA, 14 nt, Yersinia pestis KIM
gcagcuuguugaua

SEQ ID NO: 4211284 - RNA, 21 nt, Yersinia pestis KIM
gcagcuuuugugcaggaguaa

SEQ ID NO: 4211285 - RNA, 22 nt, Yersinia pestis KIM
gcaggaaauugccgcaucagcc

SEQ ID NO: 4211286 - RNA, 22 nt, Yersinia pestis KIM
gcaggaaguuauggaugaccaa

SEQ ID NO: 4211287 - RNA, 13 nt, Yersinia pestis KIM
gcaggauuucaau

SEQ ID NO: 4211288 - RNA, 12 nt, Yersinia pestis KIM
gcaggcaaacaa

SEQ ID NO: 4211289 - RNA, 22 nt, Yersinia pestis KIM
gcaggcaaacaaugugccgcgc

SEQ ID NO: 4211290 - RNA, 18 nt, Yersinia pestis KIM
gcaggcacugcagaaaau

SEQ ID NO: 4211291 - RNA, 22 nt, Yersinia pestis KIM
gcaggccagacccauuucugcu

SEQ ID NO: 4211292 - RNA, 18 nt, Yersinia pestis KIM
gcaggcccagcagugcug

SEQ ID NO: 4211293 - RNA, 21 nt, Yersinia pestis KIM
gcaggccccaucauaaaggcu

SEQ ID NO: 4211294 - RNA, 14 nt, Yersinia pestis KIM
gcaggcccugguug

SEQ ID NO: 4211295 - RNA, 15 nt, Yersinia pestis KIM
gcaggcggaugauga

SEQ ID NO: 4211296 - RNA, 18 nt, Yersinia pestis KIM
gcaggcggcgauacaacg

SEQ ID NO: 4211297 - RNA, 14 nt, Yersinia pestis KIM
gcaggcuucaacua

SEQ ID NO: 4211298 - RNA, 22 nt, Yersinia pestis KIM
gcagggaaagguagaucgggga

SEQ ID NO: 4211299 - RNA, 13 nt, Yersinia pestis KIM
gcagggaaccugg

SEQ ID NO: 4211300 - RNA, 23 nt, Yersinia pestis KIM
gcagggaauggauuaucggcggc

SEQ ID NO: 4211301 - RNA, 12 nt, Yersinia pestis KIM
gcagggagugaa

SEQ ID NO: 4211302 - RNA, 21 nt, Yersinia pestis KIM
gcagggccgcccagauaaaga

SEQ ID NO: 4211303 - RNA, 19 nt, Yersinia pestis KIM
gcagggccgguuaauugaa

SEQ ID NO: 4211304 - RNA, 20 nt, Yersinia pestis KIM
gcaggggguuagcugcaagc

SEQ ID NO: 4211305 - RNA, 15 nt, Yersinia pestis KIM
gcaggguauuuucuc

SEQ ID NO: 4211306 - RNA, 20 nt, Yersinia pestis KIM
gcaggguggagagaaaggcu

SEQ ID NO: 4211307 - RNA, 19 nt, Yersinia pestis KIM
gcagguagggcggcccacu

SEQ ID NO: 4211308 - RNA, 22 nt, Yersinia pestis KIM
gcagguauaggcgcagaauuag

SEQ ID NO: 4211309 - RNA, 22 nt, Yersinia pestis KIM
gcaggucucgcaaugaaagugg

SEQ ID NO: 4211310 - RNA, 12 nt, Yersinia pestis KIM
gcagguggaucc

SEQ ID NO: 4211311 - RNA, 22 nt, Yersinia pestis KIM
gcauuaucuaaacaauugccuu

SEQ ID NO: 4211312 - RNA, 21 nt, Yersinia pestis KIM
gcauucauaucguccaaaggg

SEQ ID NO: 4211313 - RNA, 15 nt, Yersinia pestis KIM
gcauucauuucuuug

SEQ ID NO: 4211314 - RNA, 17 nt, Yersinia pestis KIM
gcauugaccgccaaauc

SEQ ID NO: 4211315 - RNA, 23 nt, Yersinia pestis KIM
gcauugacgauaucaauaaagaa

SEQ ID NO: 4211316 - RNA, 20 nt, Yersinia pestis KIM
gcauugaguuucaaugccaa

SEQ ID NO: 4211317 - RNA, 16 nt, Yersinia pestis KIM
gcauugcaugaugaau

SEQ ID NO: 4211318 - RNA, 14 nt, Yersinia pestis KIM
gcauuggcaaauca

SEQ ID NO: 4211319 - RNA, 20 nt, Yersinia pestis KIM
gcauuggguaauaucaccau

SEQ ID NO: 4211320 - RNA, 15 nt, Yersinia pestis KIM
gcauuucauuaaaug

SEQ ID NO: 4211321 - RNA, 17 nt, Yersinia pestis KIM
gcauuucauuaaaugcu

SEQ ID NO: 4211322 - RNA, 18 nt, Yersinia pestis KIM
gcauuucuuuuucaacuc

SEQ ID NO: 4211323 - RNA, 18 nt, Yersinia pestis KIM
gcauuuuaucuucuucag

SEQ ID NO: 4211324 - RNA, 14 nt, Yersinia pestis KIM
gcauuuuuugccag

SEQ ID NO: 4211325 - RNA, 16 nt, Yersinia pestis KIM
gcauuuuuugccagau

SEQ ID NO: 4211326 - RNA, 22 nt, Yersinia pestis KIM
gcauuuuuuucacaccacggcg

SEQ ID NO: 4211327 - RNA, 15 nt, Yersinia pestis KIM
gccaaaaaaagggcg

SEQ ID NO: 4211328 - RNA, 20 nt, Yersinia pestis KIM
gccaaaaaauaagggccacc

SEQ ID NO: 4211329 - RNA, 18 nt, Yersinia pestis KIM
gccaaaauaauuaccguu

SEQ ID NO: 4211330 - RNA, 19 nt, Yersinia pestis KIM
gccaaacgugcuacuuaau

SEQ ID NO: 4211331 - RNA, 23 nt, Yersinia pestis KIM
gccaaacgugcuacuuaauaucu

SEQ ID NO: 4211332 - RNA, 20 nt, Yersinia pestis KIM
gccaaauacauauaaccauc

SEQ ID NO: 4211333 - RNA, 19 nt, Yersinia pestis KIM
gccaaaucaucagacagcc

SEQ ID NO: 4211334 - RNA, 15 nt, Yersinia pestis KIM
gccaaaugaaaauau

SEQ ID NO: 4211335 - RNA, 20 nt, Yersinia pestis KIM
gccaaaugaaaauauucauu

SEQ ID NO: 4211336 - RNA, 17 nt, Yersinia pestis KIM
gccaaaugcaaaccagg

SEQ ID NO: 4211337 - RNA, 13 nt, Yersinia pestis KIM
gccaaaugucacc

SEQ ID NO: 4211338 - RNA, 21 nt, Yersinia pestis KIM
gccaacaacuggguggccagu

SEQ ID NO: 4211339 - RNA, 19 nt, Yersinia pestis KIM
gccaacacucaugacaaaa

SEQ ID NO: 4211340 - RNA, 13 nt, Yersinia pestis KIM
gccaacaggcccc

SEQ ID NO: 4211341 - RNA, 15 nt, Yersinia pestis KIM
gccaacaggccccuu

SEQ ID NO: 4211342 - RNA, 18 nt, Yersinia pestis KIM
gccaacagugaauaacug

SEQ ID NO: 4211343 - RNA, 21 nt, Yersinia pestis KIM
gccaacaucgcgcugcuuucc

SEQ ID NO: 4211344 - RNA, 22 nt, Yersinia pestis KIM
gccaaccggauaaaacaauagc

SEQ ID NO: 4211345 - RNA, 22 nt, Yersinia pestis KIM
gccaacgauaaugacauaauca

SEQ ID NO: 4211346 - RNA, 14 nt, Yersinia pestis KIM
gccaacgucucuuc

SEQ ID NO: 4211347 - RNA, 11 nt, Yersinia pestis KIM
gccaacgugua

SEQ ID NO: 4211348 - RNA, 21 nt, Yersinia pestis KIM
gccaacucagcggccugggua

SEQ ID NO: 4211349 - RNA, 13 nt, Yersinia pestis KIM
gccaacuggcgca

SEQ ID NO: 4211350 - RNA, 15 nt, Yersinia pestis KIM
gccaagccaguaauu

SEQ ID NO: 4211351 - RNA, 20 nt, Yersinia pestis KIM
gccaagcgccgugcauaaug

SEQ ID NO: 4211352 - RNA, 13 nt, Yersinia pestis KIM
gccaagcuaacgc

SEQ ID NO: 4211353 - RNA, 20 nt, Yersinia pestis KIM
gccaagguccaacucccaaa

SEQ ID NO: 4211354 - RNA, 16 nt, Yersinia pestis KIM
gccaauaaccgcagca

SEQ ID NO: 4211355 - RNA, 19 nt, Yersinia pestis KIM
gccaauaaccgcagcaggc

SEQ ID NO: 4211356 - RNA, 22 nt, Yersinia pestis KIM
gccaauagaaaaacacuggcag

SEQ ID NO: 4211357 - RNA, 20 nt, Yersinia pestis KIM
gccaauagacaaaagugacg

SEQ ID NO: 4211358 - RNA, 21 nt, Yersinia pestis KIM
gccaauagacaaaagugacga

SEQ ID NO: 4211359 - RNA, 15 nt, Yersinia pestis KIM
gccaauagaggcucc

SEQ ID NO: 4211360 - RNA, 13 nt, Yersinia pestis KIM
gccaauaggcccc

SEQ ID NO: 4211361 - RNA, 14 nt, Yersinia pestis KIM
gccaauaggccccu

SEQ ID NO: 4211362 - RNA, 15 nt, Yersinia pestis KIM
gccaauaggccccuc

SEQ ID NO: 4211363 - RNA, 18 nt, Yersinia pestis KIM
gccaauauccauauuaaa

SEQ ID NO: 4211364 - RNA, 19 nt, Yersinia pestis KIM
gccaauauguuagcagcac

SEQ ID NO: 4211365 - RNA, 15 nt, Yersinia pestis KIM
gccaaucaaaaugac

SEQ ID NO: 4211366 - RNA, 13 nt, Yersinia pestis KIM
gccaauccuuccu

SEQ ID NO: 4211367 - RNA, 22 nt, Yersinia pestis KIM
gccaaugccaagaauaauuacu

SEQ ID NO: 4211368 - RNA, 18 nt, Yersinia pestis KIM
gccaaugccucuucaaua

SEQ ID NO: 4211369 - RNA, 23 nt, Yersinia pestis KIM
gccaaugccuuagguaagucagc

SEQ ID NO: 4211370 - RNA, 22 nt, Yersinia pestis KIM
gccaaugcgguuuuucuugcca

SEQ ID NO: 4211371 - RNA, 14 nt, Yersinia pestis KIM
gccaaugcugcugu

SEQ ID NO: 4211372 - RNA, 15 nt, Yersinia pestis KIM
gccaauggccacugc

SEQ ID NO: 4211373 - RNA, 20 nt, Yersinia pestis KIM
gccaauggccacugcgggca

SEQ ID NO: 4211374 - RNA, 23 nt, Yersinia pestis KIM
gccaauggccacugcgggcagua

SEQ ID NO: 4211375 - RNA, 24 nt, Yersinia pestis KIM
gccaauguaugaccgguuuauaca

SEQ ID NO: 4211376 - RNA, 23 nt, Yersinia pestis KIM
gccaauucguuuuucauuuuucu

SEQ ID NO: 4211377 - RNA, 13 nt, Yersinia pestis KIM
gccaauugcaucg

SEQ ID NO: 4211378 - RNA, 21 nt, Yersinia pestis KIM
gccaauuggucaugaugaaua

SEQ ID NO: 4211379 - RNA, 21 nt, Yersinia pestis KIM
gccaauuucaguaaucguuua

SEQ ID NO: 4211380 - RNA, 18 nt, Yersinia pestis KIM
gccaauuuggggcugcuu

SEQ ID NO: 4211381 - RNA, 16 nt, Yersinia pestis KIM
gccacaacccaauaau

SEQ ID NO: 4211382 - RNA, 17 nt, Yersinia pestis KIM
gccacacauucagucac

SEQ ID NO: 4211383 - RNA, 14 nt, Yersinia pestis KIM
gccacacucagaca

SEQ ID NO: 4211384 - RNA, 14 nt, Yersinia pestis KIM
gccacagcaacagg

SEQ ID NO: 4211385 - RNA, 16 nt, Yersinia pestis KIM
gccacagucgccguca

SEQ ID NO: 4211386 - RNA, 17 nt, Yersinia pestis KIM
gccaccaaauaaaacaa

SEQ ID NO: 4211387 - RNA, 18 nt, Yersinia pestis KIM
gccacccugccaaaaaau

SEQ ID NO: 4211388 - RNA, 23 nt, Yersinia pestis KIM
gccaccgcacaguuaauuuucac

SEQ ID NO: 4211389 - RNA, 17 nt, Yersinia pestis KIM
gccaccgcauuccagcg

SEQ ID NO: 4211390 - RNA, 20 nt, Yersinia pestis KIM
gccaccgcucgucacacugg

SEQ ID NO: 4211391 - RNA, 15 nt, Yersinia pestis KIM
gccaccggcaguuca

SEQ ID NO: 4211392 - RNA, 19 nt, Yersinia pestis KIM
gccaccggcaguucauucc

SEQ ID NO: 4211393 - RNA, 13 nt, Yersinia pestis KIM
gccaccucacuca

SEQ ID NO: 4211394 - RNA, 15 nt, Yersinia pestis KIM
gccaccucacucagc

SEQ ID NO: 4211395 - RNA, 20 nt, Yersinia pestis KIM
gccacgaccauucgcaggcc

SEQ ID NO: 4211396 - RNA, 17 nt, Yersinia pestis KIM
gccacgaugugaagcaa

SEQ ID NO: 4211397 - RNA, 17 nt, Yersinia pestis KIM
gccacgccaguaaacag

SEQ ID NO: 4211398 - RNA, 21 nt, Yersinia pestis KIM
gccacgccaguaaacagccag

SEQ ID NO: 4211399 - RNA, 22 nt, Yersinia pestis KIM
gccacgccaguaaacagccagc

SEQ ID NO: 4211400 - RNA, 14 nt, Yersinia pestis KIM
gccacgcuguguca

SEQ ID NO: 4211401 - RNA, 21 nt, Yersinia pestis KIM
gccacggcgagaccuacucgc

SEQ ID NO: 4211402 - RNA, 23 nt, Yersinia pestis KIM
gccacgggcauccgcuucgcugg

SEQ ID NO: 4211403 - RNA, 21 nt, Yersinia pestis KIM
gccacuacggcgacuugccgu

SEQ ID NO: 4211404 - RNA, 16 nt, Yersinia pestis KIM
gccacucacauaagaa

SEQ ID NO: 4211405 - RNA, 14 nt, Yersinia pestis KIM
gccacucuagcugu

SEQ ID NO: 4211406 - RNA, 20 nt, Yersinia pestis KIM
gccacucuagcuguguuuua

SEQ ID NO: 4211407 - RNA, 14 nt, Yersinia pestis KIM
gccacugacugcuu

SEQ ID NO: 4211408 - RNA, 19 nt, Yersinia pestis KIM
gccacugagcaaacagugc

SEQ ID NO: 4211409 - RNA, 12 nt, Yersinia pestis KIM
gccacuucggug

SEQ ID NO: 4211410 - RNA, 18 nt, Yersinia pestis KIM
gccacuucgguggcccuu

SEQ ID NO: 4211411 - RNA, 15 nt, Yersinia pestis KIM
gccagaacagcaggc

SEQ ID NO: 4211412 - RNA, 18 nt, Yersinia pestis KIM
gccagaauaucguggaga

SEQ ID NO: 4211413 - RNA, 15 nt, Yersinia pestis KIM
gccagaaucagcccc

SEQ ID NO: 4211414 - RNA, 13 nt, Yersinia pestis KIM
gccagacacaaug

SEQ ID NO: 4211415 - RNA, 15 nt, Yersinia pestis KIM
gccagagagcugaga

SEQ ID NO: 4211416 - RNA, 15 nt, Yersinia pestis KIM
gccagagcuugcugg

SEQ ID NO: 4211417 - RNA, 17 nt, Yersinia pestis KIM
gccagauagaccccuuc

SEQ ID NO: 4211418 - RNA, 16 nt, Yersinia pestis KIM
gccagauagucaucuu

SEQ ID NO: 4211419 - RNA, 19 nt, Yersinia pestis KIM
gccagauccguaccaccac

SEQ ID NO: 4211420 - RNA, 19 nt, Yersinia pestis KIM
gccagauccucuuuauugg

SEQ ID NO: 4211421 - RNA, 20 nt, Yersinia pestis KIM
gccagauucgcaaagcgggc

SEQ ID NO: 4211422 - RNA, 20 nt, Yersinia pestis KIM
gccagauugccaaucagaac

SEQ ID NO: 4211423 - RNA, 22 nt, Yersinia pestis KIM
gccagauugugcuccagcacuu

SEQ ID NO: 4211424 - RNA, 14 nt, Yersinia pestis KIM
gccagcaaaucaca

SEQ ID NO: 4211425 - RNA, 16 nt, Yersinia pestis KIM
gcccagccucuggaua

SEQ ID NO: 4211426 - RNA, 17 nt, Yersinia pestis KIM
gcccagcggccaugacg

SEQ ID NO: 4211427 - RNA, 16 nt, Yersinia pestis KIM
gcccaguggagccaug

SEQ ID NO: 4211428 - RNA, 20 nt, Yersinia pestis KIM
gcccauaaacccgauuccau

SEQ ID NO: 4211429 - RNA, 16 nt, Yersinia pestis KIM
gcccauagaugggcca

SEQ ID NO: 4211430 - RNA, 19 nt, Yersinia pestis KIM
gcccauauagcggcguuca

SEQ ID NO: 4211431 - RNA, 19 nt, Yersinia pestis KIM
gcccauaucuuuaaaaacc

SEQ ID NO: 4211432 - RNA, 11 nt, Yersinia pestis KIM
gcccaucagca

SEQ ID NO: 4211433 - RNA, 18 nt, Yersinia pestis KIM
gcccauccgcaggaagca

SEQ ID NO: 4211434 - RNA, 19 nt, Yersinia pestis KIM
gcccauccuguucaaaagg

SEQ ID NO: 4211435 - RNA, 21 nt, Yersinia pestis KIM
gcccaucuaugggcuucgcca

SEQ ID NO: 4211436 - RNA, 14 nt, Yersinia pestis KIM
gcccaugaccacuu

SEQ ID NO: 4211437 - RNA, 20 nt, Yersinia pestis KIM
gcccauggcugaaauaacuu

SEQ ID NO: 4211438 - RNA, 13 nt, Yersinia pestis KIM
gccccaaaugcca

SEQ ID NO: 4211439 - RNA, 18 nt, Yersinia pestis KIM
gccccaacacuggggcgc

SEQ ID NO: 4211440 - RNA, 17 nt, Yersinia pestis KIM
gccccaauagauagaga

SEQ ID NO: 4211441 - RNA, 15 nt, Yersinia pestis KIM
gccccaaucaccggc

SEQ ID NO: 4211442 - RNA, 12 nt, Yersinia pestis KIM
gccccacauuac

SEQ ID NO: 4211443 - RNA, 22 nt, Yersinia pestis KIM
gccccaccgauauugauagcca

SEQ ID NO: 4211444 - RNA, 17 nt, Yersinia pestis KIM
gccccagcccagcaggc

SEQ ID NO: 4211445 - RNA, 12 nt, Yersinia pestis KIM
gccccaucagca

SEQ ID NO: 4211446 - RNA, 22 nt, Yersinia pestis KIM
gccccauccugacgaaugacuc

SEQ ID NO: 4211447 - RNA, 22 nt, Yersinia pestis KIM
gccccaugguuacgccagcagc

SEQ ID NO: 4211448 - RNA, 21 nt, Yersinia pestis KIM
gcccccaauaagggccacccu

SEQ ID NO: 4211449 - RNA, 14 nt, Yersinia pestis KIM
gcccccaaugacac

SEQ ID NO: 4211450 - RNA, 22 nt, Yersinia pestis KIM
gcccccaucacuagggggcaau

SEQ ID NO: 4211451 - RNA, 18 nt, Yersinia pestis KIM
gcccccuagugauggggg

SEQ ID NO: 4211452 - RNA, 15 nt, Yersinia pestis KIM
gccccggugacaaag

SEQ ID NO: 4211453 - RNA, 20 nt, Yersinia pestis KIM
gccccuaagaaucggccagu

SEQ ID NO: 4211454 - RNA, 17 nt, Yersinia pestis KIM
gccccuguuugcgcagc

SEQ ID NO: 4211455 - RNA, 15 nt, Yersinia pestis KIM
gccccuugcuucagu

SEQ ID NO: 4211456 - RNA, 16 nt, Yersinia pestis KIM
gcccgauccccugcuu

SEQ ID NO: 4211457 - RNA, 14 nt, Yersinia pestis KIM
gcccgauucaccuu

SEQ ID NO: 4211458 - RNA, 16 nt, Yersinia pestis KIM
gcccgcaacgggagag

SEQ ID NO: 4211459 - RNA, 21 nt, Yersinia pestis KIM
gcccgcacacugagccgcccu

SEQ ID NO: 4211460 - RNA, 21 nt, Yersinia pestis KIM
gcccgcagcggcuagcagcag

SEQ ID NO: 4211461 - RNA, 16 nt, Yersinia pestis KIM
gcccgccggguaaaug

SEQ ID NO: 4211462 - RNA, 12 nt, Yersinia pestis KIM
gcccgcuaucac

SEQ ID NO: 4211463 - RNA, 21 nt, Yersinia pestis KIM
gcccgcuaucacuagcgggcc

SEQ ID NO: 4211464 - RNA, 14 nt, Yersinia pestis KIM
gcccgcuucccuac

SEQ ID NO: 4211465 - RNA, 15 nt, Yersinia pestis KIM
gcccggaagccguga

SEQ ID NO: 4211466 - RNA, 14 nt, Yersinia pestis KIM
gcccggcauggacg

SEQ ID NO: 4211467 - RNA, 18 nt, Yersinia pestis KIM
gcccggcucauccgccaa

SEQ ID NO: 4211468 - RNA, 22 nt, Yersinia pestis KIM
gcccggcugauauaacaaguua

SEQ ID NO: 4211469 - RNA, 17 nt, Yersinia pestis KIM
gcccguugcccaccgag

SEQ ID NO: 4211470 - RNA, 22 nt, Yersinia pestis KIM
gcccuaaccgcuuuuuacccag

SEQ ID NO: 4211471 - RNA, 13 nt, Yersinia pestis KIM
gcccuaacugcuc

SEQ ID NO: 4211472 - RNA, 20 nt, Yersinia pestis KIM
gcccuaauauccucaaaauu

SEQ ID NO: 4211473 - RNA, 12 nt, Yersinia pestis KIM
gcccuacuggcu

SEQ ID NO: 4211474 - RNA, 15 nt, Yersinia pestis KIM
gcccuacuggcugaa

SEQ ID NO: 4211475 - RNA, 13 nt, Yersinia pestis KIM
gcccucuugaacg

SEQ ID NO: 4211476 - RNA, 16 nt, Yersinia pestis KIM
gcccugaauuucaaua

SEQ ID NO: 4211477 - RNA, 19 nt, Yersinia pestis KIM
gcccugagauucaacccac

SEQ ID NO: 4211478 - RNA, 14 nt, Yersinia pestis KIM
gcccugaguuaagu

SEQ ID NO: 4211479 - RNA, 18 nt, Yersinia pestis KIM
gcccugaguuaucuguuu

SEQ ID NO: 4211480 - RNA, 15 nt, Yersinia pestis KIM
gcccugcucuucugg

SEQ ID NO: 4211481 - RNA, 14 nt, Yersinia pestis KIM
gcccuguaaagcca

SEQ ID NO: 4211482 - RNA, 21 nt, Yersinia pestis KIM
gcccuguaacuuuauugacug

SEQ ID NO: 4211483 - RNA, 15 nt, Yersinia pestis KIM
gcccugugaaucuuu

SEQ ID NO: 4211484 - RNA, 16 nt, Yersinia pestis KIM
gcccuguugcccagca

SEQ ID NO: 4211485 - RNA, 14 nt, Yersinia pestis KIM
gcccuguuucauuu

SEQ ID NO: 4211486 - RNA, 15 nt, Yersinia pestis KIM
gcccuguuucauuuc

SEQ ID NO: 4211487 - RNA, 16 nt, Yersinia pestis KIM
gcccuucccauuuaug

SEQ ID NO: 4211488 - RNA, 19 nt, Yersinia pestis KIM
gcccuucggacggcugaca

SEQ ID NO: 4211489 - RNA, 15 nt, Yersinia pestis KIM
gcccuugaccucauu

SEQ ID NO: 4211490 - RNA, 20 nt, Yersinia pestis KIM
gcccuugagggucgcccgga

SEQ ID NO: 4211491 - RNA, 18 nt, Yersinia pestis KIM
gcccuuucgcagcccaau

SEQ ID NO: 4211492 - RNA, 14 nt, Yersinia pestis KIM
gccgaaccugcaug

SEQ ID NO: 4211493 - RNA, 13 nt, Yersinia pestis KIM
gccgacaaaaucc

SEQ ID NO: 4211494 - RNA, 17 nt, Yersinia pestis KIM
gccgacaaaauccccca

SEQ ID NO: 4211495 - RNA, 12 nt, Yersinia pestis KIM
gccgacaaaccc

SEQ ID NO: 4211496 - RNA, 20 nt, Yersinia pestis KIM
gccgacaaacccacacccuu

SEQ ID NO: 4211497 - RNA, 17 nt, Yersinia pestis KIM
gccgaccugcaacgcca

SEQ ID NO: 4211498 - RNA, 20 nt, Yersinia pestis KIM
gccgacgaucuugcccaaug

SEQ ID NO: 4211499 - RNA, 13 nt, Yersinia pestis KIM
gccgagaacagaa

SEQ ID NO: 4211500 - RNA, 14 nt, Yersinia pestis KIM
gccgagaacagaau

SEQ ID NO: 4211501 - RNA, 18 nt, Yersinia pestis KIM
gccgagcaagugaauaac

SEQ ID NO: 4211502 - RNA, 13 nt, Yersinia pestis KIM
gccgaguaaguca

SEQ ID NO: 4211503 - RNA, 19 nt, Yersinia pestis KIM
gccgaguucgucgggggug

SEQ ID NO: 4211504 - RNA, 14 nt, Yersinia pestis KIM
gccgauacgaucau

SEQ ID NO: 4211505 - RNA, 20 nt, Yersinia pestis KIM
gccgauaguuggcaagacgg

SEQ ID NO: 4211506 - RNA, 16 nt, Yersinia pestis KIM
gccgauauacacccca

SEQ ID NO: 4211507 - RNA, 18 nt, Yersinia pestis KIM
gccgaucaacaggccacc

SEQ ID NO: 4211508 - RNA, 22 nt, Yersinia pestis KIM
gccgaugagcuucuucaaaagc

SEQ ID NO: 4211509 - RNA, 15 nt, Yersinia pestis KIM
gccgaugcgacaauu

SEQ ID NO: 4211510 - RNA, 14 nt, Yersinia pestis KIM
gccgauggaaccac

SEQ ID NO: 4211511 - RNA, 18 nt, Yersinia pestis KIM
gccgcagcagugccuggu

SEQ ID NO: 4211512 - RNA, 14 nt, Yersinia pestis KIM
gccgcagccagcgu

SEQ ID NO: 4211513 - RNA, 17 nt, Yersinia pestis KIM
gccgcaugcaacagaua

SEQ ID NO: 4211514 - RNA, 19 nt, Yersinia pestis KIM
gccgcaugcaacagauaau

SEQ ID NO: 4211515 - RNA, 15 nt, Yersinia pestis KIM
gccgcauucaccacc

SEQ ID NO: 4211516 - RNA, 15 nt, Yersinia pestis KIM
gccgccaacagugaa

SEQ ID NO: 4211517 - RNA, 21 nt, Yersinia pestis KIM
gccgccagauuauccagcccu

SEQ ID NO: 4211518 - RNA, 19 nt, Yersinia pestis KIM
gccgccagccccgcuacca

SEQ ID NO: 4211519 - RNA, 20 nt, Yersinia pestis KIM
gccgccagccccgcuaccaa

SEQ ID NO: 4211520 - RNA, 13 nt, Yersinia pestis KIM
gccgcccagcgac

SEQ ID NO: 4211521 - RNA, 16 nt, Yersinia pestis KIM
gccgcccuuuagccag

SEQ ID NO: 4211522 - RNA, 14 nt, Yersinia pestis KIM
gccgccgccagccc

SEQ ID NO: 4211523 - RNA, 15 nt, Yersinia pestis KIM
gccgccuuccugcua

SEQ ID NO: 4211524 - RNA, 16 nt, Yersinia pestis KIM
gccgcgauaaaaaaua

SEQ ID NO: 4211525 - RNA, 20 nt, Yersinia pestis KIM
gccgcgcccuaacaggcgca

SEQ ID NO: 4211526 - RNA, 12 nt, Yersinia pestis KIM
gccgcggcggcc

SEQ ID NO: 4211527 - RNA, 13 nt, Yersinia pestis KIM
gccgcggcuggga

SEQ ID NO: 4211528 - RNA, 15 nt, Yersinia pestis KIM
gccgcucaucaucca

SEQ ID NO: 4211529 - RNA, 19 nt, Yersinia pestis KIM
gccgcuggcgauccccuuc

SEQ ID NO: 4211530 - RNA, 21 nt, Yersinia pestis KIM
gccgcuucggucucuggaugc

SEQ ID NO: 4211531 - RNA, 19 nt, Yersinia pestis KIM
gccgcuuuagcgaugacca

SEQ ID NO: 4211532 - RNA, 21 nt, Yersinia pestis KIM
gccgcuuucaucgauugcugg

SEQ ID NO: 4211533 - RNA, 17 nt, Yersinia pestis KIM
gccggaacggucaggga

SEQ ID NO: 4211534 - RNA, 22 nt, Yersinia pestis KIM
gccggagucuaucugcaguauu

SEQ ID NO: 4211535 - RNA, 18 nt, Yersinia pestis KIM
gccggcaacagcgccugc

SEQ ID NO: 4211536 - RNA, 23 nt, Yersinia pestis KIM
gccggccauucagcguauagccu

SEQ ID NO: 4211537 - RNA, 13 nt, Yersinia pestis KIM
gccggcuacuggu

SEQ ID NO: 4211538 - RNA, 14 nt, Yersinia pestis KIM
gccggcuucccugu

SEQ ID NO: 4211539 - RNA, 15 nt, Yersinia pestis KIM
gccgggauuugcuca

SEQ ID NO: 4211540 - RNA, 18 nt, Yersinia pestis KIM
gccgggucaggaagagaa

SEQ ID NO: 4211541 - RNA, 15 nt, Yersinia pestis KIM
gcgacacuuauuggu

SEQ ID NO: 4211542 - RNA, 18 nt, Yersinia pestis KIM
gcgacaggcucagcacaa

SEQ ID NO: 4211543 - RNA, 12 nt, Yersinia pestis KIM
gcgaccagcaga

SEQ ID NO: 4211544 - RNA, 13 nt, Yersinia pestis KIM
gcgaccagcagaa

SEQ ID NO: 4211545 - RNA, 18 nt, Yersinia pestis KIM
gcgaccggccgcuugcca

SEQ ID NO: 4211546 - RNA, 15 nt, Yersinia pestis KIM
gcgaccuugauucuc

SEQ ID NO: 4211547 - RNA, 15 nt, Yersinia pestis KIM
gcgacgugaugccag

SEQ ID NO: 4211548 - RNA, 20 nt, Yersinia pestis KIM
gcgacuauagauacccacuu

SEQ ID NO: 4211549 - RNA, 15 nt, Yersinia pestis KIM
gcgacuccuggcaau

SEQ ID NO: 4211550 - RNA, 18 nt, Yersinia pestis KIM
gcgacugugcuuugccau

SEQ ID NO: 4211551 - RNA, 20 nt, Yersinia pestis KIM
gcgagauauaaacuaauauc

SEQ ID NO: 4211552 - RNA, 18 nt, Yersinia pestis KIM
gcgagcaauaccaaaaau

SEQ ID NO: 4211553 - RNA, 14 nt, Yersinia pestis KIM
gcgagcacugcccc

SEQ ID NO: 4211554 - RNA, 13 nt, Yersinia pestis KIM
gcgagcaugacac

SEQ ID NO: 4211555 - RNA, 15 nt, Yersinia pestis KIM
gcgagucucaucaag

SEQ ID NO: 4211556 - RNA, 17 nt, Yersinia pestis KIM
gcgagugaaccgcgcuc

SEQ ID NO: 4211557 - RNA, 21 nt, Yersinia pestis KIM
gcgagugaaccgcgcucugcu

SEQ ID NO: 4211558 - RNA, 21 nt, Yersinia pestis KIM
gcgauaaaaaauaaaguccag

SEQ ID NO: 4211559 - RNA, 12 nt, Yersinia pestis KIM
gcgauaaaagau

SEQ ID NO: 4211560 - RNA, 18 nt, Yersinia pestis KIM
gcgauacggucaucgccg

SEQ ID NO: 4211561 - RNA, 17 nt, Yersinia pestis KIM
gcgauagagauagccaa

SEQ ID NO: 4211562 - RNA, 21 nt, Yersinia pestis KIM
gcgauagaguugauaaacaau

SEQ ID NO: 4211563 - RNA, 13 nt, Yersinia pestis KIM
gcgauauacauca

SEQ ID NO: 4211564 - RNA, 18 nt, Yersinia pestis KIM
gcgauauucugauggugu

SEQ ID NO: 4211565 - RNA, 12 nt, Yersinia pestis KIM
gcgauauuuauu

SEQ ID NO: 4211566 - RNA, 14 nt, Yersinia pestis KIM
gcgaucacaauaca

SEQ ID NO: 4211567 - RNA, 20 nt, Yersinia pestis KIM
gcgaucuauucucuguaaug

SEQ ID NO: 4211568 - RNA, 13 nt, Yersinia pestis KIM
gcgaucugaaacg

SEQ ID NO: 4211569 - RNA, 13 nt, Yersinia pestis KIM
gcgauuaaaauaa

SEQ ID NO: 4211570 - RNA, 16 nt, Yersinia pestis KIM
gcgauuaaaauaaagc

SEQ ID NO: 4211571 - RNA, 17 nt, Yersinia pestis KIM
gcgauugugcagagugu

SEQ ID NO: 4211572 - RNA, 16 nt, Yersinia pestis KIM
gcgcaaaauuaagaca

SEQ ID NO: 4211573 - RNA, 19 nt, Yersinia pestis KIM
gcgcaaaugcguagcgggg

SEQ ID NO: 4211574 - RNA, 13 nt, Yersinia pestis KIM
gcgcaaccauccg

SEQ ID NO: 4211575 - RNA, 16 nt, Yersinia pestis KIM
gcgcaaccuggccaau

SEQ ID NO: 4211576 - RNA, 20 nt, Yersinia pestis KIM
gcgcaagaguuagggcugga

SEQ ID NO: 4211577 - RNA, 18 nt, Yersinia pestis KIM
gcgcaccgaaauagucgc

SEQ ID NO: 4211578 - RNA, 20 nt, Yersinia pestis KIM
gcgcacguaccacggcggga

SEQ ID NO: 4211579 - RNA, 16 nt, Yersinia pestis KIM
gcgcacucauccucug

SEQ ID NO: 4211580 - RNA, 15 nt, Yersinia pestis KIM
gcgcacugucugagc

SEQ ID NO: 4211581 - RNA, 18 nt, Yersinia pestis KIM
gcgcagagaucgauagca

SEQ ID NO: 4211582 - RNA, 15 nt, Yersinia pestis KIM
gcgcagaguauccag

SEQ ID NO: 4211583 - RNA, 22 nt, Yersinia pestis KIM
gcgcagaugaucaacgccaaaa

SEQ ID NO: 4211584 - RNA, 18 nt, Yersinia pestis KIM
gcgcagauuauggguggu

SEQ ID NO: 4211585 - RNA, 13 nt, Yersinia pestis KIM
gcgcagccaacgg

SEQ ID NO: 4211586 - RNA, 14 nt, Yersinia pestis KIM
gcgcaggauuucaa

SEQ ID NO: 4211587 - RNA, 18 nt, Yersinia pestis KIM
gcgcaggauuucaauaua

SEQ ID NO: 4211588 - RNA, 20 nt, Yersinia pestis KIM
gcgcagguaaugucacugcc

SEQ ID NO: 4211589 - RNA, 19 nt, Yersinia pestis KIM
gcgcaguaacuguguuuga

SEQ ID NO: 4211590 - RNA, 18 nt, Yersinia pestis KIM
gcgcaguacucaccgccg

SEQ ID NO: 4211591 - RNA, 23 nt, Yersinia pestis KIM
gcgcagugccgucaauuaucaaa

SEQ ID NO: 4211592 - RNA, 22 nt, Yersinia pestis KIM
gcgcauauaggcgaaaggcgca

SEQ ID NO: 4211593 - RNA, 20 nt, Yersinia pestis KIM
gcgcaucugcugcacuuaac

SEQ ID NO: 4211594 - RNA, 19 nt, Yersinia pestis KIM
gcgccaaggauggcgcggc

SEQ ID NO: 4211595 - RNA, 15 nt, Yersinia pestis KIM
gcgccaaucgccacc

SEQ ID NO: 4211596 - RNA, 14 nt, Yersinia pestis KIM
gcgccacaucggcg

SEQ ID NO: 4211597 - RNA, 16 nt, Yersinia pestis KIM
gcgccacccauugcuc

SEQ ID NO: 4211598 - RNA, 20 nt, Yersinia pestis KIM
gcgccacuucuuucacuaau

SEQ ID NO: 4211599 - RNA, 15 nt, Yersinia pestis KIM
gcgccagacuggccg

SEQ ID NO: 4211600 - RNA, 11 nt, Yersinia pestis KIM
gcgccagcagc

SEQ ID NO: 4211601 - RNA, 16 nt, Yersinia pestis KIM
gcgccauauauugauc

SEQ ID NO: 4211602 - RNA, 23 nt, Yersinia pestis KIM
gcgccaucgcuaaucauauccau

SEQ ID NO: 4211603 - RNA, 16 nt, Yersinia pestis KIM
gcgccauuaccacugu

SEQ ID NO: 4211604 - RNA, 20 nt, Yersinia pestis KIM
gcgcccaagcuuggccccuu

SEQ ID NO: 4211605 - RNA, 18 nt, Yersinia pestis KIM
gcgcccaguggagccaug

SEQ ID NO: 4211606 - RNA, 15 nt, Yersinia pestis KIM
gcgcccggcccacuu

SEQ ID NO: 4211607 - RNA, 12 nt, Yersinia pestis KIM
gcgcccucccug

SEQ ID NO: 4211608 - RNA, 17 nt, Yersinia pestis KIM
gcgccgaaauaaaacca

SEQ ID NO: 4211609 - RNA, 13 nt, Yersinia pestis KIM
gcgccgacugcug

SEQ ID NO: 4211610 - RNA, 19 nt, Yersinia pestis KIM
gcgccguaaaaagcagcaa

SEQ ID NO: 4211611 - RNA, 14 nt, Yersinia pestis KIM
gcgccguaaacugc

SEQ ID NO: 4211612 - RNA, 15 nt, Yersinia pestis KIM
gcgccugugggcggc

SEQ ID NO: 4211613 - RNA, 17 nt, Yersinia pestis KIM
gcgccuuccuuuuauuu

SEQ ID NO: 4211614 - RNA, 12 nt, Yersinia pestis KIM
gcgcgauaguca

SEQ ID NO: 4211615 - RNA, 22 nt, Yersinia pestis KIM
gcgcgaucccagaauggcaaag

SEQ ID NO: 4211616 - RNA, 16 nt, Yersinia pestis KIM
gcgcgcuucgagcccc

SEQ ID NO: 4211617 - RNA, 13 nt, Yersinia pestis KIM
gcgcggcuagcca

SEQ ID NO: 4211618 - RNA, 24 nt, Yersinia pestis KIM
gcgcgucaucaacguuaaucgcca

SEQ ID NO: 4211619 - RNA, 13 nt, Yersinia pestis KIM
gcgcgucgccugg

SEQ ID NO: 4211620 - RNA, 21 nt, Yersinia pestis KIM
gcgcuacgcaugaugcugccu

SEQ ID NO: 4211621 - RNA, 22 nt, Yersinia pestis KIM
gcgcuauuccgcgccugggcua

SEQ ID NO: 4211622 - RNA, 22 nt, Yersinia pestis KIM
gcgcuauuuauccacuaauuca

SEQ ID NO: 4211623 - RNA, 15 nt, Yersinia pestis KIM
gcgcucacuuuuauu

SEQ ID NO: 4211624 - RNA, 17 nt, Yersinia pestis KIM
gcgcugaucaucaucaa

SEQ ID NO: 4211625 - RNA, 19 nt, Yersinia pestis KIM
gcgcugaucaucaucaaug

SEQ ID NO: 4211626 - RNA, 15 nt, Yersinia pestis KIM
gcgcugcaucagcag

SEQ ID NO: 4211627 - RNA, 21 nt, Yersinia pestis KIM
gcgcugcaucagcagugacgu

SEQ ID NO: 4211628 - RNA, 19 nt, Yersinia pestis KIM
gcgcugcgucuuuaucgcc

SEQ ID NO: 4211629 - RNA, 15 nt, Yersinia pestis KIM
gcgcuggcuuuuuca

SEQ ID NO: 4211630 - RNA, 18 nt, Yersinia pestis KIM
gcgcuuaccgucugggcu

SEQ ID NO: 4211631 - RNA, 13 nt, Yersinia pestis KIM
gcgcuuccaggcu

SEQ ID NO: 4211632 - RNA, 16 nt, Yersinia pestis KIM
gcggaaauaaggcgca

SEQ ID NO: 4211633 - RNA, 19 nt, Yersinia pestis KIM
gcggaaaugccgauaaaaa

SEQ ID NO: 4211634 - RNA, 20 nt, Yersinia pestis KIM
gcggaagaaggcuagucugu

SEQ ID NO: 4211635 - RNA, 16 nt, Yersinia pestis KIM
gcggacaucuuacuga

SEQ ID NO: 4211636 - RNA, 23 nt, Yersinia pestis KIM
gcggacaucuuacugauacccgc

SEQ ID NO: 4211637 - RNA, 13 nt, Yersinia pestis KIM
gcggacgggcaau

SEQ ID NO: 4211638 - RNA, 19 nt, Yersinia pestis KIM
gcggagcugacgucagauc

SEQ ID NO: 4211639 - RNA, 21 nt, Yersinia pestis KIM
gcggauaaucuaggccugggu

SEQ ID NO: 4211640 - RNA, 15 nt, Yersinia pestis KIM
gcggaucaaccgccc

SEQ ID NO: 4211641 - RNA, 21 nt, Yersinia pestis KIM
gcggaucgacgugaagugagc

SEQ ID NO: 4211642 - RNA, 15 nt, Yersinia pestis KIM
gcggauuuauaagga

SEQ ID NO: 4211643 - RNA, 15 nt, Yersinia pestis KIM
gcggcaaauagagca

SEQ ID NO: 4211644 - RNA, 16 nt, Yersinia pestis KIM
gcggcaauaagcauua

SEQ ID NO: 4211645 - RNA, 19 nt, Yersinia pestis KIM
gcggcagagccaaucccca

SEQ ID NO: 4211646 - RNA, 19 nt, Yersinia pestis KIM
gcggcagcacagagcacaa

SEQ ID NO: 4211647 - RNA, 23 nt, Yersinia pestis KIM
gcggcaggcaugguaagaauaaa

SEQ ID NO: 4211648 - RNA, 16 nt, Yersinia pestis KIM
gcggcauaauccucaa

SEQ ID NO: 4211649 - RNA, 17 nt, Yersinia pestis KIM
gcggcauauaaccaugc

SEQ ID NO: 4211650 - RNA, 12 nt, Yersinia pestis KIM
gcggcauccagu

SEQ ID NO: 4211651 - RNA, 11 nt, Yersinia pestis KIM
gcggccaauag

SEQ ID NO: 4211652 - RNA, 18 nt, Yersinia pestis KIM
gcggccagcaagagcagc

SEQ ID NO: 4211653 - RNA, 23 nt, Yersinia pestis KIM
gcggccuggguagacauggcaac

SEQ ID NO: 4211654 - RNA, 17 nt, Yersinia pestis KIM
gcggcgauuucaucagc

SEQ ID NO: 4211655 - RNA, 17 nt, Yersinia pestis KIM
gcggcggcuaugugccg

SEQ ID NO: 4211656 - RNA, 15 nt, Yersinia pestis KIM
gcuaccccaacauug

SEQ ID NO: 4211657 - RNA, 18 nt, Yersinia pestis KIM
gcuacccgcagcaugacg

SEQ ID NO: 4211658 - RNA, 19 nt, Yersinia pestis KIM
gcuaccucguaguaaugac

SEQ ID NO: 4211659 - RNA, 13 nt, Yersinia pestis KIM
gcuaccugcacca

SEQ ID NO: 4211660 - RNA, 16 nt, Yersinia pestis KIM
gcuacgcaaaaucagu

SEQ ID NO: 4211661 - RNA, 11 nt, Yersinia pestis KIM
gcuacgccgug

SEQ ID NO: 4211662 - RNA, 21 nt, Yersinia pestis KIM
gcuacggauugcaaauccguc

SEQ ID NO: 4211663 - RNA, 20 nt, Yersinia pestis KIM
gcuacgggcaaacuccucca

SEQ ID NO: 4211664 - RNA, 23 nt, Yersinia pestis KIM
gcuacguuuaucgugcaguaaug

SEQ ID NO: 4211665 - RNA, 14 nt, Yersinia pestis KIM
gcuacugggcuacc

SEQ ID NO: 4211666 - RNA, 16 nt, Yersinia pestis KIM
gcuacugguagcagcc

SEQ ID NO: 4211667 - RNA, 21 nt, Yersinia pestis KIM
gcuacuuaauaucuaacugau

SEQ ID NO: 4211668 - RNA, 20 nt, Yersinia pestis KIM
gcuagaauaaguugaugcag

SEQ ID NO: 4211669 - RNA, 16 nt, Yersinia pestis KIM
gcuagcaaauuccgcu

SEQ ID NO: 4211670 - RNA, 23 nt, Yersinia pestis KIM
gcuagccaccucacucagcgacu

SEQ ID NO: 4211671 - RNA, 17 nt, Yersinia pestis KIM
gcuagcccccagggagg

SEQ ID NO: 4211672 - RNA, 14 nt, Yersinia pestis KIM
gcuagcuuauccag

SEQ ID NO: 4211673 - RNA, 18 nt, Yersinia pestis KIM
gcuaggaggccaggacuu

SEQ ID NO: 4211674 - RNA, 17 nt, Yersinia pestis KIM
gcuaggcgcagcagggc

SEQ ID NO: 4211675 - RNA, 20 nt, Yersinia pestis KIM
gcuagucuguuaugcccaac

SEQ ID NO: 4211676 - RNA, 18 nt, Yersinia pestis KIM
gcuaucaccggaugaaac

SEQ ID NO: 4211677 - RNA, 16 nt, Yersinia pestis KIM
gcuauccaccaucgga

SEQ ID NO: 4211678 - RNA, 14 nt, Yersinia pestis KIM
gcuaucuguuaucu

SEQ ID NO: 4211679 - RNA, 18 nt, Yersinia pestis KIM
gcuaucuuaugacgcugc

SEQ ID NO: 4211680 - RNA, 16 nt, Yersinia pestis KIM
gcuaucuuauuuaccu

SEQ ID NO: 4211681 - RNA, 15 nt, Yersinia pestis KIM
gcuaugcagcccaga

SEQ ID NO: 4211682 - RNA, 15 nt, Yersinia pestis KIM
gcuaugcuaaaaaac

SEQ ID NO: 4211683 - RNA, 23 nt, Yersinia pestis KIM
gcuauggguaauccccaccaaca

SEQ ID NO: 4211684 - RNA, 16 nt, Yersinia pestis KIM
gcuaugugaaugcagu

SEQ ID NO: 4211685 - RNA, 18 nt, Yersinia pestis KIM
gcuauguuggcaaauaau

SEQ ID NO: 4211686 - RNA, 18 nt, Yersinia pestis KIM
gcuauuaaacauuuaugu

SEQ ID NO: 4211687 - RNA, 14 nt, Yersinia pestis KIM
gcuauuaagaaacc

SEQ ID NO: 4211688 - RNA, 13 nt, Yersinia pestis KIM
gcuauucagauca

SEQ ID NO: 4211689 - RNA, 14 nt, Yersinia pestis KIM
gcuauucuuagccu

SEQ ID NO: 4211690 - RNA, 18 nt, Yersinia pestis KIM
gcuauugaacauucaucu

SEQ ID NO: 4211691 - RNA, 20 nt, Yersinia pestis KIM
gcuauugaccgaugacuaac

SEQ ID NO: 4211692 - RNA, 15 nt, Yersinia pestis KIM
gcuauugagcauauu

SEQ ID NO: 4211693 - RNA, 13 nt, Yersinia pestis KIM
gcuauugcaacgc

SEQ ID NO: 4211694 - RNA, 21 nt, Yersinia pestis KIM
gcuauugcuuuuauugccuac

SEQ ID NO: 4211695 - RNA, 18 nt, Yersinia pestis KIM
gcuauuggcgagcaugac

SEQ ID NO: 4211696 - RNA, 22 nt, Yersinia pestis KIM
gcuauuuauccacuaauucauc

SEQ ID NO: 4211697 - RNA, 12 nt, Yersinia pestis KIM
gcuauuucucuc

SEQ ID NO: 4211698 - RNA, 15 nt, Yersinia pestis KIM
gcuauuuuuucucac

SEQ ID NO: 4211699 - RNA, 14 nt, Yersinia pestis KIM
gcucaaauacggua

SEQ ID NO: 4211700 - RNA, 12 nt, Yersinia pestis KIM
gcucaacugcuc

SEQ ID NO: 4211701 - RNA, 17 nt, Yersinia pestis KIM
gcucaacugcucaacug

SEQ ID NO: 4211702 - RNA, 20 nt, Yersinia pestis KIM
gcucaacugcucaacugcuc

SEQ ID NO: 4211703 - RNA, 13 nt, Yersinia pestis KIM
gcucaagccucua

SEQ ID NO: 4211704 - RNA, 23 nt, Yersinia pestis KIM
gcucaagggcacaguuuaucucg

SEQ ID NO: 4211705 - RNA, 16 nt, Yersinia pestis KIM
gcucaauggcgggggc

SEQ ID NO: 4211706 - RNA, 19 nt, Yersinia pestis KIM
gcucacccauuuuauccuc

SEQ ID NO: 4211707 - RNA, 20 nt, Yersinia pestis KIM
gcucacccauuuuauccucu

SEQ ID NO: 4211708 - RNA, 14 nt, Yersinia pestis KIM
gcucacgucaccac

SEQ ID NO: 4211709 - RNA, 15 nt, Yersinia pestis KIM
gcucacgucaccacg

SEQ ID NO: 4211710 - RNA, 16 nt, Yersinia pestis KIM
gcucacuuuuauccag

SEQ ID NO: 4211711 - RNA, 14 nt, Yersinia pestis KIM
gcucagcaagaacu

SEQ ID NO: 4211712 - RNA, 13 nt, Yersinia pestis KIM
gcucagccaggca

SEQ ID NO: 4211713 - RNA, 15 nt, Yersinia pestis KIM
gcucagcgggcuaaa

SEQ ID NO: 4211714 - RNA, 12 nt, Yersinia pestis KIM
gcucagggccac

SEQ ID NO: 4211715 - RNA, 13 nt, Yersinia pestis KIM
gcucagggccacu

SEQ ID NO: 4211716 - RNA, 19 nt, Yersinia pestis KIM
gcucauaaagcaucagacu

SEQ ID NO: 4211717 - RNA, 21 nt, Yersinia pestis KIM
gcucauaccaugccaucaaug

SEQ ID NO: 4211718 - RNA, 23 nt, Yersinia pestis KIM
gcucauaugcagcauccagcuca

SEQ ID NO: 4211719 - RNA, 22 nt, Yersinia pestis KIM
gcucaucaaaggagugcccggc

SEQ ID NO: 4211720 - RNA, 18 nt, Yersinia pestis KIM
gcucaucaaccucagccu

SEQ ID NO: 4211721 - RNA, 22 nt, Yersinia pestis KIM
gcucaucaaccucagccucauu

SEQ ID NO: 4211722 - RNA, 16 nt, Yersinia pestis KIM
gcucaucauaaaaaua

SEQ ID NO: 4211723 - RNA, 17 nt, Yersinia pestis KIM
gcucaucauaaaaauac

SEQ ID NO: 4211724 - RNA, 23 nt, Yersinia pestis KIM
gcucaucauccaucacaaaaccu

SEQ ID NO: 4211725 - RNA, 14 nt, Yersinia pestis KIM
gcucaucgguacca

SEQ ID NO: 4211726 - RNA, 15 nt, Yersinia pestis KIM
gcucaucgguaccag

SEQ ID NO: 4211727 - RNA, 23 nt, Yersinia pestis KIM
gcucaucuaacucauucauaauu

SEQ ID NO: 4211728 - RNA, 21 nt, Yersinia pestis KIM
gcucauguucgcacugcucug

SEQ ID NO: 4211729 - RNA, 16 nt, Yersinia pestis KIM
gcucauuaaacuguuc

SEQ ID NO: 4211730 - RNA, 21 nt, Yersinia pestis KIM
gcucauuaaacuguucuuauu

SEQ ID NO: 4211731 - RNA, 14 nt, Yersinia pestis KIM
gcuccaauaaaaaa

SEQ ID NO: 4211732 - RNA, 21 nt, Yersinia pestis KIM
gcuccacuacucaguugcagu

SEQ ID NO: 4211733 - RNA, 11 nt, Yersinia pestis KIM
gcuccagauug

SEQ ID NO: 4211734 - RNA, 17 nt, Yersinia pestis KIM
gcuccagcgucacuuca

SEQ ID NO: 4211735 - RNA, 15 nt, Yersinia pestis KIM
gcuccaguucgacua

SEQ ID NO: 4211736 - RNA, 21 nt, Yersinia pestis KIM
gcuccauuuuuugugcccaga

SEQ ID NO: 4211737 - RNA, 20 nt, Yersinia pestis KIM
gcucccccggaucacuggcu

SEQ ID NO: 4211738 - RNA, 15 nt, Yersinia pestis KIM
gcucccgcacucugu

SEQ ID NO: 4211739 - RNA, 21 nt, Yersinia pestis KIM
gcucccguaaacguucugcca

SEQ ID NO: 4211740 - RNA, 14 nt, Yersinia pestis KIM
gcucccuccugcgg

SEQ ID NO: 4211741 - RNA, 16 nt, Yersinia pestis KIM
gcuccgcacuuggccc

SEQ ID NO: 4211742 - RNA, 14 nt, Yersinia pestis KIM
gcuccgcggugcuu

SEQ ID NO: 4211743 - RNA, 20 nt, Yersinia pestis KIM
gcuccgguuuucacccccac

SEQ ID NO: 4211744 - RNA, 14 nt, Yersinia pestis KIM
gcuccuauagcuca

SEQ ID NO: 4211745 - RNA, 21 nt, Yersinia pestis KIM
gcuccuauagcucagaaaaua

SEQ ID NO: 4211746 - RNA, 14 nt, Yersinia pestis KIM
gcuccucaaccccu

SEQ ID NO: 4211747 - RNA, 22 nt, Yersinia pestis KIM
gcuccucacuuugcauuuucug

SEQ ID NO: 4211748 - RNA, 18 nt, Yersinia pestis KIM
gcuccuccuuggggccuc

SEQ ID NO: 4211749 - RNA, 15 nt, Yersinia pestis KIM
gcuccugagcugagu

SEQ ID NO: 4211750 - RNA, 21 nt, Yersinia pestis KIM
gcuccugagggugaugacaau

SEQ ID NO: 4211751 - RNA, 14 nt, Yersinia pestis KIM
gcuccugaugacuc

SEQ ID NO: 4211752 - RNA, 15 nt, Yersinia pestis KIM
gcuccugaugacuca

SEQ ID NO: 4211753 - RNA, 21 nt, Yersinia pestis KIM
gcuccugccacagacuuucuu

SEQ ID NO: 4211754 - RNA, 18 nt, Yersinia pestis KIM
gcuccuuacuauuuucau

SEQ ID NO: 4211755 - RNA, 13 nt, Yersinia pestis KIM
gcucgaaccugaa

SEQ ID NO: 4211756 - RNA, 17 nt, Yersinia pestis KIM
gcucgcuguggcuacca

SEQ ID NO: 4211757 - RNA, 12 nt, Yersinia pestis KIM
gcucggcuuuac

SEQ ID NO: 4211758 - RNA, 18 nt, Yersinia pestis KIM
gcucgucuucgacagcag

SEQ ID NO: 4211759 - RNA, 18 nt, Yersinia pestis KIM
gcucgugaucagcagacu

SEQ ID NO: 4211760 - RNA, 14 nt, Yersinia pestis KIM
gcucguuaucugua

SEQ ID NO: 4211761 - RNA, 17 nt, Yersinia pestis KIM
gcucguuggccggaugc

SEQ ID NO: 4211762 - RNA, 20 nt, Yersinia pestis KIM
gcucuacaacguccagaaca

SEQ ID NO: 4211763 - RNA, 14 nt, Yersinia pestis KIM
aaaaaaaagaaaau

SEQ ID NO: 4211764 - RNA, 12 nt, Yersinia pestis KIM
aaaaaaaauaaa

SEQ ID NO: 4211765 - RNA, 12 nt, Yersinia pestis KIM
aaaaaaagacac

SEQ ID NO: 4211766 - RNA, 15 nt, Yersinia pestis KIM
aaaaaaagacacuaa

SEQ ID NO: 4211767 - RNA, 13 nt, Yersinia pestis KIM
aaaaaacagacua

SEQ ID NO: 4211768 - RNA, 20 nt, Yersinia pestis KIM
aaaaaaccuuauuuuugcau

SEQ ID NO: 4211769 - RNA, 23 nt, Yersinia pestis KIM
aaaaaacgggucgucucuugcaa

SEQ ID NO: 4211770 - RNA, 16 nt, Yersinia pestis KIM
aaaaaacuaagggcga

SEQ ID NO: 4211771 - RNA, 16 nt, Yersinia pestis KIM
aaaaaagaaaauggcu

SEQ ID NO: 4211772 - RNA, 19 nt, Yersinia pestis KIM
aaaaaagcuauaaauaaau

SEQ ID NO: 4211773 - RNA, 18 nt, Yersinia pestis KIM
aaaaaagcugucauaaaa

SEQ ID NO: 4211774 - RNA, 13 nt, Yersinia pestis KIM
aaaaaauaucuuu

SEQ ID NO: 4211775 - RNA, 16 nt, Yersinia pestis KIM
aaaaaauuaaaauaau

SEQ ID NO: 4211776 - RNA, 13 nt, Yersinia pestis KIM
aaaaaauuaucau

SEQ ID NO: 4211777 - RNA, 17 nt, Yersinia pestis KIM
aaaaacagacuaaaaac

SEQ ID NO: 4211778 - RNA, 19 nt, Yersinia pestis KIM
aaaaacagcgaucuauucu

SEQ ID NO: 4211779 - RNA, 21 nt, Yersinia pestis KIM
aaaaaccaucugaugcagguu

SEQ ID NO: 4211780 - RNA, 19 nt, Yersinia pestis KIM
aaaaacccauuaaaaacaa

SEQ ID NO: 4211781 - RNA, 21 nt, Yersinia pestis KIM
aaaaacccauuaaaaacaaau

SEQ ID NO: 4211782 - RNA, 19 nt, Yersinia pestis KIM
aaaaaccggcguaaauaaa

SEQ ID NO: 4211783 - RNA, 17 nt, Yersinia pestis KIM
aaaaacgcacgaaaaca

SEQ ID NO: 4211784 - RNA, 18 nt, Yersinia pestis KIM
aaaaacgcagauuuguac

SEQ ID NO: 4211785 - RNA, 17 nt, Yersinia pestis KIM
aaaaacgccaucaauaa

SEQ ID NO: 4211786 - RNA, 19 nt, Yersinia pestis KIM
aaaaacgccaucaauaauu

SEQ ID NO: 4211787 - RNA, 11 nt, Yersinia pestis KIM
aaaaacgcugg

SEQ ID NO: 4211788 - RNA, 15 nt, Yersinia pestis KIM
aaaaacgcuggccag

SEQ ID NO: 4211789 - RNA, 23 nt, Yersinia pestis KIM
aaaaacggacgaccuguagcuuu

SEQ ID NO: 4211790 - RNA, 16 nt, Yersinia pestis KIM
aaaaacgugaauaucc

SEQ ID NO: 4211791 - RNA, 23 nt, Yersinia pestis KIM
aaaaacucgcgccugaaaucauu

SEQ ID NO: 4211792 - RNA, 20 nt, Yersinia pestis KIM
aaaaacugugcaaauggcuu

SEQ ID NO: 4211793 - RNA, 17 nt, Yersinia pestis KIM
aaaaacuuaucuaaaaa

SEQ ID NO: 4211794 - RNA, 15 nt, Yersinia pestis KIM
aaaaacuucaucgau

SEQ ID NO: 4211795 - RNA, 21 nt, Yersinia pestis KIM
aaaaacuucaucgauaguaaa

SEQ ID NO: 4211796 - RNA, 15 nt, Yersinia pestis KIM
aaaaagacauaaaga

SEQ ID NO: 4211797 - RNA, 13 nt, Yersinia pestis KIM
aaaaagagucagu

SEQ ID NO: 4211798 - RNA, 12 nt, Yersinia pestis KIM
aaaaagauggcu

SEQ ID NO: 4211799 - RNA, 17 nt, Yersinia pestis KIM
aaaaagcagcaaacgaa

SEQ ID NO: 4211800 - RNA, 13 nt, Yersinia pestis KIM
aaaaagccagcga

SEQ ID NO: 4211801 - RNA, 18 nt, Yersinia pestis KIM
aaaaagcgacuaauauca

SEQ ID NO: 4211802 - RNA, 15 nt, Yersinia pestis KIM
aaaaagcgaucgacc

SEQ ID NO: 4211803 - RNA, 22 nt, Yersinia pestis KIM
aaaaagcugucauaaaaaaagc

SEQ ID NO: 4211804 - RNA, 22 nt, Yersinia pestis KIM
aaaaaggauuuuauuaaaucac

SEQ ID NO: 4211805 - RNA, 21 nt, Yersinia pestis KIM
aaaaaggcaccagcgcacuga

SEQ ID NO: 4211806 - RNA, 12 nt, Yersinia pestis KIM
aaaaagggcaag

SEQ ID NO: 4211807 - RNA, 18 nt, Yersinia pestis KIM
aaaaagucauuaacuguu

SEQ ID NO: 4211808 - RNA, 13 nt, Yersinia pestis KIM
aaaaauaaucaau

SEQ ID NO: 4211809 - RNA, 13 nt, Yersinia pestis KIM
aaaauaaccaaca

SEQ ID NO: 4211810 - RNA, 13 nt, Yersinia pestis KIM
aaaauaacguagu

SEQ ID NO: 4211811 - RNA, 21 nt, Yersinia pestis KIM
aaaauacaaccaacaaacaau

SEQ ID NO: 4211812 - RNA, 15 nt, Yersinia pestis KIM
aaaauacauaucaac

SEQ ID NO: 4211813 - RNA, 16 nt, Yersinia pestis KIM
aaaauacauaucaaca

SEQ ID NO: 4211814 - RNA, 18 nt, Yersinia pestis KIM
aaaauacccaaagucauu

SEQ ID NO: 4211815 - RNA, 21 nt, Yersinia pestis KIM
aaaauacugccaaucgcucug

SEQ ID NO: 4211816 - RNA, 16 nt, Yersinia pestis KIM
aaaauagccuucccug

SEQ ID NO: 4211817 - RNA, 15 nt, Yersinia pestis KIM
aaaauagccuuccuu

SEQ ID NO: 4211818 - RNA, 15 nt, Yersinia pestis KIM
aaaauagcuucccug

SEQ ID NO: 4211819 - RNA, 23 nt, Yersinia pestis KIM
aaaauagggaagguguuuaaaau

SEQ ID NO: 4211820 - RNA, 21 nt, Yersinia pestis KIM
aaaauagguguuuuucgucau

SEQ ID NO: 4211821 - RNA, 13 nt, Yersinia pestis KIM
aaaauauccagca

SEQ ID NO: 4211822 - RNA, 16 nt, Yersinia pestis KIM
aaaauauccagcaacg

SEQ ID NO: 4211823 - RNA, 17 nt, Yersinia pestis KIM
aaaauaucgcgcuucag

SEQ ID NO: 4211824 - RNA, 19 nt, Yersinia pestis KIM
aaaauaucgcgcuucaggu

SEQ ID NO: 4211825 - RNA, 19 nt, Yersinia pestis KIM
aaaauaugauaguguaaaa

SEQ ID NO: 4211826 - RNA, 18 nt, Yersinia pestis KIM
aaaauauucuaaguaaaa

SEQ ID NO: 4211827 - RNA, 13 nt, Yersinia pestis KIM
aaaauauuuugcu

SEQ ID NO: 4211828 - RNA, 15 nt, Yersinia pestis KIM
aaaaucaaaaaugau

SEQ ID NO: 4211829 - RNA, 23 nt, Yersinia pestis KIM
aaaaucaccuggccaggaauuaa

SEQ ID NO: 4211830 - RNA, 18 nt, Yersinia pestis KIM
aaaaucacguuuccaaaa

SEQ ID NO: 4211831 - RNA, 22 nt, Yersinia pestis KIM
aaaaucaguaccgacaccaaua

SEQ ID NO: 4211832 - RNA, 18 nt, Yersinia pestis KIM
aaaaucaguuuacaugau

SEQ ID NO: 4211833 - RNA, 18 nt, Yersinia pestis KIM
aaaaucauggcauaaacc

SEQ ID NO: 4211834 - RNA, 14 nt, Yersinia pestis KIM
aaaaucauugacgu

SEQ ID NO: 4211835 - RNA, 15 nt, Yersinia pestis KIM
aaaaucccaaaauau

SEQ ID NO: 4211836 - RNA, 11 nt, Yersinia pestis KIM
aaaauccccca

SEQ ID NO: 4211837 - RNA, 14 nt, Yersinia pestis KIM
aaaaucccccacca

SEQ ID NO: 4211838 - RNA, 19 nt, Yersinia pestis KIM
aaaauccgguaauggccaa

SEQ ID NO: 4211839 - RNA, 18 nt, Yersinia pestis KIM
aaaauccugaauaauacu

SEQ ID NO: 4211840 - RNA, 17 nt, Yersinia pestis KIM
aaaaucgauagucaacu

SEQ ID NO: 4211841 - RNA, 19 nt, Yersinia pestis KIM
aaaaucgauagucaacuuu

SEQ ID NO: 4211842 - RNA, 19 nt, Yersinia pestis KIM
aaaaucguauaacauaaua

SEQ ID NO: 4211843 - RNA, 22 nt, Yersinia pestis KIM
aaaaucguauaacauaauaaau

SEQ ID NO: 4211844 - RNA, 19 nt, Yersinia pestis KIM
aaaaucuuccuuuccauuu

SEQ ID NO: 4211845 - RNA, 20 nt, Yersinia pestis KIM
aaaaucuuguuaauuuaaac

SEQ ID NO: 4211846 - RNA, 15 nt, Yersinia pestis KIM
aaaaucuuucuguuc

SEQ ID NO: 4211847 - RNA, 18 nt, Yersinia pestis KIM
aaaaucuuucuguucagc

SEQ ID NO: 4211848 - RNA, 18 nt, Yersinia pestis KIM
aaaaugaucaucagcagc

SEQ ID NO: 4211849 - RNA, 18 nt, Yersinia pestis KIM
aaaaugauuuuauucacu

SEQ ID NO: 4211850 - RNA, 18 nt, Yersinia pestis KIM
aaaaugccaacaacuggg

SEQ ID NO: 4211851 - RNA, 17 nt, Yersinia pestis KIM
aaaaugccguacaacaa

SEQ ID NO: 4211852 - RNA, 19 nt, Yersinia pestis KIM
aaaaugccguacaacaaua

SEQ ID NO: 4211853 - RNA, 22 nt, Yersinia pestis KIM
aaaauggcguuuaaaguaaauc

SEQ ID NO: 4211854 - RNA, 18 nt, Yersinia pestis KIM
aaaauggcuuuuuuaaua

SEQ ID NO: 4211855 - RNA, 13 nt, Yersinia pestis KIM
aaaaugguuucag

SEQ ID NO: 4211856 - RNA, 22 nt, Yersinia pestis KIM
aaaaugguuugcuguucuugca

SEQ ID NO: 4211857 - RNA, 12 nt, Yersinia pestis KIM
aaaauuaaaaua

SEQ ID NO: 4211858 - RNA, 13 nt, Yersinia pestis KIM
aaaauuaaaauaa

SEQ ID NO: 4211859 - RNA, 11 nt, Yersinia pestis KIM
aaaauuaagac

SEQ ID NO: 4211860 - RNA, 20 nt, Yersinia pestis KIM
aaaauuaagacauugcgcaa

SEQ ID NO: 4211861 - RNA, 13 nt, Yersinia pestis KIM
aaaauuaauaaau

SEQ ID NO: 4211862 - RNA, 17 nt, Yersinia pestis KIM
aaaauuaauaaauuaua

SEQ ID NO: 4211863 - RNA, 13 nt, Yersinia pestis KIM
aaaauuagagcaa

SEQ ID NO: 4211864 - RNA, 20 nt, Yersinia pestis KIM
aaaauuauggcuauacuuaa

SEQ ID NO: 4211865 - RNA, 18 nt, Yersinia pestis KIM
aaaauuauugccgcagau

SEQ ID NO: 4211866 - RNA, 17 nt, Yersinia pestis KIM
aaaauucaaacaaauau

SEQ ID NO: 4211867 - RNA, 15 nt, Yersinia pestis KIM
aaaauuguuugacuu

SEQ ID NO: 4211868 - RNA, 23 nt, Yersinia pestis KIM
aaaauuuauauucauauuucacu

SEQ ID NO: 4211869 - RNA, 18 nt, Yersinia pestis KIM
aaaauuugcuucguuucc

SEQ ID NO: 4211870 - RNA, 23 nt, Yersinia pestis KIM
aaacaaaaccuaacgccaaaaug

SEQ ID NO: 4211871 - RNA, 12 nt, Yersinia pestis KIM
aaacaaauacac

SEQ ID NO: 4211872 - RNA, 15 nt, Yersinia pestis KIM
aaacaaaucuuaaau

SEQ ID NO: 4211873 - RNA, 22 nt, Yersinia pestis KIM
aaacaaaucuuaaauugaagag

SEQ ID NO: 4211874 - RNA, 22 nt, Yersinia pestis KIM
aaacaacgccgcucaauuaacc

SEQ ID NO: 4211875 - RNA, 22 nt, Yersinia pestis KIM
aaacaacgcugaaaaaucuuug

SEQ ID NO: 4211876 - RNA, 23 nt, Yersinia pestis KIM
aaacaauaaacagacuaaaaacc

SEQ ID NO: 4211877 - RNA, 19 nt, Yersinia pestis KIM
aaacaaucugaugaauuaa

SEQ ID NO: 4211878 - RNA, 22 nt, Yersinia pestis KIM
aaacaaugugccgcgcaaccau

SEQ ID NO: 4211879 - RNA, 23 nt, Yersinia pestis KIM
aaacaauuuugguacagguguug

SEQ ID NO: 4211880 - RNA, 16 nt, Yersinia pestis KIM
aaacacccaagaauau

SEQ ID NO: 4211881 - RNA, 17 nt, Yersinia pestis KIM
aaacaccggcaauauga

SEQ ID NO: 4211882 - RNA, 14 nt, Yersinia pestis KIM
aaacacgcaacacu

SEQ ID NO: 4211883 - RNA, 15 nt, Yersinia pestis KIM
aaacacgcauaugaa

SEQ ID NO: 4211884 - RNA, 22 nt, Yersinia pestis KIM
aaacacugauuuauaaauaauu

SEQ ID NO: 4211885 - RNA, 17 nt, Yersinia pestis KIM
aaacacuuaugaucuug

SEQ ID NO: 4211886 - RNA, 21 nt, Yersinia pestis KIM
aaacagaacccccgcgaacag

SEQ ID NO: 4211887 - RNA, 14 nt, Yersinia pestis KIM
aaacagacaaaaaa

SEQ ID NO: 4211888 - RNA, 15 nt, Yersinia pestis KIM
aaacagacaaaaaau

SEQ ID NO: 4211889 - RNA, 12 nt, Yersinia pestis KIM
aaacagacccca

SEQ ID NO: 4211890 - RNA, 14 nt, Yersinia pestis KIM
aaacagagcaccgg

SEQ ID NO: 4211891 - RNA, 23 nt, Yersinia pestis KIM
aaacagauacaucgccaguguug

SEQ ID NO: 4211892 - RNA, 22 nt, Yersinia pestis KIM
aaacagauauuuucggguaucu

SEQ ID NO: 4211893 - RNA, 23 nt, Yersinia pestis KIM
aaacagaucacccgcaaaacuga

SEQ ID NO: 4211894 - RNA, 19 nt, Yersinia pestis KIM
aaacagguaaugcgcgcag

SEQ ID NO: 4211895 - RNA, 13 nt, Yersinia pestis KIM
aaacaguagcagg

SEQ ID NO: 4211896 - RNA, 12 nt, Yersinia pestis KIM
aaacagucuuau

SEQ ID NO: 4211897 - RNA, 15 nt, Yersinia pestis KIM
aaacagugucacuuc

SEQ ID NO: 4211898 - RNA, 18 nt, Yersinia pestis KIM
aaacaguuaaagguaaaa

SEQ ID NO: 4211899 - RNA, 13 nt, Yersinia pestis KIM
aaacauaaaaaau

SEQ ID NO: 4211900 - RNA, 23 nt, Yersinia pestis KIM
aaacaucaucccuauagacaaua

SEQ ID NO: 4211901 - RNA, 17 nt, Yersinia pestis KIM
aaacaucaugacaaaaa

SEQ ID NO: 4211902 - RNA, 17 nt, Yersinia pestis KIM
aaacaucgacaccaaga

SEQ ID NO: 4211903 - RNA, 20 nt, Yersinia pestis KIM
aaacauggcggcagcacaga

SEQ ID NO: 4211904 - RNA, 19 nt, Yersinia pestis KIM
aaacauugacgauggaauc

SEQ ID NO: 4211905 - RNA, 16 nt, Yersinia pestis KIM
aaacauugucaccuaa

SEQ ID NO: 4211906 - RNA, 16 nt, Yersinia pestis KIM
aaacauugucaccuga

SEQ ID NO: 4211907 - RNA, 22 nt, Yersinia pestis KIM
aaacauuguuaccuaaccaaac

SEQ ID NO: 4211908 - RNA, 17 nt, Yersinia pestis KIM
aaacauuuaaauaugaa

SEQ ID NO: 4211909 - RNA, 18 nt, Yersinia pestis KIM
aaacauuuacuuauaaac

SEQ ID NO: 4211910 - RNA, 20 nt, Yersinia pestis KIM
aaacauuuacuuauaaacac

SEQ ID NO: 4211911 - RNA, 20 nt, Yersinia pestis KIM
aaacauuuauguaugauauu

SEQ ID NO: 4211912 - RNA, 21 nt, Yersinia pestis KIM
aaaccaacaauauucgcagcc

SEQ ID NO: 4211913 - RNA, 17 nt, Yersinia pestis KIM
aaaccaacugaaacugg

SEQ ID NO: 4211914 - RNA, 16 nt, Yersinia pestis KIM
aaaccaagaagacuaa

SEQ ID NO: 4211915 - RNA, 15 nt, Yersinia pestis KIM
aaaccaccaaaauag

SEQ ID NO: 4211916 - RNA, 12 nt, Yersinia pestis KIM
aaaccacgcggu

SEQ ID NO: 4211917 - RNA, 10 nt, Yersinia pestis KIM
aaaccacuga

SEQ ID NO: 4211918 - RNA, 16 nt, Yersinia pestis KIM
aaaccacugaccuauu

SEQ ID NO: 4211919 - RNA, 21 nt, Yersinia pestis KIM
aaaccacugaccuauugauaa

SEQ ID NO: 4211920 - RNA, 18 nt, Yersinia pestis KIM
aaaccaucugaugcaggu

SEQ ID NO: 4211921 - RNA, 13 nt, Yersinia pestis KIM
aaaccauuuuuau

SEQ ID NO: 4211922 - RNA, 17 nt, Yersinia pestis KIM
aaacccaccugaaucuc

SEQ ID NO: 4211923 - RNA, 17 nt, Yersinia pestis KIM
aaacccauagcaaagau

SEQ ID NO: 4211924 - RNA, 21 nt, Yersinia pestis KIM
aaagauagcaaaagaaucagu

SEQ ID NO: 4211925 - RNA, 16 nt, Yersinia pestis KIM
aaagauccccacaaaa

SEQ ID NO: 4211926 - RNA, 22 nt, Yersinia pestis KIM
aaagauccccacaaaaucaacg

SEQ ID NO: 4211927 - RNA, 23 nt, Yersinia pestis KIM
aaagaucugcauugauuaaauca

SEQ ID NO: 4211928 - RNA, 16 nt, Yersinia pestis KIM
aaagauuaagacuuuc

SEQ ID NO: 4211929 - RNA, 20 nt, Yersinia pestis KIM
aaagauucauaaaaaaagaa

SEQ ID NO: 4211930 - RNA, 21 nt, Yersinia pestis KIM
aaagauuucaucggcaaaaac

SEQ ID NO: 4211931 - RNA, 22 nt, Yersinia pestis KIM
aaagauuucaucggcaaaaaca

SEQ ID NO: 4211932 - RNA, 14 nt, Yersinia pestis KIM
aaagauuuccuuuc

SEQ ID NO: 4211933 - RNA, 22 nt, Yersinia pestis KIM
aaagcaaacgccgcucuucagc

SEQ ID NO: 4211934 - RNA, 19 nt, Yersinia pestis KIM
aaagcaccgcagucgauaa

SEQ ID NO: 4211935 - RNA, 22 nt, Yersinia pestis KIM
aaagcaccgcgcgaugauggcg

SEQ ID NO: 4211936 - RNA, 21 nt, Yersinia pestis KIM
aaagcagaaagggcgcaugua

SEQ ID NO: 4211937 - RNA, 15 nt, Yersinia pestis KIM
aaagcagacuugaac

SEQ ID NO: 4211938 - RNA, 17 nt, Yersinia pestis KIM
aaagcagagaaugagua

SEQ ID NO: 4211939 - RNA, 19 nt, Yersinia pestis KIM
aaagcaucaaucaucugcu

SEQ ID NO: 4211940 - RNA, 14 nt, Yersinia pestis KIM
aaagcaucaccaaa

SEQ ID NO: 4211941 - RNA, 13 nt, Yersinia pestis KIM
aaagcaugcagaa

SEQ ID NO: 4211942 - RNA, 15 nt, Yersinia pestis KIM
aaagcaugcagaaua

SEQ ID NO: 4211943 - RNA, 17 nt, Yersinia pestis KIM
aaagcaugcagaauauc

SEQ ID NO: 4211944 - RNA, 20 nt, Yersinia pestis KIM
aaagcauuuaucauauuaac

SEQ ID NO: 4211945 - RNA, 13 nt, Yersinia pestis KIM
aaagccaaacccc

SEQ ID NO: 4211946 - RNA, 13 nt, Yersinia pestis KIM
aaagcccagguua

SEQ ID NO: 4211947 - RNA, 17 nt, Yersinia pestis KIM
aaagcccggucacucaa

SEQ ID NO: 4211948 - RNA, 11 nt, Yersinia pestis KIM
aaagccgacau

SEQ ID NO: 4211949 - RNA, 16 nt, Yersinia pestis KIM
aaagccgucaguuccu

SEQ ID NO: 4211950 - RNA, 14 nt, Yersinia pestis KIM
aaagccucuaccaa

SEQ ID NO: 4211951 - RNA, 12 nt, Yersinia pestis KIM
aaagccugccau

SEQ ID NO: 4211952 - RNA, 18 nt, Yersinia pestis KIM
aaagccuuucagcgcugc

SEQ ID NO: 4211953 - RNA, 19 nt, Yersinia pestis KIM
aaagcgccugugggcggcu

SEQ ID NO: 4211954 - RNA, 14 nt, Yersinia pestis KIM
aaagcgccuuuuau

SEQ ID NO: 4211955 - RNA, 19 nt, Yersinia pestis KIM
aaagcgggccagcaaccac

SEQ ID NO: 4211956 - RNA, 17 nt, Yersinia pestis KIM
aaagcgguaaauggcga

SEQ ID NO: 4211957 - RNA, 14 nt, Yersinia pestis KIM
aaagcgguuaucac

SEQ ID NO: 4211958 - RNA, 11 nt, Yersinia pestis KIM
aaagcgucagc

SEQ ID NO: 4211959 - RNA, 23 nt, Yersinia pestis KIM
aaagcguccgcgccaaggcaagg

SEQ ID NO: 4211960 - RNA, 18 nt, Yersinia pestis KIM
aaagcguccgcgccaggg

SEQ ID NO: 4211961 - RNA, 16 nt, Yersinia pestis KIM
aaagcguuaauuauag

SEQ ID NO: 4211962 - RNA, 20 nt, Yersinia pestis KIM
aaagcuaaaaaucucaacaa

SEQ ID NO: 4211963 - RNA, 17 nt, Yersinia pestis KIM
aaagcuauaaauaaauu

SEQ ID NO: 4211964 - RNA, 16 nt, Yersinia pestis KIM
aaagcuauccaccauc

SEQ ID NO: 4211965 - RNA, 16 nt, Yersinia pestis KIM
aaagcucugacaaaau

SEQ ID NO: 4211966 - RNA, 20 nt, Yersinia pestis KIM
aaagcugaucgcuaaaaagc

SEQ ID NO: 4211967 - RNA, 13 nt, Yersinia pestis KIM
aaagcuguaucga

SEQ ID NO: 4211968 - RNA, 16 nt, Yersinia pestis KIM
aaaggaacaaaagaga

SEQ ID NO: 4211969 - RNA, 15 nt, Yersinia pestis KIM
aaaggaguucugcag

SEQ ID NO: 4211970 - RNA, 21 nt, Yersinia pestis KIM
aaaggauggcccaagccaucc

SEQ ID NO: 4211971 - RNA, 23 nt, Yersinia pestis KIM
aaaggauggcccaagccauccuu

SEQ ID NO: 4211972 - RNA, 16 nt, Yersinia pestis KIM
aaaggcaaaaauugac

SEQ ID NO: 4211973 - RNA, 17 nt, Yersinia pestis KIM
aaaggcaaaagcaucac

SEQ ID NO: 4211974 - RNA, 12 nt, Yersinia pestis KIM
aaaggcaaagaa

SEQ ID NO: 4211975 - RNA, 21 nt, Yersinia pestis KIM
aaaggcaacgaaggcaacaac

SEQ ID NO: 4211976 - RNA, 17 nt, Yersinia pestis KIM
aaaggcaagauuucucu

SEQ ID NO: 4211977 - RNA, 20 nt, Yersinia pestis KIM
aaaggccaccaaauugcggc

SEQ ID NO: 4211978 - RNA, 20 nt, Yersinia pestis KIM
aaaggccagcgcagguggau

SEQ ID NO: 4211979 - RNA, 16 nt, Yersinia pestis KIM
aaaggcccgcuaguga

SEQ ID NO: 4211980 - RNA, 21 nt, Yersinia pestis KIM
aaaggcccgcuagugauagcg

SEQ ID NO: 4211981 - RNA, 15 nt, Yersinia pestis KIM
aaaggcuauuuaaau

SEQ ID NO: 4211982 - RNA, 16 nt, Yersinia pestis KIM
aaaggcuauuuaaauu

SEQ ID NO: 4211983 - RNA, 19 nt, Yersinia pestis KIM
aaagggauuacgccaucca

SEQ ID NO: 4211984 - RNA, 15 nt, Yersinia pestis KIM
aaagggcaacaauau

SEQ ID NO: 4211985 - RNA, 13 nt, Yersinia pestis KIM
aaagggggcggcu

SEQ ID NO: 4211986 - RNA, 15 nt, Yersinia pestis KIM
aaaggguaaucagaa

SEQ ID NO: 4211987 - RNA, 18 nt, Yersinia pestis KIM
aaagguaugugccaaaaa

SEQ ID NO: 4211988 - RNA, 20 nt, Yersinia pestis KIM
aaagguaugugccaaaaaaa

SEQ ID NO: 4211989 - RNA, 16 nt, Yersinia pestis KIM
aaagguuaacugcagu

SEQ ID NO: 4211990 - RNA, 15 nt, Yersinia pestis KIM
aaaguaaucaggcau

SEQ ID NO: 4211991 - RNA, 17 nt, Yersinia pestis KIM
aaaguaaucuuugagca

SEQ ID NO: 4211992 - RNA, 13 nt, Yersinia pestis KIM
aaaguagaaauaa

SEQ ID NO: 4211993 - RNA, 12 nt, Yersinia pestis KIM
aaaguagccaau

SEQ ID NO: 4211994 - RNA, 13 nt, Yersinia pestis KIM
aaaguaucgcuau

SEQ ID NO: 4211995 - RNA, 22 nt, Yersinia pestis KIM
aaaguauucuuaucaaucaaaa

SEQ ID NO: 4211996 - RNA, 22 nt, Yersinia pestis KIM
aaagucagcaaaucaaacaaau

SEQ ID NO: 4211997 - RNA, 20 nt, Yersinia pestis KIM
aaagucaucccgcaauggcg

SEQ ID NO: 4211998 - RNA, 14 nt, Yersinia pestis KIM
aaagucuuaaucuu

SEQ ID NO: 4211999 - RNA, 18 nt, Yersinia pestis KIM
aaagugcuauccucuuaa

SEQ ID NO: 4212000 - RNA, 20 nt, Yersinia pestis KIM
aaagugcugcaaggcauuaa

SEQ ID NO: 4212001 - RNA, 21 nt, Yersinia pestis KIM
aaagugcuuaacccaccaaua

SEQ ID NO: 4212002 - RNA, 14 nt, Yersinia pestis KIM
aaagugcuucucug

SEQ ID NO: 4212003 - RNA, 18 nt, Yersinia pestis KIM
aaaguggccacucaccuc

SEQ ID NO: 4212004 - RNA, 22 nt, Yersinia pestis KIM
aaaguggugagcugaucugcca

SEQ ID NO: 4212005 - RNA, 12 nt, Yersinia pestis KIM
aaaguguaauuu

SEQ ID NO: 4212006 - RNA, 14 nt, Yersinia pestis KIM
aaaguuaucaccaa

SEQ ID NO: 4212007 - RNA, 18 nt, Yersinia pestis KIM
aaaguuauugaccaauau

SEQ ID NO: 4212008 - RNA, 16 nt, Yersinia pestis KIM
aaaguucuucgaucaa

SEQ ID NO: 4212009 - RNA, 18 nt, Yersinia pestis KIM
aaaguugagcagcaauaa

SEQ ID NO: 4212010 - RNA, 17 nt, Yersinia pestis KIM
aaaguuuagcaaagcau

SEQ ID NO: 4212011 - RNA, 20 nt, Yersinia pestis KIM
aaaguuuagcaaagcaucga

SEQ ID NO: 4212012 - RNA, 20 nt, Yersinia pestis KIM
aaaguuuauaugcuugacug

SEQ ID NO: 4212013 - RNA, 15 nt, Yersinia pestis KIM
aaaguuuuuugaaau

SEQ ID NO: 4212014 - RNA, 17 nt, Yersinia pestis KIM
aaaguuuuuugaaauua

SEQ ID NO: 4212015 - RNA, 12 nt, Yersinia pestis KIM
aaauaaaauaau

SEQ ID NO: 4212016 - RNA, 12 nt, Yersinia pestis KIM
aaauaaacaaaa

SEQ ID NO: 4212017 - RNA, 13 nt, Yersinia pestis KIM
aaauaaacuuuua

SEQ ID NO: 4212018 - RNA, 19 nt, Yersinia pestis KIM
aaauaaaguccagaggccg

SEQ ID NO: 4212019 - RNA, 19 nt, Yersinia pestis KIM
aaauaaauaaguucagauu

SEQ ID NO: 4212020 - RNA, 12 nt, Yersinia pestis KIM
aaauaaauuuaa

SEQ ID NO: 4212021 - RNA, 13 nt, Yersinia pestis KIM
aaauaaccaacac

SEQ ID NO: 4212022 - RNA, 21 nt, Yersinia pestis KIM
aaauaaccgagcgugaagagc

SEQ ID NO: 4212023 - RNA, 19 nt, Yersinia pestis KIM
aaauaaccgccaaaauauc

SEQ ID NO: 4212024 - RNA, 14 nt, Yersinia pestis KIM
aaauaaccucuaau

SEQ ID NO: 4212025 - RNA, 16 nt, Yersinia pestis KIM
aaauaagaauaagggu

SEQ ID NO: 4212026 - RNA, 22 nt, Yersinia pestis KIM
aaauaaguacuuccaauaagug

SEQ ID NO: 4212027 - RNA, 19 nt, Yersinia pestis KIM
aaauaaguuaauacgccau

SEQ ID NO: 4212028 - RNA, 22 nt, Yersinia pestis KIM
aaauaauauaauucaauauaua

SEQ ID NO: 4212029 - RNA, 22 nt, Yersinia pestis KIM
aaauaauaucaagucuugaaga

SEQ ID NO: 4212030 - RNA, 15 nt, Yersinia pestis KIM
aaauaauaucaauga

SEQ ID NO: 4212031 - RNA, 18 nt, Yersinia pestis KIM
aaauaaucagcucauuaa

SEQ ID NO: 4212032 - RNA, 20 nt, Yersinia pestis KIM
aaauaaucagcucauuaaac

SEQ ID NO: 4212033 - RNA, 20 nt, Yersinia pestis KIM
aaauaaucauaucaaaauaa

SEQ ID NO: 4212034 - RNA, 16 nt, Yersinia pestis KIM
aaauaauggccaagcg

SEQ ID NO: 4212035 - RNA, 22 nt, Yersinia pestis KIM
aaauaaugucgucaauuaaaau

SEQ ID NO: 4212036 - RNA, 12 nt, Yersinia pestis KIM
aaauacaaaaau

SEQ ID NO: 4212037 - RNA, 16 nt, Yersinia pestis KIM
aaauacaaaaauacaa

SEQ ID NO: 4212038 - RNA, 23 nt, Yersinia pestis KIM
aaauacaggggcguuauugagaa

SEQ ID NO: 4212039 - RNA, 21 nt, Yersinia pestis KIM
aaaugaccaacuguaaaaucu

SEQ ID NO: 4212040 - RNA, 21 nt, Yersinia pestis KIM
aaaugacuaucccuucaauca

SEQ ID NO: 4212041 - RNA, 16 nt, Yersinia pestis KIM
aaaugaucaucagcag

SEQ ID NO: 4212042 - RNA, 24 nt, Yersinia pestis KIM
aaaugauuauuuauuuacagccac

SEQ ID NO: 4212043 - RNA, 14 nt, Yersinia pestis KIM
aaaugauuuaauuu

SEQ ID NO: 4212044 - RNA, 15 nt, Yersinia pestis KIM
aaaugcaauauugcu

SEQ ID NO: 4212045 - RNA, 22 nt, Yersinia pestis KIM
aaaugccauuuauugcggcuua

SEQ ID NO: 4212046 - RNA, 16 nt, Yersinia pestis KIM
aaaugccguacaacaa

SEQ ID NO: 4212047 - RNA, 18 nt, Yersinia pestis KIM
aaauggaauaaaaaguca

SEQ ID NO: 4212048 - RNA, 20 nt, Yersinia pestis KIM
aaauggcacuggaaacaaaa

SEQ ID NO: 4212049 - RNA, 21 nt, Yersinia pestis KIM
aaauggcacuggaaacaaaac

SEQ ID NO: 4212050 - RNA, 21 nt, Yersinia pestis KIM
aaauggcagggccgauaaaaa

SEQ ID NO: 4212051 - RNA, 15 nt, Yersinia pestis KIM
aaauggccuugccca

SEQ ID NO: 4212052 - RNA, 16 nt, Yersinia pestis KIM
aaauggccuugcccau

SEQ ID NO: 4212053 - RNA, 18 nt, Yersinia pestis KIM
aaauggcguuguagggag

SEQ ID NO: 4212054 - RNA, 19 nt, Yersinia pestis KIM
aaauggcuuuuuuaauaaa

SEQ ID NO: 4212055 - RNA, 19 nt, Yersinia pestis KIM
aaaugggccugaguggggg

SEQ ID NO: 4212056 - RNA, 18 nt, Yersinia pestis KIM
aaauggguauauuuacca

SEQ ID NO: 4212057 - RNA, 19 nt, Yersinia pestis KIM
aaauggguauauuuaccaa

SEQ ID NO: 4212058 - RNA, 15 nt, Yersinia pestis KIM
aaauggguuguucuu

SEQ ID NO: 4212059 - RNA, 16 nt, Yersinia pestis KIM
aaauggucaguuuaau

SEQ ID NO: 4212060 - RNA, 17 nt, Yersinia pestis KIM
aaaugguuugcuguucu

SEQ ID NO: 4212061 - RNA, 19 nt, Yersinia pestis KIM
aaaugguuugcuguucuug

SEQ ID NO: 4212062 - RNA, 17 nt, Yersinia pestis KIM
aaauguacagucauuua

SEQ ID NO: 4212063 - RNA, 23 nt, Yersinia pestis KIM
aaauguguuuucugugcuugagu

SEQ ID NO: 4212064 - RNA, 12 nt, Yersinia pestis KIM
aaauuaaaaauu

SEQ ID NO: 4212065 - RNA, 13 nt, Yersinia pestis KIM
aaauuaaaacuga

SEQ ID NO: 4212066 - RNA, 15 nt, Yersinia pestis KIM
aaauuaaaacugaaa

SEQ ID NO: 4212067 - RNA, 13 nt, Yersinia pestis KIM
aaauuaaaauaau

SEQ ID NO: 4212068 - RNA, 12 nt, Yersinia pestis KIM
aaauuaauaggu

SEQ ID NO: 4212069 - RNA, 14 nt, Yersinia pestis KIM
aaauuaaucuugua

SEQ ID NO: 4212070 - RNA, 16 nt, Yersinia pestis KIM
aaauuaaucuuguaaa

SEQ ID NO: 4212071 - RNA, 20 nt, Yersinia pestis KIM
aaauuacgugcccaaaaacg

SEQ ID NO: 4212072 - RNA, 19 nt, Yersinia pestis KIM
aaauuacucguauaaaaaa

SEQ ID NO: 4212073 - RNA, 22 nt, Yersinia pestis KIM
aaauuacucguauaaaaaauaa

SEQ ID NO: 4212074 - RNA, 15 nt, Yersinia pestis KIM
aaauuagaaaacaag

SEQ ID NO: 4212075 - RNA, 16 nt, Yersinia pestis KIM
aaauuagaaaacaagu

SEQ ID NO: 4212076 - RNA, 14 nt, Yersinia pestis KIM
aaauuauaaugaug

SEQ ID NO: 4212077 - RNA, 23 nt, Yersinia pestis KIM
aaauuauauucuuggguguuuau

SEQ ID NO: 4212078 - RNA, 12 nt, Yersinia pestis KIM
aaauuaucuaau

SEQ ID NO: 4212079 - RNA, 19 nt, Yersinia pestis KIM
aaauuaugccagucuucca

SEQ ID NO: 4212080 - RNA, 21 nt, Yersinia pestis KIM
aaauucaaaauagaggaaaua

SEQ ID NO: 4212081 - RNA, 18 nt, Yersinia pestis KIM
aaauucaaauaucauuau

SEQ ID NO: 4212082 - RNA, 22 nt, Yersinia pestis KIM
aaauucaaccucuuguaaacca

SEQ ID NO: 4212083 - RNA, 17 nt, Yersinia pestis KIM
aaauucaacuucuccug

SEQ ID NO: 4212084 - RNA, 11 nt, Yersinia pestis KIM
aaauucaauuc

SEQ ID NO: 4212085 - RNA, 17 nt, Yersinia pestis KIM
aaauucacaacagugca

SEQ ID NO: 4212086 - RNA, 19 nt, Yersinia pestis KIM
aaauucagguugaggcagg

SEQ ID NO: 4212087 - RNA, 14 nt, Yersinia pestis KIM
aaauucaucucacg

SEQ ID NO: 4212088 - RNA, 20 nt, Yersinia pestis KIM
aaauucaucuuuaacaacaa

SEQ ID NO: 4212089 - RNA, 14 nt, Yersinia pestis KIM
aaauucauucuuuu

SEQ ID NO: 4212090 - RNA, 16 nt, Yersinia pestis KIM
aaauucccguuuuauu

SEQ ID NO: 4212091 - RNA, 18 nt, Yersinia pestis KIM
aaauuccuauaaauuuua

SEQ ID NO: 4212092 - RNA, 18 nt, Yersinia pestis KIM
aaauucgugcucaucaac

SEQ ID NO: 4212093 - RNA, 23 nt, Yersinia pestis KIM
aaauucguuucucuaaaauuuua

SEQ ID NO: 4212094 - RNA, 14 nt, Yersinia pestis KIM
aaauucuaccuggc

SEQ ID NO: 4212095 - RNA, 15 nt, Yersinia pestis KIM
aaauucuaccuggcu

SEQ ID NO: 4212096 - RNA, 17 nt, Yersinia pestis KIM
aaauucucaaugauaaa

SEQ ID NO: 4212097 - RNA, 19 nt, Yersinia pestis KIM
aaauucucaaugauaaaau

SEQ ID NO: 4212098 - RNA, 22 nt, Yersinia pestis KIM
aaauucucaaugauaaaauccu

SEQ ID NO: 4212099 - RNA, 23 nt, Yersinia pestis KIM
aaauucucaaugauaaaauccug

SEQ ID NO: 4212100 - RNA, 21 nt, Yersinia pestis KIM
aaauucuguagaguaaaacug

SEQ ID NO: 4212101 - RNA, 23 nt, Yersinia pestis KIM
aaauucuuuauacccaaaauaau

SEQ ID NO: 4212102 - RNA, 12 nt, Yersinia pestis KIM
aaauugaagagu

SEQ ID NO: 4212103 - RNA, 18 nt, Yersinia pestis KIM
aaauugccccacauuacu

SEQ ID NO: 4212104 - RNA, 15 nt, Yersinia pestis KIM
aaauugccgcuuuag

SEQ ID NO: 4212105 - RNA, 19 nt, Yersinia pestis KIM
aaauugcgcccggcccacu

SEQ ID NO: 4212106 - RNA, 20 nt, Yersinia pestis KIM
aaauugcgcccggcccacuu

SEQ ID NO: 4212107 - RNA, 18 nt, Yersinia pestis KIM
aaauugggggucagggcg

SEQ ID NO: 4212108 - RNA, 20 nt, Yersinia pestis KIM
aaauugucugggauacgcgc

SEQ ID NO: 4212109 - RNA, 20 nt, Yersinia pestis KIM
aaauugugauucaacugccg

SEQ ID NO: 4212110 - RNA, 21 nt, Yersinia pestis KIM
aaauuguuccguuucucuuug

SEQ ID NO: 4212111 - RNA, 17 nt, Yersinia pestis KIM
aaauuuaagaaaucuau

SEQ ID NO: 4212112 - RNA, 14 nt, Yersinia pestis KIM
aaauuuaauaaguu

SEQ ID NO: 4212113 - RNA, 13 nt, Yersinia pestis KIM
aaauuuagccgca

SEQ ID NO: 4212114 - RNA, 15 nt, Yersinia pestis KIM
aaauuuaucaguagc

SEQ ID NO: 4212115 - RNA, 14 nt, Yersinia pestis KIM
aaauuuauccugua

SEQ ID NO: 4212116 - RNA, 13 nt, Yersinia pestis KIM
aaauuuaucuaau

SEQ ID NO: 4212117 - RNA, 10 nt, Yersinia pestis KIM
aaauuucagu

SEQ ID NO: 4212118 - RNA, 12 nt, Yersinia pestis KIM
aaauuucccccu

SEQ ID NO: 4212119 - RNA, 20 nt, Yersinia pestis KIM
aaauuuggccuuucucggug

SEQ ID NO: 4212120 - RNA, 11 nt, Yersinia pestis KIM
aaauuuuaaac

SEQ ID NO: 4212121 - RNA, 15 nt, Yersinia pestis KIM
aaauuuuauauuauc

SEQ ID NO: 4212122 - RNA, 11 nt, Yersinia pestis KIM
aaauuuuauga

SEQ ID NO: 4212123 - RNA, 22 nt, Yersinia pestis KIM
aaauuuuauucgcguuucauuu

SEQ ID NO: 4212124 - RNA, 19 nt, Yersinia pestis KIM
aaauuuucuaagcugccug

SEQ ID NO: 4212125 - RNA, 20 nt, Yersinia pestis KIM
aaauuuucuaagcugccugu

SEQ ID NO: 4212126 - RNA, 23 nt, Yersinia pestis KIM
aacaaaauagggcgccccgauaa

SEQ ID NO: 4212127 - RNA, 21 nt, Yersinia pestis KIM
aacaaaaucgcgaccagcaga

SEQ ID NO: 4212128 - RNA, 22 nt, Yersinia pestis KIM
aacaaaaucgcgaccagcagaa

SEQ ID NO: 4212129 - RNA, 14 nt, Yersinia pestis KIM
aacaaacacaucca

SEQ ID NO: 4212130 - RNA, 22 nt, Yersinia pestis KIM
aacaaaccuaaaccuuucagac

SEQ ID NO: 4212131 - RNA, 23 nt, Yersinia pestis KIM
aacaaaucuuaaauugaagaguu

SEQ ID NO: 4212132 - RNA, 16 nt, Yersinia pestis KIM
aacaaaugaacccuuu

SEQ ID NO: 4212133 - RNA, 23 nt, Yersinia pestis KIM
aacaacccauuuccccuuucugg

SEQ ID NO: 4212134 - RNA, 17 nt, Yersinia pestis KIM
aacaacccgaauuaaua

SEQ ID NO: 4212135 - RNA, 22 nt, Yersinia pestis KIM
aacaaccguggcgucgcccguu

SEQ ID NO: 4212136 - RNA, 19 nt, Yersinia pestis KIM
aacaaccuaaaaaaaacaa

SEQ ID NO: 4212137 - RNA, 17 nt, Yersinia pestis KIM
aacaacgacuccaucac

SEQ ID NO: 4212138 - RNA, 19 nt, Yersinia pestis KIM
aacaacgccgcucaauuaa

SEQ ID NO: 4212139 - RNA, 15 nt, Yersinia pestis KIM
aacaacggugaacag

SEQ ID NO: 4212140 - RNA, 16 nt, Yersinia pestis KIM
aacaacgucauuugug

SEQ ID NO: 4212141 - RNA, 23 nt, Yersinia pestis KIM
aacaagacugcuaauaccaccac

SEQ ID NO: 4212142 - RNA, 17 nt, Yersinia pestis KIM
aacaagccccacaguac

SEQ ID NO: 4212143 - RNA, 16 nt, Yersinia pestis KIM
aacaaggcaaauagag

SEQ ID NO: 4212144 - RNA, 16 nt, Yersinia pestis KIM
aacaagggguuucaga

SEQ ID NO: 4212145 - RNA, 17 nt, Yersinia pestis KIM
aacaaguugaaccauaa

SEQ ID NO: 4212146 - RNA, 21 nt, Yersinia pestis KIM
aacaauaaaaagaucugcauu

SEQ ID NO: 4212147 - RNA, 21 nt, Yersinia pestis KIM
aacaauaauucgcaugguuaa

SEQ ID NO: 4212148 - RNA, 15 nt, Yersinia pestis KIM
aacaauaccgccaau

SEQ ID NO: 4212149 - RNA, 21 nt, Yersinia pestis KIM
aacaauauucauuuugcugga

SEQ ID NO: 4212150 - RNA, 14 nt, Yersinia pestis KIM
aacaaucaccaccu

SEQ ID NO: 4212151 - RNA, 19 nt, Yersinia pestis KIM
aacaaucagugcaauaaau

SEQ ID NO: 4212152 - RNA, 14 nt, Yersinia pestis KIM
aacaauccgaacaa

SEQ ID NO: 4212153 - RNA, 16 nt, Yersinia pestis KIM
aacauaucaaacagcu

SEQ ID NO: 4212154 - RNA, 12 nt, Yersinia pestis KIM
aacauaucaaua

SEQ ID NO: 4212155 - RNA, 16 nt, Yersinia pestis KIM
aacauauccugugcca

SEQ ID NO: 4212156 - RNA, 17 nt, Yersinia pestis KIM
aacauauccugugccaa

SEQ ID NO: 4212157 - RNA, 21 nt, Yersinia pestis KIM
aacauauugcucugccgcagu

SEQ ID NO: 4212158 - RNA, 18 nt, Yersinia pestis KIM
aacaucaugagauaaaua

SEQ ID NO: 4212159 - RNA, 19 nt, Yersinia pestis KIM
aacauccagauauggcauu

SEQ ID NO: 4212160 - RNA, 14 nt, Yersinia pestis KIM
aacauccauguaag

SEQ ID NO: 4212161 - RNA, 17 nt, Yersinia pestis KIM
aacauccgaauuuuuac

SEQ ID NO: 4212162 - RNA, 22 nt, Yersinia pestis KIM
aacaucgacaccaagacugaag

SEQ ID NO: 4212163 - RNA, 18 nt, Yersinia pestis KIM
aacaucgccacgaauggc

SEQ ID NO: 4212164 - RNA, 14 nt, Yersinia pestis KIM
aacaucgcgcugcu

SEQ ID NO: 4212165 - RNA, 14 nt, Yersinia pestis KIM
aacaucgcggaugc

SEQ ID NO: 4212166 - RNA, 14 nt, Yersinia pestis KIM
aacaucuaccucug

SEQ ID NO: 4212167 - RNA, 19 nt, Yersinia pestis KIM
aacaugagccacacauuca

SEQ ID NO: 4212168 - RNA, 12 nt, Yersinia pestis KIM
aacaugcugaag

SEQ ID NO: 4212169 - RNA, 13 nt, Yersinia pestis KIM
aacaugcugaagc

SEQ ID NO: 4212170 - RNA, 19 nt, Yersinia pestis KIM
aacaugcugaagccagcac

SEQ ID NO: 4212171 - RNA, 18 nt, Yersinia pestis KIM
aacaugggguaaucccga

SEQ ID NO: 4212172 - RNA, 18 nt, Yersinia pestis KIM
aacaugguaugccacuua

SEQ ID NO: 4212173 - RNA, 12 nt, Yersinia pestis KIM
aacauguagcac

SEQ ID NO: 4212174 - RNA, 13 nt, Yersinia pestis KIM
aacauuaaaaaua

SEQ ID NO: 4212175 - RNA, 21 nt, Yersinia pestis KIM
aacauuacuuugaauagcacc

SEQ ID NO: 4212176 - RNA, 13 nt, Yersinia pestis KIM
aacauuauccguu

SEQ ID NO: 4212177 - RNA, 18 nt, Yersinia pestis KIM
aacauuauccguuugcaa

SEQ ID NO: 4212178 - RNA, 14 nt, Yersinia pestis KIM
aacauuauuuuuca

SEQ ID NO: 4212179 - RNA, 19 nt, Yersinia pestis KIM
aacauuauuuuucacgagg

SEQ ID NO: 4212180 - RNA, 20 nt, Yersinia pestis KIM
aacauugguuacccuaagaa

SEQ ID NO: 4212181 - RNA, 23 nt, Yersinia pestis KIM
aacauuguuaccuaaccaaacau

SEQ ID NO: 4212182 - RNA, 17 nt, Yersinia pestis KIM
aacauuuacuuauaaac

SEQ ID NO: 4212183 - RNA, 22 nt, Yersinia pestis KIM
aacauuuaucuaucuguucacc

SEQ ID NO: 4212184 - RNA, 12 nt, Yersinia pestis KIM
aacauuucauuc

SEQ ID NO: 4212185 - RNA, 12 nt, Yersinia pestis KIM
aacauuuucuaa

SEQ ID NO: 4212186 - RNA, 16 nt, Yersinia pestis KIM
aacauuuucuaagcug

SEQ ID NO: 4212187 - RNA, 18 nt, Yersinia pestis KIM
aacauuuucuaagcugcc

SEQ ID NO: 4212188 - RNA, 20 nt, Yersinia pestis KIM
aacauuuucuaagcugccug

SEQ ID NO: 4212189 - RNA, 14 nt, Yersinia pestis KIM
aacauuuuuucuuu

SEQ ID NO: 4212190 - RNA, 23 nt, Yersinia pestis KIM
aaccaaaaagggcacagcgagau

SEQ ID NO: 4212191 - RNA, 24 nt, Yersinia pestis KIM
aaccaaaauauucgcauugugcuu

SEQ ID NO: 4212192 - RNA, 23 nt, Yersinia pestis KIM
aaccaaagauaauacauaaaauc

SEQ ID NO: 4212193 - RNA, 14 nt, Yersinia pestis KIM
aaccaacaaacaau

SEQ ID NO: 4212194 - RNA, 20 nt, Yersinia pestis KIM
aaccaacaauauucgcagcc

SEQ ID NO: 4212195 - RNA, 14 nt, Yersinia pestis KIM
aaccaagacauaau

SEQ ID NO: 4212196 - RNA, 15 nt, Yersinia pestis KIM
aaccaauccaugcca

SEQ ID NO: 4212197 - RNA, 12 nt, Yersinia pestis KIM
aaccacagcaau

SEQ ID NO: 4212198 - RNA, 14 nt, Yersinia pestis KIM
aaccaccaaaauag

SEQ ID NO: 4212199 - RNA, 21 nt, Yersinia pestis KIM
aaccaccgggugaguuaccua

SEQ ID NO: 4212200 - RNA, 18 nt, Yersinia pestis KIM
aaccaccggguuuaguau

SEQ ID NO: 4212201 - RNA, 16 nt, Yersinia pestis KIM
aaccaccgucaccaaa

SEQ ID NO: 4212202 - RNA, 15 nt, Yersinia pestis KIM
aaccacgguaucaau

SEQ ID NO: 4212203 - RNA, 15 nt, Yersinia pestis KIM
aaccacucucccuca

SEQ ID NO: 4212204 - RNA, 14 nt, Yersinia pestis KIM
aaccacugaccuau

SEQ ID NO: 4212205 - RNA, 19 nt, Yersinia pestis KIM
aaccacugaccuauugaua

SEQ ID NO: 4212206 - RNA, 21 nt, Yersinia pestis KIM
aaccacugaccuauugauaaa

SEQ ID NO: 4212207 - RNA, 13 nt, Yersinia pestis KIM
aaccagaauaauc

SEQ ID NO: 4212208 - RNA, 20 nt, Yersinia pestis KIM
aaccagagcggagccucagu

SEQ ID NO: 4212209 - RNA, 17 nt, Yersinia pestis KIM
aaccagauaacaacaaa

SEQ ID NO: 4212210 - RNA, 21 nt, Yersinia pestis KIM
aaccagauaacaacaaagaua

SEQ ID NO: 4212211 - RNA, 14 nt, Yersinia pestis KIM
aaccagcguugaga

SEQ ID NO: 4212212 - RNA, 20 nt, Yersinia pestis KIM
aaccaggccgccaucaucau

SEQ ID NO: 4212213 - RNA, 16 nt, Yersinia pestis KIM
aaccaguuagaaucca

SEQ ID NO: 4212214 - RNA, 12 nt, Yersinia pestis KIM
aaccaguucugg

SEQ ID NO: 4212215 - RNA, 19 nt, Yersinia pestis KIM
aaccauaaaauaaauaauu

SEQ ID NO: 4212216 - RNA, 20 nt, Yersinia pestis KIM
aaccauaaaauaaauaauuu

SEQ ID NO: 4212217 - RNA, 14 nt, Yersinia pestis KIM
aaccaucaaauaca

SEQ ID NO: 4212218 - RNA, 15 nt, Yersinia pestis KIM
aaccaucaaauacac

SEQ ID NO: 4212219 - RNA, 13 nt, Yersinia pestis KIM
aaccauccauauu

SEQ ID NO: 4212220 - RNA, 13 nt, Yersinia pestis KIM
aaccaugagaaua

SEQ ID NO: 4212221 - RNA, 15 nt, Yersinia pestis KIM
aaccaugaugacaau

SEQ ID NO: 4212222 - RNA, 20 nt, Yersinia pestis KIM
aaccaugcugcccgcacacu

SEQ ID NO: 4212223 - RNA, 15 nt, Yersinia pestis KIM
aaccauggcacucuc

SEQ ID NO: 4212224 - RNA, 17 nt, Yersinia pestis KIM
aaccauggcacucucuu

SEQ ID NO: 4212225 - RNA, 15 nt, Yersinia pestis KIM
aaccauuguggcuaa

SEQ ID NO: 4212226 - RNA, 18 nt, Yersinia pestis KIM
aacccaaaggggagccaa

SEQ ID NO: 4212227 - RNA, 20 nt, Yersinia pestis KIM
aacccacaucccggcagcag

SEQ ID NO: 4212228 - RNA, 21 nt, Yersinia pestis KIM
aacccagccccuaacagcagu

SEQ ID NO: 4212229 - RNA, 23 nt, Yersinia pestis KIM
aacccagccccuaacagcagugc

SEQ ID NO: 4212230 - RNA, 13 nt, Yersinia pestis KIM
aacccauagcaaa

SEQ ID NO: 4212231 - RNA, 17 nt, Yersinia pestis KIM
aacccauauuacucaca

SEQ ID NO: 4212232 - RNA, 21 nt, Yersinia pestis KIM
aacccaucaagcggcccauca

SEQ ID NO: 4212233 - RNA, 23 nt, Yersinia pestis KIM
aacccauuaaaaacaaaugauua

SEQ ID NO: 4212234 - RNA, 12 nt, Yersinia pestis KIM
aacccauucauc

SEQ ID NO: 4212235 - RNA, 16 nt, Yersinia pestis KIM
aacccauugguuuuua

SEQ ID NO: 4212236 - RNA, 23 nt, Yersinia pestis KIM
aacccauuuccccuuucuggugg

SEQ ID NO: 4212237 - RNA, 19 nt, Yersinia pestis KIM
aacccauuugcacagcauu

SEQ ID NO: 4212238 - RNA, 22 nt, Yersinia pestis KIM
aacccauuugcacagcauuuau

SEQ ID NO: 4212239 - RNA, 16 nt, Yersinia pestis KIM
aacccccugcuaggca

SEQ ID NO: 4212240 - RNA, 13 nt, Yersinia pestis KIM
aaccccuagccag

SEQ ID NO: 4212241 - RNA, 22 nt, Yersinia pestis KIM
aaccccuagccagccaccgcac

SEQ ID NO: 4212242 - RNA, 13 nt, Yersinia pestis KIM
aaccccuuuugau

SEQ ID NO: 4212243 - RNA, 17 nt, Yersinia pestis KIM
aacccgcuaauauuuuc

SEQ ID NO: 4212244 - RNA, 21 nt, Yersinia pestis KIM
aacccgcugcguacggacggu

SEQ ID NO: 4212245 - RNA, 12 nt, Yersinia pestis KIM
aacccggcgacg

SEQ ID NO: 4212246 - RNA, 14 nt, Yersinia pestis KIM
aacccggcuguuaa

SEQ ID NO: 4212247 - RNA, 16 nt, Yersinia pestis KIM
aacccggcuguuaaau

SEQ ID NO: 4212248 - RNA, 15 nt, Yersinia pestis KIM
aacccuaccuaggcc

SEQ ID NO: 4212249 - RNA, 13 nt, Yersinia pestis KIM
aacccucaguaaa

SEQ ID NO: 4212250 - RNA, 21 nt, Yersinia pestis KIM
aacccugcguaaauuacguuc

SEQ ID NO: 4212251 - RNA, 16 nt, Yersinia pestis KIM
aaccgaagcugcggcu

SEQ ID NO: 4212252 - RNA, 17 nt, Yersinia pestis KIM
aaccgaggcgcugacau

SEQ ID NO: 4212253 - RNA, 21 nt, Yersinia pestis KIM
aaccgaugaagaagcguucaa

SEQ ID NO: 4212254 - RNA, 19 nt, Yersinia pestis KIM
aaccgauugcaugauacug

SEQ ID NO: 4212255 - RNA, 22 nt, Yersinia pestis KIM
aaccgcaccacaaaggcaaaau

SEQ ID NO: 4212256 - RNA, 23 nt, Yersinia pestis KIM
aaccgcaucauuguuuacuauuu

SEQ ID NO: 4212257 - RNA, 13 nt, Yersinia pestis KIM
aaccgccaaaaua

SEQ ID NO: 4212258 - RNA, 20 nt, Yersinia pestis KIM
aaccgccacugauaccgaua

SEQ ID NO: 4212259 - RNA, 17 nt, Yersinia pestis KIM
aaccgccauugcauauu

SEQ ID NO: 4212260 - RNA, 15 nt, Yersinia pestis KIM
aaccgccccccaucc

SEQ ID NO: 4212261 - RNA, 17 nt, Yersinia pestis KIM
aaccgccccccaucccc

SEQ ID NO: 4212262 - RNA, 16 nt, Yersinia pestis KIM
aaccgcccucuugaac

SEQ ID NO: 4212263 - RNA, 18 nt, Yersinia pestis KIM
aaccgcccucuugaacgg

SEQ ID NO: 4212264 - RNA, 19 nt, Yersinia pestis KIM
aaccgcccucuugaacggu

SEQ ID NO: 4212265 - RNA, 20 nt, Yersinia pestis KIM
aaccgcgaagaggguuuuuu

SEQ ID NO: 4212266 - RNA, 22 nt, Yersinia pestis KIM
aaccgcuauaucaucagcagag

SEQ ID NO: 4212267 - RNA, 18 nt, Yersinia pestis KIM
aaccgcuguuuuaaucgg

SEQ ID NO: 4212268 - RNA, 14 nt, Yersinia pestis KIM
aacguaaacaucuu

SEQ ID NO: 4212269 - RNA, 17 nt, Yersinia pestis KIM
aacguaauaucugccac

SEQ ID NO: 4212270 - RNA, 12 nt, Yersinia pestis KIM
aacguagcuaac

SEQ ID NO: 4212271 - RNA, 15 nt, Yersinia pestis KIM
aacguagcugaauug

SEQ ID NO: 4212272 - RNA, 21 nt, Yersinia pestis KIM
aacguauucccgcuaccgagu

SEQ ID NO: 4212273 - RNA, 12 nt, Yersinia pestis KIM
aacgucaacaga

SEQ ID NO: 4212274 - RNA, 17 nt, Yersinia pestis KIM
aacgucaacagaacuaa

SEQ ID NO: 4212275 - RNA, 20 nt, Yersinia pestis KIM
aacgucagauaaaaaagggu

SEQ ID NO: 4212276 - RNA, 17 nt, Yersinia pestis KIM
aacgucagauaaacaaa

SEQ ID NO: 4212277 - RNA, 12 nt, Yersinia pestis KIM
aacgucagauua

SEQ ID NO: 4212278 - RNA, 19 nt, Yersinia pestis KIM
aacgucaucgccacacgca

SEQ ID NO: 4212279 - RNA, 16 nt, Yersinia pestis KIM
aacguccaacugacgc

SEQ ID NO: 4212280 - RNA, 12 nt, Yersinia pestis KIM
aacgucccauuc

SEQ ID NO: 4212281 - RNA, 18 nt, Yersinia pestis KIM
aacgucuuaugccauaac

SEQ ID NO: 4212282 - RNA, 18 nt, Yersinia pestis KIM
aacgugaacauugcagua

SEQ ID NO: 4212283 - RNA, 11 nt, Yersinia pestis KIM
aacgugacaua

SEQ ID NO: 4212284 - RNA, 16 nt, Yersinia pestis KIM
aacgugacucuuuguu

SEQ ID NO: 4212285 - RNA, 22 nt, Yersinia pestis KIM
aacgugguugcggcaccugccc

SEQ ID NO: 4212286 - RNA, 22 nt, Yersinia pestis KIM
aacguguacuuucccugcuggc

SEQ ID NO: 4212287 - RNA, 22 nt, Yersinia pestis KIM
aacguguuagguaauaccaaug

SEQ ID NO: 4212288 - RNA, 13 nt, Yersinia pestis KIM
aacguuaacugca

SEQ ID NO: 4212289 - RNA, 14 nt, Yersinia pestis KIM
aacguuaacugcag

SEQ ID NO: 4212290 - RNA, 16 nt, Yersinia pestis KIM
aacguuaacugcagua

SEQ ID NO: 4212291 - RNA, 13 nt, Yersinia pestis KIM
aacguuagagcac

SEQ ID NO: 4212292 - RNA, 16 nt, Yersinia pestis KIM
aacguucaacaccaca

SEQ ID NO: 4212293 - RNA, 21 nt, Yersinia pestis KIM
aacguucguagauaauuucua

SEQ ID NO: 4212294 - RNA, 13 nt, Yersinia pestis KIM
aacguucugccaa

SEQ ID NO: 4212295 - RNA, 19 nt, Yersinia pestis KIM
aacguuguuauuucuguuc

SEQ ID NO: 4212296 - RNA, 19 nt, Yersinia pestis KIM
aacguuuaucgcuaccgcg

SEQ ID NO: 4212297 - RNA, 22 nt, Yersinia pestis KIM
aacguuucuggaaugagaugaa

SEQ ID NO: 4212298 - RNA, 15 nt, Yersinia pestis KIM
aacguuuuaacgcuu

SEQ ID NO: 4212299 - RNA, 15 nt, Yersinia pestis KIM
aacuaaacgccaaca

SEQ ID NO: 4212300 - RNA, 22 nt, Yersinia pestis KIM
aacuaacgauugacggaaaauu

SEQ ID NO: 4212301 - RNA, 21 nt, Yersinia pestis KIM
aacuaacguuuuguaaucaac

SEQ ID NO: 4212302 - RNA, 12 nt, Yersinia pestis KIM
aacuaagcugcc

SEQ ID NO: 4212303 - RNA, 13 nt, Yersinia pestis KIM
aacuaaggggcca

SEQ ID NO: 4212304 - RNA, 18 nt, Yersinia pestis KIM
aacuaauaucaacagaac

SEQ ID NO: 4212305 - RNA, 21 nt, Yersinia pestis KIM
aacuaauaucaacagaacuaa

SEQ ID NO: 4212306 - RNA, 22 nt, Yersinia pestis KIM
aacuaauaucaacagaacuaaa

SEQ ID NO: 4212307 - RNA, 17 nt, Yersinia pestis KIM
aacuacaccgcuaaccu

SEQ ID NO: 4212308 - RNA, 20 nt, Yersinia pestis KIM
aacuacaccgcuaaccuuaa

SEQ ID NO: 4212309 - RNA, 13 nt, Yersinia pestis KIM
aacuacuccaucc

SEQ ID NO: 4212310 - RNA, 16 nt, Yersinia pestis KIM
aacuacuccaucccca

SEQ ID NO: 4212311 - RNA, 13 nt, Yersinia pestis KIM
aacuauucauccc

SEQ ID NO: 4212312 - RNA, 21 nt, Yersinia pestis KIM
aacuauuggucaaucuagagg

SEQ ID NO: 4212313 - RNA, 15 nt, Yersinia pestis KIM
aacuauuuggugguu

SEQ ID NO: 4212314 - RNA, 13 nt, Yersinia pestis KIM
aacucaaaacaau

SEQ ID NO: 4212315 - RNA, 13 nt, Yersinia pestis KIM
aacucaaauuauu

SEQ ID NO: 4212316 - RNA, 22 nt, Yersinia pestis KIM
aacucaccgagcauauuuuuua

SEQ ID NO: 4212317 - RNA, 16 nt, Yersinia pestis KIM
aacucaccuaaaucau

SEQ ID NO: 4212318 - RNA, 19 nt, Yersinia pestis KIM
aacucaccuaaaucauaca

SEQ ID NO: 4212319 - RNA, 16 nt, Yersinia pestis KIM
aacucaccuuuaucgc

SEQ ID NO: 4212320 - RNA, 16 nt, Yersinia pestis KIM
aacucacuguucagac

SEQ ID NO: 4212321 - RNA, 16 nt, Yersinia pestis KIM
aacucagccaucaguu

SEQ ID NO: 4212322 - RNA, 15 nt, Yersinia pestis KIM
aacucagccauugcu

SEQ ID NO: 4212323 - RNA, 20 nt, Yersinia pestis KIM
aacucagccauugcuuugcg

SEQ ID NO: 4212324 - RNA, 22 nt, Yersinia pestis KIM
aacucaggauccucgucguaau

SEQ ID NO: 4212325 - RNA, 13 nt, Yersinia pestis KIM
aacucagugaaac

SEQ ID NO: 4212326 - RNA, 19 nt, Yersinia pestis KIM
aacucauccuaccgccagc

SEQ ID NO: 4212327 - RNA, 23 nt, Yersinia pestis KIM
aacucauccuaccgccagcugac

SEQ ID NO: 4212328 - RNA, 20 nt, Yersinia pestis KIM
aacucaucggcguuacagua

SEQ ID NO: 4212329 - RNA, 18 nt, Yersinia pestis KIM
aacucaugacaucccagc

SEQ ID NO: 4212330 - RNA, 19 nt, Yersinia pestis KIM
aacucauuuaucuaaaacu

SEQ ID NO: 4212331 - RNA, 20 nt, Yersinia pestis KIM
aacuccaggguaauaaguga

SEQ ID NO: 4212332 - RNA, 23 nt, Yersinia pestis KIM
aacucccgauucagcucugccag

SEQ ID NO: 4212333 - RNA, 20 nt, Yersinia pestis KIM
aacuccuuuguuauuucugg

SEQ ID NO: 4212334 - RNA, 17 nt, Yersinia pestis KIM
aacucgagcauuugacc

SEQ ID NO: 4212335 - RNA, 18 nt, Yersinia pestis KIM
aacucgagcauuugaccg

SEQ ID NO: 4212336 - RNA, 16 nt, Yersinia pestis KIM
aacucgccacucacaa

SEQ ID NO: 4212337 - RNA, 22 nt, Yersinia pestis KIM
aacucuaaggguaaaaucccca

SEQ ID NO: 4212338 - RNA, 14 nt, Yersinia pestis KIM
aacucuucuguugc

SEQ ID NO: 4212339 - RNA, 15 nt, Yersinia pestis KIM
aacugaacugaacug

SEQ ID NO: 4212340 - RNA, 20 nt, Yersinia pestis KIM
aacugaauacuuugcggcuc

SEQ ID NO: 4212341 - RNA, 11 nt, Yersinia pestis KIM
aacugaaucac

SEQ ID NO: 4212342 - RNA, 13 nt, Yersinia pestis KIM
aacugaaugcguu

SEQ ID NO: 4212343 - RNA, 19 nt, Yersinia pestis KIM
aacugacacacaccaguga

SEQ ID NO: 4212344 - RNA, 22 nt, Yersinia pestis KIM
aacugaccgaugucaucaccgu

SEQ ID NO: 4212345 - RNA, 17 nt, Yersinia pestis KIM
aacugaccgcagccuuc

SEQ ID NO: 4212346 - RNA, 14 nt, Yersinia pestis KIM
aacugacugaaguu

SEQ ID NO: 4212347 - RNA, 15 nt, Yersinia pestis KIM
aacugacugaaguua

SEQ ID NO: 4212348 - RNA, 21 nt, Yersinia pestis KIM
aacugaggugaacugaacuga

SEQ ID NO: 4212349 - RNA, 23 nt, Yersinia pestis KIM
aacugaguuggaaaugacaaauc

SEQ ID NO: 4212350 - RNA, 13 nt, Yersinia pestis KIM
aacugaucaauau

SEQ ID NO: 4212351 - RNA, 18 nt, Yersinia pestis KIM
aacugauuuaaccgaugc

SEQ ID NO: 4212352 - RNA, 15 nt, Yersinia pestis KIM
aacugcaaauguuca

SEQ ID NO: 4212353 - RNA, 19 nt, Yersinia pestis KIM
aacugcauagcuaaccuua

SEQ ID NO: 4212354 - RNA, 22 nt, Yersinia pestis KIM
aacugcauuucaauucguucaa

SEQ ID NO: 4212355 - RNA, 20 nt, Yersinia pestis KIM
aacugccagcuaaaagggga

SEQ ID NO: 4212356 - RNA, 12 nt, Yersinia pestis KIM
aacugccgccau

SEQ ID NO: 4212357 - RNA, 21 nt, Yersinia pestis KIM
aacugcggcaauaagcauuau

SEQ ID NO: 4212358 - RNA, 14 nt, Yersinia pestis KIM
aacugcggcauuaa

SEQ ID NO: 4212359 - RNA, 20 nt, Yersinia pestis KIM
aacuggcccagcuuuaucgg

SEQ ID NO: 4212360 - RNA, 16 nt, Yersinia pestis KIM
aacuggcgcaauguca

SEQ ID NO: 4212361 - RNA, 23 nt, Yersinia pestis KIM
aacuggcgcuggaccuuaucauc

SEQ ID NO: 4212362 - RNA, 15 nt, Yersinia pestis KIM
aacugguugagauaa

SEQ ID NO: 4212363 - RNA, 16 nt, Yersinia pestis KIM
aacuguaaaaucuuuc

SEQ ID NO: 4212364 - RNA, 14 nt, Yersinia pestis KIM
aacuguaaauauca

SEQ ID NO: 4212365 - RNA, 20 nt, Yersinia pestis KIM
aacugucagucaaaagaaac

SEQ ID NO: 4212366 - RNA, 20 nt, Yersinia pestis KIM
aacugucgggggcucguugg

SEQ ID NO: 4212367 - RNA, 19 nt, Yersinia pestis KIM
aacugugcgaauggaaaaa

SEQ ID NO: 4212368 - RNA, 19 nt, Yersinia pestis KIM
aacuguggauuaugugcgg

SEQ ID NO: 4212369 - RNA, 17 nt, Yersinia pestis KIM
aacuguggcaugacuga

SEQ ID NO: 4212370 - RNA, 21 nt, Yersinia pestis KIM
aacuguggcaugacugaugcg

SEQ ID NO: 4212371 - RNA, 16 nt, Yersinia pestis KIM
aacuguguuuauacca

SEQ ID NO: 4212372 - RNA, 17 nt, Yersinia pestis KIM
aacuguguuuauaccaa

SEQ ID NO: 4212373 - RNA, 15 nt, Yersinia pestis KIM
aacuguuaaaacagg

SEQ ID NO: 4212374 - RNA, 20 nt, Yersinia pestis KIM
aacuguucuuauugcuaucu

SEQ ID NO: 4212375 - RNA, 23 nt, Yersinia pestis KIM
aacuguucuuauugcuaucuguu

SEQ ID NO: 4212376 - RNA, 22 nt, Yersinia pestis KIM
aacuguugcaaacggauaaugu

SEQ ID NO: 4212377 - RNA, 23 nt, Yersinia pestis KIM
aacuguuuugcugauucagauuu

SEQ ID NO: 4212378 - RNA, 15 nt, Yersinia pestis KIM
aacuuaaaaaucaaa

SEQ ID NO: 4212379 - RNA, 14 nt, Yersinia pestis KIM
aacuuaaauaauuu

SEQ ID NO: 4212380 - RNA, 20 nt, Yersinia pestis KIM
aacuuaagauagccggauua

SEQ ID NO: 4212381 - RNA, 15 nt, Yersinia pestis KIM
aacuuaagcaauauu

SEQ ID NO: 4212382 - RNA, 12 nt, Yersinia pestis KIM
aacuuacaggcu

SEQ ID NO: 4212383 - RNA, 19 nt, Yersinia pestis KIM
aagaugacuacugucuuuu

SEQ ID NO: 4212384 - RNA, 12 nt, Yersinia pestis KIM
aagaugcauauu

SEQ ID NO: 4212385 - RNA, 18 nt, Yersinia pestis KIM
aagaugccuauuugcaga

SEQ ID NO: 4212386 - RNA, 12 nt, Yersinia pestis KIM
aagauucaacca

SEQ ID NO: 4212387 - RNA, 16 nt, Yersinia pestis KIM
aagauucauaaaaaaa

SEQ ID NO: 4212388 - RNA, 15 nt, Yersinia pestis KIM
aagauugcauccgcu

SEQ ID NO: 4212389 - RNA, 16 nt, Yersinia pestis KIM
aagauuggcagcguaa

SEQ ID NO: 4212390 - RNA, 19 nt, Yersinia pestis KIM
aagauuugugcauauucau

SEQ ID NO: 4212391 - RNA, 16 nt, Yersinia pestis KIM
aagauuuuguagccca

SEQ ID NO: 4212392 - RNA, 13 nt, Yersinia pestis KIM
aagcaaaucgaua

SEQ ID NO: 4212393 - RNA, 23 nt, Yersinia pestis KIM
aagcaacagccauauuuuucaau

SEQ ID NO: 4212394 - RNA, 23 nt, Yersinia pestis KIM
aagcaaccgcaaugccgcuaggg

SEQ ID NO: 4212395 - RNA, 20 nt, Yersinia pestis KIM
aagcaaccuuguuuuaucgc

SEQ ID NO: 4212396 - RNA, 13 nt, Yersinia pestis KIM
aagcaagaaacug

SEQ ID NO: 4212397 - RNA, 19 nt, Yersinia pestis KIM
aagcaagaccgguggcuuu

SEQ ID NO: 4212398 - RNA, 14 nt, Yersinia pestis KIM
aagcaaugaaauau

SEQ ID NO: 4212399 - RNA, 21 nt, Yersinia pestis KIM
aagcaauuugaucaccaaucg

SEQ ID NO: 4212400 - RNA, 19 nt, Yersinia pestis KIM
aagcacgaucagcucuggc

SEQ ID NO: 4212401 - RNA, 22 nt, Yersinia pestis KIM
aagcacuguacugggaugaaga

SEQ ID NO: 4212402 - RNA, 17 nt, Yersinia pestis KIM
aagcagagaauuucaag

SEQ ID NO: 4212403 - RNA, 13 nt, Yersinia pestis KIM
aagcagauaaaga

SEQ ID NO: 4212404 - RNA, 16 nt, Yersinia pestis KIM
aagcagauaaagaaaa

SEQ ID NO: 4212405 - RNA, 15 nt, Yersinia pestis KIM
aagcagcuuuucacg

SEQ ID NO: 4212406 - RNA, 16 nt, Yersinia pestis KIM
aagcaggaaugcgguu

SEQ ID NO: 4212407 - RNA, 17 nt, Yersinia pestis KIM
aagcagguaguuacagc

SEQ ID NO: 4212408 - RNA, 16 nt, Yersinia pestis KIM
aagcauauaaccauuu

SEQ ID NO: 4212409 - RNA, 15 nt, Yersinia pestis KIM
aagcaucggaaucca

SEQ ID NO: 4212410 - RNA, 22 nt, Yersinia pestis KIM
aagcaugcccagccucuggaua

SEQ ID NO: 4212411 - RNA, 22 nt, Yersinia pestis KIM
aagcauggcagguaucaauaca

SEQ ID NO: 4212412 - RNA, 17 nt, Yersinia pestis KIM
aagccaaacaaaugaac

SEQ ID NO: 4212413 - RNA, 14 nt, Yersinia pestis KIM
aagccaacccccau

SEQ ID NO: 4212414 - RNA, 12 nt, Yersinia pestis KIM
aagccaaucucu

SEQ ID NO: 4212415 - RNA, 21 nt, Yersinia pestis KIM
aagccaccaccacggccagaa

SEQ ID NO: 4212416 - RNA, 13 nt, Yersinia pestis KIM
aagccagucaggg

SEQ ID NO: 4212417 - RNA, 14 nt, Yersinia pestis KIM
aagccagucagggc

SEQ ID NO: 4212418 - RNA, 21 nt, Yersinia pestis KIM
aagccaucgccaucgccgaca

SEQ ID NO: 4212419 - RNA, 20 nt, Yersinia pestis KIM
aagccauuuuuuauaaacac

SEQ ID NO: 4212420 - RNA, 22 nt, Yersinia pestis KIM
aagccauuuuuuauaaacacuu

SEQ ID NO: 4212421 - RNA, 22 nt, Yersinia pestis KIM
aagcccaguaaagcaaauuccc

SEQ ID NO: 4212422 - RNA, 20 nt, Yersinia pestis KIM
aagccccagugcgcaaaaau

SEQ ID NO: 4212423 - RNA, 15 nt, Yersinia pestis KIM
aagcccucauuuucg

SEQ ID NO: 4212424 - RNA, 15 nt, Yersinia pestis KIM
aagccgcguucaaau

SEQ ID NO: 4212425 - RNA, 13 nt, Yersinia pestis KIM
aagccgcugcuca

SEQ ID NO: 4212426 - RNA, 15 nt, Yersinia pestis KIM
aagccgugaccaaag

SEQ ID NO: 4212427 - RNA, 18 nt, Yersinia pestis KIM
aagccucggucacugccu

SEQ ID NO: 4212428 - RNA, 21 nt, Yersinia pestis KIM
aagccugcaccauauucccag

SEQ ID NO: 4212429 - RNA, 11 nt, Yersinia pestis KIM
aagccugugcu

SEQ ID NO: 4212430 - RNA, 21 nt, Yersinia pestis KIM
aagcgaucaccucuugcauac

SEQ ID NO: 4212431 - RNA, 19 nt, Yersinia pestis KIM
aagcgaugcucaauacuaa

SEQ ID NO: 4212432 - RNA, 22 nt, Yersinia pestis KIM
aagcgauuagucccuaaagagc

SEQ ID NO: 4212433 - RNA, 20 nt, Yersinia pestis KIM
aagcgauugccggaagguca

SEQ ID NO: 4212434 - RNA, 21 nt, Yersinia pestis KIM
aagcgcacaucggugagucac

SEQ ID NO: 4212435 - RNA, 12 nt, Yersinia pestis KIM
aagcgcagugcu

SEQ ID NO: 4212436 - RNA, 18 nt, Yersinia pestis KIM
aagcgcagugcucauuaa

SEQ ID NO: 4212437 - RNA, 11 nt, Yersinia pestis KIM
aagcgcccuga

SEQ ID NO: 4212438 - RNA, 21 nt, Yersinia pestis KIM
aagcgcccuucggacggcuga

SEQ ID NO: 4212439 - RNA, 20 nt, Yersinia pestis KIM
aagcgccguaaaaagcagca

SEQ ID NO: 4212440 - RNA, 22 nt, Yersinia pestis KIM
aagcgccgugcauaauggacga

SEQ ID NO: 4212441 - RNA, 14 nt, Yersinia pestis KIM
aagcgccugcgaca

SEQ ID NO: 4212442 - RNA, 23 nt, Yersinia pestis KIM
aagcgccugugggcggcuuucau

SEQ ID NO: 4212443 - RNA, 18 nt, Yersinia pestis KIM
aagcgccuuccuuuuauu

SEQ ID NO: 4212444 - RNA, 14 nt, Yersinia pestis KIM
aagcgccuuuuauu

SEQ ID NO: 4212445 - RNA, 22 nt, Yersinia pestis KIM
aagcgcuauguuggcaaauaau

SEQ ID NO: 4212446 - RNA, 12 nt, Yersinia pestis KIM
aagcgcucaaau

SEQ ID NO: 4212447 - RNA, 15 nt, Yersinia pestis KIM
aagcgcucaaauacg

SEQ ID NO: 4212448 - RNA, 19 nt, Yersinia pestis KIM
aagcgggcuuuaauagcca

SEQ ID NO: 4212449 - RNA, 21 nt, Yersinia pestis KIM
aagcgggugagauauugcaug

SEQ ID NO: 4212450 - RNA, 13 nt, Yersinia pestis KIM
aagcgguaaaugg

SEQ ID NO: 4212451 - RNA, 22 nt, Yersinia pestis KIM
aagcgucuacgggcgcuuuucu

SEQ ID NO: 4212452 - RNA, 20 nt, Yersinia pestis KIM
aagcuaaaaaucucaacaag

SEQ ID NO: 4212453 - RNA, 17 nt, Yersinia pestis KIM
aagcuacagcucagacu

SEQ ID NO: 4212454 - RNA, 21 nt, Yersinia pestis KIM
aagcuacuaauggagagaugu

SEQ ID NO: 4212455 - RNA, 18 nt, Yersinia pestis KIM
aagcucgccaucgcacca

SEQ ID NO: 4212456 - RNA, 20 nt, Yersinia pestis KIM
aagcucgccaucgcaccaaa

SEQ ID NO: 4212457 - RNA, 17 nt, Yersinia pestis KIM
aagcucugacaaaaugc

SEQ ID NO: 4212458 - RNA, 21 nt, Yersinia pestis KIM
aagcucugacaaaaugccaga

SEQ ID NO: 4212459 - RNA, 22 nt, Yersinia pestis KIM
aagcucugacaaaaugccagaa

SEQ ID NO: 4212460 - RNA, 14 nt, Yersinia pestis KIM
aagcucuuccaaua

SEQ ID NO: 4212461 - RNA, 17 nt, Yersinia pestis KIM
aagcucuuccaauagca

SEQ ID NO: 4212462 - RNA, 13 nt, Yersinia pestis KIM
aagcugaaauuuu

SEQ ID NO: 4212463 - RNA, 21 nt, Yersinia pestis KIM
aagcugccugugcggcaguga

SEQ ID NO: 4212464 - RNA, 19 nt, Yersinia pestis KIM
aagcugccuuuuuugauaa

SEQ ID NO: 4212465 - RNA, 22 nt, Yersinia pestis KIM
aagcugcggcuugggagucaga

SEQ ID NO: 4212466 - RNA, 22 nt, Yersinia pestis KIM
aagcugcuuuuaccgcagggcg

SEQ ID NO: 4212467 - RNA, 20 nt, Yersinia pestis KIM
aagcuggcgcacucauccuc

SEQ ID NO: 4212468 - RNA, 16 nt, Yersinia pestis KIM
aagcuguugaccugaa

SEQ ID NO: 4212469 - RNA, 18 nt, Yersinia pestis KIM
aagcuguuggcuuuaucu

SEQ ID NO: 4212470 - RNA, 15 nt, Yersinia pestis KIM
aagcuuacuguucac

SEQ ID NO: 4212471 - RNA, 14 nt, Yersinia pestis KIM
aagcuucaacuuaa

SEQ ID NO: 4212472 - RNA, 14 nt, Yersinia pestis KIM
aagcuucucccuuu

SEQ ID NO: 4212473 - RNA, 20 nt, Yersinia pestis KIM
aagcuuuugccacauuuccc

SEQ ID NO: 4212474 - RNA, 22 nt, Yersinia pestis KIM
aagcuuuugccacauuucccuu

SEQ ID NO: 4212475 - RNA, 18 nt, Yersinia pestis KIM
aaggagaccgcaugcugc

SEQ ID NO: 4212476 - RNA, 17 nt, Yersinia pestis KIM
aaggauaaacgaaagag

SEQ ID NO: 4212477 - RNA, 16 nt, Yersinia pestis KIM
aaggauaagcaguucu

SEQ ID NO: 4212478 - RNA, 18 nt, Yersinia pestis KIM
aaggauagggagccaaua

SEQ ID NO: 4212479 - RNA, 14 nt, Yersinia pestis KIM
aaggauggcccaag

SEQ ID NO: 4212480 - RNA, 18 nt, Yersinia pestis KIM
aaggauggcccaagccau

SEQ ID NO: 4212481 - RNA, 15 nt, Yersinia pestis KIM
aaggcaaaaugauca

SEQ ID NO: 4212482 - RNA, 23 nt, Yersinia pestis KIM
aaggcaaaaugaucaucagcagc

SEQ ID NO: 4212483 - RNA, 13 nt, Yersinia pestis KIM
aaggcaaagaaga

SEQ ID NO: 4212484 - RNA, 13 nt, Yersinia pestis KIM
aaggcaauaccgg

SEQ ID NO: 4212485 - RNA, 23 nt, Yersinia pestis KIM
aaggcacaucuccagaauauaaa

SEQ ID NO: 4212486 - RNA, 13 nt, Yersinia pestis KIM
aaggcaccagcgc

SEQ ID NO: 4212487 - RNA, 13 nt, Yersinia pestis KIM
aaggcagcaagca

SEQ ID NO: 4212488 - RNA, 16 nt, Yersinia pestis KIM
aaggcagcaagugaau

SEQ ID NO: 4212489 - RNA, 16 nt, Yersinia pestis KIM
aaggcaucaaccaguu

SEQ ID NO: 4212490 - RNA, 14 nt, Yersinia pestis KIM
aaggcauccacauc

SEQ ID NO: 4212491 - RNA, 22 nt, Yersinia pestis KIM
aaggcauccccggcaccaacgc

SEQ ID NO: 4212492 - RNA, 12 nt, Yersinia pestis KIM
aaggccaaugga

SEQ ID NO: 4212493 - RNA, 14 nt, Yersinia pestis KIM
aaggccaauuggcu

SEQ ID NO: 4212494 - RNA, 16 nt, Yersinia pestis KIM
aaggccagcagaacua

SEQ ID NO: 4212495 - RNA, 11 nt, Yersinia pestis KIM
aaggccaggca

SEQ ID NO: 4212496 - RNA, 22 nt, Yersinia pestis KIM
aaggccaguaguaaaaaaucua

SEQ ID NO: 4212497 - RNA, 22 nt, Yersinia pestis KIM
aaggcccauuugucgcgccuga

SEQ ID NO: 4212498 - RNA, 22 nt, Yersinia pestis KIM
aaguucacuugagagaaacuuu

SEQ ID NO: 4212499 - RNA, 19 nt, Yersinia pestis KIM
aaguucagguugaaauaaa

SEQ ID NO: 4212500 - RNA, 22 nt, Yersinia pestis KIM
aaguucggagauuucgguuaau

SEQ ID NO: 4212501 - RNA, 14 nt, Yersinia pestis KIM
aaguucuaaggaaa

SEQ ID NO: 4212502 - RNA, 15 nt, Yersinia pestis KIM
aaguucuaagggaaa

SEQ ID NO: 4212503 - RNA, 16 nt, Yersinia pestis KIM
aaguugagaucaacuc

SEQ ID NO: 4212504 - RNA, 20 nt, Yersinia pestis KIM
aaguugaguugaauuuuuau

SEQ ID NO: 4212505 - RNA, 13 nt, Yersinia pestis KIM
aaguugauaaaag

SEQ ID NO: 4212506 - RNA, 13 nt, Yersinia pestis KIM
aaguugauaacgc

SEQ ID NO: 4212507 - RNA, 19 nt, Yersinia pestis KIM
aaguugccggacgccccac

SEQ ID NO: 4212508 - RNA, 15 nt, Yersinia pestis KIM
aaguuggcuuuugcc

SEQ ID NO: 4212509 - RNA, 12 nt, Yersinia pestis KIM
aaguuguucauu

SEQ ID NO: 4212510 - RNA, 22 nt, Yersinia pestis KIM
aaguuuaccgcaugaauauuca

SEQ ID NO: 4212511 - RNA, 21 nt, Yersinia pestis KIM
aaguuuacuuuguauuuugca

SEQ ID NO: 4212512 - RNA, 16 nt, Yersinia pestis KIM
aaguuuauuuaacaca

SEQ ID NO: 4212513 - RNA, 16 nt, Yersinia pestis KIM
aaguuuucuggcaauu

SEQ ID NO: 4212514 - RNA, 19 nt, Yersinia pestis KIM
aaguuuucuggcaauuucu

SEQ ID NO: 4212515 - RNA, 15 nt, Yersinia pestis KIM
aauaaaaaaccccga

SEQ ID NO: 4212516 - RNA, 23 nt, Yersinia pestis KIM
aauaaaaagucagcuggaacaag

SEQ ID NO: 4212517 - RNA, 16 nt, Yersinia pestis KIM
aauaaaaccuuuacaa

SEQ ID NO: 4212518 - RNA, 14 nt, Yersinia pestis KIM
aauaaaacucacuu

SEQ ID NO: 4212519 - RNA, 16 nt, Yersinia pestis KIM
aauaaaaucguaauca

SEQ ID NO: 4212520 - RNA, 13 nt, Yersinia pestis KIM
aauaaaaucugcu

SEQ ID NO: 4212521 - RNA, 14 nt, Yersinia pestis KIM
aauaaacaaccuuc

SEQ ID NO: 4212522 - RNA, 18 nt, Yersinia pestis KIM
aauaaaccgaaaugaucu

SEQ ID NO: 4212523 - RNA, 23 nt, Yersinia pestis KIM
aauaaagauacccgccauaaaua

SEQ ID NO: 4212524 - RNA, 19 nt, Yersinia pestis KIM
aauaaagcgauaaauacuc

SEQ ID NO: 4212525 - RNA, 19 nt, Yersinia pestis KIM
aauaaagcucugacaaaau

SEQ ID NO: 4212526 - RNA, 16 nt, Yersinia pestis KIM
aauaaagggccugcaa

SEQ ID NO: 4212527 - RNA, 22 nt, Yersinia pestis KIM
aauaaaguaaaagccagucagg

SEQ ID NO: 4212528 - RNA, 17 nt, Yersinia pestis KIM
aauaaauaauuuguaaa

SEQ ID NO: 4212529 - RNA, 12 nt, Yersinia pestis KIM
aauaaauacccu

SEQ ID NO: 4212530 - RNA, 19 nt, Yersinia pestis KIM
aauaaauacccugcaccau

SEQ ID NO: 4212531 - RNA, 21 nt, Yersinia pestis KIM
aauaaauaccggcaggaaagc

SEQ ID NO: 4212532 - RNA, 20 nt, Yersinia pestis KIM
aauaaauagagugaaguauc

SEQ ID NO: 4212533 - RNA, 19 nt, Yersinia pestis KIM
aauaaauauccuccggcau

SEQ ID NO: 4212534 - RNA, 18 nt, Yersinia pestis KIM
aauaaauauucgguaaug

SEQ ID NO: 4212535 - RNA, 16 nt, Yersinia pestis KIM
aauaaauucaaaauag

SEQ ID NO: 4212536 - RNA, 12 nt, Yersinia pestis KIM
aauaaauucagg

SEQ ID NO: 4212537 - RNA, 11 nt, Yersinia pestis KIM
aauaacaaaca

SEQ ID NO: 4212538 - RNA, 12 nt, Yersinia pestis KIM
aauaacaacaca

SEQ ID NO: 4212539 - RNA, 18 nt, Yersinia pestis KIM
aauaacaauauucauuuu

SEQ ID NO: 4212540 - RNA, 16 nt, Yersinia pestis KIM
aauaacaccagcaggu

SEQ ID NO: 4212541 - RNA, 23 nt, Yersinia pestis KIM
aauaacacggccuauugaauaac

SEQ ID NO: 4212542 - RNA, 18 nt, Yersinia pestis KIM
aauaacagcuaaaaugau

SEQ ID NO: 4212543 - RNA, 15 nt, Yersinia pestis KIM
aauaacagcuaauca

SEQ ID NO: 4212544 - RNA, 21 nt, Yersinia pestis KIM
aauaaccagaauaauccaagc

SEQ ID NO: 4212545 - RNA, 10 nt, Yersinia pestis KIM
aauaaccauu

SEQ ID NO: 4212546 - RNA, 22 nt, Yersinia pestis KIM
aauaaccgagcgugaagagcga

SEQ ID NO: 4212547 - RNA, 21 nt, Yersinia pestis KIM
aauaaccuacuccaacaacca

SEQ ID NO: 4212548 - RNA, 22 nt, Yersinia pestis KIM
aauaaccucacgggcuuccauc

SEQ ID NO: 4212549 - RNA, 22 nt, Yersinia pestis KIM
aauaaccucaggcccgcuauca

SEQ ID NO: 4212550 - RNA, 19 nt, Yersinia pestis KIM
aauaaccucagggagccaa

SEQ ID NO: 4212551 - RNA, 17 nt, Yersinia pestis KIM
aauaaccucaggggcca

SEQ ID NO: 4212552 - RNA, 18 nt, Yersinia pestis KIM
aauaacgaauuucauuuu

SEQ ID NO: 4212553 - RNA, 14 nt, Yersinia pestis KIM
aauaacgauuaauu

SEQ ID NO: 4212554 - RNA, 13 nt, Yersinia pestis KIM
aauaacgcaaaaa

SEQ ID NO: 4212555 - RNA, 18 nt, Yersinia pestis KIM
aauaacgcaaaaaucacu

SEQ ID NO: 4212556 - RNA, 13 nt, Yersinia pestis KIM
aauaacgccacaa

SEQ ID NO: 4212557 - RNA, 23 nt, Yersinia pestis KIM
aauaacgccccuguaaauaaaua

SEQ ID NO: 4212558 - RNA, 14 nt, Yersinia pestis KIM
aauaacgccugcaa

SEQ ID NO: 4212559 - RNA, 17 nt, Yersinia pestis KIM
aauaacgcggcacauac

SEQ ID NO: 4212560 - RNA, 15 nt, Yersinia pestis KIM
aauaacgcuggauaa

SEQ ID NO: 4212561 - RNA, 19 nt, Yersinia pestis KIM
aauaacgcuggauaaguga

SEQ ID NO: 4212562 - RNA, 16 nt, Yersinia pestis KIM
aauaacguccugauga

SEQ ID NO: 4212563 - RNA, 15 nt, Yersinia pestis KIM
aauaacuaaaaaagu

SEQ ID NO: 4212564 - RNA, 19 nt, Yersinia pestis KIM
aauaacucagccauugcuu

SEQ ID NO: 4212565 - RNA, 20 nt, Yersinia pestis KIM
aauaacucagccauugcuuu

SEQ ID NO: 4212566 - RNA, 16 nt, Yersinia pestis KIM
aauaacucagggcuuu

SEQ ID NO: 4212567 - RNA, 23 nt, Yersinia pestis KIM
aauaacugccagggcguuuacca

SEQ ID NO: 4212568 - RNA, 13 nt, Yersinia pestis KIM
aauaacuuaaaua

SEQ ID NO: 4212569 - RNA, 17 nt, Yersinia pestis KIM
aauaacuuaaauaauuu

SEQ ID NO: 4212570 - RNA, 23 nt, Yersinia pestis KIM
aauaacuuauuacaccuuaaaac

SEQ ID NO: 4212571 - RNA, 15 nt, Yersinia pestis KIM
aauaagaaugacuuu

SEQ ID NO: 4212572 - RNA, 11 nt, Yersinia pestis KIM
aauaagaucca

SEQ ID NO: 4212573 - RNA, 13 nt, Yersinia pestis KIM
aauaagccacgcu

SEQ ID NO: 4212574 - RNA, 21 nt, Yersinia pestis KIM
aauaagccagauaucacucag

SEQ ID NO: 4212575 - RNA, 23 nt, Yersinia pestis KIM
aauaagcccaguauugcagagca

SEQ ID NO: 4212576 - RNA, 18 nt, Yersinia pestis KIM
aauaagcuaucauuaaau

SEQ ID NO: 4212577 - RNA, 13 nt, Yersinia pestis KIM
aauaagcucuggg

SEQ ID NO: 4212578 - RNA, 15 nt, Yersinia pestis KIM
aauaaggaauaacuu

SEQ ID NO: 4212579 - RNA, 18 nt, Yersinia pestis KIM
aauaagggauaugaauaa

SEQ ID NO: 4212580 - RNA, 19 nt, Yersinia pestis KIM
aauaaggguagguucaaua

SEQ ID NO: 4212581 - RNA, 18 nt, Yersinia pestis KIM
aauaaggugccacacaga

SEQ ID NO: 4212582 - RNA, 15 nt, Yersinia pestis KIM
aauaaguacuuccaa

SEQ ID NO: 4212583 - RNA, 19 nt, Yersinia pestis KIM
aauaagugcaaacuuaaaa

SEQ ID NO: 4212584 - RNA, 21 nt, Yersinia pestis KIM
aauaaguguguguauuuaaaa

SEQ ID NO: 4212585 - RNA, 23 nt, Yersinia pestis KIM
aauaaguguguguauuuaaaaga

SEQ ID NO: 4212586 - RNA, 17 nt, Yersinia pestis KIM
aauaaguguuucaaaua

SEQ ID NO: 4212587 - RNA, 19 nt, Yersinia pestis KIM
aauaaguguuucaaauaag

SEQ ID NO: 4212588 - RNA, 22 nt, Yersinia pestis KIM
aauaaguucagguugaaauaaa

SEQ ID NO: 4212589 - RNA, 17 nt, Yersinia pestis KIM
aauaaguugaaccauaa

SEQ ID NO: 4212590 - RNA, 19 nt, Yersinia pestis KIM
aauaaguugauaacgccgg

SEQ ID NO: 4212591 - RNA, 16 nt, Yersinia pestis KIM
aauaauaaaaaaaaau

SEQ ID NO: 4212592 - RNA, 18 nt, Yersinia pestis KIM
aauaauaaaaaaaaauaa

SEQ ID NO: 4212593 - RNA, 12 nt, Yersinia pestis KIM
aauaauaaaauc

SEQ ID NO: 4212594 - RNA, 13 nt, Yersinia pestis KIM
aauaauaacgaau

SEQ ID NO: 4212595 - RNA, 13 nt, Yersinia pestis KIM
aauaauagauagu

SEQ ID NO: 4212596 - RNA, 23 nt, Yersinia pestis KIM
aauaauaggcugaucaacgggcu

SEQ ID NO: 4212597 - RNA, 14 nt, Yersinia pestis KIM
aauaauaucaauga

SEQ ID NO: 4212598 - RNA, 16 nt, Yersinia pestis KIM
aauaauaucaaugaug

SEQ ID NO: 4212599 - RNA, 20 nt, Yersinia pestis KIM
aauaauaucggcaaauuaaa

SEQ ID NO: 4212600 - RNA, 12 nt, Yersinia pestis KIM
aauaaucaauga

SEQ ID NO: 4212601 - RNA, 13 nt, Yersinia pestis KIM
aauaaucaaugac

SEQ ID NO: 4212602 - RNA, 20 nt, Yersinia pestis KIM
aauaaucacaggggcaauaa

SEQ ID NO: 4212603 - RNA, 16 nt, Yersinia pestis KIM
aauaaucaccagacaa

SEQ ID NO: 4212604 - RNA, 22 nt, Yersinia pestis KIM
aauaaucauaucaaaauaaaaa

SEQ ID NO: 4212605 - RNA, 21 nt, Yersinia pestis KIM
aauaaugaccacgcaucaaua

SEQ ID NO: 4212606 - RNA, 22 nt, Yersinia pestis KIM
aauaaugaccacgcaucaauaa

SEQ ID NO: 4212607 - RNA, 15 nt, Yersinia pestis KIM
aauaaugagccauaa

SEQ ID NO: 4212608 - RNA, 20 nt, Yersinia pestis KIM
aauaauguggcauguucagc

SEQ ID NO: 4212609 - RNA, 16 nt, Yersinia pestis KIM
aauaauuaaucuuaau

SEQ ID NO: 4212610 - RNA, 14 nt, Yersinia pestis KIM
aauaauuaauuuca

SEQ ID NO: 4212611 - RNA, 12 nt, Yersinia pestis KIM
aauaauuaggaa

SEQ ID NO: 4212612 - RNA, 20 nt, Yersinia pestis KIM
aauaauuauaccuacccuuu

SEQ ID NO: 4212613 - RNA, 13 nt, Yersinia pestis KIM
aauagucaguaaa

SEQ ID NO: 4212614 - RNA, 21 nt, Yersinia pestis KIM
aauagucagugggcuauuuau

SEQ ID NO: 4212615 - RNA, 16 nt, Yersinia pestis KIM
aauagucauauauuuu

SEQ ID NO: 4212616 - RNA, 21 nt, Yersinia pestis KIM
aauagucguuauauaaauggc

SEQ ID NO: 4212617 - RNA, 22 nt, Yersinia pestis KIM
aauagucuuuuuaauaugugac

SEQ ID NO: 4212618 - RNA, 23 nt, Yersinia pestis KIM
aauagugauuguuugauuauugu

SEQ ID NO: 4212619 - RNA, 20 nt, Yersinia pestis KIM
aauaguguuguaagauuuca

SEQ ID NO: 4212620 - RNA, 14 nt, Yersinia pestis KIM
aauauaaaagcaca

SEQ ID NO: 4212621 - RNA, 20 nt, Yersinia pestis KIM
aauauaaaagcacagacaaa

SEQ ID NO: 4212622 - RNA, 19 nt, Yersinia pestis KIM
aauauaacguuuaccuauu

SEQ ID NO: 4212623 - RNA, 18 nt, Yersinia pestis KIM
aauauaauaaucuauaua

SEQ ID NO: 4212624 - RNA, 20 nt, Yersinia pestis KIM
aauauacuguuaacucgcca

SEQ ID NO: 4212625 - RNA, 21 nt, Yersinia pestis KIM
aauauacuuuacauauaggaa

SEQ ID NO: 4212626 - RNA, 14 nt, Yersinia pestis KIM
aauauaguugaucu

SEQ ID NO: 4212627 - RNA, 20 nt, Yersinia pestis KIM
aauauauucucuuaucgauu

SEQ ID NO: 4212628 - RNA, 22 nt, Yersinia pestis KIM
aauauauucucuuaucgauuca

SEQ ID NO: 4212629 - RNA, 18 nt, Yersinia pestis KIM
aauaucaagucuugaaga

SEQ ID NO: 4212630 - RNA, 19 nt, Yersinia pestis KIM
aauaucacugauaucggua

SEQ ID NO: 4212631 - RNA, 14 nt, Yersinia pestis KIM
aauaucaggcacug

SEQ ID NO: 4212632 - RNA, 22 nt, Yersinia pestis KIM
aauaucaggcacuguagaccuc

SEQ ID NO: 4212633 - RNA, 23 nt, Yersinia pestis KIM
aauaucagucgcuuuuuaacaaa

SEQ ID NO: 4212634 - RNA, 13 nt, Yersinia pestis KIM
aauaucauagcca

SEQ ID NO: 4212635 - RNA, 14 nt, Yersinia pestis KIM
aauaucauccccuu

SEQ ID NO: 4212636 - RNA, 18 nt, Yersinia pestis KIM
aauaucauccccuuucug

SEQ ID NO: 4212637 - RNA, 12 nt, Yersinia pestis KIM
aauauccaacca

SEQ ID NO: 4212638 - RNA, 15 nt, Yersinia pestis KIM
aauauccgugauuaa

SEQ ID NO: 4212639 - RNA, 21 nt, Yersinia pestis KIM
aauauccgugauuaaccuuaa

SEQ ID NO: 4212640 - RNA, 22 nt, Yersinia pestis KIM
aauauccgugauuaaccuuaau

SEQ ID NO: 4212641 - RNA, 16 nt, Yersinia pestis KIM
aauauccgugggcaaa

SEQ ID NO: 4212642 - RNA, 23 nt, Yersinia pestis KIM
aauauccgugggcaaaggcccaa

SEQ ID NO: 4212643 - RNA, 19 nt, Yersinia pestis KIM
aauauccugcucagcuaaa

SEQ ID NO: 4212644 - RNA, 16 nt, Yersinia pestis KIM
aauauccuggaagcag

SEQ ID NO: 4212645 - RNA, 18 nt, Yersinia pestis KIM
aauauccuggaagcagaa

SEQ ID NO: 4212646 - RNA, 15 nt, Yersinia pestis KIM
aauaucgauuuuuaa

SEQ ID NO: 4212647 - RNA, 21 nt, Yersinia pestis KIM
aauaucggccaucgccaguaa

SEQ ID NO: 4212648 - RNA, 17 nt, Yersinia pestis KIM
aauaucuauauagggaa

SEQ ID NO: 4212649 - RNA, 12 nt, Yersinia pestis KIM
aauaucuauuuc

SEQ ID NO: 4212650 - RNA, 20 nt, Yersinia pestis KIM
aauaucuuccacaugcuuuu

SEQ ID NO: 4212651 - RNA, 21 nt, Yersinia pestis KIM
aauaugauaguguaaaaacca

SEQ ID NO: 4212652 - RNA, 20 nt, Yersinia pestis KIM
aauaugaucuugauaaacau

SEQ ID NO: 4212653 - RNA, 15 nt, Yersinia pestis KIM
aauaugcaaaaaaag

SEQ ID NO: 4212654 - RNA, 23 nt, Yersinia pestis KIM
aauaugccaaaucucaucggcau

SEQ ID NO: 4212655 - RNA, 21 nt, Yersinia pestis KIM
aauauggggugcuucaagccc

SEQ ID NO: 4212656 - RNA, 17 nt, Yersinia pestis KIM
aauauggguuaaaaacu

SEQ ID NO: 4212657 - RNA, 20 nt, Yersinia pestis KIM
aauaugguagaauuuaccuc

SEQ ID NO: 4212658 - RNA, 17 nt, Yersinia pestis KIM
aauauuaaaauagcaac

SEQ ID NO: 4212659 - RNA, 16 nt, Yersinia pestis KIM
aauauuaacugcagug

SEQ ID NO: 4212660 - RNA, 14 nt, Yersinia pestis KIM
aauauuaauaaugc

SEQ ID NO: 4212661 - RNA, 14 nt, Yersinia pestis KIM
aauauucaagagau

SEQ ID NO: 4212662 - RNA, 15 nt, Yersinia pestis KIM
aauauucaagagauu

SEQ ID NO: 4212663 - RNA, 17 nt, Yersinia pestis KIM
aauauucaauaggguaa

SEQ ID NO: 4212664 - RNA, 22 nt, Yersinia pestis KIM
aauauucaccaucugccugcaa

SEQ ID NO: 4212665 - RNA, 13 nt, Yersinia pestis KIM
aauauucaguaag

SEQ ID NO: 4212666 - RNA, 20 nt, Yersinia pestis KIM
aauauucaguaagguuuuac

SEQ ID NO: 4212667 - RNA, 13 nt, Yersinia pestis KIM
aauauucauuaaa

SEQ ID NO: 4212668 - RNA, 15 nt, Yersinia pestis KIM
aauauuccaaaaaau

SEQ ID NO: 4212669 - RNA, 15 nt, Yersinia pestis KIM
aauauuccauacugu

SEQ ID NO: 4212670 - RNA, 21 nt, Yersinia pestis KIM
aauauuccccaccauugcaaa

SEQ ID NO: 4212671 - RNA, 19 nt, Yersinia pestis KIM
aauauuccggccagcuuuu

SEQ ID NO: 4212672 - RNA, 22 nt, Yersinia pestis KIM
aauauuccggccagcuuuuuau

SEQ ID NO: 4212673 - RNA, 23 nt, Yersinia pestis KIM
aauauucugacgggacaaucugu

SEQ ID NO: 4212674 - RNA, 14 nt, Yersinia pestis KIM
aauauugacaggau

SEQ ID NO: 4212675 - RNA, 15 nt, Yersinia pestis KIM
aauauugauccaccg

SEQ ID NO: 4212676 - RNA, 16 nt, Yersinia pestis KIM
aauauugcauuuuaca

SEQ ID NO: 4212677 - RNA, 21 nt, Yersinia pestis KIM
aauauugcguuaccuaaaacu

SEQ ID NO: 4212678 - RNA, 20 nt, Yersinia pestis KIM
aauauuggauaauaaccuga

SEQ ID NO: 4212679 - RNA, 12 nt, Yersinia pestis KIM
aauauuucaggc

SEQ ID NO: 4212680 - RNA, 15 nt, Yersinia pestis KIM
aaucaaaaaauaaau

SEQ ID NO: 4212681 - RNA, 23 nt, Yersinia pestis KIM
aaucaaaaguuaggguucaguaa

SEQ ID NO: 4212682 - RNA, 14 nt, Yersinia pestis KIM
aaucaaaauaccca

SEQ ID NO: 4212683 - RNA, 19 nt, Yersinia pestis KIM
aaucaaaauacccauugag

SEQ ID NO: 4212684 - RNA, 14 nt, Yersinia pestis KIM
aaucaaacaaaucu

SEQ ID NO: 4212685 - RNA, 21 nt, Yersinia pestis KIM
aaucaacgcucaaucacgaca

SEQ ID NO: 4212686 - RNA, 12 nt, Yersinia pestis KIM
aaucaagauauu

SEQ ID NO: 4212687 - RNA, 18 nt, Yersinia pestis KIM
aaucaagauauuacuucu

SEQ ID NO: 4212688 - RNA, 14 nt, Yersinia pestis KIM
aaucaaguaaccaa

SEQ ID NO: 4212689 - RNA, 15 nt, Yersinia pestis KIM
aaucaaucaauugcc

SEQ ID NO: 4212690 - RNA, 14 nt, Yersinia pestis KIM
aaucaaucuaaugg

SEQ ID NO: 4212691 - RNA, 17 nt, Yersinia pestis KIM
aaucaaugggauauuau

SEQ ID NO: 4212692 - RNA, 15 nt, Yersinia pestis KIM
aaucaauguauugcu

SEQ ID NO: 4212693 - RNA, 20 nt, Yersinia pestis KIM
aaucaauugcccccaucacu

SEQ ID NO: 4212694 - RNA, 12 nt, Yersinia pestis KIM
aaucaauuuuug

SEQ ID NO: 4212695 - RNA, 13 nt, Yersinia pestis KIM
aaucaauuuuugc

SEQ ID NO: 4212696 - RNA, 14 nt, Yersinia pestis KIM
aaucacauacuggc

SEQ ID NO: 4212697 - RNA, 15 nt, Yersinia pestis KIM
aaucacaucaccgac

SEQ ID NO: 4212698 - RNA, 22 nt, Yersinia pestis KIM
aaucacauuucaaauuaucgau

SEQ ID NO: 4212699 - RNA, 17 nt, Yersinia pestis KIM
aaucaccaaauccaacu

SEQ ID NO: 4212700 - RNA, 16 nt, Yersinia pestis KIM
aaucaccauaacugcu

SEQ ID NO: 4212701 - RNA, 14 nt, Yersinia pestis KIM
aaucacccgcaaga

SEQ ID NO: 4212702 - RNA, 17 nt, Yersinia pestis KIM
aaucaccuggccaggaa

SEQ ID NO: 4212703 - RNA, 15 nt, Yersinia pestis KIM
aaucacgacaaguca

SEQ ID NO: 4212704 - RNA, 17 nt, Yersinia pestis KIM
aaucacgcagcaggcca

SEQ ID NO: 4212705 - RNA, 20 nt, Yersinia pestis KIM
aaucacgguuuaucccccuc

SEQ ID NO: 4212706 - RNA, 23 nt, Yersinia pestis KIM
aaucacugaggccaaaugaaaau

SEQ ID NO: 4212707 - RNA, 18 nt, Yersinia pestis KIM
aaucacugauucagaaag

SEQ ID NO: 4212708 - RNA, 19 nt, Yersinia pestis KIM
aaucacuggcaauaauuca

SEQ ID NO: 4212709 - RNA, 18 nt, Yersinia pestis KIM
aaucagauacggcuccag

SEQ ID NO: 4212710 - RNA, 14 nt, Yersinia pestis KIM
aaucagaucaacag

SEQ ID NO: 4212711 - RNA, 20 nt, Yersinia pestis KIM
aaucagaucaacagauuuuc

SEQ ID NO: 4212712 - RNA, 23 nt, Yersinia pestis KIM
aaucagcgaaugccggugccuau

SEQ ID NO: 4212713 - RNA, 20 nt, Yersinia pestis KIM
aaucagcgugguauaaaugg

SEQ ID NO: 4212714 - RNA, 16 nt, Yersinia pestis KIM
aaucagcuaauaucau

SEQ ID NO: 4212715 - RNA, 13 nt, Yersinia pestis KIM
aaucagcucauua

SEQ ID NO: 4212716 - RNA, 15 nt, Yersinia pestis KIM
aaucagcugauauga

SEQ ID NO: 4212717 - RNA, 18 nt, Yersinia pestis KIM
aaucagcuucauuaagga

SEQ ID NO: 4212718 - RNA, 19 nt, Yersinia pestis KIM
aaucaggugaacguuggcu

SEQ ID NO: 4212719 - RNA, 17 nt, Yersinia pestis KIM
aaucaguacaucaauag

SEQ ID NO: 4212720 - RNA, 21 nt, Yersinia pestis KIM
aaucaguaccgacaccaauac

SEQ ID NO: 4212721 - RNA, 17 nt, Yersinia pestis KIM
aaucaguguaucaauag

SEQ ID NO: 4212722 - RNA, 22 nt, Yersinia pestis KIM
aaucaguguauuacuccacacg

SEQ ID NO: 4212723 - RNA, 17 nt, Yersinia pestis KIM
aaucaguuccugauucg

SEQ ID NO: 4212724 - RNA, 15 nt, Yersinia pestis KIM
aaucaucagccucua

SEQ ID NO: 4212725 - RNA, 18 nt, Yersinia pestis KIM
aaucaucaucacaaauaa

SEQ ID NO: 4212726 - RNA, 11 nt, Yersinia pestis KIM
aaucaucaucc

SEQ ID NO: 4212727 - RNA, 21 nt, Yersinia pestis KIM
aaugaguuucaagucaauaaa

SEQ ID NO: 4212728 - RNA, 20 nt, Yersinia pestis KIM
aaugaguuuuguccugagcc

SEQ ID NO: 4212729 - RNA, 20 nt, Yersinia pestis KIM
aaugauaaaauccugaauaa

SEQ ID NO: 4212730 - RNA, 22 nt, Yersinia pestis KIM
aaugauaacguuccauggcuga

SEQ ID NO: 4212731 - RNA, 18 nt, Yersinia pestis KIM
aaugauacugcccgucgu

SEQ ID NO: 4212732 - RNA, 12 nt, Yersinia pestis KIM
aaugauagcgag

SEQ ID NO: 4212733 - RNA, 21 nt, Yersinia pestis KIM
aaugauauugaucuuuaauau

SEQ ID NO: 4212734 - RNA, 18 nt, Yersinia pestis KIM
aaugaucaucagcagcag

SEQ ID NO: 4212735 - RNA, 20 nt, Yersinia pestis KIM
aaugaugaaaauugcaggug

SEQ ID NO: 4212736 - RNA, 18 nt, Yersinia pestis KIM
aaugaugacuugauuaac

SEQ ID NO: 4212737 - RNA, 13 nt, Yersinia pestis KIM
aaugauggcggcu

SEQ ID NO: 4212738 - RNA, 23 nt, Yersinia pestis KIM
aaugauggcggcuaaauguucaa

SEQ ID NO: 4212739 - RNA, 16 nt, Yersinia pestis KIM
aaugaugguaacgcgc

SEQ ID NO: 4212740 - RNA, 17 nt, Yersinia pestis KIM
aaugaugguauuaauca

SEQ ID NO: 4212741 - RNA, 18 nt, Yersinia pestis KIM
aaugaugguauuaaucaa

SEQ ID NO: 4212742 - RNA, 14 nt, Yersinia pestis KIM
aaugauuauugacc

SEQ ID NO: 4212743 - RNA, 14 nt, Yersinia pestis KIM
aaugauucagugau

SEQ ID NO: 4212744 - RNA, 17 nt, Yersinia pestis KIM
aaugauugauuaucaag

SEQ ID NO: 4212745 - RNA, 23 nt, Yersinia pestis KIM
aaugauugauuaucaaguuaaau

SEQ ID NO: 4212746 - RNA, 18 nt, Yersinia pestis KIM
aaugcaaccaguuaaaga

SEQ ID NO: 4212747 - RNA, 17 nt, Yersinia pestis KIM
aaugcaauuuuggaaua

SEQ ID NO: 4212748 - RNA, 12 nt, Yersinia pestis KIM
aaugcacccaau

SEQ ID NO: 4212749 - RNA, 17 nt, Yersinia pestis KIM
aaugcacccaauggcaa

SEQ ID NO: 4212750 - RNA, 16 nt, Yersinia pestis KIM
aaugcaccgacaaaga

SEQ ID NO: 4212751 - RNA, 17 nt, Yersinia pestis KIM
aaugcaccgacaaagau

SEQ ID NO: 4212752 - RNA, 16 nt, Yersinia pestis KIM
aaugcacguaaagagu

SEQ ID NO: 4212753 - RNA, 18 nt, Yersinia pestis KIM
aaugcacguaaagaguua

SEQ ID NO: 4212754 - RNA, 20 nt, Yersinia pestis KIM
aaugcagguucauuacacag

SEQ ID NO: 4212755 - RNA, 15 nt, Yersinia pestis KIM
aaugcagucagcacu

SEQ ID NO: 4212756 - RNA, 19 nt, Yersinia pestis KIM
aaugcaucgcaucagacgg

SEQ ID NO: 4212757 - RNA, 21 nt, Yersinia pestis KIM
aaugccagacacaagauaaau

SEQ ID NO: 4212758 - RNA, 16 nt, Yersinia pestis KIM
aaugccauagcugcug

SEQ ID NO: 4212759 - RNA, 17 nt, Yersinia pestis KIM
aaugccccacuucacgc

SEQ ID NO: 4212760 - RNA, 19 nt, Yersinia pestis KIM
aaugccccacuucacgcac

SEQ ID NO: 4212761 - RNA, 16 nt, Yersinia pestis KIM
aaugccccauccugac

SEQ ID NO: 4212762 - RNA, 16 nt, Yersinia pestis KIM
aaugccgaaugauuca

SEQ ID NO: 4212763 - RNA, 20 nt, Yersinia pestis KIM
aaugccggcggcccauaucc

SEQ ID NO: 4212764 - RNA, 15 nt, Yersinia pestis KIM
aaugcgccagccaau

SEQ ID NO: 4212765 - RNA, 22 nt, Yersinia pestis KIM
aaugcgcgcagcaagcugagua

SEQ ID NO: 4212766 - RNA, 16 nt, Yersinia pestis KIM
aaugcgcucaccaaga

SEQ ID NO: 4212767 - RNA, 15 nt, Yersinia pestis KIM
aaugcggguuucauc

SEQ ID NO: 4212768 - RNA, 17 nt, Yersinia pestis KIM
aaugcguuauaaccaug

SEQ ID NO: 4212769 - RNA, 17 nt, Yersinia pestis KIM
aaugcuaccuguaacau

SEQ ID NO: 4212770 - RNA, 21 nt, Yersinia pestis KIM
aaugcuacuuaacguugagaa

SEQ ID NO: 4212771 - RNA, 16 nt, Yersinia pestis KIM
aaugcucgcucaucau

SEQ ID NO: 4212772 - RNA, 21 nt, Yersinia pestis KIM
aaugcucgcucaucauaaaaa

SEQ ID NO: 4212773 - RNA, 20 nt, Yersinia pestis KIM
aaugcucggcgucagccgcg

SEQ ID NO: 4212774 - RNA, 20 nt, Yersinia pestis KIM
aaugcucuucaccaaaggaa

SEQ ID NO: 4212775 - RNA, 15 nt, Yersinia pestis KIM
aaugcugaugcaaua

SEQ ID NO: 4212776 - RNA, 19 nt, Yersinia pestis KIM
aaugcuguuuugucauaaa

SEQ ID NO: 4212777 - RNA, 19 nt, Yersinia pestis KIM
aaugcuuauuucacacugu

SEQ ID NO: 4212778 - RNA, 20 nt, Yersinia pestis KIM
aauggaaaaacgugaauauc

SEQ ID NO: 4212779 - RNA, 19 nt, Yersinia pestis KIM
aauggauaaugcugaugca

SEQ ID NO: 4212780 - RNA, 16 nt, Yersinia pestis KIM
aauggauuaucggcgg

SEQ ID NO: 4212781 - RNA, 18 nt, Yersinia pestis KIM
aauggauugaucauucuc

SEQ ID NO: 4212782 - RNA, 14 nt, Yersinia pestis KIM
aauggcaacaaaau

SEQ ID NO: 4212783 - RNA, 18 nt, Yersinia pestis KIM
aauggcaacaucaggcuu

SEQ ID NO: 4212784 - RNA, 18 nt, Yersinia pestis KIM
aauggcacuggaaacaaa

SEQ ID NO: 4212785 - RNA, 11 nt, Yersinia pestis KIM
aauggcauuaa

SEQ ID NO: 4212786 - RNA, 19 nt, Yersinia pestis KIM
aauggccagcgggaaucaa

SEQ ID NO: 4212787 - RNA, 16 nt, Yersinia pestis KIM
aauggccggacucauu

SEQ ID NO: 4212788 - RNA, 19 nt, Yersinia pestis KIM
aauggcguuuaaaguaaau

SEQ ID NO: 4212789 - RNA, 18 nt, Yersinia pestis KIM
aauggcuggcaaggcacg

SEQ ID NO: 4212790 - RNA, 20 nt, Yersinia pestis KIM
aauggcuuucgaucaucacg

SEQ ID NO: 4212791 - RNA, 23 nt, Yersinia pestis KIM
aauggcuuuuuuaauaaaaaacu

SEQ ID NO: 4212792 - RNA, 14 nt, Yersinia pestis KIM
aaugggguaaugac

SEQ ID NO: 4212793 - RNA, 12 nt, Yersinia pestis KIM
aauggguauauu

SEQ ID NO: 4212794 - RNA, 21 nt, Yersinia pestis KIM
aauggguauauuuaccaaaag

SEQ ID NO: 4212795 - RNA, 21 nt, Yersinia pestis KIM
aaugggugugaacagugauga

SEQ ID NO: 4212796 - RNA, 12 nt, Yersinia pestis KIM
aauggucaggaa

SEQ ID NO: 4212797 - RNA, 16 nt, Yersinia pestis KIM
aauggucgaucagcgu

SEQ ID NO: 4212798 - RNA, 12 nt, Yersinia pestis KIM
aauggucuugau

SEQ ID NO: 4212799 - RNA, 18 nt, Yersinia pestis KIM
aauggugcccaucacauc

SEQ ID NO: 4212800 - RNA, 18 nt, Yersinia pestis KIM
aauggugcuauuucuggc

SEQ ID NO: 4212801 - RNA, 22 nt, Yersinia pestis KIM
aauggugucaucgcuaaauacu

SEQ ID NO: 4212802 - RNA, 18 nt, Yersinia pestis KIM
aaugguucacuauaauuu

SEQ ID NO: 4212803 - RNA, 17 nt, Yersinia pestis KIM
aaugguuguuaauuaag

SEQ ID NO: 4212804 - RNA, 17 nt, Yersinia pestis KIM
aaugguuugcuguucuu

SEQ ID NO: 4212805 - RNA, 18 nt, Yersinia pestis KIM
aauguacagucauuuacu

SEQ ID NO: 4212806 - RNA, 20 nt, Yersinia pestis KIM
aauguauuuauucaaaaaau

SEQ ID NO: 4212807 - RNA, 14 nt, Yersinia pestis KIM
aaugucaggaaaug

SEQ ID NO: 4212808 - RNA, 23 nt, Yersinia pestis KIM
aauguccccuugaguauccaaua

SEQ ID NO: 4212809 - RNA, 16 nt, Yersinia pestis KIM
aaugugaaaagcaguc

SEQ ID NO: 4212810 - RNA, 15 nt, Yersinia pestis KIM
aaugugacugauuaa

SEQ ID NO: 4212811 - RNA, 15 nt, Yersinia pestis KIM
aauguguugaauauc

SEQ ID NO: 4212812 - RNA, 17 nt, Yersinia pestis KIM
aauguguugaauaucca

SEQ ID NO: 4212813 - RNA, 21 nt, Yersinia pestis KIM
aauguguugauuaacauccau

SEQ ID NO: 4212814 - RNA, 23 nt, Yersinia pestis KIM
aauguuaaacuuugcuauuaaga

SEQ ID NO: 4212815 - RNA, 14 nt, Yersinia pestis KIM
aauguuaauauuuu

SEQ ID NO: 4212816 - RNA, 20 nt, Yersinia pestis KIM
aauguuaauauuuuacugcc

SEQ ID NO: 4212817 - RNA, 14 nt, Yersinia pestis KIM
aauguuaucgccaa

SEQ ID NO: 4212818 - RNA, 17 nt, Yersinia pestis KIM
aauguucccccuucagc

SEQ ID NO: 4212819 - RNA, 22 nt, Yersinia pestis KIM
aauguuccggacuucauaaaua

SEQ ID NO: 4212820 - RNA, 21 nt, Yersinia pestis KIM
aauguucucuggguaagaaca

SEQ ID NO: 4212821 - RNA, 24 nt, Yersinia pestis KIM
aauguugauacuccauuugaacug

SEQ ID NO: 4212822 - RNA, 12 nt, Yersinia pestis KIM
aauguugcaaac

SEQ ID NO: 4212823 - RNA, 19 nt, Yersinia pestis KIM
aauguuggggcacaauaag

SEQ ID NO: 4212824 - RNA, 21 nt, Yersinia pestis KIM
aauguuucuauccgaaaaaua

SEQ ID NO: 4212825 - RNA, 22 nt, Yersinia pestis KIM
aauguuucuauccgaaaaauau

SEQ ID NO: 4212826 - RNA, 15 nt, Yersinia pestis KIM
aauuaaaaagagugu

SEQ ID NO: 4212827 - RNA, 11 nt, Yersinia pestis KIM
aauuaaaaauu

SEQ ID NO: 4212828 - RNA, 19 nt, Yersinia pestis KIM
aauuaaaacugaaaaguuu

SEQ ID NO: 4212829 - RNA, 14 nt, Yersinia pestis KIM
aauuaaaauaauga

SEQ ID NO: 4212830 - RNA, 16 nt, Yersinia pestis KIM
aauuaacagcaucacu

SEQ ID NO: 4212831 - RNA, 23 nt, Yersinia pestis KIM
aauuaaccugcuggcgcaacugu

SEQ ID NO: 4212832 - RNA, 17 nt, Yersinia pestis KIM
aauuaagaagccucaug

SEQ ID NO: 4212833 - RNA, 23 nt, Yersinia pestis KIM
aauuaagaagccucaugaaugag

SEQ ID NO: 4212834 - RNA, 14 nt, Yersinia pestis KIM
aauuaagcaaaaag

SEQ ID NO: 4212835 - RNA, 19 nt, Yersinia pestis KIM
aauuaagcaaaaaggcugc

SEQ ID NO: 4212836 - RNA, 13 nt, Yersinia pestis KIM
aauuaaggaaaag

SEQ ID NO: 4212837 - RNA, 18 nt, Yersinia pestis KIM
aauuaaggugguuuuggc

SEQ ID NO: 4212838 - RNA, 17 nt, Yersinia pestis KIM
aauuaauaacaguauca

SEQ ID NO: 4212839 - RNA, 19 nt, Yersinia pestis KIM
aauuaauaaccauaaaaua

SEQ ID NO: 4212840 - RNA, 23 nt, Yersinia pestis KIM
aauuaauaugccgacaaccaaca

SEQ ID NO: 4212841 - RNA, 13 nt, Yersinia pestis KIM
aauuuagccgcaa

SEQ ID NO: 4212842 - RNA, 23 nt, Yersinia pestis KIM
aauuuagccgcccucucuagauu

SEQ ID NO: 4212843 - RNA, 13 nt, Yersinia pestis KIM
aauuuaucaaaca

SEQ ID NO: 4212844 - RNA, 14 nt, Yersinia pestis KIM
aauuuaucagacaa

SEQ ID NO: 4212845 - RNA, 19 nt, Yersinia pestis KIM
aauuuaucaggcuaauaca

SEQ ID NO: 4212846 - RNA, 22 nt, Yersinia pestis KIM
aauuuaucaguagucaauacaa

SEQ ID NO: 4212847 - RNA, 16 nt, Yersinia pestis KIM
aauuuauuucagauuu

SEQ ID NO: 4212848 - RNA, 14 nt, Yersinia pestis KIM
aauuucaccacauc

SEQ ID NO: 4212849 - RNA, 21 nt, Yersinia pestis KIM
aauuucacuaucguuagcaua

SEQ ID NO: 4212850 - RNA, 13 nt, Yersinia pestis KIM
aauuucacuggca

SEQ ID NO: 4212851 - RNA, 18 nt, Yersinia pestis KIM
aauuucacuggcaccgcu

SEQ ID NO: 4212852 - RNA, 16 nt, Yersinia pestis KIM
aauuucagauaaaaau

SEQ ID NO: 4212853 - RNA, 19 nt, Yersinia pestis KIM
aauuucagauaaaaauaau

SEQ ID NO: 4212854 - RNA, 23 nt, Yersinia pestis KIM
aauuucagcagcacguucaccaa

SEQ ID NO: 4212855 - RNA, 15 nt, Yersinia pestis KIM
aauuucagcuuuuag

SEQ ID NO: 4212856 - RNA, 22 nt, Yersinia pestis KIM
aauuucaggucgauuacauacu

SEQ ID NO: 4212857 - RNA, 14 nt, Yersinia pestis KIM
aauuucagucaaua

SEQ ID NO: 4212858 - RNA, 20 nt, Yersinia pestis KIM
aauuucauuguggaggaagg

SEQ ID NO: 4212859 - RNA, 13 nt, Yersinia pestis KIM
aauuucauuuacg

SEQ ID NO: 4212860 - RNA, 20 nt, Yersinia pestis KIM
aauuucgcuggucuuaauca

SEQ ID NO: 4212861 - RNA, 21 nt, Yersinia pestis KIM
aauuucuacgccgucaucauc

SEQ ID NO: 4212862 - RNA, 16 nt, Yersinia pestis KIM
aauuucuguuaccaga

SEQ ID NO: 4212863 - RNA, 22 nt, Yersinia pestis KIM
aauuucuugcucgucaucuuuc

SEQ ID NO: 4212864 - RNA, 14 nt, Yersinia pestis KIM
aauuucuugucacc

SEQ ID NO: 4212865 - RNA, 22 nt, Yersinia pestis KIM
aauuucuugucaccugaguaau

SEQ ID NO: 4212866 - RNA, 16 nt, Yersinia pestis KIM
aauuugauacagugau

SEQ ID NO: 4212867 - RNA, 13 nt, Yersinia pestis KIM
aauuugaucacca

SEQ ID NO: 4212868 - RNA, 14 nt, Yersinia pestis KIM
aauuugaucaccaa

SEQ ID NO: 4212869 - RNA, 12 nt, Yersinia pestis KIM
aauuugcugcuc

SEQ ID NO: 4212870 - RNA, 13 nt, Yersinia pestis KIM
aauuugcugcucg

SEQ ID NO: 4212871 - RNA, 13 nt, Yersinia pestis KIM
aauuuggccaaua

SEQ ID NO: 4212872 - RNA, 18 nt, Yersinia pestis KIM
aauuugucguuuacuggc

SEQ ID NO: 4212873 - RNA, 21 nt, Yersinia pestis KIM
aauuuuaaguuaauguuuaua

SEQ ID NO: 4212874 - RNA, 15 nt, Yersinia pestis KIM
aauuuuacguucaga

SEQ ID NO: 4212875 - RNA, 12 nt, Yersinia pestis KIM
aauuuuauauua

SEQ ID NO: 4212876 - RNA, 15 nt, Yersinia pestis KIM
aauuuuauauuauua

SEQ ID NO: 4212877 - RNA, 19 nt, Yersinia pestis KIM
aauuuuauauuauuauaaa

SEQ ID NO: 4212878 - RNA, 13 nt, Yersinia pestis KIM
aauuuuauucagc

SEQ ID NO: 4212879 - RNA, 16 nt, Yersinia pestis KIM
aauuuuauucagcaag

SEQ ID NO: 4212880 - RNA, 13 nt, Yersinia pestis KIM
aauuuucaguuca

SEQ ID NO: 4212881 - RNA, 16 nt, Yersinia pestis KIM
aauuuucccaaaguga

SEQ ID NO: 4212882 - RNA, 15 nt, Yersinia pestis KIM
aauuuucucagaaaa

SEQ ID NO: 4212883 - RNA, 16 nt, Yersinia pestis KIM
aauuuuugauacuguu

SEQ ID NO: 4212884 - RNA, 12 nt, Yersinia pestis KIM
aauuuuuuuaac

SEQ ID NO: 4212885 - RNA, 23 nt, Yersinia pestis KIM
acaaaaaauaguuguuagccacu

SEQ ID NO: 4212886 - RNA, 15 nt, Yersinia pestis KIM
acaaaaacgcucacg

SEQ ID NO: 4212887 - RNA, 22 nt, Yersinia pestis KIM
acaaaagagauccguuuaauca

SEQ ID NO: 4212888 - RNA, 19 nt, Yersinia pestis KIM
acaaaagugacgaaugagc

SEQ ID NO: 4212889 - RNA, 16 nt, Yersinia pestis KIM
acaaaauagaaaacag

SEQ ID NO: 4212890 - RNA, 17 nt, Yersinia pestis KIM
acaaaauagaaaacagc

SEQ ID NO: 4212891 - RNA, 14 nt, Yersinia pestis KIM
acaaaaucccccac

SEQ ID NO: 4212892 - RNA, 20 nt, Yersinia pestis KIM
acaaaaugccguacaacaau

SEQ ID NO: 4212893 - RNA, 21 nt, Yersinia pestis KIM
acaaaaugccguacaacaaua

SEQ ID NO: 4212894 - RNA, 17 nt, Yersinia pestis KIM
acaaaaugugaaaagca

SEQ ID NO: 4212895 - RNA, 22 nt, Yersinia pestis KIM
acaaacaaccuaaaaaaaacaa

SEQ ID NO: 4212896 - RNA, 16 nt, Yersinia pestis KIM
acaaacagggcagcca

SEQ ID NO: 4212897 - RNA, 18 nt, Yersinia pestis KIM
acaaacauggcggcagca

SEQ ID NO: 4212898 - RNA, 15 nt, Yersinia pestis KIM
acaaaccuaaaccuu

SEQ ID NO: 4212899 - RNA, 22 nt, Yersinia pestis KIM
acaaacgcguuaauuaagaccc

SEQ ID NO: 4212900 - RNA, 23 nt, Yersinia pestis KIM
acaaacuguuuuuuaaagaaaaa

SEQ ID NO: 4212901 - RNA, 15 nt, Yersinia pestis KIM
acaaagauagcguca

SEQ ID NO: 4212902 - RNA, 13 nt, Yersinia pestis KIM
acaaagcauuuca

SEQ ID NO: 4212903 - RNA, 15 nt, Yersinia pestis KIM
acaaaggcaaaauga

SEQ ID NO: 4212904 - RNA, 16 nt, Yersinia pestis KIM
acaaaggcaaaaugau

SEQ ID NO: 4212905 - RNA, 21 nt, Yersinia pestis KIM
acaaaggucagcauggucccu

SEQ ID NO: 4212906 - RNA, 14 nt, Yersinia pestis KIM
acaaauaaaacaga

SEQ ID NO: 4212907 - RNA, 23 nt, Yersinia pestis KIM
acaaauaacccgccuagcaucau

SEQ ID NO: 4212908 - RNA, 18 nt, Yersinia pestis KIM
acaaauaaggcguuuaau

SEQ ID NO: 4212909 - RNA, 23 nt, Yersinia pestis KIM
acaaauaugacgcagcgaaaugu

SEQ ID NO: 4212910 - RNA, 19 nt, Yersinia pestis KIM
acaaauauuggcccacugg

SEQ ID NO: 4212911 - RNA, 14 nt, Yersinia pestis KIM
acaaauccuuuuaa

SEQ ID NO: 4212912 - RNA, 16 nt, Yersinia pestis KIM
acaaauccuuuuaaaa

SEQ ID NO: 4212913 - RNA, 17 nt, Yersinia pestis KIM
acaaaucuuaaauugaa

SEQ ID NO: 4212914 - RNA, 20 nt, Yersinia pestis KIM
acaaaucuuaaauugaagag

SEQ ID NO: 4212915 - RNA, 18 nt, Yersinia pestis KIM
acaaaugcugugccaugu

SEQ ID NO: 4212916 - RNA, 23 nt, Yersinia pestis KIM
acaaauggucaggaacccauuug

SEQ ID NO: 4212917 - RNA, 18 nt, Yersinia pestis KIM
acaaauucaccagcaaua

SEQ ID NO: 4212918 - RNA, 17 nt, Yersinia pestis KIM
acaaauuugacauuucc

SEQ ID NO: 4212919 - RNA, 18 nt, Yersinia pestis KIM
acaaauuugacauuuccu

SEQ ID NO: 4212920 - RNA, 12 nt, Yersinia pestis KIM
acaacaaaggcg

SEQ ID NO: 4212921 - RNA, 17 nt, Yersinia pestis KIM
acaacaacggugaacag

SEQ ID NO: 4212922 - RNA, 22 nt, Yersinia pestis KIM
acaacagucacaccaacacuga

SEQ ID NO: 4212923 - RNA, 19 nt, Yersinia pestis KIM
acaacauagguuuuuucac

SEQ ID NO: 4212924 - RNA, 15 nt, Yersinia pestis KIM
acaacaucaucguca

SEQ ID NO: 4212925 - RNA, 15 nt, Yersinia pestis KIM
acaaccaacaaacaa

SEQ ID NO: 4212926 - RNA, 14 nt, Yersinia pestis KIM
acaaccaacaguuu

SEQ ID NO: 4212927 - RNA, 21 nt, Yersinia pestis KIM
acaaccacccgacaucaagaa

SEQ ID NO: 4212928 - RNA, 18 nt, Yersinia pestis KIM
acaaccacugaacaccau

SEQ ID NO: 4212929 - RNA, 16 nt, Yersinia pestis KIM
acaaccccaugaccgc

SEQ ID NO: 4212930 - RNA, 14 nt, Yersinia pestis KIM
acaaccgugcacca

SEQ ID NO: 4212931 - RNA, 15 nt, Yersinia pestis KIM
acaacgagggcucaa

SEQ ID NO: 4212932 - RNA, 19 nt, Yersinia pestis KIM
acaacgagggcucaaucuc

SEQ ID NO: 4212933 - RNA, 20 nt, Yersinia pestis KIM
acaacgcuuaucaaagugcu

SEQ ID NO: 4212934 - RNA, 16 nt, Yersinia pestis KIM
acaacgucauuuguga

SEQ ID NO: 4212935 - RNA, 13 nt, Yersinia pestis KIM
acaacguuucugg

SEQ ID NO: 4212936 - RNA, 14 nt, Yersinia pestis KIM
acaacguuucugga

SEQ ID NO: 4212937 - RNA, 18 nt, Yersinia pestis KIM
acaacucaccgccgacca

SEQ ID NO: 4212938 - RNA, 16 nt, Yersinia pestis KIM
acaacucguuaucuuc

SEQ ID NO: 4212939 - RNA, 18 nt, Yersinia pestis KIM
acaacugacaacaucaaa

SEQ ID NO: 4212940 - RNA, 14 nt, Yersinia pestis KIM
acaacuuccacaca

SEQ ID NO: 4212941 - RNA, 11 nt, Yersinia pestis KIM
acaacuucuuc

SEQ ID NO: 4212942 - RNA, 14 nt, Yersinia pestis KIM
acaagaaaucaaaa

SEQ ID NO: 4212943 - RNA, 12 nt, Yersinia pestis KIM
acaagacaauau

SEQ ID NO: 4212944 - RNA, 19 nt, Yersinia pestis KIM
acaagauaaauaccgccaa

SEQ ID NO: 4212945 - RNA, 21 nt, Yersinia pestis KIM
acaagauaaauaccgccaaau

SEQ ID NO: 4212946 - RNA, 21 nt, Yersinia pestis KIM
acaagcacucaaugucaugca

SEQ ID NO: 4212947 - RNA, 14 nt, Yersinia pestis KIM
acaagccaacauug

SEQ ID NO: 4212948 - RNA, 21 nt, Yersinia pestis KIM
acaagccagcgaggcuucuca

SEQ ID NO: 4212949 - RNA, 19 nt, Yersinia pestis KIM
acaagccagugacugagca

SEQ ID NO: 4212950 - RNA, 14 nt, Yersinia pestis KIM
acaagccauuucac

SEQ ID NO: 4212951 - RNA, 20 nt, Yersinia pestis KIM
acaagccgugaccaaagugc

SEQ ID NO: 4212952 - RNA, 19 nt, Yersinia pestis KIM
acaagcgaccaucaugaau

SEQ ID NO: 4212953 - RNA, 16 nt, Yersinia pestis KIM
acaagcggacuucacu

SEQ ID NO: 4212954 - RNA, 15 nt, Yersinia pestis KIM
acaagucagugauuc

SEQ ID NO: 4212955 - RNA, 21 nt, Yersinia pestis KIM
acaagucagugauucggguga

SEQ ID NO: 4212956 - RNA, 13 nt, Yersinia pestis KIM
acacuccauuaau

SEQ ID NO: 4212957 - RNA, 15 nt, Yersinia pestis KIM
acacugacaucauca

SEQ ID NO: 4212958 - RNA, 14 nt, Yersinia pestis KIM
acacugacauuuau

SEQ ID NO: 4212959 - RNA, 20 nt, Yersinia pestis KIM
acacugagcaccgcaggaac

SEQ ID NO: 4212960 - RNA, 15 nt, Yersinia pestis KIM
acacugcaucucugc

SEQ ID NO: 4212961 - RNA, 15 nt, Yersinia pestis KIM
acacuggugcucacu

SEQ ID NO: 4212962 - RNA, 17 nt, Yersinia pestis KIM
acacuggugcucacuga

SEQ ID NO: 4212963 - RNA, 16 nt, Yersinia pestis KIM
acacugucgcauaaga

SEQ ID NO: 4212964 - RNA, 16 nt, Yersinia pestis KIM
acacuguuuaguucac

SEQ ID NO: 4212965 - RNA, 12 nt, Yersinia pestis KIM
acacuuauuggu

SEQ ID NO: 4212966 - RNA, 18 nt, Yersinia pestis KIM
acacuuauuugaaauacu

SEQ ID NO: 4212967 - RNA, 22 nt, Yersinia pestis KIM
acacuucgccaggucaggaaga

SEQ ID NO: 4212968 - RNA, 15 nt, Yersinia pestis KIM
acacuugcucuacca

SEQ ID NO: 4212969 - RNA, 15 nt, Yersinia pestis KIM
acagaaacgauuacc

SEQ ID NO: 4212970 - RNA, 11 nt, Yersinia pestis KIM
acagaaaucaa

SEQ ID NO: 4212971 - RNA, 12 nt, Yersinia pestis KIM
acagaaaucaau

SEQ ID NO: 4212972 - RNA, 19 nt, Yersinia pestis KIM
acagaaaucaaugugccgu

SEQ ID NO: 4212973 - RNA, 11 nt, Yersinia pestis KIM
acagaacuaau

SEQ ID NO: 4212974 - RNA, 20 nt, Yersinia pestis KIM
acagaacuaauaucaacaga

SEQ ID NO: 4212975 - RNA, 21 nt, Yersinia pestis KIM
acagaacuaauaucaacagaa

SEQ ID NO: 4212976 - RNA, 22 nt, Yersinia pestis KIM
acagaacuaauaucaacagaac

SEQ ID NO: 4212977 - RNA, 19 nt, Yersinia pestis KIM
acagaagcguaaagcaccc

SEQ ID NO: 4212978 - RNA, 15 nt, Yersinia pestis KIM
acagaaucaccaaca

SEQ ID NO: 4212979 - RNA, 24 nt, Yersinia pestis KIM
acagaaucaccaacaccaccauca

SEQ ID NO: 4212980 - RNA, 15 nt, Yersinia pestis KIM
acagacaaacaaccu

SEQ ID NO: 4212981 - RNA, 21 nt, Yersinia pestis KIM
acagacaaacaaccuaaaaaa

SEQ ID NO: 4212982 - RNA, 15 nt, Yersinia pestis KIM
acagacacagcaaca

SEQ ID NO: 4212983 - RNA, 15 nt, Yersinia pestis KIM
acagacauuugcaac

SEQ ID NO: 4212984 - RNA, 20 nt, Yersinia pestis KIM
acagacauuugcaacuuccu

SEQ ID NO: 4212985 - RNA, 23 nt, Yersinia pestis KIM
acagaccccagaagaucgguuca

SEQ ID NO: 4212986 - RNA, 23 nt, Yersinia pestis KIM
acagacgccccgaaccauuuacc

SEQ ID NO: 4212987 - RNA, 19 nt, Yersinia pestis KIM
acagacuaaaaaccgccac

SEQ ID NO: 4212988 - RNA, 13 nt, Yersinia pestis KIM
acagacuggugaa

SEQ ID NO: 4212989 - RNA, 21 nt, Yersinia pestis KIM
acagagcaaaaagccagcgau

SEQ ID NO: 4212990 - RNA, 18 nt, Yersinia pestis KIM
acagagcagaaagcagca

SEQ ID NO: 4212991 - RNA, 21 nt, Yersinia pestis KIM
acagagccagaauaucgugga

SEQ ID NO: 4212992 - RNA, 12 nt, Yersinia pestis KIM
acagauaaagcu

SEQ ID NO: 4212993 - RNA, 15 nt, Yersinia pestis KIM
acagauaaauaaaau

SEQ ID NO: 4212994 - RNA, 14 nt, Yersinia pestis KIM
acagauaauaugac

SEQ ID NO: 4212995 - RNA, 15 nt, Yersinia pestis KIM
acagauauagcgugc

SEQ ID NO: 4212996 - RNA, 20 nt, Yersinia pestis KIM
acagauauauccaggcacug

SEQ ID NO: 4212997 - RNA, 16 nt, Yersinia pestis KIM
acagauauuacgcagc

SEQ ID NO: 4212998 - RNA, 22 nt, Yersinia pestis KIM
acagauauuacgcagccauacc

SEQ ID NO: 4212999 - RNA, 23 nt, Yersinia pestis KIM
acagauauuuucggguaucugug

SEQ ID NO: 4213000 - RNA, 19 nt, Yersinia pestis KIM
acagaucacccgcaaaacu

SEQ ID NO: 4213001 - RNA, 15 nt, Yersinia pestis KIM
acagaucauuaggcc

SEQ ID NO: 4213002 - RNA, 22 nt, Yersinia pestis KIM
acagaucauuaggccacuuaac

SEQ ID NO: 4213003 - RNA, 21 nt, Yersinia pestis KIM
acagauccugccgccucugcu

SEQ ID NO: 4213004 - RNA, 19 nt, Yersinia pestis KIM
acagauuauuucagcuuca

SEQ ID NO: 4213005 - RNA, 16 nt, Yersinia pestis KIM
acagauucaauauuua

SEQ ID NO: 4213006 - RNA, 18 nt, Yersinia pestis KIM
acagauuuuccauccccu

SEQ ID NO: 4213007 - RNA, 14 nt, Yersinia pestis KIM
acagcaacaacccc

SEQ ID NO: 4213008 - RNA, 19 nt, Yersinia pestis KIM
acagcaacaggguaauaac

SEQ ID NO: 4213009 - RNA, 13 nt, Yersinia pestis KIM
acagcaacgacgc

SEQ ID NO: 4213010 - RNA, 21 nt, Yersinia pestis KIM
acagcaaugcaccgacaaaga

SEQ ID NO: 4213011 - RNA, 23 nt, Yersinia pestis KIM
acagcaaugcaccgacaaagaua

SEQ ID NO: 4213012 - RNA, 16 nt, Yersinia pestis KIM
acagcacgguaaccuu

SEQ ID NO: 4213013 - RNA, 15 nt, Yersinia pestis KIM
acagcacguaccgcu

SEQ ID NO: 4213014 - RNA, 19 nt, Yersinia pestis KIM
acagcagaacaaaacaagc

SEQ ID NO: 4213015 - RNA, 22 nt, Yersinia pestis KIM
acagcagaacaaaacaagcccc

SEQ ID NO: 4213016 - RNA, 19 nt, Yersinia pestis KIM
acagcaguucaucuucgau

SEQ ID NO: 4213017 - RNA, 19 nt, Yersinia pestis KIM
acagcaucaacauggaugu

SEQ ID NO: 4213018 - RNA, 13 nt, Yersinia pestis KIM
acagcaucaauau

SEQ ID NO: 4213019 - RNA, 18 nt, Yersinia pestis KIM
acagcauuaccaaggaaa

SEQ ID NO: 4213020 - RNA, 17 nt, Yersinia pestis KIM
acagcauucugcuucca

SEQ ID NO: 4213021 - RNA, 16 nt, Yersinia pestis KIM
acagccaccagccaac

SEQ ID NO: 4213022 - RNA, 23 nt, Yersinia pestis KIM
acagccacgauuaucucuuacau

SEQ ID NO: 4213023 - RNA, 12 nt, Yersinia pestis KIM
acagccagccuu

SEQ ID NO: 4213024 - RNA, 16 nt, Yersinia pestis KIM
acagccauauuuuuca

SEQ ID NO: 4213025 - RNA, 15 nt, Yersinia pestis KIM
acagcccaagagaaa

SEQ ID NO: 4213026 - RNA, 17 nt, Yersinia pestis KIM
acagccccaaccaucuc

SEQ ID NO: 4213027 - RNA, 15 nt, Yersinia pestis KIM
acagcccccugccua

SEQ ID NO: 4213028 - RNA, 14 nt, Yersinia pestis KIM
acagcccgguauca

SEQ ID NO: 4213029 - RNA, 20 nt, Yersinia pestis KIM
acagccgcugaauuaacaua

SEQ ID NO: 4213030 - RNA, 21 nt, Yersinia pestis KIM
acagccguauaucuuaccuuc

SEQ ID NO: 4213031 - RNA, 23 nt, Yersinia pestis KIM
acagccguguagcauggcuuuau

SEQ ID NO: 4213032 - RNA, 14 nt, Yersinia pestis KIM
acagccuaaccgcu

SEQ ID NO: 4213033 - RNA, 16 nt, Yersinia pestis KIM
acagccuaaccgcugu

SEQ ID NO: 4213034 - RNA, 12 nt, Yersinia pestis KIM
acagccugugcc

SEQ ID NO: 4213035 - RNA, 19 nt, Yersinia pestis KIM
acagcgcccgugguugaga

SEQ ID NO: 4213036 - RNA, 15 nt, Yersinia pestis KIM
acagcgccucaguau

SEQ ID NO: 4213037 - RNA, 16 nt, Yersinia pestis KIM
acagcgcgcagccaac

SEQ ID NO: 4213038 - RNA, 21 nt, Yersinia pestis KIM
acagcgcuuuuuuaacgucca

SEQ ID NO: 4213039 - RNA, 14 nt, Yersinia pestis KIM
acagcguauucacg

SEQ ID NO: 4213040 - RNA, 17 nt, Yersinia pestis KIM
acagcuaacacuggcuu

SEQ ID NO: 4213041 - RNA, 19 nt, Yersinia pestis KIM
acagcuaauuuucauugau

SEQ ID NO: 4213042 - RNA, 17 nt, Yersinia pestis KIM
acagcuaucuugaaaca

SEQ ID NO: 4213043 - RNA, 22 nt, Yersinia pestis KIM
acagcucagacuggccagaagg

SEQ ID NO: 4213044 - RNA, 19 nt, Yersinia pestis KIM
acagcucggccagcauuca

SEQ ID NO: 4213045 - RNA, 23 nt, Yersinia pestis KIM
acagcuuaaaaucuguaauuaau

SEQ ID NO: 4213046 - RNA, 14 nt, Yersinia pestis KIM
acaggaucugcucc

SEQ ID NO: 4213047 - RNA, 12 nt, Yersinia pestis KIM
acaggauuaaau

SEQ ID NO: 4213048 - RNA, 18 nt, Yersinia pestis KIM
acaggccccaauccacca

SEQ ID NO: 4213049 - RNA, 19 nt, Yersinia pestis KIM
acaggccgugggcaauaac

SEQ ID NO: 4213050 - RNA, 14 nt, Yersinia pestis KIM
acaggcgaguuggc

SEQ ID NO: 4213051 - RNA, 20 nt, Yersinia pestis KIM
acaggcucagcacaaacaug

SEQ ID NO: 4213052 - RNA, 22 nt, Yersinia pestis KIM
acaggcucuaucucuucagggc

SEQ ID NO: 4213053 - RNA, 14 nt, Yersinia pestis KIM
acaggcugccugcc

SEQ ID NO: 4213054 - RNA, 22 nt, Yersinia pestis KIM
acaggcuugaugaaagcuauuu

SEQ ID NO: 4213055 - RNA, 13 nt, Yersinia pestis KIM
acagggcagaaaa

SEQ ID NO: 4213056 - RNA, 20 nt, Yersinia pestis KIM
acagguacuucaaauaagca

SEQ ID NO: 4213057 - RNA, 23 nt, Yersinia pestis KIM
acagguagaucaaacauaaccug

SEQ ID NO: 4213058 - RNA, 16 nt, Yersinia pestis KIM
acaggugucaucaagg

SEQ ID NO: 4213059 - RNA, 19 nt, Yersinia pestis KIM
acaguaagguauugacaca

SEQ ID NO: 4213060 - RNA, 15 nt, Yersinia pestis KIM
acaguaauuaaguug

SEQ ID NO: 4213061 - RNA, 15 nt, Yersinia pestis KIM
acaguacugccaacc

SEQ ID NO: 4213062 - RNA, 15 nt, Yersinia pestis KIM
acaguagaagcuacc

SEQ ID NO: 4213063 - RNA, 18 nt, Yersinia pestis KIM
acaguaggcugaaggccu

SEQ ID NO: 4213064 - RNA, 21 nt, Yersinia pestis KIM
acaguaggcugaaggccugcu

SEQ ID NO: 4213065 - RNA, 18 nt, Yersinia pestis KIM
acaguaucaaccaccgcu

SEQ ID NO: 4213066 - RNA, 15 nt, Yersinia pestis KIM
acagucaauugagaa

SEQ ID NO: 4213067 - RNA, 18 nt, Yersinia pestis KIM
acagucaauugagaauaa

SEQ ID NO: 4213068 - RNA, 16 nt, Yersinia pestis KIM
acagucacaccaacac

SEQ ID NO: 4213069 - RNA, 12 nt, Yersinia pestis KIM
acagucauuuac

SEQ ID NO: 4213070 - RNA, 18 nt, Yersinia pestis KIM
acagugcaacauuaaaaa

SEQ ID NO: 4213071 - RNA, 16 nt, Yersinia pestis KIM
acauuguuauauuaac

SEQ ID NO: 4213072 - RNA, 13 nt, Yersinia pestis KIM
acauuuacuuaua

SEQ ID NO: 4213073 - RNA, 14 nt, Yersinia pestis KIM
acauuucuuuuuau

SEQ ID NO: 4213074 - RNA, 17 nt, Yersinia pestis KIM
acauuugcaucuaugga

SEQ ID NO: 4213075 - RNA, 15 nt, Yersinia pestis KIM
acauuuguugcaaua

SEQ ID NO: 4213076 - RNA, 16 nt, Yersinia pestis KIM
acauuuuacucccuga

SEQ ID NO: 4213077 - RNA, 13 nt, Yersinia pestis KIM
acauuuucuaagc

SEQ ID NO: 4213078 - RNA, 14 nt, Yersinia pestis KIM
acauuuucuaucuc

SEQ ID NO: 4213079 - RNA, 11 nt, Yersinia pestis KIM
acauuuugguu

SEQ ID NO: 4213080 - RNA, 23 nt, Yersinia pestis KIM
acauuuugguuucuccaagcaca

SEQ ID NO: 4213081 - RNA, 11 nt, Yersinia pestis KIM
acauuuugugc

SEQ ID NO: 4213082 - RNA, 13 nt, Yersinia pestis KIM
acauuuuucuauu

SEQ ID NO: 4213083 - RNA, 23 nt, Yersinia pestis KIM
accaaaacccaucagacggaaug

SEQ ID NO: 4213084 - RNA, 12 nt, Yersinia pestis KIM
accaaaauagcg

SEQ ID NO: 4213085 - RNA, 14 nt, Yersinia pestis KIM
accaaaaugacaau

SEQ ID NO: 4213086 - RNA, 17 nt, Yersinia pestis KIM
accaaacauugucaccu

SEQ ID NO: 4213087 - RNA, 21 nt, Yersinia pestis KIM
accaaaccggaugauuucaaa

SEQ ID NO: 4213088 - RNA, 14 nt, Yersinia pestis KIM
accaaagauauguu

SEQ ID NO: 4213089 - RNA, 18 nt, Yersinia pestis KIM
accaaagcaacagccaua

SEQ ID NO: 4213090 - RNA, 11 nt, Yersinia pestis KIM
accaaagcagu

SEQ ID NO: 4213091 - RNA, 17 nt, Yersinia pestis KIM
accaaaggcuauuuaag

SEQ ID NO: 4213092 - RNA, 13 nt, Yersinia pestis KIM
accaaauaaaaca

SEQ ID NO: 4213093 - RNA, 15 nt, Yersinia pestis KIM
accaaauaaaacaag

SEQ ID NO: 4213094 - RNA, 17 nt, Yersinia pestis KIM
accaaauagccggcucu

SEQ ID NO: 4213095 - RNA, 13 nt, Yersinia pestis KIM
accaaaucuucca

SEQ ID NO: 4213096 - RNA, 17 nt, Yersinia pestis KIM
accaaaucuuccagcgg

SEQ ID NO: 4213097 - RNA, 21 nt, Yersinia pestis KIM
accaaaucuuccagcggcaaa

SEQ ID NO: 4213098 - RNA, 12 nt, Yersinia pestis KIM
accaacaaacaa

SEQ ID NO: 4213099 - RNA, 17 nt, Yersinia pestis KIM
accaacaaacaauccua

SEQ ID NO: 4213100 - RNA, 21 nt, Yersinia pestis KIM
accaacaacuccacuuccuca

SEQ ID NO: 4213101 - RNA, 20 nt, Yersinia pestis KIM
accaacaauauucgcagcca

SEQ ID NO: 4213102 - RNA, 14 nt, Yersinia pestis KIM
accaacaccaaugg

SEQ ID NO: 4213103 - RNA, 22 nt, Yersinia pestis KIM
accaacaccacacugagcaccg

SEQ ID NO: 4213104 - RNA, 14 nt, Yersinia pestis KIM
accaacaccaccau

SEQ ID NO: 4213105 - RNA, 20 nt, Yersinia pestis KIM
accaacacuccucuuucuua

SEQ ID NO: 4213106 - RNA, 23 nt, Yersinia pestis KIM
accaacacugauugugccgacau

SEQ ID NO: 4213107 - RNA, 13 nt, Yersinia pestis KIM
accaacagacgcc

SEQ ID NO: 4213108 - RNA, 17 nt, Yersinia pestis KIM
accaacaguuugguaau

SEQ ID NO: 4213109 - RNA, 20 nt, Yersinia pestis KIM
accaacaugagccacacauu

SEQ ID NO: 4213110 - RNA, 17 nt, Yersinia pestis KIM
accaaccgcuuuaucgc

SEQ ID NO: 4213111 - RNA, 17 nt, Yersinia pestis KIM
accaaccgguugacguu

SEQ ID NO: 4213112 - RNA, 22 nt, Yersinia pestis KIM
accaaccuugggggaccagcac

SEQ ID NO: 4213113 - RNA, 14 nt, Yersinia pestis KIM
accaacgaaaucac

SEQ ID NO: 4213114 - RNA, 19 nt, Yersinia pestis KIM
accaacgaaaucacccggc

SEQ ID NO: 4213115 - RNA, 14 nt, Yersinia pestis KIM
accaacuggcaauc

SEQ ID NO: 4213116 - RNA, 13 nt, Yersinia pestis KIM
accaagaaaaccc

SEQ ID NO: 4213117 - RNA, 19 nt, Yersinia pestis KIM
accaagacuucaugacuac

SEQ ID NO: 4213118 - RNA, 21 nt, Yersinia pestis KIM
accaagacuucaugacuaccu

SEQ ID NO: 4213119 - RNA, 17 nt, Yersinia pestis KIM
accaagaggaaaugccg

SEQ ID NO: 4213120 - RNA, 12 nt, Yersinia pestis KIM
accaagaggcug

SEQ ID NO: 4213121 - RNA, 20 nt, Yersinia pestis KIM
accaagcccaguaaagcaaa

SEQ ID NO: 4213122 - RNA, 14 nt, Yersinia pestis KIM
accaagcuuugccu

SEQ ID NO: 4213123 - RNA, 16 nt, Yersinia pestis KIM
accaaggcucuggcaa

SEQ ID NO: 4213124 - RNA, 12 nt, Yersinia pestis KIM
accaauaagcug

SEQ ID NO: 4213125 - RNA, 15 nt, Yersinia pestis KIM
accaauaaucgggaa

SEQ ID NO: 4213126 - RNA, 24 nt, Yersinia pestis KIM
accaauaaucgggaaauugugauu

SEQ ID NO: 4213127 - RNA, 13 nt, Yersinia pestis KIM
accaauaauuaau

SEQ ID NO: 4213128 - RNA, 12 nt, Yersinia pestis KIM
accaauagucac

SEQ ID NO: 4213129 - RNA, 14 nt, Yersinia pestis KIM
accaauauaaaagc

SEQ ID NO: 4213130 - RNA, 15 nt, Yersinia pestis KIM
accaauaucauaaua

SEQ ID NO: 4213131 - RNA, 21 nt, Yersinia pestis KIM
accaaucaaaaauugccccac

SEQ ID NO: 4213132 - RNA, 15 nt, Yersinia pestis KIM
accaaucuccaauga

SEQ ID NO: 4213133 - RNA, 22 nt, Yersinia pestis KIM
accaaugaauuacguuuuggau

SEQ ID NO: 4213134 - RNA, 15 nt, Yersinia pestis KIM
accaaugacgauauu

SEQ ID NO: 4213135 - RNA, 18 nt, Yersinia pestis KIM
accaaugacuaauugugc

SEQ ID NO: 4213136 - RNA, 13 nt, Yersinia pestis KIM
accaaugauuaac

SEQ ID NO: 4213137 - RNA, 17 nt, Yersinia pestis KIM
accaaugccgguccaga

SEQ ID NO: 4213138 - RNA, 17 nt, Yersinia pestis KIM
accaaugguuucaccgu

SEQ ID NO: 4213139 - RNA, 20 nt, Yersinia pestis KIM
accaauguugggguagccaa

SEQ ID NO: 4213140 - RNA, 12 nt, Yersinia pestis KIM
accaauuaauaa

SEQ ID NO: 4213141 - RNA, 15 nt, Yersinia pestis KIM
accaauucaucagcg

SEQ ID NO: 4213142 - RNA, 12 nt, Yersinia pestis KIM
accaauucuuag

SEQ ID NO: 4213143 - RNA, 21 nt, Yersinia pestis KIM
accaauugaugucaugauaaa

SEQ ID NO: 4213144 - RNA, 16 nt, Yersinia pestis KIM
accacaaaaacagugu

SEQ ID NO: 4213145 - RNA, 19 nt, Yersinia pestis KIM
accacaaaggcaaaaugau

SEQ ID NO: 4213146 - RNA, 18 nt, Yersinia pestis KIM
accacaaaggucagcaug

SEQ ID NO: 4213147 - RNA, 19 nt, Yersinia pestis KIM
accacacugagcaccgcag

SEQ ID NO: 4213148 - RNA, 22 nt, Yersinia pestis KIM
accacacugagcaccgcaggaa

SEQ ID NO: 4213149 - RNA, 18 nt, Yersinia pestis KIM
accacaucaaccugauca

SEQ ID NO: 4213150 - RNA, 15 nt, Yersinia pestis KIM
accacaucacgcagc

SEQ ID NO: 4213151 - RNA, 22 nt, Yersinia pestis KIM
accaccaaaaacuucaucgaua

SEQ ID NO: 4213152 - RNA, 15 nt, Yersinia pestis KIM
accaccaaaauagcg

SEQ ID NO: 4213153 - RNA, 11 nt, Yersinia pestis KIM
accaccaacuc

SEQ ID NO: 4213154 - RNA, 17 nt, Yersinia pestis KIM
accaccaacuccugccu

SEQ ID NO: 4213155 - RNA, 19 nt, Yersinia pestis KIM
accaccaacuccugccuac

SEQ ID NO: 4213156 - RNA, 13 nt, Yersinia pestis KIM
accaccacugcau

SEQ ID NO: 4213157 - RNA, 15 nt, Yersinia pestis KIM
accaccagguuaccu

SEQ ID NO: 4213158 - RNA, 15 nt, Yersinia pestis KIM
accacccgcuggcgc

SEQ ID NO: 4213159 - RNA, 21 nt, Yersinia pestis KIM
accacccguugcauuuuucug

SEQ ID NO: 4213160 - RNA, 16 nt, Yersinia pestis KIM
accaccggguuuagua

SEQ ID NO: 4213161 - RNA, 20 nt, Yersinia pestis KIM
accaccgucaagacaacaaa

SEQ ID NO: 4213162 - RNA, 15 nt, Yersinia pestis KIM
accaccuaauacagc

SEQ ID NO: 4213163 - RNA, 19 nt, Yersinia pestis KIM
accaccuaauacagcacca

SEQ ID NO: 4213164 - RNA, 16 nt, Yersinia pestis KIM
accaccuuuaccaugc

SEQ ID NO: 4213165 - RNA, 19 nt, Yersinia pestis KIM
accacgaaaaaauggcagc

SEQ ID NO: 4213166 - RNA, 14 nt, Yersinia pestis KIM
accacgagugacgg

SEQ ID NO: 4213167 - RNA, 18 nt, Yersinia pestis KIM
accacgcaucaauaauaa

SEQ ID NO: 4213168 - RNA, 19 nt, Yersinia pestis KIM
accacgcauuccaucagcc

SEQ ID NO: 4213169 - RNA, 21 nt, Yersinia pestis KIM
accacgcauuccaucagccaa

SEQ ID NO: 4213170 - RNA, 18 nt, Yersinia pestis KIM
accacugacaaaaacagc

SEQ ID NO: 4213171 - RNA, 21 nt, Yersinia pestis KIM
accacugaccuauugauaaaa

SEQ ID NO: 4213172 - RNA, 16 nt, Yersinia pestis KIM
accacugauacccagu

SEQ ID NO: 4213173 - RNA, 16 nt, Yersinia pestis KIM
accacugauaggucau

SEQ ID NO: 4213174 - RNA, 21 nt, Yersinia pestis KIM
accacugccacacuuuugcug

SEQ ID NO: 4213175 - RNA, 15 nt, Yersinia pestis KIM
accacugugauaaac

SEQ ID NO: 4213176 - RNA, 19 nt, Yersinia pestis KIM
accacuugcuaccaagacu

SEQ ID NO: 4213177 - RNA, 14 nt, Yersinia pestis KIM
accacuuuccaggu

SEQ ID NO: 4213178 - RNA, 20 nt, Yersinia pestis KIM
accagaaauaacguaacgac

SEQ ID NO: 4213179 - RNA, 12 nt, Yersinia pestis KIM
accagaauaauc

SEQ ID NO: 4213180 - RNA, 19 nt, Yersinia pestis KIM
accagaaugguuuggccgu

SEQ ID NO: 4213181 - RNA, 16 nt, Yersinia pestis KIM
accagacaacagucac

SEQ ID NO: 4213182 - RNA, 17 nt, Yersinia pestis KIM
accagacaaccaauaca

SEQ ID NO: 4213183 - RNA, 22 nt, Yersinia pestis KIM
accagacucugcuaccaggaag

SEQ ID NO: 4213184 - RNA, 15 nt, Yersinia pestis KIM
accagauaacaacaa

SEQ ID NO: 4213185 - RNA, 16 nt, Yersinia pestis KIM
accagauaacaacaaa

SEQ ID NO: 4213186 - RNA, 17 nt, Yersinia pestis KIM
accagauuaaucaccuc

SEQ ID NO: 4213187 - RNA, 21 nt, Yersinia pestis KIM
accccuaauccagcagccucu

SEQ ID NO: 4213188 - RNA, 16 nt, Yersinia pestis KIM
accccuauuagggaac

SEQ ID NO: 4213189 - RNA, 16 nt, Yersinia pestis KIM
accccugucuuauuuu

SEQ ID NO: 4213190 - RNA, 22 nt, Yersinia pestis KIM
accccuucaccgggaucuauca

SEQ ID NO: 4213191 - RNA, 18 nt, Yersinia pestis KIM
accccuucgagcaccgcg

SEQ ID NO: 4213192 - RNA, 14 nt, Yersinia pestis KIM
accccuuuugauuu

SEQ ID NO: 4213193 - RNA, 19 nt, Yersinia pestis KIM
acccgaauuaauaaaaccu

SEQ ID NO: 4213194 - RNA, 15 nt, Yersinia pestis KIM
acccgaccagacaac

SEQ ID NO: 4213195 - RNA, 15 nt, Yersinia pestis KIM
acccgagccgcacca

SEQ ID NO: 4213196 - RNA, 15 nt, Yersinia pestis KIM
acccgauacaggcuc

SEQ ID NO: 4213197 - RNA, 13 nt, Yersinia pestis KIM
acccgauuucacg

SEQ ID NO: 4213198 - RNA, 18 nt, Yersinia pestis KIM
acccgccaucaggcaaaa

SEQ ID NO: 4213199 - RNA, 17 nt, Yersinia pestis KIM
acccgcgcagccuaaaa

SEQ ID NO: 4213200 - RNA, 16 nt, Yersinia pestis KIM
acccgcgggagucagu

SEQ ID NO: 4213201 - RNA, 18 nt, Yersinia pestis KIM
acccgcucugucagcccu

SEQ ID NO: 4213202 - RNA, 19 nt, Yersinia pestis KIM
acccgcucugucagcccua

SEQ ID NO: 4213203 - RNA, 15 nt, Yersinia pestis KIM
acccgcuguuucucu

SEQ ID NO: 4213204 - RNA, 20 nt, Yersinia pestis KIM
acccgcuucguccgcuuagc

SEQ ID NO: 4213205 - RNA, 17 nt, Yersinia pestis KIM
acccgcuugucuugaaa

SEQ ID NO: 4213206 - RNA, 14 nt, Yersinia pestis KIM
acccggcaaauaaa

SEQ ID NO: 4213207 - RNA, 23 nt, Yersinia pestis KIM
acccggcaaauaaauaccggcag

SEQ ID NO: 4213208 - RNA, 15 nt, Yersinia pestis KIM
acccggcaucaacca

SEQ ID NO: 4213209 - RNA, 17 nt, Yersinia pestis KIM
acccggcuggcaccaag

SEQ ID NO: 4213210 - RNA, 15 nt, Yersinia pestis KIM
acccguaaacacaaa

SEQ ID NO: 4213211 - RNA, 17 nt, Yersinia pestis KIM
acccguaaacacaaaau

SEQ ID NO: 4213212 - RNA, 17 nt, Yersinia pestis KIM
acccguacgaauuuuuc

SEQ ID NO: 4213213 - RNA, 20 nt, Yersinia pestis KIM
acccguaggcccacaaucaa

SEQ ID NO: 4213214 - RNA, 16 nt, Yersinia pestis KIM
acccgucaccacaaag

SEQ ID NO: 4213215 - RNA, 14 nt, Yersinia pestis KIM
acccguuacugcau

SEQ ID NO: 4213216 - RNA, 17 nt, Yersinia pestis KIM
acccguugcaaggccuc

SEQ ID NO: 4213217 - RNA, 22 nt, Yersinia pestis KIM
acccuauuuuugccaaugcugc

SEQ ID NO: 4213218 - RNA, 17 nt, Yersinia pestis KIM
acccucauguaagccaa

SEQ ID NO: 4213219 - RNA, 21 nt, Yersinia pestis KIM
acccucgacaccaaaacuccc

SEQ ID NO: 4213220 - RNA, 21 nt, Yersinia pestis KIM
acccucucuuuccagcaaaag

SEQ ID NO: 4213221 - RNA, 16 nt, Yersinia pestis KIM
acccucuuaaugaaug

SEQ ID NO: 4213222 - RNA, 21 nt, Yersinia pestis KIM
acccugaaggcugauuaauau

SEQ ID NO: 4213223 - RNA, 19 nt, Yersinia pestis KIM
acccugacgaaauuuaaga

SEQ ID NO: 4213224 - RNA, 18 nt, Yersinia pestis KIM
acccuugauuuuaccaac

SEQ ID NO: 4213225 - RNA, 24 nt, Yersinia pestis KIM
acccuuugagaaaggauuugaaga

SEQ ID NO: 4213226 - RNA, 23 nt, Yersinia pestis KIM
accgaaauauucgucucaucaau

SEQ ID NO: 4213227 - RNA, 14 nt, Yersinia pestis KIM
accgaacacgaucc

SEQ ID NO: 4213228 - RNA, 16 nt, Yersinia pestis KIM
accgacaccaaccggu

SEQ ID NO: 4213229 - RNA, 21 nt, Yersinia pestis KIM
accgacgguucccaugacgau

SEQ ID NO: 4213230 - RNA, 20 nt, Yersinia pestis KIM
accgagcgucaagccaaccc

SEQ ID NO: 4213231 - RNA, 17 nt, Yersinia pestis KIM
accgagcgugaagagcg

SEQ ID NO: 4213232 - RNA, 16 nt, Yersinia pestis KIM
accgaggcgcugacau

SEQ ID NO: 4213233 - RNA, 17 nt, Yersinia pestis KIM
accgaggcgcugacaua

SEQ ID NO: 4213234 - RNA, 20 nt, Yersinia pestis KIM
accgaggcgggucagaaaca

SEQ ID NO: 4213235 - RNA, 21 nt, Yersinia pestis KIM
accgaggcucgacgggaacga

SEQ ID NO: 4213236 - RNA, 22 nt, Yersinia pestis KIM
accgaggcucgacgggaacgac

SEQ ID NO: 4213237 - RNA, 16 nt, Yersinia pestis KIM
accgaguguaaaaagc

SEQ ID NO: 4213238 - RNA, 17 nt, Yersinia pestis KIM
accgaguguaaaaagca

SEQ ID NO: 4213239 - RNA, 19 nt, Yersinia pestis KIM
accgauauugauagccaca

SEQ ID NO: 4213240 - RNA, 23 nt, Yersinia pestis KIM
accgaugauaagugaauaaauca

SEQ ID NO: 4213241 - RNA, 22 nt, Yersinia pestis KIM
accgcaaccaccuuuaccaugc

SEQ ID NO: 4213242 - RNA, 12 nt, Yersinia pestis KIM
accgcaaccggg

SEQ ID NO: 4213243 - RNA, 22 nt, Yersinia pestis KIM
accgcacacugacagcaacgac

SEQ ID NO: 4213244 - RNA, 23 nt, Yersinia pestis KIM
accgcacugcccagguucaaaau

SEQ ID NO: 4213245 - RNA, 20 nt, Yersinia pestis KIM
accgcacuugcggcaauggc

SEQ ID NO: 4213246 - RNA, 13 nt, Yersinia pestis KIM
accgcagaaccuu

SEQ ID NO: 4213247 - RNA, 19 nt, Yersinia pestis KIM
accgcagccuucagaugaa

SEQ ID NO: 4213248 - RNA, 11 nt, Yersinia pestis KIM
accgcauaaga

SEQ ID NO: 4213249 - RNA, 14 nt, Yersinia pestis KIM
accgcauucccugc

SEQ ID NO: 4213250 - RNA, 15 nt, Yersinia pestis KIM
accgccaaauacaaa

SEQ ID NO: 4213251 - RNA, 13 nt, Yersinia pestis KIM
accgccaaaucca

SEQ ID NO: 4213252 - RNA, 14 nt, Yersinia pestis KIM
accgccaaaugaaa

SEQ ID NO: 4213253 - RNA, 17 nt, Yersinia pestis KIM
accgccaauauaaggcu

SEQ ID NO: 4213254 - RNA, 17 nt, Yersinia pestis KIM
accgccacagcaacagg

SEQ ID NO: 4213255 - RNA, 15 nt, Yersinia pestis KIM
accgccagcaacagc

SEQ ID NO: 4213256 - RNA, 22 nt, Yersinia pestis KIM
accgccagcaauaagccacgcu

SEQ ID NO: 4213257 - RNA, 15 nt, Yersinia pestis KIM
accgccagcugaccc

SEQ ID NO: 4213258 - RNA, 13 nt, Yersinia pestis KIM
accgccagugccg

SEQ ID NO: 4213259 - RNA, 22 nt, Yersinia pestis KIM
accgccagugccgcggcggcca

SEQ ID NO: 4213260 - RNA, 21 nt, Yersinia pestis KIM
accgcccccaauaagggccac

SEQ ID NO: 4213261 - RNA, 22 nt, Yersinia pestis KIM
accgcccgacuugcugaaucaa

SEQ ID NO: 4213262 - RNA, 20 nt, Yersinia pestis KIM
accgccgcaacaauaaagcg

SEQ ID NO: 4213263 - RNA, 14 nt, Yersinia pestis KIM
accgccgcaggcca

SEQ ID NO: 4213264 - RNA, 18 nt, Yersinia pestis KIM
accgccggauuucaaucc

SEQ ID NO: 4213265 - RNA, 15 nt, Yersinia pestis KIM
accgccggcaacagc

SEQ ID NO: 4213266 - RNA, 19 nt, Yersinia pestis KIM
accgccggcaacagcgccu

SEQ ID NO: 4213267 - RNA, 14 nt, Yersinia pestis KIM
accgcgaucacaau

SEQ ID NO: 4213268 - RNA, 13 nt, Yersinia pestis KIM
accgcgcaggagc

SEQ ID NO: 4213269 - RNA, 17 nt, Yersinia pestis KIM
accgcgcuugcaucaac

SEQ ID NO: 4213270 - RNA, 22 nt, Yersinia pestis KIM
accgcgucgccgcuuuuuguaa

SEQ ID NO: 4213271 - RNA, 15 nt, Yersinia pestis KIM
accgcguuauggaga

SEQ ID NO: 4213272 - RNA, 16 nt, Yersinia pestis KIM
accgcguuuguggcua

SEQ ID NO: 4213273 - RNA, 14 nt, Yersinia pestis KIM
accgcucaguauuc

SEQ ID NO: 4213274 - RNA, 18 nt, Yersinia pestis KIM
accgcuccaggcuggcca

SEQ ID NO: 4213275 - RNA, 22 nt, Yersinia pestis KIM
accgcucucaccuaagccucuc

SEQ ID NO: 4213276 - RNA, 12 nt, Yersinia pestis KIM
accgcugauaac

SEQ ID NO: 4213277 - RNA, 16 nt, Yersinia pestis KIM
accgcugauaaccagc

SEQ ID NO: 4213278 - RNA, 19 nt, Yersinia pestis KIM
accgcugauaaccagcagc

SEQ ID NO: 4213279 - RNA, 22 nt, Yersinia pestis KIM
accgcugcagcuuuagcggcga

SEQ ID NO: 4213280 - RNA, 21 nt, Yersinia pestis KIM
accgcugcuaccagcagugca

SEQ ID NO: 4213281 - RNA, 21 nt, Yersinia pestis KIM
accgcuguaaacuggcagaua

SEQ ID NO: 4213282 - RNA, 23 nt, Yersinia pestis KIM
accgcuguaaaugcgugguaaac

SEQ ID NO: 4213283 - RNA, 14 nt, Yersinia pestis KIM
accgcuuaaggcau

SEQ ID NO: 4213284 - RNA, 23 nt, Yersinia pestis KIM
accgcuuaaggcaucaaccaguu

SEQ ID NO: 4213285 - RNA, 18 nt, Yersinia pestis KIM
accgcuucagcaggggca

SEQ ID NO: 4213286 - RNA, 16 nt, Yersinia pestis KIM
accgcuuuacgcacau

SEQ ID NO: 4213287 - RNA, 21 nt, Yersinia pestis KIM
accggaaaaugcgccagccaa

SEQ ID NO: 4213288 - RNA, 14 nt, Yersinia pestis KIM
accggacaaaccag

SEQ ID NO: 4213289 - RNA, 12 nt, Yersinia pestis KIM
accggauacaaa

SEQ ID NO: 4213290 - RNA, 20 nt, Yersinia pestis KIM
accggcaguucauuccccau

SEQ ID NO: 4213291 - RNA, 13 nt, Yersinia pestis KIM
accggccaaaauc

SEQ ID NO: 4213292 - RNA, 18 nt, Yersinia pestis KIM
accggcggggaaauagca

SEQ ID NO: 4213293 - RNA, 15 nt, Yersinia pestis KIM
accggcuaaccacag

SEQ ID NO: 4213294 - RNA, 19 nt, Yersinia pestis KIM
accggcuaauaccaggcug

SEQ ID NO: 4213295 - RNA, 15 nt, Yersinia pestis KIM
accgggaugaaucga

SEQ ID NO: 4213296 - RNA, 21 nt, Yersinia pestis KIM
accggggauccauaggauccc

SEQ ID NO: 4213297 - RNA, 15 nt, Yersinia pestis KIM
accggggugaucaac

SEQ ID NO: 4213298 - RNA, 16 nt, Yersinia pestis KIM
accggggugaucaacu

SEQ ID NO: 4213299 - RNA, 19 nt, Yersinia pestis KIM
accgggguucgcaaugaac

SEQ ID NO: 4213300 - RNA, 20 nt, Yersinia pestis KIM
accggguucaaggaaaccaa

SEQ ID NO: 4213301 - RNA, 22 nt, Yersinia pestis KIM
accuucagacugacgcagagcu

SEQ ID NO: 4213302 - RNA, 15 nt, Yersinia pestis KIM
accuucagcaaagag

SEQ ID NO: 4213303 - RNA, 20 nt, Yersinia pestis KIM
accuucaggaauaaacagca

SEQ ID NO: 4213304 - RNA, 19 nt, Yersinia pestis KIM
accuucaguuuauuuaagc

SEQ ID NO: 4213305 - RNA, 15 nt, Yersinia pestis KIM
accuucccauccuag

SEQ ID NO: 4213306 - RNA, 18 nt, Yersinia pestis KIM
accuuccgucccaagaaa

SEQ ID NO: 4213307 - RNA, 22 nt, Yersinia pestis KIM
accuuccgucccaagaaaagca

SEQ ID NO: 4213308 - RNA, 16 nt, Yersinia pestis KIM
accuucugauuuuuug

SEQ ID NO: 4213309 - RNA, 21 nt, Yersinia pestis KIM
accuugcgcaauuuguuggca

SEQ ID NO: 4213310 - RNA, 22 nt, Yersinia pestis KIM
accuugcuccgcaauuugccca

SEQ ID NO: 4213311 - RNA, 14 nt, Yersinia pestis KIM
accuuggaacagcu

SEQ ID NO: 4213312 - RNA, 22 nt, Yersinia pestis KIM
accuuuaccaugcucauguuca

SEQ ID NO: 4213313 - RNA, 18 nt, Yersinia pestis KIM
accuuucagacaagccag

SEQ ID NO: 4213314 - RNA, 19 nt, Yersinia pestis KIM
accuuucgguugcaucaga

SEQ ID NO: 4213315 - RNA, 20 nt, Yersinia pestis KIM
accuuucgguugcaucagaa

SEQ ID NO: 4213316 - RNA, 16 nt, Yersinia pestis KIM
accuuucuaauuauua

SEQ ID NO: 4213317 - RNA, 13 nt, Yersinia pestis KIM
acgaaaagcagca

SEQ ID NO: 4213318 - RNA, 14 nt, Yersinia pestis KIM
acgaaaagcagcag

SEQ ID NO: 4213319 - RNA, 22 nt, Yersinia pestis KIM
acgaaauacucgagcguauugc

SEQ ID NO: 4213320 - RNA, 12 nt, Yersinia pestis KIM
acgaaaugccgc

SEQ ID NO: 4213321 - RNA, 16 nt, Yersinia pestis KIM
acgaacagccccaacc

SEQ ID NO: 4213322 - RNA, 22 nt, Yersinia pestis KIM
acgaacagugccaacagcgaga

SEQ ID NO: 4213323 - RNA, 23 nt, Yersinia pestis KIM
acgaacagugccaacagcgagau

SEQ ID NO: 4213324 - RNA, 17 nt, Yersinia pestis KIM
acgaacccgauaaccca

SEQ ID NO: 4213325 - RNA, 17 nt, Yersinia pestis KIM
acgaaccgaacgaaccc

SEQ ID NO: 4213326 - RNA, 20 nt, Yersinia pestis KIM
acgaagcgugaaagcauccc

SEQ ID NO: 4213327 - RNA, 22 nt, Yersinia pestis KIM
acgaauaaacacgucuaauucc

SEQ ID NO: 4213328 - RNA, 16 nt, Yersinia pestis KIM
acgaauaaauauccuc

SEQ ID NO: 4213329 - RNA, 18 nt, Yersinia pestis KIM
acgaauaucuagcaacac

SEQ ID NO: 4213330 - RNA, 15 nt, Yersinia pestis KIM
acgaauauucaagag

SEQ ID NO: 4213331 - RNA, 17 nt, Yersinia pestis KIM
acgaaugagcaguaaua

SEQ ID NO: 4213332 - RNA, 21 nt, Yersinia pestis KIM
acgaaugagcaguaauagcaa

SEQ ID NO: 4213333 - RNA, 19 nt, Yersinia pestis KIM
acgaaugaguuuuguccug

SEQ ID NO: 4213334 - RNA, 20 nt, Yersinia pestis KIM
acgaauggucugcaacucag

SEQ ID NO: 4213335 - RNA, 22 nt, Yersinia pestis KIM
acgaauggucugcaacucagug

SEQ ID NO: 4213336 - RNA, 16 nt, Yersinia pestis KIM
acgacaaugaucguca

SEQ ID NO: 4213337 - RNA, 22 nt, Yersinia pestis KIM
acgacacaaaugcugugccaug

SEQ ID NO: 4213338 - RNA, 14 nt, Yersinia pestis KIM
acgacagcagcagg

SEQ ID NO: 4213339 - RNA, 18 nt, Yersinia pestis KIM
acgacccacucguucuca

SEQ ID NO: 4213340 - RNA, 22 nt, Yersinia pestis KIM
acgacccacucguucucaacca

SEQ ID NO: 4213341 - RNA, 14 nt, Yersinia pestis KIM
acgaccgucaccaa

SEQ ID NO: 4213342 - RNA, 17 nt, Yersinia pestis KIM
acgacgaaauagcgccu

SEQ ID NO: 4213343 - RNA, 14 nt, Yersinia pestis KIM
acgacgauaagaau

SEQ ID NO: 4213344 - RNA, 14 nt, Yersinia pestis KIM
acgacgcccgcaga

SEQ ID NO: 4213345 - RNA, 18 nt, Yersinia pestis KIM
acgacgcccgcagacugc

SEQ ID NO: 4213346 - RNA, 16 nt, Yersinia pestis KIM
acgacgugcagcgcgc

SEQ ID NO: 4213347 - RNA, 19 nt, Yersinia pestis KIM
acgacguuaucaauacugc

SEQ ID NO: 4213348 - RNA, 17 nt, Yersinia pestis KIM
acgagagaucguaggcu

SEQ ID NO: 4213349 - RNA, 23 nt, Yersinia pestis KIM
acgagaucauuggcuaucacaca

SEQ ID NO: 4213350 - RNA, 14 nt, Yersinia pestis KIM
acgaguaaugaaau

SEQ ID NO: 4213351 - RNA, 20 nt, Yersinia pestis KIM
acgaguuaacacgggcauga

SEQ ID NO: 4213352 - RNA, 23 nt, Yersinia pestis KIM
acgaguuuucccugcgccagcag

SEQ ID NO: 4213353 - RNA, 14 nt, Yersinia pestis KIM
acgauaaaggcggu

SEQ ID NO: 4213354 - RNA, 19 nt, Yersinia pestis KIM
acgauaacgcucuuguagc

SEQ ID NO: 4213355 - RNA, 22 nt, Yersinia pestis KIM
acgauaacuuuuggcagcacca

SEQ ID NO: 4213356 - RNA, 16 nt, Yersinia pestis KIM
acgauacgacuucuua

SEQ ID NO: 4213357 - RNA, 18 nt, Yersinia pestis KIM
acgauacgacuucuuauu

SEQ ID NO: 4213358 - RNA, 18 nt, Yersinia pestis KIM
acgauacguugcagguca

SEQ ID NO: 4213359 - RNA, 16 nt, Yersinia pestis KIM
acgauaucaauaaaga

SEQ ID NO: 4213360 - RNA, 14 nt, Yersinia pestis KIM
acgauauuaccgag

SEQ ID NO: 4213361 - RNA, 19 nt, Yersinia pestis KIM
acgauauuuucgacaaaau

SEQ ID NO: 4213362 - RNA, 13 nt, Yersinia pestis KIM
acgauauuuuuau

SEQ ID NO: 4213363 - RNA, 18 nt, Yersinia pestis KIM
acgauauuuuuauuaaua

SEQ ID NO: 4213364 - RNA, 15 nt, Yersinia pestis KIM
acgaucaaccauggc

SEQ ID NO: 4213365 - RNA, 13 nt, Yersinia pestis KIM
acgaucacugcuu

SEQ ID NO: 4213366 - RNA, 19 nt, Yersinia pestis KIM
acgaucagugaagagauaa

SEQ ID NO: 4213367 - RNA, 14 nt, Yersinia pestis KIM
acgaucaguggcac

SEQ ID NO: 4213368 - RNA, 13 nt, Yersinia pestis KIM
acgaucgauagua

SEQ ID NO: 4213369 - RNA, 20 nt, Yersinia pestis KIM
acgaucugccuguucucucc

SEQ ID NO: 4213370 - RNA, 23 nt, Yersinia pestis KIM
acgaugccgauaaagauggcauu

SEQ ID NO: 4213371 - RNA, 14 nt, Yersinia pestis KIM
acgauggaaaaaau

SEQ ID NO: 4213372 - RNA, 20 nt, Yersinia pestis KIM
acgauggaguggucaugcuc

SEQ ID NO: 4213373 - RNA, 17 nt, Yersinia pestis KIM
acgauuaccugcauauc

SEQ ID NO: 4213374 - RNA, 15 nt, Yersinia pestis KIM
acgcaaaccccgaac

SEQ ID NO: 4213375 - RNA, 22 nt, Yersinia pestis KIM
acgcaaaccccgaaccaaaaua

SEQ ID NO: 4213376 - RNA, 18 nt, Yersinia pestis KIM
acgcaaagggcaacaaua

SEQ ID NO: 4213377 - RNA, 20 nt, Yersinia pestis KIM
acgcaaagggcaacaauaua

SEQ ID NO: 4213378 - RNA, 21 nt, Yersinia pestis KIM
acgcaaauaaagggccugcaa

SEQ ID NO: 4213379 - RNA, 22 nt, Yersinia pestis KIM
acgcaaauaaagggccugcaaa

SEQ ID NO: 4213380 - RNA, 23 nt, Yersinia pestis KIM
acgcaacguaauaucugccaccg

SEQ ID NO: 4213381 - RNA, 14 nt, Yersinia pestis KIM
acgcaaguaaaagu

SEQ ID NO: 4213382 - RNA, 16 nt, Yersinia pestis KIM
acgcaaguaaaaguca

SEQ ID NO: 4213383 - RNA, 17 nt, Yersinia pestis KIM
acgcaaguaaaagucag

SEQ ID NO: 4213384 - RNA, 18 nt, Yersinia pestis KIM
acgcaauacgguaggcau

SEQ ID NO: 4213385 - RNA, 22 nt, Yersinia pestis KIM
acgcaauuagguugcagcuaaa

SEQ ID NO: 4213386 - RNA, 14 nt, Yersinia pestis KIM
acgcaauuuuaugg

SEQ ID NO: 4213387 - RNA, 17 nt, Yersinia pestis KIM
acgcacucgaaucacuu

SEQ ID NO: 4213388 - RNA, 23 nt, Yersinia pestis KIM
acgcacugagagcauaaccccaa

SEQ ID NO: 4213389 - RNA, 14 nt, Yersinia pestis KIM
acgcagagcuaaau

SEQ ID NO: 4213390 - RNA, 15 nt, Yersinia pestis KIM
acgcagauaaaucag

SEQ ID NO: 4213391 - RNA, 21 nt, Yersinia pestis KIM
acgcagcaggcguagcgugug

SEQ ID NO: 4213392 - RNA, 14 nt, Yersinia pestis KIM
acgcagcgaaaugu

SEQ ID NO: 4213393 - RNA, 22 nt, Yersinia pestis KIM
acgcagcuccagcgucacuuca

SEQ ID NO: 4213394 - RNA, 21 nt, Yersinia pestis KIM
acgcagcuuuuucucacgaag

SEQ ID NO: 4213395 - RNA, 15 nt, Yersinia pestis KIM
acgcaucaauaauaa

SEQ ID NO: 4213396 - RNA, 16 nt, Yersinia pestis KIM
acgcaucacaucuugc

SEQ ID NO: 4213397 - RNA, 21 nt, Yersinia pestis KIM
acgcaucaugguccaguggcg

SEQ ID NO: 4213398 - RNA, 23 nt, Yersinia pestis KIM
acgcauucauaucguccaaaggg

SEQ ID NO: 4213399 - RNA, 17 nt, Yersinia pestis KIM
acgcauuccaucagcca

SEQ ID NO: 4213400 - RNA, 19 nt, Yersinia pestis KIM
acgcauugucagguuaaua

SEQ ID NO: 4213401 - RNA, 17 nt, Yersinia pestis KIM
acgccaaguaugcaggc

SEQ ID NO: 4213402 - RNA, 15 nt, Yersinia pestis KIM
acgccacaccacguu

SEQ ID NO: 4213403 - RNA, 14 nt, Yersinia pestis KIM
acgccaccccuccc

SEQ ID NO: 4213404 - RNA, 22 nt, Yersinia pestis KIM
acgccaguaaacagccagcauc

SEQ ID NO: 4213405 - RNA, 14 nt, Yersinia pestis KIM
acgccauaaaagaa

SEQ ID NO: 4213406 - RNA, 21 nt, Yersinia pestis KIM
acgcccagcuuuagcauugca

SEQ ID NO: 4213407 - RNA, 22 nt, Yersinia pestis KIM
acgcccgcagcggcuagcagca

SEQ ID NO: 4213408 - RNA, 22 nt, Yersinia pestis KIM
acgccgaggugaagacacccgu

SEQ ID NO: 4213409 - RNA, 15 nt, Yersinia pestis KIM
acgccgaucauaaau

SEQ ID NO: 4213410 - RNA, 14 nt, Yersinia pestis KIM
acgccgaugaaggu

SEQ ID NO: 4213411 - RNA, 20 nt, Yersinia pestis KIM
acgccgcucaauuaaccuga

SEQ ID NO: 4213412 - RNA, 17 nt, Yersinia pestis KIM
acgccggcgccauugcg

SEQ ID NO: 4213413 - RNA, 16 nt, Yersinia pestis KIM
acgccggcuucccugu

SEQ ID NO: 4213414 - RNA, 22 nt, Yersinia pestis KIM
acgccgggguggauuaccggcg

SEQ ID NO: 4213415 - RNA, 15 nt, Yersinia pestis KIM
acguagcgauaacag

SEQ ID NO: 4213416 - RNA, 14 nt, Yersinia pestis KIM
acguagcuaacacc

SEQ ID NO: 4213417 - RNA, 17 nt, Yersinia pestis KIM
acguagcugaauugcuu

SEQ ID NO: 4213418 - RNA, 14 nt, Yersinia pestis KIM
acguauauuggccu

SEQ ID NO: 4213419 - RNA, 13 nt, Yersinia pestis KIM
acguauggcauga

SEQ ID NO: 4213420 - RNA, 18 nt, Yersinia pestis KIM
acguauucgucaccauca

SEQ ID NO: 4213421 - RNA, 21 nt, Yersinia pestis KIM
acguauucgucaccaucaaua

SEQ ID NO: 4213422 - RNA, 21 nt, Yersinia pestis KIM
acguauugguaacgcagaaau

SEQ ID NO: 4213423 - RNA, 19 nt, Yersinia pestis KIM
acguauuuucauuuuaaca

SEQ ID NO: 4213424 - RNA, 16 nt, Yersinia pestis KIM
acgucaacagaacuaa

SEQ ID NO: 4213425 - RNA, 19 nt, Yersinia pestis KIM
acgucaauaccgugagaac

SEQ ID NO: 4213426 - RNA, 15 nt, Yersinia pestis KIM
acgucaccacgcagu

SEQ ID NO: 4213427 - RNA, 20 nt, Yersinia pestis KIM
acgucacccaaccgaccaaa

SEQ ID NO: 4213428 - RNA, 17 nt, Yersinia pestis KIM
acgucaccgccaaaaua

SEQ ID NO: 4213429 - RNA, 18 nt, Yersinia pestis KIM
acgucagauaaacaaaca

SEQ ID NO: 4213430 - RNA, 17 nt, Yersinia pestis KIM
acgucaguaaugagggu

SEQ ID NO: 4213431 - RNA, 22 nt, Yersinia pestis KIM
acgucauugguguuacagcaag

SEQ ID NO: 4213432 - RNA, 16 nt, Yersinia pestis KIM
acgucauuuuuuuuau

SEQ ID NO: 4213433 - RNA, 20 nt, Yersinia pestis KIM
acgucauuuuuuuuauuuuc

SEQ ID NO: 4213434 - RNA, 16 nt, Yersinia pestis KIM
acgucugcaauagcuc

SEQ ID NO: 4213435 - RNA, 11 nt, Yersinia pestis KIM
acgugaagaua

SEQ ID NO: 4213436 - RNA, 16 nt, Yersinia pestis KIM
acgugaagugagcuga

SEQ ID NO: 4213437 - RNA, 17 nt, Yersinia pestis KIM
acgugaguuuuuggccu

SEQ ID NO: 4213438 - RNA, 19 nt, Yersinia pestis KIM
acgugaguuuuuggccucc

SEQ ID NO: 4213439 - RNA, 20 nt, Yersinia pestis KIM
acgugcagcgcgcagccaac

SEQ ID NO: 4213440 - RNA, 22 nt, Yersinia pestis KIM
acgugcccaaaaacgcuggcca

SEQ ID NO: 4213441 - RNA, 19 nt, Yersinia pestis KIM
acgugccccaaugaugacu

SEQ ID NO: 4213442 - RNA, 22 nt, Yersinia pestis KIM
acgugcguuuuugaaauaccac

SEQ ID NO: 4213443 - RNA, 13 nt, Yersinia pestis KIM
acguggaccauuu

SEQ ID NO: 4213444 - RNA, 19 nt, Yersinia pestis KIM
acguguuggcuaagcaugc

SEQ ID NO: 4213445 - RNA, 20 nt, Yersinia pestis KIM
acguuacaacgagggcucaa

SEQ ID NO: 4213446 - RNA, 12 nt, Yersinia pestis KIM
acguuagagcac

SEQ ID NO: 4213447 - RNA, 15 nt, Yersinia pestis KIM
acguuauaacucaag

SEQ ID NO: 4213448 - RNA, 15 nt, Yersinia pestis KIM
acguuaucaauacug

SEQ ID NO: 4213449 - RNA, 16 nt, Yersinia pestis KIM
acguuaugugccauaa

SEQ ID NO: 4213450 - RNA, 18 nt, Yersinia pestis KIM
acguucaacgaccucauc

SEQ ID NO: 4213451 - RNA, 16 nt, Yersinia pestis KIM
acguugaauauucaac

SEQ ID NO: 4213452 - RNA, 15 nt, Yersinia pestis KIM
acguugcacccugcu

SEQ ID NO: 4213453 - RNA, 12 nt, Yersinia pestis KIM
acguugcagggg

SEQ ID NO: 4213454 - RNA, 21 nt, Yersinia pestis KIM
acguuggccuuucaccgguuc

SEQ ID NO: 4213455 - RNA, 15 nt, Yersinia pestis KIM
acguuggcuucaccu

SEQ ID NO: 4213456 - RNA, 21 nt, Yersinia pestis KIM
acguuguuuucccucagccaa

SEQ ID NO: 4213457 - RNA, 21 nt, Yersinia pestis KIM
acguuuauuuauaagaacaac

SEQ ID NO: 4213458 - RNA, 13 nt, Yersinia pestis KIM
acguuuuauucac

SEQ ID NO: 4213459 - RNA, 15 nt, Yersinia pestis KIM
acguuuuuuuaaauc

SEQ ID NO: 4213460 - RNA, 21 nt, Yersinia pestis KIM
acuaaaacugaagcaucaaua

SEQ ID NO: 4213461 - RNA, 14 nt, Yersinia pestis KIM
acuaaaauaucacu

SEQ ID NO: 4213462 - RNA, 17 nt, Yersinia pestis KIM
acuaaaauucaaacaaa

SEQ ID NO: 4213463 - RNA, 16 nt, Yersinia pestis KIM
acuaaacagaucaccc

SEQ ID NO: 4213464 - RNA, 20 nt, Yersinia pestis KIM
acuaaacgcccagcuaauug

SEQ ID NO: 4213465 - RNA, 19 nt, Yersinia pestis KIM
acuaaagaaauaaucauau

SEQ ID NO: 4213466 - RNA, 15 nt, Yersinia pestis KIM
acuaaauagauaaaa

SEQ ID NO: 4213467 - RNA, 17 nt, Yersinia pestis KIM
acuaaauagauaaaaac

SEQ ID NO: 4213468 - RNA, 17 nt, Yersinia pestis KIM
acuaaaucgcaggcuuu

SEQ ID NO: 4213469 - RNA, 21 nt, Yersinia pestis KIM
acuaaaucgcaggcuuugguu

SEQ ID NO: 4213470 - RNA, 23 nt, Yersinia pestis KIM
acuaaauggcuuucgaucaucac

SEQ ID NO: 4213471 - RNA, 15 nt, Yersinia pestis KIM
acuaaauuaaaugca

SEQ ID NO: 4213472 - RNA, 15 nt, Yersinia pestis KIM
acuaaauuagaaaac

SEQ ID NO: 4213473 - RNA, 17 nt, Yersinia pestis KIM
acuaaauuagaaaacaa

SEQ ID NO: 4213474 - RNA, 19 nt, Yersinia pestis KIM
acuaaauuuagugccaaca

SEQ ID NO: 4213475 - RNA, 17 nt, Yersinia pestis KIM
acuaacaugccagccug

SEQ ID NO: 4213476 - RNA, 15 nt, Yersinia pestis KIM
acuaaccaagccauc

SEQ ID NO: 4213477 - RNA, 13 nt, Yersinia pestis KIM
acuaaccucugca

SEQ ID NO: 4213478 - RNA, 18 nt, Yersinia pestis KIM
acuaacgucaacagaacu

SEQ ID NO: 4213479 - RNA, 21 nt, Yersinia pestis KIM
acuaacgucaacagaacuaau

SEQ ID NO: 4213480 - RNA, 15 nt, Yersinia pestis KIM
acuaacgucccauuc

SEQ ID NO: 4213481 - RNA, 22 nt, Yersinia pestis KIM
acuaacguuuuguaaucaacac

SEQ ID NO: 4213482 - RNA, 18 nt, Yersinia pestis KIM
acuaagagucacagcauu

SEQ ID NO: 4213483 - RNA, 21 nt, Yersinia pestis KIM
acuaagcagauggucaacuaa

SEQ ID NO: 4213484 - RNA, 15 nt, Yersinia pestis KIM
acuaauagcauuuuu

SEQ ID NO: 4213485 - RNA, 17 nt, Yersinia pestis KIM
acuaauaucaacagaac

SEQ ID NO: 4213486 - RNA, 15 nt, Yersinia pestis KIM
acuaauggagagaug

SEQ ID NO: 4213487 - RNA, 18 nt, Yersinia pestis KIM
acuaauggccagacacug

SEQ ID NO: 4213488 - RNA, 13 nt, Yersinia pestis KIM
acuaauguuuguu

SEQ ID NO: 4213489 - RNA, 19 nt, Yersinia pestis KIM
acuaauguuuguuucucug

SEQ ID NO: 4213490 - RNA, 12 nt, Yersinia pestis KIM
acuaauuucuaa

SEQ ID NO: 4213491 - RNA, 22 nt, Yersinia pestis KIM
acuaccaaauaaauauccuccg

SEQ ID NO: 4213492 - RNA, 15 nt, Yersinia pestis KIM
acuaccgaucaucag

SEQ ID NO: 4213493 - RNA, 18 nt, Yersinia pestis KIM
acuaccuugcuccgcaau

SEQ ID NO: 4213494 - RNA, 22 nt, Yersinia pestis KIM
acuaccuuuugcauauuucucu

SEQ ID NO: 4213495 - RNA, 22 nt, Yersinia pestis KIM
acuacguuguuaucaucaccac

SEQ ID NO: 4213496 - RNA, 21 nt, Yersinia pestis KIM
acuacugcaagccguaauuca

SEQ ID NO: 4213497 - RNA, 17 nt, Yersinia pestis KIM
acuagccauuuggugau

SEQ ID NO: 4213498 - RNA, 20 nt, Yersinia pestis KIM
acuagcggauuuauaaggaa

SEQ ID NO: 4213499 - RNA, 14 nt, Yersinia pestis KIM
acuaguuaaaacca

SEQ ID NO: 4213500 - RNA, 18 nt, Yersinia pestis KIM
acuauaagcgcucaaaua

SEQ ID NO: 4213501 - RNA, 15 nt, Yersinia pestis KIM
acuauauaaaugauu

SEQ ID NO: 4213502 - RNA, 18 nt, Yersinia pestis KIM
acuaucaaacucaccauu

SEQ ID NO: 4213503 - RNA, 13 nt, Yersinia pestis KIM
acuaucacuaucc

SEQ ID NO: 4213504 - RNA, 18 nt, Yersinia pestis KIM
acuaucaucccaccgaaa

SEQ ID NO: 4213505 - RNA, 12 nt, Yersinia pestis KIM
acuauccuuuga

SEQ ID NO: 4213506 - RNA, 14 nt, Yersinia pestis KIM
acuaugggauaaac

SEQ ID NO: 4213507 - RNA, 17 nt, Yersinia pestis KIM
acuauuaucuuuuaaaa

SEQ ID NO: 4213508 - RNA, 19 nt, Yersinia pestis KIM
acuauucaaugacuccuga

SEQ ID NO: 4213509 - RNA, 18 nt, Yersinia pestis KIM
acuauucaucccuaaaau

SEQ ID NO: 4213510 - RNA, 12 nt, Yersinia pestis KIM
acuauucugcuu

SEQ ID NO: 4213511 - RNA, 20 nt, Yersinia pestis KIM
acuauugcaucuuuaauuaa

SEQ ID NO: 4213512 - RNA, 22 nt, Yersinia pestis KIM
acuauuuauuaaucuauuaaua

SEQ ID NO: 4213513 - RNA, 16 nt, Yersinia pestis KIM
acuauuucagacauac

SEQ ID NO: 4213514 - RNA, 14 nt, Yersinia pestis KIM
acuauuuuucucaa

SEQ ID NO: 4213515 - RNA, 13 nt, Yersinia pestis KIM
acucaaaacaauu

SEQ ID NO: 4213516 - RNA, 16 nt, Yersinia pestis KIM
acucaaacugauaaag

SEQ ID NO: 4213517 - RNA, 18 nt, Yersinia pestis KIM
acucaacugauguuuuag

SEQ ID NO: 4213518 - RNA, 22 nt, Yersinia pestis KIM
acucaagauugccgcaaggcca

SEQ ID NO: 4213519 - RNA, 21 nt, Yersinia pestis KIM
acucaagcguacaucagggug

SEQ ID NO: 4213520 - RNA, 19 nt, Yersinia pestis KIM
acucaaguaugcaggguua

SEQ ID NO: 4213521 - RNA, 22 nt, Yersinia pestis KIM
acucaaucuuugccuauuucag

SEQ ID NO: 4213522 - RNA, 16 nt, Yersinia pestis KIM
acucaaugucaugcaa

SEQ ID NO: 4213523 - RNA, 12 nt, Yersinia pestis KIM
acucacacagcc

SEQ ID NO: 4213524 - RNA, 15 nt, Yersinia pestis KIM
acucaccgccagcaa

SEQ ID NO: 4213525 - RNA, 16 nt, Yersinia pestis KIM
acucaccgccagcaau

SEQ ID NO: 4213526 - RNA, 21 nt, Yersinia pestis KIM
acucaccgccgaccaguggug

SEQ ID NO: 4213527 - RNA, 18 nt, Yersinia pestis KIM
acucaccuucuugguuag

SEQ ID NO: 4213528 - RNA, 16 nt, Yersinia pestis KIM
acucacuacauucuga

SEQ ID NO: 4213529 - RNA, 23 nt, Yersinia pestis KIM
acucacucucaucugaacuauug

SEQ ID NO: 4213530 - RNA, 14 nt, Yersinia pestis KIM
acugauuucaggaa

SEQ ID NO: 4213531 - RNA, 19 nt, Yersinia pestis KIM
acugcaaauguucaacaag

SEQ ID NO: 4213532 - RNA, 21 nt, Yersinia pestis KIM
acugcagaaaaugcggcggcu

SEQ ID NO: 4213533 - RNA, 18 nt, Yersinia pestis KIM
acugcaguaaaaauauua

SEQ ID NO: 4213534 - RNA, 17 nt, Yersinia pestis KIM
acugcauuaccuuuaaa

SEQ ID NO: 4213535 - RNA, 14 nt, Yersinia pestis KIM
acugcauuaucuaa

SEQ ID NO: 4213536 - RNA, 19 nt, Yersinia pestis KIM
acugcauugagacccguua

SEQ ID NO: 4213537 - RNA, 15 nt, Yersinia pestis KIM
acugccaaucgcucu

SEQ ID NO: 4213538 - RNA, 18 nt, Yersinia pestis KIM
acugccacugacugcuuu

SEQ ID NO: 4213539 - RNA, 14 nt, Yersinia pestis KIM
acugccauaaucca

SEQ ID NO: 4213540 - RNA, 13 nt, Yersinia pestis KIM
acugccauacauc

SEQ ID NO: 4213541 - RNA, 13 nt, Yersinia pestis KIM
acugcccaaaaua

SEQ ID NO: 4213542 - RNA, 18 nt, Yersinia pestis KIM
acugccccgaagcucaag

SEQ ID NO: 4213543 - RNA, 18 nt, Yersinia pestis KIM
acugccccuucaaagccg

SEQ ID NO: 4213544 - RNA, 22 nt, Yersinia pestis KIM
acugccuguucuggcaaauaag

SEQ ID NO: 4213545 - RNA, 17 nt, Yersinia pestis KIM
acugcgcaaauccugaa

SEQ ID NO: 4213546 - RNA, 18 nt, Yersinia pestis KIM
acugcgcaaauccugaau

SEQ ID NO: 4213547 - RNA, 16 nt, Yersinia pestis KIM
acugcgcgcugaacgu

SEQ ID NO: 4213548 - RNA, 17 nt, Yersinia pestis KIM
acugcgcuagaccaguu

SEQ ID NO: 4213549 - RNA, 20 nt, Yersinia pestis KIM
acugcgcuagaccaguuaau

SEQ ID NO: 4213550 - RNA, 21 nt, Yersinia pestis KIM
acugcgcuagaccaguuaaua

SEQ ID NO: 4213551 - RNA, 14 nt, Yersinia pestis KIM
acugcguccuuugc

SEQ ID NO: 4213552 - RNA, 19 nt, Yersinia pestis KIM
acugcucaacugcucaacu

SEQ ID NO: 4213553 - RNA, 20 nt, Yersinia pestis KIM
acugcucaacugcucaacug

SEQ ID NO: 4213554 - RNA, 21 nt, Yersinia pestis KIM
acugcucaacugcucaacugc

SEQ ID NO: 4213555 - RNA, 12 nt, Yersinia pestis KIM
acugcucacugg

SEQ ID NO: 4213556 - RNA, 15 nt, Yersinia pestis KIM
acugcucauaaagca

SEQ ID NO: 4213557 - RNA, 14 nt, Yersinia pestis KIM
acugcuccagccaa

SEQ ID NO: 4213558 - RNA, 17 nt, Yersinia pestis KIM
acugcuccagccaacug

SEQ ID NO: 4213559 - RNA, 19 nt, Yersinia pestis KIM
acugcucgagccaauugca

SEQ ID NO: 4213560 - RNA, 16 nt, Yersinia pestis KIM
acugcucuaucucuuc

SEQ ID NO: 4213561 - RNA, 20 nt, Yersinia pestis KIM
acugcucuaucucuuccgac

SEQ ID NO: 4213562 - RNA, 12 nt, Yersinia pestis KIM
acugcugacaaa

SEQ ID NO: 4213563 - RNA, 12 nt, Yersinia pestis KIM
acugcugacaac

SEQ ID NO: 4213564 - RNA, 15 nt, Yersinia pestis KIM
acugcugacaacccc

SEQ ID NO: 4213565 - RNA, 15 nt, Yersinia pestis KIM
acugcugacaacccu

SEQ ID NO: 4213566 - RNA, 21 nt, Yersinia pestis KIM
acugcugcaacucauuaacaa

SEQ ID NO: 4213567 - RNA, 15 nt, Yersinia pestis KIM
acugcugugccagag

SEQ ID NO: 4213568 - RNA, 22 nt, Yersinia pestis KIM
acugcuuuaggauuuauuucuc

SEQ ID NO: 4213569 - RNA, 12 nt, Yersinia pestis KIM
acugcuuuucua

SEQ ID NO: 4213570 - RNA, 22 nt, Yersinia pestis KIM
acugcuuuuuauugucucuacu

SEQ ID NO: 4213571 - RNA, 21 nt, Yersinia pestis KIM
acuggaaacugacauaagcua

SEQ ID NO: 4213572 - RNA, 13 nt, Yersinia pestis KIM
acuggaagaaacc

SEQ ID NO: 4213573 - RNA, 18 nt, Yersinia pestis KIM
acuggaugcgacgcagaa

SEQ ID NO: 4213574 - RNA, 21 nt, Yersinia pestis KIM
acuggcaaaaaaacgccucca

SEQ ID NO: 4213575 - RNA, 12 nt, Yersinia pestis KIM
acuggcaccgcu

SEQ ID NO: 4213576 - RNA, 12 nt, Yersinia pestis KIM
acuggcagauag

SEQ ID NO: 4213577 - RNA, 14 nt, Yersinia pestis KIM
acuggcagccauug

SEQ ID NO: 4213578 - RNA, 16 nt, Yersinia pestis KIM
acuggcagggaaaggu

SEQ ID NO: 4213579 - RNA, 13 nt, Yersinia pestis KIM
acuggccaacagg

SEQ ID NO: 4213580 - RNA, 13 nt, Yersinia pestis KIM
acuggccaugugu

SEQ ID NO: 4213581 - RNA, 14 nt, Yersinia pestis KIM
acuggccgcaggcg

SEQ ID NO: 4213582 - RNA, 19 nt, Yersinia pestis KIM
acuggccuauuaagauaau

SEQ ID NO: 4213583 - RNA, 20 nt, Yersinia pestis KIM
acuggccuauuaagauaauu

SEQ ID NO: 4213584 - RNA, 16 nt, Yersinia pestis KIM
acuggcggacaucuua

SEQ ID NO: 4213585 - RNA, 13 nt, Yersinia pestis KIM
acuggcgggcaca

SEQ ID NO: 4213586 - RNA, 23 nt, Yersinia pestis KIM
acuggcuagauagccauaauaau

SEQ ID NO: 4213587 - RNA, 16 nt, Yersinia pestis KIM
acuggcugaaguuaau

SEQ ID NO: 4213588 - RNA, 22 nt, Yersinia pestis KIM
acugggaugaagaaauaccuga

SEQ ID NO: 4213589 - RNA, 23 nt, Yersinia pestis KIM
acugggcgcaccggggugaucaa

SEQ ID NO: 4213590 - RNA, 14 nt, Yersinia pestis KIM
acuggggugaauca

SEQ ID NO: 4213591 - RNA, 18 nt, Yersinia pestis KIM
acuggguuacauccugaa

SEQ ID NO: 4213592 - RNA, 16 nt, Yersinia pestis KIM
acugguaauaaugcug

SEQ ID NO: 4213593 - RNA, 23 nt, Yersinia pestis KIM
acugguagcagccacaugguuuc

SEQ ID NO: 4213594 - RNA, 17 nt, Yersinia pestis KIM
acugguaugcgggaaca

SEQ ID NO: 4213595 - RNA, 15 nt, Yersinia pestis KIM
acuggucccgacaaa

SEQ ID NO: 4213596 - RNA, 20 nt, Yersinia pestis KIM
acugguugaaaccucaucau

SEQ ID NO: 4213597 - RNA, 15 nt, Yersinia pestis KIM
acuguaguaaagcag

SEQ ID NO: 4213598 - RNA, 16 nt, Yersinia pestis KIM
acuguaguucaauggu

SEQ ID NO: 4213599 - RNA, 14 nt, Yersinia pestis KIM
acugucaaaaagca

SEQ ID NO: 4213600 - RNA, 18 nt, Yersinia pestis KIM
acugucaaaaagcaccuu

SEQ ID NO: 4213601 - RNA, 14 nt, Yersinia pestis KIM
acugucaaaauccg

SEQ ID NO: 4213602 - RNA, 17 nt, Yersinia pestis KIM
acugucaaaauccggau

SEQ ID NO: 4213603 - RNA, 23 nt, Yersinia pestis KIM
acugucaccuagauaaucaagua

SEQ ID NO: 4213604 - RNA, 14 nt, Yersinia pestis KIM
acugucauugcugu

SEQ ID NO: 4213605 - RNA, 18 nt, Yersinia pestis KIM
acugucuauuuuuauaau

SEQ ID NO: 4213606 - RNA, 19 nt, Yersinia pestis KIM
acugugcgcggcuagccac

SEQ ID NO: 4213607 - RNA, 22 nt, Yersinia pestis KIM
acugugcgcggcuagccaccuc

SEQ ID NO: 4213608 - RNA, 14 nt, Yersinia pestis KIM
acugugcugaauug

SEQ ID NO: 4213609 - RNA, 19 nt, Yersinia pestis KIM
acuguuaauccguauguca

SEQ ID NO: 4213610 - RNA, 14 nt, Yersinia pestis KIM
acuguuaccgcgcu

SEQ ID NO: 4213611 - RNA, 12 nt, Yersinia pestis KIM
acuguuaucacu

SEQ ID NO: 4213612 - RNA, 18 nt, Yersinia pestis KIM
acuguugaugcagaugac

SEQ ID NO: 4213613 - RNA, 12 nt, Yersinia pestis KIM
acuguugcaaac

SEQ ID NO: 4213614 - RNA, 15 nt, Yersinia pestis KIM
acuguugcaaacgga

SEQ ID NO: 4213615 - RNA, 22 nt, Yersinia pestis KIM
acuguugcgggcaucagcccau

SEQ ID NO: 4213616 - RNA, 12 nt, Yersinia pestis KIM
acuguugguaaa

SEQ ID NO: 4213617 - RNA, 16 nt, Yersinia pestis KIM
acuguugguaaauaac

SEQ ID NO: 4213618 - RNA, 17 nt, Yersinia pestis KIM
acuguuuuauuauauau

SEQ ID NO: 4213619 - RNA, 23 nt, Yersinia pestis KIM
acuguuuugguuuccgcugacau

SEQ ID NO: 4213620 - RNA, 16 nt, Yersinia pestis KIM
acuguuuuuccagccc

SEQ ID NO: 4213621 - RNA, 21 nt, Yersinia pestis KIM
acuguuuuuuaaagaaaaaac

SEQ ID NO: 4213622 - RNA, 17 nt, Yersinia pestis KIM
acuuaacuacugcaagc

SEQ ID NO: 4213623 - RNA, 17 nt, Yersinia pestis KIM
acuuaacugaaagccaa

SEQ ID NO: 4213624 - RNA, 21 nt, Yersinia pestis KIM
acuuaagcauuggcaaaucau

SEQ ID NO: 4213625 - RNA, 23 nt, Yersinia pestis KIM
acuuaaguugaguugaauuuuua

SEQ ID NO: 4213626 - RNA, 22 nt, Yersinia pestis KIM
acuuaauaaugaccacgcauca

SEQ ID NO: 4213627 - RNA, 18 nt, Yersinia pestis KIM
acuuaaucgauagugcuu

SEQ ID NO: 4213628 - RNA, 21 nt, Yersinia pestis KIM
acuuaaucgccagugaguccu

SEQ ID NO: 4213629 - RNA, 17 nt, Yersinia pestis KIM
acuuaauggucuucuuu

SEQ ID NO: 4213630 - RNA, 22 nt, Yersinia pestis KIM
acuuaauucccguuguuuaucc

SEQ ID NO: 4213631 - RNA, 16 nt, Yersinia pestis KIM
acuuaauugguuuaua

SEQ ID NO: 4213632 - RNA, 16 nt, Yersinia pestis KIM
acuuacaauaaucugg

SEQ ID NO: 4213633 - RNA, 20 nt, Yersinia pestis KIM
acuuacaggcugccugccug

SEQ ID NO: 4213634 - RNA, 15 nt, Yersinia pestis KIM
acuuaccccuugcga

SEQ ID NO: 4213635 - RNA, 18 nt, Yersinia pestis KIM
acuuagaagcgauaaccc

SEQ ID NO: 4213636 - RNA, 20 nt, Yersinia pestis KIM
acuuagcacggcaucgcugc

SEQ ID NO: 4213637 - RNA, 22 nt, Yersinia pestis KIM
acuuagguucaaucggcagugc

SEQ ID NO: 4213638 - RNA, 21 nt, Yersinia pestis KIM
acuuauaaacacugauuuaua

SEQ ID NO: 4213639 - RNA, 13 nt, Yersinia pestis KIM
acuuaucccaacu

SEQ ID NO: 4213640 - RNA, 20 nt, Yersinia pestis KIM
acuuaugaugugauuauuuu

SEQ ID NO: 4213641 - RNA, 23 nt, Yersinia pestis KIM
acuuaugaugugauuauuuuguu

SEQ ID NO: 4213642 - RNA, 15 nt, Yersinia pestis KIM
acuuauggguuuuua

SEQ ID NO: 4213643 - RNA, 22 nt, Yersinia pestis KIM
acuuauuacaccuuaaaacagc

SEQ ID NO: 4213644 - RNA, 15 nt, Yersinia pestis KIM
acuuauuauaaagcu

SEQ ID NO: 4213645 - RNA, 19 nt, Yersinia pestis KIM
agaacggccugccagaaca

SEQ ID NO: 4213646 - RNA, 22 nt, Yersinia pestis KIM
agaacgucaccgccaaaauaaa

SEQ ID NO: 4213647 - RNA, 15 nt, Yersinia pestis KIM
agaacgucagauaac

SEQ ID NO: 4213648 - RNA, 15 nt, Yersinia pestis KIM
agaacguuaauuuag

SEQ ID NO: 4213649 - RNA, 15 nt, Yersinia pestis KIM
agaacuaauaucaac

SEQ ID NO: 4213650 - RNA, 15 nt, Yersinia pestis KIM
agaacugauuucagg

SEQ ID NO: 4213651 - RNA, 19 nt, Yersinia pestis KIM
agaacugauuucaggaaug

SEQ ID NO: 4213652 - RNA, 14 nt, Yersinia pestis KIM
agaagaauaucugc

SEQ ID NO: 4213653 - RNA, 22 nt, Yersinia pestis KIM
agaagaauaucugccgggagga

SEQ ID NO: 4213654 - RNA, 21 nt, Yersinia pestis KIM
agaagaauccacauaaaaaga

SEQ ID NO: 4213655 - RNA, 20 nt, Yersinia pestis KIM
agaagaauugcagauaccac

SEQ ID NO: 4213656 - RNA, 21 nt, Yersinia pestis KIM
agaagaauugcagauaccaca

SEQ ID NO: 4213657 - RNA, 12 nt, Yersinia pestis KIM
agaagacgagua

SEQ ID NO: 4213658 - RNA, 18 nt, Yersinia pestis KIM
agaagcauauggauguga

SEQ ID NO: 4213659 - RNA, 20 nt, Yersinia pestis KIM
agaagcccugaguuaaguaa

SEQ ID NO: 4213660 - RNA, 15 nt, Yersinia pestis KIM
agaagccucaugaau

SEQ ID NO: 4213661 - RNA, 22 nt, Yersinia pestis KIM
agaagccucaugaaugaggcug

SEQ ID NO: 4213662 - RNA, 15 nt, Yersinia pestis KIM
agaagccugaauauu

SEQ ID NO: 4213663 - RNA, 16 nt, Yersinia pestis KIM
agaagcguaaagcacc

SEQ ID NO: 4213664 - RNA, 15 nt, Yersinia pestis KIM
agaagcuaccagcac

SEQ ID NO: 4213665 - RNA, 18 nt, Yersinia pestis KIM
agaagcuucaacuuaauu

SEQ ID NO: 4213666 - RNA, 17 nt, Yersinia pestis KIM
agaaggccaguaguaaa

SEQ ID NO: 4213667 - RNA, 15 nt, Yersinia pestis KIM
agaaggcuagucugu

SEQ ID NO: 4213668 - RNA, 18 nt, Yersinia pestis KIM
agaagggcggccagcaag

SEQ ID NO: 4213669 - RNA, 20 nt, Yersinia pestis KIM
agaaggguauugaagauacc

SEQ ID NO: 4213670 - RNA, 14 nt, Yersinia pestis KIM
agaagguaagccag

SEQ ID NO: 4213671 - RNA, 18 nt, Yersinia pestis KIM
agaaguucuaaauaaaau

SEQ ID NO: 4213672 - RNA, 20 nt, Yersinia pestis KIM
agaauaaacgagaauucaga

SEQ ID NO: 4213673 - RNA, 21 nt, Yersinia pestis KIM
agaauaaauaauaucaaugau

SEQ ID NO: 4213674 - RNA, 23 nt, Yersinia pestis KIM
agaauaauccccacggccagagc

SEQ ID NO: 4213675 - RNA, 20 nt, Yersinia pestis KIM
agaauagaaccggaauaaau

SEQ ID NO: 4213676 - RNA, 17 nt, Yersinia pestis KIM
agaauaggcaggggagu

SEQ ID NO: 4213677 - RNA, 23 nt, Yersinia pestis KIM
agaauauaaaagcacagacaaac

SEQ ID NO: 4213678 - RNA, 14 nt, Yersinia pestis KIM
agaauaucuuccac

SEQ ID NO: 4213679 - RNA, 16 nt, Yersinia pestis KIM
agaauauuuacgguga

SEQ ID NO: 4213680 - RNA, 17 nt, Yersinia pestis KIM
agaaucaaccacgguaa

SEQ ID NO: 4213681 - RNA, 14 nt, Yersinia pestis KIM
agaaucaaucaauu

SEQ ID NO: 4213682 - RNA, 19 nt, Yersinia pestis KIM
agaaucaccaacaccacca

SEQ ID NO: 4213683 - RNA, 17 nt, Yersinia pestis KIM
agaaucaccgaaagaag

SEQ ID NO: 4213684 - RNA, 18 nt, Yersinia pestis KIM
agaauccacauaaaaaga

SEQ ID NO: 4213685 - RNA, 23 nt, Yersinia pestis KIM
agaaucucuccagugcaaauuua

SEQ ID NO: 4213686 - RNA, 21 nt, Yersinia pestis KIM
agaaugaaaggcggugaacag

SEQ ID NO: 4213687 - RNA, 16 nt, Yersinia pestis KIM
agaaugcagauaucag

SEQ ID NO: 4213688 - RNA, 15 nt, Yersinia pestis KIM
agaaugcgacauguu

SEQ ID NO: 4213689 - RNA, 22 nt, Yersinia pestis KIM
agaaugucaugguuaaacugac

SEQ ID NO: 4213690 - RNA, 16 nt, Yersinia pestis KIM
agaauguguaguugaa

SEQ ID NO: 4213691 - RNA, 19 nt, Yersinia pestis KIM
agaauuaaggaaacucaug

SEQ ID NO: 4213692 - RNA, 14 nt, Yersinia pestis KIM
agaauuagcggcaa

SEQ ID NO: 4213693 - RNA, 18 nt, Yersinia pestis KIM
agaauuauaacuauuauc

SEQ ID NO: 4213694 - RNA, 18 nt, Yersinia pestis KIM
agaauugcagaacagauu

SEQ ID NO: 4213695 - RNA, 21 nt, Yersinia pestis KIM
agaauugcagauaccacauca

SEQ ID NO: 4213696 - RNA, 19 nt, Yersinia pestis KIM
agaauugguuauccuaaga

SEQ ID NO: 4213697 - RNA, 19 nt, Yersinia pestis KIM
agaauugugccccaagaag

SEQ ID NO: 4213698 - RNA, 13 nt, Yersinia pestis KIM
agaauuucauugu

SEQ ID NO: 4213699 - RNA, 23 nt, Yersinia pestis KIM
agaauuuucucauuaauaaugau

SEQ ID NO: 4213700 - RNA, 14 nt, Yersinia pestis KIM
agacaaacaaccua

SEQ ID NO: 4213701 - RNA, 14 nt, Yersinia pestis KIM
agacaacucuucua

SEQ ID NO: 4213702 - RNA, 18 nt, Yersinia pestis KIM
agacaacucuucuaucuu

SEQ ID NO: 4213703 - RNA, 22 nt, Yersinia pestis KIM
agacaaggauacgcauuacccu

SEQ ID NO: 4213704 - RNA, 13 nt, Yersinia pestis KIM
agacacaagauaa

SEQ ID NO: 4213705 - RNA, 16 nt, Yersinia pestis KIM
agacacaagauaaaua

SEQ ID NO: 4213706 - RNA, 22 nt, Yersinia pestis KIM
agacaccuucccuauucaaaau

SEQ ID NO: 4213707 - RNA, 23 nt, Yersinia pestis KIM
agacacuaaccagacgcaaccaa

SEQ ID NO: 4213708 - RNA, 16 nt, Yersinia pestis KIM
agacaggauaagcagg

SEQ ID NO: 4213709 - RNA, 20 nt, Yersinia pestis KIM
agacagggggauaaaaaccc

SEQ ID NO: 4213710 - RNA, 17 nt, Yersinia pestis KIM
agacaguaaauccugau

SEQ ID NO: 4213711 - RNA, 13 nt, Yersinia pestis KIM
agacaguaacuaa

SEQ ID NO: 4213712 - RNA, 12 nt, Yersinia pestis KIM
agacauaaagaa

SEQ ID NO: 4213713 - RNA, 12 nt, Yersinia pestis KIM
agacauaaagcc

SEQ ID NO: 4213714 - RNA, 12 nt, Yersinia pestis KIM
agacauaaugcc

SEQ ID NO: 4213715 - RNA, 20 nt, Yersinia pestis KIM
agacauauuguccaacaucu

SEQ ID NO: 4213716 - RNA, 14 nt, Yersinia pestis KIM
agacaucgccagau

SEQ ID NO: 4213717 - RNA, 22 nt, Yersinia pestis KIM
agacauuccgucagcaugaaug

SEQ ID NO: 4213718 - RNA, 19 nt, Yersinia pestis KIM
agacauugcgcaagccccu

SEQ ID NO: 4213719 - RNA, 19 nt, Yersinia pestis KIM
agaccaaauuccccagccc

SEQ ID NO: 4213720 - RNA, 12 nt, Yersinia pestis KIM
agaccagauaau

SEQ ID NO: 4213721 - RNA, 15 nt, Yersinia pestis KIM
agacccccaaugagu

SEQ ID NO: 4213722 - RNA, 23 nt, Yersinia pestis KIM
agaccccugcgauaaucuccauc

SEQ ID NO: 4213723 - RNA, 13 nt, Yersinia pestis KIM
agacccgauuuca

SEQ ID NO: 4213724 - RNA, 16 nt, Yersinia pestis KIM
agacccggcaaauaaa

SEQ ID NO: 4213725 - RNA, 18 nt, Yersinia pestis KIM
agaccgcaugcugcaguu

SEQ ID NO: 4213726 - RNA, 22 nt, Yersinia pestis KIM
agaccgcguuaauaccuuguuc

SEQ ID NO: 4213727 - RNA, 19 nt, Yersinia pestis KIM
agaccggacauuaauuauu

SEQ ID NO: 4213728 - RNA, 15 nt, Yersinia pestis KIM
agaccguaucacccg

SEQ ID NO: 4213729 - RNA, 19 nt, Yersinia pestis KIM
agaccugaggauaaaaacu

SEQ ID NO: 4213730 - RNA, 16 nt, Yersinia pestis KIM
agacgagcguaauucc

SEQ ID NO: 4213731 - RNA, 20 nt, Yersinia pestis KIM
agacgccguaaauacaucca

SEQ ID NO: 4213732 - RNA, 16 nt, Yersinia pestis KIM
agacggcguaagccuu

SEQ ID NO: 4213733 - RNA, 16 nt, Yersinia pestis KIM
agacgucauaaaaagc

SEQ ID NO: 4213734 - RNA, 21 nt, Yersinia pestis KIM
agacguuuaaauaagcuauca

SEQ ID NO: 4213735 - RNA, 15 nt, Yersinia pestis KIM
agacuaaccucugca

SEQ ID NO: 4213736 - RNA, 16 nt, Yersinia pestis KIM
agacucaucuaauuuu

SEQ ID NO: 4213737 - RNA, 21 nt, Yersinia pestis KIM
agacucaucuaauuuucucag

SEQ ID NO: 4213738 - RNA, 20 nt, Yersinia pestis KIM
agacugaaaguagaaauaaa

SEQ ID NO: 4213739 - RNA, 19 nt, Yersinia pestis KIM
agacugaaaugacauugcg

SEQ ID NO: 4213740 - RNA, 16 nt, Yersinia pestis KIM
agacugacgcagagcu

SEQ ID NO: 4213741 - RNA, 20 nt, Yersinia pestis KIM
agacugacgcagagcuaaau

SEQ ID NO: 4213742 - RNA, 22 nt, Yersinia pestis KIM
agacugacgcagagcuaaaugu

SEQ ID NO: 4213743 - RNA, 13 nt, Yersinia pestis KIM
agacugcugacaa

SEQ ID NO: 4213744 - RNA, 16 nt, Yersinia pestis KIM
agacugcugacaaacc

SEQ ID NO: 4213745 - RNA, 23 nt, Yersinia pestis KIM
agacuucuaaaucacgcagcagg

SEQ ID NO: 4213746 - RNA, 18 nt, Yersinia pestis KIM
agagaaaacagauauuuu

SEQ ID NO: 4213747 - RNA, 22 nt, Yersinia pestis KIM
agagaaaagcagacuugaacuu

SEQ ID NO: 4213748 - RNA, 13 nt, Yersinia pestis KIM
agagaaauaaccc

SEQ ID NO: 4213749 - RNA, 14 nt, Yersinia pestis KIM
agagaaauaaccca

SEQ ID NO: 4213750 - RNA, 19 nt, Yersinia pestis KIM
agagaaauacagaaaaaua

SEQ ID NO: 4213751 - RNA, 12 nt, Yersinia pestis KIM
agagaaaucaaa

SEQ ID NO: 4213752 - RNA, 21 nt, Yersinia pestis KIM
agagaacaggcagcaaauaaa

SEQ ID NO: 4213753 - RNA, 20 nt, Yersinia pestis KIM
agagaauuauuucucguggc

SEQ ID NO: 4213754 - RNA, 20 nt, Yersinia pestis KIM
agagacaaaaauagaaggcc

SEQ ID NO: 4213755 - RNA, 13 nt, Yersinia pestis KIM
agagaccacagau

SEQ ID NO: 4213756 - RNA, 12 nt, Yersinia pestis KIM
agagacggaaag

SEQ ID NO: 4213757 - RNA, 19 nt, Yersinia pestis KIM
agagacggaaagagccagc

SEQ ID NO: 4213758 - RNA, 19 nt, Yersinia pestis KIM
agagacuuuguaccgguuc

SEQ ID NO: 4213759 - RNA, 12 nt, Yersinia pestis KIM
agaucguaaaga

SEQ ID NO: 4213760 - RNA, 19 nt, Yersinia pestis KIM
agaucucugcgacaucagc

SEQ ID NO: 4213761 - RNA, 23 nt, Yersinia pestis KIM
agaucucuguuuuccaucaccca

SEQ ID NO: 4213762 - RNA, 16 nt, Yersinia pestis KIM
agaugaaggucaccau

SEQ ID NO: 4213763 - RNA, 13 nt, Yersinia pestis KIM
agaugaaugaggg

SEQ ID NO: 4213764 - RNA, 15 nt, Yersinia pestis KIM
agaugaaugagggag

SEQ ID NO: 4213765 - RNA, 15 nt, Yersinia pestis KIM
agaugagugguuuau

SEQ ID NO: 4213766 - RNA, 13 nt, Yersinia pestis KIM
agaugaucaaauu

SEQ ID NO: 4213767 - RNA, 20 nt, Yersinia pestis KIM
agaugaucaacgccaaaaua

SEQ ID NO: 4213768 - RNA, 13 nt, Yersinia pestis KIM
agaugauugaggc

SEQ ID NO: 4213769 - RNA, 18 nt, Yersinia pestis KIM
agaugcagagaugcagag

SEQ ID NO: 4213770 - RNA, 14 nt, Yersinia pestis KIM
agaugccaaucaaa

SEQ ID NO: 4213771 - RNA, 23 nt, Yersinia pestis KIM
agaugccaaucaaaaaaccggcu

SEQ ID NO: 4213772 - RNA, 13 nt, Yersinia pestis KIM
agaugccagacuu

SEQ ID NO: 4213773 - RNA, 19 nt, Yersinia pestis KIM
agaugccuauuugcagaaa

SEQ ID NO: 4213774 - RNA, 20 nt, Yersinia pestis KIM
agaugccuauuugcagaaag

SEQ ID NO: 4213775 - RNA, 19 nt, Yersinia pestis KIM
agaugcugaggauaggccg

SEQ ID NO: 4213776 - RNA, 17 nt, Yersinia pestis KIM
agauggccagauucacc

SEQ ID NO: 4213777 - RNA, 16 nt, Yersinia pestis KIM
agauggccccaauugu

SEQ ID NO: 4213778 - RNA, 20 nt, Yersinia pestis KIM
agaugggaagacagauccug

SEQ ID NO: 4213779 - RNA, 15 nt, Yersinia pestis KIM
agauguauccaaggc

SEQ ID NO: 4213780 - RNA, 13 nt, Yersinia pestis KIM
agaugucagauua

SEQ ID NO: 4213781 - RNA, 13 nt, Yersinia pestis KIM
agauuaagacuuu

SEQ ID NO: 4213782 - RNA, 17 nt, Yersinia pestis KIM
agauuacgcgucaucau

SEQ ID NO: 4213783 - RNA, 17 nt, Yersinia pestis KIM
agauuacggucaccaau

SEQ ID NO: 4213784 - RNA, 21 nt, Yersinia pestis KIM
agauuagucuuagacgucaga

SEQ ID NO: 4213785 - RNA, 23 nt, Yersinia pestis KIM
agauuagucuuagacgucagauu

SEQ ID NO: 4213786 - RNA, 21 nt, Yersinia pestis KIM
agauuaguuuuagacgucaga

SEQ ID NO: 4213787 - RNA, 16 nt, Yersinia pestis KIM
agauuauccagcccua

SEQ ID NO: 4213788 - RNA, 15 nt, Yersinia pestis KIM
agauuauuauuacua

SEQ ID NO: 4213789 - RNA, 23 nt, Yersinia pestis KIM
agauuauuggcgauuuaauguau

SEQ ID NO: 4213790 - RNA, 12 nt, Yersinia pestis KIM
agauucaccagu

SEQ ID NO: 4213791 - RNA, 16 nt, Yersinia pestis KIM
agauucauuagccagc

SEQ ID NO: 4213792 - RNA, 14 nt, Yersinia pestis KIM
agauuccuuaccug

SEQ ID NO: 4213793 - RNA, 17 nt, Yersinia pestis KIM
agauugaaaaacaacgc

SEQ ID NO: 4213794 - RNA, 16 nt, Yersinia pestis KIM
agauugaucaguggcu

SEQ ID NO: 4213795 - RNA, 18 nt, Yersinia pestis KIM
agauugccgcaaggccau

SEQ ID NO: 4213796 - RNA, 18 nt, Yersinia pestis KIM
agauugcuacugaagguu

SEQ ID NO: 4213797 - RNA, 19 nt, Yersinia pestis KIM
agauugugcgaucaucacg

SEQ ID NO: 4213798 - RNA, 17 nt, Yersinia pestis KIM
agauuguuuauaaauua

SEQ ID NO: 4213799 - RNA, 21 nt, Yersinia pestis KIM
agauuguuuauaaauuaaaaa

SEQ ID NO: 4213800 - RNA, 21 nt, Yersinia pestis KIM
agauuuaaaggcaugcucccu

SEQ ID NO: 4213801 - RNA, 13 nt, Yersinia pestis KIM
agauuuaaauaac

SEQ ID NO: 4213802 - RNA, 17 nt, Yersinia pestis KIM
agauuuaaccccaauuc

SEQ ID NO: 4213803 - RNA, 12 nt, Yersinia pestis KIM
agauuuaccaug

SEQ ID NO: 4213804 - RNA, 15 nt, Yersinia pestis KIM
agauuucaaacgcau

SEQ ID NO: 4213805 - RNA, 19 nt, Yersinia pestis KIM
agauuucaagcaauucaga

SEQ ID NO: 4213806 - RNA, 14 nt, Yersinia pestis KIM
agauuucagacugc

SEQ ID NO: 4213807 - RNA, 17 nt, Yersinia pestis KIM
agauuucagacugcuga

SEQ ID NO: 4213808 - RNA, 19 nt, Yersinia pestis KIM
agauuucaucauucaauac

SEQ ID NO: 4213809 - RNA, 21 nt, Yersinia pestis KIM
agauuucaucggcaaaaacag

SEQ ID NO: 4213810 - RNA, 22 nt, Yersinia pestis KIM
agauuucaucggcaaaaacagu

SEQ ID NO: 4213811 - RNA, 16 nt, Yersinia pestis KIM
agauuugguauuacgc

SEQ ID NO: 4213812 - RNA, 17 nt, Yersinia pestis KIM
agauuuuccauccccug

SEQ ID NO: 4213813 - RNA, 20 nt, Yersinia pestis KIM
agauuuuuagcgugccgcag

SEQ ID NO: 4213814 - RNA, 17 nt, Yersinia pestis KIM
agauuuuuuaugucaga

SEQ ID NO: 4213815 - RNA, 21 nt, Yersinia pestis KIM
agcaaaaaaacugacugccau

SEQ ID NO: 4213816 - RNA, 13 nt, Yersinia pestis KIM
agcaaaaagccag

SEQ ID NO: 4213817 - RNA, 14 nt, Yersinia pestis KIM
agcaaaaaggcugc

SEQ ID NO: 4213818 - RNA, 12 nt, Yersinia pestis KIM
agcaaaagccuc

SEQ ID NO: 4213819 - RNA, 12 nt, Yersinia pestis KIM
agcaaacagugc

SEQ ID NO: 4213820 - RNA, 13 nt, Yersinia pestis KIM
agcaaacagugca

SEQ ID NO: 4213821 - RNA, 14 nt, Yersinia pestis KIM
agcaaacgaacgaa

SEQ ID NO: 4213822 - RNA, 23 nt, Yersinia pestis KIM
agcaaagcgauaucguuaucaac

SEQ ID NO: 4213823 - RNA, 12 nt, Yersinia pestis KIM
agcaaaggccac

SEQ ID NO: 4213824 - RNA, 23 nt, Yersinia pestis KIM
agcaaagucccggcuaggaggcc

SEQ ID NO: 4213825 - RNA, 13 nt, Yersinia pestis KIM
agcaaaucacauu

SEQ ID NO: 4213826 - RNA, 15 nt, Yersinia pestis KIM
agcaaaucauuuaau

SEQ ID NO: 4213827 - RNA, 21 nt, Yersinia pestis KIM
agcaaauuuaucaguagcuag

SEQ ID NO: 4213828 - RNA, 16 nt, Yersinia pestis KIM
agcaaccacgguauca

SEQ ID NO: 4213829 - RNA, 21 nt, Yersinia pestis KIM
agcaaccggauacaaagugaa

SEQ ID NO: 4213830 - RNA, 15 nt, Yersinia pestis KIM
agcaaccgucaccgu

SEQ ID NO: 4213831 - RNA, 23 nt, Yersinia pestis KIM
agcaacgaaaugucgaaagauag

SEQ ID NO: 4213832 - RNA, 22 nt, Yersinia pestis KIM
agcaacgguaucccggugauca

SEQ ID NO: 4213833 - RNA, 17 nt, Yersinia pestis KIM
agcaacucgguuuuaau

SEQ ID NO: 4213834 - RNA, 20 nt, Yersinia pestis KIM
agcaagauuuuguagcccac

SEQ ID NO: 4213835 - RNA, 23 nt, Yersinia pestis KIM
agcaagauuuuguagcccacuga

SEQ ID NO: 4213836 - RNA, 19 nt, Yersinia pestis KIM
agcaagccgauaaucaauu

SEQ ID NO: 4213837 - RNA, 23 nt, Yersinia pestis KIM
agcaaggauuccccccagucacu

SEQ ID NO: 4213838 - RNA, 11 nt, Yersinia pestis KIM
agcaaggcagc

SEQ ID NO: 4213839 - RNA, 16 nt, Yersinia pestis KIM
agcaagggcagcuaac

SEQ ID NO: 4213840 - RNA, 19 nt, Yersinia pestis KIM
agcaauauaauaaucuaua

SEQ ID NO: 4213841 - RNA, 17 nt, Yersinia pestis KIM
agcaauaugaauacgaa

SEQ ID NO: 4213842 - RNA, 22 nt, Yersinia pestis KIM
agcaaucaaaagggaucaccag

SEQ ID NO: 4213843 - RNA, 20 nt, Yersinia pestis KIM
agcaaugcaccgacaaagau

SEQ ID NO: 4213844 - RNA, 23 nt, Yersinia pestis KIM
agcacaaacauggcggcagcaca

SEQ ID NO: 4213845 - RNA, 22 nt, Yersinia pestis KIM
agcacaacgcucuaacgucaga

SEQ ID NO: 4213846 - RNA, 22 nt, Yersinia pestis KIM
agcacaaugacuuaacugaaag

SEQ ID NO: 4213847 - RNA, 13 nt, Yersinia pestis KIM
agcacaaugccua

SEQ ID NO: 4213848 - RNA, 15 nt, Yersinia pestis KIM
agcacacacagccua

SEQ ID NO: 4213849 - RNA, 17 nt, Yersinia pestis KIM
agcacacaggcagcuug

SEQ ID NO: 4213850 - RNA, 19 nt, Yersinia pestis KIM
agcacaccggccaaaauca

SEQ ID NO: 4213851 - RNA, 21 nt, Yersinia pestis KIM
agcacaccggccaaaaucacc

SEQ ID NO: 4213852 - RNA, 21 nt, Yersinia pestis KIM
agcacacucagaugaaaaacu

SEQ ID NO: 4213853 - RNA, 13 nt, Yersinia pestis KIM
agcacacugguug

SEQ ID NO: 4213854 - RNA, 15 nt, Yersinia pestis KIM
agcacagacaaacaa

SEQ ID NO: 4213855 - RNA, 17 nt, Yersinia pestis KIM
agcacagccugccggga

SEQ ID NO: 4213856 - RNA, 20 nt, Yersinia pestis KIM
agcacagccugccgggauga

SEQ ID NO: 4213857 - RNA, 13 nt, Yersinia pestis KIM
agcaccaaaucuu

SEQ ID NO: 4213858 - RNA, 19 nt, Yersinia pestis KIM
agcaccaaaucuuccagcg

SEQ ID NO: 4213859 - RNA, 21 nt, Yersinia pestis KIM
agcaccaaaucuuccagcggc

SEQ ID NO: 4213860 - RNA, 14 nt, Yersinia pestis KIM
agcaccaauauugc

SEQ ID NO: 4213861 - RNA, 22 nt, Yersinia pestis KIM
agcaccauuaucuuccauagau

SEQ ID NO: 4213862 - RNA, 22 nt, Yersinia pestis KIM
agcaccauucaauguaaaacga

SEQ ID NO: 4213863 - RNA, 13 nt, Yersinia pestis KIM
agcaccuaucgcc

SEQ ID NO: 4213864 - RNA, 20 nt, Yersinia pestis KIM
agcaccuaucgccgccgcca

SEQ ID NO: 4213865 - RNA, 22 nt, Yersinia pestis KIM
agcacgaauuuuauucagcaag

SEQ ID NO: 4213866 - RNA, 19 nt, Yersinia pestis KIM
agcacgaccuugccaaggu

SEQ ID NO: 4213867 - RNA, 13 nt, Yersinia pestis KIM
agcacgauuacca

SEQ ID NO: 4213868 - RNA, 17 nt, Yersinia pestis KIM
agcacggcaggcgguua

SEQ ID NO: 4213869 - RNA, 16 nt, Yersinia pestis KIM
agcacguaaaucgguu

SEQ ID NO: 4213870 - RNA, 14 nt, Yersinia pestis KIM
agcacguaccgcug

SEQ ID NO: 4213871 - RNA, 21 nt, Yersinia pestis KIM
agcacguucaccaaagcaaug

SEQ ID NO: 4213872 - RNA, 21 nt, Yersinia pestis KIM
agcacguuuuucagcuucuuc

SEQ ID NO: 4213873 - RNA, 17 nt, Yersinia pestis KIM
agccagaaauagcacca

SEQ ID NO: 4213874 - RNA, 16 nt, Yersinia pestis KIM
agccagccuuaacugc

SEQ ID NO: 4213875 - RNA, 17 nt, Yersinia pestis KIM
agccagccuuaacugca

SEQ ID NO: 4213876 - RNA, 16 nt, Yersinia pestis KIM
agccagcgucaucaca

SEQ ID NO: 4213877 - RNA, 14 nt, Yersinia pestis KIM
agccagucaggguu

SEQ ID NO: 4213878 - RNA, 23 nt, Yersinia pestis KIM
agccagucaggguuagccgacug

SEQ ID NO: 4213879 - RNA, 15 nt, Yersinia pestis KIM
agccagugcgggaga

SEQ ID NO: 4213880 - RNA, 17 nt, Yersinia pestis KIM
agccaguugaucggcca

SEQ ID NO: 4213881 - RNA, 18 nt, Yersinia pestis KIM
agccauaaagugcguagg

SEQ ID NO: 4213882 - RNA, 17 nt, Yersinia pestis KIM
agccauauguugccacc

SEQ ID NO: 4213883 - RNA, 12 nt, Yersinia pestis KIM
agccaucgccau

SEQ ID NO: 4213884 - RNA, 13 nt, Yersinia pestis KIM
agccaucgccauc

SEQ ID NO: 4213885 - RNA, 23 nt, Yersinia pestis KIM
agccaucuugggccgacucugca

SEQ ID NO: 4213886 - RNA, 23 nt, Yersinia pestis KIM
agccauggcuuuagguugagaau

SEQ ID NO: 4213887 - RNA, 21 nt, Yersinia pestis KIM
agccaugggucauuaauuaag

SEQ ID NO: 4213888 - RNA, 16 nt, Yersinia pestis KIM
agccauuauuggcugg

SEQ ID NO: 4213889 - RNA, 17 nt, Yersinia pestis KIM
agccauucugaaucgcu

SEQ ID NO: 4213890 - RNA, 19 nt, Yersinia pestis KIM
agccauucugaaucgcugc

SEQ ID NO: 4213891 - RNA, 22 nt, Yersinia pestis KIM
agccauugagcgaagaagagau

SEQ ID NO: 4213892 - RNA, 16 nt, Yersinia pestis KIM
agccauuucaccaaua

SEQ ID NO: 4213893 - RNA, 15 nt, Yersinia pestis KIM
agccauuuuuuauaa

SEQ ID NO: 4213894 - RNA, 17 nt, Yersinia pestis KIM
agccauuuuuuauaaac

SEQ ID NO: 4213895 - RNA, 20 nt, Yersinia pestis KIM
agccauuuuuuauaaacacu

SEQ ID NO: 4213896 - RNA, 13 nt, Yersinia pestis KIM
agcccaacacuuu

SEQ ID NO: 4213897 - RNA, 16 nt, Yersinia pestis KIM
agcccaacugacugaa

SEQ ID NO: 4213898 - RNA, 13 nt, Yersinia pestis KIM
agcccaagagaaa

SEQ ID NO: 4213899 - RNA, 22 nt, Yersinia pestis KIM
agcccacaggguaagccucaag

SEQ ID NO: 4213900 - RNA, 19 nt, Yersinia pestis KIM
agcccacgaggacaggugg

SEQ ID NO: 4213901 - RNA, 20 nt, Yersinia pestis KIM
agcccacugacacugauaga

SEQ ID NO: 4213902 - RNA, 13 nt, Yersinia pestis KIM
agcccagcguucu

SEQ ID NO: 4213903 - RNA, 20 nt, Yersinia pestis KIM
agcccagguuacugcccugg

SEQ ID NO: 4213904 - RNA, 19 nt, Yersinia pestis KIM
agcccaguauugcagagca

SEQ ID NO: 4213905 - RNA, 21 nt, Yersinia pestis KIM
agcccauagaugggccaggca

SEQ ID NO: 4213906 - RNA, 21 nt, Yersinia pestis KIM
agcccauaucuuuaaaaaccc

SEQ ID NO: 4213907 - RNA, 13 nt, Yersinia pestis KIM
agcccauugcugu

SEQ ID NO: 4213908 - RNA, 20 nt, Yersinia pestis KIM
agccccaaaugccagcgaaa

SEQ ID NO: 4213909 - RNA, 19 nt, Yersinia pestis KIM
agccccacaguacaaaaaa

SEQ ID NO: 4213910 - RNA, 13 nt, Yersinia pestis KIM
agcccccagggaa

SEQ ID NO: 4213911 - RNA, 13 nt, Yersinia pestis KIM
agcccccucaaua

SEQ ID NO: 4213912 - RNA, 16 nt, Yersinia pestis KIM
agccccuaacagcagu

SEQ ID NO: 4213913 - RNA, 14 nt, Yersinia pestis KIM
agccccuagcaccg

SEQ ID NO: 4213914 - RNA, 14 nt, Yersinia pestis KIM
agccccugccagaa

SEQ ID NO: 4213915 - RNA, 19 nt, Yersinia pestis KIM
agcccgauggggagagcgu

SEQ ID NO: 4213916 - RNA, 20 nt, Yersinia pestis KIM
agcccgauggggagagcguc

SEQ ID NO: 4213917 - RNA, 19 nt, Yersinia pestis KIM
agcccgcaacgggagagaa

SEQ ID NO: 4213918 - RNA, 16 nt, Yersinia pestis KIM
agcccggaaacgucca

SEQ ID NO: 4213919 - RNA, 22 nt, Yersinia pestis KIM
agcccggcucauccgccaagau

SEQ ID NO: 4213920 - RNA, 21 nt, Yersinia pestis KIM
agcccgguguuaaccgcccca

SEQ ID NO: 4213921 - RNA, 21 nt, Yersinia pestis KIM
agcccguucggucacacuggc

SEQ ID NO: 4213922 - RNA, 22 nt, Yersinia pestis KIM
agcccuacauccgcuuguucuu

SEQ ID NO: 4213923 - RNA, 18 nt, Yersinia pestis KIM
agcccuuauucaaagaau

SEQ ID NO: 4213924 - RNA, 20 nt, Yersinia pestis KIM
agcccuuugaccauuuguuu

SEQ ID NO: 4213925 - RNA, 15 nt, Yersinia pestis KIM
agccgaagaacaaau

SEQ ID NO: 4213926 - RNA, 19 nt, Yersinia pestis KIM
agccgaagaacaaauucau

SEQ ID NO: 4213927 - RNA, 19 nt, Yersinia pestis KIM
agccgagcaagugaauaac

SEQ ID NO: 4213928 - RNA, 14 nt, Yersinia pestis KIM
agccgauaaucaau

SEQ ID NO: 4213929 - RNA, 18 nt, Yersinia pestis KIM
agccgauaauccaccuga

SEQ ID NO: 4213930 - RNA, 21 nt, Yersinia pestis KIM
agccgauaaucccugccagaa

SEQ ID NO: 4213931 - RNA, 16 nt, Yersinia pestis KIM
agccgauuuagacaag

SEQ ID NO: 4213932 - RNA, 12 nt, Yersinia pestis KIM
agccgcaccauc

SEQ ID NO: 4213933 - RNA, 15 nt, Yersinia pestis KIM
agccgcauuguucgg

SEQ ID NO: 4213934 - RNA, 21 nt, Yersinia pestis KIM
agccgccagucauucaccugc

SEQ ID NO: 4213935 - RNA, 19 nt, Yersinia pestis KIM
agccgcccccuuucuuauc

SEQ ID NO: 4213936 - RNA, 23 nt, Yersinia pestis KIM
agccgcccucucuagauuaaccu

SEQ ID NO: 4213937 - RNA, 14 nt, Yersinia pestis KIM
agccgccgcccuga

SEQ ID NO: 4213938 - RNA, 17 nt, Yersinia pestis KIM
agccgcgaaaaaccaug

SEQ ID NO: 4213939 - RNA, 19 nt, Yersinia pestis KIM
agccgcgccauccuuggcg

SEQ ID NO: 4213940 - RNA, 13 nt, Yersinia pestis KIM
agccgcgcccucc

SEQ ID NO: 4213941 - RNA, 17 nt, Yersinia pestis KIM
agccggacucaaaauac

SEQ ID NO: 4213942 - RNA, 14 nt, Yersinia pestis KIM
agccggagagucgg

SEQ ID NO: 4213943 - RNA, 21 nt, Yersinia pestis KIM
agccguaacugaccgcagccu

SEQ ID NO: 4213944 - RNA, 23 nt, Yersinia pestis KIM
agccguguaaauguacagucauu

SEQ ID NO: 4213945 - RNA, 13 nt, Yersinia pestis KIM
agccguuaaaaag

SEQ ID NO: 4213946 - RNA, 23 nt, Yersinia pestis KIM
agccguuucagauaaaaagccag

SEQ ID NO: 4213947 - RNA, 12 nt, Yersinia pestis KIM
agccuacaugga

SEQ ID NO: 4213948 - RNA, 20 nt, Yersinia pestis KIM
agccuacauggauguauuua

SEQ ID NO: 4213949 - RNA, 19 nt, Yersinia pestis KIM
agccuauggcgguuccaaa

SEQ ID NO: 4213950 - RNA, 23 nt, Yersinia pestis KIM
agccucauacaagccgugaccaa

SEQ ID NO: 4213951 - RNA, 15 nt, Yersinia pestis KIM
agccucauucaugag

SEQ ID NO: 4213952 - RNA, 16 nt, Yersinia pestis KIM
agccucauucaugagg

SEQ ID NO: 4213953 - RNA, 20 nt, Yersinia pestis KIM
agccucauucaugaggcuca

SEQ ID NO: 4213954 - RNA, 15 nt, Yersinia pestis KIM
agccucggucacugc

SEQ ID NO: 4213955 - RNA, 19 nt, Yersinia pestis KIM
agccucgugagugaagggu

SEQ ID NO: 4213956 - RNA, 21 nt, Yersinia pestis KIM
agccucuagcuaacagugacc

SEQ ID NO: 4213957 - RNA, 15 nt, Yersinia pestis KIM
agccucugaucauuc

SEQ ID NO: 4213958 - RNA, 16 nt, Yersinia pestis KIM
agccucuguagccgca

SEQ ID NO: 4213959 - RNA, 16 nt, Yersinia pestis KIM
agccucuugcgcucca

SEQ ID NO: 4213960 - RNA, 12 nt, Yersinia pestis KIM
agccugaauucu

SEQ ID NO: 4213961 - RNA, 22 nt, Yersinia pestis KIM
agccugagcauucgaguuaacu

SEQ ID NO: 4213962 - RNA, 12 nt, Yersinia pestis KIM
agccugauacac

SEQ ID NO: 4213963 - RNA, 17 nt, Yersinia pestis KIM
agccugcacggcucagg

SEQ ID NO: 4213964 - RNA, 20 nt, Yersinia pestis KIM
agccugcacggcucaggugc

SEQ ID NO: 4213965 - RNA, 22 nt, Yersinia pestis KIM
agccugcacuucuacagggcau

SEQ ID NO: 4213966 - RNA, 15 nt, Yersinia pestis KIM
agccugcccccgacg

SEQ ID NO: 4213967 - RNA, 14 nt, Yersinia pestis KIM
agccuguaggccag

SEQ ID NO: 4213968 - RNA, 20 nt, Yersinia pestis KIM
agccugucggaagagauaga

SEQ ID NO: 4213969 - RNA, 15 nt, Yersinia pestis KIM
agccugucuuaggug

SEQ ID NO: 4213970 - RNA, 13 nt, Yersinia pestis KIM
agccugugcccaa

SEQ ID NO: 4213971 - RNA, 14 nt, Yersinia pestis KIM
agccuguuaauaau

SEQ ID NO: 4213972 - RNA, 21 nt, Yersinia pestis KIM
agccuguuauuuuucuucuuu

SEQ ID NO: 4213973 - RNA, 14 nt, Yersinia pestis KIM
agccuuaauguuuu

SEQ ID NO: 4213974 - RNA, 12 nt, Yersinia pestis KIM
agccuucccugg

SEQ ID NO: 4213975 - RNA, 15 nt, Yersinia pestis KIM
agccuugcauccggu

SEQ ID NO: 4213976 - RNA, 21 nt, Yersinia pestis KIM
agccuuuuuugcuuaaaacag

SEQ ID NO: 4213977 - RNA, 13 nt, Yersinia pestis KIM
agcgaacguaaaa

SEQ ID NO: 4213978 - RNA, 12 nt, Yersinia pestis KIM
agcgaauaaaua

SEQ ID NO: 4213979 - RNA, 15 nt, Yersinia pestis KIM
agcgaauaaauaauu

SEQ ID NO: 4213980 - RNA, 23 nt, Yersinia pestis KIM
agcgaauugacuuaacaguuaaa

SEQ ID NO: 4213981 - RNA, 17 nt, Yersinia pestis KIM
agcgacaaaagugucau

SEQ ID NO: 4213982 - RNA, 13 nt, Yersinia pestis KIM
agcgacaaccugu

SEQ ID NO: 4213983 - RNA, 16 nt, Yersinia pestis KIM
agcgacaaccuguagc

SEQ ID NO: 4213984 - RNA, 14 nt, Yersinia pestis KIM
agcgacacuuauug

SEQ ID NO: 4213985 - RNA, 21 nt, Yersinia pestis KIM
agcgacacuuauuggucgcuu

SEQ ID NO: 4213986 - RNA, 22 nt, Yersinia pestis KIM
agcgacgucccuaaagccaucg

SEQ ID NO: 4213987 - RNA, 11 nt, Yersinia pestis KIM
agcgaggauaa

SEQ ID NO: 4213988 - RNA, 13 nt, Yersinia pestis KIM
agcucaucaccaa

SEQ ID NO: 4213989 - RNA, 17 nt, Yersinia pestis KIM
agcucgcuguggcuacc

SEQ ID NO: 4213990 - RNA, 19 nt, Yersinia pestis KIM
agcucgcuguggcuaccau

SEQ ID NO: 4213991 - RNA, 21 nt, Yersinia pestis KIM
agcucguugguggauaagcuc

SEQ ID NO: 4213992 - RNA, 22 nt, Yersinia pestis KIM
agcucguugguggauaagcucu

SEQ ID NO: 4213993 - RNA, 19 nt, Yersinia pestis KIM
agcucugacaaaaugccag

SEQ ID NO: 4213994 - RNA, 14 nt, Yersinia pestis KIM
agcucuucugccag

SEQ ID NO: 4213995 - RNA, 17 nt, Yersinia pestis KIM
agcugaauagccuugau

SEQ ID NO: 4213996 - RNA, 24 nt, Yersinia pestis KIM
agcugaauugcuuauccagccgcu

SEQ ID NO: 4213997 - RNA, 17 nt, Yersinia pestis KIM
agcugaugauuggcuuc

SEQ ID NO: 4213998 - RNA, 14 nt, Yersinia pestis KIM
agcugcaauugccg

SEQ ID NO: 4213999 - RNA, 15 nt, Yersinia pestis KIM
agcugcaauugccgc

SEQ ID NO: 4214000 - RNA, 16 nt, Yersinia pestis KIM
agcugcugcuuucagu

SEQ ID NO: 4214001 - RNA, 22 nt, Yersinia pestis KIM
agcugcuuuaucguagccaaua

SEQ ID NO: 4214002 - RNA, 17 nt, Yersinia pestis KIM
agcuggcgcacucaucc

SEQ ID NO: 4214003 - RNA, 16 nt, Yersinia pestis KIM
agcuggcuucaaaauc

SEQ ID NO: 4214004 - RNA, 19 nt, Yersinia pestis KIM
agcuguagaacuuguucau

SEQ ID NO: 4214005 - RNA, 18 nt, Yersinia pestis KIM
agcuguagcaauauaucu

SEQ ID NO: 4214006 - RNA, 13 nt, Yersinia pestis KIM
agcuguuguuguu

SEQ ID NO: 4214007 - RNA, 21 nt, Yersinia pestis KIM
agcuguuuccugagucuguuu

SEQ ID NO: 4214008 - RNA, 14 nt, Yersinia pestis KIM
agcuguuugcaccu

SEQ ID NO: 4214009 - RNA, 16 nt, Yersinia pestis KIM
agcuguuugcaccuuu

SEQ ID NO: 4214010 - RNA, 21 nt, Yersinia pestis KIM
agcuuacaccauguucuucaa

SEQ ID NO: 4214011 - RNA, 16 nt, Yersinia pestis KIM
agcuuauauuauucau

SEQ ID NO: 4214012 - RNA, 23 nt, Yersinia pestis KIM
agcuucaagguacugauaaugga

SEQ ID NO: 4214013 - RNA, 18 nt, Yersinia pestis KIM
agcuuccaacugauaaac

SEQ ID NO: 4214014 - RNA, 20 nt, Yersinia pestis KIM
agcuuccagcaccccuucac

SEQ ID NO: 4214015 - RNA, 11 nt, Yersinia pestis KIM
agcuucccugg

SEQ ID NO: 4214016 - RNA, 17 nt, Yersinia pestis KIM
agcuuccgcuucaacuu

SEQ ID NO: 4214017 - RNA, 22 nt, Yersinia pestis KIM
agcuucugcuauaaccccggcc

SEQ ID NO: 4214018 - RNA, 15 nt, Yersinia pestis KIM
agcuucuucaaaagc

SEQ ID NO: 4214019 - RNA, 16 nt, Yersinia pestis KIM
agcuucuucaaaagca

SEQ ID NO: 4214020 - RNA, 19 nt, Yersinia pestis KIM
agcuucuucaaaagcaagu

SEQ ID NO: 4214021 - RNA, 13 nt, Yersinia pestis KIM
agcuucuuuuaaa

SEQ ID NO: 4214022 - RNA, 24 nt, Yersinia pestis KIM
agcuugacgaccaauaucauaaua

SEQ ID NO: 4214023 - RNA, 20 nt, Yersinia pestis KIM
agcuugauagggcugaagac

SEQ ID NO: 4214024 - RNA, 21 nt, Yersinia pestis KIM
agcuugcaacaaaauggccuu

SEQ ID NO: 4214025 - RNA, 14 nt, Yersinia pestis KIM
agcuugcuggcggc

SEQ ID NO: 4214026 - RNA, 14 nt, Yersinia pestis KIM
agcuuggggauggc

SEQ ID NO: 4214027 - RNA, 22 nt, Yersinia pestis KIM
agcuuguugauaucaaucucuu

SEQ ID NO: 4214028 - RNA, 14 nt, Yersinia pestis KIM
agcuuuaagaucca

SEQ ID NO: 4214029 - RNA, 20 nt, Yersinia pestis KIM
agcuuugugcaaaauacaaa

SEQ ID NO: 4214030 - RNA, 13 nt, Yersinia pestis KIM
agcuuuucacgag

SEQ ID NO: 4214031 - RNA, 18 nt, Yersinia pestis KIM
agcuuuucacgagagagc

SEQ ID NO: 4214032 - RNA, 20 nt, Yersinia pestis KIM
aggaaaacgcccccuaguga

SEQ ID NO: 4214033 - RNA, 12 nt, Yersinia pestis KIM
aggaaacucaug

SEQ ID NO: 4214034 - RNA, 13 nt, Yersinia pestis KIM
aggaaacuccagu

SEQ ID NO: 4214035 - RNA, 15 nt, Yersinia pestis KIM
aggaaauucacguuu

SEQ ID NO: 4214036 - RNA, 13 nt, Yersinia pestis KIM
aggaaauuucagu

SEQ ID NO: 4214037 - RNA, 20 nt, Yersinia pestis KIM
aggaacgaaguuagacccaa

SEQ ID NO: 4214038 - RNA, 14 nt, Yersinia pestis KIM
aggaagagaaaagc

SEQ ID NO: 4214039 - RNA, 21 nt, Yersinia pestis KIM
aggaaggcgguuaucuggaau

SEQ ID NO: 4214040 - RNA, 20 nt, Yersinia pestis KIM
aggaagggguucuuccaacg

SEQ ID NO: 4214041 - RNA, 16 nt, Yersinia pestis KIM
aggaaguccaguaaua

SEQ ID NO: 4214042 - RNA, 20 nt, Yersinia pestis KIM
aggaaguccaguaauaccuu

SEQ ID NO: 4214043 - RNA, 15 nt, Yersinia pestis KIM
aggaauaagguuuuu

SEQ ID NO: 4214044 - RNA, 15 nt, Yersinia pestis KIM
aggaaugcgcccuuu

SEQ ID NO: 4214045 - RNA, 17 nt, Yersinia pestis KIM
aggaauggcgugauauc

SEQ ID NO: 4214046 - RNA, 17 nt, Yersinia pestis KIM
aggacaaauagauuuaa

SEQ ID NO: 4214047 - RNA, 22 nt, Yersinia pestis KIM
aggacgaaggguaaaauaaaua

SEQ ID NO: 4214048 - RNA, 17 nt, Yersinia pestis KIM
aggacgacggguauauu

SEQ ID NO: 4214049 - RNA, 15 nt, Yersinia pestis KIM
aggacggaugguaaa

SEQ ID NO: 4214050 - RNA, 14 nt, Yersinia pestis KIM
aggacggugccaug

SEQ ID NO: 4214051 - RNA, 22 nt, Yersinia pestis KIM
aggacuauucaaugacuccuga

SEQ ID NO: 4214052 - RNA, 20 nt, Yersinia pestis KIM
aggacucugcgcucauacuc

SEQ ID NO: 4214053 - RNA, 19 nt, Yersinia pestis KIM
aggagaaacauuaaaccca

SEQ ID NO: 4214054 - RNA, 14 nt, Yersinia pestis KIM
aggagaauuuaggc

SEQ ID NO: 4214055 - RNA, 21 nt, Yersinia pestis KIM
aggagaucgauaaagccgagc

SEQ ID NO: 4214056 - RNA, 17 nt, Yersinia pestis KIM
aggagauuucagacugc

SEQ ID NO: 4214057 - RNA, 20 nt, Yersinia pestis KIM
aggagauuucagacugcuga

SEQ ID NO: 4214058 - RNA, 16 nt, Yersinia pestis KIM
aggagccauugauugg

SEQ ID NO: 4214059 - RNA, 15 nt, Yersinia pestis KIM
aggagcccucuguca

SEQ ID NO: 4214060 - RNA, 23 nt, Yersinia pestis KIM
aggagcgauaacauuuuuucuuu

SEQ ID NO: 4214061 - RNA, 17 nt, Yersinia pestis KIM
aggauaaucaucaguuu

SEQ ID NO: 4214062 - RNA, 23 nt, Yersinia pestis KIM
aggauagccaaccccucuggugu

SEQ ID NO: 4214063 - RNA, 21 nt, Yersinia pestis KIM
aggauaggcagaggaguaaag

SEQ ID NO: 4214064 - RNA, 15 nt, Yersinia pestis KIM
aggauagggagccaa

SEQ ID NO: 4214065 - RNA, 23 nt, Yersinia pestis KIM
aggaucugaagaauuacgcacua

SEQ ID NO: 4214066 - RNA, 14 nt, Yersinia pestis KIM
aggauggcccaagc

SEQ ID NO: 4214067 - RNA, 16 nt, Yersinia pestis KIM
aggauuaaauaaagau

SEQ ID NO: 4214068 - RNA, 15 nt, Yersinia pestis KIM
aggauuagcuucugc

SEQ ID NO: 4214069 - RNA, 17 nt, Yersinia pestis KIM
aggauuagcuucugcua

SEQ ID NO: 4214070 - RNA, 19 nt, Yersinia pestis KIM
aggauuccguuuuacccuc

SEQ ID NO: 4214071 - RNA, 19 nt, Yersinia pestis KIM
aggauucuguuaccucgcc

SEQ ID NO: 4214072 - RNA, 16 nt, Yersinia pestis KIM
aggauugaccaauaaa

SEQ ID NO: 4214073 - RNA, 23 nt, Yersinia pestis KIM
aggauuggagucaugaggcagug

SEQ ID NO: 4214074 - RNA, 16 nt, Yersinia pestis KIM
aggauuucauaccgcu

SEQ ID NO: 4214075 - RNA, 21 nt, Yersinia pestis KIM
aggauuuuccgcagcucaccu

SEQ ID NO: 4214076 - RNA, 20 nt, Yersinia pestis KIM
aggcaaaaugaucaucagca

SEQ ID NO: 4214077 - RNA, 11 nt, Yersinia pestis KIM
aggcaaagaag

SEQ ID NO: 4214078 - RNA, 13 nt, Yersinia pestis KIM
aggcaaagaagaa

SEQ ID NO: 4214079 - RNA, 15 nt, Yersinia pestis KIM
aggcaaauucucaau

SEQ ID NO: 4214080 - RNA, 18 nt, Yersinia pestis KIM
aggcaaauucucaaugau

SEQ ID NO: 4214081 - RNA, 16 nt, Yersinia pestis KIM
aggcaacaacacccga

SEQ ID NO: 4214082 - RNA, 18 nt, Yersinia pestis KIM
aggcaaccuuggugaaga

SEQ ID NO: 4214083 - RNA, 14 nt, Yersinia pestis KIM
aggcaacgaaggca

SEQ ID NO: 4214084 - RNA, 11 nt, Yersinia pestis KIM
aggcaagaaac

SEQ ID NO: 4214085 - RNA, 14 nt, Yersinia pestis KIM
aggcaauaagaaua

SEQ ID NO: 4214086 - RNA, 15 nt, Yersinia pestis KIM
aggcaauaccaauau

SEQ ID NO: 4214087 - RNA, 14 nt, Yersinia pestis KIM
aggcaaugagugca

SEQ ID NO: 4214088 - RNA, 14 nt, Yersinia pestis KIM
aggcaauuauccau

SEQ ID NO: 4214089 - RNA, 23 nt, Yersinia pestis KIM
aggcacaucuccagaauauaaaa

SEQ ID NO: 4214090 - RNA, 22 nt, Yersinia pestis KIM
aggcaccagagagguuucagua

SEQ ID NO: 4214091 - RNA, 11 nt, Yersinia pestis KIM
aggcaccagcg

SEQ ID NO: 4214092 - RNA, 18 nt, Yersinia pestis KIM
aggcaccguugaggugcc

SEQ ID NO: 4214093 - RNA, 20 nt, Yersinia pestis KIM
aggcaccucaacggugccuc

SEQ ID NO: 4214094 - RNA, 16 nt, Yersinia pestis KIM
aggcacgagcggugga

SEQ ID NO: 4214095 - RNA, 16 nt, Yersinia pestis KIM
aggcacgugccgcugg

SEQ ID NO: 4214096 - RNA, 18 nt, Yersinia pestis KIM
aggcacuuguuuugccag

SEQ ID NO: 4214097 - RNA, 14 nt, Yersinia pestis KIM
aggcagaaauaaua

SEQ ID NO: 4214098 - RNA, 18 nt, Yersinia pestis KIM
aggcagaaauaauaucaa

SEQ ID NO: 4214099 - RNA, 14 nt, Yersinia pestis KIM
aggcagaggaagua

SEQ ID NO: 4214100 - RNA, 20 nt, Yersinia pestis KIM
aggcagaggaguaaagcguc

SEQ ID NO: 4214101 - RNA, 15 nt, Yersinia pestis KIM
aggcaguauuccaau

SEQ ID NO: 4214102 - RNA, 15 nt, Yersinia pestis KIM
aggcauauacaaccu

SEQ ID NO: 4214103 - RNA, 19 nt, Yersinia pestis KIM
aggggguuuuccccucaga

SEQ ID NO: 4214104 - RNA, 22 nt, Yersinia pestis KIM
aggggugauguugacguucagg

SEQ ID NO: 4214105 - RNA, 23 nt, Yersinia pestis KIM
aggggugcuguuccaaccaaccu

SEQ ID NO: 4214106 - RNA, 18 nt, Yersinia pestis KIM
aggguaagccucaaggau

SEQ ID NO: 4214107 - RNA, 22 nt, Yersinia pestis KIM
aggguacuguugaugcagauga

SEQ ID NO: 4214108 - RNA, 17 nt, Yersinia pestis KIM
agggugaaagcccaacu

SEQ ID NO: 4214109 - RNA, 19 nt, Yersinia pestis KIM
aggguggaaacagguagug

SEQ ID NO: 4214110 - RNA, 17 nt, Yersinia pestis KIM
aggguuaaccagaagaa

SEQ ID NO: 4214111 - RNA, 17 nt, Yersinia pestis KIM
aggguucaguaaaacca

SEQ ID NO: 4214112 - RNA, 22 nt, Yersinia pestis KIM
aggguugagccaauuaagaaau

SEQ ID NO: 4214113 - RNA, 20 nt, Yersinia pestis KIM
aggguugcgggccucuucuu

SEQ ID NO: 4214114 - RNA, 13 nt, Yersinia pestis KIM
aggguugucagca

SEQ ID NO: 4214115 - RNA, 21 nt, Yersinia pestis KIM
agguaaacagacacagcaaca

SEQ ID NO: 4214116 - RNA, 19 nt, Yersinia pestis KIM
agguaaaccgguuaaaaca

SEQ ID NO: 4214117 - RNA, 20 nt, Yersinia pestis KIM
agguaaaccgguuaaaacag

SEQ ID NO: 4214118 - RNA, 22 nt, Yersinia pestis KIM
agguaaaccgguuaaaacagau

SEQ ID NO: 4214119 - RNA, 20 nt, Yersinia pestis KIM
agguaacgggagauuaauac

SEQ ID NO: 4214120 - RNA, 16 nt, Yersinia pestis KIM
agguaacuaagcugcc

SEQ ID NO: 4214121 - RNA, 19 nt, Yersinia pestis KIM
agguaauacucauccagau

SEQ ID NO: 4214122 - RNA, 17 nt, Yersinia pestis KIM
agguaaugguaaaaaau

SEQ ID NO: 4214123 - RNA, 12 nt, Yersinia pestis KIM
agguaauuaaac

SEQ ID NO: 4214124 - RNA, 21 nt, Yersinia pestis KIM
agguaccccauaaaucccgag

SEQ ID NO: 4214125 - RNA, 22 nt, Yersinia pestis KIM
agguaccgcugcccggcucauc

SEQ ID NO: 4214126 - RNA, 15 nt, Yersinia pestis KIM
agguacggccagcaa

SEQ ID NO: 4214127 - RNA, 17 nt, Yersinia pestis KIM
agguacggccagcaaug

SEQ ID NO: 4214128 - RNA, 18 nt, Yersinia pestis KIM
agguaguuacagcaaaua

SEQ ID NO: 4214129 - RNA, 19 nt, Yersinia pestis KIM
agguaucauuuuccugcau

SEQ ID NO: 4214130 - RNA, 23 nt, Yersinia pestis KIM
agguaucucguaacaacggcugg

SEQ ID NO: 4214131 - RNA, 21 nt, Yersinia pestis KIM
agguaugacggggauauaugg

SEQ ID NO: 4214132 - RNA, 18 nt, Yersinia pestis KIM
agguaugugccaaaaaaa

SEQ ID NO: 4214133 - RNA, 18 nt, Yersinia pestis KIM
agguauuacaggccccuu

SEQ ID NO: 4214134 - RNA, 11 nt, Yersinia pestis KIM
agguauucagc

SEQ ID NO: 4214135 - RNA, 11 nt, Yersinia pestis KIM
aggucaggaag

SEQ ID NO: 4214136 - RNA, 20 nt, Yersinia pestis KIM
aggucaggaagagaaaagca

SEQ ID NO: 4214137 - RNA, 19 nt, Yersinia pestis KIM
aggucagugguuuuaucaa

SEQ ID NO: 4214138 - RNA, 19 nt, Yersinia pestis KIM
aggucgaugaacugcacgu

SEQ ID NO: 4214139 - RNA, 23 nt, Yersinia pestis KIM
aggucucgcaaugaaaguggcca

SEQ ID NO: 4214140 - RNA, 16 nt, Yersinia pestis KIM
aggugacaggcaaaga

SEQ ID NO: 4214141 - RNA, 19 nt, Yersinia pestis KIM
aggugacaggcaaagacua

SEQ ID NO: 4214142 - RNA, 22 nt, Yersinia pestis KIM
aggugagcacuucguagugacu

SEQ ID NO: 4214143 - RNA, 13 nt, Yersinia pestis KIM
aggugauuucaaa

SEQ ID NO: 4214144 - RNA, 13 nt, Yersinia pestis KIM
aggugcaguaacc

SEQ ID NO: 4214145 - RNA, 17 nt, Yersinia pestis KIM
aggugcaguuucuaccg

SEQ ID NO: 4214146 - RNA, 21 nt, Yersinia pestis KIM
aggugcauccacauauauaga

SEQ ID NO: 4214147 - RNA, 22 nt, Yersinia pestis KIM
aggugccuuuuaacguuagagc

SEQ ID NO: 4214148 - RNA, 22 nt, Yersinia pestis KIM
aggugcgccaguggcaucaaua

SEQ ID NO: 4214149 - RNA, 18 nt, Yersinia pestis KIM
aggugguuuuggccggga

SEQ ID NO: 4214150 - RNA, 23 nt, Yersinia pestis KIM
aggugucaucaaggcaaccauca

SEQ ID NO: 4214151 - RNA, 19 nt, Yersinia pestis KIM
agguguucuacagggaaaa

SEQ ID NO: 4214152 - RNA, 21 nt, Yersinia pestis KIM
agguguucuacagggaaaaac

SEQ ID NO: 4214153 - RNA, 17 nt, Yersinia pestis KIM
agguguuucgugccgca

SEQ ID NO: 4214154 - RNA, 15 nt, Yersinia pestis KIM
agguuaacagccccg

SEQ ID NO: 4214155 - RNA, 13 nt, Yersinia pestis KIM
agguuaacugcag

SEQ ID NO: 4214156 - RNA, 16 nt, Yersinia pestis KIM
agguuaacugcaguga

SEQ ID NO: 4214157 - RNA, 14 nt, Yersinia pestis KIM
agguuacugcccug

SEQ ID NO: 4214158 - RNA, 20 nt, Yersinia pestis KIM
agguucaauaauuauaccua

SEQ ID NO: 4214159 - RNA, 13 nt, Yersinia pestis KIM
agguucaauuccc

SEQ ID NO: 4214160 - RNA, 18 nt, Yersinia pestis KIM
agguucauuacacagcau

SEQ ID NO: 4214161 - RNA, 13 nt, Yersinia pestis KIM
agguucuaaaccu

SEQ ID NO: 4214162 - RNA, 18 nt, Yersinia pestis KIM
agguugcagcuaaacacg

SEQ ID NO: 4214163 - RNA, 23 nt, Yersinia pestis KIM
agguugcauugccucccauugcu

SEQ ID NO: 4214164 - RNA, 20 nt, Yersinia pestis KIM
agguugcgccauuaccacug

SEQ ID NO: 4214165 - RNA, 18 nt, Yersinia pestis KIM
agguuggggaugccauuu

SEQ ID NO: 4214166 - RNA, 15 nt, Yersinia pestis KIM
agguuucagccucug

SEQ ID NO: 4214167 - RNA, 15 nt, Yersinia pestis KIM
agguuugcuccaccg

SEQ ID NO: 4214168 - RNA, 23 nt, Yersinia pestis KIM
agguuuuucauaugcgccuauaa

SEQ ID NO: 4214169 - RNA, 18 nt, Yersinia pestis KIM
agguuuuuucaccaacca

SEQ ID NO: 4214170 - RNA, 22 nt, Yersinia pestis KIM
aguaaaaauauuaacugcagug

SEQ ID NO: 4214171 - RNA, 23 nt, Yersinia pestis KIM
aguaaaaauauuaacugcaguga

SEQ ID NO: 4214172 - RNA, 21 nt, Yersinia pestis KIM
aguaaaacugauauaaagcau

SEQ ID NO: 4214173 - RNA, 13 nt, Yersinia pestis KIM
aguaaaagucagc

SEQ ID NO: 4214174 - RNA, 16 nt, Yersinia pestis KIM
aguaaaauauugauau

SEQ ID NO: 4214175 - RNA, 20 nt, Yersinia pestis KIM
aguaaagcaaauucccacca

SEQ ID NO: 4214176 - RNA, 12 nt, Yersinia pestis KIM
aguaaagcuuuc

SEQ ID NO: 4214177 - RNA, 14 nt, Yersinia pestis KIM
aguaaauaccuuca

SEQ ID NO: 4214178 - RNA, 12 nt, Yersinia pestis KIM
aguaaauagcaa

SEQ ID NO: 4214179 - RNA, 12 nt, Yersinia pestis KIM
aguaaauauauc

SEQ ID NO: 4214180 - RNA, 15 nt, Yersinia pestis KIM
aguaaaucaggccgg

SEQ ID NO: 4214181 - RNA, 19 nt, Yersinia pestis KIM
aguaaauccugaugaccag

SEQ ID NO: 4214182 - RNA, 23 nt, Yersinia pestis KIM
aguaaauucgggcuuuaauacaa

SEQ ID NO: 4214183 - RNA, 20 nt, Yersinia pestis KIM
aguaacaaaaugcgguggca

SEQ ID NO: 4214184 - RNA, 22 nt, Yersinia pestis KIM
aguaacaaaaugcgguggcacu

SEQ ID NO: 4214185 - RNA, 19 nt, Yersinia pestis KIM
aguaacacguuuaacucau

SEQ ID NO: 4214186 - RNA, 20 nt, Yersinia pestis KIM
aguaaccccuucgagcaccg

SEQ ID NO: 4214187 - RNA, 22 nt, Yersinia pestis KIM
aguaaccccuucgagcaccgcg

SEQ ID NO: 4214188 - RNA, 11 nt, Yersinia pestis KIM
aguaaccgggc

SEQ ID NO: 4214189 - RNA, 21 nt, Yersinia pestis KIM
aguaaccgggcuugauuaaau

SEQ ID NO: 4214190 - RNA, 19 nt, Yersinia pestis KIM
aguaacgccauaaucgcuu

SEQ ID NO: 4214191 - RNA, 16 nt, Yersinia pestis KIM
aguaacggaauucaga

SEQ ID NO: 4214192 - RNA, 14 nt, Yersinia pestis KIM
aguaacguccaacu

SEQ ID NO: 4214193 - RNA, 16 nt, Yersinia pestis KIM
aguaacuguaaggcca

SEQ ID NO: 4214194 - RNA, 21 nt, Yersinia pestis KIM
aguaagccugaugccuugauc

SEQ ID NO: 4214195 - RNA, 16 nt, Yersinia pestis KIM
aguaagcguuuacucg

SEQ ID NO: 4214196 - RNA, 11 nt, Yersinia pestis KIM
aguaaggcagc

SEQ ID NO: 4214197 - RNA, 18 nt, Yersinia pestis KIM
aguaaggcagcaagugaa

SEQ ID NO: 4214198 - RNA, 18 nt, Yersinia pestis KIM
aguaaggccaauuggcuu

SEQ ID NO: 4214199 - RNA, 12 nt, Yersinia pestis KIM
aguaagguuuua

SEQ ID NO: 4214200 - RNA, 18 nt, Yersinia pestis KIM
aguaagugauucggguga

SEQ ID NO: 4214201 - RNA, 20 nt, Yersinia pestis KIM
aguaauacuggcaguaaaac

SEQ ID NO: 4214202 - RNA, 13 nt, Yersinia pestis KIM
aguaauagcaaaa

SEQ ID NO: 4214203 - RNA, 19 nt, Yersinia pestis KIM
aguaauagcaaaaaaaaag

SEQ ID NO: 4214204 - RNA, 17 nt, Yersinia pestis KIM
aguaauauuauucaauu

SEQ ID NO: 4214205 - RNA, 18 nt, Yersinia pestis KIM
aguaaucaggcauuacag

SEQ ID NO: 4214206 - RNA, 15 nt, Yersinia pestis KIM
aguaaucgccaggcg

SEQ ID NO: 4214207 - RNA, 19 nt, Yersinia pestis KIM
aguaaugaggcuaccugca

SEQ ID NO: 4214208 - RNA, 23 nt, Yersinia pestis KIM
aguaaugaggcuaccugcaccaa

SEQ ID NO: 4214209 - RNA, 13 nt, Yersinia pestis KIM
aguaaugggauca

SEQ ID NO: 4214210 - RNA, 18 nt, Yersinia pestis KIM
aguaauuaauuaugauaa

SEQ ID NO: 4214211 - RNA, 13 nt, Yersinia pestis KIM
aguaauucacccu

SEQ ID NO: 4214212 - RNA, 14 nt, Yersinia pestis KIM
aguaauuuccuugg

SEQ ID NO: 4214213 - RNA, 13 nt, Yersinia pestis KIM
aguacaaaaaaca

SEQ ID NO: 4214214 - RNA, 15 nt, Yersinia pestis KIM
aguacaaaaaacaaa

SEQ ID NO: 4214215 - RNA, 13 nt, Yersinia pestis KIM
aguaccagcaaag

SEQ ID NO: 4214216 - RNA, 14 nt, Yersinia pestis KIM
aguacgcuggccag

SEQ ID NO: 4214217 - RNA, 18 nt, Yersinia pestis KIM
agugaacguagcuaacac

SEQ ID NO: 4214218 - RNA, 12 nt, Yersinia pestis KIM
agugaagacauc

SEQ ID NO: 4214219 - RNA, 15 nt, Yersinia pestis KIM
agugaaguaucacca

SEQ ID NO: 4214220 - RNA, 16 nt, Yersinia pestis KIM
agugaaguaucaccac

SEQ ID NO: 4214221 - RNA, 15 nt, Yersinia pestis KIM
agugaauaacgcuga

SEQ ID NO: 4214222 - RNA, 11 nt, Yersinia pestis KIM
agugaaucagc

SEQ ID NO: 4214223 - RNA, 16 nt, Yersinia pestis KIM
agugaaucaucaauac

SEQ ID NO: 4214224 - RNA, 16 nt, Yersinia pestis KIM
agugaaugcugcgugu

SEQ ID NO: 4214225 - RNA, 15 nt, Yersinia pestis KIM
agugacaacaaaaaa

SEQ ID NO: 4214226 - RNA, 13 nt, Yersinia pestis KIM
agugacagccaca

SEQ ID NO: 4214227 - RNA, 14 nt, Yersinia pestis KIM
agugacagccacaa

SEQ ID NO: 4214228 - RNA, 19 nt, Yersinia pestis KIM
agugacccaagaugaccac

SEQ ID NO: 4214229 - RNA, 18 nt, Yersinia pestis KIM
agugaccuuauauaacua

SEQ ID NO: 4214230 - RNA, 23 nt, Yersinia pestis KIM
agugacgaugagcuaccggcuga

SEQ ID NO: 4214231 - RNA, 23 nt, Yersinia pestis KIM
agugacguaaaaaggcagugaca

SEQ ID NO: 4214232 - RNA, 15 nt, Yersinia pestis KIM
agugacguugauucu

SEQ ID NO: 4214233 - RNA, 22 nt, Yersinia pestis KIM
agugacuucgcugcuaaacagg

SEQ ID NO: 4214234 - RNA, 22 nt, Yersinia pestis KIM
agugagaaggguauugaagaua

SEQ ID NO: 4214235 - RNA, 17 nt, Yersinia pestis KIM
agugagcgcgggucaug

SEQ ID NO: 4214236 - RNA, 21 nt, Yersinia pestis KIM
agugagucaguaacuggauau

SEQ ID NO: 4214237 - RNA, 16 nt, Yersinia pestis KIM
agugaguuaacgagug

SEQ ID NO: 4214238 - RNA, 14 nt, Yersinia pestis KIM
agugauaaaaagag

SEQ ID NO: 4214239 - RNA, 15 nt, Yersinia pestis KIM
agugauagcgggccu

SEQ ID NO: 4214240 - RNA, 21 nt, Yersinia pestis KIM
agugauagugaguauguaucc

SEQ ID NO: 4214241 - RNA, 15 nt, Yersinia pestis KIM
agugaugacuagcga

SEQ ID NO: 4214242 - RNA, 13 nt, Yersinia pestis KIM
agugaugauauuu

SEQ ID NO: 4214243 - RNA, 15 nt, Yersinia pestis KIM
agugaugggggcaau

SEQ ID NO: 4214244 - RNA, 21 nt, Yersinia pestis KIM
agugauuauagcggcaaggau

SEQ ID NO: 4214245 - RNA, 18 nt, Yersinia pestis KIM
agugauucgagugcguga

SEQ ID NO: 4214246 - RNA, 19 nt, Yersinia pestis KIM
agugauucgggugagugaa

SEQ ID NO: 4214247 - RNA, 16 nt, Yersinia pestis KIM
agugauuguuugauua

SEQ ID NO: 4214248 - RNA, 20 nt, Yersinia pestis KIM
agugauuguuugauuauugu

SEQ ID NO: 4214249 - RNA, 13 nt, Yersinia pestis KIM
agugauuucagug

SEQ ID NO: 4214250 - RNA, 22 nt, Yersinia pestis KIM
agugauuucagugucaguucga

SEQ ID NO: 4214251 - RNA, 16 nt, Yersinia pestis KIM
agugauuucuuacagu

SEQ ID NO: 4214252 - RNA, 19 nt, Yersinia pestis KIM
agugcaaccaacaccaaug

SEQ ID NO: 4214253 - RNA, 17 nt, Yersinia pestis KIM
agugcaauaaauucaaa

SEQ ID NO: 4214254 - RNA, 21 nt, Yersinia pestis KIM
agugcaauuauuuagccugcc

SEQ ID NO: 4214255 - RNA, 12 nt, Yersinia pestis KIM
agugcacugaac

SEQ ID NO: 4214256 - RNA, 14 nt, Yersinia pestis KIM
agugcagccaagau

SEQ ID NO: 4214257 - RNA, 22 nt, Yersinia pestis KIM
agugcauccagcguaaacagua

SEQ ID NO: 4214258 - RNA, 16 nt, Yersinia pestis KIM
agugcauccccacuga

SEQ ID NO: 4214259 - RNA, 18 nt, Yersinia pestis KIM
agugcccgcgggggcccc

SEQ ID NO: 4214260 - RNA, 22 nt, Yersinia pestis KIM
agugccgcggcggccagcggca

SEQ ID NO: 4214261 - RNA, 18 nt, Yersinia pestis KIM
agugccuaucugaaugcu

SEQ ID NO: 4214262 - RNA, 17 nt, Yersinia pestis KIM
agugcgacgauaaaggc

SEQ ID NO: 4214263 - RNA, 23 nt, Yersinia pestis KIM
agugcgauguuuuccaacuccau

SEQ ID NO: 4214264 - RNA, 17 nt, Yersinia pestis KIM
agugcgcuacgcaugau

SEQ ID NO: 4214265 - RNA, 22 nt, Yersinia pestis KIM
agugcgcuacgcaugaugcugc

SEQ ID NO: 4214266 - RNA, 18 nt, Yersinia pestis KIM
agugcggcauguacaccg

SEQ ID NO: 4214267 - RNA, 23 nt, Yersinia pestis KIM
agugcggccaccuaucuauuuuu

SEQ ID NO: 4214268 - RNA, 13 nt, Yersinia pestis KIM
agugcgguaacca

SEQ ID NO: 4214269 - RNA, 15 nt, Yersinia pestis KIM
agugcguuuuauuca

SEQ ID NO: 4214270 - RNA, 16 nt, Yersinia pestis KIM
agugcuacagcagcag

SEQ ID NO: 4214271 - RNA, 15 nt, Yersinia pestis KIM
agugcuauccucuua

SEQ ID NO: 4214272 - RNA, 20 nt, Yersinia pestis KIM
agugcucaccuaggcuuuca

SEQ ID NO: 4214273 - RNA, 16 nt, Yersinia pestis KIM
agugcuggcaagcccu

SEQ ID NO: 4214274 - RNA, 16 nt, Yersinia pestis KIM
agugcuuaacccacca

SEQ ID NO: 4214275 - RNA, 15 nt, Yersinia pestis KIM
aguggaaaaacugaa

SEQ ID NO: 4214276 - RNA, 16 nt, Yersinia pestis KIM
aguggaugauaaauau

SEQ ID NO: 4214277 - RNA, 21 nt, Yersinia pestis KIM
aguggaugauaaauaucauua

SEQ ID NO: 4214278 - RNA, 15 nt, Yersinia pestis KIM
aguggcacaaauaaa

SEQ ID NO: 4214279 - RNA, 16 nt, Yersinia pestis KIM
aguggcacaaauaaaa

SEQ ID NO: 4214280 - RNA, 16 nt, Yersinia pestis KIM
aguggcgguaucacuu

SEQ ID NO: 4214281 - RNA, 16 nt, Yersinia pestis KIM
aguggcuuaauugaag

SEQ ID NO: 4214282 - RNA, 18 nt, Yersinia pestis KIM
agugggggugauauaugc

SEQ ID NO: 4214283 - RNA, 15 nt, Yersinia pestis KIM
aguggucauuaauuu

SEQ ID NO: 4214284 - RNA, 15 nt, Yersinia pestis KIM
aguggugagcgccau

SEQ ID NO: 4214285 - RNA, 13 nt, Yersinia pestis KIM
agugguucaccac

SEQ ID NO: 4214286 - RNA, 22 nt, Yersinia pestis KIM
aguguaaaaaccaucugaugca

SEQ ID NO: 4214287 - RNA, 14 nt, Yersinia pestis KIM
aguguaaaaagcag

SEQ ID NO: 4214288 - RNA, 21 nt, Yersinia pestis KIM
aguguaaaaagcagugcugaa

SEQ ID NO: 4214289 - RNA, 18 nt, Yersinia pestis KIM
aguguaauuggucaccuu

SEQ ID NO: 4214290 - RNA, 17 nt, Yersinia pestis KIM
aguguacuguuaacuca

SEQ ID NO: 4214291 - RNA, 19 nt, Yersinia pestis KIM
aguguacuguuaacucaug

SEQ ID NO: 4214292 - RNA, 18 nt, Yersinia pestis KIM
aguguaucaauaggauuu

SEQ ID NO: 4214293 - RNA, 21 nt, Yersinia pestis KIM
aguguauucgcaucuuccaaa

SEQ ID NO: 4214294 - RNA, 18 nt, Yersinia pestis KIM
aguguauuuaucaaaguu

SEQ ID NO: 4214295 - RNA, 16 nt, Yersinia pestis KIM
aguguccgcgccauaa

SEQ ID NO: 4214296 - RNA, 17 nt, Yersinia pestis KIM
aguguccgcgccauaaa

SEQ ID NO: 4214297 - RNA, 14 nt, Yersinia pestis KIM
agugugcaaauaaa

SEQ ID NO: 4214298 - RNA, 15 nt, Yersinia pestis KIM
agugugcaaauaaac

SEQ ID NO: 4214299 - RNA, 20 nt, Yersinia pestis KIM
agugugccuuggucucagaa

SEQ ID NO: 4214300 - RNA, 22 nt, Yersinia pestis KIM
agugugccuuggucucagaaca

SEQ ID NO: 4214301 - RNA, 23 nt, Yersinia pestis KIM
agugugccuuggucucagaacaa

SEQ ID NO: 4214302 - RNA, 16 nt, Yersinia pestis KIM
agugugcgcaucagcc

SEQ ID NO: 4214303 - RNA, 22 nt, Yersinia pestis KIM
agugugcugcgaagaucacuca

SEQ ID NO: 4214304 - RNA, 24 nt, Yersinia pestis KIM
agugugcugcgaagaucacucaug

SEQ ID NO: 4214305 - RNA, 17 nt, Yersinia pestis KIM
agugugugguauucacg

SEQ ID NO: 4214306 - RNA, 20 nt, Yersinia pestis KIM
agugugugugcgcugaguga

SEQ ID NO: 4214307 - RNA, 20 nt, Yersinia pestis KIM
aguguguuuucuuguauaua

SEQ ID NO: 4214308 - RNA, 18 nt, Yersinia pestis KIM
aguguucauaaauuaaaa

SEQ ID NO: 4214309 - RNA, 21 nt, Yersinia pestis KIM
aguguucggggguugucagca

SEQ ID NO: 4214310 - RNA, 22 nt, Yersinia pestis KIM
aguguucggggguugucagcag

SEQ ID NO: 4214311 - RNA, 13 nt, Yersinia pestis KIM
aguguugccaugg

SEQ ID NO: 4214312 - RNA, 15 nt, Yersinia pestis KIM
aguguugcgguuauu

SEQ ID NO: 4214313 - RNA, 17 nt, Yersinia pestis KIM
aguguugcgguuauuuu

SEQ ID NO: 4214314 - RNA, 20 nt, Yersinia pestis KIM
aguguuuuucucagcauaau

SEQ ID NO: 4214315 - RNA, 12 nt, Yersinia pestis KIM
aguuaaaaccag

SEQ ID NO: 4214316 - RNA, 14 nt, Yersinia pestis KIM
aguuaaaaccagua

SEQ ID NO: 4214317 - RNA, 17 nt, Yersinia pestis KIM
aguuaaaaccaguaacu

SEQ ID NO: 4214318 - RNA, 18 nt, Yersinia pestis KIM
aguuaaacaacgcugaaa

SEQ ID NO: 4214319 - RNA, 21 nt, Yersinia pestis KIM
aguuaaacgguaaccauccau

SEQ ID NO: 4214320 - RNA, 22 nt, Yersinia pestis KIM
aguuaaacgguaaccauccaua

SEQ ID NO: 4214321 - RNA, 16 nt, Yersinia pestis KIM
aguuaaagguaaaagg

SEQ ID NO: 4214322 - RNA, 12 nt, Yersinia pestis KIM
aguuaaauaaug

SEQ ID NO: 4214323 - RNA, 14 nt, Yersinia pestis KIM
aguuaaaugaagga

SEQ ID NO: 4214324 - RNA, 12 nt, Yersinia pestis KIM
aguuaacaccau

SEQ ID NO: 4214325 - RNA, 20 nt, Yersinia pestis KIM
aguuaacacgaaaagcagca

SEQ ID NO: 4214326 - RNA, 20 nt, Yersinia pestis KIM
aguuaacacgggcaugaacg

SEQ ID NO: 4214327 - RNA, 20 nt, Yersinia pestis KIM
aguuaacccuaccuaggcca

SEQ ID NO: 4214328 - RNA, 22 nt, Yersinia pestis KIM
aguuaacccuauuuuugccaau

SEQ ID NO: 4214329 - RNA, 22 nt, Yersinia pestis KIM
aguuaacggaaaugauaucuga

SEQ ID NO: 4214330 - RNA, 23 nt, Yersinia pestis KIM
aguuaauaccagaugcauauacu

SEQ ID NO: 4214331 - RNA, 16 nt, Yersinia pestis KIM
auaaaauaauaauggu

SEQ ID NO: 4214332 - RNA, 11 nt, Yersinia pestis KIM
auaaaauagcc

SEQ ID NO: 4214333 - RNA, 22 nt, Yersinia pestis KIM
auaaaauagcccagugcggaag

SEQ ID NO: 4214334 - RNA, 13 nt, Yersinia pestis KIM
auaaaaucaaaac

SEQ ID NO: 4214335 - RNA, 22 nt, Yersinia pestis KIM
auaaaaucaccgccggauuuca

SEQ ID NO: 4214336 - RNA, 13 nt, Yersinia pestis KIM
auaaaauccacua

SEQ ID NO: 4214337 - RNA, 16 nt, Yersinia pestis KIM
auaaaauccugaauaa

SEQ ID NO: 4214338 - RNA, 20 nt, Yersinia pestis KIM
auaaaauccugaauaauacu

SEQ ID NO: 4214339 - RNA, 16 nt, Yersinia pestis KIM
auaaaaucgaacccuu

SEQ ID NO: 4214340 - RNA, 12 nt, Yersinia pestis KIM
auaaaauuaacg

SEQ ID NO: 4214341 - RNA, 14 nt, Yersinia pestis KIM
auaaaauucagcca

SEQ ID NO: 4214342 - RNA, 22 nt, Yersinia pestis KIM
auaaaauucguuucucuaaaau

SEQ ID NO: 4214343 - RNA, 21 nt, Yersinia pestis KIM
auaaacaaucugaugaauuaa

SEQ ID NO: 4214344 - RNA, 15 nt, Yersinia pestis KIM
auaaacacccaagaa

SEQ ID NO: 4214345 - RNA, 20 nt, Yersinia pestis KIM
auaaacaccgugcuggguaa

SEQ ID NO: 4214346 - RNA, 23 nt, Yersinia pestis KIM
auaaacacuuaccuauaaacauu

SEQ ID NO: 4214347 - RNA, 16 nt, Yersinia pestis KIM
auaaacagacaaaaaa

SEQ ID NO: 4214348 - RNA, 15 nt, Yersinia pestis KIM
auaaacagacuaaaa

SEQ ID NO: 4214349 - RNA, 20 nt, Yersinia pestis KIM
auaaacaucaugacaaaaau

SEQ ID NO: 4214350 - RNA, 23 nt, Yersinia pestis KIM
auaaacauuuacuuauaaacacu

SEQ ID NO: 4214351 - RNA, 11 nt, Yersinia pestis KIM
auaaaccaaau

SEQ ID NO: 4214352 - RNA, 22 nt, Yersinia pestis KIM
auaaaccaauaucugccaauuc

SEQ ID NO: 4214353 - RNA, 17 nt, Yersinia pestis KIM
auaaaccauacauaaca

SEQ ID NO: 4214354 - RNA, 18 nt, Yersinia pestis KIM
auaaacccacagacauuu

SEQ ID NO: 4214355 - RNA, 22 nt, Yersinia pestis KIM
auaaacccgucgcucacuagca

SEQ ID NO: 4214356 - RNA, 20 nt, Yersinia pestis KIM
auaaaccuacagccaucggu

SEQ ID NO: 4214357 - RNA, 19 nt, Yersinia pestis KIM
auaaaccuagucucacuaa

SEQ ID NO: 4214358 - RNA, 21 nt, Yersinia pestis KIM
auaaacgaccauuucucugau

SEQ ID NO: 4214359 - RNA, 20 nt, Yersinia pestis KIM
auaaacgccagucagcuagc

SEQ ID NO: 4214360 - RNA, 19 nt, Yersinia pestis KIM
auaaacgcuuuugcugcaa

SEQ ID NO: 4214361 - RNA, 23 nt, Yersinia pestis KIM
auaaacgggugcaguaacauaau

SEQ ID NO: 4214362 - RNA, 22 nt, Yersinia pestis KIM
auaaacgucuuaugccauaaca

SEQ ID NO: 4214363 - RNA, 16 nt, Yersinia pestis KIM
auaaacugaaguuaaa

SEQ ID NO: 4214364 - RNA, 18 nt, Yersinia pestis KIM
auaaacugaaguuaaaaa

SEQ ID NO: 4214365 - RNA, 21 nt, Yersinia pestis KIM
auaaacugugcccuugagcua

SEQ ID NO: 4214366 - RNA, 16 nt, Yersinia pestis KIM
auaaacuucacaaugc

SEQ ID NO: 4214367 - RNA, 19 nt, Yersinia pestis KIM
auaaacuucacaaugcaca

SEQ ID NO: 4214368 - RNA, 12 nt, Yersinia pestis KIM
auaaagaaugcg

SEQ ID NO: 4214369 - RNA, 13 nt, Yersinia pestis KIM
auaaagagugaaa

SEQ ID NO: 4214370 - RNA, 16 nt, Yersinia pestis KIM
auaaagagugaaauau

SEQ ID NO: 4214371 - RNA, 15 nt, Yersinia pestis KIM
auaaagauaauguga

SEQ ID NO: 4214372 - RNA, 14 nt, Yersinia pestis KIM
auaaagauacccgc

SEQ ID NO: 4214373 - RNA, 14 nt, Yersinia pestis KIM
auaaagaugcaagc

SEQ ID NO: 4214374 - RNA, 21 nt, Yersinia pestis KIM
auaaagauggcauuaaaaauc

SEQ ID NO: 4214375 - RNA, 15 nt, Yersinia pestis KIM
auaaagcaucagacu

SEQ ID NO: 4214376 - RNA, 18 nt, Yersinia pestis KIM
auaaagcaucagacugcu

SEQ ID NO: 4214377 - RNA, 23 nt, Yersinia pestis KIM
auaaagccauuggucaaucuaga

SEQ ID NO: 4214378 - RNA, 22 nt, Yersinia pestis KIM
auaaagccgagcaagugaauaa

SEQ ID NO: 4214379 - RNA, 14 nt, Yersinia pestis KIM
auaaagcgguuggu

SEQ ID NO: 4214380 - RNA, 16 nt, Yersinia pestis KIM
auaaaggcaaaagcau

SEQ ID NO: 4214381 - RNA, 18 nt, Yersinia pestis KIM
auaaaggcuguaaugacu

SEQ ID NO: 4214382 - RNA, 15 nt, Yersinia pestis KIM
auaaaguuuuuccuc

SEQ ID NO: 4214383 - RNA, 13 nt, Yersinia pestis KIM
auaaauaaaauaa

SEQ ID NO: 4214384 - RNA, 14 nt, Yersinia pestis KIM
auaaauaaauuuaa

SEQ ID NO: 4214385 - RNA, 14 nt, Yersinia pestis KIM
auaaauaaccgagc

SEQ ID NO: 4214386 - RNA, 21 nt, Yersinia pestis KIM
auaaauaaccgagcgugaaga

SEQ ID NO: 4214387 - RNA, 17 nt, Yersinia pestis KIM
auaaauaauaucaauga

SEQ ID NO: 4214388 - RNA, 19 nt, Yersinia pestis KIM
auaaauaauuuguaaauuu

SEQ ID NO: 4214389 - RNA, 20 nt, Yersinia pestis KIM
auaaauaccgccaaauacaa

SEQ ID NO: 4214390 - RNA, 19 nt, Yersinia pestis KIM
auaaauaccggcaggaaag

SEQ ID NO: 4214391 - RNA, 11 nt, Yersinia pestis KIM
auaaauagucg

SEQ ID NO: 4214392 - RNA, 14 nt, Yersinia pestis KIM
auaaauauccuccg

SEQ ID NO: 4214393 - RNA, 18 nt, Yersinia pestis KIM
auaaauauucauuaaaaa

SEQ ID NO: 4214394 - RNA, 20 nt, Yersinia pestis KIM
auaaauauucauuaaaaaau

SEQ ID NO: 4214395 - RNA, 15 nt, Yersinia pestis KIM
auaaaucaugucccu

SEQ ID NO: 4214396 - RNA, 19 nt, Yersinia pestis KIM
auaaaucgcccaacccccc

SEQ ID NO: 4214397 - RNA, 20 nt, Yersinia pestis KIM
auaaaugaccaacuguaaaa

SEQ ID NO: 4214398 - RNA, 22 nt, Yersinia pestis KIM
auaaaugaccaacuguaaaauc

SEQ ID NO: 4214399 - RNA, 14 nt, Yersinia pestis KIM
auaaaugcaauauu

SEQ ID NO: 4214400 - RNA, 15 nt, Yersinia pestis KIM
auaaauggcauuuuu

SEQ ID NO: 4214401 - RNA, 17 nt, Yersinia pestis KIM
auaaauggucaguuuaa

SEQ ID NO: 4214402 - RNA, 18 nt, Yersinia pestis KIM
auaaauggucaguuuaau

SEQ ID NO: 4214403 - RNA, 20 nt, Yersinia pestis KIM
auaaaugguuauuauguaaa

SEQ ID NO: 4214404 - RNA, 14 nt, Yersinia pestis KIM
auaaaugucacuug

SEQ ID NO: 4214405 - RNA, 21 nt, Yersinia pestis KIM
auaaaugucgcuaauaggccu

SEQ ID NO: 4214406 - RNA, 14 nt, Yersinia pestis KIM
auaaauuaaaaaga

SEQ ID NO: 4214407 - RNA, 12 nt, Yersinia pestis KIM
auaaauuaaaac

SEQ ID NO: 4214408 - RNA, 19 nt, Yersinia pestis KIM
auaaauuaaaacugaaaag

SEQ ID NO: 4214409 - RNA, 22 nt, Yersinia pestis KIM
auaaauuacucguauaaaaaau

SEQ ID NO: 4214410 - RNA, 15 nt, Yersinia pestis KIM
auaaauuauaaugau

SEQ ID NO: 4214411 - RNA, 16 nt, Yersinia pestis KIM
auaaauuauaaugaug

SEQ ID NO: 4214412 - RNA, 14 nt, Yersinia pestis KIM
auaaauucaaaaua

SEQ ID NO: 4214413 - RNA, 17 nt, Yersinia pestis KIM
auaaauucaaauaucau

SEQ ID NO: 4214414 - RNA, 23 nt, Yersinia pestis KIM
auaaauucaaauaucauuauuuu

SEQ ID NO: 4214415 - RNA, 20 nt, Yersinia pestis KIM
auaaauugcacacccauaca

SEQ ID NO: 4214416 - RNA, 22 nt, Yersinia pestis KIM
auaaauugcuuugucaucaacc

SEQ ID NO: 4214417 - RNA, 13 nt, Yersinia pestis KIM
auaaauuuucuaa

SEQ ID NO: 4214418 - RNA, 18 nt, Yersinia pestis KIM
auaacaacgacuccauca

SEQ ID NO: 4214419 - RNA, 22 nt, Yersinia pestis KIM
auaacaacgacuccaucaccgu

SEQ ID NO: 4214420 - RNA, 20 nt, Yersinia pestis KIM
auaacaaguuacauuuuuaa

SEQ ID NO: 4214421 - RNA, 22 nt, Yersinia pestis KIM
auaacaauggccggacucauua

SEQ ID NO: 4214422 - RNA, 16 nt, Yersinia pestis KIM
auaacacauauauuau

SEQ ID NO: 4214423 - RNA, 20 nt, Yersinia pestis KIM
auaacacuuaauugguuuau

SEQ ID NO: 4214424 - RNA, 20 nt, Yersinia pestis KIM
auaacagauauuacgcagcc

SEQ ID NO: 4214425 - RNA, 12 nt, Yersinia pestis KIM
auaacagcuaaa

SEQ ID NO: 4214426 - RNA, 23 nt, Yersinia pestis KIM
auaacagcuaaucauugcaaugc

SEQ ID NO: 4214427 - RNA, 12 nt, Yersinia pestis KIM
auaacaguuuac

SEQ ID NO: 4214428 - RNA, 17 nt, Yersinia pestis KIM
auaacaguuuacgguga

SEQ ID NO: 4214429 - RNA, 17 nt, Yersinia pestis KIM
auaacauccauguaagc

SEQ ID NO: 4214430 - RNA, 18 nt, Yersinia pestis KIM
auaacaugggguaauccc

SEQ ID NO: 4214431 - RNA, 16 nt, Yersinia pestis KIM
auaacauuuuuucuuu

SEQ ID NO: 4214432 - RNA, 13 nt, Yersinia pestis KIM
auaaccacuucaa

SEQ ID NO: 4214433 - RNA, 18 nt, Yersinia pestis KIM
auaaccagaauaauccaa

SEQ ID NO: 4214434 - RNA, 20 nt, Yersinia pestis KIM
auaaccagaauaauccaagc

SEQ ID NO: 4214435 - RNA, 21 nt, Yersinia pestis KIM
auaaccauaaaauaaauaauu

SEQ ID NO: 4214436 - RNA, 18 nt, Yersinia pestis KIM
auaaccauuaauugguuu

SEQ ID NO: 4214437 - RNA, 23 nt, Yersinia pestis KIM
auaacccgccuagcaucauaaau

SEQ ID NO: 4214438 - RNA, 22 nt, Yersinia pestis KIM
auaaccgcagcaggcagagcaa

SEQ ID NO: 4214439 - RNA, 15 nt, Yersinia pestis KIM
auaaccgccggauaa

SEQ ID NO: 4214440 - RNA, 19 nt, Yersinia pestis KIM
auaaccgcgaagaggguuu

SEQ ID NO: 4214441 - RNA, 21 nt, Yersinia pestis KIM
auaaccgcguuauggagaggc

SEQ ID NO: 4214442 - RNA, 21 nt, Yersinia pestis KIM
auaaccgcuaaggccaaugga

SEQ ID NO: 4214443 - RNA, 17 nt, Yersinia pestis KIM
auaaccgucaccaaaau

SEQ ID NO: 4214444 - RNA, 14 nt, Yersinia pestis KIM
auaaccguuuuuuc

SEQ ID NO: 4214445 - RNA, 12 nt, Yersinia pestis KIM
auaauuacuuau

SEQ ID NO: 4214446 - RNA, 15 nt, Yersinia pestis KIM
auaauuacuuauaaa

SEQ ID NO: 4214447 - RNA, 22 nt, Yersinia pestis KIM
auaauuauccauuuucugccaa

SEQ ID NO: 4214448 - RNA, 15 nt, Yersinia pestis KIM
auaauuauuucucug

SEQ ID NO: 4214449 - RNA, 19 nt, Yersinia pestis KIM
auaauucacgucgccggug

SEQ ID NO: 4214450 - RNA, 12 nt, Yersinia pestis KIM
auaauucagacg

SEQ ID NO: 4214451 - RNA, 21 nt, Yersinia pestis KIM
auaauucagcaucaaauuauu

SEQ ID NO: 4214452 - RNA, 21 nt, Yersinia pestis KIM
auaauucauuuuuugggauga

SEQ ID NO: 4214453 - RNA, 14 nt, Yersinia pestis KIM
auaauuccacauaa

SEQ ID NO: 4214454 - RNA, 11 nt, Yersinia pestis KIM
auaauugaaga

SEQ ID NO: 4214455 - RNA, 17 nt, Yersinia pestis KIM
auaauugaagauuuaaa

SEQ ID NO: 4214456 - RNA, 22 nt, Yersinia pestis KIM
auaauugaguggcgaucuuaau

SEQ ID NO: 4214457 - RNA, 23 nt, Yersinia pestis KIM
auaauugcuacgacaguuuuuug

SEQ ID NO: 4214458 - RNA, 15 nt, Yersinia pestis KIM
auaauuggcaauaau

SEQ ID NO: 4214459 - RNA, 21 nt, Yersinia pestis KIM
auaauuguucauaaaccugau

SEQ ID NO: 4214460 - RNA, 15 nt, Yersinia pestis KIM
auaauuuagcaaagc

SEQ ID NO: 4214461 - RNA, 21 nt, Yersinia pestis KIM
auaauuucuacgccgucauca

SEQ ID NO: 4214462 - RNA, 23 nt, Yersinia pestis KIM
auaauuucuacgccgucaucauc

SEQ ID NO: 4214463 - RNA, 14 nt, Yersinia pestis KIM
auaauuugccuggc

SEQ ID NO: 4214464 - RNA, 17 nt, Yersinia pestis KIM
auaauuuuauggcguuu

SEQ ID NO: 4214465 - RNA, 21 nt, Yersinia pestis KIM
auaauuuuuacgauaucacca

SEQ ID NO: 4214466 - RNA, 18 nt, Yersinia pestis KIM
auacaaaaagcgacuaau

SEQ ID NO: 4214467 - RNA, 14 nt, Yersinia pestis KIM
auacaaauaaaaua

SEQ ID NO: 4214468 - RNA, 18 nt, Yersinia pestis KIM
auacaaccaacaaacaau

SEQ ID NO: 4214469 - RNA, 15 nt, Yersinia pestis KIM
auacaacgguuuaug

SEQ ID NO: 4214470 - RNA, 18 nt, Yersinia pestis KIM
auacaauccaaccuauau

SEQ ID NO: 4214471 - RNA, 15 nt, Yersinia pestis KIM
auacaauuauuuuua

SEQ ID NO: 4214472 - RNA, 11 nt, Yersinia pestis KIM
auacaauuuuu

SEQ ID NO: 4214473 - RNA, 23 nt, Yersinia pestis KIM
auacacagcacggcaacaggcuu

SEQ ID NO: 4214474 - RNA, 17 nt, Yersinia pestis KIM
auacacaugaaaaucaa

SEQ ID NO: 4214475 - RNA, 17 nt, Yersinia pestis KIM
auacaccauuuccaggc

SEQ ID NO: 4214476 - RNA, 21 nt, Yersinia pestis KIM
auacacccgaaggccauugcc

SEQ ID NO: 4214477 - RNA, 12 nt, Yersinia pestis KIM
auacaccgccag

SEQ ID NO: 4214478 - RNA, 18 nt, Yersinia pestis KIM
auacaccguaucugccaa

SEQ ID NO: 4214479 - RNA, 17 nt, Yersinia pestis KIM
auacacuggcagugcca

SEQ ID NO: 4214480 - RNA, 16 nt, Yersinia pestis KIM
auacagcauauaaaaa

SEQ ID NO: 4214481 - RNA, 16 nt, Yersinia pestis KIM
auacagccagcgggcg

SEQ ID NO: 4214482 - RNA, 19 nt, Yersinia pestis KIM
auacaggcuauauugcuga

SEQ ID NO: 4214483 - RNA, 16 nt, Yersinia pestis KIM
auacagguacuucaaa

SEQ ID NO: 4214484 - RNA, 19 nt, Yersinia pestis KIM
auacaggugucaucaaggc

SEQ ID NO: 4214485 - RNA, 17 nt, Yersinia pestis KIM
auacagucaauugagaa

SEQ ID NO: 4214486 - RNA, 20 nt, Yersinia pestis KIM
auacagucaauugagaauaa

SEQ ID NO: 4214487 - RNA, 23 nt, Yersinia pestis KIM
auacaguggcgagcgcaggguca

SEQ ID NO: 4214488 - RNA, 15 nt, Yersinia pestis KIM
auacaguuccuguuu

SEQ ID NO: 4214489 - RNA, 14 nt, Yersinia pestis KIM
auacaguuuugccg

SEQ ID NO: 4214490 - RNA, 18 nt, Yersinia pestis KIM
auacauaaaaucaauauc

SEQ ID NO: 4214491 - RNA, 22 nt, Yersinia pestis KIM
auacauaacaugguuacacaca

SEQ ID NO: 4214492 - RNA, 14 nt, Yersinia pestis KIM
auacauaccauaag

SEQ ID NO: 4214493 - RNA, 17 nt, Yersinia pestis KIM
auacauagaagcucaua

SEQ ID NO: 4214494 - RNA, 15 nt, Yersinia pestis KIM
auacauaucaacacu

SEQ ID NO: 4214495 - RNA, 13 nt, Yersinia pestis KIM
auacaucacguua

SEQ ID NO: 4214496 - RNA, 17 nt, Yersinia pestis KIM
auacauccuaaauaauu

SEQ ID NO: 4214497 - RNA, 20 nt, Yersinia pestis KIM
auacaucgcuggacgcauca

SEQ ID NO: 4214498 - RNA, 15 nt, Yersinia pestis KIM
auaccaaaaaucucu

SEQ ID NO: 4214499 - RNA, 12 nt, Yersinia pestis KIM
auaccaaauuua

SEQ ID NO: 4214500 - RNA, 17 nt, Yersinia pestis KIM
auaccaaauuuaccgac

SEQ ID NO: 4214501 - RNA, 19 nt, Yersinia pestis KIM
auaccaacucugaaguaaa

SEQ ID NO: 4214502 - RNA, 13 nt, Yersinia pestis KIM
auaccacaucaaa

SEQ ID NO: 4214503 - RNA, 14 nt, Yersinia pestis KIM
auaccaccaccaca

SEQ ID NO: 4214504 - RNA, 15 nt, Yersinia pestis KIM
auaccacuuaguggc

SEQ ID NO: 4214505 - RNA, 12 nt, Yersinia pestis KIM
auaccagagacg

SEQ ID NO: 4214506 - RNA, 14 nt, Yersinia pestis KIM
auaccagaugcaua

SEQ ID NO: 4214507 - RNA, 11 nt, Yersinia pestis KIM
auaccagcaag

SEQ ID NO: 4214508 - RNA, 20 nt, Yersinia pestis KIM
auaccagcaagaaucccauc

SEQ ID NO: 4214509 - RNA, 20 nt, Yersinia pestis KIM
auaccaggccacggccgccu

SEQ ID NO: 4214510 - RNA, 15 nt, Yersinia pestis KIM
auaccauaacgcugc

SEQ ID NO: 4214511 - RNA, 15 nt, Yersinia pestis KIM
auaccaugccaucaa

SEQ ID NO: 4214512 - RNA, 20 nt, Yersinia pestis KIM
auaccaugccaucaauguuc

SEQ ID NO: 4214513 - RNA, 21 nt, Yersinia pestis KIM
auaccauguugaaucaauugc

SEQ ID NO: 4214514 - RNA, 14 nt, Yersinia pestis KIM
auacccaaaauaau

SEQ ID NO: 4214515 - RNA, 14 nt, Yersinia pestis KIM
auacccaaaccaac

SEQ ID NO: 4214516 - RNA, 16 nt, Yersinia pestis KIM
auacccaacagguugg

SEQ ID NO: 4214517 - RNA, 20 nt, Yersinia pestis KIM
auacccagcuucuuuuaaag

SEQ ID NO: 4214518 - RNA, 12 nt, Yersinia pestis KIM
auacccugcacc

SEQ ID NO: 4214519 - RNA, 16 nt, Yersinia pestis KIM
auaccgcaaccauugc

SEQ ID NO: 4214520 - RNA, 18 nt, Yersinia pestis KIM
auaccgccacacaauaca

SEQ ID NO: 4214521 - RNA, 16 nt, Yersinia pestis KIM
auaccgccgguuuuug

SEQ ID NO: 4214522 - RNA, 18 nt, Yersinia pestis KIM
auaccggcggcacacugg

SEQ ID NO: 4214523 - RNA, 16 nt, Yersinia pestis KIM
auaccggucauauuua

SEQ ID NO: 4214524 - RNA, 13 nt, Yersinia pestis KIM
auaccgguggcau

SEQ ID NO: 4214525 - RNA, 13 nt, Yersinia pestis KIM
auaccuacccuuu

SEQ ID NO: 4214526 - RNA, 22 nt, Yersinia pestis KIM
auaccucacuggcuuuauuaua

SEQ ID NO: 4214527 - RNA, 23 nt, Yersinia pestis KIM
auaccugaguagcauaaaaauca

SEQ ID NO: 4214528 - RNA, 18 nt, Yersinia pestis KIM
auaccuuaauuaacucuu

SEQ ID NO: 4214529 - RNA, 18 nt, Yersinia pestis KIM
auacgcgcaccggcuaac

SEQ ID NO: 4214530 - RNA, 17 nt, Yersinia pestis KIM
auacgcuuccugcgcca

SEQ ID NO: 4214531 - RNA, 21 nt, Yersinia pestis KIM
auacggcaccaauggcuaaau

SEQ ID NO: 4214532 - RNA, 15 nt, Yersinia pestis KIM
auacggucaaaagcu

SEQ ID NO: 4214533 - RNA, 14 nt, Yersinia pestis KIM
auacgguccagcau

SEQ ID NO: 4214534 - RNA, 20 nt, Yersinia pestis KIM
auacgguccagcaucgcuga

SEQ ID NO: 4214535 - RNA, 14 nt, Yersinia pestis KIM
auacguuaccccuc

SEQ ID NO: 4214536 - RNA, 21 nt, Yersinia pestis KIM
auacguucguagccacgaucg

SEQ ID NO: 4214537 - RNA, 16 nt, Yersinia pestis KIM
auacguugccagccau

SEQ ID NO: 4214538 - RNA, 12 nt, Yersinia pestis KIM
auacuaaaacag

SEQ ID NO: 4214539 - RNA, 13 nt, Yersinia pestis KIM
auacuaaaacagc

SEQ ID NO: 4214540 - RNA, 19 nt, Yersinia pestis KIM
auacuaaagaaauaaucau

SEQ ID NO: 4214541 - RNA, 15 nt, Yersinia pestis KIM
auacuacuuucucuu

SEQ ID NO: 4214542 - RNA, 14 nt, Yersinia pestis KIM
auacucaaaaaugg

SEQ ID NO: 4214543 - RNA, 14 nt, Yersinia pestis KIM
auacucaccucccu

SEQ ID NO: 4214544 - RNA, 18 nt, Yersinia pestis KIM
auacucauccagauuauu

SEQ ID NO: 4214545 - RNA, 15 nt, Yersinia pestis KIM
auacuccauuugaac

SEQ ID NO: 4214546 - RNA, 23 nt, Yersinia pestis KIM
auacugacauucuggcuuuucau

SEQ ID NO: 4214547 - RNA, 12 nt, Yersinia pestis KIM
auacugcaaaug

SEQ ID NO: 4214548 - RNA, 22 nt, Yersinia pestis KIM
auacugccaaucgcucugcguu

SEQ ID NO: 4214549 - RNA, 17 nt, Yersinia pestis KIM
auacugcccgucguuau

SEQ ID NO: 4214550 - RNA, 18 nt, Yersinia pestis KIM
auacugccgaccauaucu

SEQ ID NO: 4214551 - RNA, 14 nt, Yersinia pestis KIM
auacuguugcuagg

SEQ ID NO: 4214552 - RNA, 16 nt, Yersinia pestis KIM
auacuucaagcugcau

SEQ ID NO: 4214553 - RNA, 22 nt, Yersinia pestis KIM
auacuucgaugauuauuuugug

SEQ ID NO: 4214554 - RNA, 21 nt, Yersinia pestis KIM
auacuuugcggcucaguuaac

SEQ ID NO: 4214555 - RNA, 20 nt, Yersinia pestis KIM
auacuuuuagccagcaacau

SEQ ID NO: 4214556 - RNA, 16 nt, Yersinia pestis KIM
auacuuuucauuuccu

SEQ ID NO: 4214557 - RNA, 13 nt, Yersinia pestis KIM
auagaaacaucag

SEQ ID NO: 4214558 - RNA, 12 nt, Yersinia pestis KIM
auagaaaggcua

SEQ ID NO: 4214559 - RNA, 16 nt, Yersinia pestis KIM
auagaacggcagugau

SEQ ID NO: 4214560 - RNA, 15 nt, Yersinia pestis KIM
auagaagagaggcaa

SEQ ID NO: 4214561 - RNA, 22 nt, Yersinia pestis KIM
auagaagagaggcaaugauuuu

SEQ ID NO: 4214562 - RNA, 15 nt, Yersinia pestis KIM
auagaagcucauaug

SEQ ID NO: 4214563 - RNA, 18 nt, Yersinia pestis KIM
auagaaggcggagaaugu

SEQ ID NO: 4214564 - RNA, 21 nt, Yersinia pestis KIM
auagaagguaaucagacugcu

SEQ ID NO: 4214565 - RNA, 17 nt, Yersinia pestis KIM
auagacauauuguccaa

SEQ ID NO: 4214566 - RNA, 16 nt, Yersinia pestis KIM
auagacgaauggccgc

SEQ ID NO: 4214567 - RNA, 22 nt, Yersinia pestis KIM
auagacucaucuaauuuucuca

SEQ ID NO: 4214568 - RNA, 16 nt, Yersinia pestis KIM
auagacuguuuuauua

SEQ ID NO: 4214569 - RNA, 18 nt, Yersinia pestis KIM
auagagaauaaauuuagg

SEQ ID NO: 4214570 - RNA, 13 nt, Yersinia pestis KIM
auagagcaccaaa

SEQ ID NO: 4214571 - RNA, 20 nt, Yersinia pestis KIM
auagagcaguaaguuaaaaa

SEQ ID NO: 4214572 - RNA, 23 nt, Yersinia pestis KIM
auagagcaguaaguuaaaaagaa

SEQ ID NO: 4214573 - RNA, 22 nt, Yersinia pestis KIM
auagagcuucgcgaucagacau

SEQ ID NO: 4214574 - RNA, 14 nt, Yersinia pestis KIM
auagauaaaaacau

SEQ ID NO: 4214575 - RNA, 21 nt, Yersinia pestis KIM
auagauacacuccauuaauuu

SEQ ID NO: 4214576 - RNA, 16 nt, Yersinia pestis KIM
auagauagcaaucaau

SEQ ID NO: 4214577 - RNA, 16 nt, Yersinia pestis KIM
auagaucccauaccca

SEQ ID NO: 4214578 - RNA, 16 nt, Yersinia pestis KIM
auagauggcuuuggug

SEQ ID NO: 4214579 - RNA, 17 nt, Yersinia pestis KIM
auagauuaagaaaacau

SEQ ID NO: 4214580 - RNA, 21 nt, Yersinia pestis KIM
auagauuaaucgaaacaccac

SEQ ID NO: 4214581 - RNA, 17 nt, Yersinia pestis KIM
auagauuuauucaacau

SEQ ID NO: 4214582 - RNA, 15 nt, Yersinia pestis KIM
auagauuuuaaugaa

SEQ ID NO: 4214583 - RNA, 17 nt, Yersinia pestis KIM
auagauuuuaaugaaaa

SEQ ID NO: 4214584 - RNA, 15 nt, Yersinia pestis KIM
auagcaaaauugaga

SEQ ID NO: 4214585 - RNA, 15 nt, Yersinia pestis KIM
auagcaacaucgacc

SEQ ID NO: 4214586 - RNA, 21 nt, Yersinia pestis KIM
auagcaaccggauacaaagug

SEQ ID NO: 4214587 - RNA, 14 nt, Yersinia pestis KIM
auagcaacuaaaca

SEQ ID NO: 4214588 - RNA, 14 nt, Yersinia pestis KIM
auagcaacugccaa

SEQ ID NO: 4214589 - RNA, 20 nt, Yersinia pestis KIM
auagcaccgagcaugcuaac

SEQ ID NO: 4214590 - RNA, 19 nt, Yersinia pestis KIM
auagcaucauccagcucaa

SEQ ID NO: 4214591 - RNA, 15 nt, Yersinia pestis KIM
auagcaucuggccag

SEQ ID NO: 4214592 - RNA, 14 nt, Yersinia pestis KIM
auagccaagccuug

SEQ ID NO: 4214593 - RNA, 18 nt, Yersinia pestis KIM
auagccacgucugcggau

SEQ ID NO: 4214594 - RNA, 16 nt, Yersinia pestis KIM
auagccauauuuuaaa

SEQ ID NO: 4214595 - RNA, 14 nt, Yersinia pestis KIM
auagcccaaauaac

SEQ ID NO: 4214596 - RNA, 23 nt, Yersinia pestis KIM
auagccccauauaaaaaacuaau

SEQ ID NO: 4214597 - RNA, 20 nt, Yersinia pestis KIM
auagccccugacgcugacau

SEQ ID NO: 4214598 - RNA, 13 nt, Yersinia pestis KIM
auagcccggugcc

SEQ ID NO: 4214599 - RNA, 23 nt, Yersinia pestis KIM
auagcccucguuguuguaugaca

SEQ ID NO: 4214600 - RNA, 23 nt, Yersinia pestis KIM
auagcccuucccccaaguaaaaa

SEQ ID NO: 4214601 - RNA, 16 nt, Yersinia pestis KIM
auagccgaagaaugua

SEQ ID NO: 4214602 - RNA, 17 nt, Yersinia pestis KIM
auagccggcucuucucg

SEQ ID NO: 4214603 - RNA, 23 nt, Yersinia pestis KIM
auagccuguaauccggcaaaaac

SEQ ID NO: 4214604 - RNA, 14 nt, Yersinia pestis KIM
auagccuucccugg

SEQ ID NO: 4214605 - RNA, 21 nt, Yersinia pestis KIM
auagccuugauucagcucauc

SEQ ID NO: 4214606 - RNA, 15 nt, Yersinia pestis KIM
auagcgaucagcaac

SEQ ID NO: 4214607 - RNA, 19 nt, Yersinia pestis KIM
auagcgcaauucagccuca

SEQ ID NO: 4214608 - RNA, 17 nt, Yersinia pestis KIM
auagcgcauccaaccug

SEQ ID NO: 4214609 - RNA, 16 nt, Yersinia pestis KIM
auagcgcugcaucagc

SEQ ID NO: 4214610 - RNA, 15 nt, Yersinia pestis KIM
auagcgcuucaguga

SEQ ID NO: 4214611 - RNA, 21 nt, Yersinia pestis KIM
auagcggaauauuuaaccaga

SEQ ID NO: 4214612 - RNA, 14 nt, Yersinia pestis KIM
auagcgugcaguaa

SEQ ID NO: 4214613 - RNA, 13 nt, Yersinia pestis KIM
auagcuaacaccg

SEQ ID NO: 4214614 - RNA, 14 nt, Yersinia pestis KIM
auagcuaucacgac

SEQ ID NO: 4214615 - RNA, 15 nt, Yersinia pestis KIM
auagcuaucuugccu

SEQ ID NO: 4214616 - RNA, 20 nt, Yersinia pestis KIM
auagcuaucuugccuguuga

SEQ ID NO: 4214617 - RNA, 21 nt, Yersinia pestis KIM
auagcucauuuuaaauaugau

SEQ ID NO: 4214618 - RNA, 15 nt, Yersinia pestis KIM
auagcugauugcucc

SEQ ID NO: 4214619 - RNA, 18 nt, Yersinia pestis KIM
auagcugcgauaauccgc

SEQ ID NO: 4214620 - RNA, 20 nt, Yersinia pestis KIM
auagcugcugcuuucagugu

SEQ ID NO: 4214621 - RNA, 20 nt, Yersinia pestis KIM
auagcuggcuucaaaaucac

SEQ ID NO: 4214622 - RNA, 15 nt, Yersinia pestis KIM
auagcuggcuuucgc

SEQ ID NO: 4214623 - RNA, 18 nt, Yersinia pestis KIM
auagcuguaaaauaccaa

SEQ ID NO: 4214624 - RNA, 12 nt, Yersinia pestis KIM
auagcuucagga

SEQ ID NO: 4214625 - RNA, 11 nt, Yersinia pestis KIM
auagcuucccu

SEQ ID NO: 4214626 - RNA, 13 nt, Yersinia pestis KIM
auagcuucccugg

SEQ ID NO: 4214627 - RNA, 22 nt, Yersinia pestis KIM
auaggauaagggccauuuugcu

SEQ ID NO: 4214628 - RNA, 13 nt, Yersinia pestis KIM
auaggauuuucau

SEQ ID NO: 4214629 - RNA, 19 nt, Yersinia pestis KIM
auaggcagaaaagcaaagg

SEQ ID NO: 4214630 - RNA, 17 nt, Yersinia pestis KIM
auaggcagaauagucac

SEQ ID NO: 4214631 - RNA, 15 nt, Yersinia pestis KIM
auaggcagaggaagu

SEQ ID NO: 4214632 - RNA, 13 nt, Yersinia pestis KIM
auaggcagaggag

SEQ ID NO: 4214633 - RNA, 14 nt, Yersinia pestis KIM
auaggcaggggagu

SEQ ID NO: 4214634 - RNA, 15 nt, Yersinia pestis KIM
auaggccacuagcca

SEQ ID NO: 4214635 - RNA, 17 nt, Yersinia pestis KIM
auaggcgaaaggcgcaa

SEQ ID NO: 4214636 - RNA, 14 nt, Yersinia pestis KIM
auagggaaaaguua

SEQ ID NO: 4214637 - RNA, 14 nt, Yersinia pestis KIM
auaggguaauacca

SEQ ID NO: 4214638 - RNA, 20 nt, Yersinia pestis KIM
auagguaucauuuuccugca

SEQ ID NO: 4214639 - RNA, 17 nt, Yersinia pestis KIM
auaggucagugguuuua

SEQ ID NO: 4214640 - RNA, 18 nt, Yersinia pestis KIM
auagguuggggaugccau

SEQ ID NO: 4214641 - RNA, 17 nt, Yersinia pestis KIM
auaguacguagcgauaa

SEQ ID NO: 4214642 - RNA, 20 nt, Yersinia pestis KIM
auaguacuugccacaacuga

SEQ ID NO: 4214643 - RNA, 22 nt, Yersinia pestis KIM
auagucacgucuucaccaauga

SEQ ID NO: 4214644 - RNA, 13 nt, Yersinia pestis KIM
auagucaucuuuc

SEQ ID NO: 4214645 - RNA, 16 nt, Yersinia pestis KIM
auagucggugucuucg

SEQ ID NO: 4214646 - RNA, 14 nt, Yersinia pestis KIM
auagucguuauaua

SEQ ID NO: 4214647 - RNA, 17 nt, Yersinia pestis KIM
auagucuuggaugcguu

SEQ ID NO: 4214648 - RNA, 21 nt, Yersinia pestis KIM
auagucuuuuuaauaugugac

SEQ ID NO: 4214649 - RNA, 12 nt, Yersinia pestis KIM
auagugaguaug

SEQ ID NO: 4214650 - RNA, 17 nt, Yersinia pestis KIM
auagugauuuuuuucac

SEQ ID NO: 4214651 - RNA, 19 nt, Yersinia pestis KIM
auagugggucguggaguag

SEQ ID NO: 4214652 - RNA, 16 nt, Yersinia pestis KIM
auaguguaaaaaccau

SEQ ID NO: 4214653 - RNA, 14 nt, Yersinia pestis KIM
auaguguugcuaag

SEQ ID NO: 4214654 - RNA, 21 nt, Yersinia pestis KIM
auaguguuguucugauagaga

SEQ ID NO: 4214655 - RNA, 17 nt, Yersinia pestis KIM
auaguuaaucgcagcag

SEQ ID NO: 4214656 - RNA, 17 nt, Yersinia pestis KIM
auaguuacccacauuca

SEQ ID NO: 4214657 - RNA, 20 nt, Yersinia pestis KIM
auaguuagugaguuauucgc

SEQ ID NO: 4214658 - RNA, 13 nt, Yersinia pestis KIM
auaguugaucuac

SEQ ID NO: 4214659 - RNA, 15 nt, Yersinia pestis KIM
auaguuguuagccac

SEQ ID NO: 4214660 - RNA, 20 nt, Yersinia pestis KIM
auaguuuuuuuuauggcugc

SEQ ID NO: 4214661 - RNA, 21 nt, Yersinia pestis KIM
auaguuuuuuuuauggcugcg

SEQ ID NO: 4214662 - RNA, 12 nt, Yersinia pestis KIM
auauaaaaaaug

SEQ ID NO: 4214663 - RNA, 22 nt, Yersinia pestis KIM
auauaaaagcacagacaaacaa

SEQ ID NO: 4214664 - RNA, 14 nt, Yersinia pestis KIM
auauaaaccagcca

SEQ ID NO: 4214665 - RNA, 15 nt, Yersinia pestis KIM
auauaaaccagccag

SEQ ID NO: 4214666 - RNA, 17 nt, Yersinia pestis KIM
auauaaacuaauaucuu

SEQ ID NO: 4214667 - RNA, 21 nt, Yersinia pestis KIM
auauaaagcauuuaucauauu

SEQ ID NO: 4214668 - RNA, 13 nt, Yersinia pestis KIM
auauaaauccagc

SEQ ID NO: 4214669 - RNA, 17 nt, Yersinia pestis KIM
auauaaaugauugcuau

SEQ ID NO: 4214670 - RNA, 20 nt, Yersinia pestis KIM
auauaacaaguuacauuuuu

SEQ ID NO: 4214671 - RNA, 14 nt, Yersinia pestis KIM
auauaaccaucaaa

SEQ ID NO: 4214672 - RNA, 24 nt, Yersinia pestis KIM
auauaaccaucaaauacacauaac

SEQ ID NO: 4214673 - RNA, 22 nt, Yersinia pestis KIM
auauaacgaauauucaagagau

SEQ ID NO: 4214674 - RNA, 13 nt, Yersinia pestis KIM
auauaagagaaau

SEQ ID NO: 4214675 - RNA, 14 nt, Yersinia pestis KIM
auauaagagaaauu

SEQ ID NO: 4214676 - RNA, 13 nt, Yersinia pestis KIM
aucacaugcucag

SEQ ID NO: 4214677 - RNA, 14 nt, Yersinia pestis KIM
aucacauuucaaau

SEQ ID NO: 4214678 - RNA, 12 nt, Yersinia pestis KIM
aucaccaaacag

SEQ ID NO: 4214679 - RNA, 17 nt, Yersinia pestis KIM
aucaccaaagcaacagc

SEQ ID NO: 4214680 - RNA, 20 nt, Yersinia pestis KIM
aucaccaacaccaccaucac

SEQ ID NO: 4214681 - RNA, 17 nt, Yersinia pestis KIM
aucaccagacaaccaau

SEQ ID NO: 4214682 - RNA, 14 nt, Yersinia pestis KIM
aucaccaucauuac

SEQ ID NO: 4214683 - RNA, 18 nt, Yersinia pestis KIM
aucaccauuaauaauaug

SEQ ID NO: 4214684 - RNA, 15 nt, Yersinia pestis KIM
aucaccauucaagau

SEQ ID NO: 4214685 - RNA, 14 nt, Yersinia pestis KIM
aucaccauugacca

SEQ ID NO: 4214686 - RNA, 12 nt, Yersinia pestis KIM
aucacccagcaa

SEQ ID NO: 4214687 - RNA, 14 nt, Yersinia pestis KIM
aucacccagcaaaa

SEQ ID NO: 4214688 - RNA, 15 nt, Yersinia pestis KIM
aucacccagcaaaau

SEQ ID NO: 4214689 - RNA, 18 nt, Yersinia pestis KIM
aucaccccacuagaaaua

SEQ ID NO: 4214690 - RNA, 19 nt, Yersinia pestis KIM
aucaccccacuagaaauac

SEQ ID NO: 4214691 - RNA, 22 nt, Yersinia pestis KIM
aucaccccacuagaaauacugu

SEQ ID NO: 4214692 - RNA, 12 nt, Yersinia pestis KIM
aucaccccccug

SEQ ID NO: 4214693 - RNA, 22 nt, Yersinia pestis KIM
aucacccgauacaggcucugaa

SEQ ID NO: 4214694 - RNA, 15 nt, Yersinia pestis KIM
aucacccgcaaaacu

SEQ ID NO: 4214695 - RNA, 17 nt, Yersinia pestis KIM
aucacccgccucuaaau

SEQ ID NO: 4214696 - RNA, 23 nt, Yersinia pestis KIM
aucacccggccaucuucagaaac

SEQ ID NO: 4214697 - RNA, 15 nt, Yersinia pestis KIM
aucaccgaaagaaga

SEQ ID NO: 4214698 - RNA, 21 nt, Yersinia pestis KIM
aucaccgccggauuucaaucc

SEQ ID NO: 4214699 - RNA, 11 nt, Yersinia pestis KIM
aucaccgccug

SEQ ID NO: 4214700 - RNA, 16 nt, Yersinia pestis KIM
aucaccuuauccaaua

SEQ ID NO: 4214701 - RNA, 15 nt, Yersinia pestis KIM
aucaccuuccaaacu

SEQ ID NO: 4214702 - RNA, 22 nt, Yersinia pestis KIM
aucaccuuccaaacuuugugga

SEQ ID NO: 4214703 - RNA, 23 nt, Yersinia pestis KIM
aucaccuuccgucccaagaaaag

SEQ ID NO: 4214704 - RNA, 18 nt, Yersinia pestis KIM
aucaccuuggaaaacagc

SEQ ID NO: 4214705 - RNA, 20 nt, Yersinia pestis KIM
aucaccuuggaaaacagcaa

SEQ ID NO: 4214706 - RNA, 19 nt, Yersinia pestis KIM
aucaccuuggauggcgaaa

SEQ ID NO: 4214707 - RNA, 13 nt, Yersinia pestis KIM
aucacgcagcaga

SEQ ID NO: 4214708 - RNA, 14 nt, Yersinia pestis KIM
aucacgcagcagac

SEQ ID NO: 4214709 - RNA, 22 nt, Yersinia pestis KIM
aucacgcagcaggccauuuuca

SEQ ID NO: 4214710 - RNA, 19 nt, Yersinia pestis KIM
aucacgcagcuuuuucuca

SEQ ID NO: 4214711 - RNA, 13 nt, Yersinia pestis KIM
aucacgcguucaa

SEQ ID NO: 4214712 - RNA, 15 nt, Yersinia pestis KIM
aucacggguuuuucc

SEQ ID NO: 4214713 - RNA, 16 nt, Yersinia pestis KIM
aucacgguacgcauga

SEQ ID NO: 4214714 - RNA, 13 nt, Yersinia pestis KIM
aucacuauaauua

SEQ ID NO: 4214715 - RNA, 20 nt, Yersinia pestis KIM
aucacuauaauuauuucucu

SEQ ID NO: 4214716 - RNA, 16 nt, Yersinia pestis KIM
aucacuauuucagaca

SEQ ID NO: 4214717 - RNA, 22 nt, Yersinia pestis KIM
aucacuauuucaggcauaucac

SEQ ID NO: 4214718 - RNA, 18 nt, Yersinia pestis KIM
aucacucgggauaugacu

SEQ ID NO: 4214719 - RNA, 14 nt, Yersinia pestis KIM
aucacucucaugaa

SEQ ID NO: 4214720 - RNA, 13 nt, Yersinia pestis KIM
aucacugaaagug

SEQ ID NO: 4214721 - RNA, 19 nt, Yersinia pestis KIM
aucacugauucagaaaggu

SEQ ID NO: 4214722 - RNA, 22 nt, Yersinia pestis KIM
aucacuggaggcguuuuuauug

SEQ ID NO: 4214723 - RNA, 20 nt, Yersinia pestis KIM
aucacuggcaauaauucaga

SEQ ID NO: 4214724 - RNA, 16 nt, Yersinia pestis KIM
aucacugucaaaaagc

SEQ ID NO: 4214725 - RNA, 13 nt, Yersinia pestis KIM
aucacuuauugga

SEQ ID NO: 4214726 - RNA, 14 nt, Yersinia pestis KIM
aucacuuucccgcg

SEQ ID NO: 4214727 - RNA, 19 nt, Yersinia pestis KIM
aucacuuuuaugacggcau

SEQ ID NO: 4214728 - RNA, 21 nt, Yersinia pestis KIM
aucacuuuuaugacggcaucg

SEQ ID NO: 4214729 - RNA, 21 nt, Yersinia pestis KIM
aucagaccuuuacaggacuga

SEQ ID NO: 4214730 - RNA, 19 nt, Yersinia pestis KIM
aucagaccuuuaggaaagc

SEQ ID NO: 4214731 - RNA, 13 nt, Yersinia pestis KIM
aucagacugcuga

SEQ ID NO: 4214732 - RNA, 13 nt, Yersinia pestis KIM
aucagagcucaau

SEQ ID NO: 4214733 - RNA, 15 nt, Yersinia pestis KIM
aucagaguccaauag

SEQ ID NO: 4214734 - RNA, 19 nt, Yersinia pestis KIM
aucagagucugucauggca

SEQ ID NO: 4214735 - RNA, 19 nt, Yersinia pestis KIM
aucagauacggcuccagaa

SEQ ID NO: 4214736 - RNA, 21 nt, Yersinia pestis KIM
aucagauuguuuauaaauuaa

SEQ ID NO: 4214737 - RNA, 23 nt, Yersinia pestis KIM
aucagauuguuuauaaauuaaaa

SEQ ID NO: 4214738 - RNA, 17 nt, Yersinia pestis KIM
aucagcacauccaugcc

SEQ ID NO: 4214739 - RNA, 14 nt, Yersinia pestis KIM
aucagcagagagcg

SEQ ID NO: 4214740 - RNA, 22 nt, Yersinia pestis KIM
aucagcagagagcgacucacga

SEQ ID NO: 4214741 - RNA, 21 nt, Yersinia pestis KIM
aucagcaguggcuuggcaacc

SEQ ID NO: 4214742 - RNA, 23 nt, Yersinia pestis KIM
aucagccauauguugccaccagc

SEQ ID NO: 4214743 - RNA, 16 nt, Yersinia pestis KIM
aucagcccauugcugu

SEQ ID NO: 4214744 - RNA, 20 nt, Yersinia pestis KIM
aucagccgcggcgcuggcau

SEQ ID NO: 4214745 - RNA, 13 nt, Yersinia pestis KIM
aucagcgaaaaau

SEQ ID NO: 4214746 - RNA, 24 nt, Yersinia pestis KIM
aucagcgaccaaauggacgaacag

SEQ ID NO: 4214747 - RNA, 15 nt, Yersinia pestis KIM
aucagcgauuuuaaa

SEQ ID NO: 4214748 - RNA, 14 nt, Yersinia pestis KIM
aucagcgcacugca

SEQ ID NO: 4214749 - RNA, 15 nt, Yersinia pestis KIM
aucagcgcacugcau

SEQ ID NO: 4214750 - RNA, 19 nt, Yersinia pestis KIM
aucagcgcacugcaugcca

SEQ ID NO: 4214751 - RNA, 22 nt, Yersinia pestis KIM
aucagcgcccuugccagugcaa

SEQ ID NO: 4214752 - RNA, 22 nt, Yersinia pestis KIM
aucagcgcuagauuuucuuuca

SEQ ID NO: 4214753 - RNA, 18 nt, Yersinia pestis KIM
aucagcgguugaaaaguu

SEQ ID NO: 4214754 - RNA, 20 nt, Yersinia pestis KIM
aucagcguauagcgccgcca

SEQ ID NO: 4214755 - RNA, 16 nt, Yersinia pestis KIM
aucagcguuacccaga

SEQ ID NO: 4214756 - RNA, 16 nt, Yersinia pestis KIM
aucagcguuuuauucg

SEQ ID NO: 4214757 - RNA, 17 nt, Yersinia pestis KIM
aucagcuucauuaagga

SEQ ID NO: 4214758 - RNA, 17 nt, Yersinia pestis KIM
aucagcuuucugucgau

SEQ ID NO: 4214759 - RNA, 20 nt, Yersinia pestis KIM
aucaggcauuacagacuggc

SEQ ID NO: 4214760 - RNA, 16 nt, Yersinia pestis KIM
aucaggccuucuuuuc

SEQ ID NO: 4214761 - RNA, 18 nt, Yersinia pestis KIM
aucaggccuucuuuucuc

SEQ ID NO: 4214762 - RNA, 16 nt, Yersinia pestis KIM
aucaggcgcuuuucua

SEQ ID NO: 4214763 - RNA, 15 nt, Yersinia pestis KIM
aucaggcuguucuug

SEQ ID NO: 4214764 - RNA, 15 nt, Yersinia pestis KIM
aucaggcuguugaca

SEQ ID NO: 4214765 - RNA, 18 nt, Yersinia pestis KIM
aucaggucgucaguggau

SEQ ID NO: 4214766 - RNA, 20 nt, Yersinia pestis KIM
aucaggucgucaguggaugg

SEQ ID NO: 4214767 - RNA, 16 nt, Yersinia pestis KIM
aucagguuguauuuug

SEQ ID NO: 4214768 - RNA, 14 nt, Yersinia pestis KIM
aucaguaacgccgu

SEQ ID NO: 4214769 - RNA, 16 nt, Yersinia pestis KIM
aucaguagucaauaca

SEQ ID NO: 4214770 - RNA, 16 nt, Yersinia pestis KIM
aucaguauuauaaaau

SEQ ID NO: 4214771 - RNA, 21 nt, Yersinia pestis KIM
aucaguauuauaaaauucgcu

SEQ ID NO: 4214772 - RNA, 17 nt, Yersinia pestis KIM
aucagucgcuuuuuaac

SEQ ID NO: 4214773 - RNA, 19 nt, Yersinia pestis KIM
aucagucgcuuuuuaacaa

SEQ ID NO: 4214774 - RNA, 16 nt, Yersinia pestis KIM
aucagugaagagauaa

SEQ ID NO: 4214775 - RNA, 17 nt, Yersinia pestis KIM
aucaguggcgguucgag

SEQ ID NO: 4214776 - RNA, 20 nt, Yersinia pestis KIM
aucaguggcgguucgagcgg

SEQ ID NO: 4214777 - RNA, 23 nt, Yersinia pestis KIM
aucaguggcgguucgagcggcau

SEQ ID NO: 4214778 - RNA, 19 nt, Yersinia pestis KIM
aucaguggcugaaggggcu

SEQ ID NO: 4214779 - RNA, 12 nt, Yersinia pestis KIM
aucaguggguca

SEQ ID NO: 4214780 - RNA, 18 nt, Yersinia pestis KIM
aucaguguauuuaucaaa

SEQ ID NO: 4214781 - RNA, 19 nt, Yersinia pestis KIM
aucaguuccugauucgguu

SEQ ID NO: 4214782 - RNA, 15 nt, Yersinia pestis KIM
aucaguugcaguugg

SEQ ID NO: 4214783 - RNA, 14 nt, Yersinia pestis KIM
aucauaaaaauaca

SEQ ID NO: 4214784 - RNA, 18 nt, Yersinia pestis KIM
aucauaaaaauacauauc

SEQ ID NO: 4214785 - RNA, 20 nt, Yersinia pestis KIM
aucauaaugguaccggcacc

SEQ ID NO: 4214786 - RNA, 20 nt, Yersinia pestis KIM
aucauaggccacuagccauu

SEQ ID NO: 4214787 - RNA, 17 nt, Yersinia pestis KIM
aucauauaagcggcaaa

SEQ ID NO: 4214788 - RNA, 13 nt, Yersinia pestis KIM
aucauauauuaaa

SEQ ID NO: 4214789 - RNA, 19 nt, Yersinia pestis KIM
aucauauguucgaucaaaa

SEQ ID NO: 4214790 - RNA, 22 nt, Yersinia pestis KIM
aucaucaauggauucuugcugc

SEQ ID NO: 4214791 - RNA, 17 nt, Yersinia pestis KIM
aucccuuacgaucacuu

SEQ ID NO: 4214792 - RNA, 20 nt, Yersinia pestis KIM
aucccuucggcaugcaacuu

SEQ ID NO: 4214793 - RNA, 23 nt, Yersinia pestis KIM
aucccuucugaaacuucaaaauc

SEQ ID NO: 4214794 - RNA, 20 nt, Yersinia pestis KIM
aucccuugcggcauagcaaa

SEQ ID NO: 4214795 - RNA, 17 nt, Yersinia pestis KIM
aucccuuguucaggcag

SEQ ID NO: 4214796 - RNA, 13 nt, Yersinia pestis KIM
auccgaaaaauau

SEQ ID NO: 4214797 - RNA, 17 nt, Yersinia pestis KIM
auccgaauuuaucuuuu

SEQ ID NO: 4214798 - RNA, 17 nt, Yersinia pestis KIM
auccgaguuauugauau

SEQ ID NO: 4214799 - RNA, 16 nt, Yersinia pestis KIM
auccgcaaaaugggua

SEQ ID NO: 4214800 - RNA, 13 nt, Yersinia pestis KIM
auccgcaccgcua

SEQ ID NO: 4214801 - RNA, 16 nt, Yersinia pestis KIM
auccgcagcuuagguu

SEQ ID NO: 4214802 - RNA, 20 nt, Yersinia pestis KIM
auccgccucggugaaauaag

SEQ ID NO: 4214803 - RNA, 21 nt, Yersinia pestis KIM
auccgccugagauuaaccgcg

SEQ ID NO: 4214804 - RNA, 23 nt, Yersinia pestis KIM
auccggauuaaauucuaccuggc

SEQ ID NO: 4214805 - RNA, 22 nt, Yersinia pestis KIM
auccggccauuuuuuaccauua

SEQ ID NO: 4214806 - RNA, 21 nt, Yersinia pestis KIM
auccggcgggcaauauaggcg

SEQ ID NO: 4214807 - RNA, 22 nt, Yersinia pestis KIM
auccgggaaccccuucaggcca

SEQ ID NO: 4214808 - RNA, 13 nt, Yersinia pestis KIM
auccguagacauu

SEQ ID NO: 4214809 - RNA, 17 nt, Yersinia pestis KIM
auccguagacauuaucc

SEQ ID NO: 4214810 - RNA, 17 nt, Yersinia pestis KIM
auccgucguucucuauu

SEQ ID NO: 4214811 - RNA, 18 nt, Yersinia pestis KIM
auccguuaacccaaagcc

SEQ ID NO: 4214812 - RNA, 17 nt, Yersinia pestis KIM
auccguucccacuucca

SEQ ID NO: 4214813 - RNA, 15 nt, Yersinia pestis KIM
auccguuugcaacag

SEQ ID NO: 4214814 - RNA, 22 nt, Yersinia pestis KIM
auccguuuuaacgcugcccaau

SEQ ID NO: 4214815 - RNA, 13 nt, Yersinia pestis KIM
auccuaagaauua

SEQ ID NO: 4214816 - RNA, 14 nt, Yersinia pestis KIM
auccuacaauaucu

SEQ ID NO: 4214817 - RNA, 17 nt, Yersinia pestis KIM
auccuacaauaucuucc

SEQ ID NO: 4214818 - RNA, 13 nt, Yersinia pestis KIM
auccuauuuuuac

SEQ ID NO: 4214819 - RNA, 18 nt, Yersinia pestis KIM
auccucaccguucaagau

SEQ ID NO: 4214820 - RNA, 15 nt, Yersinia pestis KIM
auccucgagauguau

SEQ ID NO: 4214821 - RNA, 18 nt, Yersinia pestis KIM
auccucgucguaauauuu

SEQ ID NO: 4214822 - RNA, 23 nt, Yersinia pestis KIM
auccugaacgaggacuuccugcc

SEQ ID NO: 4214823 - RNA, 21 nt, Yersinia pestis KIM
auccugaauaauacugucaaa

SEQ ID NO: 4214824 - RNA, 17 nt, Yersinia pestis KIM
auccugccgccucugcu

SEQ ID NO: 4214825 - RNA, 15 nt, Yersinia pestis KIM
auccugcgggccagc

SEQ ID NO: 4214826 - RNA, 18 nt, Yersinia pestis KIM
auccugcucagcuaaaga

SEQ ID NO: 4214827 - RNA, 20 nt, Yersinia pestis KIM
auccuggccguguuuuuccc

SEQ ID NO: 4214828 - RNA, 22 nt, Yersinia pestis KIM
auccuggccguguuuuucccua

SEQ ID NO: 4214829 - RNA, 16 nt, Yersinia pestis KIM
auccuuacuuugcgau

SEQ ID NO: 4214830 - RNA, 16 nt, Yersinia pestis KIM
auccuugaucgccaaa

SEQ ID NO: 4214831 - RNA, 19 nt, Yersinia pestis KIM
auccuugcuaguuauauaa

SEQ ID NO: 4214832 - RNA, 19 nt, Yersinia pestis KIM
auccuugggucaguuuuau

SEQ ID NO: 4214833 - RNA, 16 nt, Yersinia pestis KIM
aucgaaaagcgccuuu

SEQ ID NO: 4214834 - RNA, 14 nt, Yersinia pestis KIM
aucgaacaucuccu

SEQ ID NO: 4214835 - RNA, 12 nt, Yersinia pestis KIM
aucgaaugauca

SEQ ID NO: 4214836 - RNA, 19 nt, Yersinia pestis KIM
aucgaaugaucagaggcug

SEQ ID NO: 4214837 - RNA, 19 nt, Yersinia pestis KIM
aucgaccgaguguaaaaag

SEQ ID NO: 4214838 - RNA, 16 nt, Yersinia pestis KIM
aucgacgcgaaauuca

SEQ ID NO: 4214839 - RNA, 16 nt, Yersinia pestis KIM
aucgacggcagugacg

SEQ ID NO: 4214840 - RNA, 20 nt, Yersinia pestis KIM
aucgacgugaagugagcuga

SEQ ID NO: 4214841 - RNA, 20 nt, Yersinia pestis KIM
aucgacuggccgauaucaug

SEQ ID NO: 4214842 - RNA, 18 nt, Yersinia pestis KIM
aucgagaguugcucaccc

SEQ ID NO: 4214843 - RNA, 23 nt, Yersinia pestis KIM
aucgagaguugcucacccauuuu

SEQ ID NO: 4214844 - RNA, 20 nt, Yersinia pestis KIM
aucgaguugaugcaauggca

SEQ ID NO: 4214845 - RNA, 15 nt, Yersinia pestis KIM
aucgauacggcaccg

SEQ ID NO: 4214846 - RNA, 19 nt, Yersinia pestis KIM
aucgcaccauaaccaaucc

SEQ ID NO: 4214847 - RNA, 17 nt, Yersinia pestis KIM
aucgcacguugcagaug

SEQ ID NO: 4214848 - RNA, 18 nt, Yersinia pestis KIM
aucgcacguugcagaugg

SEQ ID NO: 4214849 - RNA, 22 nt, Yersinia pestis KIM
aucgcacugaguucugcugcca

SEQ ID NO: 4214850 - RNA, 19 nt, Yersinia pestis KIM
aucgcaggcuuugguuuug

SEQ ID NO: 4214851 - RNA, 21 nt, Yersinia pestis KIM
aucgcaguggcgcuacuuccc

SEQ ID NO: 4214852 - RNA, 23 nt, Yersinia pestis KIM
aucgcauccgggaaccccuucag

SEQ ID NO: 4214853 - RNA, 17 nt, Yersinia pestis KIM
aucgcauugucacccac

SEQ ID NO: 4214854 - RNA, 12 nt, Yersinia pestis KIM
aucgccaacacu

SEQ ID NO: 4214855 - RNA, 17 nt, Yersinia pestis KIM
aucgccaacaggccuaa

SEQ ID NO: 4214856 - RNA, 16 nt, Yersinia pestis KIM
aucgccaacauaagua

SEQ ID NO: 4214857 - RNA, 17 nt, Yersinia pestis KIM
aucgccaauaaccgcag

SEQ ID NO: 4214858 - RNA, 21 nt, Yersinia pestis KIM
aucgccaauggucaguuguuc

SEQ ID NO: 4214859 - RNA, 12 nt, Yersinia pestis KIM
aucgccaauugg

SEQ ID NO: 4214860 - RNA, 18 nt, Yersinia pestis KIM
aucgccagcaaaucacau

SEQ ID NO: 4214861 - RNA, 19 nt, Yersinia pestis KIM
aucgccagcaaaucacauu

SEQ ID NO: 4214862 - RNA, 16 nt, Yersinia pestis KIM
aucgccagcugcaauu

SEQ ID NO: 4214863 - RNA, 16 nt, Yersinia pestis KIM
aucgccaguguugcca

SEQ ID NO: 4214864 - RNA, 22 nt, Yersinia pestis KIM
aucgccguagauuuaaccccaa

SEQ ID NO: 4214865 - RNA, 20 nt, Yersinia pestis KIM
aucgccuaccaucaaaauau

SEQ ID NO: 4214866 - RNA, 19 nt, Yersinia pestis KIM
aucgccugaugcuuuucuu

SEQ ID NO: 4214867 - RNA, 22 nt, Yersinia pestis KIM
aucgccuggcuugaccuugccu

SEQ ID NO: 4214868 - RNA, 14 nt, Yersinia pestis KIM
aucgcgaccaauuc

SEQ ID NO: 4214869 - RNA, 17 nt, Yersinia pestis KIM
aucgcgacgaaaaccua

SEQ ID NO: 4214870 - RNA, 17 nt, Yersinia pestis KIM
aucgcgcauuucuucuc

SEQ ID NO: 4214871 - RNA, 21 nt, Yersinia pestis KIM
aucgcgcccauccgcaggaag

SEQ ID NO: 4214872 - RNA, 13 nt, Yersinia pestis KIM
aucgcgcuucagg

SEQ ID NO: 4214873 - RNA, 15 nt, Yersinia pestis KIM
aucgcggcugauuaa

SEQ ID NO: 4214874 - RNA, 21 nt, Yersinia pestis KIM
aucgcgggcgcgcugcugcuc

SEQ ID NO: 4214875 - RNA, 12 nt, Yersinia pestis KIM
aucgcuaaaaag

SEQ ID NO: 4214876 - RNA, 15 nt, Yersinia pestis KIM
aucgcuaaauacugc

SEQ ID NO: 4214877 - RNA, 19 nt, Yersinia pestis KIM
aucgcuaacccucaguaaa

SEQ ID NO: 4214878 - RNA, 19 nt, Yersinia pestis KIM
aucgcucugcguuuuuccc

SEQ ID NO: 4214879 - RNA, 21 nt, Yersinia pestis KIM
aucgcucugcguuuuucccug

SEQ ID NO: 4214880 - RNA, 15 nt, Yersinia pestis KIM
aucgcugacaauuua

SEQ ID NO: 4214881 - RNA, 11 nt, Yersinia pestis KIM
aucgcuguaug

SEQ ID NO: 4214882 - RNA, 15 nt, Yersinia pestis KIM
aucgcuguaugguau

SEQ ID NO: 4214883 - RNA, 20 nt, Yersinia pestis KIM
aucgcuuggucacugguuca

SEQ ID NO: 4214884 - RNA, 18 nt, Yersinia pestis KIM
aucgcuuuuagauaaagg

SEQ ID NO: 4214885 - RNA, 24 nt, Yersinia pestis KIM
aucgcuuuuaugguuuugugucac

SEQ ID NO: 4214886 - RNA, 13 nt, Yersinia pestis KIM
aucggcagugcca

SEQ ID NO: 4214887 - RNA, 15 nt, Yersinia pestis KIM
aucggccaauaugau

SEQ ID NO: 4214888 - RNA, 20 nt, Yersinia pestis KIM
aucggccagugcgccggccu

SEQ ID NO: 4214889 - RNA, 15 nt, Yersinia pestis KIM
aucggccccugacau

SEQ ID NO: 4214890 - RNA, 14 nt, Yersinia pestis KIM
aucggcccugccau

SEQ ID NO: 4214891 - RNA, 14 nt, Yersinia pestis KIM
aucggccugcgcug

SEQ ID NO: 4214892 - RNA, 20 nt, Yersinia pestis KIM
aucggccugcgcugcuuuuu

SEQ ID NO: 4214893 - RNA, 22 nt, Yersinia pestis KIM
aucggcguuacaguaaggcagc

SEQ ID NO: 4214894 - RNA, 23 nt, Yersinia pestis KIM
aucgggguuugucagcagucuga

SEQ ID NO: 4214895 - RNA, 14 nt, Yersinia pestis KIM
aucggguagcaucc

SEQ ID NO: 4214896 - RNA, 15 nt, Yersinia pestis KIM
aucgguaaaaaauca

SEQ ID NO: 4214897 - RNA, 18 nt, Yersinia pestis KIM
aucgguggcuauaagccu

SEQ ID NO: 4214898 - RNA, 18 nt, Yersinia pestis KIM
aucguauucucaauggcu

SEQ ID NO: 4214899 - RNA, 17 nt, Yersinia pestis KIM
aucgucacgaucaacca

SEQ ID NO: 4214900 - RNA, 17 nt, Yersinia pestis KIM
aucgucacuggcaccau

SEQ ID NO: 4214901 - RNA, 21 nt, Yersinia pestis KIM
aucgucagccccugccagaau

SEQ ID NO: 4214902 - RNA, 22 nt, Yersinia pestis KIM
aucgucagccccugccagaauc

SEQ ID NO: 4214903 - RNA, 15 nt, Yersinia pestis KIM
aucguccggucugaa

SEQ ID NO: 4214904 - RNA, 18 nt, Yersinia pestis KIM
aucguccggucugaagag

SEQ ID NO: 4214905 - RNA, 15 nt, Yersinia pestis KIM
aucuuccacaugcuu

SEQ ID NO: 4214906 - RNA, 23 nt, Yersinia pestis KIM
aucuuccacaugcuuuuuuuaag

SEQ ID NO: 4214907 - RNA, 18 nt, Yersinia pestis KIM
aucuuccacucuuucaau

SEQ ID NO: 4214908 - RNA, 17 nt, Yersinia pestis KIM
aucuuccagcggcaaau

SEQ ID NO: 4214909 - RNA, 19 nt, Yersinia pestis KIM
aucuucgcuuucaucuucu

SEQ ID NO: 4214910 - RNA, 17 nt, Yersinia pestis KIM
aucuucgguaaauuuau

SEQ ID NO: 4214911 - RNA, 22 nt, Yersinia pestis KIM
aucuucgguaaauuuauauuua

SEQ ID NO: 4214912 - RNA, 23 nt, Yersinia pestis KIM
aucuucgguaaauuuauauuuac

SEQ ID NO: 4214913 - RNA, 14 nt, Yersinia pestis KIM
aucuucugccagcc

SEQ ID NO: 4214914 - RNA, 16 nt, Yersinia pestis KIM
aucuugaaacaaccca

SEQ ID NO: 4214915 - RNA, 19 nt, Yersinia pestis KIM
aucuugaaccaauuuuucu

SEQ ID NO: 4214916 - RNA, 19 nt, Yersinia pestis KIM
aucuugaacggugaggaua

SEQ ID NO: 4214917 - RNA, 18 nt, Yersinia pestis KIM
aucuugcaacaacgccuc

SEQ ID NO: 4214918 - RNA, 20 nt, Yersinia pestis KIM
aucuugcagcgaucacagau

SEQ ID NO: 4214919 - RNA, 19 nt, Yersinia pestis KIM
aucuugcugaaaacaauau

SEQ ID NO: 4214920 - RNA, 19 nt, Yersinia pestis KIM
aucuugggcgggaucucca

SEQ ID NO: 4214921 - RNA, 23 nt, Yersinia pestis KIM
aucuuguaaauagucauauauuu

SEQ ID NO: 4214922 - RNA, 14 nt, Yersinia pestis KIM
aucuuguaguaacc

SEQ ID NO: 4214923 - RNA, 16 nt, Yersinia pestis KIM
aucuuguaguaaccac

SEQ ID NO: 4214924 - RNA, 23 nt, Yersinia pestis KIM
aucuugucauuaccaaugguuuc

SEQ ID NO: 4214925 - RNA, 17 nt, Yersinia pestis KIM
aucuugugaugaaauua

SEQ ID NO: 4214926 - RNA, 13 nt, Yersinia pestis KIM
aucuuuaaaaacc

SEQ ID NO: 4214927 - RNA, 22 nt, Yersinia pestis KIM
aucuuuaacaacaaccaagcuu

SEQ ID NO: 4214928 - RNA, 18 nt, Yersinia pestis KIM
aucuuuaauaaauuuucu

SEQ ID NO: 4214929 - RNA, 19 nt, Yersinia pestis KIM
aucuuuaauaaauuuucua

SEQ ID NO: 4214930 - RNA, 16 nt, Yersinia pestis KIM
aucuuuaauaauagau

SEQ ID NO: 4214931 - RNA, 17 nt, Yersinia pestis KIM
aucuuuaauauugcauu

SEQ ID NO: 4214932 - RNA, 17 nt, Yersinia pestis KIM
aucuuuaauuuucugac

SEQ ID NO: 4214933 - RNA, 17 nt, Yersinia pestis KIM
aucuuuauuauuauuua

SEQ ID NO: 4214934 - RNA, 17 nt, Yersinia pestis KIM
aucuuuauugcuccuua

SEQ ID NO: 4214935 - RNA, 14 nt, Yersinia pestis KIM
aucuuuccagccaa

SEQ ID NO: 4214936 - RNA, 15 nt, Yersinia pestis KIM
aucuuuccagccaau

SEQ ID NO: 4214937 - RNA, 16 nt, Yersinia pestis KIM
aucuuucggccucccc

SEQ ID NO: 4214938 - RNA, 22 nt, Yersinia pestis KIM
aucuuucuccaguaaaagaaua

SEQ ID NO: 4214939 - RNA, 16 nt, Yersinia pestis KIM
aucuuuucugauuuuu

SEQ ID NO: 4214940 - RNA, 18 nt, Yersinia pestis KIM
aucuuuucugauuuuuua

SEQ ID NO: 4214941 - RNA, 20 nt, Yersinia pestis KIM
aucuuuucugauuuuuuacu

SEQ ID NO: 4214942 - RNA, 13 nt, Yersinia pestis KIM
aucuuuuuguaau

SEQ ID NO: 4214943 - RNA, 23 nt, Yersinia pestis KIM
aucuuuuuuuuuauuaucaucuu

SEQ ID NO: 4214944 - RNA, 20 nt, Yersinia pestis KIM
augaaaggcggugaacagua

SEQ ID NO: 4214945 - RNA, 21 nt, Yersinia pestis KIM
augaaaguaagagucuggauu

SEQ ID NO: 4214946 - RNA, 18 nt, Yersinia pestis KIM
augaaauaguaauuaauu

SEQ ID NO: 4214947 - RNA, 22 nt, Yersinia pestis KIM
augaaauauggugauaacugcc

SEQ ID NO: 4214948 - RNA, 12 nt, Yersinia pestis KIM
augaaauuaaaa

SEQ ID NO: 4214949 - RNA, 17 nt, Yersinia pestis KIM
augaaccgucauagcau

SEQ ID NO: 4214950 - RNA, 12 nt, Yersinia pestis KIM
augaacgugccg

SEQ ID NO: 4214951 - RNA, 23 nt, Yersinia pestis KIM
augaacguguuagguaauaccaa

SEQ ID NO: 4214952 - RNA, 12 nt, Yersinia pestis KIM
augaagaaauac

SEQ ID NO: 4214953 - RNA, 19 nt, Yersinia pestis KIM
augaagcacaaaaagaguc

SEQ ID NO: 4214954 - RNA, 19 nt, Yersinia pestis KIM
augaagggggcuuauucua

SEQ ID NO: 4214955 - RNA, 22 nt, Yersinia pestis KIM
augaaguuauccuccauucugc

SEQ ID NO: 4214956 - RNA, 15 nt, Yersinia pestis KIM
augaauaaagggggu

SEQ ID NO: 4214957 - RNA, 23 nt, Yersinia pestis KIM
augaauaaaggggguuuuccccu

SEQ ID NO: 4214958 - RNA, 13 nt, Yersinia pestis KIM
augaauauaugau

SEQ ID NO: 4214959 - RNA, 15 nt, Yersinia pestis KIM
augaauauaugauac

SEQ ID NO: 4214960 - RNA, 16 nt, Yersinia pestis KIM
augaauauucaccacc

SEQ ID NO: 4214961 - RNA, 16 nt, Yersinia pestis KIM
augaauauuuucauuu

SEQ ID NO: 4214962 - RNA, 14 nt, Yersinia pestis KIM
augaauccguauuc

SEQ ID NO: 4214963 - RNA, 24 nt, Yersinia pestis KIM
augaaucgaguaauauuuuguugc

SEQ ID NO: 4214964 - RNA, 13 nt, Yersinia pestis KIM
augaaugaggcug

SEQ ID NO: 4214965 - RNA, 14 nt, Yersinia pestis KIM
augaaugaggcuga

SEQ ID NO: 4214966 - RNA, 22 nt, Yersinia pestis KIM
augaaugagguuuacauuuaaa

SEQ ID NO: 4214967 - RNA, 17 nt, Yersinia pestis KIM
augaaugaguuucaagu

SEQ ID NO: 4214968 - RNA, 21 nt, Yersinia pestis KIM
augaauggaaguuaaaaaaau

SEQ ID NO: 4214969 - RNA, 13 nt, Yersinia pestis KIM
augaauuaaagau

SEQ ID NO: 4214970 - RNA, 12 nt, Yersinia pestis KIM
augaauuaucaa

SEQ ID NO: 4214971 - RNA, 17 nt, Yersinia pestis KIM
augaauuccuacaagau

SEQ ID NO: 4214972 - RNA, 12 nt, Yersinia pestis KIM
augacaaauaag

SEQ ID NO: 4214973 - RNA, 19 nt, Yersinia pestis KIM
augacaaguugucuguaau

SEQ ID NO: 4214974 - RNA, 13 nt, Yersinia pestis KIM
augacaauauccg

SEQ ID NO: 4214975 - RNA, 14 nt, Yersinia pestis KIM
augacacaauuccc

SEQ ID NO: 4214976 - RNA, 22 nt, Yersinia pestis KIM
augacagacgcgguuaacgacg

SEQ ID NO: 4214977 - RNA, 16 nt, Yersinia pestis KIM
augacagcaucaauau

SEQ ID NO: 4214978 - RNA, 21 nt, Yersinia pestis KIM
augacaggggauagcaacugc

SEQ ID NO: 4214979 - RNA, 13 nt, Yersinia pestis KIM
augacaguauuug

SEQ ID NO: 4214980 - RNA, 19 nt, Yersinia pestis KIM
augacaguauuugcagugg

SEQ ID NO: 4214981 - RNA, 20 nt, Yersinia pestis KIM
augacaguauuugcagugga

SEQ ID NO: 4214982 - RNA, 20 nt, Yersinia pestis KIM
augacaguauuuguagugga

SEQ ID NO: 4214983 - RNA, 20 nt, Yersinia pestis KIM
augacauauucaaccgccag

SEQ ID NO: 4214984 - RNA, 16 nt, Yersinia pestis KIM
augacauauugugcua

SEQ ID NO: 4214985 - RNA, 19 nt, Yersinia pestis KIM
augacaucccagcacaaug

SEQ ID NO: 4214986 - RNA, 22 nt, Yersinia pestis KIM
augacaucgacggcagugacga

SEQ ID NO: 4214987 - RNA, 19 nt, Yersinia pestis KIM
augacauugcgaauauugc

SEQ ID NO: 4214988 - RNA, 17 nt, Yersinia pestis KIM
augaccaagguuauaca

SEQ ID NO: 4214989 - RNA, 17 nt, Yersinia pestis KIM
augaccauuuauuucca

SEQ ID NO: 4214990 - RNA, 23 nt, Yersinia pestis KIM
augaccccgcgugcgcaucaaug

SEQ ID NO: 4214991 - RNA, 17 nt, Yersinia pestis KIM
augaccgccagugccgc

SEQ ID NO: 4214992 - RNA, 14 nt, Yersinia pestis KIM
augaccuggaagaa

SEQ ID NO: 4214993 - RNA, 23 nt, Yersinia pestis KIM
augaccuggaagaacagcuuugc

SEQ ID NO: 4214994 - RNA, 13 nt, Yersinia pestis KIM
augacgagaucau

SEQ ID NO: 4214995 - RNA, 19 nt, Yersinia pestis KIM
augacgccaacuucaagcc

SEQ ID NO: 4214996 - RNA, 17 nt, Yersinia pestis KIM
augacgcgaucuugaac

SEQ ID NO: 4214997 - RNA, 23 nt, Yersinia pestis KIM
augacgcuaaccaccgucaccaa

SEQ ID NO: 4214998 - RNA, 17 nt, Yersinia pestis KIM
augacgggaauauuuac

SEQ ID NO: 4214999 - RNA, 19 nt, Yersinia pestis KIM
augacgggaauauuuacac

SEQ ID NO: 4215000 - RNA, 17 nt, Yersinia pestis KIM
augacggguauauuuau

SEQ ID NO: 4215001 - RNA, 20 nt, Yersinia pestis KIM
augacgggugccgcgucuga

SEQ ID NO: 4215002 - RNA, 18 nt, Yersinia pestis KIM
augacgguugcugggauc

SEQ ID NO: 4215003 - RNA, 13 nt, Yersinia pestis KIM
augacuagcgagc

SEQ ID NO: 4215004 - RNA, 20 nt, Yersinia pestis KIM
augacucgaucuugaacggu

SEQ ID NO: 4215005 - RNA, 19 nt, Yersinia pestis KIM
augacucuggcagugaggc

SEQ ID NO: 4215006 - RNA, 12 nt, Yersinia pestis KIM
augacugaacau

SEQ ID NO: 4215007 - RNA, 18 nt, Yersinia pestis KIM
augacuuaacugaaagcc

SEQ ID NO: 4215008 - RNA, 16 nt, Yersinia pestis KIM
augagaaccaguucug

SEQ ID NO: 4215009 - RNA, 23 nt, Yersinia pestis KIM
augagaauaucuauauagggaaa

SEQ ID NO: 4215010 - RNA, 14 nt, Yersinia pestis KIM
augagaaugugacu

SEQ ID NO: 4215011 - RNA, 18 nt, Yersinia pestis KIM
augagagcgcagcaguga

SEQ ID NO: 4215012 - RNA, 22 nt, Yersinia pestis KIM
augagauccugaaaauagagca

SEQ ID NO: 4215013 - RNA, 16 nt, Yersinia pestis KIM
augagaugaacacaga

SEQ ID NO: 4215014 - RNA, 16 nt, Yersinia pestis KIM
augagauuaauucaaa

SEQ ID NO: 4215015 - RNA, 19 nt, Yersinia pestis KIM
augagauugaugggauuaa

SEQ ID NO: 4215016 - RNA, 20 nt, Yersinia pestis KIM
augagcacgaauuuugagga

SEQ ID NO: 4215017 - RNA, 14 nt, Yersinia pestis KIM
augagcuguagaac

SEQ ID NO: 4215018 - RNA, 21 nt, Yersinia pestis KIM
augaggcuaccugcaccaauc

SEQ ID NO: 4215019 - RNA, 21 nt, Yersinia pestis KIM
augcguuuagcuuccaacuga

SEQ ID NO: 4215020 - RNA, 12 nt, Yersinia pestis KIM
augcuaaaaaac

SEQ ID NO: 4215021 - RNA, 15 nt, Yersinia pestis KIM
augcuaaaaaacagc

SEQ ID NO: 4215022 - RNA, 18 nt, Yersinia pestis KIM
augcuaacaacuuccaca

SEQ ID NO: 4215023 - RNA, 18 nt, Yersinia pestis KIM
augcuaaccgaauaaaac

SEQ ID NO: 4215024 - RNA, 11 nt, Yersinia pestis KIM
augcuaacucg

SEQ ID NO: 4215025 - RNA, 17 nt, Yersinia pestis KIM
augcuaacucgcgauaa

SEQ ID NO: 4215026 - RNA, 11 nt, Yersinia pestis KIM
augcuauauuu

SEQ ID NO: 4215027 - RNA, 21 nt, Yersinia pestis KIM
augcuauauuuggcuuucagc

SEQ ID NO: 4215028 - RNA, 18 nt, Yersinia pestis KIM
augcuauuuacugcauuc

SEQ ID NO: 4215029 - RNA, 21 nt, Yersinia pestis KIM
augcucaauacuaaacccggu

SEQ ID NO: 4215030 - RNA, 13 nt, Yersinia pestis KIM
augcucacaauca

SEQ ID NO: 4215031 - RNA, 14 nt, Yersinia pestis KIM
augcucauuuaaaa

SEQ ID NO: 4215032 - RNA, 16 nt, Yersinia pestis KIM
augcucauuuaaaaua

SEQ ID NO: 4215033 - RNA, 11 nt, Yersinia pestis KIM
augcuccagau

SEQ ID NO: 4215034 - RNA, 15 nt, Yersinia pestis KIM
augcucgcuaaucaa

SEQ ID NO: 4215035 - RNA, 21 nt, Yersinia pestis KIM
augcucgcuaaucaagccuuc

SEQ ID NO: 4215036 - RNA, 17 nt, Yersinia pestis KIM
augcucgcucaucauaa

SEQ ID NO: 4215037 - RNA, 21 nt, Yersinia pestis KIM
augcucggugcgguaucaaca

SEQ ID NO: 4215038 - RNA, 16 nt, Yersinia pestis KIM
augcucugcugggaua

SEQ ID NO: 4215039 - RNA, 15 nt, Yersinia pestis KIM
augcucuuuuuaugc

SEQ ID NO: 4215040 - RNA, 21 nt, Yersinia pestis KIM
augcugaccccaaauuugaau

SEQ ID NO: 4215041 - RNA, 16 nt, Yersinia pestis KIM
augcugaugcaauaac

SEQ ID NO: 4215042 - RNA, 21 nt, Yersinia pestis KIM
augcugaugcaauaacuccac

SEQ ID NO: 4215043 - RNA, 14 nt, Yersinia pestis KIM
augcugcacaucaa

SEQ ID NO: 4215044 - RNA, 19 nt, Yersinia pestis KIM
augcuggguauauauacag

SEQ ID NO: 4215045 - RNA, 18 nt, Yersinia pestis KIM
augcuguagcagccugua

SEQ ID NO: 4215046 - RNA, 12 nt, Yersinia pestis KIM
augcugugccau

SEQ ID NO: 4215047 - RNA, 22 nt, Yersinia pestis KIM
augcuguuuuuuaguuaaauaa

SEQ ID NO: 4215048 - RNA, 13 nt, Yersinia pestis KIM
augcuuucaucuu

SEQ ID NO: 4215049 - RNA, 15 nt, Yersinia pestis KIM
augcuuuucuuuccc

SEQ ID NO: 4215050 - RNA, 22 nt, Yersinia pestis KIM
augcuuuucuuucccgccggca

SEQ ID NO: 4215051 - RNA, 16 nt, Yersinia pestis KIM
auggaaaaaauacagg

SEQ ID NO: 4215052 - RNA, 19 nt, Yersinia pestis KIM
auggaaaccggcaauagcc

SEQ ID NO: 4215053 - RNA, 21 nt, Yersinia pestis KIM
auggaaaccggcaauagccau

SEQ ID NO: 4215054 - RNA, 19 nt, Yersinia pestis KIM
auggaaauacgcuuaccug

SEQ ID NO: 4215055 - RNA, 15 nt, Yersinia pestis KIM
auggaaauagcucaa

SEQ ID NO: 4215056 - RNA, 18 nt, Yersinia pestis KIM
auggaacuguaaauauca

SEQ ID NO: 4215057 - RNA, 12 nt, Yersinia pestis KIM
auggaagaauca

SEQ ID NO: 4215058 - RNA, 24 nt, Yersinia pestis KIM
auggaagaaucaccgaaagaagac

SEQ ID NO: 4215059 - RNA, 13 nt, Yersinia pestis KIM
auggaaguuaaaa

SEQ ID NO: 4215060 - RNA, 21 nt, Yersinia pestis KIM
auggaauccccauggcuuuca

SEQ ID NO: 4215061 - RNA, 22 nt, Yersinia pestis KIM
auggaauguucauucaaguaaa

SEQ ID NO: 4215062 - RNA, 22 nt, Yersinia pestis KIM
auggacgaacagugccaacagc

SEQ ID NO: 4215063 - RNA, 22 nt, Yersinia pestis KIM
auggacgccgcuacaagcaugu

SEQ ID NO: 4215064 - RNA, 14 nt, Yersinia pestis KIM
auggacggcauaua

SEQ ID NO: 4215065 - RNA, 23 nt, Yersinia pestis KIM
auggacuacacagacuggugaac

SEQ ID NO: 4215066 - RNA, 14 nt, Yersinia pestis KIM
auggagagauguug

SEQ ID NO: 4215067 - RNA, 13 nt, Yersinia pestis KIM
auggagaggcgcu

SEQ ID NO: 4215068 - RNA, 14 nt, Yersinia pestis KIM
auggagaggcgcua

SEQ ID NO: 4215069 - RNA, 13 nt, Yersinia pestis KIM
auggauauuuucc

SEQ ID NO: 4215070 - RNA, 14 nt, Yersinia pestis KIM
auggaugaccaaug

SEQ ID NO: 4215071 - RNA, 21 nt, Yersinia pestis KIM
auggauuaucgccuggcuuga

SEQ ID NO: 4215072 - RNA, 15 nt, Yersinia pestis KIM
auggauuugcacaua

SEQ ID NO: 4215073 - RNA, 12 nt, Yersinia pestis KIM
auggcaacaaaa

SEQ ID NO: 4215074 - RNA, 13 nt, Yersinia pestis KIM
auggcaacagcau

SEQ ID NO: 4215075 - RNA, 15 nt, Yersinia pestis KIM
auggcaacagcaugg

SEQ ID NO: 4215076 - RNA, 18 nt, Yersinia pestis KIM
auggcacgcuuaaucuuu

SEQ ID NO: 4215077 - RNA, 22 nt, Yersinia pestis KIM
auggcagcccuuauucaaagaa

SEQ ID NO: 4215078 - RNA, 18 nt, Yersinia pestis KIM
auggcauauucaccagac

SEQ ID NO: 4215079 - RNA, 15 nt, Yersinia pestis KIM
auggccaauacccau

SEQ ID NO: 4215080 - RNA, 14 nt, Yersinia pestis KIM
auggccagacacug

SEQ ID NO: 4215081 - RNA, 15 nt, Yersinia pestis KIM
auggcccaagccauc

SEQ ID NO: 4215082 - RNA, 18 nt, Yersinia pestis KIM
auggcccaagccauccuu

SEQ ID NO: 4215083 - RNA, 15 nt, Yersinia pestis KIM
auggccgccagcacg

SEQ ID NO: 4215084 - RNA, 14 nt, Yersinia pestis KIM
auggccggacucau

SEQ ID NO: 4215085 - RNA, 21 nt, Yersinia pestis KIM
auggccucguauuacccucau

SEQ ID NO: 4215086 - RNA, 18 nt, Yersinia pestis KIM
auggcgaaaauccuucau

SEQ ID NO: 4215087 - RNA, 21 nt, Yersinia pestis KIM
auggcggcucgccugauagcg

SEQ ID NO: 4215088 - RNA, 20 nt, Yersinia pestis KIM
auggcggcuggaaaaccaau

SEQ ID NO: 4215089 - RNA, 13 nt, Yersinia pestis KIM
auggcggucgcac

SEQ ID NO: 4215090 - RNA, 19 nt, Yersinia pestis KIM
auggcguauugagugucau

SEQ ID NO: 4215091 - RNA, 20 nt, Yersinia pestis KIM
auggcuaagcacaauuguua

SEQ ID NO: 4215092 - RNA, 14 nt, Yersinia pestis KIM
auggcucagauuga

SEQ ID NO: 4215093 - RNA, 16 nt, Yersinia pestis KIM
auggcugaaauaacuu

SEQ ID NO: 4215094 - RNA, 16 nt, Yersinia pestis KIM
auggcugccaucagga

SEQ ID NO: 4215095 - RNA, 17 nt, Yersinia pestis KIM
auggcugccaucaggau

SEQ ID NO: 4215096 - RNA, 15 nt, Yersinia pestis KIM
auggcuuauuucacu

SEQ ID NO: 4215097 - RNA, 16 nt, Yersinia pestis KIM
auggcuugugcagcaa

SEQ ID NO: 4215098 - RNA, 14 nt, Yersinia pestis KIM
auggcuuuaugacc

SEQ ID NO: 4215099 - RNA, 17 nt, Yersinia pestis KIM
auggcuuuggugaucau

SEQ ID NO: 4215100 - RNA, 20 nt, Yersinia pestis KIM
auggcuuuuuuacgcgccug

SEQ ID NO: 4215101 - RNA, 13 nt, Yersinia pestis KIM
augggaaacaagg

SEQ ID NO: 4215102 - RNA, 12 nt, Yersinia pestis KIM
augggauaaacu

SEQ ID NO: 4215103 - RNA, 17 nt, Yersinia pestis KIM
augggcaucucaauaug

SEQ ID NO: 4215104 - RNA, 20 nt, Yersinia pestis KIM
augggcgccgcuuuaccugu

SEQ ID NO: 4215105 - RNA, 22 nt, Yersinia pestis KIM
augggcugcacuuuuacgggcc

SEQ ID NO: 4215106 - RNA, 15 nt, Yersinia pestis KIM
auggggacucuuuau

SEQ ID NO: 4215107 - RNA, 16 nt, Yersinia pestis KIM
auggggaucauguggg

SEQ ID NO: 4215108 - RNA, 19 nt, Yersinia pestis KIM
auggggccaccuaauccaa

SEQ ID NO: 4215109 - RNA, 14 nt, Yersinia pestis KIM
augggggauuaucg

SEQ ID NO: 4215110 - RNA, 20 nt, Yersinia pestis KIM
augggguaaucccgaaucaa

SEQ ID NO: 4215111 - RNA, 20 nt, Yersinia pestis KIM
augggguucgcuauccccac

SEQ ID NO: 4215112 - RNA, 21 nt, Yersinia pestis KIM
augggguuuauugguuauuuu

SEQ ID NO: 4215113 - RNA, 23 nt, Yersinia pestis KIM
auggguauauuaucauucaagaa

SEQ ID NO: 4215114 - RNA, 14 nt, Yersinia pestis KIM
augggugacucuuu

SEQ ID NO: 4215115 - RNA, 22 nt, Yersinia pestis KIM
auggguuguucuuuacuugguu

SEQ ID NO: 4215116 - RNA, 18 nt, Yersinia pestis KIM
augguaagaauaaauaau

SEQ ID NO: 4215117 - RNA, 22 nt, Yersinia pestis KIM
auggucaacuaaacagaucacc

SEQ ID NO: 4215118 - RNA, 16 nt, Yersinia pestis KIM
auggucacccuuuuga

SEQ ID NO: 4215119 - RNA, 21 nt, Yersinia pestis KIM
auggucacccuuuugaauuca

SEQ ID NO: 4215120 - RNA, 18 nt, Yersinia pestis KIM
auggucaggaacccauuu

SEQ ID NO: 4215121 - RNA, 16 nt, Yersinia pestis KIM
auggucaguuguucac

SEQ ID NO: 4215122 - RNA, 15 nt, Yersinia pestis KIM
auggugaaccagaua

SEQ ID NO: 4215123 - RNA, 19 nt, Yersinia pestis KIM
auggugagcucaucuuauu

SEQ ID NO: 4215124 - RNA, 19 nt, Yersinia pestis KIM
auggugcuguauuuaaccg

SEQ ID NO: 4215125 - RNA, 19 nt, Yersinia pestis KIM
auggugggccgugcgggau

SEQ ID NO: 4215126 - RNA, 18 nt, Yersinia pestis KIM
auggugggucgugcggga

SEQ ID NO: 4215127 - RNA, 17 nt, Yersinia pestis KIM
augguguaaaugcccgu

SEQ ID NO: 4215128 - RNA, 20 nt, Yersinia pestis KIM
augguguguagucuucauca

SEQ ID NO: 4215129 - RNA, 16 nt, Yersinia pestis KIM
augguguuaucuucac

SEQ ID NO: 4215130 - RNA, 17 nt, Yersinia pestis KIM
augguguuaucuucacu

SEQ ID NO: 4215131 - RNA, 15 nt, Yersinia pestis KIM
augguuaaaacucaa

SEQ ID NO: 4215132 - RNA, 21 nt, Yersinia pestis KIM
augguuaagagaucccgugcc

SEQ ID NO: 4215133 - RNA, 18 nt, Yersinia pestis KIM
augguucaucauuuuuua

SEQ ID NO: 4215134 - RNA, 14 nt, Yersinia pestis KIM
auuaaggcgauauu

SEQ ID NO: 4215135 - RNA, 19 nt, Yersinia pestis KIM
auuaauaaccauaaaauaa

SEQ ID NO: 4215136 - RNA, 14 nt, Yersinia pestis KIM
auuaauaacgccga

SEQ ID NO: 4215137 - RNA, 17 nt, Yersinia pestis KIM
auuaauaauaaauugca

SEQ ID NO: 4215138 - RNA, 13 nt, Yersinia pestis KIM
auuaauacaucau

SEQ ID NO: 4215139 - RNA, 14 nt, Yersinia pestis KIM
auuaauacaucauc

SEQ ID NO: 4215140 - RNA, 21 nt, Yersinia pestis KIM
auuaauaguguuguaagauuu

SEQ ID NO: 4215141 - RNA, 16 nt, Yersinia pestis KIM
auuaauaucaaaacug

SEQ ID NO: 4215142 - RNA, 17 nt, Yersinia pestis KIM
auuaauaucaaaacuga

SEQ ID NO: 4215143 - RNA, 20 nt, Yersinia pestis KIM
auuaaucaacagauaugcau

SEQ ID NO: 4215144 - RNA, 23 nt, Yersinia pestis KIM
auuaaucaagauauuacuucuuu

SEQ ID NO: 4215145 - RNA, 23 nt, Yersinia pestis KIM
auuaauccccggucacuuaaaua

SEQ ID NO: 4215146 - RNA, 16 nt, Yersinia pestis KIM
auuaaugagucaauga

SEQ ID NO: 4215147 - RNA, 12 nt, Yersinia pestis KIM
auuaaugauaac

SEQ ID NO: 4215148 - RNA, 16 nt, Yersinia pestis KIM
auuaauggauaaugcu

SEQ ID NO: 4215149 - RNA, 20 nt, Yersinia pestis KIM
auuaauggauaaugcugaug

SEQ ID NO: 4215150 - RNA, 17 nt, Yersinia pestis KIM
auuaauggauagcugua

SEQ ID NO: 4215151 - RNA, 22 nt, Yersinia pestis KIM
auuaauggauugaucauucucu

SEQ ID NO: 4215152 - RNA, 20 nt, Yersinia pestis KIM
auuaaugggcgauauauuuc

SEQ ID NO: 4215153 - RNA, 20 nt, Yersinia pestis KIM
auuaaugucgccauaacgca

SEQ ID NO: 4215154 - RNA, 22 nt, Yersinia pestis KIM
auuaaugucgccauaacgcaca

SEQ ID NO: 4215155 - RNA, 13 nt, Yersinia pestis KIM
auuaauuaagcua

SEQ ID NO: 4215156 - RNA, 15 nt, Yersinia pestis KIM
auuaauuaagcuauu

SEQ ID NO: 4215157 - RNA, 13 nt, Yersinia pestis KIM
auuaauuaaugaa

SEQ ID NO: 4215158 - RNA, 16 nt, Yersinia pestis KIM
auuaauuaguuuuaau

SEQ ID NO: 4215159 - RNA, 18 nt, Yersinia pestis KIM
auuaauuaguuuuaauaa

SEQ ID NO: 4215160 - RNA, 11 nt, Yersinia pestis KIM
auuaauuauuc

SEQ ID NO: 4215161 - RNA, 22 nt, Yersinia pestis KIM
auuaauuccacgcugaaacuuu

SEQ ID NO: 4215162 - RNA, 13 nt, Yersinia pestis KIM
auuaauuuaaaca

SEQ ID NO: 4215163 - RNA, 15 nt, Yersinia pestis KIM
auuaauuuaaacaac

SEQ ID NO: 4215164 - RNA, 16 nt, Yersinia pestis KIM
auuaauuucaccacau

SEQ ID NO: 4215165 - RNA, 13 nt, Yersinia pestis KIM
auuacaaaauaua

SEQ ID NO: 4215166 - RNA, 13 nt, Yersinia pestis KIM
auuacaacuugaa

SEQ ID NO: 4215167 - RNA, 15 nt, Yersinia pestis KIM
auuacaagugccaaa

SEQ ID NO: 4215168 - RNA, 13 nt, Yersinia pestis KIM
auuacacagcauc

SEQ ID NO: 4215169 - RNA, 18 nt, Yersinia pestis KIM
auuacaccuuaaaacagc

SEQ ID NO: 4215170 - RNA, 22 nt, Yersinia pestis KIM
auuacacgaucccucggugaua

SEQ ID NO: 4215171 - RNA, 22 nt, Yersinia pestis KIM
auuacacuuucuuugaugcaua

SEQ ID NO: 4215172 - RNA, 17 nt, Yersinia pestis KIM
auuacaggccccaaucc

SEQ ID NO: 4215173 - RNA, 18 nt, Yersinia pestis KIM
auuacaguucuuuaucca

SEQ ID NO: 4215174 - RNA, 18 nt, Yersinia pestis KIM
auuacaguugauauuauu

SEQ ID NO: 4215175 - RNA, 23 nt, Yersinia pestis KIM
auuaccaccgucaagacaacaaa

SEQ ID NO: 4215176 - RNA, 16 nt, Yersinia pestis KIM
auuaccauuacuucua

SEQ ID NO: 4215177 - RNA, 21 nt, Yersinia pestis KIM
auuacccacgccgaaaacaau

SEQ ID NO: 4215178 - RNA, 13 nt, Yersinia pestis KIM
auuacccauaacu

SEQ ID NO: 4215179 - RNA, 20 nt, Yersinia pestis KIM
auuacccucauuuuacccga

SEQ ID NO: 4215180 - RNA, 16 nt, Yersinia pestis KIM
auuaccggcacuggcu

SEQ ID NO: 4215181 - RNA, 20 nt, Yersinia pestis KIM
auuaccggcguuuuuacagu

SEQ ID NO: 4215182 - RNA, 23 nt, Yersinia pestis KIM
auuaccgucagggacaacaucau

SEQ ID NO: 4215183 - RNA, 23 nt, Yersinia pestis KIM
auuaccugagagagguugaggau

SEQ ID NO: 4215184 - RNA, 22 nt, Yersinia pestis KIM
auuaccugccccacaaugaauu

SEQ ID NO: 4215185 - RNA, 13 nt, Yersinia pestis KIM
auuaccuuuaaaa

SEQ ID NO: 4215186 - RNA, 21 nt, Yersinia pestis KIM
auuaccuuuaaaacuggucag

SEQ ID NO: 4215187 - RNA, 13 nt, Yersinia pestis KIM
auuaccuuuuuac

SEQ ID NO: 4215188 - RNA, 16 nt, Yersinia pestis KIM
auuacgccauccacuc

SEQ ID NO: 4215189 - RNA, 14 nt, Yersinia pestis KIM
auuacgcgucauca

SEQ ID NO: 4215190 - RNA, 14 nt, Yersinia pestis KIM
auuacggucaccaa

SEQ ID NO: 4215191 - RNA, 15 nt, Yersinia pestis KIM
auuacggucaccaau

SEQ ID NO: 4215192 - RNA, 23 nt, Yersinia pestis KIM
auuacgguuuaccaccuuaaaau

SEQ ID NO: 4215193 - RNA, 15 nt, Yersinia pestis KIM
auuacucaggaacaa

SEQ ID NO: 4215194 - RNA, 22 nt, Yersinia pestis KIM
auuacucaggaacaagacuuuc

SEQ ID NO: 4215195 - RNA, 13 nt, Yersinia pestis KIM
auuacuccacacg

SEQ ID NO: 4215196 - RNA, 17 nt, Yersinia pestis KIM
auuacucguauaaaaaa

SEQ ID NO: 4215197 - RNA, 18 nt, Yersinia pestis KIM
auuacuguucaucauauc

SEQ ID NO: 4215198 - RNA, 15 nt, Yersinia pestis KIM
auuacuucgcuuuac

SEQ ID NO: 4215199 - RNA, 15 nt, Yersinia pestis KIM
auuacuucuuuuuaa

SEQ ID NO: 4215200 - RNA, 15 nt, Yersinia pestis KIM
auuacuuuauuuaaa

SEQ ID NO: 4215201 - RNA, 14 nt, Yersinia pestis KIM
auuacuuugaauag

SEQ ID NO: 4215202 - RNA, 19 nt, Yersinia pestis KIM
auuagaauguguaguugaa

SEQ ID NO: 4215203 - RNA, 19 nt, Yersinia pestis KIM
auuagaugagugguuuaua

SEQ ID NO: 4215204 - RNA, 19 nt, Yersinia pestis KIM
auuagaugguuaacucauu

SEQ ID NO: 4215205 - RNA, 16 nt, Yersinia pestis KIM
auuagcagggcaguaa

SEQ ID NO: 4215206 - RNA, 13 nt, Yersinia pestis KIM
auuagcaguaacg

SEQ ID NO: 4215207 - RNA, 15 nt, Yersinia pestis KIM
auuagcauuaccggu

SEQ ID NO: 4215208 - RNA, 21 nt, Yersinia pestis KIM
auuagccaagguccaacuccc

SEQ ID NO: 4215209 - RNA, 18 nt, Yersinia pestis KIM
auuagccagccaauggcc

SEQ ID NO: 4215210 - RNA, 12 nt, Yersinia pestis KIM
auuagccauaag

SEQ ID NO: 4215211 - RNA, 18 nt, Yersinia pestis KIM
auuagccccaaaugccag

SEQ ID NO: 4215212 - RNA, 22 nt, Yersinia pestis KIM
auuagccugaccgguaauaucg

SEQ ID NO: 4215213 - RNA, 21 nt, Yersinia pestis KIM
auuagcuugugugcuuacauu

SEQ ID NO: 4215214 - RNA, 15 nt, Yersinia pestis KIM
auuaggcaugauaag

SEQ ID NO: 4215215 - RNA, 16 nt, Yersinia pestis KIM
auuagggcugacagag

SEQ ID NO: 4215216 - RNA, 19 nt, Yersinia pestis KIM
auuagucccuaaagagcga

SEQ ID NO: 4215217 - RNA, 21 nt, Yersinia pestis KIM
auuagucgcuuuuuguauuuu

SEQ ID NO: 4215218 - RNA, 15 nt, Yersinia pestis KIM
auuagugacagccac

SEQ ID NO: 4215219 - RNA, 20 nt, Yersinia pestis KIM
auuagugagcgguugaaaag

SEQ ID NO: 4215220 - RNA, 22 nt, Yersinia pestis KIM
auuagugagcgguugaaaaguu

SEQ ID NO: 4215221 - RNA, 19 nt, Yersinia pestis KIM
auuaguuuuaauaaccauu

SEQ ID NO: 4215222 - RNA, 12 nt, Yersinia pestis KIM
auuauaaugaaa

SEQ ID NO: 4215223 - RNA, 13 nt, Yersinia pestis KIM
auuauaaugaaau

SEQ ID NO: 4215224 - RNA, 22 nt, Yersinia pestis KIM
auuauagccaaaucuggauaau

SEQ ID NO: 4215225 - RNA, 23 nt, Yersinia pestis KIM
auuauauaagagaugaaauuuua

SEQ ID NO: 4215226 - RNA, 15 nt, Yersinia pestis KIM
auuaucaaguuaaau

SEQ ID NO: 4215227 - RNA, 15 nt, Yersinia pestis KIM
auuaucaucaauagc

SEQ ID NO: 4215228 - RNA, 16 nt, Yersinia pestis KIM
auuaucaucaauagcg

SEQ ID NO: 4215229 - RNA, 12 nt, Yersinia pestis KIM
auuaucaucacc

SEQ ID NO: 4215230 - RNA, 13 nt, Yersinia pestis KIM
auuaucaucacca

SEQ ID NO: 4215231 - RNA, 14 nt, Yersinia pestis KIM
auuaucaucaccau

SEQ ID NO: 4215232 - RNA, 19 nt, Yersinia pestis KIM
auuaucaucauuacacuga

SEQ ID NO: 4215233 - RNA, 12 nt, Yersinia pestis KIM
auuaucaucuuu

SEQ ID NO: 4215234 - RNA, 18 nt, Yersinia pestis KIM
auuaucauucaagaaaau

SEQ ID NO: 4215235 - RNA, 23 nt, Yersinia pestis KIM
auuauccacgggcgcaauggaag

SEQ ID NO: 4215236 - RNA, 15 nt, Yersinia pestis KIM
auuaucccaguuuuu

SEQ ID NO: 4215237 - RNA, 21 nt, Yersinia pestis KIM
auuaucccguucaauaauagu

SEQ ID NO: 4215238 - RNA, 21 nt, Yersinia pestis KIM
auuauccgcaccauagauuaa

SEQ ID NO: 4215239 - RNA, 16 nt, Yersinia pestis KIM
auuauccguuugcaac

SEQ ID NO: 4215240 - RNA, 19 nt, Yersinia pestis KIM
auuauccguuugcaacagu

SEQ ID NO: 4215241 - RNA, 19 nt, Yersinia pestis KIM
auuaucgauaaauaauuac

SEQ ID NO: 4215242 - RNA, 12 nt, Yersinia pestis KIM
auuaucuucuau

SEQ ID NO: 4215243 - RNA, 18 nt, Yersinia pestis KIM
auuaucuuuaauuuucug

SEQ ID NO: 4215244 - RNA, 14 nt, Yersinia pestis KIM
auuaugaaaguaag

SEQ ID NO: 4215245 - RNA, 19 nt, Yersinia pestis KIM
auuaugaaaguaagagucu

SEQ ID NO: 4215246 - RNA, 15 nt, Yersinia pestis KIM
auuauguaaauaguu

SEQ ID NO: 4215247 - RNA, 22 nt, Yersinia pestis KIM
auuauuaaacagauucaauauu

SEQ ID NO: 4215248 - RNA, 18 nt, Yersinia pestis KIM
auuauuaaacugauuuaa

SEQ ID NO: 4215249 - RNA, 16 nt, Yersinia pestis KIM
auuccuauaaauuuua

SEQ ID NO: 4215250 - RNA, 19 nt, Yersinia pestis KIM
auuccucaucgaaauuccc

SEQ ID NO: 4215251 - RNA, 22 nt, Yersinia pestis KIM
auuccuggccgguguuggauaa

SEQ ID NO: 4215252 - RNA, 16 nt, Yersinia pestis KIM
auuccuuaccugaugu

SEQ ID NO: 4215253 - RNA, 20 nt, Yersinia pestis KIM
auucgaguuaacuucagguu

SEQ ID NO: 4215254 - RNA, 16 nt, Yersinia pestis KIM
auucgauaaaaggcua

SEQ ID NO: 4215255 - RNA, 14 nt, Yersinia pestis KIM
auucgauagaaaca

SEQ ID NO: 4215256 - RNA, 18 nt, Yersinia pestis KIM
auucgauagaaacaucag

SEQ ID NO: 4215257 - RNA, 22 nt, Yersinia pestis KIM
auucgcacaguuuucuuaaaau

SEQ ID NO: 4215258 - RNA, 21 nt, Yersinia pestis KIM
auucgcaucuuccaaaggaag

SEQ ID NO: 4215259 - RNA, 13 nt, Yersinia pestis KIM
auucgccagauac

SEQ ID NO: 4215260 - RNA, 18 nt, Yersinia pestis KIM
auucgccugauaaaauua

SEQ ID NO: 4215261 - RNA, 16 nt, Yersinia pestis KIM
auucgcgguuacacca

SEQ ID NO: 4215262 - RNA, 19 nt, Yersinia pestis KIM
auucgcugaacaauugcca

SEQ ID NO: 4215263 - RNA, 22 nt, Yersinia pestis KIM
auucgggcugaguaaagcccag

SEQ ID NO: 4215264 - RNA, 15 nt, Yersinia pestis KIM
auucgggugagugaa

SEQ ID NO: 4215265 - RNA, 18 nt, Yersinia pestis KIM
auucgucaccaucaauau

SEQ ID NO: 4215266 - RNA, 23 nt, Yersinia pestis KIM
auucgugccauaaaguuuuuccu

SEQ ID NO: 4215267 - RNA, 21 nt, Yersinia pestis KIM
auucgugcucaucaaccucag

SEQ ID NO: 4215268 - RNA, 18 nt, Yersinia pestis KIM
auucguggugaugaugac

SEQ ID NO: 4215269 - RNA, 18 nt, Yersinia pestis KIM
auucguuagcucuucacg

SEQ ID NO: 4215270 - RNA, 21 nt, Yersinia pestis KIM
auucuaccuggcucaaauuug

SEQ ID NO: 4215271 - RNA, 17 nt, Yersinia pestis KIM
auucuauccggauuaaa

SEQ ID NO: 4215272 - RNA, 18 nt, Yersinia pestis KIM
auucuauccggauuaaau

SEQ ID NO: 4215273 - RNA, 22 nt, Yersinia pestis KIM
auucucaaaggagacuucgcca

SEQ ID NO: 4215274 - RNA, 12 nt, Yersinia pestis KIM
auucucaauauu

SEQ ID NO: 4215275 - RNA, 14 nt, Yersinia pestis KIM
auucucaauauuaa

SEQ ID NO: 4215276 - RNA, 19 nt, Yersinia pestis KIM
auucucaauauuaauaaug

SEQ ID NO: 4215277 - RNA, 15 nt, Yersinia pestis KIM
auucucccauuuauu

SEQ ID NO: 4215278 - RNA, 14 nt, Yersinia pestis KIM
auucuccuuucuuu

SEQ ID NO: 4215279 - RNA, 23 nt, Yersinia pestis KIM
auucucggcaugcuuccagauaa

SEQ ID NO: 4215280 - RNA, 20 nt, Yersinia pestis KIM
auucucuacucgcucaccac

SEQ ID NO: 4215281 - RNA, 21 nt, Yersinia pestis KIM
auucucuacucgcucaccacu

SEQ ID NO: 4215282 - RNA, 23 nt, Yersinia pestis KIM
auucucucuuuugagaguucacu

SEQ ID NO: 4215283 - RNA, 17 nt, Yersinia pestis KIM
auucucuggugauacca

SEQ ID NO: 4215284 - RNA, 12 nt, Yersinia pestis KIM
auucucugucuu

SEQ ID NO: 4215285 - RNA, 15 nt, Yersinia pestis KIM
auucucuucaccuuc

SEQ ID NO: 4215286 - RNA, 20 nt, Yersinia pestis KIM
auucugaagacacacuuauu

SEQ ID NO: 4215287 - RNA, 18 nt, Yersinia pestis KIM
auucugaaucgcugccau

SEQ ID NO: 4215288 - RNA, 20 nt, Yersinia pestis KIM
auucugacggcacucuauuu

SEQ ID NO: 4215289 - RNA, 22 nt, Yersinia pestis KIM
auucugacgggacaaucuguuc

SEQ ID NO: 4215290 - RNA, 18 nt, Yersinia pestis KIM
auucugagggacagagag

SEQ ID NO: 4215291 - RNA, 22 nt, Yersinia pestis KIM
auucugagggacagagagauaa

SEQ ID NO: 4215292 - RNA, 19 nt, Yersinia pestis KIM
auucugauagugauuuuuu

SEQ ID NO: 4215293 - RNA, 13 nt, Yersinia pestis KIM
auucugcaugcuu

SEQ ID NO: 4215294 - RNA, 21 nt, Yersinia pestis KIM
auucugccgacuaauauuuca

SEQ ID NO: 4215295 - RNA, 16 nt, Yersinia pestis KIM
auucugccuauccuca

SEQ ID NO: 4215296 - RNA, 16 nt, Yersinia pestis KIM
auucugcuuuuugcuu

SEQ ID NO: 4215297 - RNA, 17 nt, Yersinia pestis KIM
auucugcuuuuugcuuu

SEQ ID NO: 4215298 - RNA, 22 nt, Yersinia pestis KIM
auucuggcggcuuuaauccauu

SEQ ID NO: 4215299 - RNA, 13 nt, Yersinia pestis KIM
auucuggcugaua

SEQ ID NO: 4215300 - RNA, 19 nt, Yersinia pestis KIM
auucugggaucgcgcagug

SEQ ID NO: 4215301 - RNA, 20 nt, Yersinia pestis KIM
auucuggguacaacacaaaa

SEQ ID NO: 4215302 - RNA, 18 nt, Yersinia pestis KIM
auucuguagaguaaaacu

SEQ ID NO: 4215303 - RNA, 21 nt, Yersinia pestis KIM
auucuguagaguaaaacugau

SEQ ID NO: 4215304 - RNA, 12 nt, Yersinia pestis KIM
auucuuagccag

SEQ ID NO: 4215305 - RNA, 18 nt, Yersinia pestis KIM
auucuuaucaaucaaaaa

SEQ ID NO: 4215306 - RNA, 20 nt, Yersinia pestis KIM
auucuuaucaaucaaaaaau

SEQ ID NO: 4215307 - RNA, 12 nt, Yersinia pestis KIM
auucuugaaauu

SEQ ID NO: 4215308 - RNA, 16 nt, Yersinia pestis KIM
auucuuggguguuuau

SEQ ID NO: 4215309 - RNA, 14 nt, Yersinia pestis KIM
auucuuuuauacag

SEQ ID NO: 4215310 - RNA, 18 nt, Yersinia pestis KIM
auucuuuuuguuaaaaua

SEQ ID NO: 4215311 - RNA, 21 nt, Yersinia pestis KIM
auucuuuuuguuaaaauagug

SEQ ID NO: 4215312 - RNA, 15 nt, Yersinia pestis KIM
auugaaaaaauaaug

SEQ ID NO: 4215313 - RNA, 22 nt, Yersinia pestis KIM
auugaaaaucaguuuacaugau

SEQ ID NO: 4215314 - RNA, 12 nt, Yersinia pestis KIM
auugaacaugau

SEQ ID NO: 4215315 - RNA, 11 nt, Yersinia pestis KIM
auugaagaguu

SEQ ID NO: 4215316 - RNA, 19 nt, Yersinia pestis KIM
auugaagaguuugaucaug

SEQ ID NO: 4215317 - RNA, 14 nt, Yersinia pestis KIM
auugaagauacccu

SEQ ID NO: 4215318 - RNA, 21 nt, Yersinia pestis KIM
auugaauaacuucgcgaacac

SEQ ID NO: 4215319 - RNA, 17 nt, Yersinia pestis KIM
auugaauuaaauuuuau

SEQ ID NO: 4215320 - RNA, 14 nt, Yersinia pestis KIM
auugacaaagugcc

SEQ ID NO: 4215321 - RNA, 19 nt, Yersinia pestis KIM
auugacaaagugccugcaa

SEQ ID NO: 4215322 - RNA, 17 nt, Yersinia pestis KIM
auugacaacgcuauucu

SEQ ID NO: 4215323 - RNA, 22 nt, Yersinia pestis KIM
auugacacaauagaugcaguaa

SEQ ID NO: 4215324 - RNA, 15 nt, Yersinia pestis KIM
auugaccaauaaaau

SEQ ID NO: 4215325 - RNA, 14 nt, Yersinia pestis KIM
auugaccaccagag

SEQ ID NO: 4215326 - RNA, 12 nt, Yersinia pestis KIM
auugaccacuug

SEQ ID NO: 4215327 - RNA, 16 nt, Yersinia pestis KIM
auugacugaaugugaa

SEQ ID NO: 4215328 - RNA, 16 nt, Yersinia pestis KIM
auugacuuuaaaaaaa

SEQ ID NO: 4215329 - RNA, 15 nt, Yersinia pestis KIM
auugagaagaaauca

SEQ ID NO: 4215330 - RNA, 23 nt, Yersinia pestis KIM
auugagacccguuacugcaucua

SEQ ID NO: 4215331 - RNA, 24 nt, Yersinia pestis KIM
auugagcauaucaaucagcaucuu

SEQ ID NO: 4215332 - RNA, 20 nt, Yersinia pestis KIM
auugagcgccacaucggcgu

SEQ ID NO: 4215333 - RNA, 18 nt, Yersinia pestis KIM
auugaggguugucagcag

SEQ ID NO: 4215334 - RNA, 13 nt, Yersinia pestis KIM
auugauaaaaccg

SEQ ID NO: 4215335 - RNA, 17 nt, Yersinia pestis KIM
auugauaaaaguaauuu

SEQ ID NO: 4215336 - RNA, 23 nt, Yersinia pestis KIM
auugauaagccauuuuuuauaaa

SEQ ID NO: 4215337 - RNA, 19 nt, Yersinia pestis KIM
auugauaauggcauuuuca

SEQ ID NO: 4215338 - RNA, 16 nt, Yersinia pestis KIM
auugauauauagaaau

SEQ ID NO: 4215339 - RNA, 15 nt, Yersinia pestis KIM
auugaucauucucug

SEQ ID NO: 4215340 - RNA, 17 nt, Yersinia pestis KIM
auugauccaaauggcug

SEQ ID NO: 4215341 - RNA, 12 nt, Yersinia pestis KIM
auugauccaggg

SEQ ID NO: 4215342 - RNA, 15 nt, Yersinia pestis KIM
auugaugcacaguag

SEQ ID NO: 4215343 - RNA, 19 nt, Yersinia pestis KIM
auugauggccuugaaucaa

SEQ ID NO: 4215344 - RNA, 14 nt, Yersinia pestis KIM
auugauugcuuacc

SEQ ID NO: 4215345 - RNA, 22 nt, Yersinia pestis KIM
auugauuuguaauaacgauuaa

SEQ ID NO: 4215346 - RNA, 14 nt, Yersinia pestis KIM
auugcaaaacauag

SEQ ID NO: 4215347 - RNA, 21 nt, Yersinia pestis KIM
auugcaacaacgccagauaac

SEQ ID NO: 4215348 - RNA, 14 nt, Yersinia pestis KIM
auugcaacgcuugc

SEQ ID NO: 4215349 - RNA, 13 nt, Yersinia pestis KIM
auugcaacugggc

SEQ ID NO: 4215350 - RNA, 15 nt, Yersinia pestis KIM
auugcacaauagcua

SEQ ID NO: 4215351 - RNA, 21 nt, Yersinia pestis KIM
auugcacaugcagcauuucag

SEQ ID NO: 4215352 - RNA, 20 nt, Yersinia pestis KIM
auugcacgguauagcuauca

SEQ ID NO: 4215353 - RNA, 17 nt, Yersinia pestis KIM
auugcagagcaaaacug

SEQ ID NO: 4215354 - RNA, 17 nt, Yersinia pestis KIM
auugcagauaccacauc

SEQ ID NO: 4215355 - RNA, 18 nt, Yersinia pestis KIM
auugcaggaaguuaugga

SEQ ID NO: 4215356 - RNA, 16 nt, Yersinia pestis KIM
auugcauccgcuuuca

SEQ ID NO: 4215357 - RNA, 13 nt, Yersinia pestis KIM
auugcaucuuuaa

SEQ ID NO: 4215358 - RNA, 22 nt, Yersinia pestis KIM
auugcauuuuacaggauuaaau

SEQ ID NO: 4215359 - RNA, 13 nt, Yersinia pestis KIM
auugccaaaugca

SEQ ID NO: 4215360 - RNA, 18 nt, Yersinia pestis KIM
auugccagaacaagacug

SEQ ID NO: 4215361 - RNA, 14 nt, Yersinia pestis KIM
auugccagugaacc

SEQ ID NO: 4215362 - RNA, 22 nt, Yersinia pestis KIM
auugccaucuuguucuaauaau

SEQ ID NO: 4215363 - RNA, 17 nt, Yersinia pestis KIM
auuuaucgccaacauaa

SEQ ID NO: 4215364 - RNA, 19 nt, Yersinia pestis KIM
auuuaucgcuguuuacuga

SEQ ID NO: 4215365 - RNA, 19 nt, Yersinia pestis KIM
auuuaucuaauguauuuau

SEQ ID NO: 4215366 - RNA, 14 nt, Yersinia pestis KIM
auuuaugaacacuc

SEQ ID NO: 4215367 - RNA, 22 nt, Yersinia pestis KIM
auuuaugacggguauauagcca

SEQ ID NO: 4215368 - RNA, 23 nt, Yersinia pestis KIM
auuuaugcaccaaauucagaaug

SEQ ID NO: 4215369 - RNA, 18 nt, Yersinia pestis KIM
auuuauugccauuuuaau

SEQ ID NO: 4215370 - RNA, 18 nt, Yersinia pestis KIM
auuuauuggucaauaaaa

SEQ ID NO: 4215371 - RNA, 19 nt, Yersinia pestis KIM
auuuauuggucaauaaaau

SEQ ID NO: 4215372 - RNA, 20 nt, Yersinia pestis KIM
auuuauuggucaauaaaauu

SEQ ID NO: 4215373 - RNA, 21 nt, Yersinia pestis KIM
auuucaaacguguacuuuccc

SEQ ID NO: 4215374 - RNA, 21 nt, Yersinia pestis KIM
auuucaacgcaccauccagca

SEQ ID NO: 4215375 - RNA, 10 nt, Yersinia pestis KIM
auuucaagcu

SEQ ID NO: 4215376 - RNA, 16 nt, Yersinia pestis KIM
auuucaauauaugaau

SEQ ID NO: 4215377 - RNA, 12 nt, Yersinia pestis KIM
auuucaaucacu

SEQ ID NO: 4215378 - RNA, 20 nt, Yersinia pestis KIM
auuucacacuguuuaguuca

SEQ ID NO: 4215379 - RNA, 17 nt, Yersinia pestis KIM
auuucaccuauaauuaa

SEQ ID NO: 4215380 - RNA, 18 nt, Yersinia pestis KIM
auuucaccuauaauuaac

SEQ ID NO: 4215381 - RNA, 18 nt, Yersinia pestis KIM
auuucacuggaaaaagug

SEQ ID NO: 4215382 - RNA, 16 nt, Yersinia pestis KIM
auuucacuuccauucc

SEQ ID NO: 4215383 - RNA, 13 nt, Yersinia pestis KIM
auuucagacugcu

SEQ ID NO: 4215384 - RNA, 19 nt, Yersinia pestis KIM
auuucagacugcugacaac

SEQ ID NO: 4215385 - RNA, 22 nt, Yersinia pestis KIM
auuucagauaaaaauaaucaau

SEQ ID NO: 4215386 - RNA, 17 nt, Yersinia pestis KIM
auuucagcagcacguuc

SEQ ID NO: 4215387 - RNA, 14 nt, Yersinia pestis KIM
auuucagcguagca

SEQ ID NO: 4215388 - RNA, 13 nt, Yersinia pestis KIM
auuucagcuuuua

SEQ ID NO: 4215389 - RNA, 11 nt, Yersinia pestis KIM
auuucagggcg

SEQ ID NO: 4215390 - RNA, 15 nt, Yersinia pestis KIM
auuucagucaauaaa

SEQ ID NO: 4215391 - RNA, 19 nt, Yersinia pestis KIM
auuucagucaauaaacauu

SEQ ID NO: 4215392 - RNA, 15 nt, Yersinia pestis KIM
auuucaguuuuuagg

SEQ ID NO: 4215393 - RNA, 19 nt, Yersinia pestis KIM
auuucaucggcaaaaacag

SEQ ID NO: 4215394 - RNA, 20 nt, Yersinia pestis KIM
auuucaucggcaaaaacagu

SEQ ID NO: 4215395 - RNA, 24 nt, Yersinia pestis KIM
auuucaucggcaaaaacagucauu

SEQ ID NO: 4215396 - RNA, 17 nt, Yersinia pestis KIM
auuucaugcgaauacuu

SEQ ID NO: 4215397 - RNA, 16 nt, Yersinia pestis KIM
auuucccguugauauc

SEQ ID NO: 4215398 - RNA, 16 nt, Yersinia pestis KIM
auuucccugcggccau

SEQ ID NO: 4215399 - RNA, 22 nt, Yersinia pestis KIM
auuucccugcggccauccagaa

SEQ ID NO: 4215400 - RNA, 11 nt, Yersinia pestis KIM
auuuccgaaag

SEQ ID NO: 4215401 - RNA, 22 nt, Yersinia pestis KIM
auuuccgccccuugcuucaguu

SEQ ID NO: 4215402 - RNA, 17 nt, Yersinia pestis KIM
auuuccguuaacccaaa

SEQ ID NO: 4215403 - RNA, 20 nt, Yersinia pestis KIM
auuuccuuggcagcaauagc

SEQ ID NO: 4215404 - RNA, 14 nt, Yersinia pestis KIM
auuucgaaaacuca

SEQ ID NO: 4215405 - RNA, 23 nt, Yersinia pestis KIM
auuucgaaaacucaaagauuuca

SEQ ID NO: 4215406 - RNA, 16 nt, Yersinia pestis KIM
auuucgacaacgccaa

SEQ ID NO: 4215407 - RNA, 13 nt, Yersinia pestis KIM
auuucgcccugca

SEQ ID NO: 4215408 - RNA, 19 nt, Yersinia pestis KIM
auuucgcccugcauaucau

SEQ ID NO: 4215409 - RNA, 22 nt, Yersinia pestis KIM
auuucgccguauuuguauuuac

SEQ ID NO: 4215410 - RNA, 17 nt, Yersinia pestis KIM
auuucgccuuucauaca

SEQ ID NO: 4215411 - RNA, 15 nt, Yersinia pestis KIM
auuucggcuauuuca

SEQ ID NO: 4215412 - RNA, 15 nt, Yersinia pestis KIM
auuucgguaggaaua

SEQ ID NO: 4215413 - RNA, 23 nt, Yersinia pestis KIM
auuucuaauucgugggcauuuuu

SEQ ID NO: 4215414 - RNA, 20 nt, Yersinia pestis KIM
auuucuacgccgucaucauc

SEQ ID NO: 4215415 - RNA, 16 nt, Yersinia pestis KIM
auuucuccauugcggu

SEQ ID NO: 4215416 - RNA, 13 nt, Yersinia pestis KIM
auuucuccccacu

SEQ ID NO: 4215417 - RNA, 23 nt, Yersinia pestis KIM
auuucuccccacuucaucaucaa

SEQ ID NO: 4215418 - RNA, 21 nt, Yersinia pestis KIM
auuucucugaugaacggagau

SEQ ID NO: 4215419 - RNA, 13 nt, Yersinia pestis KIM
auuucugccacac

SEQ ID NO: 4215420 - RNA, 18 nt, Yersinia pestis KIM
auuucugcuucuacccug

SEQ ID NO: 4215421 - RNA, 16 nt, Yersinia pestis KIM
auuucuguuaccagaa

SEQ ID NO: 4215422 - RNA, 16 nt, Yersinia pestis KIM
auuucuguuccaggca

SEQ ID NO: 4215423 - RNA, 20 nt, Yersinia pestis KIM
auuucuugaugucggguggu

SEQ ID NO: 4215424 - RNA, 18 nt, Yersinia pestis KIM
auuucuuuuaaaucagaa

SEQ ID NO: 4215425 - RNA, 18 nt, Yersinia pestis KIM
auuucuuuuuauguuaaa

SEQ ID NO: 4215426 - RNA, 22 nt, Yersinia pestis KIM
auuugaaacacuuauuugaaau

SEQ ID NO: 4215427 - RNA, 11 nt, Yersinia pestis KIM
auuugaaacag

SEQ ID NO: 4215428 - RNA, 19 nt, Yersinia pestis KIM
auuugaacgugcucucauu

SEQ ID NO: 4215429 - RNA, 16 nt, Yersinia pestis KIM
auuugaacuucaaauc

SEQ ID NO: 4215430 - RNA, 14 nt, Yersinia pestis KIM
auuugacauuuccu

SEQ ID NO: 4215431 - RNA, 20 nt, Yersinia pestis KIM
auuugaccuccguaggccaa

SEQ ID NO: 4215432 - RNA, 20 nt, Yersinia pestis KIM
auuugaguaagacaacuuau

SEQ ID NO: 4215433 - RNA, 15 nt, Yersinia pestis KIM
auuugauaacacagu

SEQ ID NO: 4215434 - RNA, 19 nt, Yersinia pestis KIM
auuugauacagugauaaau

SEQ ID NO: 4215435 - RNA, 17 nt, Yersinia pestis KIM
auuugauauuagccaag

SEQ ID NO: 4215436 - RNA, 19 nt, Yersinia pestis KIM
auuugcacguagagauuaa

SEQ ID NO: 4215437 - RNA, 14 nt, Yersinia pestis KIM
auuugcagaaagua

SEQ ID NO: 4215438 - RNA, 19 nt, Yersinia pestis KIM
auuugccagagugugggau

SEQ ID NO: 4215439 - RNA, 22 nt, Yersinia pestis KIM
auuugccagauugugcuccagc

SEQ ID NO: 4215440 - RNA, 17 nt, Yersinia pestis KIM
auuugcugccuguucuc

SEQ ID NO: 4215441 - RNA, 14 nt, Yersinia pestis KIM
auuugggcuucagc

SEQ ID NO: 4215442 - RNA, 20 nt, Yersinia pestis KIM
auuugguauuggcuagaaau

SEQ ID NO: 4215443 - RNA, 15 nt, Yersinia pestis KIM
auuuguaaauuuuuu

SEQ ID NO: 4215444 - RNA, 14 nt, Yersinia pestis KIM
auuuguaauaacga

SEQ ID NO: 4215445 - RNA, 19 nt, Yersinia pestis KIM
auuugucauguugaccaaa

SEQ ID NO: 4215446 - RNA, 18 nt, Yersinia pestis KIM
auuugugucgggauuuuu

SEQ ID NO: 4215447 - RNA, 15 nt, Yersinia pestis KIM
auuuguuaaaacagu

SEQ ID NO: 4215448 - RNA, 14 nt, Yersinia pestis KIM
auuuguucaagcgu

SEQ ID NO: 4215449 - RNA, 13 nt, Yersinia pestis KIM
auuuuaaaaaauc

SEQ ID NO: 4215450 - RNA, 21 nt, Yersinia pestis KIM
auuuuaaacaagcuuauauua

SEQ ID NO: 4215451 - RNA, 17 nt, Yersinia pestis KIM
auuuuaacaacccauuu

SEQ ID NO: 4215452 - RNA, 12 nt, Yersinia pestis KIM
auuuuaacaauu

SEQ ID NO: 4215453 - RNA, 14 nt, Yersinia pestis KIM
auuuuaagaaaacu

SEQ ID NO: 4215454 - RNA, 15 nt, Yersinia pestis KIM
auuuuaagaaaacug

SEQ ID NO: 4215455 - RNA, 18 nt, Yersinia pestis KIM
auuuuaagccgcaaggau

SEQ ID NO: 4215456 - RNA, 22 nt, Yersinia pestis KIM
auuuuaagcugucuaaauugcu

SEQ ID NO: 4215457 - RNA, 22 nt, Yersinia pestis KIM
auuuuaaguuaauguuuauauu

SEQ ID NO: 4215458 - RNA, 19 nt, Yersinia pestis KIM
auuuuaaucagaaaauuca

SEQ ID NO: 4215459 - RNA, 18 nt, Yersinia pestis KIM
auuuuaaucucuccauga

SEQ ID NO: 4215460 - RNA, 16 nt, Yersinia pestis KIM
auuuuacaggauuaaa

SEQ ID NO: 4215461 - RNA, 12 nt, Yersinia pestis KIM
auuuuaccaaca

SEQ ID NO: 4215462 - RNA, 19 nt, Yersinia pestis KIM
auuuuacccgaaagccaug

SEQ ID NO: 4215463 - RNA, 13 nt, Yersinia pestis KIM
auuuuaccuauuu

SEQ ID NO: 4215464 - RNA, 14 nt, Yersinia pestis KIM
auuuuacugaugaa

SEQ ID NO: 4215465 - RNA, 18 nt, Yersinia pestis KIM
auuuuacugccacugacu

SEQ ID NO: 4215466 - RNA, 18 nt, Yersinia pestis KIM
auuuuacuuccugccaac

SEQ ID NO: 4215467 - RNA, 16 nt, Yersinia pestis KIM
auuuuagcauuuucca

SEQ ID NO: 4215468 - RNA, 16 nt, Yersinia pestis KIM
auuuuaggugcaguuu

SEQ ID NO: 4215469 - RNA, 17 nt, Yersinia pestis KIM
auuuuagugaugauauu

SEQ ID NO: 4215470 - RNA, 20 nt, Yersinia pestis KIM
auuuuagugaugauauuuau

SEQ ID NO: 4215471 - RNA, 22 nt, Yersinia pestis KIM
auuuucagacugaaaugacauu

SEQ ID NO: 4215472 - RNA, 16 nt, Yersinia pestis KIM
auuuucaucugaccaa

SEQ ID NO: 4215473 - RNA, 14 nt, Yersinia pestis KIM
auuuucauuauuuu

SEQ ID NO: 4215474 - RNA, 16 nt, Yersinia pestis KIM
auuuucauuuuaacaa

SEQ ID NO: 4215475 - RNA, 21 nt, Yersinia pestis KIM
auuuuccagaugaauauguuc

SEQ ID NO: 4215476 - RNA, 21 nt, Yersinia pestis KIM
auuuucccagugcguacgcca

SEQ ID NO: 4215477 - RNA, 17 nt, Yersinia pestis KIM
auuuucccugugcaauc

SEQ ID NO: 4215478 - RNA, 20 nt, Yersinia pestis KIM
caaaaugccguacaacaaua

SEQ ID NO: 4215479 - RNA, 23 nt, Yersinia pestis KIM
caaaaugcucuucaccaaaggaa

SEQ ID NO: 4215480 - RNA, 15 nt, Yersinia pestis KIM
caaaaugugaaaagc

SEQ ID NO: 4215481 - RNA, 16 nt, Yersinia pestis KIM
caaaaugugaaaagca

SEQ ID NO: 4215482 - RNA, 18 nt, Yersinia pestis KIM
caaaauucgugcucauca

SEQ ID NO: 4215483 - RNA, 12 nt, Yersinia pestis KIM
caaaauuuauau

SEQ ID NO: 4215484 - RNA, 15 nt, Yersinia pestis KIM
caaacaaccuaaaaa

SEQ ID NO: 4215485 - RNA, 16 nt, Yersinia pestis KIM
caaacaaccuaaaaaa

SEQ ID NO: 4215486 - RNA, 17 nt, Yersinia pestis KIM
caaacaaccuaaaaaaa

SEQ ID NO: 4215487 - RNA, 19 nt, Yersinia pestis KIM
caaacaaccuaaaaaaaac

SEQ ID NO: 4215488 - RNA, 15 nt, Yersinia pestis KIM
caaacaaggccacca

SEQ ID NO: 4215489 - RNA, 13 nt, Yersinia pestis KIM
caaacaauccuau

SEQ ID NO: 4215490 - RNA, 16 nt, Yersinia pestis KIM
caaacagaccccagaa

SEQ ID NO: 4215491 - RNA, 18 nt, Yersinia pestis KIM
caaacagugcacaucaau

SEQ ID NO: 4215492 - RNA, 15 nt, Yersinia pestis KIM
caaacauaaccugca

SEQ ID NO: 4215493 - RNA, 22 nt, Yersinia pestis KIM
caaacauaauaaagcgaugcuc

SEQ ID NO: 4215494 - RNA, 21 nt, Yersinia pestis KIM
caaacauggcggcagcacaga

SEQ ID NO: 4215495 - RNA, 13 nt, Yersinia pestis KIM
caaacauugucac

SEQ ID NO: 4215496 - RNA, 12 nt, Yersinia pestis KIM
caaaccauggcg

SEQ ID NO: 4215497 - RNA, 22 nt, Yersinia pestis KIM
caaaccauuugcggccuaaaua

SEQ ID NO: 4215498 - RNA, 23 nt, Yersinia pestis KIM
caaaccauuugcggccuaaauac

SEQ ID NO: 4215499 - RNA, 17 nt, Yersinia pestis KIM
caaaccccacuaacgcu

SEQ ID NO: 4215500 - RNA, 23 nt, Yersinia pestis KIM
caaaccccgaugacucgaacuga

SEQ ID NO: 4215501 - RNA, 21 nt, Yersinia pestis KIM
caaacccuaauaccaacagca

SEQ ID NO: 4215502 - RNA, 17 nt, Yersinia pestis KIM
caaaccgcuaagcugcg

SEQ ID NO: 4215503 - RNA, 17 nt, Yersinia pestis KIM
caaaccgggguucgcaa

SEQ ID NO: 4215504 - RNA, 22 nt, Yersinia pestis KIM
caaaccgggguucgcaaugaac

SEQ ID NO: 4215505 - RNA, 18 nt, Yersinia pestis KIM
caaaccucuggcgcaaga

SEQ ID NO: 4215506 - RNA, 13 nt, Yersinia pestis KIM
caaacgcugcaca

SEQ ID NO: 4215507 - RNA, 21 nt, Yersinia pestis KIM
caaacggacuccccgcucgac

SEQ ID NO: 4215508 - RNA, 17 nt, Yersinia pestis KIM
caaacggauaaucgcgg

SEQ ID NO: 4215509 - RNA, 14 nt, Yersinia pestis KIM
caaacggauaaugu

SEQ ID NO: 4215510 - RNA, 16 nt, Yersinia pestis KIM
caaacggauaauguug

SEQ ID NO: 4215511 - RNA, 18 nt, Yersinia pestis KIM
caaacggggauacaucuu

SEQ ID NO: 4215512 - RNA, 22 nt, Yersinia pestis KIM
caaacgggugcgccaaucgcca

SEQ ID NO: 4215513 - RNA, 17 nt, Yersinia pestis KIM
caaacggugugcaaugc

SEQ ID NO: 4215514 - RNA, 14 nt, Yersinia pestis KIM
caaacguuuuauuc

SEQ ID NO: 4215515 - RNA, 20 nt, Yersinia pestis KIM
caaacucagccaucaguuca

SEQ ID NO: 4215516 - RNA, 19 nt, Yersinia pestis KIM
caaacucagcgaauaaaua

SEQ ID NO: 4215517 - RNA, 23 nt, Yersinia pestis KIM
caaacucagcgaauaaauaauug

SEQ ID NO: 4215518 - RNA, 14 nt, Yersinia pestis KIM
caaacucauacacu

SEQ ID NO: 4215519 - RNA, 17 nt, Yersinia pestis KIM
caaacucauacacuaau

SEQ ID NO: 4215520 - RNA, 12 nt, Yersinia pestis KIM
caaacugauaaa

SEQ ID NO: 4215521 - RNA, 15 nt, Yersinia pestis KIM
caaacuggcccagcu

SEQ ID NO: 4215522 - RNA, 20 nt, Yersinia pestis KIM
caaacuguuuuuuaaagaaa

SEQ ID NO: 4215523 - RNA, 13 nt, Yersinia pestis KIM
caaacuuaaaaau

SEQ ID NO: 4215524 - RNA, 14 nt, Yersinia pestis KIM
caaacuuaaaaauc

SEQ ID NO: 4215525 - RNA, 18 nt, Yersinia pestis KIM
caaacuuaaaaaucaaaa

SEQ ID NO: 4215526 - RNA, 17 nt, Yersinia pestis KIM
caaacuuaaagcccagg

SEQ ID NO: 4215527 - RNA, 18 nt, Yersinia pestis KIM
caaacuugaucagcgccu

SEQ ID NO: 4215528 - RNA, 20 nt, Yersinia pestis KIM
caaacuugaucagcgccugc

SEQ ID NO: 4215529 - RNA, 20 nt, Yersinia pestis KIM
caaagacuuuauucacagca

SEQ ID NO: 4215530 - RNA, 21 nt, Yersinia pestis KIM
caaagagaacgggcaaccugu

SEQ ID NO: 4215531 - RNA, 17 nt, Yersinia pestis KIM
caaagagucgcaaaacu

SEQ ID NO: 4215532 - RNA, 23 nt, Yersinia pestis KIM
caaagauaauacauaaaaucaau

SEQ ID NO: 4215533 - RNA, 15 nt, Yersinia pestis KIM
caaagauacagugga

SEQ ID NO: 4215534 - RNA, 22 nt, Yersinia pestis KIM
caaagauagacauauuguccaa

SEQ ID NO: 4215535 - RNA, 21 nt, Yersinia pestis KIM
caaagaucucucgaacccgca

SEQ ID NO: 4215536 - RNA, 16 nt, Yersinia pestis KIM
caaagauuggcagcgu

SEQ ID NO: 4215537 - RNA, 22 nt, Yersinia pestis KIM
caaagauuucaucggcaaaaac

SEQ ID NO: 4215538 - RNA, 21 nt, Yersinia pestis KIM
caaagcaaugaauacccaaaa

SEQ ID NO: 4215539 - RNA, 21 nt, Yersinia pestis KIM
caaagcaccaacuaagcagau

SEQ ID NO: 4215540 - RNA, 21 nt, Yersinia pestis KIM
caaagcaucgguauauuaguu

SEQ ID NO: 4215541 - RNA, 22 nt, Yersinia pestis KIM
caaagccgcugcucacauagcg

SEQ ID NO: 4215542 - RNA, 14 nt, Yersinia pestis KIM
caaagccgucaguu

SEQ ID NO: 4215543 - RNA, 14 nt, Yersinia pestis KIM
caaagcgauaucgu

SEQ ID NO: 4215544 - RNA, 12 nt, Yersinia pestis KIM
caaagcuauuuu

SEQ ID NO: 4215545 - RNA, 13 nt, Yersinia pestis KIM
caaagcuauuuuu

SEQ ID NO: 4215546 - RNA, 17 nt, Yersinia pestis KIM
caaagcuauuuuuagcc

SEQ ID NO: 4215547 - RNA, 17 nt, Yersinia pestis KIM
caaagcuuacuguucac

SEQ ID NO: 4215548 - RNA, 16 nt, Yersinia pestis KIM
caaaggaagggguucu

SEQ ID NO: 4215549 - RNA, 15 nt, Yersinia pestis KIM
caaaggcaaaaugau

SEQ ID NO: 4215550 - RNA, 14 nt, Yersinia pestis KIM
caaaggcuauuuaa

SEQ ID NO: 4215551 - RNA, 18 nt, Yersinia pestis KIM
caaaggggagccaaugua

SEQ ID NO: 4215552 - RNA, 22 nt, Yersinia pestis KIM
caaaguaccuauggcgaagaga

SEQ ID NO: 4215553 - RNA, 17 nt, Yersinia pestis KIM
caaagucauuggcguua

SEQ ID NO: 4215554 - RNA, 20 nt, Yersinia pestis KIM
caaagugccugcggcggaga

SEQ ID NO: 4215555 - RNA, 23 nt, Yersinia pestis KIM
caaagugcugaucccgguuuuug

SEQ ID NO: 4215556 - RNA, 20 nt, Yersinia pestis KIM
caaagugcugcaaggcauua

SEQ ID NO: 4215557 - RNA, 22 nt, Yersinia pestis KIM
caaagugcuuaacccaccaaua

SEQ ID NO: 4215558 - RNA, 15 nt, Yersinia pestis KIM
caaauaaaacagaac

SEQ ID NO: 4215559 - RNA, 21 nt, Yersinia pestis KIM
caaauaacccgccuagcauca

SEQ ID NO: 4215560 - RNA, 22 nt, Yersinia pestis KIM
caaauaagcaucggcaacguca

SEQ ID NO: 4215561 - RNA, 18 nt, Yersinia pestis KIM
caaauaaguauuucaaau

SEQ ID NO: 4215562 - RNA, 23 nt, Yersinia pestis KIM
caaauaaguauuucaaauaagug

SEQ ID NO: 4215563 - RNA, 15 nt, Yersinia pestis KIM
caaauaauucagacg

SEQ ID NO: 4215564 - RNA, 17 nt, Yersinia pestis KIM
caaauaauucagacggc

SEQ ID NO: 4215565 - RNA, 22 nt, Yersinia pestis KIM
caaauacaaaccguuugccguu

SEQ ID NO: 4215566 - RNA, 23 nt, Yersinia pestis KIM
caaauacgaccgucaccaaauag

SEQ ID NO: 4215567 - RNA, 13 nt, Yersinia pestis KIM
caaauacggcacc

SEQ ID NO: 4215568 - RNA, 16 nt, Yersinia pestis KIM
caaauacggcgaaaua

SEQ ID NO: 4215569 - RNA, 20 nt, Yersinia pestis KIM
caaauacggcgaaauauaaa

SEQ ID NO: 4215570 - RNA, 14 nt, Yersinia pestis KIM
caaauagagcacca

SEQ ID NO: 4215571 - RNA, 21 nt, Yersinia pestis KIM
caaauagagcaccaaaucuuc

SEQ ID NO: 4215572 - RNA, 20 nt, Yersinia pestis KIM
caaauagauagcaaucaaua

SEQ ID NO: 4215573 - RNA, 20 nt, Yersinia pestis KIM
caaauagcuggcauccucag

SEQ ID NO: 4215574 - RNA, 15 nt, Yersinia pestis KIM
caaauaucauuauuu

SEQ ID NO: 4215575 - RNA, 14 nt, Yersinia pestis KIM
caaauaucggccau

SEQ ID NO: 4215576 - RNA, 18 nt, Yersinia pestis KIM
caaauauugaauuaaagu

SEQ ID NO: 4215577 - RNA, 19 nt, Yersinia pestis KIM
caaauauugcacaauagcu

SEQ ID NO: 4215578 - RNA, 20 nt, Yersinia pestis KIM
caaaucaccugacaccaaga

SEQ ID NO: 4215579 - RNA, 23 nt, Yersinia pestis KIM
caaaucaucgcugacaauuuaca

SEQ ID NO: 4215580 - RNA, 22 nt, Yersinia pestis KIM
caaaucaugcucaaucugcaau

SEQ ID NO: 4215581 - RNA, 17 nt, Yersinia pestis KIM
caaaucauuuaauuuau

SEQ ID NO: 4215582 - RNA, 18 nt, Yersinia pestis KIM
caaaucauuuaauuuauc

SEQ ID NO: 4215583 - RNA, 21 nt, Yersinia pestis KIM
caaauccucggguuuuauacc

SEQ ID NO: 4215584 - RNA, 19 nt, Yersinia pestis KIM
caaaucgccaaacugcuca

SEQ ID NO: 4215585 - RNA, 22 nt, Yersinia pestis KIM
caaaucuuccagcggcaaauag

SEQ ID NO: 4215586 - RNA, 13 nt, Yersinia pestis KIM
caaaugaaaauau

SEQ ID NO: 4215587 - RNA, 15 nt, Yersinia pestis KIM
caaaugaaaauauuc

SEQ ID NO: 4215588 - RNA, 22 nt, Yersinia pestis KIM
caaauggaauaaaaagucagcu

SEQ ID NO: 4215589 - RNA, 20 nt, Yersinia pestis KIM
caaaugggugugaacaguga

SEQ ID NO: 4215590 - RNA, 13 nt, Yersinia pestis KIM
caaauguuggaua

SEQ ID NO: 4215591 - RNA, 13 nt, Yersinia pestis KIM
caaauuaaauaac

SEQ ID NO: 4215592 - RNA, 21 nt, Yersinia pestis KIM
caacggcccaauauugaucca

SEQ ID NO: 4215593 - RNA, 21 nt, Yersinia pestis KIM
caacggcuggccgagcagacc

SEQ ID NO: 4215594 - RNA, 23 nt, Yersinia pestis KIM
caacgggugacgcuggcacugga

SEQ ID NO: 4215595 - RNA, 17 nt, Yersinia pestis KIM
caacgguaucccgguga

SEQ ID NO: 4215596 - RNA, 14 nt, Yersinia pestis KIM
caacggugaacaga

SEQ ID NO: 4215597 - RNA, 20 nt, Yersinia pestis KIM
caacguaacaugcagcccga

SEQ ID NO: 4215598 - RNA, 14 nt, Yersinia pestis KIM
caacgucacuucca

SEQ ID NO: 4215599 - RNA, 23 nt, Yersinia pestis KIM
caacguccagaacaauaccgcca

SEQ ID NO: 4215600 - RNA, 19 nt, Yersinia pestis KIM
caacgugauaugccugaag

SEQ ID NO: 4215601 - RNA, 16 nt, Yersinia pestis KIM
caacuaaacagaucac

SEQ ID NO: 4215602 - RNA, 13 nt, Yersinia pestis KIM
caacuaagcugcc

SEQ ID NO: 4215603 - RNA, 14 nt, Yersinia pestis KIM
caacuaagcugccu

SEQ ID NO: 4215604 - RNA, 22 nt, Yersinia pestis KIM
caacuaauucuuaggauaacca

SEQ ID NO: 4215605 - RNA, 18 nt, Yersinia pestis KIM
caacuagcccacucagcc

SEQ ID NO: 4215606 - RNA, 21 nt, Yersinia pestis KIM
caacuauugcaucuuuaauua

SEQ ID NO: 4215607 - RNA, 22 nt, Yersinia pestis KIM
caacuauugcaucuuuaauuaa

SEQ ID NO: 4215608 - RNA, 14 nt, Yersinia pestis KIM
caacucaaaacaau

SEQ ID NO: 4215609 - RNA, 17 nt, Yersinia pestis KIM
caacucagcggccuggg

SEQ ID NO: 4215610 - RNA, 16 nt, Yersinia pestis KIM
caacucaucggcguua

SEQ ID NO: 4215611 - RNA, 21 nt, Yersinia pestis KIM
caacucccaaauauauucuau

SEQ ID NO: 4215612 - RNA, 20 nt, Yersinia pestis KIM
caacuccugccuacgcuggc

SEQ ID NO: 4215613 - RNA, 17 nt, Yersinia pestis KIM
caacuccuuaccacugc

SEQ ID NO: 4215614 - RNA, 21 nt, Yersinia pestis KIM
caacucuacauugacuaauua

SEQ ID NO: 4215615 - RNA, 18 nt, Yersinia pestis KIM
caacucuucguugcucag

SEQ ID NO: 4215616 - RNA, 14 nt, Yersinia pestis KIM
caacugaaacugga

SEQ ID NO: 4215617 - RNA, 16 nt, Yersinia pestis KIM
caacugacugaaguua

SEQ ID NO: 4215618 - RNA, 17 nt, Yersinia pestis KIM
caacugagcuaacgacc

SEQ ID NO: 4215619 - RNA, 11 nt, Yersinia pestis KIM
caacugauaaa

SEQ ID NO: 4215620 - RNA, 19 nt, Yersinia pestis KIM
caacugccaaauuuggccu

SEQ ID NO: 4215621 - RNA, 17 nt, Yersinia pestis KIM
caacugccccucuuuuc

SEQ ID NO: 4215622 - RNA, 19 nt, Yersinia pestis KIM
caacugcucaacgccccgu

SEQ ID NO: 4215623 - RNA, 13 nt, Yersinia pestis KIM
caacugcucaacu

SEQ ID NO: 4215624 - RNA, 15 nt, Yersinia pestis KIM
caacugcucaacugc

SEQ ID NO: 4215625 - RNA, 18 nt, Yersinia pestis KIM
caacugcucaacugcuca

SEQ ID NO: 4215626 - RNA, 19 nt, Yersinia pestis KIM
caacugcucaacugcucaa

SEQ ID NO: 4215627 - RNA, 20 nt, Yersinia pestis KIM
caacuggcgcaacagcgccu

SEQ ID NO: 4215628 - RNA, 20 nt, Yersinia pestis KIM
caacuggguggccaguaacg

SEQ ID NO: 4215629 - RNA, 19 nt, Yersinia pestis KIM
caacugguuaucacugucc

SEQ ID NO: 4215630 - RNA, 14 nt, Yersinia pestis KIM
caacuguaaugccc

SEQ ID NO: 4215631 - RNA, 21 nt, Yersinia pestis KIM
caacuguuagcguggcugaaa

SEQ ID NO: 4215632 - RNA, 17 nt, Yersinia pestis KIM
caacuguuuuauuggca

SEQ ID NO: 4215633 - RNA, 14 nt, Yersinia pestis KIM
caacuucaagccga

SEQ ID NO: 4215634 - RNA, 19 nt, Yersinia pestis KIM
caacuucaauaccaaauuu

SEQ ID NO: 4215635 - RNA, 20 nt, Yersinia pestis KIM
caacuucaauaccaaauuua

SEQ ID NO: 4215636 - RNA, 17 nt, Yersinia pestis KIM
caacuucaccacuguga

SEQ ID NO: 4215637 - RNA, 13 nt, Yersinia pestis KIM
caacuucacuuug

SEQ ID NO: 4215638 - RNA, 18 nt, Yersinia pestis KIM
caacuuccuugauuuuca

SEQ ID NO: 4215639 - RNA, 19 nt, Yersinia pestis KIM
caacuuccuugauuuucau

SEQ ID NO: 4215640 - RNA, 14 nt, Yersinia pestis KIM
caacuucuccugua

SEQ ID NO: 4215641 - RNA, 11 nt, Yersinia pestis KIM
caacuucuuca

SEQ ID NO: 4215642 - RNA, 12 nt, Yersinia pestis KIM
caacuucuucau

SEQ ID NO: 4215643 - RNA, 15 nt, Yersinia pestis KIM
caacuuggcaccuaa

SEQ ID NO: 4215644 - RNA, 21 nt, Yersinia pestis KIM
caacuuucccagucauaaaua

SEQ ID NO: 4215645 - RNA, 13 nt, Yersinia pestis KIM
caacuuuuacugu

SEQ ID NO: 4215646 - RNA, 18 nt, Yersinia pestis KIM
caacuuuuuucauccuaa

SEQ ID NO: 4215647 - RNA, 14 nt, Yersinia pestis KIM
caagaaaagcaccg

SEQ ID NO: 4215648 - RNA, 22 nt, Yersinia pestis KIM
caagaaacuucauuucagguaa

SEQ ID NO: 4215649 - RNA, 23 nt, Yersinia pestis KIM
caagaaacuucauuucagguaaa

SEQ ID NO: 4215650 - RNA, 15 nt, Yersinia pestis KIM
caagaaagaaaaaua

SEQ ID NO: 4215651 - RNA, 18 nt, Yersinia pestis KIM
caagaaagaaaaauagac

SEQ ID NO: 4215652 - RNA, 17 nt, Yersinia pestis KIM
caagaaaucaaaagggg

SEQ ID NO: 4215653 - RNA, 18 nt, Yersinia pestis KIM
caagaaauuuaaaaaccc

SEQ ID NO: 4215654 - RNA, 19 nt, Yersinia pestis KIM
caagaagacuaaacgcuac

SEQ ID NO: 4215655 - RNA, 15 nt, Yersinia pestis KIM
caagaagauaacuuu

SEQ ID NO: 4215656 - RNA, 16 nt, Yersinia pestis KIM
caagaagauaacuuuu

SEQ ID NO: 4215657 - RNA, 18 nt, Yersinia pestis KIM
caagaauaauuacugacg

SEQ ID NO: 4215658 - RNA, 23 nt, Yersinia pestis KIM
caagaauuucgucuucgcccaga

SEQ ID NO: 4215659 - RNA, 14 nt, Yersinia pestis KIM
caagacaagcccga

SEQ ID NO: 4215660 - RNA, 17 nt, Yersinia pestis KIM
caagacgauaucgacgc

SEQ ID NO: 4215661 - RNA, 21 nt, Yersinia pestis KIM
caagacuuuccccagaugaau

SEQ ID NO: 4215662 - RNA, 20 nt, Yersinia pestis KIM
caagagaaacccauagcaaa

SEQ ID NO: 4215663 - RNA, 15 nt, Yersinia pestis KIM
caagagugagucauc

SEQ ID NO: 4215664 - RNA, 22 nt, Yersinia pestis KIM
caagagugagucaucgggguuu

SEQ ID NO: 4215665 - RNA, 23 nt, Yersinia pestis KIM
caagagugagucaucgggguuug

SEQ ID NO: 4215666 - RNA, 13 nt, Yersinia pestis KIM
caagauaaaguuc

SEQ ID NO: 4215667 - RNA, 20 nt, Yersinia pestis KIM
caagauagaaccaugagaau

SEQ ID NO: 4215668 - RNA, 17 nt, Yersinia pestis KIM
caagauauuacuucuuu

SEQ ID NO: 4215669 - RNA, 13 nt, Yersinia pestis KIM
caagaucccaagc

SEQ ID NO: 4215670 - RNA, 13 nt, Yersinia pestis KIM
caagaugcauauu

SEQ ID NO: 4215671 - RNA, 15 nt, Yersinia pestis KIM
caagaugcgugaaau

SEQ ID NO: 4215672 - RNA, 15 nt, Yersinia pestis KIM
caagauggucauaaa

SEQ ID NO: 4215673 - RNA, 19 nt, Yersinia pestis KIM
caagauugggaucaacgcc

SEQ ID NO: 4215674 - RNA, 18 nt, Yersinia pestis KIM
caagauuuuguagcccac

SEQ ID NO: 4215675 - RNA, 13 nt, Yersinia pestis KIM
caagcaaacugau

SEQ ID NO: 4215676 - RNA, 18 nt, Yersinia pestis KIM
caagcaucggaauccauu

SEQ ID NO: 4215677 - RNA, 18 nt, Yersinia pestis KIM
caagcaugugauguggcu

SEQ ID NO: 4215678 - RNA, 16 nt, Yersinia pestis KIM
caagccaacccccauu

SEQ ID NO: 4215679 - RNA, 14 nt, Yersinia pestis KIM
caagccaauggcca

SEQ ID NO: 4215680 - RNA, 15 nt, Yersinia pestis KIM
caagccagugcggga

SEQ ID NO: 4215681 - RNA, 18 nt, Yersinia pestis KIM
caagccgcguuccaaucu

SEQ ID NO: 4215682 - RNA, 22 nt, Yersinia pestis KIM
caagccgcuuaucucggggcca

SEQ ID NO: 4215683 - RNA, 11 nt, Yersinia pestis KIM
caagccucuag

SEQ ID NO: 4215684 - RNA, 16 nt, Yersinia pestis KIM
caagccugugcuaaau

SEQ ID NO: 4215685 - RNA, 21 nt, Yersinia pestis KIM
caagccugugcuaaaucccag

SEQ ID NO: 4215686 - RNA, 17 nt, Yersinia pestis KIM
caagcgcaguagcggcu

SEQ ID NO: 4215687 - RNA, 20 nt, Yersinia pestis KIM
caagcgcguuagccuacugg

SEQ ID NO: 4215688 - RNA, 14 nt, Yersinia pestis KIM
caagcggcagcgcu

SEQ ID NO: 4215689 - RNA, 17 nt, Yersinia pestis KIM
caagcgggugagauauu

SEQ ID NO: 4215690 - RNA, 15 nt, Yersinia pestis KIM
caagcuacggccugu

SEQ ID NO: 4215691 - RNA, 23 nt, Yersinia pestis KIM
caagcuacggccuguaccaccac

SEQ ID NO: 4215692 - RNA, 17 nt, Yersinia pestis KIM
caagcugagauaagccu

SEQ ID NO: 4215693 - RNA, 20 nt, Yersinia pestis KIM
caagcuguuauucagcuuca

SEQ ID NO: 4215694 - RNA, 14 nt, Yersinia pestis KIM
caagcuuaauauua

SEQ ID NO: 4215695 - RNA, 22 nt, Yersinia pestis KIM
caagcuuaauauuauucucaac

SEQ ID NO: 4215696 - RNA, 22 nt, Yersinia pestis KIM
caagcuuaguauccgcgccaga

SEQ ID NO: 4215697 - RNA, 16 nt, Yersinia pestis KIM
caagcuuggccccuua

SEQ ID NO: 4215698 - RNA, 21 nt, Yersinia pestis KIM
caagcuuugccuaacggcaua

SEQ ID NO: 4215699 - RNA, 19 nt, Yersinia pestis KIM
caagcuuuugccacauuuc

SEQ ID NO: 4215700 - RNA, 23 nt, Yersinia pestis KIM
caaggagaucgcucucacccugc

SEQ ID NO: 4215701 - RNA, 16 nt, Yersinia pestis KIM
caaggcacgagcggug

SEQ ID NO: 4215702 - RNA, 15 nt, Yersinia pestis KIM
caaggccgaucaaca

SEQ ID NO: 4215703 - RNA, 20 nt, Yersinia pestis KIM
caaggccgaucaacaggcca

SEQ ID NO: 4215704 - RNA, 21 nt, Yersinia pestis KIM
caaggccgaucaacaggccac

SEQ ID NO: 4215705 - RNA, 20 nt, Yersinia pestis KIM
caaggcgacuuugaugccaa

SEQ ID NO: 4215706 - RNA, 22 nt, Yersinia pestis KIM
caaucaaaaugaccuuaucugg

SEQ ID NO: 4215707 - RNA, 17 nt, Yersinia pestis KIM
caaucaagcaauaauug

SEQ ID NO: 4215708 - RNA, 16 nt, Yersinia pestis KIM
caaucaauaagcuaca

SEQ ID NO: 4215709 - RNA, 16 nt, Yersinia pestis KIM
caaucaauacacuggc

SEQ ID NO: 4215710 - RNA, 23 nt, Yersinia pestis KIM
caaucaaucaccauaacugcugc

SEQ ID NO: 4215711 - RNA, 17 nt, Yersinia pestis KIM
caaucaauugcccccau

SEQ ID NO: 4215712 - RNA, 14 nt, Yersinia pestis KIM
caaucacaucaccg

SEQ ID NO: 4215713 - RNA, 13 nt, Yersinia pestis KIM
caaucaccccaga

SEQ ID NO: 4215714 - RNA, 13 nt, Yersinia pestis KIM
caaucagaauguc

SEQ ID NO: 4215715 - RNA, 15 nt, Yersinia pestis KIM
caaucaggaaauuac

SEQ ID NO: 4215716 - RNA, 18 nt, Yersinia pestis KIM
caaucaggaaauuaccac

SEQ ID NO: 4215717 - RNA, 17 nt, Yersinia pestis KIM
caaucagugcaauaaau

SEQ ID NO: 4215718 - RNA, 15 nt, Yersinia pestis KIM
caaucaucaucccag

SEQ ID NO: 4215719 - RNA, 16 nt, Yersinia pestis KIM
caaucaucguggcuuu

SEQ ID NO: 4215720 - RNA, 19 nt, Yersinia pestis KIM
caaucaugggccaauccaa

SEQ ID NO: 4215721 - RNA, 15 nt, Yersinia pestis KIM
caaucauuacaucau

SEQ ID NO: 4215722 - RNA, 18 nt, Yersinia pestis KIM
caaucauuacaucaucuu

SEQ ID NO: 4215723 - RNA, 20 nt, Yersinia pestis KIM
caauccaaccuauauagccc

SEQ ID NO: 4215724 - RNA, 13 nt, Yersinia pestis KIM
caauccaugccag

SEQ ID NO: 4215725 - RNA, 19 nt, Yersinia pestis KIM
caaucccgauaaaaaccau

SEQ ID NO: 4215726 - RNA, 21 nt, Yersinia pestis KIM
caaucccggccauuugcucug

SEQ ID NO: 4215727 - RNA, 23 nt, Yersinia pestis KIM
caaucccuucgcccuguaaagcc

SEQ ID NO: 4215728 - RNA, 14 nt, Yersinia pestis KIM
caauccgaacaaaa

SEQ ID NO: 4215729 - RNA, 15 nt, Yersinia pestis KIM
caauccgaacaaaau

SEQ ID NO: 4215730 - RNA, 16 nt, Yersinia pestis KIM
caauccuacauucagu

SEQ ID NO: 4215731 - RNA, 15 nt, Yersinia pestis KIM
caauccuaucguuua

SEQ ID NO: 4215732 - RNA, 13 nt, Yersinia pestis KIM
caaucgccaccgg

SEQ ID NO: 4215733 - RNA, 17 nt, Yersinia pestis KIM
caaucggcagauuggau

SEQ ID NO: 4215734 - RNA, 18 nt, Yersinia pestis KIM
caaucgucuucggucaua

SEQ ID NO: 4215735 - RNA, 15 nt, Yersinia pestis KIM
caaucuaacuaauaa

SEQ ID NO: 4215736 - RNA, 12 nt, Yersinia pestis KIM
caaucucaaagc

SEQ ID NO: 4215737 - RNA, 13 nt, Yersinia pestis KIM
caaucucaucaau

SEQ ID NO: 4215738 - RNA, 13 nt, Yersinia pestis KIM
caaucuccaauga

SEQ ID NO: 4215739 - RNA, 21 nt, Yersinia pestis KIM
caaucuccaguaaaucuacuu

SEQ ID NO: 4215740 - RNA, 21 nt, Yersinia pestis KIM
caaucuccccguuuaggauug

SEQ ID NO: 4215741 - RNA, 21 nt, Yersinia pestis KIM
caaucucugggugcugcuccc

SEQ ID NO: 4215742 - RNA, 16 nt, Yersinia pestis KIM
caaucucuugacgccg

SEQ ID NO: 4215743 - RNA, 20 nt, Yersinia pestis KIM
caaucuggggguaacgccgc

SEQ ID NO: 4215744 - RNA, 18 nt, Yersinia pestis KIM
caaucuguuccugauucc

SEQ ID NO: 4215745 - RNA, 21 nt, Yersinia pestis KIM
caaucuguuccugauuccaaa

SEQ ID NO: 4215746 - RNA, 19 nt, Yersinia pestis KIM
caaucuuauugaaaacaag

SEQ ID NO: 4215747 - RNA, 21 nt, Yersinia pestis KIM
caaugaaauauggugauaacu

SEQ ID NO: 4215748 - RNA, 13 nt, Yersinia pestis KIM
caaugaauaccca

SEQ ID NO: 4215749 - RNA, 18 nt, Yersinia pestis KIM
caaugaauccggauccag

SEQ ID NO: 4215750 - RNA, 15 nt, Yersinia pestis KIM
caaugacuuaacuga

SEQ ID NO: 4215751 - RNA, 15 nt, Yersinia pestis KIM
caaugauaaaauccu

SEQ ID NO: 4215752 - RNA, 16 nt, Yersinia pestis KIM
caaugaucaaacggau

SEQ ID NO: 4215753 - RNA, 16 nt, Yersinia pestis KIM
caaugaugucaucuuc

SEQ ID NO: 4215754 - RNA, 19 nt, Yersinia pestis KIM
caaugauuacaucacuuuu

SEQ ID NO: 4215755 - RNA, 21 nt, Yersinia pestis KIM
caaugcaccgacaaagauacu

SEQ ID NO: 4215756 - RNA, 14 nt, Yersinia pestis KIM
caaugcaguaaaga

SEQ ID NO: 4215757 - RNA, 17 nt, Yersinia pestis KIM
caaugccucuucaauac

SEQ ID NO: 4215758 - RNA, 14 nt, Yersinia pestis KIM
caaugcgcccaagc

SEQ ID NO: 4215759 - RNA, 19 nt, Yersinia pestis KIM
caaugcgcggguaacaacu

SEQ ID NO: 4215760 - RNA, 21 nt, Yersinia pestis KIM
caaugcgcggguaacaacuca

SEQ ID NO: 4215761 - RNA, 13 nt, Yersinia pestis KIM
caaugcuuauuuc

SEQ ID NO: 4215762 - RNA, 18 nt, Yersinia pestis KIM
caauggauuugugcaaau

SEQ ID NO: 4215763 - RNA, 21 nt, Yersinia pestis KIM
caauggccggacucauuaucc

SEQ ID NO: 4215764 - RNA, 17 nt, Yersinia pestis KIM
caauggccuuagcacgu

SEQ ID NO: 4215765 - RNA, 19 nt, Yersinia pestis KIM
caauggcuaaaucaucauu

SEQ ID NO: 4215766 - RNA, 22 nt, Yersinia pestis KIM
caauggcuaauuagaugagugg

SEQ ID NO: 4215767 - RNA, 14 nt, Yersinia pestis KIM
caauggcuccaccg

SEQ ID NO: 4215768 - RNA, 18 nt, Yersinia pestis KIM
caauggcuggcaaggcac

SEQ ID NO: 4215769 - RNA, 21 nt, Yersinia pestis KIM
caaugggucauugcgugcaau

SEQ ID NO: 4215770 - RNA, 19 nt, Yersinia pestis KIM
caaugguguuaucuucacu

SEQ ID NO: 4215771 - RNA, 17 nt, Yersinia pestis KIM
caaugguucaucauuuu

SEQ ID NO: 4215772 - RNA, 18 nt, Yersinia pestis KIM
caaugucaccugaaccug

SEQ ID NO: 4215773 - RNA, 22 nt, Yersinia pestis KIM
caauguguugaauauccaaugg

SEQ ID NO: 4215774 - RNA, 19 nt, Yersinia pestis KIM
caauguuaaacuuugcuau

SEQ ID NO: 4215775 - RNA, 14 nt, Yersinia pestis KIM
caauguucucuggg

SEQ ID NO: 4215776 - RNA, 15 nt, Yersinia pestis KIM
caauguucucugggu

SEQ ID NO: 4215777 - RNA, 13 nt, Yersinia pestis KIM
caauuaaaauugc

SEQ ID NO: 4215778 - RNA, 23 nt, Yersinia pestis KIM
caauuacacgguggcccggaagg

SEQ ID NO: 4215779 - RNA, 17 nt, Yersinia pestis KIM
caauuacuuuggcauuu

SEQ ID NO: 4215780 - RNA, 21 nt, Yersinia pestis KIM
caauuagguugcagcuaaaca

SEQ ID NO: 4215781 - RNA, 13 nt, Yersinia pestis KIM
caauuagucacua

SEQ ID NO: 4215782 - RNA, 14 nt, Yersinia pestis KIM
caauuaucuuaucc

SEQ ID NO: 4215783 - RNA, 17 nt, Yersinia pestis KIM
caauucacgcaaggcca

SEQ ID NO: 4215784 - RNA, 18 nt, Yersinia pestis KIM
caauucacgcaaggccag

SEQ ID NO: 4215785 - RNA, 13 nt, Yersinia pestis KIM
caauucaucagcg

SEQ ID NO: 4215786 - RNA, 18 nt, Yersinia pestis KIM
caauucauguugccaaug

SEQ ID NO: 4215787 - RNA, 15 nt, Yersinia pestis KIM
caauucgcaagaagc

SEQ ID NO: 4215788 - RNA, 16 nt, Yersinia pestis KIM
caauucgcuucgcucc

SEQ ID NO: 4215789 - RNA, 21 nt, Yersinia pestis KIM
caauucguuuuucauuuuucu

SEQ ID NO: 4215790 - RNA, 22 nt, Yersinia pestis KIM
caauucuuaggguaaccaaugu

SEQ ID NO: 4215791 - RNA, 19 nt, Yersinia pestis KIM
caauugaugucaugauaaa

SEQ ID NO: 4215792 - RNA, 17 nt, Yersinia pestis KIM
caauugcccccuaguga

SEQ ID NO: 4215793 - RNA, 13 nt, Yersinia pestis KIM
caauugccgucgu

SEQ ID NO: 4215794 - RNA, 12 nt, Yersinia pestis KIM
caauugcuggcu

SEQ ID NO: 4215795 - RNA, 16 nt, Yersinia pestis KIM
caauuggucaugauga

SEQ ID NO: 4215796 - RNA, 17 nt, Yersinia pestis KIM
caauuggucaugaugaa

SEQ ID NO: 4215797 - RNA, 20 nt, Yersinia pestis KIM
caauuguccguggauuggcu

SEQ ID NO: 4215798 - RNA, 17 nt, Yersinia pestis KIM
caauuuacgguccauaa

SEQ ID NO: 4215799 - RNA, 18 nt, Yersinia pestis KIM
caauuuacgguccauaaa

SEQ ID NO: 4215800 - RNA, 13 nt, Yersinia pestis KIM
caauuuagacagc

SEQ ID NO: 4215801 - RNA, 15 nt, Yersinia pestis KIM
caauuuagacagcuu

SEQ ID NO: 4215802 - RNA, 23 nt, Yersinia pestis KIM
caauuuagacagcuuaaaaucug

SEQ ID NO: 4215803 - RNA, 21 nt, Yersinia pestis KIM
caauuuaucagacaaucugug

SEQ ID NO: 4215804 - RNA, 10 nt, Yersinia pestis KIM
caauuucagc

SEQ ID NO: 4215805 - RNA, 14 nt, Yersinia pestis KIM
caauuuccccugcu

SEQ ID NO: 4215806 - RNA, 22 nt, Yersinia pestis KIM
caauuucgaaaacucaaagauu

SEQ ID NO: 4215807 - RNA, 14 nt, Yersinia pestis KIM
caauuugcccaucu

SEQ ID NO: 4215808 - RNA, 13 nt, Yersinia pestis KIM
caauuuggccaau

SEQ ID NO: 4215809 - RNA, 22 nt, Yersinia pestis KIM
caauuugucauguugaccaaac

SEQ ID NO: 4215810 - RNA, 20 nt, Yersinia pestis KIM
caauuugucguuuacuggcu

SEQ ID NO: 4215811 - RNA, 16 nt, Yersinia pestis KIM
caauuuuugcagugca

SEQ ID NO: 4215812 - RNA, 23 nt, Yersinia pestis KIM
cacaaaaaccggcguaaauaaaa

SEQ ID NO: 4215813 - RNA, 21 nt, Yersinia pestis KIM
cacaaaaccuuuaaucagaua

SEQ ID NO: 4215814 - RNA, 12 nt, Yersinia pestis KIM
cacaaacauggc

SEQ ID NO: 4215815 - RNA, 17 nt, Yersinia pestis KIM
cacaaacauggcggcag

SEQ ID NO: 4215816 - RNA, 16 nt, Yersinia pestis KIM
cacaaaggcaaaauga

SEQ ID NO: 4215817 - RNA, 22 nt, Yersinia pestis KIM
cacaaaguaaauuggcacgggc

SEQ ID NO: 4215818 - RNA, 20 nt, Yersinia pestis KIM
cacaaaguagguuaagaccc

SEQ ID NO: 4215819 - RNA, 22 nt, Yersinia pestis KIM
cacaaaucgucgucagcgacau

SEQ ID NO: 4215820 - RNA, 14 nt, Yersinia pestis KIM
cacaacacauuacu

SEQ ID NO: 4215821 - RNA, 22 nt, Yersinia pestis KIM
caccacggcgcugcagcgauau

SEQ ID NO: 4215822 - RNA, 23 nt, Yersinia pestis KIM
caccacggcuuucaauaaaacuc

SEQ ID NO: 4215823 - RNA, 21 nt, Yersinia pestis KIM
caccacuacacgcuuuacugu

SEQ ID NO: 4215824 - RNA, 18 nt, Yersinia pestis KIM
caccacuaguuaaaacca

SEQ ID NO: 4215825 - RNA, 13 nt, Yersinia pestis KIM
caccacuuuccag

SEQ ID NO: 4215826 - RNA, 14 nt, Yersinia pestis KIM
caccacuuuccagg

SEQ ID NO: 4215827 - RNA, 13 nt, Yersinia pestis KIM
caccagacaacca

SEQ ID NO: 4215828 - RNA, 16 nt, Yersinia pestis KIM
caccagacaccugaua

SEQ ID NO: 4215829 - RNA, 20 nt, Yersinia pestis KIM
caccagauggcgaucaaggu

SEQ ID NO: 4215830 - RNA, 13 nt, Yersinia pestis KIM
caccagauugccg

SEQ ID NO: 4215831 - RNA, 15 nt, Yersinia pestis KIM
caccagcgcacugaa

SEQ ID NO: 4215832 - RNA, 20 nt, Yersinia pestis KIM
caccagggaaauuagcgccu

SEQ ID NO: 4215833 - RNA, 16 nt, Yersinia pestis KIM
caccaguaaacgccaa

SEQ ID NO: 4215834 - RNA, 17 nt, Yersinia pestis KIM
caccaguaaacgccaau

SEQ ID NO: 4215835 - RNA, 16 nt, Yersinia pestis KIM
caccaguagcccagcc

SEQ ID NO: 4215836 - RNA, 20 nt, Yersinia pestis KIM
caccaguugaccauuuuuau

SEQ ID NO: 4215837 - RNA, 21 nt, Yersinia pestis KIM
caccauaaaaacuucagagcc

SEQ ID NO: 4215838 - RNA, 16 nt, Yersinia pestis KIM
caccauaaugugccuc

SEQ ID NO: 4215839 - RNA, 21 nt, Yersinia pestis KIM
caccauagauuaagaaaacau

SEQ ID NO: 4215840 - RNA, 12 nt, Yersinia pestis KIM
caccauagccac

SEQ ID NO: 4215841 - RNA, 13 nt, Yersinia pestis KIM
caccauagccacg

SEQ ID NO: 4215842 - RNA, 23 nt, Yersinia pestis KIM
caccauagccacgcuauucacuc

SEQ ID NO: 4215843 - RNA, 15 nt, Yersinia pestis KIM
caccauauucccagc

SEQ ID NO: 4215844 - RNA, 21 nt, Yersinia pestis KIM
caccauauucccagccaacuc

SEQ ID NO: 4215845 - RNA, 14 nt, Yersinia pestis KIM
caccaucaacaugg

SEQ ID NO: 4215846 - RNA, 15 nt, Yersinia pestis KIM
caccaucaacauggg

SEQ ID NO: 4215847 - RNA, 15 nt, Yersinia pestis KIM
caccaucgcccccug

SEQ ID NO: 4215848 - RNA, 14 nt, Yersinia pestis KIM
caccaucugccugc

SEQ ID NO: 4215849 - RNA, 14 nt, Yersinia pestis KIM
caccaucuucgcug

SEQ ID NO: 4215850 - RNA, 16 nt, Yersinia pestis KIM
caccaugaugaaucug

SEQ ID NO: 4215851 - RNA, 21 nt, Yersinia pestis KIM
caccauguacauggccgugcu

SEQ ID NO: 4215852 - RNA, 15 nt, Yersinia pestis KIM
caccauuaacaagcg

SEQ ID NO: 4215853 - RNA, 16 nt, Yersinia pestis KIM
caccauuaauaauaac

SEQ ID NO: 4215854 - RNA, 14 nt, Yersinia pestis KIM
caccauuuccaggc

SEQ ID NO: 4215855 - RNA, 19 nt, Yersinia pestis KIM
caccauuuucaaaccgcug

SEQ ID NO: 4215856 - RNA, 13 nt, Yersinia pestis KIM
cacccaacaauga

SEQ ID NO: 4215857 - RNA, 15 nt, Yersinia pestis KIM
cacccaauaauaaaa

SEQ ID NO: 4215858 - RNA, 18 nt, Yersinia pestis KIM
cacccaauggcaacaaaa

SEQ ID NO: 4215859 - RNA, 20 nt, Yersinia pestis KIM
cacccacggcgggcaacaga

SEQ ID NO: 4215860 - RNA, 21 nt, Yersinia pestis KIM
cacccacggcgggcaacagag

SEQ ID NO: 4215861 - RNA, 12 nt, Yersinia pestis KIM
cacccagcaaaa

SEQ ID NO: 4215862 - RNA, 20 nt, Yersinia pestis KIM
cacccagcaaaauagcacag

SEQ ID NO: 4215863 - RNA, 14 nt, Yersinia pestis KIM
cacccaguaacuga

SEQ ID NO: 4215864 - RNA, 16 nt, Yersinia pestis KIM
cacccauagcucagcu

SEQ ID NO: 4215865 - RNA, 17 nt, Yersinia pestis KIM
cacccauagcucagcug

SEQ ID NO: 4215866 - RNA, 23 nt, Yersinia pestis KIM
cacccaugcucccuccugcccau

SEQ ID NO: 4215867 - RNA, 12 nt, Yersinia pestis KIM
cacccauguauc

SEQ ID NO: 4215868 - RNA, 22 nt, Yersinia pestis KIM
cacccauugcucaaacucagca

SEQ ID NO: 4215869 - RNA, 23 nt, Yersinia pestis KIM
caccccuauuagggaacgccagc

SEQ ID NO: 4215870 - RNA, 12 nt, Yersinia pestis KIM
cacccgcaccaa

SEQ ID NO: 4215871 - RNA, 22 nt, Yersinia pestis KIM
cacccgcuucauucgcauaggg

SEQ ID NO: 4215872 - RNA, 16 nt, Yersinia pestis KIM
cacccggcuggcacca

SEQ ID NO: 4215873 - RNA, 23 nt, Yersinia pestis KIM
cacccggcuggcaccaagcagcc

SEQ ID NO: 4215874 - RNA, 12 nt, Yersinia pestis KIM
cacccguugcaa

SEQ ID NO: 4215875 - RNA, 23 nt, Yersinia pestis KIM
cacccguugcauuuuucuguuca

SEQ ID NO: 4215876 - RNA, 20 nt, Yersinia pestis KIM
cacccuaaugaacgaguaaa

SEQ ID NO: 4215877 - RNA, 16 nt, Yersinia pestis KIM
cacccucaacucaaaa

SEQ ID NO: 4215878 - RNA, 22 nt, Yersinia pestis KIM
cacccucaagagcgauaaccgc

SEQ ID NO: 4215879 - RNA, 21 nt, Yersinia pestis KIM
cacccucucuuuccagcaaaa

SEQ ID NO: 4215880 - RNA, 20 nt, Yersinia pestis KIM
cacccugcgugguauacccu

SEQ ID NO: 4215881 - RNA, 22 nt, Yersinia pestis KIM
cacccuguguauuuaaccaaca

SEQ ID NO: 4215882 - RNA, 22 nt, Yersinia pestis KIM
cacccuuuaaaucuagcccuuc

SEQ ID NO: 4215883 - RNA, 21 nt, Yersinia pestis KIM
cacccuuuacgcauugguaua

SEQ ID NO: 4215884 - RNA, 13 nt, Yersinia pestis KIM
caccgagcaccaa

SEQ ID NO: 4215885 - RNA, 20 nt, Yersinia pestis KIM
caccgaggcgggucagaaac

SEQ ID NO: 4215886 - RNA, 21 nt, Yersinia pestis KIM
caccgaguaaacguggcccuu

SEQ ID NO: 4215887 - RNA, 20 nt, Yersinia pestis KIM
caccgauaaaagugaccaca

SEQ ID NO: 4215888 - RNA, 16 nt, Yersinia pestis KIM
caccgccagcaacagc

SEQ ID NO: 4215889 - RNA, 14 nt, Yersinia pestis KIM
caccgccagcaaua

SEQ ID NO: 4215890 - RNA, 22 nt, Yersinia pestis KIM
caccgccgucaaaccaagcccu

SEQ ID NO: 4215891 - RNA, 21 nt, Yersinia pestis KIM
caccgcuagcggcaguuauga

SEQ ID NO: 4215892 - RNA, 23 nt, Yersinia pestis KIM
caccgcuuagcaauaccagccga

SEQ ID NO: 4215893 - RNA, 23 nt, Yersinia pestis KIM
caccggcgagaaggauugaccaa

SEQ ID NO: 4215894 - RNA, 19 nt, Yersinia pestis KIM
caccggggugaucaacugc

SEQ ID NO: 4215895 - RNA, 18 nt, Yersinia pestis KIM
caccgguuuacccugcgc

SEQ ID NO: 4215896 - RNA, 18 nt, Yersinia pestis KIM
caccguaacuucuucgcg

SEQ ID NO: 4215897 - RNA, 14 nt, Yersinia pestis KIM
caccguaucugcca

SEQ ID NO: 4215898 - RNA, 15 nt, Yersinia pestis KIM
caccguaucugccaa

SEQ ID NO: 4215899 - RNA, 14 nt, Yersinia pestis KIM
caccgucaccaaau

SEQ ID NO: 4215900 - RNA, 17 nt, Yersinia pestis KIM
caccgucgguuucucuu

SEQ ID NO: 4215901 - RNA, 15 nt, Yersinia pestis KIM
caccgugugauaaac

SEQ ID NO: 4215902 - RNA, 16 nt, Yersinia pestis KIM
caccuaaaaugacgau

SEQ ID NO: 4215903 - RNA, 15 nt, Yersinia pestis KIM
caccuaacaugcuga

SEQ ID NO: 4215904 - RNA, 14 nt, Yersinia pestis KIM
caccuauaauuaac

SEQ ID NO: 4215905 - RNA, 21 nt, Yersinia pestis KIM
caccuaucgccgccgccagcc

SEQ ID NO: 4215906 - RNA, 13 nt, Yersinia pestis KIM
caccucaaacuga

SEQ ID NO: 4215907 - RNA, 16 nt, Yersinia pestis KIM
caccucaccagcaucu

SEQ ID NO: 4215908 - RNA, 15 nt, Yersinia pestis KIM
caccucagucaucgc

SEQ ID NO: 4215909 - RNA, 20 nt, Yersinia pestis KIM
caccuccaaaugucaggggg

SEQ ID NO: 4215910 - RNA, 12 nt, Yersinia pestis KIM
caccuccugugg

SEQ ID NO: 4215911 - RNA, 15 nt, Yersinia pestis KIM
caccucgcucaggcg

SEQ ID NO: 4215912 - RNA, 13 nt, Yersinia pestis KIM
caccugaaccuga

SEQ ID NO: 4215913 - RNA, 16 nt, Yersinia pestis KIM
caccugaguaauauua

SEQ ID NO: 4215914 - RNA, 20 nt, Yersinia pestis KIM
caccugcccagacucaaaau

SEQ ID NO: 4215915 - RNA, 14 nt, Yersinia pestis KIM
caccugcccgcccc

SEQ ID NO: 4215916 - RNA, 15 nt, Yersinia pestis KIM
caccugcccgccccg

SEQ ID NO: 4215917 - RNA, 20 nt, Yersinia pestis KIM
caccugcuuaguuacaauaa

SEQ ID NO: 4215918 - RNA, 13 nt, Yersinia pestis KIM
caccuggcccugg

SEQ ID NO: 4215919 - RNA, 14 nt, Yersinia pestis KIM
caccuuaaaauaag

SEQ ID NO: 4215920 - RNA, 13 nt, Yersinia pestis KIM
caccuuccaaacu

SEQ ID NO: 4215921 - RNA, 19 nt, Yersinia pestis KIM
caccuuccgucccaagaaa

SEQ ID NO: 4215922 - RNA, 21 nt, Yersinia pestis KIM
caccuucugcccguagcaaau

SEQ ID NO: 4215923 - RNA, 18 nt, Yersinia pestis KIM
caccuucuugguuaguuc

SEQ ID NO: 4215924 - RNA, 19 nt, Yersinia pestis KIM
caccuucuugguuaguucu

SEQ ID NO: 4215925 - RNA, 18 nt, Yersinia pestis KIM
caccuuggaaaacagcaa

SEQ ID NO: 4215926 - RNA, 13 nt, Yersinia pestis KIM
caccuuuaccaug

SEQ ID NO: 4215927 - RNA, 22 nt, Yersinia pestis KIM
caccuuuaccuuuacggccgcu

SEQ ID NO: 4215928 - RNA, 15 nt, Yersinia pestis KIM
cacgaaaagcagcag

SEQ ID NO: 4215929 - RNA, 15 nt, Yersinia pestis KIM
cacgaauuugcugcu

SEQ ID NO: 4215930 - RNA, 14 nt, Yersinia pestis KIM
cacgaccugugcac

SEQ ID NO: 4215931 - RNA, 18 nt, Yersinia pestis KIM
cacgacgcagcuccagcg

SEQ ID NO: 4215932 - RNA, 18 nt, Yersinia pestis KIM
cacgaguugguaaaauau

SEQ ID NO: 4215933 - RNA, 19 nt, Yersinia pestis KIM
cacgauaaauucgauaaaa

SEQ ID NO: 4215934 - RNA, 22 nt, Yersinia pestis KIM
cacgauaaauucgauaaaaggc

SEQ ID NO: 4215935 - RNA, 14 nt, Yersinia pestis KIM
cacgauagccagug

SEQ ID NO: 4215936 - RNA, 14 nt, Yersinia pestis KIM
cacugauuuauaaa

SEQ ID NO: 4215937 - RNA, 19 nt, Yersinia pestis KIM
cacugauuuauaaauaauu

SEQ ID NO: 4215938 - RNA, 20 nt, Yersinia pestis KIM
cacugauuuauaaauaauua

SEQ ID NO: 4215939 - RNA, 22 nt, Yersinia pestis KIM
cacugauuuuuuaccugagaaa

SEQ ID NO: 4215940 - RNA, 23 nt, Yersinia pestis KIM
cacugauuuuuuaccugagaaaa

SEQ ID NO: 4215941 - RNA, 13 nt, Yersinia pestis KIM
cacugccaucuca

SEQ ID NO: 4215942 - RNA, 16 nt, Yersinia pestis KIM
cacugccugcucucug

SEQ ID NO: 4215943 - RNA, 20 nt, Yersinia pestis KIM
cacugccugcucucugcugc

SEQ ID NO: 4215944 - RNA, 23 nt, Yersinia pestis KIM
cacugcgcgaucccagaauggca

SEQ ID NO: 4215945 - RNA, 23 nt, Yersinia pestis KIM
cacugcgggagggauuucuucau

SEQ ID NO: 4215946 - RNA, 14 nt, Yersinia pestis KIM
cacugcuccagcca

SEQ ID NO: 4215947 - RNA, 20 nt, Yersinia pestis KIM
cacugcuccagccaacuggc

SEQ ID NO: 4215948 - RNA, 14 nt, Yersinia pestis KIM
cacuggaaaaagug

SEQ ID NO: 4215949 - RNA, 15 nt, Yersinia pestis KIM
cacuggaaaaagugu

SEQ ID NO: 4215950 - RNA, 13 nt, Yersinia pestis KIM
cacuggaaacaaa

SEQ ID NO: 4215951 - RNA, 15 nt, Yersinia pestis KIM
cacuggaggaacuga

SEQ ID NO: 4215952 - RNA, 16 nt, Yersinia pestis KIM
cacuggaggaacugag

SEQ ID NO: 4215953 - RNA, 19 nt, Yersinia pestis KIM
cacuggauguguggcaguc

SEQ ID NO: 4215954 - RNA, 15 nt, Yersinia pestis KIM
cacuggcaccgcuuc

SEQ ID NO: 4215955 - RNA, 17 nt, Yersinia pestis KIM
cacuggcaccgcuucug

SEQ ID NO: 4215956 - RNA, 16 nt, Yersinia pestis KIM
cacuggccgcaggcgc

SEQ ID NO: 4215957 - RNA, 18 nt, Yersinia pestis KIM
cacuggcgguugaauaug

SEQ ID NO: 4215958 - RNA, 22 nt, Yersinia pestis KIM
cacuggugcucacugauuuuuu

SEQ ID NO: 4215959 - RNA, 15 nt, Yersinia pestis KIM
cacuguacugggaug

SEQ ID NO: 4215960 - RNA, 13 nt, Yersinia pestis KIM
cacuguagaccuc

SEQ ID NO: 4215961 - RNA, 16 nt, Yersinia pestis KIM
cacuguagaccucuuu

SEQ ID NO: 4215962 - RNA, 14 nt, Yersinia pestis KIM
cacugucuauuuuu

SEQ ID NO: 4215963 - RNA, 20 nt, Yersinia pestis KIM
cacuguugcgggcaucagcc

SEQ ID NO: 4215964 - RNA, 21 nt, Yersinia pestis KIM
cacuguuggcgggauccaucu

SEQ ID NO: 4215965 - RNA, 18 nt, Yersinia pestis KIM
cacuguuuuuccagcccu

SEQ ID NO: 4215966 - RNA, 12 nt, Yersinia pestis KIM
cacuuaauaaug

SEQ ID NO: 4215967 - RNA, 17 nt, Yersinia pestis KIM
cacuuaccuauaaacau

SEQ ID NO: 4215968 - RNA, 13 nt, Yersinia pestis KIM
cacuuagugcugg

SEQ ID NO: 4215969 - RNA, 15 nt, Yersinia pestis KIM
cacuuagugcuggcc

SEQ ID NO: 4215970 - RNA, 15 nt, Yersinia pestis KIM
cacuuauuauaaagc

SEQ ID NO: 4215971 - RNA, 21 nt, Yersinia pestis KIM
cacuuauuggaaguacuuauu

SEQ ID NO: 4215972 - RNA, 22 nt, Yersinia pestis KIM
cacuuauuggaaguacuuauuu

SEQ ID NO: 4215973 - RNA, 23 nt, Yersinia pestis KIM
cacuuauuggaaguacuuauuug

SEQ ID NO: 4215974 - RNA, 12 nt, Yersinia pestis KIM
cacuuauuugaa

SEQ ID NO: 4215975 - RNA, 22 nt, Yersinia pestis KIM
cacuucaacguggaaguucaga

SEQ ID NO: 4215976 - RNA, 20 nt, Yersinia pestis KIM
cacuucaauugccaugccga

SEQ ID NO: 4215977 - RNA, 14 nt, Yersinia pestis KIM
cacuucaucaucaa

SEQ ID NO: 4215978 - RNA, 20 nt, Yersinia pestis KIM
cacuucgauacuacaaucau

SEQ ID NO: 4215979 - RNA, 16 nt, Yersinia pestis KIM
cacuucgguggcccuu

SEQ ID NO: 4215980 - RNA, 17 nt, Yersinia pestis KIM
cacuucguaaucuggcu

SEQ ID NO: 4215981 - RNA, 20 nt, Yersinia pestis KIM
cacuucguagggcacuuuca

SEQ ID NO: 4215982 - RNA, 16 nt, Yersinia pestis KIM
cacuucuacagggcau

SEQ ID NO: 4215983 - RNA, 14 nt, Yersinia pestis KIM
cacuugagagaaac

SEQ ID NO: 4215984 - RNA, 16 nt, Yersinia pestis KIM
cacuugauagcguggc

SEQ ID NO: 4215985 - RNA, 15 nt, Yersinia pestis KIM
cacuugcaacauuau

SEQ ID NO: 4215986 - RNA, 11 nt, Yersinia pestis KIM
cacuugcuacc

SEQ ID NO: 4215987 - RNA, 16 nt, Yersinia pestis KIM
cacuugcucuaccacg

SEQ ID NO: 4215988 - RNA, 16 nt, Yersinia pestis KIM
cacuuggccccaucau

SEQ ID NO: 4215989 - RNA, 17 nt, Yersinia pestis KIM
cacuuggcuaauuguca

SEQ ID NO: 4215990 - RNA, 19 nt, Yersinia pestis KIM
cacuuguaccugugccagu

SEQ ID NO: 4215991 - RNA, 20 nt, Yersinia pestis KIM
cacuugugguaaccccgucg

SEQ ID NO: 4215992 - RNA, 12 nt, Yersinia pestis KIM
cacuuuaaauac

SEQ ID NO: 4215993 - RNA, 17 nt, Yersinia pestis KIM
cacuuuagccaagguua

SEQ ID NO: 4215994 - RNA, 18 nt, Yersinia pestis KIM
cacuuucaacuauugcau

SEQ ID NO: 4215995 - RNA, 22 nt, Yersinia pestis KIM
cacuuucagaauugugccccuu

SEQ ID NO: 4215996 - RNA, 20 nt, Yersinia pestis KIM
cacuuucaucgccgucagcu

SEQ ID NO: 4215997 - RNA, 21 nt, Yersinia pestis KIM
cacuuugucaauaaccucaaa

SEQ ID NO: 4215998 - RNA, 23 nt, Yersinia pestis KIM
cacuuugucaauaaccucagccu

SEQ ID NO: 4215999 - RNA, 21 nt, Yersinia pestis KIM
cacuuuuaagauccuguggcu

SEQ ID NO: 4216000 - RNA, 18 nt, Yersinia pestis KIM
cacuuuuaccgcaaccac

SEQ ID NO: 4216001 - RNA, 21 nt, Yersinia pestis KIM
cacuuuuauauccgccauccu

SEQ ID NO: 4216002 - RNA, 14 nt, Yersinia pestis KIM
cacuuuuauuuuuu

SEQ ID NO: 4216003 - RNA, 22 nt, Yersinia pestis KIM
cacuuuuauuuuuuaugacuuc

SEQ ID NO: 4216004 - RNA, 14 nt, Yersinia pestis KIM
cacuuuucagauag

SEQ ID NO: 4216005 - RNA, 20 nt, Yersinia pestis KIM
cacuuuugcuggugucacaa

SEQ ID NO: 4216006 - RNA, 15 nt, Yersinia pestis KIM
cagaaaaauaggcca

SEQ ID NO: 4216007 - RNA, 16 nt, Yersinia pestis KIM
cagaaaacccccugcu

SEQ ID NO: 4216008 - RNA, 14 nt, Yersinia pestis KIM
cagaaaaccuucag

SEQ ID NO: 4216009 - RNA, 20 nt, Yersinia pestis KIM
cagaaaaccuucagcaaaga

SEQ ID NO: 4216010 - RNA, 16 nt, Yersinia pestis KIM
cagaaacggcaucugc

SEQ ID NO: 4216011 - RNA, 22 nt, Yersinia pestis KIM
cagaaagguaugugccaaaaaa

SEQ ID NO: 4216012 - RNA, 16 nt, Yersinia pestis KIM
cagaaaguaaucuuug

SEQ ID NO: 4216013 - RNA, 17 nt, Yersinia pestis KIM
cagaaaguaaucuuuga

SEQ ID NO: 4216014 - RNA, 14 nt, Yersinia pestis KIM
cagaaaguuguuca

SEQ ID NO: 4216015 - RNA, 22 nt, Yersinia pestis KIM
cagaaauaaauauccuccggca

SEQ ID NO: 4216016 - RNA, 17 nt, Yersinia pestis KIM
cagaaauaauaucaagu

SEQ ID NO: 4216017 - RNA, 15 nt, Yersinia pestis KIM
cagaaaucaaugugc

SEQ ID NO: 4216018 - RNA, 23 nt, Yersinia pestis KIM
cagaacaccaacaccacacugag

SEQ ID NO: 4216019 - RNA, 24 nt, Yersinia pestis KIM
cagaacaccaacaccacacugagc

SEQ ID NO: 4216020 - RNA, 13 nt, Yersinia pestis KIM
cagaacagcaggc

SEQ ID NO: 4216021 - RNA, 16 nt, Yersinia pestis KIM
cagaacagguuuuuuc

SEQ ID NO: 4216022 - RNA, 19 nt, Yersinia pestis KIM
cagaacccccgcgaacagc

SEQ ID NO: 4216023 - RNA, 21 nt, Yersinia pestis KIM
cagaacccccgcgaacagcag

SEQ ID NO: 4216024 - RNA, 22 nt, Yersinia pestis KIM
cagaacccccgcgaacagcaga

SEQ ID NO: 4216025 - RNA, 16 nt, Yersinia pestis KIM
cagaacgcaaucaggg

SEQ ID NO: 4216026 - RNA, 17 nt, Yersinia pestis KIM
cagaacuaacaugccag

SEQ ID NO: 4216027 - RNA, 16 nt, Yersinia pestis KIM
cagaacuaauaucaac

SEQ ID NO: 4216028 - RNA, 16 nt, Yersinia pestis KIM
cagaacugauuucagg

SEQ ID NO: 4216029 - RNA, 14 nt, Yersinia pestis KIM
cagaacugggggua

SEQ ID NO: 4216030 - RNA, 23 nt, Yersinia pestis KIM
cagaagaacagcccuccagccgg

SEQ ID NO: 4216031 - RNA, 14 nt, Yersinia pestis KIM
cagaagcauaugga

SEQ ID NO: 4216032 - RNA, 16 nt, Yersinia pestis KIM
cagaagcauauggaug

SEQ ID NO: 4216033 - RNA, 18 nt, Yersinia pestis KIM
cagaagggcggccagcaa

SEQ ID NO: 4216034 - RNA, 20 nt, Yersinia pestis KIM
cagaagggcggccagcaaga

SEQ ID NO: 4216035 - RNA, 22 nt, Yersinia pestis KIM
cagaaguaugcguggguucuuc

SEQ ID NO: 4216036 - RNA, 21 nt, Yersinia pestis KIM
cagaauaauaagccgugccug

SEQ ID NO: 4216037 - RNA, 19 nt, Yersinia pestis KIM
cagaauaauccaagccaug

SEQ ID NO: 4216038 - RNA, 21 nt, Yersinia pestis KIM
cagaauacguagcccuuugcu

SEQ ID NO: 4216039 - RNA, 16 nt, Yersinia pestis KIM
cagaauaucguggaga

SEQ ID NO: 4216040 - RNA, 14 nt, Yersinia pestis KIM
cagaaucaccaaca

SEQ ID NO: 4216041 - RNA, 21 nt, Yersinia pestis KIM
cagaaucaccaacaccaccau

SEQ ID NO: 4216042 - RNA, 21 nt, Yersinia pestis KIM
cagaaucacugucaaaaagca

SEQ ID NO: 4216043 - RNA, 17 nt, Yersinia pestis KIM
cagaaucagccccaagc

SEQ ID NO: 4216044 - RNA, 18 nt, Yersinia pestis KIM
cagaaucgccugcacacg

SEQ ID NO: 4216045 - RNA, 12 nt, Yersinia pestis KIM
cagaaugaaagg

SEQ ID NO: 4216046 - RNA, 21 nt, Yersinia pestis KIM
cagaaugaaaggcggugaaca

SEQ ID NO: 4216047 - RNA, 17 nt, Yersinia pestis KIM
cagaaugaaguucacca

SEQ ID NO: 4216048 - RNA, 23 nt, Yersinia pestis KIM
cagaaugaaguucaccagcuugg

SEQ ID NO: 4216049 - RNA, 17 nt, Yersinia pestis KIM
cagaauggcaaagcaca

SEQ ID NO: 4216050 - RNA, 20 nt, Yersinia pestis KIM
cagauucgcaaagcgggcca

SEQ ID NO: 4216051 - RNA, 21 nt, Yersinia pestis KIM
cagauucgcaaagcgggccag

SEQ ID NO: 4216052 - RNA, 18 nt, Yersinia pestis KIM
cagauuggcuugcuugau

SEQ ID NO: 4216053 - RNA, 14 nt, Yersinia pestis KIM
cagauuuaaaucau

SEQ ID NO: 4216054 - RNA, 13 nt, Yersinia pestis KIM
cagauuuacuccc

SEQ ID NO: 4216055 - RNA, 23 nt, Yersinia pestis KIM
cagauuuuaagcugucuaaauug

SEQ ID NO: 4216056 - RNA, 21 nt, Yersinia pestis KIM
cagcaaacaucgguaaaucgc

SEQ ID NO: 4216057 - RNA, 22 nt, Yersinia pestis KIM
cagcaaagccucuaccaaugcc

SEQ ID NO: 4216058 - RNA, 12 nt, Yersinia pestis KIM
cagcaaaucaaa

SEQ ID NO: 4216059 - RNA, 21 nt, Yersinia pestis KIM
cagcaaaucuugugaugcaua

SEQ ID NO: 4216060 - RNA, 15 nt, Yersinia pestis KIM
cagcaacagcgaccg

SEQ ID NO: 4216061 - RNA, 19 nt, Yersinia pestis KIM
cagcaaccacgguaucaau

SEQ ID NO: 4216062 - RNA, 17 nt, Yersinia pestis KIM
cagcaaccacuucaacg

SEQ ID NO: 4216063 - RNA, 20 nt, Yersinia pestis KIM
cagcaacccgcccaagcccu

SEQ ID NO: 4216064 - RNA, 18 nt, Yersinia pestis KIM
cagcaaccgucaccgugu

SEQ ID NO: 4216065 - RNA, 21 nt, Yersinia pestis KIM
cagcaaccuggcggcccgaga

SEQ ID NO: 4216066 - RNA, 15 nt, Yersinia pestis KIM
cagcaacgaauaaaa

SEQ ID NO: 4216067 - RNA, 17 nt, Yersinia pestis KIM
cagcaacgaauaaaaaa

SEQ ID NO: 4216068 - RNA, 15 nt, Yersinia pestis KIM
cagcaacgguuucaa

SEQ ID NO: 4216069 - RNA, 13 nt, Yersinia pestis KIM
cagcaacuguuuu

SEQ ID NO: 4216070 - RNA, 12 nt, Yersinia pestis KIM
cagcaagagcag

SEQ ID NO: 4216071 - RNA, 12 nt, Yersinia pestis KIM
cagcaagccaau

SEQ ID NO: 4216072 - RNA, 12 nt, Yersinia pestis KIM
cagcaaggcaga

SEQ ID NO: 4216073 - RNA, 14 nt, Yersinia pestis KIM
cagcaaggcagcaa

SEQ ID NO: 4216074 - RNA, 17 nt, Yersinia pestis KIM
cagcaaggcagcaagca

SEQ ID NO: 4216075 - RNA, 18 nt, Yersinia pestis KIM
cagcaaggcagcaagcaa

SEQ ID NO: 4216076 - RNA, 21 nt, Yersinia pestis KIM
cagcaaggcggcaagcaagca

SEQ ID NO: 4216077 - RNA, 16 nt, Yersinia pestis KIM
cagcaagugaauaaca

SEQ ID NO: 4216078 - RNA, 17 nt, Yersinia pestis KIM
cagcaagugagcaaauc

SEQ ID NO: 4216079 - RNA, 21 nt, Yersinia pestis KIM
cagcaaguuagcgauaucugc

SEQ ID NO: 4216080 - RNA, 17 nt, Yersinia pestis KIM
cagcaauaaccaacggg

SEQ ID NO: 4216081 - RNA, 16 nt, Yersinia pestis KIM
cagcaauaagccacgc

SEQ ID NO: 4216082 - RNA, 22 nt, Yersinia pestis KIM
cagcaauauccgugauuaaccu

SEQ ID NO: 4216083 - RNA, 18 nt, Yersinia pestis KIM
cagcaauaugaauacgaa

SEQ ID NO: 4216084 - RNA, 14 nt, Yersinia pestis KIM
cagcacaagcgccu

SEQ ID NO: 4216085 - RNA, 13 nt, Yersinia pestis KIM
cagcacaaugacu

SEQ ID NO: 4216086 - RNA, 16 nt, Yersinia pestis KIM
cagcacagagcacaac

SEQ ID NO: 4216087 - RNA, 17 nt, Yersinia pestis KIM
cagcacagagcacaacg

SEQ ID NO: 4216088 - RNA, 21 nt, Yersinia pestis KIM
cagcacagagcacaacggaag

SEQ ID NO: 4216089 - RNA, 11 nt, Yersinia pestis KIM
cagcaccaccg

SEQ ID NO: 4216090 - RNA, 14 nt, Yersinia pestis KIM
cagcaccaccgaug

SEQ ID NO: 4216091 - RNA, 23 nt, Yersinia pestis KIM
cagcaccagggaugggcgccgcu

SEQ ID NO: 4216092 - RNA, 15 nt, Yersinia pestis KIM
cagcaccauuaucuu

SEQ ID NO: 4216093 - RNA, 18 nt, Yersinia pestis KIM
cagcacgaaccugagcga

SEQ ID NO: 4216094 - RNA, 12 nt, Yersinia pestis KIM
cagcacgccagu

SEQ ID NO: 4216095 - RNA, 15 nt, Yersinia pestis KIM
cagcacgccaguguu

SEQ ID NO: 4216096 - RNA, 21 nt, Yersinia pestis KIM
cagcacgggcuaucggguaac

SEQ ID NO: 4216097 - RNA, 13 nt, Yersinia pestis KIM
cagcacgguaacc

SEQ ID NO: 4216098 - RNA, 16 nt, Yersinia pestis KIM
cagcacgguaaccuuu

SEQ ID NO: 4216099 - RNA, 15 nt, Yersinia pestis KIM
cagcacguaccgcug

SEQ ID NO: 4216100 - RNA, 23 nt, Yersinia pestis KIM
cagcacuacguguuuuucaucug

SEQ ID NO: 4216101 - RNA, 15 nt, Yersinia pestis KIM
cagcacuauccccaa

SEQ ID NO: 4216102 - RNA, 19 nt, Yersinia pestis KIM
cagcagaacaaaacaagcc

SEQ ID NO: 4216103 - RNA, 17 nt, Yersinia pestis KIM
cagcagaguaaagcagg

SEQ ID NO: 4216104 - RNA, 19 nt, Yersinia pestis KIM
cagcagagucgcaaaaaau

SEQ ID NO: 4216105 - RNA, 22 nt, Yersinia pestis KIM
cagcagauugauaacaccggcu

SEQ ID NO: 4216106 - RNA, 11 nt, Yersinia pestis KIM
cagcagcagga

SEQ ID NO: 4216107 - RNA, 14 nt, Yersinia pestis KIM
cagcagcaggaaua

SEQ ID NO: 4216108 - RNA, 13 nt, Yersinia pestis KIM
cagcagcuuuugu

SEQ ID NO: 4216109 - RNA, 23 nt, Yersinia pestis KIM
cagcagcuuuugugcaggaguaa

SEQ ID NO: 4216110 - RNA, 14 nt, Yersinia pestis KIM
cagcaggaauaccc

SEQ ID NO: 4216111 - RNA, 16 nt, Yersinia pestis KIM
cagcaggcgugcugcu

SEQ ID NO: 4216112 - RNA, 20 nt, Yersinia pestis KIM
cagcaggcugugaucugcca

SEQ ID NO: 4216113 - RNA, 23 nt, Yersinia pestis KIM
cagcagggauucugucagagcua

SEQ ID NO: 4216114 - RNA, 22 nt, Yersinia pestis KIM
cagcaggggcaaccucuucuuc

SEQ ID NO: 4216115 - RNA, 12 nt, Yersinia pestis KIM
cagcagucugaa

SEQ ID NO: 4216116 - RNA, 15 nt, Yersinia pestis KIM
cagcagucugaagcc

SEQ ID NO: 4216117 - RNA, 16 nt, Yersinia pestis KIM
cagcagucugaagcga

SEQ ID NO: 4216118 - RNA, 15 nt, Yersinia pestis KIM
cagcagucugacaga

SEQ ID NO: 4216119 - RNA, 21 nt, Yersinia pestis KIM
cagcagucugagccucaugaa

SEQ ID NO: 4216120 - RNA, 12 nt, Yersinia pestis KIM
cagcagucugau

SEQ ID NO: 4216121 - RNA, 17 nt, Yersinia pestis KIM
cagcaguggcuuggcaa

SEQ ID NO: 4216122 - RNA, 13 nt, Yersinia pestis KIM
cagcaguuccagu

SEQ ID NO: 4216123 - RNA, 20 nt, Yersinia pestis KIM
cagcauaaauauucauuaaa

SEQ ID NO: 4216124 - RNA, 16 nt, Yersinia pestis KIM
cagcauaaccagugcc

SEQ ID NO: 4216125 - RNA, 16 nt, Yersinia pestis KIM
cagcauacgugccaaa

SEQ ID NO: 4216126 - RNA, 20 nt, Yersinia pestis KIM
cagcauaguaagcuggcccu

SEQ ID NO: 4216127 - RNA, 21 nt, Yersinia pestis KIM
cagcauaucccuguuuucuag

SEQ ID NO: 4216128 - RNA, 22 nt, Yersinia pestis KIM
cagcauauugagcauacuguug

SEQ ID NO: 4216129 - RNA, 14 nt, Yersinia pestis KIM
cagcauauuguaaa

SEQ ID NO: 4216130 - RNA, 20 nt, Yersinia pestis KIM
cagcauauuguaaacuucca

SEQ ID NO: 4216131 - RNA, 16 nt, Yersinia pestis KIM
cagcaucaaacuuccc

SEQ ID NO: 4216132 - RNA, 15 nt, Yersinia pestis KIM
cagcaucaacaugga

SEQ ID NO: 4216133 - RNA, 14 nt, Yersinia pestis KIM
cagcaucaccgccg

SEQ ID NO: 4216134 - RNA, 16 nt, Yersinia pestis KIM
cagcaucaguagcauc

SEQ ID NO: 4216135 - RNA, 15 nt, Yersinia pestis KIM
cagcaucccaaugaa

SEQ ID NO: 4216136 - RNA, 18 nt, Yersinia pestis KIM
cagcaucgcugaggucag

SEQ ID NO: 4216137 - RNA, 23 nt, Yersinia pestis KIM
cagcaucgcugaggucagugcug

SEQ ID NO: 4216138 - RNA, 17 nt, Yersinia pestis KIM
cagcaucugcaauggcu

SEQ ID NO: 4216139 - RNA, 16 nt, Yersinia pestis KIM
cagcaucuuuaauaaa

SEQ ID NO: 4216140 - RNA, 13 nt, Yersinia pestis KIM
cagcaugguagcc

SEQ ID NO: 4216141 - RNA, 23 nt, Yersinia pestis KIM
cagcauguaggaggagguuuccu

SEQ ID NO: 4216142 - RNA, 16 nt, Yersinia pestis KIM
cagcauuaacccauau

SEQ ID NO: 4216143 - RNA, 21 nt, Yersinia pestis KIM
cagcauuaacccauauuacuc

SEQ ID NO: 4216144 - RNA, 15 nt, Yersinia pestis KIM
cagcauucaggcuuu

SEQ ID NO: 4216145 - RNA, 18 nt, Yersinia pestis KIM
cagcauucucacuuacua

SEQ ID NO: 4216146 - RNA, 22 nt, Yersinia pestis KIM
cagcauuucaggaucgaucugg

SEQ ID NO: 4216147 - RNA, 21 nt, Yersinia pestis KIM
cagccaacuccuugaauauuu

SEQ ID NO: 4216148 - RNA, 15 nt, Yersinia pestis KIM
cagccaagaucccaa

SEQ ID NO: 4216149 - RNA, 15 nt, Yersinia pestis KIM
cagccaagucaggga

SEQ ID NO: 4216150 - RNA, 13 nt, Yersinia pestis KIM
cagccaccagcca

SEQ ID NO: 4216151 - RNA, 17 nt, Yersinia pestis KIM
cagccaccgcacacuga

SEQ ID NO: 4216152 - RNA, 18 nt, Yersinia pestis KIM
cagccacgauuaucucuu

SEQ ID NO: 4216153 - RNA, 18 nt, Yersinia pestis KIM
cagccacucacauaagaa

SEQ ID NO: 4216154 - RNA, 13 nt, Yersinia pestis KIM
cagccagaaccuc

SEQ ID NO: 4216155 - RNA, 14 nt, Yersinia pestis KIM
cagccagacgagua

SEQ ID NO: 4216156 - RNA, 19 nt, Yersinia pestis KIM
cagccagcgggcgcagcca

SEQ ID NO: 4216157 - RNA, 21 nt, Yersinia pestis KIM
cagccagcuccugccacagac

SEQ ID NO: 4216158 - RNA, 22 nt, Yersinia pestis KIM
cagccauauguugccaccagcg

SEQ ID NO: 4216159 - RNA, 23 nt, Yersinia pestis KIM
cagccaucaguucacugaauccc

SEQ ID NO: 4216160 - RNA, 19 nt, Yersinia pestis KIM
cagccaucggucauuuuac

SEQ ID NO: 4216161 - RNA, 23 nt, Yersinia pestis KIM
cagccaucuugggccgacucugc

SEQ ID NO: 4216162 - RNA, 23 nt, Yersinia pestis KIM
cagccauuugaacaaaccccacu

SEQ ID NO: 4216163 - RNA, 13 nt, Yersinia pestis KIM
cagcccagcaggc

SEQ ID NO: 4216164 - RNA, 20 nt, Yersinia pestis KIM
cagcccagucucuuugccaa

SEQ ID NO: 4216165 - RNA, 14 nt, Yersinia pestis KIM
caggccaaagcugu

SEQ ID NO: 4216166 - RNA, 16 nt, Yersinia pestis KIM
caggccaagccugugc

SEQ ID NO: 4216167 - RNA, 13 nt, Yersinia pestis KIM
caggccaagugcu

SEQ ID NO: 4216168 - RNA, 16 nt, Yersinia pestis KIM
caggccaccuaacacu

SEQ ID NO: 4216169 - RNA, 15 nt, Yersinia pestis KIM
caggccauuggcaaa

SEQ ID NO: 4216170 - RNA, 21 nt, Yersinia pestis KIM
caggccauuggcaaaggccag

SEQ ID NO: 4216171 - RNA, 22 nt, Yersinia pestis KIM
caggccauuggcaaaggccagc

SEQ ID NO: 4216172 - RNA, 12 nt, Yersinia pestis KIM
caggccauuuuc

SEQ ID NO: 4216173 - RNA, 18 nt, Yersinia pestis KIM
caggccccaauccaccac

SEQ ID NO: 4216174 - RNA, 21 nt, Yersinia pestis KIM
caggccccaauccaccacuga

SEQ ID NO: 4216175 - RNA, 16 nt, Yersinia pestis KIM
caggccccaucauaaa

SEQ ID NO: 4216176 - RNA, 17 nt, Yersinia pestis KIM
caggcccgcuaucacua

SEQ ID NO: 4216177 - RNA, 22 nt, Yersinia pestis KIM
caggcccgcuuuaaucagcccu

SEQ ID NO: 4216178 - RNA, 18 nt, Yersinia pestis KIM
caggcccugguugcagca

SEQ ID NO: 4216179 - RNA, 19 nt, Yersinia pestis KIM
caggccgcgaauauggcau

SEQ ID NO: 4216180 - RNA, 18 nt, Yersinia pestis KIM
caggccuagcccaguacc

SEQ ID NO: 4216181 - RNA, 23 nt, Yersinia pestis KIM
caggccuagcccaguaccgcugg

SEQ ID NO: 4216182 - RNA, 14 nt, Yersinia pestis KIM
caggccugcaccgg

SEQ ID NO: 4216183 - RNA, 13 nt, Yersinia pestis KIM
caggccuucuuuu

SEQ ID NO: 4216184 - RNA, 21 nt, Yersinia pestis KIM
caggcgacccagcgccauaac

SEQ ID NO: 4216185 - RNA, 20 nt, Yersinia pestis KIM
caggcgaguuucccuuuucc

SEQ ID NO: 4216186 - RNA, 16 nt, Yersinia pestis KIM
caggcgcaacugccau

SEQ ID NO: 4216187 - RNA, 14 nt, Yersinia pestis KIM
caggcgcuacgcaa

SEQ ID NO: 4216188 - RNA, 19 nt, Yersinia pestis KIM
caggcgcuauuccgcgccu

SEQ ID NO: 4216189 - RNA, 18 nt, Yersinia pestis KIM
caggcgguuacagccgcc

SEQ ID NO: 4216190 - RNA, 16 nt, Yersinia pestis KIM
caggcgugcugcuucc

SEQ ID NO: 4216191 - RNA, 23 nt, Yersinia pestis KIM
caggcgugggcuaauugaauaca

SEQ ID NO: 4216192 - RNA, 17 nt, Yersinia pestis KIM
caggcguucuguagcug

SEQ ID NO: 4216193 - RNA, 17 nt, Yersinia pestis KIM
caggcuaauacaugcug

SEQ ID NO: 4216194 - RNA, 17 nt, Yersinia pestis KIM
caggcuacggcugaucu

SEQ ID NO: 4216195 - RNA, 15 nt, Yersinia pestis KIM
caggcucagcacaaa

SEQ ID NO: 4216196 - RNA, 14 nt, Yersinia pestis KIM
caggcucaucaccu

SEQ ID NO: 4216197 - RNA, 17 nt, Yersinia pestis KIM
caggcucaucaccuucc

SEQ ID NO: 4216198 - RNA, 15 nt, Yersinia pestis KIM
caggcucuaucucuu

SEQ ID NO: 4216199 - RNA, 13 nt, Yersinia pestis KIM
caggcugcaccca

SEQ ID NO: 4216200 - RNA, 17 nt, Yersinia pestis KIM
caggcugccugccugag

SEQ ID NO: 4216201 - RNA, 23 nt, Yersinia pestis KIM
caggcuggauugauuuuuauaau

SEQ ID NO: 4216202 - RNA, 21 nt, Yersinia pestis KIM
caggcuguucuuggaacaggc

SEQ ID NO: 4216203 - RNA, 21 nt, Yersinia pestis KIM
caggcuuugguuuugauuuuu

SEQ ID NO: 4216204 - RNA, 23 nt, Yersinia pestis KIM
cagggaaaaacgcagagcgauug

SEQ ID NO: 4216205 - RNA, 14 nt, Yersinia pestis KIM
cagggagccaauag

SEQ ID NO: 4216206 - RNA, 15 nt, Yersinia pestis KIM
cagggagucagggag

SEQ ID NO: 4216207 - RNA, 18 nt, Yersinia pestis KIM
cagggagucagggaguca

SEQ ID NO: 4216208 - RNA, 20 nt, Yersinia pestis KIM
cagggagucagggagucagg

SEQ ID NO: 4216209 - RNA, 15 nt, Yersinia pestis KIM
cagggaucaccucuu

SEQ ID NO: 4216210 - RNA, 21 nt, Yersinia pestis KIM
cagggcaaucaggaaaggccg

SEQ ID NO: 4216211 - RNA, 16 nt, Yersinia pestis KIM
cagggcagcaucguca

SEQ ID NO: 4216212 - RNA, 21 nt, Yersinia pestis KIM
cagggccaguuaccgaugauu

SEQ ID NO: 4216213 - RNA, 20 nt, Yersinia pestis KIM
cagggcgauagcccuacugg

SEQ ID NO: 4216214 - RNA, 15 nt, Yersinia pestis KIM
cagggcgaucaggaa

SEQ ID NO: 4216215 - RNA, 16 nt, Yersinia pestis KIM
cagggcgaucaggaag

SEQ ID NO: 4216216 - RNA, 16 nt, Yersinia pestis KIM
cagggcguauaaacag

SEQ ID NO: 4216217 - RNA, 19 nt, Yersinia pestis KIM
cagggcguauaaacagagc

SEQ ID NO: 4216218 - RNA, 23 nt, Yersinia pestis KIM
caggggauagcaacugccaauau

SEQ ID NO: 4216219 - RNA, 23 nt, Yersinia pestis KIM
caggggcguuauucucaauugac

SEQ ID NO: 4216220 - RNA, 18 nt, Yersinia pestis KIM
cagggggaaacgaacagg

SEQ ID NO: 4216221 - RNA, 19 nt, Yersinia pestis KIM
cagggggaaacgaacaggg

SEQ ID NO: 4216222 - RNA, 20 nt, Yersinia pestis KIM
cagggggaugccuuguuucu

SEQ ID NO: 4216223 - RNA, 13 nt, Yersinia pestis KIM
caggggguuaucc

SEQ ID NO: 4216224 - RNA, 20 nt, Yersinia pestis KIM
cagggguaagauccaccaca

SEQ ID NO: 4216225 - RNA, 15 nt, Yersinia pestis KIM
caggguaauaaccga

SEQ ID NO: 4216226 - RNA, 22 nt, Yersinia pestis KIM
caggguauuccacccgcacaau

SEQ ID NO: 4216227 - RNA, 20 nt, Yersinia pestis KIM
cagggugaccgcacugccca

SEQ ID NO: 4216228 - RNA, 17 nt, Yersinia pestis KIM
caggguuagccgacugg

SEQ ID NO: 4216229 - RNA, 18 nt, Yersinia pestis KIM
caggguuuaacgggcuua

SEQ ID NO: 4216230 - RNA, 14 nt, Yersinia pestis KIM
cagguaaaacauuu

SEQ ID NO: 4216231 - RNA, 13 nt, Yersinia pestis KIM
cagguaaauccuu

SEQ ID NO: 4216232 - RNA, 13 nt, Yersinia pestis KIM
cagguaagaaaga

SEQ ID NO: 4216233 - RNA, 16 nt, Yersinia pestis KIM
cagguaaucacauaac

SEQ ID NO: 4216234 - RNA, 21 nt, Yersinia pestis KIM
cagguaaugcgcgcagcaagc

SEQ ID NO: 4216235 - RNA, 14 nt, Yersinia pestis KIM
cagguaccccauaa

SEQ ID NO: 4216236 - RNA, 19 nt, Yersinia pestis KIM
cagguaccccauaaauccc

SEQ ID NO: 4216237 - RNA, 22 nt, Yersinia pestis KIM
cagguaccgggccauagcccau

SEQ ID NO: 4216238 - RNA, 16 nt, Yersinia pestis KIM
cagguacuucaaauaa

SEQ ID NO: 4216239 - RNA, 18 nt, Yersinia pestis KIM
cagguagaucaaacauaa

SEQ ID NO: 4216240 - RNA, 14 nt, Yersinia pestis KIM
cagguaguggaaau

SEQ ID NO: 4216241 - RNA, 21 nt, Yersinia pestis KIM
cagguaguucauuuugaccag

SEQ ID NO: 4216242 - RNA, 14 nt, Yersinia pestis KIM
cagguauucuccag

SEQ ID NO: 4216243 - RNA, 19 nt, Yersinia pestis KIM
cagguauucuccaguuggc

SEQ ID NO: 4216244 - RNA, 20 nt, Yersinia pestis KIM
cagguauucuccaguuggcg

SEQ ID NO: 4216245 - RNA, 19 nt, Yersinia pestis KIM
cagguauuugggcuucagc

SEQ ID NO: 4216246 - RNA, 22 nt, Yersinia pestis KIM
caggucaggaagagaaaagcag

SEQ ID NO: 4216247 - RNA, 15 nt, Yersinia pestis KIM
caggucgauuacaua

SEQ ID NO: 4216248 - RNA, 22 nt, Yersinia pestis KIM
caggugaacguuggcuucaccu

SEQ ID NO: 4216249 - RNA, 17 nt, Yersinia pestis KIM
caggugcguuaucuuca

SEQ ID NO: 4216250 - RNA, 17 nt, Yersinia pestis KIM
cagguggauccgucauc

SEQ ID NO: 4216251 - RNA, 17 nt, Yersinia pestis KIM
caggugggcauaccggu

SEQ ID NO: 4216252 - RNA, 14 nt, Yersinia pestis KIM
cagguucaauuccc

SEQ ID NO: 4216253 - RNA, 16 nt, Yersinia pestis KIM
cagguucagcgaccag

SEQ ID NO: 4216254 - RNA, 13 nt, Yersinia pestis KIM
cagguucauuaca

SEQ ID NO: 4216255 - RNA, 18 nt, Yersinia pestis KIM
cagguucauuacacagca

SEQ ID NO: 4216256 - RNA, 16 nt, Yersinia pestis KIM
cagguucggcgcaauc

SEQ ID NO: 4216257 - RNA, 13 nt, Yersinia pestis KIM
cagguugaaauaa

SEQ ID NO: 4216258 - RNA, 17 nt, Yersinia pestis KIM
cagguugaaauaaauaa

SEQ ID NO: 4216259 - RNA, 13 nt, Yersinia pestis KIM
cagguugaagauc

SEQ ID NO: 4216260 - RNA, 22 nt, Yersinia pestis KIM
cagguuguuaucgaacaucucc

SEQ ID NO: 4216261 - RNA, 21 nt, Yersinia pestis KIM
cagguuguuauuacuaaugag

SEQ ID NO: 4216262 - RNA, 22 nt, Yersinia pestis KIM
caguaaaaaaaccccguacaug

SEQ ID NO: 4216263 - RNA, 11 nt, Yersinia pestis KIM
caguaaaaacu

SEQ ID NO: 4216264 - RNA, 14 nt, Yersinia pestis KIM
caguaaaaacucac

SEQ ID NO: 4216265 - RNA, 12 nt, Yersinia pestis KIM
caguaaaaacug

SEQ ID NO: 4216266 - RNA, 16 nt, Yersinia pestis KIM
caguaaaaccagcagc

SEQ ID NO: 4216267 - RNA, 21 nt, Yersinia pestis KIM
caguaaacagccagcaucacg

SEQ ID NO: 4216268 - RNA, 17 nt, Yersinia pestis KIM
caguaaacgccaaucac

SEQ ID NO: 4216269 - RNA, 18 nt, Yersinia pestis KIM
caguaaacgguugcugua

SEQ ID NO: 4216270 - RNA, 23 nt, Yersinia pestis KIM
caguaaagcaaauucccaccaua

SEQ ID NO: 4216271 - RNA, 17 nt, Yersinia pestis KIM
caguaaauuauuuucca

SEQ ID NO: 4216272 - RNA, 13 nt, Yersinia pestis KIM
caguaacaacauc

SEQ ID NO: 4216273 - RNA, 18 nt, Yersinia pestis KIM
caguaaccccuucgagca

SEQ ID NO: 4216274 - RNA, 21 nt, Yersinia pestis KIM
caguaaccccuucgagcaccg

SEQ ID NO: 4216275 - RNA, 19 nt, Yersinia pestis KIM
caguaacggaauucagaac

SEQ ID NO: 4216276 - RNA, 19 nt, Yersinia pestis KIM
caguaacggggcgcacuga

SEQ ID NO: 4216277 - RNA, 17 nt, Yersinia pestis KIM
caguaacgggucucaau

SEQ ID NO: 4216278 - RNA, 18 nt, Yersinia pestis KIM
caguaacgggucucaaug

SEQ ID NO: 4216279 - RNA, 21 nt, Yersinia pestis KIM
caguucauuacaggccccaau

SEQ ID NO: 4216280 - RNA, 16 nt, Yersinia pestis KIM
caguucccuguucucu

SEQ ID NO: 4216281 - RNA, 18 nt, Yersinia pestis KIM
caguucugguagcugcuc

SEQ ID NO: 4216282 - RNA, 15 nt, Yersinia pestis KIM
caguugaccauuuuu

SEQ ID NO: 4216283 - RNA, 19 nt, Yersinia pestis KIM
caguugauauuauuauugc

SEQ ID NO: 4216284 - RNA, 18 nt, Yersinia pestis KIM
caguugaugaaucaauga

SEQ ID NO: 4216285 - RNA, 14 nt, Yersinia pestis KIM
caguugaugcaaaa

SEQ ID NO: 4216286 - RNA, 18 nt, Yersinia pestis KIM
caguugauggcugucuau

SEQ ID NO: 4216287 - RNA, 22 nt, Yersinia pestis KIM
caguugcugauucugacguugg

SEQ ID NO: 4216288 - RNA, 17 nt, Yersinia pestis KIM
caguugcugcucuguca

SEQ ID NO: 4216289 - RNA, 15 nt, Yersinia pestis KIM
caguuggccaccauu

SEQ ID NO: 4216290 - RNA, 17 nt, Yersinia pestis KIM
caguugguagagcacga

SEQ ID NO: 4216291 - RNA, 23 nt, Yersinia pestis KIM
caguugucuauuuucauuauuuu

SEQ ID NO: 4216292 - RNA, 17 nt, Yersinia pestis KIM
caguuuaccauccacua

SEQ ID NO: 4216293 - RNA, 17 nt, Yersinia pestis KIM
caguuuauuguuauuuu

SEQ ID NO: 4216294 - RNA, 14 nt, Yersinia pestis KIM
caguuuauuuuccc

SEQ ID NO: 4216295 - RNA, 17 nt, Yersinia pestis KIM
caguuucgucaugauaa

SEQ ID NO: 4216296 - RNA, 17 nt, Yersinia pestis KIM
caguuugagaaacugau

SEQ ID NO: 4216297 - RNA, 19 nt, Yersinia pestis KIM
caguuugaucgcuaaucgc

SEQ ID NO: 4216298 - RNA, 15 nt, Yersinia pestis KIM
caguuuuuucucaau

SEQ ID NO: 4216299 - RNA, 22 nt, Yersinia pestis KIM
cauaaaaaaacggugaacauuu

SEQ ID NO: 4216300 - RNA, 16 nt, Yersinia pestis KIM
cauaaaaaaagaaggg

SEQ ID NO: 4216301 - RNA, 14 nt, Yersinia pestis KIM
cauaaaaaccgccc

SEQ ID NO: 4216302 - RNA, 17 nt, Yersinia pestis KIM
cauaaaaagaaaaaaac

SEQ ID NO: 4216303 - RNA, 13 nt, Yersinia pestis KIM
cauaaaaauacau

SEQ ID NO: 4216304 - RNA, 19 nt, Yersinia pestis KIM
cauaaaaauacauaucaac

SEQ ID NO: 4216305 - RNA, 13 nt, Yersinia pestis KIM
cauaaaaggaugg

SEQ ID NO: 4216306 - RNA, 20 nt, Yersinia pestis KIM
cauaaaaggauggcccaagc

SEQ ID NO: 4216307 - RNA, 16 nt, Yersinia pestis KIM
cauaaaauaaauaauu

SEQ ID NO: 4216308 - RNA, 16 nt, Yersinia pestis KIM
cauaaaaugagccuga

SEQ ID NO: 4216309 - RNA, 15 nt, Yersinia pestis KIM
cauaaaccggugacu

SEQ ID NO: 4216310 - RNA, 14 nt, Yersinia pestis KIM
cauaaacugaaguu

SEQ ID NO: 4216311 - RNA, 21 nt, Yersinia pestis KIM
cauaaagaaaugacaaugaac

SEQ ID NO: 4216312 - RNA, 16 nt, Yersinia pestis KIM
cauaaagauagccacu

SEQ ID NO: 4216313 - RNA, 19 nt, Yersinia pestis KIM
cauaaagauagccacuaac

SEQ ID NO: 4216314 - RNA, 13 nt, Yersinia pestis KIM
cauaaauaaagag

SEQ ID NO: 4216315 - RNA, 22 nt, Yersinia pestis KIM
cauaaauauucauuaaaaaaua

SEQ ID NO: 4216316 - RNA, 17 nt, Yersinia pestis KIM
cauaaauauugguacau

SEQ ID NO: 4216317 - RNA, 21 nt, Yersinia pestis KIM
cauaaaucacaauuucacccc

SEQ ID NO: 4216318 - RNA, 15 nt, Yersinia pestis KIM
cauaaauuaaaacug

SEQ ID NO: 4216319 - RNA, 14 nt, Yersinia pestis KIM
cauaacaauuaauu

SEQ ID NO: 4216320 - RNA, 17 nt, Yersinia pestis KIM
cauaaccaucaaacaua

SEQ ID NO: 4216321 - RNA, 18 nt, Yersinia pestis KIM
cauaaccauugaaaccac

SEQ ID NO: 4216322 - RNA, 17 nt, Yersinia pestis KIM
cauaacugaauacuuug

SEQ ID NO: 4216323 - RNA, 19 nt, Yersinia pestis KIM
cauaagcgggguauuuuac

SEQ ID NO: 4216324 - RNA, 23 nt, Yersinia pestis KIM
cauaagcuaauagaucagccaaa

SEQ ID NO: 4216325 - RNA, 16 nt, Yersinia pestis KIM
cauaaggccaggcaau

SEQ ID NO: 4216326 - RNA, 17 nt, Yersinia pestis KIM
cauaauaaagcgaugcu

SEQ ID NO: 4216327 - RNA, 14 nt, Yersinia pestis KIM
cauaauaaugcgau

SEQ ID NO: 4216328 - RNA, 11 nt, Yersinia pestis KIM
cauaaucaggg

SEQ ID NO: 4216329 - RNA, 16 nt, Yersinia pestis KIM
cauaauccagaagcca

SEQ ID NO: 4216330 - RNA, 19 nt, Yersinia pestis KIM
cauaauccucaaccugauc

SEQ ID NO: 4216331 - RNA, 19 nt, Yersinia pestis KIM
cauaaucgauuacuggcua

SEQ ID NO: 4216332 - RNA, 20 nt, Yersinia pestis KIM
cauaaucugggguuccaggc

SEQ ID NO: 4216333 - RNA, 15 nt, Yersinia pestis KIM
cauaaucuuuacugc

SEQ ID NO: 4216334 - RNA, 22 nt, Yersinia pestis KIM
cauaauggacgaacagugccaa

SEQ ID NO: 4216335 - RNA, 14 nt, Yersinia pestis KIM
cauaauucugccga

SEQ ID NO: 4216336 - RNA, 15 nt, Yersinia pestis KIM
cauacaaccauuuca

SEQ ID NO: 4216337 - RNA, 19 nt, Yersinia pestis KIM
cauacaagccgugaccaaa

SEQ ID NO: 4216338 - RNA, 13 nt, Yersinia pestis KIM
cauacacggucug

SEQ ID NO: 4216339 - RNA, 19 nt, Yersinia pestis KIM
cauacagguguaccgcuuc

SEQ ID NO: 4216340 - RNA, 15 nt, Yersinia pestis KIM
cauacauaacauggu

SEQ ID NO: 4216341 - RNA, 15 nt, Yersinia pestis KIM
cauacauccacccau

SEQ ID NO: 4216342 - RNA, 20 nt, Yersinia pestis KIM
cauaccauaaggccaggcaa

SEQ ID NO: 4216343 - RNA, 17 nt, Yersinia pestis KIM
cauacccgcuguacugc

SEQ ID NO: 4216344 - RNA, 16 nt, Yersinia pestis KIM
cauacucaggcccuga

SEQ ID NO: 4216345 - RNA, 18 nt, Yersinia pestis KIM
cauacucaggcccugaga

SEQ ID NO: 4216346 - RNA, 23 nt, Yersinia pestis KIM
cauacuccauuuuuuugaugcau

SEQ ID NO: 4216347 - RNA, 13 nt, Yersinia pestis KIM
cauacucccccau

SEQ ID NO: 4216348 - RNA, 21 nt, Yersinia pestis KIM
cauacucucgcccucuggugc

SEQ ID NO: 4216349 - RNA, 19 nt, Yersinia pestis KIM
cauacucuuccaacgcuuc

SEQ ID NO: 4216350 - RNA, 19 nt, Yersinia pestis KIM
cauacuggcuaauauaucu

SEQ ID NO: 4216351 - RNA, 13 nt, Yersinia pestis KIM
cauacuuugccuu

SEQ ID NO: 4216352 - RNA, 13 nt, Yersinia pestis KIM
cauagaaaauaau

SEQ ID NO: 4216353 - RNA, 22 nt, Yersinia pestis KIM
cauagaagaagaauugcagaua

SEQ ID NO: 4216354 - RNA, 21 nt, Yersinia pestis KIM
cauagaagcucauaugcagca

SEQ ID NO: 4216355 - RNA, 15 nt, Yersinia pestis KIM
cauagacgaaggcac

SEQ ID NO: 4216356 - RNA, 19 nt, Yersinia pestis KIM
cauagaguucguguugugc

SEQ ID NO: 4216357 - RNA, 16 nt, Yersinia pestis KIM
cauagauuaagaaaac

SEQ ID NO: 4216358 - RNA, 18 nt, Yersinia pestis KIM
cauagauuauuuuuauac

SEQ ID NO: 4216359 - RNA, 19 nt, Yersinia pestis KIM
cauagauuauuuuuauaca

SEQ ID NO: 4216360 - RNA, 15 nt, Yersinia pestis KIM
cauagcgcauuauaa

SEQ ID NO: 4216361 - RNA, 17 nt, Yersinia pestis KIM
cauagcgcauuauaagg

SEQ ID NO: 4216362 - RNA, 17 nt, Yersinia pestis KIM
cauagcgugauuuuuau

SEQ ID NO: 4216363 - RNA, 17 nt, Yersinia pestis KIM
cauagcuaacaccgcug

SEQ ID NO: 4216364 - RNA, 19 nt, Yersinia pestis KIM
cauagcuaacaccgcugua

SEQ ID NO: 4216365 - RNA, 17 nt, Yersinia pestis KIM
cauagcuggcuucaaaa

SEQ ID NO: 4216366 - RNA, 14 nt, Yersinia pestis KIM
cauagguugcgcca

SEQ ID NO: 4216367 - RNA, 15 nt, Yersinia pestis KIM
cauaguccaacgcac

SEQ ID NO: 4216368 - RNA, 23 nt, Yersinia pestis KIM
cauagugcaaaauuccaccauuc

SEQ ID NO: 4216369 - RNA, 14 nt, Yersinia pestis KIM
cauauaaaaaagca

SEQ ID NO: 4216370 - RNA, 12 nt, Yersinia pestis KIM
cauauaaaccag

SEQ ID NO: 4216371 - RNA, 17 nt, Yersinia pestis KIM
cauauaaaccagccagu

SEQ ID NO: 4216372 - RNA, 19 nt, Yersinia pestis KIM
cauauaaaccagccaguga

SEQ ID NO: 4216373 - RNA, 19 nt, Yersinia pestis KIM
cauauaaccaugcgauacg

SEQ ID NO: 4216374 - RNA, 23 nt, Yersinia pestis KIM
cauauaaccauuuuaauauuaug

SEQ ID NO: 4216375 - RNA, 16 nt, Yersinia pestis KIM
cauauaagcaauaccg

SEQ ID NO: 4216376 - RNA, 22 nt, Yersinia pestis KIM
cauauaagcggcaaaaagcgcc

SEQ ID NO: 4216377 - RNA, 15 nt, Yersinia pestis KIM
cauauacuggagcua

SEQ ID NO: 4216378 - RNA, 22 nt, Yersinia pestis KIM
cauauagcggcguucagcaaua

SEQ ID NO: 4216379 - RNA, 17 nt, Yersinia pestis KIM
cauauaguuuuugcgcc

SEQ ID NO: 4216380 - RNA, 13 nt, Yersinia pestis KIM
cauauaucacuau

SEQ ID NO: 4216381 - RNA, 15 nt, Yersinia pestis KIM
cauauaucacuauuu

SEQ ID NO: 4216382 - RNA, 17 nt, Yersinia pestis KIM
cauauaucacuauuuca

SEQ ID NO: 4216383 - RNA, 21 nt, Yersinia pestis KIM
cauauauugauccaaauggcu

SEQ ID NO: 4216384 - RNA, 15 nt, Yersinia pestis KIM
cauauauugcauuua

SEQ ID NO: 4216385 - RNA, 11 nt, Yersinia pestis KIM
cauauauuuca

SEQ ID NO: 4216386 - RNA, 19 nt, Yersinia pestis KIM
cauauauuuuucuuucucg

SEQ ID NO: 4216387 - RNA, 20 nt, Yersinia pestis KIM
cauauauuuuucuuucucga

SEQ ID NO: 4216388 - RNA, 15 nt, Yersinia pestis KIM
cauaucaaaauaaaa

SEQ ID NO: 4216389 - RNA, 16 nt, Yersinia pestis KIM
cauaucaaaauaaaaa

SEQ ID NO: 4216390 - RNA, 16 nt, Yersinia pestis KIM
cauaucaacacugccu

SEQ ID NO: 4216391 - RNA, 18 nt, Yersinia pestis KIM
cauaucaacacugccuga

SEQ ID NO: 4216392 - RNA, 14 nt, Yersinia pestis KIM
cauaucaaccguuu

SEQ ID NO: 4216393 - RNA, 18 nt, Yersinia pestis KIM
cauaucagcaaugacggu

SEQ ID NO: 4216394 - RNA, 20 nt, Yersinia pestis KIM
caucauccagcucaacgacc

SEQ ID NO: 4216395 - RNA, 20 nt, Yersinia pestis KIM
caucaucccagucgucuuca

SEQ ID NO: 4216396 - RNA, 22 nt, Yersinia pestis KIM
caucaucccagucgucuucagc

SEQ ID NO: 4216397 - RNA, 22 nt, Yersinia pestis KIM
caucaucuucaaccuggaacca

SEQ ID NO: 4216398 - RNA, 13 nt, Yersinia pestis KIM
caucaucuucuuc

SEQ ID NO: 4216399 - RNA, 15 nt, Yersinia pestis KIM
caucaucuucuucau

SEQ ID NO: 4216400 - RNA, 19 nt, Yersinia pestis KIM
caucaugagauaaauauuu

SEQ ID NO: 4216401 - RNA, 14 nt, Yersinia pestis KIM
caucaugaguaaaa

SEQ ID NO: 4216402 - RNA, 17 nt, Yersinia pestis KIM
caucaugaguaaaagau

SEQ ID NO: 4216403 - RNA, 18 nt, Yersinia pestis KIM
caucaugcucauguugca

SEQ ID NO: 4216404 - RNA, 22 nt, Yersinia pestis KIM
caucaugguccaguggcgguau

SEQ ID NO: 4216405 - RNA, 15 nt, Yersinia pestis KIM
caucauuauuaugua

SEQ ID NO: 4216406 - RNA, 19 nt, Yersinia pestis KIM
caucauucauuuuaaaaaa

SEQ ID NO: 4216407 - RNA, 22 nt, Yersinia pestis KIM
caucauucauuuuaaaaaaauu

SEQ ID NO: 4216408 - RNA, 14 nt, Yersinia pestis KIM
cauccaaacggaau

SEQ ID NO: 4216409 - RNA, 15 nt, Yersinia pestis KIM
cauccaaauagccuu

SEQ ID NO: 4216410 - RNA, 21 nt, Yersinia pestis KIM
cauccaacaacugccaaauuu

SEQ ID NO: 4216411 - RNA, 19 nt, Yersinia pestis KIM
cauccaaccugcaaugccu

SEQ ID NO: 4216412 - RNA, 20 nt, Yersinia pestis KIM
cauccaaccugcaaugccua

SEQ ID NO: 4216413 - RNA, 16 nt, Yersinia pestis KIM
cauccaagccaucauu

SEQ ID NO: 4216414 - RNA, 17 nt, Yersinia pestis KIM
cauccaagccaucauua

SEQ ID NO: 4216415 - RNA, 19 nt, Yersinia pestis KIM
cauccacaucuugcgccga

SEQ ID NO: 4216416 - RNA, 16 nt, Yersinia pestis KIM
cauccagauauggcau

SEQ ID NO: 4216417 - RNA, 23 nt, Yersinia pestis KIM
cauccagcguaaacaguagcagg

SEQ ID NO: 4216418 - RNA, 17 nt, Yersinia pestis KIM
cauccagcucauauaau

SEQ ID NO: 4216419 - RNA, 14 nt, Yersinia pestis KIM
cauccaguaagcug

SEQ ID NO: 4216420 - RNA, 18 nt, Yersinia pestis KIM
cauccaguaagcuguuga

SEQ ID NO: 4216421 - RNA, 13 nt, Yersinia pestis KIM
cauccaucauugc

SEQ ID NO: 4216422 - RNA, 22 nt, Yersinia pestis KIM
cauccaucgggaugaccuuccc

SEQ ID NO: 4216423 - RNA, 15 nt, Yersinia pestis KIM
cauccaugccauggc

SEQ ID NO: 4216424 - RNA, 20 nt, Yersinia pestis KIM
cauccauguaggcucgagcc

SEQ ID NO: 4216425 - RNA, 16 nt, Yersinia pestis KIM
cauccauuacauccuu

SEQ ID NO: 4216426 - RNA, 13 nt, Yersinia pestis KIM
cauccauuguauu

SEQ ID NO: 4216427 - RNA, 22 nt, Yersinia pestis KIM
cauccauuguauugcucagggc

SEQ ID NO: 4216428 - RNA, 13 nt, Yersinia pestis KIM
caucccaacaauu

SEQ ID NO: 4216429 - RNA, 14 nt, Yersinia pestis KIM
caucccacucugua

SEQ ID NO: 4216430 - RNA, 11 nt, Yersinia pestis KIM
caucccagcac

SEQ ID NO: 4216431 - RNA, 19 nt, Yersinia pestis KIM
cauccccacugacaucauu

SEQ ID NO: 4216432 - RNA, 19 nt, Yersinia pestis KIM
cauccccacuuguaccugu

SEQ ID NO: 4216433 - RNA, 11 nt, Yersinia pestis KIM
cauccccagaa

SEQ ID NO: 4216434 - RNA, 16 nt, Yersinia pestis KIM
cauccccggcaacacc

SEQ ID NO: 4216435 - RNA, 19 nt, Yersinia pestis KIM
cauccccggcaacacccug

SEQ ID NO: 4216436 - RNA, 20 nt, Yersinia pestis KIM
caucccggcgacggcuggaa

SEQ ID NO: 4216437 - RNA, 16 nt, Yersinia pestis KIM
caucccguaggcuugg

SEQ ID NO: 4216438 - RNA, 14 nt, Yersinia pestis KIM
caucccuuaaccac

SEQ ID NO: 4216439 - RNA, 17 nt, Yersinia pestis KIM
cauccgaauuuuuacug

SEQ ID NO: 4216440 - RNA, 23 nt, Yersinia pestis KIM
cauccgaugaaauaaacuuuuau

SEQ ID NO: 4216441 - RNA, 19 nt, Yersinia pestis KIM
cauccgcaaaauggguaua

SEQ ID NO: 4216442 - RNA, 20 nt, Yersinia pestis KIM
cauccgcaggaagcaaugaa

SEQ ID NO: 4216443 - RNA, 15 nt, Yersinia pestis KIM
cauccgcauaaguua

SEQ ID NO: 4216444 - RNA, 22 nt, Yersinia pestis KIM
cauccgcgaugacacaauuccc

SEQ ID NO: 4216445 - RNA, 13 nt, Yersinia pestis KIM
cauccgcuugcag

SEQ ID NO: 4216446 - RNA, 16 nt, Yersinia pestis KIM
cauccgcuugcagcaa

SEQ ID NO: 4216447 - RNA, 18 nt, Yersinia pestis KIM
cauccgcuuguucuuccg

SEQ ID NO: 4216448 - RNA, 14 nt, Yersinia pestis KIM
cauccggcgggcaa

SEQ ID NO: 4216449 - RNA, 21 nt, Yersinia pestis KIM
cauccucaacaguacugccaa

SEQ ID NO: 4216450 - RNA, 15 nt, Yersinia pestis KIM
cauccugauuacguu

SEQ ID NO: 4216451 - RNA, 20 nt, Yersinia pestis KIM
cauccugcgggccagcgcug

SEQ ID NO: 4216452 - RNA, 16 nt, Yersinia pestis KIM
cauccuguucaaaagg

SEQ ID NO: 4216453 - RNA, 14 nt, Yersinia pestis KIM
caucgacaauggcu

SEQ ID NO: 4216454 - RNA, 21 nt, Yersinia pestis KIM
caucgacaccaagacugaagu

SEQ ID NO: 4216455 - RNA, 18 nt, Yersinia pestis KIM
caucgacgcgccauaagc

SEQ ID NO: 4216456 - RNA, 12 nt, Yersinia pestis KIM
caucgacuggcc

SEQ ID NO: 4216457 - RNA, 19 nt, Yersinia pestis KIM
caucgacuugaugaaguua

SEQ ID NO: 4216458 - RNA, 20 nt, Yersinia pestis KIM
caucgaggaauagccagcgu

SEQ ID NO: 4216459 - RNA, 15 nt, Yersinia pestis KIM
caucgauugcuggcg

SEQ ID NO: 4216460 - RNA, 15 nt, Yersinia pestis KIM
caucgcacugauagc

SEQ ID NO: 4216461 - RNA, 15 nt, Yersinia pestis KIM
caucgccacuucuaa

SEQ ID NO: 4216462 - RNA, 17 nt, Yersinia pestis KIM
caucgccacuucuaaca

SEQ ID NO: 4216463 - RNA, 16 nt, Yersinia pestis KIM
caucgccccaaagaua

SEQ ID NO: 4216464 - RNA, 15 nt, Yersinia pestis KIM
caucgccccugugcu

SEQ ID NO: 4216465 - RNA, 14 nt, Yersinia pestis KIM
caucgcccugcucu

SEQ ID NO: 4216466 - RNA, 17 nt, Yersinia pestis KIM
caucgccuucuggcaaa

SEQ ID NO: 4216467 - RNA, 20 nt, Yersinia pestis KIM
caucgcggaugcgcgcguca

SEQ ID NO: 4216468 - RNA, 22 nt, Yersinia pestis KIM
caucgcggaugcgcgcgucacu

SEQ ID NO: 4216469 - RNA, 22 nt, Yersinia pestis KIM
caucgcgggcgcgcugcugcuc

SEQ ID NO: 4216470 - RNA, 15 nt, Yersinia pestis KIM
caucgcucaucgcca

SEQ ID NO: 4216471 - RNA, 20 nt, Yersinia pestis KIM
caucgcugaggucagugcug

SEQ ID NO: 4216472 - RNA, 21 nt, Yersinia pestis KIM
caucgcuggacgcaucagauc

SEQ ID NO: 4216473 - RNA, 23 nt, Yersinia pestis KIM
caucggaaacagaggguggaaac

SEQ ID NO: 4216474 - RNA, 21 nt, Yersinia pestis KIM
caucggaucacggauaucaau

SEQ ID NO: 4216475 - RNA, 16 nt, Yersinia pestis KIM
caucggauugcaacaa

SEQ ID NO: 4216476 - RNA, 15 nt, Yersinia pestis KIM
caucggcaaaaacag

SEQ ID NO: 4216477 - RNA, 17 nt, Yersinia pestis KIM
caucggccugcgcugcu

SEQ ID NO: 4216478 - RNA, 22 nt, Yersinia pestis KIM
caucggcgaggcguuggcuucu

SEQ ID NO: 4216479 - RNA, 15 nt, Yersinia pestis KIM
caucggcguucggua

SEQ ID NO: 4216480 - RNA, 14 nt, Yersinia pestis KIM
caucgggaacagga

SEQ ID NO: 4216481 - RNA, 18 nt, Yersinia pestis KIM
caucgggcauucacugcu

SEQ ID NO: 4216482 - RNA, 16 nt, Yersinia pestis KIM
caucgggccacugagc

SEQ ID NO: 4216483 - RNA, 17 nt, Yersinia pestis KIM
caucgucagaaccugca

SEQ ID NO: 4216484 - RNA, 15 nt, Yersinia pestis KIM
caucguccuguaagg

SEQ ID NO: 4216485 - RNA, 22 nt, Yersinia pestis KIM
caucgugcuccgcuuccaucac

SEQ ID NO: 4216486 - RNA, 23 nt, Yersinia pestis KIM
caucguggucaccgccaaaugaa

SEQ ID NO: 4216487 - RNA, 22 nt, Yersinia pestis KIM
caucguugcggguuaacucuuc

SEQ ID NO: 4216488 - RNA, 20 nt, Yersinia pestis KIM
caucuaacucauucauaauu

SEQ ID NO: 4216489 - RNA, 17 nt, Yersinia pestis KIM
caucuacaacaucaucg

SEQ ID NO: 4216490 - RNA, 14 nt, Yersinia pestis KIM
caucuagcagugau

SEQ ID NO: 4216491 - RNA, 18 nt, Yersinia pestis KIM
caucuagcagugauuuca

SEQ ID NO: 4216492 - RNA, 21 nt, Yersinia pestis KIM
caucuagcucaagggcacagu

SEQ ID NO: 4216493 - RNA, 16 nt, Yersinia pestis KIM
caucuaugcuauccag

SEQ ID NO: 4216494 - RNA, 18 nt, Yersinia pestis KIM
caucuaugggcuucgcca

SEQ ID NO: 4216495 - RNA, 19 nt, Yersinia pestis KIM
caucuccgccaacccuuuu

SEQ ID NO: 4216496 - RNA, 18 nt, Yersinia pestis KIM
caucucggcguaaacaau

SEQ ID NO: 4216497 - RNA, 12 nt, Yersinia pestis KIM
caucucggcuuu

SEQ ID NO: 4216498 - RNA, 13 nt, Yersinia pestis KIM
caucucugcauca

SEQ ID NO: 4216499 - RNA, 15 nt, Yersinia pestis KIM
caucugaaagcuuca

SEQ ID NO: 4216500 - RNA, 21 nt, Yersinia pestis KIM
caucugcuuuacugcuuuucu

SEQ ID NO: 4216501 - RNA, 14 nt, Yersinia pestis KIM
caucugucuaagug

SEQ ID NO: 4216502 - RNA, 16 nt, Yersinia pestis KIM
caucuuaccggccucu

SEQ ID NO: 4216503 - RNA, 13 nt, Yersinia pestis KIM
caucuuauuauua

SEQ ID NO: 4216504 - RNA, 18 nt, Yersinia pestis KIM
caucuuccaaaggaaggg

SEQ ID NO: 4216505 - RNA, 15 nt, Yersinia pestis KIM
caucuuccgucaguu

SEQ ID NO: 4216506 - RNA, 18 nt, Yersinia pestis KIM
caucuucgcuuucaucuu

SEQ ID NO: 4216507 - RNA, 19 nt, Yersinia pestis KIM
caucuucuucaucccaauc

SEQ ID NO: 4216508 - RNA, 15 nt, Yersinia pestis KIM
caucuucuucuuuaa

SEQ ID NO: 4216509 - RNA, 18 nt, Yersinia pestis KIM
cauuaauuaaucagacac

SEQ ID NO: 4216510 - RNA, 17 nt, Yersinia pestis KIM
cauuaauugguuuuaau

SEQ ID NO: 4216511 - RNA, 21 nt, Yersinia pestis KIM
cauuaauugguuuuaauaacc

SEQ ID NO: 4216512 - RNA, 19 nt, Yersinia pestis KIM
cauuaauuuaucugcuaau

SEQ ID NO: 4216513 - RNA, 20 nt, Yersinia pestis KIM
cauuacaagugccaaaugga

SEQ ID NO: 4216514 - RNA, 23 nt, Yersinia pestis KIM
cauuacaggccccaauccaccac

SEQ ID NO: 4216515 - RNA, 18 nt, Yersinia pestis KIM
cauuaccaaggaaaccac

SEQ ID NO: 4216516 - RNA, 20 nt, Yersinia pestis KIM
cauuaccgcgccgaaugaac

SEQ ID NO: 4216517 - RNA, 17 nt, Yersinia pestis KIM
cauuaccuuuaaaacug

SEQ ID NO: 4216518 - RNA, 21 nt, Yersinia pestis KIM
cauuacggcgcagggcgauau

SEQ ID NO: 4216519 - RNA, 22 nt, Yersinia pestis KIM
cauuacguaauaguaaaacagg

SEQ ID NO: 4216520 - RNA, 16 nt, Yersinia pestis KIM
cauuacguuaaacgca

SEQ ID NO: 4216521 - RNA, 22 nt, Yersinia pestis KIM
cauuacugcguucuucuugugg

SEQ ID NO: 4216522 - RNA, 17 nt, Yersinia pestis KIM
cauuacuuugaauagca

SEQ ID NO: 4216523 - RNA, 16 nt, Yersinia pestis KIM
cauuagcccaacggcu

SEQ ID NO: 4216524 - RNA, 20 nt, Yersinia pestis KIM
cauuagugaaucaucaauac

SEQ ID NO: 4216525 - RNA, 18 nt, Yersinia pestis KIM
cauuauaaggaauauacu

SEQ ID NO: 4216526 - RNA, 22 nt, Yersinia pestis KIM
cauuauaaggaauauacuuuac

SEQ ID NO: 4216527 - RNA, 14 nt, Yersinia pestis KIM
cauuauauagauuu

SEQ ID NO: 4216528 - RNA, 14 nt, Yersinia pestis KIM
cauuauauuauuua

SEQ ID NO: 4216529 - RNA, 15 nt, Yersinia pestis KIM
cauuauauuauuuau

SEQ ID NO: 4216530 - RNA, 14 nt, Yersinia pestis KIM
cauuauccguuugc

SEQ ID NO: 4216531 - RNA, 15 nt, Yersinia pestis KIM
cauuauccguuugca

SEQ ID NO: 4216532 - RNA, 18 nt, Yersinia pestis KIM
cauuauccguuugcaaca

SEQ ID NO: 4216533 - RNA, 20 nt, Yersinia pestis KIM
cauuauccguuugcaacagu

SEQ ID NO: 4216534 - RNA, 22 nt, Yersinia pestis KIM
cauuaucucgccuuuaaacgca

SEQ ID NO: 4216535 - RNA, 23 nt, Yersinia pestis KIM
cauuaucuuccauagauacacuc

SEQ ID NO: 4216536 - RNA, 14 nt, Yersinia pestis KIM
cauuauuaaacuga

SEQ ID NO: 4216537 - RNA, 17 nt, Yersinia pestis KIM
cauuauuauguauuuuu

SEQ ID NO: 4216538 - RNA, 21 nt, Yersinia pestis KIM
cauuauuauguauuuuuaugc

SEQ ID NO: 4216539 - RNA, 13 nt, Yersinia pestis KIM
cauucaaacacuu

SEQ ID NO: 4216540 - RNA, 13 nt, Yersinia pestis KIM
cauucaagccuaa

SEQ ID NO: 4216541 - RNA, 14 nt, Yersinia pestis KIM
cauucaaguaaaug

SEQ ID NO: 4216542 - RNA, 17 nt, Yersinia pestis KIM
cauucaauggaauguuc

SEQ ID NO: 4216543 - RNA, 22 nt, Yersinia pestis KIM
cauucaauggaauguucauuca

SEQ ID NO: 4216544 - RNA, 13 nt, Yersinia pestis KIM
cauucaauguaaa

SEQ ID NO: 4216545 - RNA, 14 nt, Yersinia pestis KIM
cauucaauguaaaa

SEQ ID NO: 4216546 - RNA, 23 nt, Yersinia pestis KIM
cauucaccugcccgucacucaga

SEQ ID NO: 4216547 - RNA, 14 nt, Yersinia pestis KIM
cauucacugcuaac

SEQ ID NO: 4216548 - RNA, 14 nt, Yersinia pestis KIM
cauucagcaauauu

SEQ ID NO: 4216549 - RNA, 15 nt, Yersinia pestis KIM
cauucaguacauaaa

SEQ ID NO: 4216550 - RNA, 18 nt, Yersinia pestis KIM
cauucauaauugaagagu

SEQ ID NO: 4216551 - RNA, 15 nt, Yersinia pestis KIM
cauucaucaccuuau

SEQ ID NO: 4216552 - RNA, 23 nt, Yersinia pestis KIM
cauucaucccgguugcgauacag

SEQ ID NO: 4216553 - RNA, 22 nt, Yersinia pestis KIM
cauucaugaggcuucuuaauuc

SEQ ID NO: 4216554 - RNA, 17 nt, Yersinia pestis KIM
cauucauuuuaaaaaaa

SEQ ID NO: 4216555 - RNA, 18 nt, Yersinia pestis KIM
cauucauuuuaaaaaaau

SEQ ID NO: 4216556 - RNA, 20 nt, Yersinia pestis KIM
cauuccaauuagauuugagc

SEQ ID NO: 4216557 - RNA, 20 nt, Yersinia pestis KIM
cauuccccaucgccaauugg

SEQ ID NO: 4216558 - RNA, 17 nt, Yersinia pestis KIM
cauucccgagauaacca

SEQ ID NO: 4216559 - RNA, 15 nt, Yersinia pestis KIM
cauucccugcgguua

SEQ ID NO: 4216560 - RNA, 22 nt, Yersinia pestis KIM
cauucccugcgguuauuugcua

SEQ ID NO: 4216561 - RNA, 15 nt, Yersinia pestis KIM
cauuccguuuaaacu

SEQ ID NO: 4216562 - RNA, 17 nt, Yersinia pestis KIM
cauuccguuuaaacucc

SEQ ID NO: 4216563 - RNA, 15 nt, Yersinia pestis KIM
cauuccugguuuuac

SEQ ID NO: 4216564 - RNA, 23 nt, Yersinia pestis KIM
cauucgagcuaccggcauuggcu

SEQ ID NO: 4216565 - RNA, 23 nt, Yersinia pestis KIM
cauucgcacaguuuucuuaaaau

SEQ ID NO: 4216566 - RNA, 19 nt, Yersinia pestis KIM
cauucgcacgggcuuuaau

SEQ ID NO: 4216567 - RNA, 14 nt, Yersinia pestis KIM
cauucgccugauaa

SEQ ID NO: 4216568 - RNA, 22 nt, Yersinia pestis KIM
cauucgcgguuacaccaauaau

SEQ ID NO: 4216569 - RNA, 22 nt, Yersinia pestis KIM
cauucucuacucgcucaccacu

SEQ ID NO: 4216570 - RNA, 17 nt, Yersinia pestis KIM
cauucugaaucgcugcc

SEQ ID NO: 4216571 - RNA, 15 nt, Yersinia pestis KIM
cauucugaaugguuu

SEQ ID NO: 4216572 - RNA, 16 nt, Yersinia pestis KIM
cauucugauagugauu

SEQ ID NO: 4216573 - RNA, 18 nt, Yersinia pestis KIM
cauucugcagauguauua

SEQ ID NO: 4216574 - RNA, 21 nt, Yersinia pestis KIM
cauucuggggcgguuuuccuc

SEQ ID NO: 4216575 - RNA, 11 nt, Yersinia pestis KIM
cauucuuaucg

SEQ ID NO: 4216576 - RNA, 12 nt, Yersinia pestis KIM
cauucuugauuu

SEQ ID NO: 4216577 - RNA, 22 nt, Yersinia pestis KIM
cauugacgauaucaauaaagaa

SEQ ID NO: 4216578 - RNA, 16 nt, Yersinia pestis KIM
cauugacuagccauuu

SEQ ID NO: 4216579 - RNA, 14 nt, Yersinia pestis KIM
cauugagacgagua

SEQ ID NO: 4216580 - RNA, 22 nt, Yersinia pestis KIM
cauugagcauaucaaucagcau

SEQ ID NO: 4216581 - RNA, 23 nt, Yersinia pestis KIM
cauugaggguugucagcagucug

SEQ ID NO: 4216582 - RNA, 23 nt, Yersinia pestis KIM
cauugagucacggauggaucccc

SEQ ID NO: 4216583 - RNA, 23 nt, Yersinia pestis KIM
cauugaguucugaucauuauuau

SEQ ID NO: 4216584 - RNA, 15 nt, Yersinia pestis KIM
cauugaguuucaaug

SEQ ID NO: 4216585 - RNA, 23 nt, Yersinia pestis KIM
cauugauuggcuccuauagcuca

SEQ ID NO: 4216586 - RNA, 21 nt, Yersinia pestis KIM
cauugccacgacgcagcucca

SEQ ID NO: 4216587 - RNA, 16 nt, Yersinia pestis KIM
cauugcgcuaacagcg

SEQ ID NO: 4216588 - RNA, 22 nt, Yersinia pestis KIM
cauugcgguucaggauccgccu

SEQ ID NO: 4216589 - RNA, 19 nt, Yersinia pestis KIM
cauugcgugcaauaaagcg

SEQ ID NO: 4216590 - RNA, 19 nt, Yersinia pestis KIM
cauugcucaaacucagcau

SEQ ID NO: 4216591 - RNA, 16 nt, Yersinia pestis KIM
cauugcugcuguuauu

SEQ ID NO: 4216592 - RNA, 20 nt, Yersinia pestis KIM
cauugcugcuguuauuacug

SEQ ID NO: 4216593 - RNA, 20 nt, Yersinia pestis KIM
cauugcuguuguuauuacug

SEQ ID NO: 4216594 - RNA, 20 nt, Yersinia pestis KIM
cauugcuuugcgauacacca

SEQ ID NO: 4216595 - RNA, 17 nt, Yersinia pestis KIM
cauuggaaaaaaucuuc

SEQ ID NO: 4216596 - RNA, 19 nt, Yersinia pestis KIM
cauuggagauccguuuuuu

SEQ ID NO: 4216597 - RNA, 15 nt, Yersinia pestis KIM
cauuggcaaaggcca

SEQ ID NO: 4216598 - RNA, 18 nt, Yersinia pestis KIM
cauuggcguuacagcaag

SEQ ID NO: 4216599 - RNA, 15 nt, Yersinia pestis KIM
cauuggcuaccccaa

SEQ ID NO: 4216600 - RNA, 20 nt, Yersinia pestis KIM
cauuggcuucaacuuuuuuc

SEQ ID NO: 4216601 - RNA, 13 nt, Yersinia pestis KIM
cauuggcuuuuug

SEQ ID NO: 4216602 - RNA, 19 nt, Yersinia pestis KIM
cauugguauaccguacccg

SEQ ID NO: 4216603 - RNA, 19 nt, Yersinia pestis KIM
cauugguuacccuaagaau

SEQ ID NO: 4216604 - RNA, 16 nt, Yersinia pestis KIM
cauuguagauggccau

SEQ ID NO: 4216605 - RNA, 23 nt, Yersinia pestis KIM
cauugucagguuaauaccugcac

SEQ ID NO: 4216606 - RNA, 21 nt, Yersinia pestis KIM
cauugucauggccugaugcac

SEQ ID NO: 4216607 - RNA, 20 nt, Yersinia pestis KIM
cauuguccugcaauccuccc

SEQ ID NO: 4216608 - RNA, 21 nt, Yersinia pestis KIM
cauugugcuuuuuggcaaacu

SEQ ID NO: 4216609 - RNA, 13 nt, Yersinia pestis KIM
cauuguucuuacu

SEQ ID NO: 4216610 - RNA, 14 nt, Yersinia pestis KIM
cauuuaaaauacuc

SEQ ID NO: 4216611 - RNA, 13 nt, Yersinia pestis KIM
cauuuaaacacuc

SEQ ID NO: 4216612 - RNA, 14 nt, Yersinia pestis KIM
cauuuaaauacaga

SEQ ID NO: 4216613 - RNA, 13 nt, Yersinia pestis KIM
cauuuaauucagu

SEQ ID NO: 4216614 - RNA, 14 nt, Yersinia pestis KIM
cauuuaccaucagg

SEQ ID NO: 4216615 - RNA, 16 nt, Yersinia pestis KIM
cauuuacuuauaaaca

SEQ ID NO: 4216616 - RNA, 16 nt, Yersinia pestis KIM
cauuuagcacuguuca

SEQ ID NO: 4216617 - RNA, 19 nt, Yersinia pestis KIM
cauuuaucgccaagccagu

SEQ ID NO: 4216618 - RNA, 18 nt, Yersinia pestis KIM
cauuuaucuaaaacugcc

SEQ ID NO: 4216619 - RNA, 19 nt, Yersinia pestis KIM
cauuuaucuaaaacugccu

SEQ ID NO: 4216620 - RNA, 15 nt, Yersinia pestis KIM
cauuuauuacauuua

SEQ ID NO: 4216621 - RNA, 22 nt, Yersinia pestis KIM
cauuuauugcggcuuagccacu

SEQ ID NO: 4216622 - RNA, 18 nt, Yersinia pestis KIM
cauuucaaccucaauuua

SEQ ID NO: 4216623 - RNA, 17 nt, Yersinia pestis KIM
ccaagaacgccaaauga

SEQ ID NO: 4216624 - RNA, 19 nt, Yersinia pestis KIM
ccaagaagauaacuuuuua

SEQ ID NO: 4216625 - RNA, 17 nt, Yersinia pestis KIM
ccaagauagcuguguga

SEQ ID NO: 4216626 - RNA, 22 nt, Yersinia pestis KIM
ccaagcauauaaccauuuuaau

SEQ ID NO: 4216627 - RNA, 15 nt, Yersinia pestis KIM
ccaagcccaguaaag

SEQ ID NO: 4216628 - RNA, 17 nt, Yersinia pestis KIM
ccaagcccgcugcaacu

SEQ ID NO: 4216629 - RNA, 18 nt, Yersinia pestis KIM
ccaagcggcaggggcgcg

SEQ ID NO: 4216630 - RNA, 13 nt, Yersinia pestis KIM
ccaaggauggcgc

SEQ ID NO: 4216631 - RNA, 17 nt, Yersinia pestis KIM
ccaaggcaugauaggca

SEQ ID NO: 4216632 - RNA, 20 nt, Yersinia pestis KIM
ccaaggcggaauagaggaag

SEQ ID NO: 4216633 - RNA, 21 nt, Yersinia pestis KIM
ccaagguugcauugccuccca

SEQ ID NO: 4216634 - RNA, 14 nt, Yersinia pestis KIM
ccaaguaaaaaaaa

SEQ ID NO: 4216635 - RNA, 22 nt, Yersinia pestis KIM
ccaaguaaaaaaaaccuggcuc

SEQ ID NO: 4216636 - RNA, 12 nt, Yersinia pestis KIM
ccaagucucuag

SEQ ID NO: 4216637 - RNA, 23 nt, Yersinia pestis KIM
ccaaguguccgcgccauaaaaga

SEQ ID NO: 4216638 - RNA, 17 nt, Yersinia pestis KIM
ccaauaaaaugcaccgc

SEQ ID NO: 4216639 - RNA, 21 nt, Yersinia pestis KIM
ccaauaaagcucugacaaaau

SEQ ID NO: 4216640 - RNA, 14 nt, Yersinia pestis KIM
ccaauaauaaaaaa

SEQ ID NO: 4216641 - RNA, 18 nt, Yersinia pestis KIM
ccaauaauaaaaaaaaau

SEQ ID NO: 4216642 - RNA, 23 nt, Yersinia pestis KIM
ccaauaauaaaaaaaaauaaaau

SEQ ID NO: 4216643 - RNA, 14 nt, Yersinia pestis KIM
ccaauaaugcuuug

SEQ ID NO: 4216644 - RNA, 12 nt, Yersinia pestis KIM
ccaauaauucac

SEQ ID NO: 4216645 - RNA, 16 nt, Yersinia pestis KIM
ccaauacaaacagggc

SEQ ID NO: 4216646 - RNA, 23 nt, Yersinia pestis KIM
ccaauacaaacagggcagccaau

SEQ ID NO: 4216647 - RNA, 19 nt, Yersinia pestis KIM
ccaauagaaaaacacuggc

SEQ ID NO: 4216648 - RNA, 17 nt, Yersinia pestis KIM
ccaauagaaaagcgccu

SEQ ID NO: 4216649 - RNA, 23 nt, Yersinia pestis KIM
ccaauagaaaagcgccugauggc

SEQ ID NO: 4216650 - RNA, 13 nt, Yersinia pestis KIM
ccaauagaaaggc

SEQ ID NO: 4216651 - RNA, 19 nt, Yersinia pestis KIM
ccaauagcccaaauaaccu

SEQ ID NO: 4216652 - RNA, 17 nt, Yersinia pestis KIM
ccaauagcgaucagcaa

SEQ ID NO: 4216653 - RNA, 17 nt, Yersinia pestis KIM
ccaauagcugugcgcgg

SEQ ID NO: 4216654 - RNA, 14 nt, Yersinia pestis KIM
ccaauauaaaagcc

SEQ ID NO: 4216655 - RNA, 16 nt, Yersinia pestis KIM
ccaauaucugccaauu

SEQ ID NO: 4216656 - RNA, 13 nt, Yersinia pestis KIM
ccaauauuaaaau

SEQ ID NO: 4216657 - RNA, 17 nt, Yersinia pestis KIM
ccaauauugauccaccg

SEQ ID NO: 4216658 - RNA, 20 nt, Yersinia pestis KIM
ccaauauuggauaauaaccu

SEQ ID NO: 4216659 - RNA, 24 nt, Yersinia pestis KIM
ccaaucaccuuggaaaacagcaac

SEQ ID NO: 4216660 - RNA, 20 nt, Yersinia pestis KIM
ccaaucagaacuauacgcgg

SEQ ID NO: 4216661 - RNA, 18 nt, Yersinia pestis KIM
ccaaucauuacaucaucu

SEQ ID NO: 4216662 - RNA, 18 nt, Yersinia pestis KIM
ccaaucauucugucauca

SEQ ID NO: 4216663 - RNA, 17 nt, Yersinia pestis KIM
ccaauccuuuggauuua

SEQ ID NO: 4216664 - RNA, 16 nt, Yersinia pestis KIM
ccaaucgauaauauua

SEQ ID NO: 4216665 - RNA, 22 nt, Yersinia pestis KIM
ccaaucgcucugcguuuuuccc

SEQ ID NO: 4216666 - RNA, 20 nt, Yersinia pestis KIM
ccaaucucaaagcaaccaca

SEQ ID NO: 4216667 - RNA, 15 nt, Yersinia pestis KIM
ccaaucuccaaugac

SEQ ID NO: 4216668 - RNA, 21 nt, Yersinia pestis KIM
ccaaugaugacuugauuaaca

SEQ ID NO: 4216669 - RNA, 12 nt, Yersinia pestis KIM
ccaaugauuaac

SEQ ID NO: 4216670 - RNA, 16 nt, Yersinia pestis KIM
ccaaugcacguaaaga

SEQ ID NO: 4216671 - RNA, 18 nt, Yersinia pestis KIM
ccaaugccaagaauaauu

SEQ ID NO: 4216672 - RNA, 17 nt, Yersinia pestis KIM
ccaauggccaccauuaa

SEQ ID NO: 4216673 - RNA, 14 nt, Yersinia pestis KIM
ccaauggcucaccu

SEQ ID NO: 4216674 - RNA, 18 nt, Yersinia pestis KIM
ccaauuacgcugcccuga

SEQ ID NO: 4216675 - RNA, 19 nt, Yersinia pestis KIM
ccaauucaaggccagcacg

SEQ ID NO: 4216676 - RNA, 20 nt, Yersinia pestis KIM
ccaauucaaggccagcacgu

SEQ ID NO: 4216677 - RNA, 13 nt, Yersinia pestis KIM
ccaauucaucagc

SEQ ID NO: 4216678 - RNA, 16 nt, Yersinia pestis KIM
ccaauugacuagcagg

SEQ ID NO: 4216679 - RNA, 16 nt, Yersinia pestis KIM
ccaauugaguaacuga

SEQ ID NO: 4216680 - RNA, 19 nt, Yersinia pestis KIM
ccaauugaguaacugauua

SEQ ID NO: 4216681 - RNA, 22 nt, Yersinia pestis KIM
ccaauuggugcuuuauguauuc

SEQ ID NO: 4216682 - RNA, 16 nt, Yersinia pestis KIM
ccaauuuuucuguauc

SEQ ID NO: 4216683 - RNA, 14 nt, Yersinia pestis KIM
ccacaauaaaauaa

SEQ ID NO: 4216684 - RNA, 11 nt, Yersinia pestis KIM
ccacaauccgg

SEQ ID NO: 4216685 - RNA, 21 nt, Yersinia pestis KIM
ccacacagcauucugcuucca

SEQ ID NO: 4216686 - RNA, 17 nt, Yersinia pestis KIM
ccacaccacguuuaauu

SEQ ID NO: 4216687 - RNA, 14 nt, Yersinia pestis KIM
ccacacccucucuu

SEQ ID NO: 4216688 - RNA, 15 nt, Yersinia pestis KIM
ccacaccggcugcaa

SEQ ID NO: 4216689 - RNA, 11 nt, Yersinia pestis KIM
ccacacucaag

SEQ ID NO: 4216690 - RNA, 14 nt, Yersinia pestis KIM
ccacacuuuugcug

SEQ ID NO: 4216691 - RNA, 17 nt, Yersinia pestis KIM
ccacagucauuugaacg

SEQ ID NO: 4216692 - RNA, 17 nt, Yersinia pestis KIM
ccacauaaaauagccca

SEQ ID NO: 4216693 - RNA, 21 nt, Yersinia pestis KIM
ccacauauauagagaaaucua

SEQ ID NO: 4216694 - RNA, 11 nt, Yersinia pestis KIM
ccacaucauua

SEQ ID NO: 4216695 - RNA, 21 nt, Yersinia pestis KIM
ccacaugccacccgcaccaaa

SEQ ID NO: 4216696 - RNA, 22 nt, Yersinia pestis KIM
ccacaugguuucaaugagcaua

SEQ ID NO: 4216697 - RNA, 16 nt, Yersinia pestis KIM
ccacauuauucuaggc

SEQ ID NO: 4216698 - RNA, 21 nt, Yersinia pestis KIM
ccacauuucccuuacugucga

SEQ ID NO: 4216699 - RNA, 15 nt, Yersinia pestis KIM
ccaccaauuucaucg

SEQ ID NO: 4216700 - RNA, 16 nt, Yersinia pestis KIM
ccaccacaucauccag

SEQ ID NO: 4216701 - RNA, 17 nt, Yersinia pestis KIM
ccaccacaucauccagu

SEQ ID NO: 4216702 - RNA, 24 nt, Yersinia pestis KIM
ccaccagguuaccuauaaacuuga

SEQ ID NO: 4216703 - RNA, 17 nt, Yersinia pestis KIM
ccaccaucacuuccagc

SEQ ID NO: 4216704 - RNA, 19 nt, Yersinia pestis KIM
ccaccaucacuuccagcgc

SEQ ID NO: 4216705 - RNA, 18 nt, Yersinia pestis KIM
ccaccaugaugaaucugu

SEQ ID NO: 4216706 - RNA, 13 nt, Yersinia pestis KIM
ccaccauucgcca

SEQ ID NO: 4216707 - RNA, 15 nt, Yersinia pestis KIM
ccaccccagcauuca

SEQ ID NO: 4216708 - RNA, 19 nt, Yersinia pestis KIM
ccacccguugcauuuuucu

SEQ ID NO: 4216709 - RNA, 12 nt, Yersinia pestis KIM
ccaccgcacacu

SEQ ID NO: 4216710 - RNA, 14 nt, Yersinia pestis KIM
ccaccgcagugccc

SEQ ID NO: 4216711 - RNA, 20 nt, Yersinia pestis KIM
ccaccgucaagacaacaaac

SEQ ID NO: 4216712 - RNA, 16 nt, Yersinia pestis KIM
ccaccgucaccaaaua

SEQ ID NO: 4216713 - RNA, 23 nt, Yersinia pestis KIM
ccaccgucaccaaauauuaccgu

SEQ ID NO: 4216714 - RNA, 22 nt, Yersinia pestis KIM
ccaccguggcgcgccacuucuu

SEQ ID NO: 4216715 - RNA, 22 nt, Yersinia pestis KIM
ccaccuaauacagcaccaccga

SEQ ID NO: 4216716 - RNA, 16 nt, Yersinia pestis KIM
ccaccuaucuauuuuu

SEQ ID NO: 4216717 - RNA, 19 nt, Yersinia pestis KIM
ccaccugaaucucgcgccc

SEQ ID NO: 4216718 - RNA, 14 nt, Yersinia pestis KIM
ccaccuuaaaauaa

SEQ ID NO: 4216719 - RNA, 18 nt, Yersinia pestis KIM
ccaccuucggcugccgug

SEQ ID NO: 4216720 - RNA, 13 nt, Yersinia pestis KIM
ccaccuuuaccau

SEQ ID NO: 4216721 - RNA, 13 nt, Yersinia pestis KIM
ccacgaaggcacc

SEQ ID NO: 4216722 - RNA, 14 nt, Yersinia pestis KIM
ccacgcaucaauaa

SEQ ID NO: 4216723 - RNA, 13 nt, Yersinia pestis KIM
ccacgcauuccau

SEQ ID NO: 4216724 - RNA, 17 nt, Yersinia pestis KIM
ccacgccaacccucuuc

SEQ ID NO: 4216725 - RNA, 22 nt, Yersinia pestis KIM
ccacgccaacccucuuccgguu

SEQ ID NO: 4216726 - RNA, 19 nt, Yersinia pestis KIM
ccacgcccaacucuuuagc

SEQ ID NO: 4216727 - RNA, 12 nt, Yersinia pestis KIM
ccacgcccaauu

SEQ ID NO: 4216728 - RNA, 14 nt, Yersinia pestis KIM
ccacgccccaacgg

SEQ ID NO: 4216729 - RNA, 16 nt, Yersinia pestis KIM
ccacgcuccacacaaa

SEQ ID NO: 4216730 - RNA, 17 nt, Yersinia pestis KIM
ccacggauauccaacgg

SEQ ID NO: 4216731 - RNA, 13 nt, Yersinia pestis KIM
ccacggauuaacu

SEQ ID NO: 4216732 - RNA, 13 nt, Yersinia pestis KIM
ccacggcacccac

SEQ ID NO: 4216733 - RNA, 22 nt, Yersinia pestis KIM
ccacggcaccuucugauuuuuu

SEQ ID NO: 4216734 - RNA, 13 nt, Yersinia pestis KIM
ccacggcgcugca

SEQ ID NO: 4216735 - RNA, 17 nt, Yersinia pestis KIM
ccacggcgcugcagcga

SEQ ID NO: 4216736 - RNA, 15 nt, Yersinia pestis KIM
ccacgguaucaauca

SEQ ID NO: 4216737 - RNA, 18 nt, Yersinia pestis KIM
ccacgucuaauugcugcc

SEQ ID NO: 4216738 - RNA, 18 nt, Yersinia pestis KIM
ccagggcguuuaccaucc

SEQ ID NO: 4216739 - RNA, 22 nt, Yersinia pestis KIM
ccaggguuucugcgagcguuua

SEQ ID NO: 4216740 - RNA, 17 nt, Yersinia pestis KIM
ccaggucaaucaauucu

SEQ ID NO: 4216741 - RNA, 12 nt, Yersinia pestis KIM
ccagguuacugc

SEQ ID NO: 4216742 - RNA, 17 nt, Yersinia pestis KIM
ccagguuuuuuuuacuu

SEQ ID NO: 4216743 - RNA, 13 nt, Yersinia pestis KIM
ccaguaaaaaaau

SEQ ID NO: 4216744 - RNA, 14 nt, Yersinia pestis KIM
ccaguaaaaaaaua

SEQ ID NO: 4216745 - RNA, 17 nt, Yersinia pestis KIM
ccaguaaaagaauaaau

SEQ ID NO: 4216746 - RNA, 21 nt, Yersinia pestis KIM
ccaguaagccugaugccuuga

SEQ ID NO: 4216747 - RNA, 17 nt, Yersinia pestis KIM
ccaguaagcuguugacc

SEQ ID NO: 4216748 - RNA, 13 nt, Yersinia pestis KIM
ccaguaagugauu

SEQ ID NO: 4216749 - RNA, 22 nt, Yersinia pestis KIM
ccaguaauaccuuaauggcuuu

SEQ ID NO: 4216750 - RNA, 15 nt, Yersinia pestis KIM
ccaguagcccagccg

SEQ ID NO: 4216751 - RNA, 13 nt, Yersinia pestis KIM
ccagucauucacc

SEQ ID NO: 4216752 - RNA, 18 nt, Yersinia pestis KIM
ccagucuaaacgccgcgu

SEQ ID NO: 4216753 - RNA, 17 nt, Yersinia pestis KIM
ccagucucuuugccaag

SEQ ID NO: 4216754 - RNA, 12 nt, Yersinia pestis KIM
ccagugccaauc

SEQ ID NO: 4216755 - RNA, 19 nt, Yersinia pestis KIM
ccagugccaauccccacca

SEQ ID NO: 4216756 - RNA, 15 nt, Yersinia pestis KIM
ccagugccaauugag

SEQ ID NO: 4216757 - RNA, 19 nt, Yersinia pestis KIM
ccagugccgcggcggccag

SEQ ID NO: 4216758 - RNA, 20 nt, Yersinia pestis KIM
ccagugcuuuauccaauggc

SEQ ID NO: 4216759 - RNA, 16 nt, Yersinia pestis KIM
ccaguggcaucaauau

SEQ ID NO: 4216760 - RNA, 19 nt, Yersinia pestis KIM
ccaguggcucgacggccaa

SEQ ID NO: 4216761 - RNA, 14 nt, Yersinia pestis KIM
ccaguggugcuccc

SEQ ID NO: 4216762 - RNA, 21 nt, Yersinia pestis KIM
ccaguggugcucccgcacucu

SEQ ID NO: 4216763 - RNA, 15 nt, Yersinia pestis KIM
ccaguguucauauuc

SEQ ID NO: 4216764 - RNA, 17 nt, Yersinia pestis KIM
ccaguuaaagaauacag

SEQ ID NO: 4216765 - RNA, 22 nt, Yersinia pestis KIM
ccaguuaaagaauacagccagc

SEQ ID NO: 4216766 - RNA, 23 nt, Yersinia pestis KIM
ccaguuaauaucaaugagucuca

SEQ ID NO: 4216767 - RNA, 13 nt, Yersinia pestis KIM
ccaguuauuauuu

SEQ ID NO: 4216768 - RNA, 23 nt, Yersinia pestis KIM
ccaguucaagauaaaguucuucg

SEQ ID NO: 4216769 - RNA, 16 nt, Yersinia pestis KIM
ccaguucaguccagcc

SEQ ID NO: 4216770 - RNA, 17 nt, Yersinia pestis KIM
ccaguucaguccagcca

SEQ ID NO: 4216771 - RNA, 23 nt, Yersinia pestis KIM
ccaguugccacucauauucaaaa

SEQ ID NO: 4216772 - RNA, 14 nt, Yersinia pestis KIM
ccaguugucuauuu

SEQ ID NO: 4216773 - RNA, 17 nt, Yersinia pestis KIM
ccaguuugcucaucagu

SEQ ID NO: 4216774 - RNA, 22 nt, Yersinia pestis KIM
ccaguuugcucaucaguugguc

SEQ ID NO: 4216775 - RNA, 20 nt, Yersinia pestis KIM
ccaguuuuccagagcccggg

SEQ ID NO: 4216776 - RNA, 12 nt, Yersinia pestis KIM
ccauaaaaggau

SEQ ID NO: 4216777 - RNA, 19 nt, Yersinia pestis KIM
ccauaaaaggauggcccaa

SEQ ID NO: 4216778 - RNA, 21 nt, Yersinia pestis KIM
ccauaaaauaaauaauuugua

SEQ ID NO: 4216779 - RNA, 18 nt, Yersinia pestis KIM
ccauaaacggaacucauc

SEQ ID NO: 4216780 - RNA, 16 nt, Yersinia pestis KIM
ccauaaaguuuuuccu

SEQ ID NO: 4216781 - RNA, 11 nt, Yersinia pestis KIM
ccauaaauaaa

SEQ ID NO: 4216782 - RNA, 14 nt, Yersinia pestis KIM
ccauaaccauugaa

SEQ ID NO: 4216783 - RNA, 12 nt, Yersinia pestis KIM
ccauaaccgaug

SEQ ID NO: 4216784 - RNA, 16 nt, Yersinia pestis KIM
ccauaacgcugcucaa

SEQ ID NO: 4216785 - RNA, 23 nt, Yersinia pestis KIM
ccauaagcccccguaucauggaa

SEQ ID NO: 4216786 - RNA, 20 nt, Yersinia pestis KIM
ccauaagcgacgacauuaau

SEQ ID NO: 4216787 - RNA, 16 nt, Yersinia pestis KIM
ccauaauccagaagcc

SEQ ID NO: 4216788 - RNA, 23 nt, Yersinia pestis KIM
ccauaaucgcaccggagcaaggg

SEQ ID NO: 4216789 - RNA, 21 nt, Yersinia pestis KIM
ccauaaugccguuauagaucu

SEQ ID NO: 4216790 - RNA, 13 nt, Yersinia pestis KIM
ccauacagaacug

SEQ ID NO: 4216791 - RNA, 17 nt, Yersinia pestis KIM
ccauaccaggccacggc

SEQ ID NO: 4216792 - RNA, 19 nt, Yersinia pestis KIM
ccauacgaauuuuucccug

SEQ ID NO: 4216793 - RNA, 13 nt, Yersinia pestis KIM
ccauacuguugcu

SEQ ID NO: 4216794 - RNA, 14 nt, Yersinia pestis KIM
ccauagaugggcca

SEQ ID NO: 4216795 - RNA, 18 nt, Yersinia pestis KIM
ccauagccgaucaccgca

SEQ ID NO: 4216796 - RNA, 23 nt, Yersinia pestis KIM
ccauagugauuauuuaaacaaug

SEQ ID NO: 4216797 - RNA, 16 nt, Yersinia pestis KIM
ccauauacgcauaaug

SEQ ID NO: 4216798 - RNA, 15 nt, Yersinia pestis KIM
ccauauccaguugcc

SEQ ID NO: 4216799 - RNA, 16 nt, Yersinia pestis KIM
ccauauccucaagacc

SEQ ID NO: 4216800 - RNA, 13 nt, Yersinia pestis KIM
ccauauccucgag

SEQ ID NO: 4216801 - RNA, 18 nt, Yersinia pestis KIM
ccauaucuuuaaaaaccc

SEQ ID NO: 4216802 - RNA, 14 nt, Yersinia pestis KIM
ccauaugcauggca

SEQ ID NO: 4216803 - RNA, 13 nt, Yersinia pestis KIM
ccauaugccauga

SEQ ID NO: 4216804 - RNA, 18 nt, Yersinia pestis KIM
ccauauucccagccaacu

SEQ ID NO: 4216805 - RNA, 12 nt, Yersinia pestis KIM
ccauauuccccc

SEQ ID NO: 4216806 - RNA, 20 nt, Yersinia pestis KIM
ccauauucgcggccugcugu

SEQ ID NO: 4216807 - RNA, 13 nt, Yersinia pestis KIM
ccauauuuuucaa

SEQ ID NO: 4216808 - RNA, 16 nt, Yersinia pestis KIM
ccaucaaacauagaca

SEQ ID NO: 4216809 - RNA, 13 nt, Yersinia pestis KIM
ccaucaacauggg

SEQ ID NO: 4216810 - RNA, 13 nt, Yersinia pestis KIM
ccaucaauaaacu

SEQ ID NO: 4216811 - RNA, 21 nt, Yersinia pestis KIM
ccaucaauaccaauaaaaccu

SEQ ID NO: 4216812 - RNA, 22 nt, Yersinia pestis KIM
ccaucacaaaaccuuuaaucag

SEQ ID NO: 4216813 - RNA, 15 nt, Yersinia pestis KIM
ccaucaccacaauau

SEQ ID NO: 4216814 - RNA, 20 nt, Yersinia pestis KIM
ccaucaccauugaccagcgu

SEQ ID NO: 4216815 - RNA, 21 nt, Yersinia pestis KIM
ccaucaccgggugaaaauggc

SEQ ID NO: 4216816 - RNA, 16 nt, Yersinia pestis KIM
ccaucacgcagcagac

SEQ ID NO: 4216817 - RNA, 13 nt, Yersinia pestis KIM
ccaucagagucca

SEQ ID NO: 4216818 - RNA, 20 nt, Yersinia pestis KIM
ccaucagaguccaauagcug

SEQ ID NO: 4216819 - RNA, 11 nt, Yersinia pestis KIM
ccaucaggaag

SEQ ID NO: 4216820 - RNA, 23 nt, Yersinia pestis KIM
ccaucaggcgcuuuucuauugga

SEQ ID NO: 4216821 - RNA, 15 nt, Yersinia pestis KIM
ccaucaguucacuga

SEQ ID NO: 4216822 - RNA, 24 nt, Yersinia pestis KIM
ccaucauuacccucauguaagcca

SEQ ID NO: 4216823 - RNA, 20 nt, Yersinia pestis KIM
ccaucccccauggggccacc

SEQ ID NO: 4216824 - RNA, 16 nt, Yersinia pestis KIM
ccauccgcaccugcac

SEQ ID NO: 4216825 - RNA, 17 nt, Yersinia pestis KIM
ccauccuagcguuucua

SEQ ID NO: 4216826 - RNA, 19 nt, Yersinia pestis KIM
ccauccuagcguuucuaca

SEQ ID NO: 4216827 - RNA, 15 nt, Yersinia pestis KIM
ccauccuuggcgcgg

SEQ ID NO: 4216828 - RNA, 23 nt, Yersinia pestis KIM
ccauccuuggcgcggacgcuuua

SEQ ID NO: 4216829 - RNA, 13 nt, Yersinia pestis KIM
ccaucgcaccaaa

SEQ ID NO: 4216830 - RNA, 17 nt, Yersinia pestis KIM
ccaucgcuaaucauauc

SEQ ID NO: 4216831 - RNA, 15 nt, Yersinia pestis KIM
ccaucguauauccac

SEQ ID NO: 4216832 - RNA, 20 nt, Yersinia pestis KIM
ccaucguauauccaccgauu

SEQ ID NO: 4216833 - RNA, 15 nt, Yersinia pestis KIM
ccaucgucucugcau

SEQ ID NO: 4216834 - RNA, 18 nt, Yersinia pestis KIM
ccaucucauguuaaauga

SEQ ID NO: 4216835 - RNA, 21 nt, Yersinia pestis KIM
ccaucugaugcagguuuugga

SEQ ID NO: 4216836 - RNA, 22 nt, Yersinia pestis KIM
ccaucuugggccgacucugcau

SEQ ID NO: 4216837 - RNA, 22 nt, Yersinia pestis KIM
ccaugacaaaauacgguucacu

SEQ ID NO: 4216838 - RNA, 13 nt, Yersinia pestis KIM
ccaugacuuugga

SEQ ID NO: 4216839 - RNA, 18 nt, Yersinia pestis KIM
ccaugagaaccaguucug

SEQ ID NO: 4216840 - RNA, 21 nt, Yersinia pestis KIM
ccaugagaauacuucaggcca

SEQ ID NO: 4216841 - RNA, 18 nt, Yersinia pestis KIM
ccaugaugacaaugcguu

SEQ ID NO: 4216842 - RNA, 15 nt, Yersinia pestis KIM
ccaugcacuccacua

SEQ ID NO: 4216843 - RNA, 14 nt, Yersinia pestis KIM
ccaugccgguugau

SEQ ID NO: 4216844 - RNA, 19 nt, Yersinia pestis KIM
ccaugcugcccgcacacug

SEQ ID NO: 4216845 - RNA, 18 nt, Yersinia pestis KIM
ccauggcggcucgccuga

SEQ ID NO: 4216846 - RNA, 15 nt, Yersinia pestis KIM
ccaugggaaaucaaa

SEQ ID NO: 4216847 - RNA, 15 nt, Yersinia pestis KIM
ccaugguaaccaccu

SEQ ID NO: 4216848 - RNA, 15 nt, Yersinia pestis KIM
ccauggugacuuacg

SEQ ID NO: 4216849 - RNA, 21 nt, Yersinia pestis KIM
ccaugguuacgccagcagcau

SEQ ID NO: 4216850 - RNA, 20 nt, Yersinia pestis KIM
ccauguaggcucgagccgcg

SEQ ID NO: 4216851 - RNA, 20 nt, Yersinia pestis KIM
ccaugucacuguucuugaug

SEQ ID NO: 4216852 - RNA, 24 nt, Yersinia pestis KIM
ccaugucacuguucuugaugguca

SEQ ID NO: 4216853 - RNA, 12 nt, Yersinia pestis KIM
ccccaccucuua

SEQ ID NO: 4216854 - RNA, 14 nt, Yersinia pestis KIM
ccccacggccagag

SEQ ID NO: 4216855 - RNA, 18 nt, Yersinia pestis KIM
ccccacuauucuccaaca

SEQ ID NO: 4216856 - RNA, 14 nt, Yersinia pestis KIM
ccccacuucacgca

SEQ ID NO: 4216857 - RNA, 22 nt, Yersinia pestis KIM
ccccacuuguaccugugccagu

SEQ ID NO: 4216858 - RNA, 13 nt, Yersinia pestis KIM
ccccagagcgcaa

SEQ ID NO: 4216859 - RNA, 20 nt, Yersinia pestis KIM
ccccagaugaaugguuuccu

SEQ ID NO: 4216860 - RNA, 17 nt, Yersinia pestis KIM
ccccagccggugucacu

SEQ ID NO: 4216861 - RNA, 12 nt, Yersinia pestis KIM
ccccauauuuuc

SEQ ID NO: 4216862 - RNA, 18 nt, Yersinia pestis KIM
ccccaucaauuuccccaa

SEQ ID NO: 4216863 - RNA, 14 nt, Yersinia pestis KIM
ccccaucauaaagg

SEQ ID NO: 4216864 - RNA, 12 nt, Yersinia pestis KIM
ccccaucucuuc

SEQ ID NO: 4216865 - RNA, 13 nt, Yersinia pestis KIM
ccccaugaccgcc

SEQ ID NO: 4216866 - RNA, 16 nt, Yersinia pestis KIM
ccccaugaccgccagu

SEQ ID NO: 4216867 - RNA, 12 nt, Yersinia pestis KIM
ccccaugcaccu

SEQ ID NO: 4216868 - RNA, 21 nt, Yersinia pestis KIM
ccccaugguuacgccagcagc

SEQ ID NO: 4216869 - RNA, 22 nt, Yersinia pestis KIM
ccccauuuaucgccaagccagu

SEQ ID NO: 4216870 - RNA, 11 nt, Yersinia pestis KIM
cccccaccaug

SEQ ID NO: 4216871 - RNA, 19 nt, Yersinia pestis KIM
cccccaguagcacaaugcc

SEQ ID NO: 4216872 - RNA, 12 nt, Yersinia pestis KIM
cccccaucccca

SEQ ID NO: 4216873 - RNA, 16 nt, Yersinia pestis KIM
cccccgacccacgccc

SEQ ID NO: 4216874 - RNA, 15 nt, Yersinia pestis KIM
cccccuguaaaacaa

SEQ ID NO: 4216875 - RNA, 16 nt, Yersinia pestis KIM
cccccuguaacgcuaa

SEQ ID NO: 4216876 - RNA, 15 nt, Yersinia pestis KIM
cccccuuuggccgcu

SEQ ID NO: 4216877 - RNA, 16 nt, Yersinia pestis KIM
ccccgacccacgcccc

SEQ ID NO: 4216878 - RNA, 22 nt, Yersinia pestis KIM
ccccgacgauauuaccgagcgu

SEQ ID NO: 4216879 - RNA, 17 nt, Yersinia pestis KIM
ccccgccucaaugcaac

SEQ ID NO: 4216880 - RNA, 15 nt, Yersinia pestis KIM
ccccgcguugucagc

SEQ ID NO: 4216881 - RNA, 22 nt, Yersinia pestis KIM
ccccgcuucucguauccccuga

SEQ ID NO: 4216882 - RNA, 16 nt, Yersinia pestis KIM
ccccggaucacuggcu

SEQ ID NO: 4216883 - RNA, 14 nt, Yersinia pestis KIM
ccccgguaaucuga

SEQ ID NO: 4216884 - RNA, 14 nt, Yersinia pestis KIM
ccccguauaacgca

SEQ ID NO: 4216885 - RNA, 19 nt, Yersinia pestis KIM
ccccuaacugaugcugaca

SEQ ID NO: 4216886 - RNA, 17 nt, Yersinia pestis KIM
ccccuagccagccaccg

SEQ ID NO: 4216887 - RNA, 15 nt, Yersinia pestis KIM
ccccuccggaaucag

SEQ ID NO: 4216888 - RNA, 15 nt, Yersinia pestis KIM
ccccuguaaaacaag

SEQ ID NO: 4216889 - RNA, 22 nt, Yersinia pestis KIM
ccccuucaaugaaugccgguga

SEQ ID NO: 4216890 - RNA, 13 nt, Yersinia pestis KIM
ccccuucaggcca

SEQ ID NO: 4216891 - RNA, 13 nt, Yersinia pestis KIM
ccccuucuucacc

SEQ ID NO: 4216892 - RNA, 14 nt, Yersinia pestis KIM
ccccuuuuuucuau

SEQ ID NO: 4216893 - RNA, 17 nt, Yersinia pestis KIM
cccgaagcucaagcugg

SEQ ID NO: 4216894 - RNA, 13 nt, Yersinia pestis KIM
cccgaaucaagcu

SEQ ID NO: 4216895 - RNA, 12 nt, Yersinia pestis KIM
cccgagccgcac

SEQ ID NO: 4216896 - RNA, 15 nt, Yersinia pestis KIM
cccgaguaagcgcug

SEQ ID NO: 4216897 - RNA, 19 nt, Yersinia pestis KIM
cccgaucaggugaugucag

SEQ ID NO: 4216898 - RNA, 17 nt, Yersinia pestis KIM
cccgaugauugcaucau

SEQ ID NO: 4216899 - RNA, 15 nt, Yersinia pestis KIM
cccgauuauugugcc

SEQ ID NO: 4216900 - RNA, 22 nt, Yersinia pestis KIM
cccgauuccaucagcgcacugc

SEQ ID NO: 4216901 - RNA, 16 nt, Yersinia pestis KIM
cccgauuucaacgcac

SEQ ID NO: 4216902 - RNA, 20 nt, Yersinia pestis KIM
cccgauuucaacgcaccauc

SEQ ID NO: 4216903 - RNA, 18 nt, Yersinia pestis KIM
cccgcaagcaaacugaua

SEQ ID NO: 4216904 - RNA, 19 nt, Yersinia pestis KIM
cccgcacacugagccgccc

SEQ ID NO: 4216905 - RNA, 22 nt, Yersinia pestis KIM
cccgcagauaauccccuugugg

SEQ ID NO: 4216906 - RNA, 18 nt, Yersinia pestis KIM
cccgcagcggcuagcagc

SEQ ID NO: 4216907 - RNA, 20 nt, Yersinia pestis KIM
cccgcaguuugagaaacuga

SEQ ID NO: 4216908 - RNA, 18 nt, Yersinia pestis KIM
cccgccaggaaaacgccc

SEQ ID NO: 4216909 - RNA, 20 nt, Yersinia pestis KIM
cccgccaggaaaacgccccc

SEQ ID NO: 4216910 - RNA, 22 nt, Yersinia pestis KIM
cccgccaggaaauuugcacugc

SEQ ID NO: 4216911 - RNA, 16 nt, Yersinia pestis KIM
cccgccaguaaaccug

SEQ ID NO: 4216912 - RNA, 18 nt, Yersinia pestis KIM
cccgccauggcaugccau

SEQ ID NO: 4216913 - RNA, 11 nt, Yersinia pestis KIM
cccgccucuga

SEQ ID NO: 4216914 - RNA, 13 nt, Yersinia pestis KIM
cccgccugcuugc

SEQ ID NO: 4216915 - RNA, 15 nt, Yersinia pestis KIM
cccgcgacggagaga

SEQ ID NO: 4216916 - RNA, 16 nt, Yersinia pestis KIM
cccgcgcuuccaggcu

SEQ ID NO: 4216917 - RNA, 15 nt, Yersinia pestis KIM
cccgcguugucagcc

SEQ ID NO: 4216918 - RNA, 13 nt, Yersinia pestis KIM
cccgcuaacaugc

SEQ ID NO: 4216919 - RNA, 17 nt, Yersinia pestis KIM
cccgcuaacaugccaca

SEQ ID NO: 4216920 - RNA, 17 nt, Yersinia pestis KIM
cccgcuaccaagcccag

SEQ ID NO: 4216921 - RNA, 12 nt, Yersinia pestis KIM
cccgcucuguca

SEQ ID NO: 4216922 - RNA, 21 nt, Yersinia pestis KIM
cccgcuggucgauaagcacuc

SEQ ID NO: 4216923 - RNA, 14 nt, Yersinia pestis KIM
cccgcuucucguau

SEQ ID NO: 4216924 - RNA, 16 nt, Yersinia pestis KIM
cccgcuugucuugaaa

SEQ ID NO: 4216925 - RNA, 21 nt, Yersinia pestis KIM
cccgcuuguuguaucacagca

SEQ ID NO: 4216926 - RNA, 13 nt, Yersinia pestis KIM
cccggaccagccg

SEQ ID NO: 4216927 - RNA, 15 nt, Yersinia pestis KIM
cccggaucacuggcu

SEQ ID NO: 4216928 - RNA, 19 nt, Yersinia pestis KIM
cccggcaucccaccuucag

SEQ ID NO: 4216929 - RNA, 21 nt, Yersinia pestis KIM
cccggccgccauugagucguu

SEQ ID NO: 4216930 - RNA, 16 nt, Yersinia pestis KIM
cccggcucauccgcca

SEQ ID NO: 4216931 - RNA, 23 nt, Yersinia pestis KIM
cccggcugaccuguuguaacacu

SEQ ID NO: 4216932 - RNA, 16 nt, Yersinia pestis KIM
cccgggaggagcugcg

SEQ ID NO: 4216933 - RNA, 20 nt, Yersinia pestis KIM
cccgguaccgaggucauuca

SEQ ID NO: 4216934 - RNA, 21 nt, Yersinia pestis KIM
cccggugaucaucgcaccaua

SEQ ID NO: 4216935 - RNA, 18 nt, Yersinia pestis KIM
cccgguugauaucggcaa

SEQ ID NO: 4216936 - RNA, 23 nt, Yersinia pestis KIM
cccguaaacgggcuaccgggaua

SEQ ID NO: 4216937 - RNA, 23 nt, Yersinia pestis KIM
cccguacaaaaauaaacgggcuu

SEQ ID NO: 4216938 - RNA, 21 nt, Yersinia pestis KIM
cccgucgggauaucuucaauc

SEQ ID NO: 4216939 - RNA, 21 nt, Yersinia pestis KIM
cccgugauaugcaaaucaugc

SEQ ID NO: 4216940 - RNA, 20 nt, Yersinia pestis KIM
cccgugcgcucuaaacgaau

SEQ ID NO: 4216941 - RNA, 13 nt, Yersinia pestis KIM
cccgugucacuua

SEQ ID NO: 4216942 - RNA, 22 nt, Yersinia pestis KIM
cccguucacuuacugccaaaga

SEQ ID NO: 4216943 - RNA, 15 nt, Yersinia pestis KIM
cccguucaucaccca

SEQ ID NO: 4216944 - RNA, 16 nt, Yersinia pestis KIM
cccguucaucacccau

SEQ ID NO: 4216945 - RNA, 12 nt, Yersinia pestis KIM
cccguuccuuca

SEQ ID NO: 4216946 - RNA, 19 nt, Yersinia pestis KIM
cccguugagugaaagccug

SEQ ID NO: 4216947 - RNA, 16 nt, Yersinia pestis KIM
cccuaaaaucauugac

SEQ ID NO: 4216948 - RNA, 20 nt, Yersinia pestis KIM
cccuaacugcucagccgacu

SEQ ID NO: 4216949 - RNA, 23 nt, Yersinia pestis KIM
cccuacauaaaaauagcuucccu

SEQ ID NO: 4216950 - RNA, 18 nt, Yersinia pestis KIM
cccuaccguaucaacgua

SEQ ID NO: 4216951 - RNA, 15 nt, Yersinia pestis KIM
cccuagccagccacc

SEQ ID NO: 4216952 - RNA, 12 nt, Yersinia pestis KIM
cccuagcgcaaa

SEQ ID NO: 4216953 - RNA, 19 nt, Yersinia pestis KIM
cccucaauagcuaauaauu

SEQ ID NO: 4216954 - RNA, 14 nt, Yersinia pestis KIM
cccucaaugacgcg

SEQ ID NO: 4216955 - RNA, 22 nt, Yersinia pestis KIM
cccucacugccagccauaaugc

SEQ ID NO: 4216956 - RNA, 12 nt, Yersinia pestis KIM
cccucagccaaa

SEQ ID NO: 4216957 - RNA, 14 nt, Yersinia pestis KIM
cccucagccaaagc

SEQ ID NO: 4216958 - RNA, 16 nt, Yersinia pestis KIM
cccucauuuuacccga

SEQ ID NO: 4216959 - RNA, 11 nt, Yersinia pestis KIM
cccuccaaacu

SEQ ID NO: 4216960 - RNA, 14 nt, Yersinia pestis KIM
cccucgacaccaaa

SEQ ID NO: 4216961 - RNA, 21 nt, Yersinia pestis KIM
cccucuguccccgcuauuauu

SEQ ID NO: 4216962 - RNA, 22 nt, Yersinia pestis KIM
cccucuugcuuaucaccccuuc

SEQ ID NO: 4216963 - RNA, 14 nt, Yersinia pestis KIM
cccugaaccauggc

SEQ ID NO: 4216964 - RNA, 14 nt, Yersinia pestis KIM
cccugaauagccug

SEQ ID NO: 4216965 - RNA, 16 nt, Yersinia pestis KIM
cccugacucccucacc

SEQ ID NO: 4216966 - RNA, 16 nt, Yersinia pestis KIM
cccugacucccugacu

SEQ ID NO: 4216967 - RNA, 19 nt, Yersinia pestis KIM
cccugacucccugacuccc

SEQ ID NO: 4216968 - RNA, 21 nt, Yersinia pestis KIM
cccugagguugcucagcgggc

SEQ ID NO: 4216969 - RNA, 14 nt, Yersinia pestis KIM
ccgccgccagcccc

SEQ ID NO: 4216970 - RNA, 21 nt, Yersinia pestis KIM
ccgccucuuuuuccacacccu

SEQ ID NO: 4216971 - RNA, 17 nt, Yersinia pestis KIM
ccgccugcucaacacag

SEQ ID NO: 4216972 - RNA, 14 nt, Yersinia pestis KIM
ccgcgaauaacaga

SEQ ID NO: 4216973 - RNA, 13 nt, Yersinia pestis KIM
ccgcgauaaaaaa

SEQ ID NO: 4216974 - RNA, 19 nt, Yersinia pestis KIM
ccgcgauaaaaaauaaagu

SEQ ID NO: 4216975 - RNA, 23 nt, Yersinia pestis KIM
ccgcgauaaaaaauaaaguccag

SEQ ID NO: 4216976 - RNA, 17 nt, Yersinia pestis KIM
ccgcgaucaacaagaau

SEQ ID NO: 4216977 - RNA, 13 nt, Yersinia pestis KIM
ccgcgccagggag

SEQ ID NO: 4216978 - RNA, 14 nt, Yersinia pestis KIM
ccgcgcccucccug

SEQ ID NO: 4216979 - RNA, 22 nt, Yersinia pestis KIM
ccgcguaagccgugccugcugg

SEQ ID NO: 4216980 - RNA, 14 nt, Yersinia pestis KIM
ccgcgucgccgcuu

SEQ ID NO: 4216981 - RNA, 22 nt, Yersinia pestis KIM
ccgcgucgugaugaaauccaga

SEQ ID NO: 4216982 - RNA, 19 nt, Yersinia pestis KIM
ccgcguucaaaucugcucc

SEQ ID NO: 4216983 - RNA, 23 nt, Yersinia pestis KIM
ccgcguugucagccaugccugcg

SEQ ID NO: 4216984 - RNA, 12 nt, Yersinia pestis KIM
ccgcguuucucu

SEQ ID NO: 4216985 - RNA, 20 nt, Yersinia pestis KIM
ccgcuaacaaccgugcacca

SEQ ID NO: 4216986 - RNA, 23 nt, Yersinia pestis KIM
ccgcuaacguuuauuuauaagaa

SEQ ID NO: 4216987 - RNA, 18 nt, Yersinia pestis KIM
ccgcuaauucaggcaaau

SEQ ID NO: 4216988 - RNA, 19 nt, Yersinia pestis KIM
ccgcuacaggcgcaacugc

SEQ ID NO: 4216989 - RNA, 17 nt, Yersinia pestis KIM
ccgcuaccaagcccagu

SEQ ID NO: 4216990 - RNA, 21 nt, Yersinia pestis KIM
ccgcuaccgagucuauuuucg

SEQ ID NO: 4216991 - RNA, 18 nt, Yersinia pestis KIM
ccgcuagugauagcgggc

SEQ ID NO: 4216992 - RNA, 19 nt, Yersinia pestis KIM
ccgcuauaucaucagcaga

SEQ ID NO: 4216993 - RNA, 14 nt, Yersinia pestis KIM
ccgcuaucugcuga

SEQ ID NO: 4216994 - RNA, 17 nt, Yersinia pestis KIM
ccgcucaucauccauca

SEQ ID NO: 4216995 - RNA, 17 nt, Yersinia pestis KIM
ccgcucgucacacuggu

SEQ ID NO: 4216996 - RNA, 15 nt, Yersinia pestis KIM
ccgcugauaaccagc

SEQ ID NO: 4216997 - RNA, 14 nt, Yersinia pestis KIM
ccgcugcaacuccu

SEQ ID NO: 4216998 - RNA, 20 nt, Yersinia pestis KIM
ccgcugcaagccgcguucaa

SEQ ID NO: 4216999 - RNA, 14 nt, Yersinia pestis KIM
ccgcugcgauacca

SEQ ID NO: 4217000 - RNA, 24 nt, Yersinia pestis KIM
ccgcugcuaccagcagugcagcca

SEQ ID NO: 4217001 - RNA, 14 nt, Yersinia pestis KIM
ccgcugcuccgccc

SEQ ID NO: 4217002 - RNA, 17 nt, Yersinia pestis KIM
ccgcuggugcugcgggc

SEQ ID NO: 4217003 - RNA, 20 nt, Yersinia pestis KIM
ccgcuguagcgccaaugaca

SEQ ID NO: 4217004 - RNA, 17 nt, Yersinia pestis KIM
ccgcuucgcgcccgccc

SEQ ID NO: 4217005 - RNA, 19 nt, Yersinia pestis KIM
ccgcuucgcgcccgcccca

SEQ ID NO: 4217006 - RNA, 12 nt, Yersinia pestis KIM
ccgcuucugggc

SEQ ID NO: 4217007 - RNA, 19 nt, Yersinia pestis KIM
ccgcuugcuuugcuucauc

SEQ ID NO: 4217008 - RNA, 14 nt, Yersinia pestis KIM
ccgcuugggcgaua

SEQ ID NO: 4217009 - RNA, 12 nt, Yersinia pestis KIM
ccgcuuggguaa

SEQ ID NO: 4217010 - RNA, 21 nt, Yersinia pestis KIM
ccgcuuguuguaucacagcaa

SEQ ID NO: 4217011 - RNA, 17 nt, Yersinia pestis KIM
ccgcuuuuaccaaccca

SEQ ID NO: 4217012 - RNA, 18 nt, Yersinia pestis KIM
ccgcuuuuuagcgaucag

SEQ ID NO: 4217013 - RNA, 20 nt, Yersinia pestis KIM
ccggaaucagcguuuuauuc

SEQ ID NO: 4217014 - RNA, 17 nt, Yersinia pestis KIM
ccggaaugaguugcccu

SEQ ID NO: 4217015 - RNA, 21 nt, Yersinia pestis KIM
ccggacauaaugcauccacuu

SEQ ID NO: 4217016 - RNA, 14 nt, Yersinia pestis KIM
ccggacucaaaaua

SEQ ID NO: 4217017 - RNA, 17 nt, Yersinia pestis KIM
ccggagaacuugaacua

SEQ ID NO: 4217018 - RNA, 23 nt, Yersinia pestis KIM
ccggagcaagggcgcauccccau

SEQ ID NO: 4217019 - RNA, 15 nt, Yersinia pestis KIM
ccggauacaccguau

SEQ ID NO: 4217020 - RNA, 21 nt, Yersinia pestis KIM
ccggauagggggcaaccauau

SEQ ID NO: 4217021 - RNA, 14 nt, Yersinia pestis KIM
ccggauaugccgcu

SEQ ID NO: 4217022 - RNA, 12 nt, Yersinia pestis KIM
ccggaucacugg

SEQ ID NO: 4217023 - RNA, 14 nt, Yersinia pestis KIM
ccggauuccaccug

SEQ ID NO: 4217024 - RNA, 20 nt, Yersinia pestis KIM
ccggcacaggcgcuggcaac

SEQ ID NO: 4217025 - RNA, 15 nt, Yersinia pestis KIM
ccggcaccuucaacg

SEQ ID NO: 4217026 - RNA, 17 nt, Yersinia pestis KIM
ccggcaucccaccuuca

SEQ ID NO: 4217027 - RNA, 20 nt, Yersinia pestis KIM
ccggcaugagauccugaaaa

SEQ ID NO: 4217028 - RNA, 13 nt, Yersinia pestis KIM
ccggcauggacga

SEQ ID NO: 4217029 - RNA, 20 nt, Yersinia pestis KIM
ccggcgaagggcgcagcccc

SEQ ID NO: 4217030 - RNA, 20 nt, Yersinia pestis KIM
ccggcugacuggacaaauaa

SEQ ID NO: 4217031 - RNA, 19 nt, Yersinia pestis KIM
ccggcugcaauaagccaga

SEQ ID NO: 4217032 - RNA, 20 nt, Yersinia pestis KIM
ccggcugcgccauaugccau

SEQ ID NO: 4217033 - RNA, 19 nt, Yersinia pestis KIM
ccggcugggccgaugccag

SEQ ID NO: 4217034 - RNA, 14 nt, Yersinia pestis KIM
ccgggaaaaaauac

SEQ ID NO: 4217035 - RNA, 14 nt, Yersinia pestis KIM
ccgggaacaacgaa

SEQ ID NO: 4217036 - RNA, 19 nt, Yersinia pestis KIM
ccgggcaaacgccagugca

SEQ ID NO: 4217037 - RNA, 20 nt, Yersinia pestis KIM
ccgggcaaacgccagugcaa

SEQ ID NO: 4217038 - RNA, 22 nt, Yersinia pestis KIM
ccggguucaaggaaaccaaugc

SEQ ID NO: 4217039 - RNA, 16 nt, Yersinia pestis KIM
ccgguacaggcaaagu

SEQ ID NO: 4217040 - RNA, 22 nt, Yersinia pestis KIM
ccgguaucaccuuuuuccgcug

SEQ ID NO: 4217041 - RNA, 19 nt, Yersinia pestis KIM
ccggucgaacccauucauc

SEQ ID NO: 4217042 - RNA, 17 nt, Yersinia pestis KIM
ccggucgcguaccuuca

SEQ ID NO: 4217043 - RNA, 18 nt, Yersinia pestis KIM
ccggugagcacgauuacc

SEQ ID NO: 4217044 - RNA, 21 nt, Yersinia pestis KIM
ccggugcggaauguccaguua

SEQ ID NO: 4217045 - RNA, 16 nt, Yersinia pestis KIM
ccgguggucccugugg

SEQ ID NO: 4217046 - RNA, 14 nt, Yersinia pestis KIM
ccggugguuuagca

SEQ ID NO: 4217047 - RNA, 22 nt, Yersinia pestis KIM
ccgguguauuuggguuaaauag

SEQ ID NO: 4217048 - RNA, 20 nt, Yersinia pestis KIM
ccgguucauuuagcagcgca

SEQ ID NO: 4217049 - RNA, 20 nt, Yersinia pestis KIM
ccgguucccccaccguaaga

SEQ ID NO: 4217050 - RNA, 16 nt, Yersinia pestis KIM
ccgguucuugcgcgcu

SEQ ID NO: 4217051 - RNA, 15 nt, Yersinia pestis KIM
ccgguuuuggucagu

SEQ ID NO: 4217052 - RNA, 18 nt, Yersinia pestis KIM
ccguaaacauugacgaug

SEQ ID NO: 4217053 - RNA, 17 nt, Yersinia pestis KIM
ccguaacgcccuccugc

SEQ ID NO: 4217054 - RNA, 12 nt, Yersinia pestis KIM
ccguaacuucuu

SEQ ID NO: 4217055 - RNA, 14 nt, Yersinia pestis KIM
ccguacaaauauaa

SEQ ID NO: 4217056 - RNA, 14 nt, Yersinia pestis KIM
ccguacaucuggcc

SEQ ID NO: 4217057 - RNA, 18 nt, Yersinia pestis KIM
ccguagccaacacaugcu

SEQ ID NO: 4217058 - RNA, 13 nt, Yersinia pestis KIM
ccguaggccaccc

SEQ ID NO: 4217059 - RNA, 12 nt, Yersinia pestis KIM
ccguauaaucag

SEQ ID NO: 4217060 - RNA, 18 nt, Yersinia pestis KIM
ccguauagauuauuuucu

SEQ ID NO: 4217061 - RNA, 23 nt, Yersinia pestis KIM
ccguaucaacgauguaaacgaau

SEQ ID NO: 4217062 - RNA, 20 nt, Yersinia pestis KIM
ccguaucauggaagaccaga

SEQ ID NO: 4217063 - RNA, 19 nt, Yersinia pestis KIM
ccguaucuuguaguaacca

SEQ ID NO: 4217064 - RNA, 14 nt, Yersinia pestis KIM
ccguaugggggaug

SEQ ID NO: 4217065 - RNA, 23 nt, Yersinia pestis KIM
ccguaugggggauggccgggcug

SEQ ID NO: 4217066 - RNA, 11 nt, Yersinia pestis KIM
ccguauuauuu

SEQ ID NO: 4217067 - RNA, 13 nt, Yersinia pestis KIM
ccgucaauaucau

SEQ ID NO: 4217068 - RNA, 20 nt, Yersinia pestis KIM
ccgucaccacaaaggucagc

SEQ ID NO: 4217069 - RNA, 21 nt, Yersinia pestis KIM
ccgucaccucaucagugacua

SEQ ID NO: 4217070 - RNA, 16 nt, Yersinia pestis KIM
ccgucagacugcugac

SEQ ID NO: 4217071 - RNA, 14 nt, Yersinia pestis KIM
ccgucauccagcac

SEQ ID NO: 4217072 - RNA, 11 nt, Yersinia pestis KIM
ccgucaucucu

SEQ ID NO: 4217073 - RNA, 20 nt, Yersinia pestis KIM
ccgucgguuucucuuggagc

SEQ ID NO: 4217074 - RNA, 17 nt, Yersinia pestis KIM
ccgucuguggugccaua

SEQ ID NO: 4217075 - RNA, 20 nt, Yersinia pestis KIM
ccgugaccaccgcagcaacc

SEQ ID NO: 4217076 - RNA, 15 nt, Yersinia pestis KIM
ccgugagcagcaaua

SEQ ID NO: 4217077 - RNA, 20 nt, Yersinia pestis KIM
ccgugauauugggccggaga

SEQ ID NO: 4217078 - RNA, 14 nt, Yersinia pestis KIM
ccgugcagggcgau

SEQ ID NO: 4217079 - RNA, 22 nt, Yersinia pestis KIM
ccgugcauagcgugauuuuuau

SEQ ID NO: 4217080 - RNA, 12 nt, Yersinia pestis KIM
ccgugccugcug

SEQ ID NO: 4217081 - RNA, 18 nt, Yersinia pestis KIM
ccgugcggcuucuuauuu

SEQ ID NO: 4217082 - RNA, 16 nt, Yersinia pestis KIM
ccgugcgggaugacuc

SEQ ID NO: 4217083 - RNA, 17 nt, Yersinia pestis KIM
ccguggauaaacaaaua

SEQ ID NO: 4217084 - RNA, 17 nt, Yersinia pestis KIM
ccucucagacugcugac

SEQ ID NO: 4217085 - RNA, 20 nt, Yersinia pestis KIM
ccucucagacugcugacaaa

SEQ ID NO: 4217086 - RNA, 15 nt, Yersinia pestis KIM
ccucuccccuaccuc

SEQ ID NO: 4217087 - RNA, 16 nt, Yersinia pestis KIM
ccucucuuuccagcaa

SEQ ID NO: 4217088 - RNA, 16 nt, Yersinia pestis KIM
ccucugccuauccuca

SEQ ID NO: 4217089 - RNA, 20 nt, Yersinia pestis KIM
ccucugcugcugcccgcgaa

SEQ ID NO: 4217090 - RNA, 23 nt, Yersinia pestis KIM
ccucuggcggugacguuccuugg

SEQ ID NO: 4217091 - RNA, 14 nt, Yersinia pestis KIM
ccucuguccccgcu

SEQ ID NO: 4217092 - RNA, 13 nt, Yersinia pestis KIM
ccucuuaaugucu

SEQ ID NO: 4217093 - RNA, 20 nt, Yersinia pestis KIM
ccucuucagguaagccuuuc

SEQ ID NO: 4217094 - RNA, 13 nt, Yersinia pestis KIM
ccucuucauaauc

SEQ ID NO: 4217095 - RNA, 13 nt, Yersinia pestis KIM
ccucuucuuccgc

SEQ ID NO: 4217096 - RNA, 20 nt, Yersinia pestis KIM
ccucuugcgcuccacgcccc

SEQ ID NO: 4217097 - RNA, 21 nt, Yersinia pestis KIM
ccucuuuacgcucugccuguu

SEQ ID NO: 4217098 - RNA, 13 nt, Yersinia pestis KIM
ccucuuuccaaca

SEQ ID NO: 4217099 - RNA, 14 nt, Yersinia pestis KIM
ccucuuuuaucugu

SEQ ID NO: 4217100 - RNA, 13 nt, Yersinia pestis KIM
ccugaaagucagg

SEQ ID NO: 4217101 - RNA, 20 nt, Yersinia pestis KIM
ccugaaagucaggauuggag

SEQ ID NO: 4217102 - RNA, 17 nt, Yersinia pestis KIM
ccugaaggcugauuaau

SEQ ID NO: 4217103 - RNA, 16 nt, Yersinia pestis KIM
ccugaauagaagucca

SEQ ID NO: 4217104 - RNA, 17 nt, Yersinia pestis KIM
ccugaauggcaucaccg

SEQ ID NO: 4217105 - RNA, 18 nt, Yersinia pestis KIM
ccugacacugcaucucug

SEQ ID NO: 4217106 - RNA, 11 nt, Yersinia pestis KIM
ccugacauuug

SEQ ID NO: 4217107 - RNA, 17 nt, Yersinia pestis KIM
ccugacccccaauuuca

SEQ ID NO: 4217108 - RNA, 23 nt, Yersinia pestis KIM
ccugacgaaauuuaagaaaucua

SEQ ID NO: 4217109 - RNA, 21 nt, Yersinia pestis KIM
ccugacgaugauaaaucagca

SEQ ID NO: 4217110 - RNA, 21 nt, Yersinia pestis KIM
ccugacgcggugacaaugaau

SEQ ID NO: 4217111 - RNA, 14 nt, Yersinia pestis KIM
ccugacggccagca

SEQ ID NO: 4217112 - RNA, 22 nt, Yersinia pestis KIM
ccugacggccagcaaccuggcg

SEQ ID NO: 4217113 - RNA, 19 nt, Yersinia pestis KIM
ccugacucacagggcuguu

SEQ ID NO: 4217114 - RNA, 19 nt, Yersinia pestis KIM
ccugacucccugacucccu

SEQ ID NO: 4217115 - RNA, 21 nt, Yersinia pestis KIM
ccugacucccugacucccuga

SEQ ID NO: 4217116 - RNA, 18 nt, Yersinia pestis KIM
ccugacuguggcugcucu

SEQ ID NO: 4217117 - RNA, 19 nt, Yersinia pestis KIM
ccugagaaucaaaaaacag

SEQ ID NO: 4217118 - RNA, 22 nt, Yersinia pestis KIM
ccugagcgaucaauacaccaga

SEQ ID NO: 4217119 - RNA, 23 nt, Yersinia pestis KIM
ccugagggugaugacaaugcguu

SEQ ID NO: 4217120 - RNA, 17 nt, Yersinia pestis KIM
ccugagguugcucagcg

SEQ ID NO: 4217121 - RNA, 17 nt, Yersinia pestis KIM
ccugaguaauauuauuc

SEQ ID NO: 4217122 - RNA, 15 nt, Yersinia pestis KIM
ccugagucaguaauu

SEQ ID NO: 4217123 - RNA, 13 nt, Yersinia pestis KIM
ccugagugggggc

SEQ ID NO: 4217124 - RNA, 21 nt, Yersinia pestis KIM
ccugaguuaucuguuucaaau

SEQ ID NO: 4217125 - RNA, 18 nt, Yersinia pestis KIM
ccugauaaggagagaggc

SEQ ID NO: 4217126 - RNA, 14 nt, Yersinia pestis KIM
ccugauacaccauu

SEQ ID NO: 4217127 - RNA, 17 nt, Yersinia pestis KIM
ccugauaucaaccuggc

SEQ ID NO: 4217128 - RNA, 14 nt, Yersinia pestis KIM
ccugauccaacauc

SEQ ID NO: 4217129 - RNA, 15 nt, Yersinia pestis KIM
ccugauccaguuuca

SEQ ID NO: 4217130 - RNA, 19 nt, Yersinia pestis KIM
ccugaucgauaacccccaa

SEQ ID NO: 4217131 - RNA, 13 nt, Yersinia pestis KIM
ccugaugagucua

SEQ ID NO: 4217132 - RNA, 18 nt, Yersinia pestis KIM
ccugaugccccaugguua

SEQ ID NO: 4217133 - RNA, 21 nt, Yersinia pestis KIM
ccugauuacguuccacugcuu

SEQ ID NO: 4217134 - RNA, 22 nt, Yersinia pestis KIM
ccugauuacguuccacugcuuu

SEQ ID NO: 4217135 - RNA, 16 nt, Yersinia pestis KIM
ccugauugguuauccu

SEQ ID NO: 4217136 - RNA, 14 nt, Yersinia pestis KIM
ccugauuguuuuua

SEQ ID NO: 4217137 - RNA, 19 nt, Yersinia pestis KIM
ccugauuugccagcaccgc

SEQ ID NO: 4217138 - RNA, 23 nt, Yersinia pestis KIM
ccugcaacgccagugacuuuaac

SEQ ID NO: 4217139 - RNA, 16 nt, Yersinia pestis KIM
ccugcaauaacaccag

SEQ ID NO: 4217140 - RNA, 17 nt, Yersinia pestis KIM
ccugcaauaaccagaau

SEQ ID NO: 4217141 - RNA, 23 nt, Yersinia pestis KIM
ccugcaauaccgccggcaacagc

SEQ ID NO: 4217142 - RNA, 23 nt, Yersinia pestis KIM
ccugcaccagugccaauccccac

SEQ ID NO: 4217143 - RNA, 14 nt, Yersinia pestis KIM
ccugcaccgguguu

SEQ ID NO: 4217144 - RNA, 18 nt, Yersinia pestis KIM
ccugcagcaacaauaacu

SEQ ID NO: 4217145 - RNA, 22 nt, Yersinia pestis KIM
ccugcagguaagaaggcaauau

SEQ ID NO: 4217146 - RNA, 15 nt, Yersinia pestis KIM
ccugcauaucauucg

SEQ ID NO: 4217147 - RNA, 19 nt, Yersinia pestis KIM
ccugcaucaucacauucaa

SEQ ID NO: 4217148 - RNA, 21 nt, Yersinia pestis KIM
ccugcauccccggcaucccac

SEQ ID NO: 4217149 - RNA, 14 nt, Yersinia pestis KIM
ccugccaauaucca

SEQ ID NO: 4217150 - RNA, 21 nt, Yersinia pestis KIM
ccugccacagacuuucuuuaa

SEQ ID NO: 4217151 - RNA, 13 nt, Yersinia pestis KIM
ccugccagaacag

SEQ ID NO: 4217152 - RNA, 19 nt, Yersinia pestis KIM
ccugccagaaucagcccca

SEQ ID NO: 4217153 - RNA, 15 nt, Yersinia pestis KIM
ccugccaugucacug

SEQ ID NO: 4217154 - RNA, 17 nt, Yersinia pestis KIM
ccugccccacaaugaau

SEQ ID NO: 4217155 - RNA, 15 nt, Yersinia pestis KIM
ccugccgccucugcu

SEQ ID NO: 4217156 - RNA, 19 nt, Yersinia pestis KIM
ccugccugggccgcugggc

SEQ ID NO: 4217157 - RNA, 15 nt, Yersinia pestis KIM
ccugcgcugcuuuuu

SEQ ID NO: 4217158 - RNA, 18 nt, Yersinia pestis KIM
ccugcggcgguuacccuc

SEQ ID NO: 4217159 - RNA, 13 nt, Yersinia pestis KIM
ccugcgggccagc

SEQ ID NO: 4217160 - RNA, 12 nt, Yersinia pestis KIM
ccugcguaaauu

SEQ ID NO: 4217161 - RNA, 19 nt, Yersinia pestis KIM
ccugcuacucgaauuauuu

SEQ ID NO: 4217162 - RNA, 13 nt, Yersinia pestis KIM
ccugcuaggcagg

SEQ ID NO: 4217163 - RNA, 12 nt, Yersinia pestis KIM
ccugcucagcua

SEQ ID NO: 4217164 - RNA, 19 nt, Yersinia pestis KIM
ccugcugaaaaaugaguca

SEQ ID NO: 4217165 - RNA, 17 nt, Yersinia pestis KIM
ccugcugcaccucugcu

SEQ ID NO: 4217166 - RNA, 12 nt, Yersinia pestis KIM
ccugcuggcgca

SEQ ID NO: 4217167 - RNA, 15 nt, Yersinia pestis KIM
ccuggcuaauuuuau

SEQ ID NO: 4217168 - RNA, 13 nt, Yersinia pestis KIM
ccuggcucaaauu

SEQ ID NO: 4217169 - RNA, 14 nt, Yersinia pestis KIM
ccuggcucaaauuu

SEQ ID NO: 4217170 - RNA, 16 nt, Yersinia pestis KIM
ccugguagcaccacau

SEQ ID NO: 4217171 - RNA, 13 nt, Yersinia pestis KIM
ccuguaaaucuug

SEQ ID NO: 4217172 - RNA, 19 nt, Yersinia pestis KIM
ccuguaacgcuaaacuaaa

SEQ ID NO: 4217173 - RNA, 16 nt, Yersinia pestis KIM
ccuguaacuuuauuga

SEQ ID NO: 4217174 - RNA, 15 nt, Yersinia pestis KIM
ccuguacauaaauuu

SEQ ID NO: 4217175 - RNA, 21 nt, Yersinia pestis KIM
ccuguaccaccaccaacagca

SEQ ID NO: 4217176 - RNA, 13 nt, Yersinia pestis KIM
ccuguauaaaaau

SEQ ID NO: 4217177 - RNA, 22 nt, Yersinia pestis KIM
ccuguauaaaaauagccuuccu

SEQ ID NO: 4217178 - RNA, 19 nt, Yersinia pestis KIM
ccugucaucaacuucacuu

SEQ ID NO: 4217179 - RNA, 15 nt, Yersinia pestis KIM
ccugucguuacugcc

SEQ ID NO: 4217180 - RNA, 21 nt, Yersinia pestis KIM
ccugucguuacugccgacagg

SEQ ID NO: 4217181 - RNA, 22 nt, Yersinia pestis KIM
ccugucuuaggugacaggcaaa

SEQ ID NO: 4217182 - RNA, 19 nt, Yersinia pestis KIM
ccugugagcgguaagcuga

SEQ ID NO: 4217183 - RNA, 17 nt, Yersinia pestis KIM
ccugugauuucagccag

SEQ ID NO: 4217184 - RNA, 16 nt, Yersinia pestis KIM
ccugugcaccacacag

SEQ ID NO: 4217185 - RNA, 17 nt, Yersinia pestis KIM
ccugugccaacaucgcg

SEQ ID NO: 4217186 - RNA, 14 nt, Yersinia pestis KIM
ccugugcggcagug

SEQ ID NO: 4217187 - RNA, 16 nt, Yersinia pestis KIM
ccugugcggcagugaa

SEQ ID NO: 4217188 - RNA, 14 nt, Yersinia pestis KIM
ccuguggaaauuua

SEQ ID NO: 4217189 - RNA, 22 nt, Yersinia pestis KIM
ccuguguuuugagcaucacuuc

SEQ ID NO: 4217190 - RNA, 15 nt, Yersinia pestis KIM
ccuguuaauaauuca

SEQ ID NO: 4217191 - RNA, 17 nt, Yersinia pestis KIM
ccuguuacaucagagcu

SEQ ID NO: 4217192 - RNA, 20 nt, Yersinia pestis KIM
ccuguucgacauucucuacu

SEQ ID NO: 4217193 - RNA, 15 nt, Yersinia pestis KIM
ccuguucucuccguc

SEQ ID NO: 4217194 - RNA, 22 nt, Yersinia pestis KIM
ccuguugagguacggcucuauu

SEQ ID NO: 4217195 - RNA, 18 nt, Yersinia pestis KIM
ccuguuguaacacuugac

SEQ ID NO: 4217196 - RNA, 16 nt, Yersinia pestis KIM
ccuguuuacguaaaua

SEQ ID NO: 4217197 - RNA, 18 nt, Yersinia pestis KIM
ccuguuuacguaaauaga

SEQ ID NO: 4217198 - RNA, 17 nt, Yersinia pestis KIM
ccuguuuaguaaauaua

SEQ ID NO: 4217199 - RNA, 18 nt, Yersinia pestis KIM
cgaacuacgccucgcaga

SEQ ID NO: 4217200 - RNA, 20 nt, Yersinia pestis KIM
cgaacugauaacugccgaua

SEQ ID NO: 4217201 - RNA, 14 nt, Yersinia pestis KIM
cgaagauaaccggc

SEQ ID NO: 4217202 - RNA, 21 nt, Yersinia pestis KIM
cgaagauaaccggcuggaaau

SEQ ID NO: 4217203 - RNA, 22 nt, Yersinia pestis KIM
cgaagccccaggccacauggcg

SEQ ID NO: 4217204 - RNA, 21 nt, Yersinia pestis KIM
cgaagcccuguuucauuucgc

SEQ ID NO: 4217205 - RNA, 20 nt, Yersinia pestis KIM
cgaagcugauggcgaucaaa

SEQ ID NO: 4217206 - RNA, 17 nt, Yersinia pestis KIM
cgaagggcgcagccccc

SEQ ID NO: 4217207 - RNA, 17 nt, Yersinia pestis KIM
cgaaggguaucagcgac

SEQ ID NO: 4217208 - RNA, 15 nt, Yersinia pestis KIM
cgaaguuagacccaa

SEQ ID NO: 4217209 - RNA, 19 nt, Yersinia pestis KIM
cgaaguuuuagccuaaaag

SEQ ID NO: 4217210 - RNA, 20 nt, Yersinia pestis KIM
cgaauaaaaccuugcgccaa

SEQ ID NO: 4217211 - RNA, 17 nt, Yersinia pestis KIM
cgaauaaacaccgugcu

SEQ ID NO: 4217212 - RNA, 22 nt, Yersinia pestis KIM
cgaauaaauauccuccggcaua

SEQ ID NO: 4217213 - RNA, 14 nt, Yersinia pestis KIM
cgaauaauugguag

SEQ ID NO: 4217214 - RNA, 20 nt, Yersinia pestis KIM
cgaauacacagcgagaaucu

SEQ ID NO: 4217215 - RNA, 16 nt, Yersinia pestis KIM
cgaauagagacggaaa

SEQ ID NO: 4217216 - RNA, 22 nt, Yersinia pestis KIM
cgaauagagacggaaagagcca

SEQ ID NO: 4217217 - RNA, 16 nt, Yersinia pestis KIM
cgaauagcuggcugac

SEQ ID NO: 4217218 - RNA, 17 nt, Yersinia pestis KIM
cgaauagcuggcugacc

SEQ ID NO: 4217219 - RNA, 15 nt, Yersinia pestis KIM
cgaauauaguugauc

SEQ ID NO: 4217220 - RNA, 17 nt, Yersinia pestis KIM
cgaauauaguugaucua

SEQ ID NO: 4217221 - RNA, 18 nt, Yersinia pestis KIM
cgaauauguucuucuugg

SEQ ID NO: 4217222 - RNA, 18 nt, Yersinia pestis KIM
cgaauauugcguuaccua

SEQ ID NO: 4217223 - RNA, 20 nt, Yersinia pestis KIM
cgaauauugcguuaccuaaa

SEQ ID NO: 4217224 - RNA, 21 nt, Yersinia pestis KIM
cgaaugagcaguaauagcaaa

SEQ ID NO: 4217225 - RNA, 22 nt, Yersinia pestis KIM
cgaaugagcaguaauagcaaaa

SEQ ID NO: 4217226 - RNA, 16 nt, Yersinia pestis KIM
cgaaugcgacaccugc

SEQ ID NO: 4217227 - RNA, 21 nt, Yersinia pestis KIM
cgaaugcgacaccugcuauca

SEQ ID NO: 4217228 - RNA, 20 nt, Yersinia pestis KIM
cgaauuauuuagagucuaua

SEQ ID NO: 4217229 - RNA, 14 nt, Yersinia pestis KIM
cgaauugaucugau

SEQ ID NO: 4217230 - RNA, 22 nt, Yersinia pestis KIM
cgaauuggaaugaaauagucac

SEQ ID NO: 4217231 - RNA, 17 nt, Yersinia pestis KIM
cgaauuugcugcucgac

SEQ ID NO: 4217232 - RNA, 13 nt, Yersinia pestis KIM
cgaauuuuauuca

SEQ ID NO: 4217233 - RNA, 13 nt, Yersinia pestis KIM
cgacaaaaccgau

SEQ ID NO: 4217234 - RNA, 23 nt, Yersinia pestis KIM
cgacaauaccgccacacaauaca

SEQ ID NO: 4217235 - RNA, 19 nt, Yersinia pestis KIM
cgacaauauuccaaaaaau

SEQ ID NO: 4217236 - RNA, 13 nt, Yersinia pestis KIM
cgacacaaaugcu

SEQ ID NO: 4217237 - RNA, 14 nt, Yersinia pestis KIM
cgacaccaagaggc

SEQ ID NO: 4217238 - RNA, 19 nt, Yersinia pestis KIM
cgacaccaagaggcugcgu

SEQ ID NO: 4217239 - RNA, 16 nt, Yersinia pestis KIM
cgacagcaacaacaaa

SEQ ID NO: 4217240 - RNA, 14 nt, Yersinia pestis KIM
cgacagcagcaggc

SEQ ID NO: 4217241 - RNA, 14 nt, Yersinia pestis KIM
cgacagcagugauc

SEQ ID NO: 4217242 - RNA, 16 nt, Yersinia pestis KIM
cgacagcaucaacaug

SEQ ID NO: 4217243 - RNA, 15 nt, Yersinia pestis KIM
cgacaggcuaacaac

SEQ ID NO: 4217244 - RNA, 23 nt, Yersinia pestis KIM
cgacagguaguuaggugaaauau

SEQ ID NO: 4217245 - RNA, 23 nt, Yersinia pestis KIM
cgacauagccggagguuuuucau

SEQ ID NO: 4217246 - RNA, 20 nt, Yersinia pestis KIM
cgacauccaacaacugccaa

SEQ ID NO: 4217247 - RNA, 18 nt, Yersinia pestis KIM
cgacauccaauucaguac

SEQ ID NO: 4217248 - RNA, 18 nt, Yersinia pestis KIM
cgacauuaagcauaucca

SEQ ID NO: 4217249 - RNA, 14 nt, Yersinia pestis KIM
cgacauuauguucu

SEQ ID NO: 4217250 - RNA, 22 nt, Yersinia pestis KIM
cgaccaacuggcaaucaugggc

SEQ ID NO: 4217251 - RNA, 21 nt, Yersinia pestis KIM
cgaccaccacugcaucaucgc

SEQ ID NO: 4217252 - RNA, 11 nt, Yersinia pestis KIM
cgaccagcaga

SEQ ID NO: 4217253 - RNA, 14 nt, Yersinia pestis KIM
cgacccacgccccu

SEQ ID NO: 4217254 - RNA, 20 nt, Yersinia pestis KIM
cgacccguuuaugccccugc

SEQ ID NO: 4217255 - RNA, 22 nt, Yersinia pestis KIM
cgaccucaguuuugcuauuuac

SEQ ID NO: 4217256 - RNA, 17 nt, Yersinia pestis KIM
cgaccugaugccccaug

SEQ ID NO: 4217257 - RNA, 23 nt, Yersinia pestis KIM
cgacgccagauagcaucauccag

SEQ ID NO: 4217258 - RNA, 13 nt, Yersinia pestis KIM
cgacgcgccauaa

SEQ ID NO: 4217259 - RNA, 13 nt, Yersinia pestis KIM
cgacggagagaac

SEQ ID NO: 4217260 - RNA, 14 nt, Yersinia pestis KIM
cgacguccaaccca

SEQ ID NO: 4217261 - RNA, 21 nt, Yersinia pestis KIM
cgacgucccuaaagccaucgc

SEQ ID NO: 4217262 - RNA, 20 nt, Yersinia pestis KIM
cgacgugaugccaguaauuc

SEQ ID NO: 4217263 - RNA, 18 nt, Yersinia pestis KIM
cgacuaaggcaaccugag

SEQ ID NO: 4217264 - RNA, 14 nt, Yersinia pestis KIM
cgacuaauggccag

SEQ ID NO: 4217265 - RNA, 14 nt, Yersinia pestis KIM
cgacuauagauacc

SEQ ID NO: 4217266 - RNA, 14 nt, Yersinia pestis KIM
cgacuccaucaccg

SEQ ID NO: 4217267 - RNA, 20 nt, Yersinia pestis KIM
cgacucuuuuugugcuucau

SEQ ID NO: 4217268 - RNA, 13 nt, Yersinia pestis KIM
cgacugcaccuug

SEQ ID NO: 4217269 - RNA, 12 nt, Yersinia pestis KIM
cgacuggucccg

SEQ ID NO: 4217270 - RNA, 22 nt, Yersinia pestis KIM
cgacuuaauggucuucuuuauu

SEQ ID NO: 4217271 - RNA, 17 nt, Yersinia pestis KIM
cgagaaagucuuaaucu

SEQ ID NO: 4217272 - RNA, 22 nt, Yersinia pestis KIM
cgagaaagucuuaaucuuuaau

SEQ ID NO: 4217273 - RNA, 19 nt, Yersinia pestis KIM
cgagaagcuucaacuuaau

SEQ ID NO: 4217274 - RNA, 20 nt, Yersinia pestis KIM
cgagagcgucccugaugggg

SEQ ID NO: 4217275 - RNA, 17 nt, Yersinia pestis KIM
cgagaggcuauuuaucg

SEQ ID NO: 4217276 - RNA, 19 nt, Yersinia pestis KIM
cgagaugcgcgaauagcug

SEQ ID NO: 4217277 - RNA, 13 nt, Yersinia pestis KIM
cgagauggucaug

SEQ ID NO: 4217278 - RNA, 17 nt, Yersinia pestis KIM
cgagcacauggcgaaca

SEQ ID NO: 4217279 - RNA, 14 nt, Yersinia pestis KIM
cgagcacugccccg

SEQ ID NO: 4217280 - RNA, 13 nt, Yersinia pestis KIM
cgagcccaggcga

SEQ ID NO: 4217281 - RNA, 14 nt, Yersinia pestis KIM
cgagcccaggcgac

SEQ ID NO: 4217282 - RNA, 17 nt, Yersinia pestis KIM
cgagcccccagggaagg

SEQ ID NO: 4217283 - RNA, 18 nt, Yersinia pestis KIM
cgagccgcgcccucccug

SEQ ID NO: 4217284 - RNA, 14 nt, Yersinia pestis KIM
cgagccuacaugga

SEQ ID NO: 4217285 - RNA, 17 nt, Yersinia pestis KIM
cgagccuacauggaugu

SEQ ID NO: 4217286 - RNA, 19 nt, Yersinia pestis KIM
cgagcgucaagccaacccc

SEQ ID NO: 4217287 - RNA, 17 nt, Yersinia pestis KIM
cgagcgugcgguagacc

SEQ ID NO: 4217288 - RNA, 20 nt, Yersinia pestis KIM
cgagcucucacugcuccagc

SEQ ID NO: 4217289 - RNA, 22 nt, Yersinia pestis KIM
cgagcucucacugcuccagcca

SEQ ID NO: 4217290 - RNA, 19 nt, Yersinia pestis KIM
cgaggacgaauacacagcg

SEQ ID NO: 4217291 - RNA, 15 nt, Yersinia pestis KIM
cgaggacuuccugcc

SEQ ID NO: 4217292 - RNA, 13 nt, Yersinia pestis KIM
cgaggaucaccac

SEQ ID NO: 4217293 - RNA, 12 nt, Yersinia pestis KIM
cgaggaugacga

SEQ ID NO: 4217294 - RNA, 15 nt, Yersinia pestis KIM
cgaggcuucucagca

SEQ ID NO: 4217295 - RNA, 19 nt, Yersinia pestis KIM
cgaguaacuccaucaggcu

SEQ ID NO: 4217296 - RNA, 11 nt, Yersinia pestis KIM
cgaguaauacc

SEQ ID NO: 4217297 - RNA, 14 nt, Yersinia pestis KIM
cgaguaaugaaauc

SEQ ID NO: 4217298 - RNA, 23 nt, Yersinia pestis KIM
cgagucuauugaaaaaauaaugu

SEQ ID NO: 4217299 - RNA, 17 nt, Yersinia pestis KIM
cgaguuaaacugggucg

SEQ ID NO: 4217300 - RNA, 23 nt, Yersinia pestis KIM
cgaguuaacacgggcaugaacgu

SEQ ID NO: 4217301 - RNA, 13 nt, Yersinia pestis KIM
cgaguucagugau

SEQ ID NO: 4217302 - RNA, 15 nt, Yersinia pestis KIM
cgaguucucaccaag

SEQ ID NO: 4217303 - RNA, 20 nt, Yersinia pestis KIM
cgaguuuauauugccacggc

SEQ ID NO: 4217304 - RNA, 14 nt, Yersinia pestis KIM
cgauaaaaaccauu

SEQ ID NO: 4217305 - RNA, 20 nt, Yersinia pestis KIM
cgauaaaaggcuauuuaaau

SEQ ID NO: 4217306 - RNA, 19 nt, Yersinia pestis KIM
cgauaaacaucaugacaaa

SEQ ID NO: 4217307 - RNA, 14 nt, Yersinia pestis KIM
cgauaaacuucaca

SEQ ID NO: 4217308 - RNA, 20 nt, Yersinia pestis KIM
cgauaaacuucacaaugcac

SEQ ID NO: 4217309 - RNA, 14 nt, Yersinia pestis KIM
cgauaaagucaucc

SEQ ID NO: 4217310 - RNA, 11 nt, Yersinia pestis KIM
cgauaaauaau

SEQ ID NO: 4217311 - RNA, 13 nt, Yersinia pestis KIM
cgauaaauaauua

SEQ ID NO: 4217312 - RNA, 23 nt, Yersinia pestis KIM
cgauaaauagucguuauauaaau

SEQ ID NO: 4217313 - RNA, 21 nt, Yersinia pestis KIM
cgauaacagauauuacgcagc

SEQ ID NO: 4217314 - RNA, 18 nt, Yersinia pestis KIM
cgcaggauaaagcugaau

SEQ ID NO: 4217315 - RNA, 15 nt, Yersinia pestis KIM
cgcaggcacugcaga

SEQ ID NO: 4217316 - RNA, 18 nt, Yersinia pestis KIM
cgcaggcacuuugucaac

SEQ ID NO: 4217317 - RNA, 17 nt, Yersinia pestis KIM
cgcagguaacgccgcug

SEQ ID NO: 4217318 - RNA, 15 nt, Yersinia pestis KIM
cgcagguucaucaga

SEQ ID NO: 4217319 - RNA, 15 nt, Yersinia pestis KIM
cgcagguuggcggca

SEQ ID NO: 4217320 - RNA, 16 nt, Yersinia pestis KIM
cgcagguuggcggcaa

SEQ ID NO: 4217321 - RNA, 12 nt, Yersinia pestis KIM
cgcaguuaucau

SEQ ID NO: 4217322 - RNA, 16 nt, Yersinia pestis KIM
cgcaguuaucauugcu

SEQ ID NO: 4217323 - RNA, 21 nt, Yersinia pestis KIM
cgcaguuaucauugcuccugu

SEQ ID NO: 4217324 - RNA, 13 nt, Yersinia pestis KIM
cgcauaagacacc

SEQ ID NO: 4217325 - RNA, 12 nt, Yersinia pestis KIM
cgcauaggccaa

SEQ ID NO: 4217326 - RNA, 13 nt, Yersinia pestis KIM
cgcaucagccagc

SEQ ID NO: 4217327 - RNA, 16 nt, Yersinia pestis KIM
cgcauccccacuugua

SEQ ID NO: 4217328 - RNA, 15 nt, Yersinia pestis KIM
cgcaucgcuugcuca

SEQ ID NO: 4217329 - RNA, 15 nt, Yersinia pestis KIM
cgcaucgucgcuguu

SEQ ID NO: 4217330 - RNA, 14 nt, Yersinia pestis KIM
cgcaucuuccaaag

SEQ ID NO: 4217331 - RNA, 17 nt, Yersinia pestis KIM
cgcauuaauccgccuga

SEQ ID NO: 4217332 - RNA, 22 nt, Yersinia pestis KIM
cgcauucuuuuuguuaaaauag

SEQ ID NO: 4217333 - RNA, 21 nt, Yersinia pestis KIM
cgcauugaccgcuguuugauu

SEQ ID NO: 4217334 - RNA, 17 nt, Yersinia pestis KIM
cgcauugaggucagcgu

SEQ ID NO: 4217335 - RNA, 21 nt, Yersinia pestis KIM
cgcauuggguaauaucaccau

SEQ ID NO: 4217336 - RNA, 20 nt, Yersinia pestis KIM
cgccaaaauaaacaucaaug

SEQ ID NO: 4217337 - RNA, 21 nt, Yersinia pestis KIM
cgccaacagagugaaucgccg

SEQ ID NO: 4217338 - RNA, 15 nt, Yersinia pestis KIM
cgccaacaggccuaa

SEQ ID NO: 4217339 - RNA, 23 nt, Yersinia pestis KIM
cgccaacaggccuaaugccgcgc

SEQ ID NO: 4217340 - RNA, 18 nt, Yersinia pestis KIM
cgccaaccggcgcgcuuu

SEQ ID NO: 4217341 - RNA, 13 nt, Yersinia pestis KIM
cgccaagcuuucu

SEQ ID NO: 4217342 - RNA, 19 nt, Yersinia pestis KIM
cgccaaggauggcgcggcu

SEQ ID NO: 4217343 - RNA, 15 nt, Yersinia pestis KIM
cgccaaguccuccuu

SEQ ID NO: 4217344 - RNA, 21 nt, Yersinia pestis KIM
cgccaauaaccgcagcaggca

SEQ ID NO: 4217345 - RNA, 23 nt, Yersinia pestis KIM
cgccaauaaccgcagcaggcaga

SEQ ID NO: 4217346 - RNA, 14 nt, Yersinia pestis KIM
cgccaauuuuguag

SEQ ID NO: 4217347 - RNA, 19 nt, Yersinia pestis KIM
cgccacaauauuccggcau

SEQ ID NO: 4217348 - RNA, 20 nt, Yersinia pestis KIM
cgccaccaaugcauccaagc

SEQ ID NO: 4217349 - RNA, 16 nt, Yersinia pestis KIM
cgccacuuaucccaac

SEQ ID NO: 4217350 - RNA, 15 nt, Yersinia pestis KIM
cgccacuucuaacaa

SEQ ID NO: 4217351 - RNA, 19 nt, Yersinia pestis KIM
cgccagauuauccagcccu

SEQ ID NO: 4217352 - RNA, 21 nt, Yersinia pestis KIM
cgccagcaaaucacauuucaa

SEQ ID NO: 4217353 - RNA, 13 nt, Yersinia pestis KIM
cgccagcaacagc

SEQ ID NO: 4217354 - RNA, 14 nt, Yersinia pestis KIM
cgccagcaacagcg

SEQ ID NO: 4217355 - RNA, 21 nt, Yersinia pestis KIM
cgccagcaauaagccacgcug

SEQ ID NO: 4217356 - RNA, 14 nt, Yersinia pestis KIM
cgccagcacgguua

SEQ ID NO: 4217357 - RNA, 20 nt, Yersinia pestis KIM
cgccagcggaauaugacgau

SEQ ID NO: 4217358 - RNA, 15 nt, Yersinia pestis KIM
cgccagcuauugcuu

SEQ ID NO: 4217359 - RNA, 17 nt, Yersinia pestis KIM
cgccagcuauugcuuuu

SEQ ID NO: 4217360 - RNA, 12 nt, Yersinia pestis KIM
cgccagcugacc

SEQ ID NO: 4217361 - RNA, 19 nt, Yersinia pestis KIM
cgccagugccgcggcggcc

SEQ ID NO: 4217362 - RNA, 18 nt, Yersinia pestis KIM
cgccaguugggauguuca

SEQ ID NO: 4217363 - RNA, 16 nt, Yersinia pestis KIM
cgccauaacaucggcg

SEQ ID NO: 4217364 - RNA, 14 nt, Yersinia pestis KIM
cgccauauccaacu

SEQ ID NO: 4217365 - RNA, 22 nt, Yersinia pestis KIM
cgccauauccaacuucuuccau

SEQ ID NO: 4217366 - RNA, 12 nt, Yersinia pestis KIM
cgccaucaauaa

SEQ ID NO: 4217367 - RNA, 15 nt, Yersinia pestis KIM
cgccaucaauaauuu

SEQ ID NO: 4217368 - RNA, 14 nt, Yersinia pestis KIM
cgccauccgcaccu

SEQ ID NO: 4217369 - RNA, 20 nt, Yersinia pestis KIM
cgccaugcucagaaaccugu

SEQ ID NO: 4217370 - RNA, 17 nt, Yersinia pestis KIM
cgccauggcaugccaug

SEQ ID NO: 4217371 - RNA, 17 nt, Yersinia pestis KIM
cgccauuaaaaggugcc

SEQ ID NO: 4217372 - RNA, 17 nt, Yersinia pestis KIM
cgccauugcauauugcu

SEQ ID NO: 4217373 - RNA, 16 nt, Yersinia pestis KIM
cgcccaacucuuuagc

SEQ ID NO: 4217374 - RNA, 18 nt, Yersinia pestis KIM
cgcccaagcuuggccccu

SEQ ID NO: 4217375 - RNA, 20 nt, Yersinia pestis KIM
cgcccagcuaauugauccuc

SEQ ID NO: 4217376 - RNA, 11 nt, Yersinia pestis KIM
cgcccaggcca

SEQ ID NO: 4217377 - RNA, 18 nt, Yersinia pestis KIM
cgcccaguggagccauga

SEQ ID NO: 4217378 - RNA, 19 nt, Yersinia pestis KIM
cgccccacaaugucccguc

SEQ ID NO: 4217379 - RNA, 21 nt, Yersinia pestis KIM
cgcccccaauaagggccaccc

SEQ ID NO: 4217380 - RNA, 14 nt, Yersinia pestis KIM
cgccccccgccugc

SEQ ID NO: 4217381 - RNA, 12 nt, Yersinia pestis KIM
cgccccggccgc

SEQ ID NO: 4217382 - RNA, 20 nt, Yersinia pestis KIM
cgccccgugcuacuccugcu

SEQ ID NO: 4217383 - RNA, 20 nt, Yersinia pestis KIM
cgccccguuaauccuucacu

SEQ ID NO: 4217384 - RNA, 20 nt, Yersinia pestis KIM
cgccccuuagcgcacgggga

SEQ ID NO: 4217385 - RNA, 23 nt, Yersinia pestis KIM
cgccccuuccaaugucaguggcg

SEQ ID NO: 4217386 - RNA, 17 nt, Yersinia pestis KIM
cgcccgcgccagauguu

SEQ ID NO: 4217387 - RNA, 13 nt, Yersinia pestis KIM
cgcccgcggccaa

SEQ ID NO: 4217388 - RNA, 17 nt, Yersinia pestis KIM
cgcccgcggccaauagc

SEQ ID NO: 4217389 - RNA, 14 nt, Yersinia pestis KIM
cgcccgcugauucu

SEQ ID NO: 4217390 - RNA, 16 nt, Yersinia pestis KIM
cgcccgguaauaauga

SEQ ID NO: 4217391 - RNA, 17 nt, Yersinia pestis KIM
cgcccguuggccggcca

SEQ ID NO: 4217392 - RNA, 16 nt, Yersinia pestis KIM
cgcccuccugcggcgg

SEQ ID NO: 4217393 - RNA, 18 nt, Yersinia pestis KIM
cgcccucuugcugaguga

SEQ ID NO: 4217394 - RNA, 16 nt, Yersinia pestis KIM
cgccgaguaagucaau

SEQ ID NO: 4217395 - RNA, 18 nt, Yersinia pestis KIM
cgccgauggugugcagca

SEQ ID NO: 4217396 - RNA, 21 nt, Yersinia pestis KIM
cgccgccucuucugucggagc

SEQ ID NO: 4217397 - RNA, 22 nt, Yersinia pestis KIM
cgccgcucaauuaaccugagcg

SEQ ID NO: 4217398 - RNA, 14 nt, Yersinia pestis KIM
cgccgcuguagcgc

SEQ ID NO: 4217399 - RNA, 13 nt, Yersinia pestis KIM
cgccggguuuugc

SEQ ID NO: 4217400 - RNA, 13 nt, Yersinia pestis KIM
cgccguaaacugc

SEQ ID NO: 4217401 - RNA, 14 nt, Yersinia pestis KIM
cgccgucagcucuu

SEQ ID NO: 4217402 - RNA, 21 nt, Yersinia pestis KIM
cgccgucaugcugaaucugua

SEQ ID NO: 4217403 - RNA, 23 nt, Yersinia pestis KIM
cgccgugucggaugccgcuccag

SEQ ID NO: 4217404 - RNA, 23 nt, Yersinia pestis KIM
cgccguuacccccuucaccaaua

SEQ ID NO: 4217405 - RNA, 19 nt, Yersinia pestis KIM
cgccuaaaaaugauuucag

SEQ ID NO: 4217406 - RNA, 23 nt, Yersinia pestis KIM
cgccuaaagcgccuuccuuuuau

SEQ ID NO: 4217407 - RNA, 15 nt, Yersinia pestis KIM
cgccuaguuaaacuc

SEQ ID NO: 4217408 - RNA, 18 nt, Yersinia pestis KIM
cgccuaucugaaugaauu

SEQ ID NO: 4217409 - RNA, 13 nt, Yersinia pestis KIM
cgccucaaugcaa

SEQ ID NO: 4217410 - RNA, 16 nt, Yersinia pestis KIM
cgccuccgauucauag

SEQ ID NO: 4217411 - RNA, 19 nt, Yersinia pestis KIM
cgccucgcuuacugguacc

SEQ ID NO: 4217412 - RNA, 22 nt, Yersinia pestis KIM
cgccugauaaaauuaccgcccc

SEQ ID NO: 4217413 - RNA, 15 nt, Yersinia pestis KIM
cgccugauccaacau

SEQ ID NO: 4217414 - RNA, 14 nt, Yersinia pestis KIM
cgccugauggcgcu

SEQ ID NO: 4217415 - RNA, 12 nt, Yersinia pestis KIM
cgccugggaucc

SEQ ID NO: 4217416 - RNA, 21 nt, Yersinia pestis KIM
cgccuguuucggcaggcagaa

SEQ ID NO: 4217417 - RNA, 16 nt, Yersinia pestis KIM
cgccuuaccgcaauuu

SEQ ID NO: 4217418 - RNA, 16 nt, Yersinia pestis KIM
cgccuucauguugcaa

SEQ ID NO: 4217419 - RNA, 19 nt, Yersinia pestis KIM
cgccuucccacaaacucca

SEQ ID NO: 4217420 - RNA, 16 nt, Yersinia pestis KIM
cgccuuucccgcuagc

SEQ ID NO: 4217421 - RNA, 19 nt, Yersinia pestis KIM
cgccuuuuuuauaauaaug

SEQ ID NO: 4217422 - RNA, 20 nt, Yersinia pestis KIM
cgccuuuuuuauaauaaugg

SEQ ID NO: 4217423 - RNA, 14 nt, Yersinia pestis KIM
cgcgaauauggcau

SEQ ID NO: 4217424 - RNA, 21 nt, Yersinia pestis KIM
cgcgaauccccccauucacac

SEQ ID NO: 4217425 - RNA, 13 nt, Yersinia pestis KIM
cgcgaccagcaga

SEQ ID NO: 4217426 - RNA, 15 nt, Yersinia pestis KIM
cgcgaccagcagaau

SEQ ID NO: 4217427 - RNA, 17 nt, Yersinia pestis KIM
cgcgaccagcagaauaa

SEQ ID NO: 4217428 - RNA, 17 nt, Yersinia pestis KIM
cgcgacggagagaacag

SEQ ID NO: 4217429 - RNA, 17 nt, Yersinia pestis KIM
cggacgccccaccgaua

SEQ ID NO: 4217430 - RNA, 14 nt, Yersinia pestis KIM
cggacgcuccucac

SEQ ID NO: 4217431 - RNA, 16 nt, Yersinia pestis KIM
cggacgcuuuacuccu

SEQ ID NO: 4217432 - RNA, 19 nt, Yersinia pestis KIM
cggacgcuuuacuccucug

SEQ ID NO: 4217433 - RNA, 22 nt, Yersinia pestis KIM
cggacgcuuuacuccucugccu

SEQ ID NO: 4217434 - RNA, 13 nt, Yersinia pestis KIM
cggagaacuugaa

SEQ ID NO: 4217435 - RNA, 13 nt, Yersinia pestis KIM
cggagcaagggcg

SEQ ID NO: 4217436 - RNA, 13 nt, Yersinia pestis KIM
cggagccugauac

SEQ ID NO: 4217437 - RNA, 20 nt, Yersinia pestis KIM
cggagcugacgucagaucgc

SEQ ID NO: 4217438 - RNA, 22 nt, Yersinia pestis KIM
cggagucuaucugcaguauuug

SEQ ID NO: 4217439 - RNA, 21 nt, Yersinia pestis KIM
cggaguuugagacccccaaug

SEQ ID NO: 4217440 - RNA, 13 nt, Yersinia pestis KIM
cggauaaaacaau

SEQ ID NO: 4217441 - RNA, 23 nt, Yersinia pestis KIM
cggauaaacacuguuuaucgcau

SEQ ID NO: 4217442 - RNA, 20 nt, Yersinia pestis KIM
cggauaaccgcauucccugc

SEQ ID NO: 4217443 - RNA, 22 nt, Yersinia pestis KIM
cggauaaccgcgaagaggguuu

SEQ ID NO: 4217444 - RNA, 17 nt, Yersinia pestis KIM
cggauaauguuaauauu

SEQ ID NO: 4217445 - RNA, 15 nt, Yersinia pestis KIM
cggauaauguugcaa

SEQ ID NO: 4217446 - RNA, 21 nt, Yersinia pestis KIM
cggauacguuccaacaucucg

SEQ ID NO: 4217447 - RNA, 14 nt, Yersinia pestis KIM
cggauacugaccca

SEQ ID NO: 4217448 - RNA, 15 nt, Yersinia pestis KIM
cggauacuguuuggu

SEQ ID NO: 4217449 - RNA, 21 nt, Yersinia pestis KIM
cggauagccgaagaauguauu

SEQ ID NO: 4217450 - RNA, 20 nt, Yersinia pestis KIM
cggauagcgcuucagugauu

SEQ ID NO: 4217451 - RNA, 23 nt, Yersinia pestis KIM
cggauaugccgcucgaaccgcca

SEQ ID NO: 4217452 - RNA, 14 nt, Yersinia pestis KIM
cggauauucucaac

SEQ ID NO: 4217453 - RNA, 18 nt, Yersinia pestis KIM
cggauauuuuuuugucug

SEQ ID NO: 4217454 - RNA, 14 nt, Yersinia pestis KIM
cggaucaaccgccc

SEQ ID NO: 4217455 - RNA, 22 nt, Yersinia pestis KIM
cggaucagagccaacugaggca

SEQ ID NO: 4217456 - RNA, 19 nt, Yersinia pestis KIM
cggaucagugugggcuggu

SEQ ID NO: 4217457 - RNA, 14 nt, Yersinia pestis KIM
cggaucgcgacgaa

SEQ ID NO: 4217458 - RNA, 21 nt, Yersinia pestis KIM
cggaucugcaacuucagccac

SEQ ID NO: 4217459 - RNA, 23 nt, Yersinia pestis KIM
cggaucugcaacuucagccacca

SEQ ID NO: 4217460 - RNA, 20 nt, Yersinia pestis KIM
cggaugaugaucaccgccug

SEQ ID NO: 4217461 - RNA, 17 nt, Yersinia pestis KIM
cggaugcaucgggcaua

SEQ ID NO: 4217462 - RNA, 21 nt, Yersinia pestis KIM
cggaugccggaaucagccaga

SEQ ID NO: 4217463 - RNA, 13 nt, Yersinia pestis KIM
cggauucacccau

SEQ ID NO: 4217464 - RNA, 23 nt, Yersinia pestis KIM
cggauuguucagcaaccgcauca

SEQ ID NO: 4217465 - RNA, 23 nt, Yersinia pestis KIM
cggcaaauuaaugucgccauaac

SEQ ID NO: 4217466 - RNA, 14 nt, Yersinia pestis KIM
cggcaacagcgccu

SEQ ID NO: 4217467 - RNA, 17 nt, Yersinia pestis KIM
cggcaaucccggccauu

SEQ ID NO: 4217468 - RNA, 22 nt, Yersinia pestis KIM
cggcaaugggucauugcgugca

SEQ ID NO: 4217469 - RNA, 16 nt, Yersinia pestis KIM
cggcaccaaccauuga

SEQ ID NO: 4217470 - RNA, 21 nt, Yersinia pestis KIM
cggcacgcguugguuguccug

SEQ ID NO: 4217471 - RNA, 14 nt, Yersinia pestis KIM
cggcacguuucccc

SEQ ID NO: 4217472 - RNA, 22 nt, Yersinia pestis KIM
cggcacguuuccccuucauuug

SEQ ID NO: 4217473 - RNA, 16 nt, Yersinia pestis KIM
cggcacugcaucugac

SEQ ID NO: 4217474 - RNA, 17 nt, Yersinia pestis KIM
cggcagagaucauguag

SEQ ID NO: 4217475 - RNA, 22 nt, Yersinia pestis KIM
cggcagauaugaugcggaagaa

SEQ ID NO: 4217476 - RNA, 17 nt, Yersinia pestis KIM
cggcagauaugccaggc

SEQ ID NO: 4217477 - RNA, 19 nt, Yersinia pestis KIM
cggcagcgagcacugcccc

SEQ ID NO: 4217478 - RNA, 20 nt, Yersinia pestis KIM
cggcagcgagcacugccccg

SEQ ID NO: 4217479 - RNA, 18 nt, Yersinia pestis KIM
cggcaguaaucuccccgc

SEQ ID NO: 4217480 - RNA, 17 nt, Yersinia pestis KIM
cggcauaaauucuagca

SEQ ID NO: 4217481 - RNA, 12 nt, Yersinia pestis KIM
cggcauaacagg

SEQ ID NO: 4217482 - RNA, 14 nt, Yersinia pestis KIM
cggcauagcaaaau

SEQ ID NO: 4217483 - RNA, 12 nt, Yersinia pestis KIM
cggcaucaccaa

SEQ ID NO: 4217484 - RNA, 13 nt, Yersinia pestis KIM
cggcaucaccaaa

SEQ ID NO: 4217485 - RNA, 21 nt, Yersinia pestis KIM
cggcaucauccucauugagca

SEQ ID NO: 4217486 - RNA, 15 nt, Yersinia pestis KIM
cggcaucggccccug

SEQ ID NO: 4217487 - RNA, 17 nt, Yersinia pestis KIM
cggcaugcaacuuggca

SEQ ID NO: 4217488 - RNA, 14 nt, Yersinia pestis KIM
cggcauugccagcg

SEQ ID NO: 4217489 - RNA, 16 nt, Yersinia pestis KIM
cggccaauucagcaac

SEQ ID NO: 4217490 - RNA, 16 nt, Yersinia pestis KIM
cggccacccgccauca

SEQ ID NO: 4217491 - RNA, 23 nt, Yersinia pestis KIM
cggccagcaaccuggcggcccga

SEQ ID NO: 4217492 - RNA, 16 nt, Yersinia pestis KIM
cggccagcauucaggc

SEQ ID NO: 4217493 - RNA, 16 nt, Yersinia pestis KIM
cggccagccuugagcc

SEQ ID NO: 4217494 - RNA, 17 nt, Yersinia pestis KIM
cggccagucaaaagaaa

SEQ ID NO: 4217495 - RNA, 18 nt, Yersinia pestis KIM
cggccaguguuuucucca

SEQ ID NO: 4217496 - RNA, 13 nt, Yersinia pestis KIM
cggccauauuacc

SEQ ID NO: 4217497 - RNA, 17 nt, Yersinia pestis KIM
cggccauuugcucuggc

SEQ ID NO: 4217498 - RNA, 20 nt, Yersinia pestis KIM
cggccauuuuuuaccauuac

SEQ ID NO: 4217499 - RNA, 18 nt, Yersinia pestis KIM
cggcccaauauugaucca

SEQ ID NO: 4217500 - RNA, 20 nt, Yersinia pestis KIM
cggcccacuuuuugaauaau

SEQ ID NO: 4217501 - RNA, 23 nt, Yersinia pestis KIM
cggcccagauauccauauucacc

SEQ ID NO: 4217502 - RNA, 21 nt, Yersinia pestis KIM
cggcccauccaugggccucgc

SEQ ID NO: 4217503 - RNA, 23 nt, Yersinia pestis KIM
cggcccauccaugggccucgcuu

SEQ ID NO: 4217504 - RNA, 14 nt, Yersinia pestis KIM
cggcccggccaggc

SEQ ID NO: 4217505 - RNA, 17 nt, Yersinia pestis KIM
cggccuaucaucaccau

SEQ ID NO: 4217506 - RNA, 12 nt, Yersinia pestis KIM
cggccugccaga

SEQ ID NO: 4217507 - RNA, 20 nt, Yersinia pestis KIM
cggccuuucguuucugucug

SEQ ID NO: 4217508 - RNA, 23 nt, Yersinia pestis KIM
cggcgaaagcauggcagguauca

SEQ ID NO: 4217509 - RNA, 20 nt, Yersinia pestis KIM
cggcgaagggcgcagccccc

SEQ ID NO: 4217510 - RNA, 15 nt, Yersinia pestis KIM
cggcgacuuacgucg

SEQ ID NO: 4217511 - RNA, 15 nt, Yersinia pestis KIM
cggcgagcacugccc

SEQ ID NO: 4217512 - RNA, 17 nt, Yersinia pestis KIM
cggcgagcacugccccg

SEQ ID NO: 4217513 - RNA, 16 nt, Yersinia pestis KIM
cggcgaguucgauaau

SEQ ID NO: 4217514 - RNA, 13 nt, Yersinia pestis KIM
cggcgauccgccc

SEQ ID NO: 4217515 - RNA, 17 nt, Yersinia pestis KIM
cggcgaugaaaaacaga

SEQ ID NO: 4217516 - RNA, 21 nt, Yersinia pestis KIM
cggcgcgcuugccacgccagu

SEQ ID NO: 4217517 - RNA, 16 nt, Yersinia pestis KIM
cggcggagagaaauag

SEQ ID NO: 4217518 - RNA, 17 nt, Yersinia pestis KIM
cggcggcgagcacugcc

SEQ ID NO: 4217519 - RNA, 19 nt, Yersinia pestis KIM
cggcggcgagcacugcccc

SEQ ID NO: 4217520 - RNA, 15 nt, Yersinia pestis KIM
cggcggcgcuggcgu

SEQ ID NO: 4217521 - RNA, 22 nt, Yersinia pestis KIM
cggcggcgcuggcguaaaauau

SEQ ID NO: 4217522 - RNA, 13 nt, Yersinia pestis KIM
cggcggcuuuauu

SEQ ID NO: 4217523 - RNA, 15 nt, Yersinia pestis KIM
cggcgucaaggacgc

SEQ ID NO: 4217524 - RNA, 15 nt, Yersinia pestis KIM
cggcgucagccgcga

SEQ ID NO: 4217525 - RNA, 18 nt, Yersinia pestis KIM
cggcgucgccaccccauu

SEQ ID NO: 4217526 - RNA, 18 nt, Yersinia pestis KIM
cggcguuaaugccacccc

SEQ ID NO: 4217527 - RNA, 20 nt, Yersinia pestis KIM
cggcuaaugagcucacuuga

SEQ ID NO: 4217528 - RNA, 21 nt, Yersinia pestis KIM
cggcuacuguuuugguuuccg

SEQ ID NO: 4217529 - RNA, 19 nt, Yersinia pestis KIM
cggcuagccaccucacuca

SEQ ID NO: 4217530 - RNA, 16 nt, Yersinia pestis KIM
cggcuagcguuaugcu

SEQ ID NO: 4217531 - RNA, 20 nt, Yersinia pestis KIM
cggcuaugugaaugcaguca

SEQ ID NO: 4217532 - RNA, 11 nt, Yersinia pestis KIM
cggcuauuuuu

SEQ ID NO: 4217533 - RNA, 20 nt, Yersinia pestis KIM
cggcucacacacuaauaaua

SEQ ID NO: 4217534 - RNA, 17 nt, Yersinia pestis KIM
cggcucaccuggccucc

SEQ ID NO: 4217535 - RNA, 14 nt, Yersinia pestis KIM
cggcucauccgcca

SEQ ID NO: 4217536 - RNA, 15 nt, Yersinia pestis KIM
cggcuccaggcauua

SEQ ID NO: 4217537 - RNA, 19 nt, Yersinia pestis KIM
cggcucgcccacggcacau

SEQ ID NO: 4217538 - RNA, 17 nt, Yersinia pestis KIM
cggcugaccacaaaaac

SEQ ID NO: 4217539 - RNA, 22 nt, Yersinia pestis KIM
cggcugaccacaaaaacagugu

SEQ ID NO: 4217540 - RNA, 13 nt, Yersinia pestis KIM
cggcugcaauaag

SEQ ID NO: 4217541 - RNA, 17 nt, Yersinia pestis KIM
cggcugggaacccauca

SEQ ID NO: 4217542 - RNA, 17 nt, Yersinia pestis KIM
cggcuggucaucacgcu

SEQ ID NO: 4217543 - RNA, 17 nt, Yersinia pestis KIM
cgguuaauugaauugcc

SEQ ID NO: 4217544 - RNA, 16 nt, Yersinia pestis KIM
cgguuacuuccauaaa

SEQ ID NO: 4217545 - RNA, 15 nt, Yersinia pestis KIM
cgguuaucuggaauu

SEQ ID NO: 4217546 - RNA, 17 nt, Yersinia pestis KIM
cgguuauucguggugau

SEQ ID NO: 4217547 - RNA, 14 nt, Yersinia pestis KIM
cgguuccaaagcac

SEQ ID NO: 4217548 - RNA, 18 nt, Yersinia pestis KIM
cgguuccaaagcaccaac

SEQ ID NO: 4217549 - RNA, 16 nt, Yersinia pestis KIM
cgguucccaugacgau

SEQ ID NO: 4217550 - RNA, 15 nt, Yersinia pestis KIM
cgguucggauaaaua

SEQ ID NO: 4217551 - RNA, 22 nt, Yersinia pestis KIM
cgguucgucaugaugcucaccg

SEQ ID NO: 4217552 - RNA, 23 nt, Yersinia pestis KIM
cgguucgucaugaugcucaccgc

SEQ ID NO: 4217553 - RNA, 18 nt, Yersinia pestis KIM
cgguugacguuugccaaa

SEQ ID NO: 4217554 - RNA, 13 nt, Yersinia pestis KIM
cgguugccgccuu

SEQ ID NO: 4217555 - RNA, 13 nt, Yersinia pestis KIM
cgguuguggcugc

SEQ ID NO: 4217556 - RNA, 15 nt, Yersinia pestis KIM
cgguuguggcugcca

SEQ ID NO: 4217557 - RNA, 23 nt, Yersinia pestis KIM
cgguuuaccggggcgaucccuga

SEQ ID NO: 4217558 - RNA, 21 nt, Yersinia pestis KIM
cgguuucaaccccuucuucac

SEQ ID NO: 4217559 - RNA, 16 nt, Yersinia pestis KIM
cgguuucagcuugcaa

SEQ ID NO: 4217560 - RNA, 18 nt, Yersinia pestis KIM
cgguuucagugccaauaa

SEQ ID NO: 4217561 - RNA, 18 nt, Yersinia pestis KIM
cgguuucgcaucaggcuu

SEQ ID NO: 4217562 - RNA, 19 nt, Yersinia pestis KIM
cgguuucgcaucaggcuua

SEQ ID NO: 4217563 - RNA, 22 nt, Yersinia pestis KIM
cgguuugaaccgccugaggccu

SEQ ID NO: 4217564 - RNA, 19 nt, Yersinia pestis KIM
cgguuugagcuugcugcug

SEQ ID NO: 4217565 - RNA, 13 nt, Yersinia pestis KIM
cgguuugccauca

SEQ ID NO: 4217566 - RNA, 16 nt, Yersinia pestis KIM
cgguuugggcaucaac

SEQ ID NO: 4217567 - RNA, 14 nt, Yersinia pestis KIM
cgguuuuaaauaca

SEQ ID NO: 4217568 - RNA, 15 nt, Yersinia pestis KIM
cgguuuuaucaauag

SEQ ID NO: 4217569 - RNA, 20 nt, Yersinia pestis KIM
cgguuuucacccccacauca

SEQ ID NO: 4217570 - RNA, 12 nt, Yersinia pestis KIM
cguaaaaagcag

SEQ ID NO: 4217571 - RNA, 13 nt, Yersinia pestis KIM
cguaaacacaaaa

SEQ ID NO: 4217572 - RNA, 15 nt, Yersinia pestis KIM
cguaaacacaaaaua

SEQ ID NO: 4217573 - RNA, 15 nt, Yersinia pestis KIM
cguaaacaucuuuug

SEQ ID NO: 4217574 - RNA, 23 nt, Yersinia pestis KIM
cguaaacauggcucucuuuuuuc

SEQ ID NO: 4217575 - RNA, 18 nt, Yersinia pestis KIM
cguaaacguucugccaau

SEQ ID NO: 4217576 - RNA, 15 nt, Yersinia pestis KIM
cguaaagaaaaaaug

SEQ ID NO: 4217577 - RNA, 14 nt, Yersinia pestis KIM
cguaaagacgccgg

SEQ ID NO: 4217578 - RNA, 11 nt, Yersinia pestis KIM
cguaaagcacc

SEQ ID NO: 4217579 - RNA, 11 nt, Yersinia pestis KIM
cguaaauacau

SEQ ID NO: 4217580 - RNA, 17 nt, Yersinia pestis KIM
cguaaaucauagccagc

SEQ ID NO: 4217581 - RNA, 14 nt, Yersinia pestis KIM
cguaaauuuauuua

SEQ ID NO: 4217582 - RNA, 20 nt, Yersinia pestis KIM
cguaacccaucacccgcagu

SEQ ID NO: 4217583 - RNA, 19 nt, Yersinia pestis KIM
cguaagccgugccugcugg

SEQ ID NO: 4217584 - RNA, 22 nt, Yersinia pestis KIM
cguaagcgguuuguuaaaaagc

SEQ ID NO: 4217585 - RNA, 23 nt, Yersinia pestis KIM
cguaagcgguuuguuaaaaagcg

SEQ ID NO: 4217586 - RNA, 21 nt, Yersinia pestis KIM
cguaauaguuaaucgcagcag

SEQ ID NO: 4217587 - RNA, 22 nt, Yersinia pestis KIM
cguaaucguauucucaauggcu

SEQ ID NO: 4217588 - RNA, 17 nt, Yersinia pestis KIM
cguaaugaugaugagua

SEQ ID NO: 4217589 - RNA, 17 nt, Yersinia pestis KIM
cguaauuauuguucaaa

SEQ ID NO: 4217590 - RNA, 14 nt, Yersinia pestis KIM
cguaauucagauaa

SEQ ID NO: 4217591 - RNA, 15 nt, Yersinia pestis KIM
cguaauuuacuggua

SEQ ID NO: 4217592 - RNA, 19 nt, Yersinia pestis KIM
cguacaacaauaauaagcc

SEQ ID NO: 4217593 - RNA, 16 nt, Yersinia pestis KIM
cguacauauaucacua

SEQ ID NO: 4217594 - RNA, 14 nt, Yersinia pestis KIM
cguacaucagggug

SEQ ID NO: 4217595 - RNA, 13 nt, Yersinia pestis KIM
cguacauuaaaug

SEQ ID NO: 4217596 - RNA, 17 nt, Yersinia pestis KIM
cguacauuaaaugaaua

SEQ ID NO: 4217597 - RNA, 13 nt, Yersinia pestis KIM
cguacgacgucca

SEQ ID NO: 4217598 - RNA, 18 nt, Yersinia pestis KIM
cguacucuucuguauaug

SEQ ID NO: 4217599 - RNA, 12 nt, Yersinia pestis KIM
cguacuuuccuu

SEQ ID NO: 4217600 - RNA, 18 nt, Yersinia pestis KIM
cguagaacgucaccgcca

SEQ ID NO: 4217601 - RNA, 18 nt, Yersinia pestis KIM
cguagacaaugacugugc

SEQ ID NO: 4217602 - RNA, 15 nt, Yersinia pestis KIM
cguagauuuucucag

SEQ ID NO: 4217603 - RNA, 17 nt, Yersinia pestis KIM
cguagcacacgacugag

SEQ ID NO: 4217604 - RNA, 22 nt, Yersinia pestis KIM
cguagccauuggguauggucag

SEQ ID NO: 4217605 - RNA, 22 nt, Yersinia pestis KIM
cguagcccuuugcuuucaggau

SEQ ID NO: 4217606 - RNA, 16 nt, Yersinia pestis KIM
cguagccguuaaauau

SEQ ID NO: 4217607 - RNA, 15 nt, Yersinia pestis KIM
cguagcgauaacaga

SEQ ID NO: 4217608 - RNA, 17 nt, Yersinia pestis KIM
cguagcuaacaccgcug

SEQ ID NO: 4217609 - RNA, 14 nt, Yersinia pestis KIM
cguagcucagcgcg

SEQ ID NO: 4217610 - RNA, 17 nt, Yersinia pestis KIM
cguaggcaacuaagcug

SEQ ID NO: 4217611 - RNA, 19 nt, Yersinia pestis KIM
cguaggcaacuaagcugcc

SEQ ID NO: 4217612 - RNA, 12 nt, Yersinia pestis KIM
cguaggccaacc

SEQ ID NO: 4217613 - RNA, 12 nt, Yersinia pestis KIM
cguaggcugacc

SEQ ID NO: 4217614 - RNA, 14 nt, Yersinia pestis KIM
cguagggauaaauc

SEQ ID NO: 4217615 - RNA, 12 nt, Yersinia pestis KIM
cguagguaauua

SEQ ID NO: 4217616 - RNA, 14 nt, Yersinia pestis KIM
cguauaaaacugug

SEQ ID NO: 4217617 - RNA, 15 nt, Yersinia pestis KIM
cguauagauuauuuu

SEQ ID NO: 4217618 - RNA, 23 nt, Yersinia pestis KIM
cguaucacccgccucuaaaucug

SEQ ID NO: 4217619 - RNA, 14 nt, Yersinia pestis KIM
cguauccgcuuuga

SEQ ID NO: 4217620 - RNA, 14 nt, Yersinia pestis KIM
cguaucguccugcu

SEQ ID NO: 4217621 - RNA, 16 nt, Yersinia pestis KIM
cguauggcaugacuua

SEQ ID NO: 4217622 - RNA, 22 nt, Yersinia pestis KIM
cguauuaaaccagugcgccgua

SEQ ID NO: 4217623 - RNA, 12 nt, Yersinia pestis KIM
cguauucacugu

SEQ ID NO: 4217624 - RNA, 14 nt, Yersinia pestis KIM
cguauucagcacug

SEQ ID NO: 4217625 - RNA, 12 nt, Yersinia pestis KIM
cgucaaaacuau

SEQ ID NO: 4217626 - RNA, 18 nt, Yersinia pestis KIM
cgucaagacaacaaacag

SEQ ID NO: 4217627 - RNA, 19 nt, Yersinia pestis KIM
cgucaagacaacaaacagu

SEQ ID NO: 4217628 - RNA, 17 nt, Yersinia pestis KIM
cgucaagccaaccccca

SEQ ID NO: 4217629 - RNA, 18 nt, Yersinia pestis KIM
cgucaauucacugcuagu

SEQ ID NO: 4217630 - RNA, 18 nt, Yersinia pestis KIM
cgucaccacaaaggucag

SEQ ID NO: 4217631 - RNA, 12 nt, Yersinia pestis KIM
cgucaccaucaa

SEQ ID NO: 4217632 - RNA, 23 nt, Yersinia pestis KIM
cgucaccaucaauauaagagaaa

SEQ ID NO: 4217633 - RNA, 18 nt, Yersinia pestis KIM
cgucaccgccaaaauaaa

SEQ ID NO: 4217634 - RNA, 19 nt, Yersinia pestis KIM
cgucaccgccaaaauaaac

SEQ ID NO: 4217635 - RNA, 16 nt, Yersinia pestis KIM
cgucaccguguucaug

SEQ ID NO: 4217636 - RNA, 19 nt, Yersinia pestis KIM
cgucacggcgcuccaucag

SEQ ID NO: 4217637 - RNA, 21 nt, Yersinia pestis KIM
cgucacgguauuggagcugaa

SEQ ID NO: 4217638 - RNA, 14 nt, Yersinia pestis KIM
cgucacuaaaucca

SEQ ID NO: 4217639 - RNA, 12 nt, Yersinia pestis KIM
cgucacuuccau

SEQ ID NO: 4217640 - RNA, 12 nt, Yersinia pestis KIM
cgucagauuagu

SEQ ID NO: 4217641 - RNA, 15 nt, Yersinia pestis KIM
cgucagccccugcca

SEQ ID NO: 4217642 - RNA, 20 nt, Yersinia pestis KIM
cgucagguaaguagaaugca

SEQ ID NO: 4217643 - RNA, 21 nt, Yersinia pestis KIM
cgucagucuugcugccaacgc

SEQ ID NO: 4217644 - RNA, 19 nt, Yersinia pestis KIM
cgucagugcgguaaccagc

SEQ ID NO: 4217645 - RNA, 16 nt, Yersinia pestis KIM
cgucauaaauaaagau

SEQ ID NO: 4217646 - RNA, 21 nt, Yersinia pestis KIM
cgucauaccauucucugucuu

SEQ ID NO: 4217647 - RNA, 13 nt, Yersinia pestis KIM
cgucaucaucuuc

SEQ ID NO: 4217648 - RNA, 14 nt, Yersinia pestis KIM
cgucauccagcacu

SEQ ID NO: 4217649 - RNA, 15 nt, Yersinia pestis KIM
cgucaucgaacccgc

SEQ ID NO: 4217650 - RNA, 18 nt, Yersinia pestis KIM
cgucaugcugaaucugua

SEQ ID NO: 4217651 - RNA, 22 nt, Yersinia pestis KIM
cgucauuaugcauuucguucca

SEQ ID NO: 4217652 - RNA, 15 nt, Yersinia pestis KIM
cgucauucuuugcca

SEQ ID NO: 4217653 - RNA, 21 nt, Yersinia pestis KIM
cgucauugaggguugucagca

SEQ ID NO: 4217654 - RNA, 21 nt, Yersinia pestis KIM
cgucauugccagugaacccgc

SEQ ID NO: 4217655 - RNA, 21 nt, Yersinia pestis KIM
cgucauugguguuacagcaag

SEQ ID NO: 4217656 - RNA, 21 nt, Yersinia pestis KIM
cguccagaacaauaccgccaa

SEQ ID NO: 4217657 - RNA, 12 nt, Yersinia pestis KIM
cguccagaugcc

SEQ ID NO: 4217658 - RNA, 14 nt, Yersinia pestis KIM
cguccagaugccaa

SEQ ID NO: 4217659 - RNA, 13 nt, Yersinia pestis KIM
cguugcaggucaa

SEQ ID NO: 4217660 - RNA, 17 nt, Yersinia pestis KIM
cguugccccaucagcac

SEQ ID NO: 4217661 - RNA, 18 nt, Yersinia pestis KIM
cguugccccaucagcacu

SEQ ID NO: 4217662 - RNA, 20 nt, Yersinia pestis KIM
cguuggaucaucgggaacag

SEQ ID NO: 4217663 - RNA, 19 nt, Yersinia pestis KIM
cguuggccggccaacaucg

SEQ ID NO: 4217664 - RNA, 19 nt, Yersinia pestis KIM
cguuguauuagccgccagu

SEQ ID NO: 4217665 - RNA, 15 nt, Yersinia pestis KIM
cguugucagccaugc

SEQ ID NO: 4217666 - RNA, 18 nt, Yersinia pestis KIM
cguuguuaucaucaccac

SEQ ID NO: 4217667 - RNA, 19 nt, Yersinia pestis KIM
cguuguuaucaucaccacc

SEQ ID NO: 4217668 - RNA, 20 nt, Yersinia pestis KIM
cguuguuaucaucaccaccc

SEQ ID NO: 4217669 - RNA, 17 nt, Yersinia pestis KIM
cguuguuggcacaacug

SEQ ID NO: 4217670 - RNA, 15 nt, Yersinia pestis KIM
cguuuaaaaaauauc

SEQ ID NO: 4217671 - RNA, 11 nt, Yersinia pestis KIM
cguuuaaauaa

SEQ ID NO: 4217672 - RNA, 13 nt, Yersinia pestis KIM
cguuuaaauaaaa

SEQ ID NO: 4217673 - RNA, 22 nt, Yersinia pestis KIM
cguuuaaauaagcuaucauuaa

SEQ ID NO: 4217674 - RNA, 17 nt, Yersinia pestis KIM
cguuuacgauaagccgc

SEQ ID NO: 4217675 - RNA, 23 nt, Yersinia pestis KIM
cguuuacugaucucaucaaacac

SEQ ID NO: 4217676 - RNA, 15 nt, Yersinia pestis KIM
cguuuccagcggcgu

SEQ ID NO: 4217677 - RNA, 13 nt, Yersinia pestis KIM
cguuuccccuuca

SEQ ID NO: 4217678 - RNA, 22 nt, Yersinia pestis KIM
cguuugccaaaauccaccagcg

SEQ ID NO: 4217679 - RNA, 18 nt, Yersinia pestis KIM
cguuuuaaugccaauuga

SEQ ID NO: 4217680 - RNA, 18 nt, Yersinia pestis KIM
cguuuugcagaucaaucg

SEQ ID NO: 4217681 - RNA, 18 nt, Yersinia pestis KIM
cguuuuuaccugauuccu

SEQ ID NO: 4217682 - RNA, 15 nt, Yersinia pestis KIM
cguuuuugaaauacc

SEQ ID NO: 4217683 - RNA, 19 nt, Yersinia pestis KIM
cguuuuugguuaaagaaga

SEQ ID NO: 4217684 - RNA, 16 nt, Yersinia pestis KIM
cguuuuuuugccagug

SEQ ID NO: 4217685 - RNA, 20 nt, Yersinia pestis KIM
cuaaaaacucgcgccugaaa

SEQ ID NO: 4217686 - RNA, 12 nt, Yersinia pestis KIM
cuaaaacugaag

SEQ ID NO: 4217687 - RNA, 15 nt, Yersinia pestis KIM
cuaaaagcuaaaaau

SEQ ID NO: 4217688 - RNA, 21 nt, Yersinia pestis KIM
cuaaaaggauagggagccaau

SEQ ID NO: 4217689 - RNA, 19 nt, Yersinia pestis KIM
cuaaaauaucacuauaauu

SEQ ID NO: 4217690 - RNA, 17 nt, Yersinia pestis KIM
cuaaaaugaauaacgcc

SEQ ID NO: 4217691 - RNA, 18 nt, Yersinia pestis KIM
cuaaaaugaucuuuauua

SEQ ID NO: 4217692 - RNA, 14 nt, Yersinia pestis KIM
cuaaaauuaagccg

SEQ ID NO: 4217693 - RNA, 13 nt, Yersinia pestis KIM
cuaaaauuuuaag

SEQ ID NO: 4217694 - RNA, 16 nt, Yersinia pestis KIM
cuaaacagggcagaaa

SEQ ID NO: 4217695 - RNA, 21 nt, Yersinia pestis KIM
cuaaacagggcagaaaauacc

SEQ ID NO: 4217696 - RNA, 9 nt, Yersinia pestis KIM
cuaaaccac

SEQ ID NO: 4217697 - RNA, 21 nt, Yersinia pestis KIM
cuaaacgccgcgucaauaaca

SEQ ID NO: 4217698 - RNA, 22 nt, Yersinia pestis KIM
cuaaacggcccugugaaucuuu

SEQ ID NO: 4217699 - RNA, 16 nt, Yersinia pestis KIM
cuaaacugaucaucaa

SEQ ID NO: 4217700 - RNA, 21 nt, Yersinia pestis KIM
cuaaagaaauaaucauaucaa

SEQ ID NO: 4217701 - RNA, 16 nt, Yersinia pestis KIM
cuaaagauaauuaauu

SEQ ID NO: 4217702 - RNA, 14 nt, Yersinia pestis KIM
cuaaagcaaagauc

SEQ ID NO: 4217703 - RNA, 18 nt, Yersinia pestis KIM
cuaaagcgccuuccuuuu

SEQ ID NO: 4217704 - RNA, 23 nt, Yersinia pestis KIM
cuaaagcguaagugcaauuauuu

SEQ ID NO: 4217705 - RNA, 14 nt, Yersinia pestis KIM
cuaaagcugucagu

SEQ ID NO: 4217706 - RNA, 23 nt, Yersinia pestis KIM
cuaaaguguacuguuaacucaug

SEQ ID NO: 4217707 - RNA, 13 nt, Yersinia pestis KIM
cuaaauaauucca

SEQ ID NO: 4217708 - RNA, 18 nt, Yersinia pestis KIM
cuaaauccugcaaauuaa

SEQ ID NO: 4217709 - RNA, 22 nt, Yersinia pestis KIM
cuaaaugacauauugugcuauc

SEQ ID NO: 4217710 - RNA, 17 nt, Yersinia pestis KIM
cuaaauucuccuugagc

SEQ ID NO: 4217711 - RNA, 17 nt, Yersinia pestis KIM
cuaaauugcuuaaaaaa

SEQ ID NO: 4217712 - RNA, 14 nt, Yersinia pestis KIM
cuaaauuguacauu

SEQ ID NO: 4217713 - RNA, 21 nt, Yersinia pestis KIM
cuaaauuuuguacaacuucuu

SEQ ID NO: 4217714 - RNA, 14 nt, Yersinia pestis KIM
cuaacaaaccuaaa

SEQ ID NO: 4217715 - RNA, 16 nt, Yersinia pestis KIM
cuaacaacaauuuacg

SEQ ID NO: 4217716 - RNA, 22 nt, Yersinia pestis KIM
cuaacacgaccuucaucucuga

SEQ ID NO: 4217717 - RNA, 13 nt, Yersinia pestis KIM
cuaacagcagugc

SEQ ID NO: 4217718 - RNA, 20 nt, Yersinia pestis KIM
cuaacaguuguuucaauaaa

SEQ ID NO: 4217719 - RNA, 21 nt, Yersinia pestis KIM
cuaacauacucagaucguuaa

SEQ ID NO: 4217720 - RNA, 17 nt, Yersinia pestis KIM
cuaacaugccagccugu

SEQ ID NO: 4217721 - RNA, 14 nt, Yersinia pestis KIM
cuaaccaaacauug

SEQ ID NO: 4217722 - RNA, 21 nt, Yersinia pestis KIM
cuaaccaaacauuguuaccua

SEQ ID NO: 4217723 - RNA, 21 nt, Yersinia pestis KIM
cuaaccaccgucaccaaauau

SEQ ID NO: 4217724 - RNA, 15 nt, Yersinia pestis KIM
cuaacccauugguuu

SEQ ID NO: 4217725 - RNA, 22 nt, Yersinia pestis KIM
cuaaccgaagauaaccggcugg

SEQ ID NO: 4217726 - RNA, 24 nt, Yersinia pestis KIM
cuaaccgcacugggucaucaccca

SEQ ID NO: 4217727 - RNA, 15 nt, Yersinia pestis KIM
cuaaccuuaacugca

SEQ ID NO: 4217728 - RNA, 14 nt, Yersinia pestis KIM
cuaacgagaaaguc

SEQ ID NO: 4217729 - RNA, 22 nt, Yersinia pestis KIM
cuaacggcagcuuccugugaaa

SEQ ID NO: 4217730 - RNA, 14 nt, Yersinia pestis KIM
cuaacgucaacaga

SEQ ID NO: 4217731 - RNA, 16 nt, Yersinia pestis KIM
cuaacgucaacagaac

SEQ ID NO: 4217732 - RNA, 18 nt, Yersinia pestis KIM
cuaacguccccugagcga

SEQ ID NO: 4217733 - RNA, 21 nt, Yersinia pestis KIM
cuaacguuaaaaggcaccuca

SEQ ID NO: 4217734 - RNA, 12 nt, Yersinia pestis KIM
cuaacucuucug

SEQ ID NO: 4217735 - RNA, 16 nt, Yersinia pestis KIM
cuaacugaugcugaca

SEQ ID NO: 4217736 - RNA, 20 nt, Yersinia pestis KIM
cuaacugugccaaugccucu

SEQ ID NO: 4217737 - RNA, 16 nt, Yersinia pestis KIM
cuaagaaucggccagu

SEQ ID NO: 4217738 - RNA, 22 nt, Yersinia pestis KIM
cuaagacgccauuaauaauaaa

SEQ ID NO: 4217739 - RNA, 14 nt, Yersinia pestis KIM
cuaagacuguuuua

SEQ ID NO: 4217740 - RNA, 17 nt, Yersinia pestis KIM
cuaagagucacagcauu

SEQ ID NO: 4217741 - RNA, 15 nt, Yersinia pestis KIM
cuaagccggucuuuu

SEQ ID NO: 4217742 - RNA, 19 nt, Yersinia pestis KIM
cuaagcucuuccaauagca

SEQ ID NO: 4217743 - RNA, 13 nt, Yersinia pestis KIM
cuaagcugccugu

SEQ ID NO: 4217744 - RNA, 23 nt, Yersinia pestis KIM
cuaagcugccugugcggcaguga

SEQ ID NO: 4217745 - RNA, 18 nt, Yersinia pestis KIM
cuaaggguaaaaucccca

SEQ ID NO: 4217746 - RNA, 14 nt, Yersinia pestis KIM
cuaaguaaaacaaa

SEQ ID NO: 4217747 - RNA, 17 nt, Yersinia pestis KIM
cuaaguccaagacagaa

SEQ ID NO: 4217748 - RNA, 17 nt, Yersinia pestis KIM
cuaaguuaacaccauca

SEQ ID NO: 4217749 - RNA, 21 nt, Yersinia pestis KIM
cuaaguuaacaccaucaacau

SEQ ID NO: 4217750 - RNA, 14 nt, Yersinia pestis KIM
cuaauaaaauggcu

SEQ ID NO: 4217751 - RNA, 21 nt, Yersinia pestis KIM
cuaauaauaaugcgccuugcu

SEQ ID NO: 4217752 - RNA, 15 nt, Yersinia pestis KIM
cuaauaauuguucau

SEQ ID NO: 4217753 - RNA, 15 nt, Yersinia pestis KIM
cuaauaauuuauaca

SEQ ID NO: 4217754 - RNA, 14 nt, Yersinia pestis KIM
cuaauagcauuuuu

SEQ ID NO: 4217755 - RNA, 16 nt, Yersinia pestis KIM
cuaauaucaacagaac

SEQ ID NO: 4217756 - RNA, 17 nt, Yersinia pestis KIM
cuaauauuuauaaaaaa

SEQ ID NO: 4217757 - RNA, 13 nt, Yersinia pestis KIM
cuaaucauaucca

SEQ ID NO: 4217758 - RNA, 21 nt, Yersinia pestis KIM
cuaaucauuuauuuuuccagg

SEQ ID NO: 4217759 - RNA, 22 nt, Yersinia pestis KIM
cuaaucgguaugaccagugaau

SEQ ID NO: 4217760 - RNA, 14 nt, Yersinia pestis KIM
cuaaugaacgagua

SEQ ID NO: 4217761 - RNA, 17 nt, Yersinia pestis KIM
cuaaugccgagaacaga

SEQ ID NO: 4217762 - RNA, 21 nt, Yersinia pestis KIM
cuaaugccgcgcccccagcca

SEQ ID NO: 4217763 - RNA, 20 nt, Yersinia pestis KIM
cuaauggccagacacugaca

SEQ ID NO: 4217764 - RNA, 16 nt, Yersinia pestis KIM
cuaaugucucuauuca

SEQ ID NO: 4217765 - RNA, 18 nt, Yersinia pestis KIM
cuaauuaaagacgcauga

SEQ ID NO: 4217766 - RNA, 23 nt, Yersinia pestis KIM
cuaauuauuuuauuuaaaauuaa

SEQ ID NO: 4217767 - RNA, 18 nt, Yersinia pestis KIM
cuaauucaggcaaauucu

SEQ ID NO: 4217768 - RNA, 20 nt, Yersinia pestis KIM
cuaauucaggcaaauucuca

SEQ ID NO: 4217769 - RNA, 21 nt, Yersinia pestis KIM
cuaauucuggguacaacacaa

SEQ ID NO: 4217770 - RNA, 13 nt, Yersinia pestis KIM
cuaauugauauua

SEQ ID NO: 4217771 - RNA, 17 nt, Yersinia pestis KIM
cuaauuguuauuauuaa

SEQ ID NO: 4217772 - RNA, 14 nt, Yersinia pestis KIM
cuacaaaaauaguu

SEQ ID NO: 4217773 - RNA, 15 nt, Yersinia pestis KIM
cuacaauaucuuccc

SEQ ID NO: 4217774 - RNA, 16 nt, Yersinia pestis KIM
cuauucucuguaaugg

SEQ ID NO: 4217775 - RNA, 13 nt, Yersinia pestis KIM
cuauugaaaaaau

SEQ ID NO: 4217776 - RNA, 13 nt, Yersinia pestis KIM
cuauugaccacca

SEQ ID NO: 4217777 - RNA, 17 nt, Yersinia pestis KIM
cuauugauaaaaccacu

SEQ ID NO: 4217778 - RNA, 22 nt, Yersinia pestis KIM
cuauugauaaaaccacugaccu

SEQ ID NO: 4217779 - RNA, 15 nt, Yersinia pestis KIM
cuauugauaaaaccg

SEQ ID NO: 4217780 - RNA, 21 nt, Yersinia pestis KIM
cuauugauguuaacucagcca

SEQ ID NO: 4217781 - RNA, 23 nt, Yersinia pestis KIM
cuauugauguuaacucagccaca

SEQ ID NO: 4217782 - RNA, 13 nt, Yersinia pestis KIM
cuauugcgacggu

SEQ ID NO: 4217783 - RNA, 15 nt, Yersinia pestis KIM
cuauugugucaauac

SEQ ID NO: 4217784 - RNA, 16 nt, Yersinia pestis KIM
cuauugugucaauacc

SEQ ID NO: 4217785 - RNA, 18 nt, Yersinia pestis KIM
cuauugugucaauaccuu

SEQ ID NO: 4217786 - RNA, 17 nt, Yersinia pestis KIM
cuauuguuacuuuuaau

SEQ ID NO: 4217787 - RNA, 13 nt, Yersinia pestis KIM
cuauuuaaauaca

SEQ ID NO: 4217788 - RNA, 16 nt, Yersinia pestis KIM
cuauuuacucucuuug

SEQ ID NO: 4217789 - RNA, 19 nt, Yersinia pestis KIM
cuauuuacugcauucugag

SEQ ID NO: 4217790 - RNA, 14 nt, Yersinia pestis KIM
cuauuuauuaaucu

SEQ ID NO: 4217791 - RNA, 16 nt, Yersinia pestis KIM
cuauuuauugccauuu

SEQ ID NO: 4217792 - RNA, 19 nt, Yersinia pestis KIM
cuauuuauuuauaaaacca

SEQ ID NO: 4217793 - RNA, 21 nt, Yersinia pestis KIM
cuauuuauuuauaaaaccacu

SEQ ID NO: 4217794 - RNA, 16 nt, Yersinia pestis KIM
cuauuuauuuuaucug

SEQ ID NO: 4217795 - RNA, 17 nt, Yersinia pestis KIM
cuauuuauuuuaucugu

SEQ ID NO: 4217796 - RNA, 23 nt, Yersinia pestis KIM
cuauuucagggcguauaaacaga

SEQ ID NO: 4217797 - RNA, 14 nt, Yersinia pestis KIM
cuauuuccccgccg

SEQ ID NO: 4217798 - RNA, 14 nt, Yersinia pestis KIM
cuauuuccgaaagc

SEQ ID NO: 4217799 - RNA, 17 nt, Yersinia pestis KIM
cuauuuccgaaagcgcc

SEQ ID NO: 4217800 - RNA, 13 nt, Yersinia pestis KIM
cuauuucuucaua

SEQ ID NO: 4217801 - RNA, 15 nt, Yersinia pestis KIM
cuauuugaugcuaac

SEQ ID NO: 4217802 - RNA, 23 nt, Yersinia pestis KIM
cuauuuuauaucgaucugauauc

SEQ ID NO: 4217803 - RNA, 19 nt, Yersinia pestis KIM
cuauuuuuauaaucaucua

SEQ ID NO: 4217804 - RNA, 15 nt, Yersinia pestis KIM
cuauuuuuauacagg

SEQ ID NO: 4217805 - RNA, 19 nt, Yersinia pestis KIM
cuauuuuuauuucuccuua

SEQ ID NO: 4217806 - RNA, 21 nt, Yersinia pestis KIM
cuauuuuuauuucuccuuacu

SEQ ID NO: 4217807 - RNA, 23 nt, Yersinia pestis KIM
cucaaaacaauuucgaaaacuca

SEQ ID NO: 4217808 - RNA, 22 nt, Yersinia pestis KIM
cucaaaacggcaauuaagcaaa

SEQ ID NO: 4217809 - RNA, 19 nt, Yersinia pestis KIM
cucaaaaggauggcccaag

SEQ ID NO: 4217810 - RNA, 20 nt, Yersinia pestis KIM
cucaaacaugagcgcaugcc

SEQ ID NO: 4217811 - RNA, 17 nt, Yersinia pestis KIM
cucaaacugauaaagca

SEQ ID NO: 4217812 - RNA, 19 nt, Yersinia pestis KIM
cucaaacugauaaagcaaa

SEQ ID NO: 4217813 - RNA, 22 nt, Yersinia pestis KIM
cucaaauagauagcaaucaaua

SEQ ID NO: 4217814 - RNA, 14 nt, Yersinia pestis KIM
cucaaccgcuggca

SEQ ID NO: 4217815 - RNA, 11 nt, Yersinia pestis KIM
cucaacggcac

SEQ ID NO: 4217816 - RNA, 22 nt, Yersinia pestis KIM
cucaacguauucccgcuaccga

SEQ ID NO: 4217817 - RNA, 14 nt, Yersinia pestis KIM
cucaacucaaaaca

SEQ ID NO: 4217818 - RNA, 16 nt, Yersinia pestis KIM
cucaacucaaaacaau

SEQ ID NO: 4217819 - RNA, 15 nt, Yersinia pestis KIM
cucaacugcucaacu

SEQ ID NO: 4217820 - RNA, 17 nt, Yersinia pestis KIM
cucaacugcucaacugc

SEQ ID NO: 4217821 - RNA, 15 nt, Yersinia pestis KIM
cucaagccucuagga

SEQ ID NO: 4217822 - RNA, 20 nt, Yersinia pestis KIM
cucaagcguacaucagggug

SEQ ID NO: 4217823 - RNA, 19 nt, Yersinia pestis KIM
cucaagcuggccagugaga

SEQ ID NO: 4217824 - RNA, 13 nt, Yersinia pestis KIM
cucaauauauucu

SEQ ID NO: 4217825 - RNA, 19 nt, Yersinia pestis KIM
cucaauaugcaguuuuccu

SEQ ID NO: 4217826 - RNA, 23 nt, Yersinia pestis KIM
cucaauaugcaguuuuccucccu

SEQ ID NO: 4217827 - RNA, 22 nt, Yersinia pestis KIM
cucaaucggcugguaacugagu

SEQ ID NO: 4217828 - RNA, 15 nt, Yersinia pestis KIM
cucaaucucugccug

SEQ ID NO: 4217829 - RNA, 18 nt, Yersinia pestis KIM
cucaaugcaguaaagauu

SEQ ID NO: 4217830 - RNA, 14 nt, Yersinia pestis KIM
cucaaugcuuaaca

SEQ ID NO: 4217831 - RNA, 19 nt, Yersinia pestis KIM
cucaauggcgggggcgaga

SEQ ID NO: 4217832 - RNA, 15 nt, Yersinia pestis KIM
cucaauggcuuuuuu

SEQ ID NO: 4217833 - RNA, 19 nt, Yersinia pestis KIM
cucaauggcuuuuuuacgc

SEQ ID NO: 4217834 - RNA, 18 nt, Yersinia pestis KIM
cucaauucaauacgcagg

SEQ ID NO: 4217835 - RNA, 21 nt, Yersinia pestis KIM
cucaauucaauacgcaggcgg

SEQ ID NO: 4217836 - RNA, 12 nt, Yersinia pestis KIM
cucaauugacug

SEQ ID NO: 4217837 - RNA, 18 nt, Yersinia pestis KIM
cucaauuugguauuggcu

SEQ ID NO: 4217838 - RNA, 22 nt, Yersinia pestis KIM
cucacaacuuuuauuggcauua

SEQ ID NO: 4217839 - RNA, 17 nt, Yersinia pestis KIM
cucacacacuaauaaua

SEQ ID NO: 4217840 - RNA, 20 nt, Yersinia pestis KIM
cucacccaauaagauaaaca

SEQ ID NO: 4217841 - RNA, 21 nt, Yersinia pestis KIM
cucacccauuuuauccucuuc

SEQ ID NO: 4217842 - RNA, 18 nt, Yersinia pestis KIM
cucacccgcuugucuuga

SEQ ID NO: 4217843 - RNA, 14 nt, Yersinia pestis KIM
cucaccgagcauau

SEQ ID NO: 4217844 - RNA, 20 nt, Yersinia pestis KIM
cucaccgagcauauuuuuua

SEQ ID NO: 4217845 - RNA, 16 nt, Yersinia pestis KIM
cucaccgccgaguucg

SEQ ID NO: 4217846 - RNA, 12 nt, Yersinia pestis KIM
cucaccgccuag

SEQ ID NO: 4217847 - RNA, 12 nt, Yersinia pestis KIM
cucaccucccug

SEQ ID NO: 4217848 - RNA, 14 nt, Yersinia pestis KIM
cucacgcaaagggc

SEQ ID NO: 4217849 - RNA, 18 nt, Yersinia pestis KIM
cucacggaagguugcccc

SEQ ID NO: 4217850 - RNA, 18 nt, Yersinia pestis KIM
cucacgggcuuccaucag

SEQ ID NO: 4217851 - RNA, 20 nt, Yersinia pestis KIM
cucacgguagugacucauca

SEQ ID NO: 4217852 - RNA, 16 nt, Yersinia pestis KIM
cucacguauuuucauu

SEQ ID NO: 4217853 - RNA, 18 nt, Yersinia pestis KIM
cucacguauuuucauuuu

SEQ ID NO: 4217854 - RNA, 21 nt, Yersinia pestis KIM
cucacgucaccacgcagucag

SEQ ID NO: 4217855 - RNA, 19 nt, Yersinia pestis KIM
cucacguuuagcccacugu

SEQ ID NO: 4217856 - RNA, 13 nt, Yersinia pestis KIM
cucacucaccgcc

SEQ ID NO: 4217857 - RNA, 15 nt, Yersinia pestis KIM
cucacugcuccagcc

SEQ ID NO: 4217858 - RNA, 17 nt, Yersinia pestis KIM
cucacugcuccagccaa

SEQ ID NO: 4217859 - RNA, 22 nt, Yersinia pestis KIM
cucacuggcuuuauuauaugau

SEQ ID NO: 4217860 - RNA, 17 nt, Yersinia pestis KIM
cucacuuugcauuuucu

SEQ ID NO: 4217861 - RNA, 19 nt, Yersinia pestis KIM
cucacuuuuauauccgcca

SEQ ID NO: 4217862 - RNA, 21 nt, Yersinia pestis KIM
cucacuuuuauauccgccauc

SEQ ID NO: 4217863 - RNA, 13 nt, Yersinia pestis KIM
cucagaaaauaaa

SEQ ID NO: 4217864 - RNA, 15 nt, Yersinia pestis KIM
cucagagacaucuuu

SEQ ID NO: 4217865 - RNA, 21 nt, Yersinia pestis KIM
cucagagacaucuuuaccagc

SEQ ID NO: 4217866 - RNA, 16 nt, Yersinia pestis KIM
cucagaggccuguugg

SEQ ID NO: 4217867 - RNA, 12 nt, Yersinia pestis KIM
cucagaggcgcu

SEQ ID NO: 4217868 - RNA, 18 nt, Yersinia pestis KIM
cucagauaaauucaacuu

SEQ ID NO: 4217869 - RNA, 12 nt, Yersinia pestis KIM
cucagauaucag

SEQ ID NO: 4217870 - RNA, 19 nt, Yersinia pestis KIM
cucagaugaaaaacugugc

SEQ ID NO: 4217871 - RNA, 21 nt, Yersinia pestis KIM
cucagauuuucguucggugca

SEQ ID NO: 4217872 - RNA, 22 nt, Yersinia pestis KIM
cucagcagagucgcaaaaaaua

SEQ ID NO: 4217873 - RNA, 23 nt, Yersinia pestis KIM
cucagcagagucgcaaaaaauau

SEQ ID NO: 4217874 - RNA, 22 nt, Yersinia pestis KIM
cucagcauauuguaaacuucca

SEQ ID NO: 4217875 - RNA, 15 nt, Yersinia pestis KIM
cucagcaucaccgcc

SEQ ID NO: 4217876 - RNA, 15 nt, Yersinia pestis KIM
cucagcauccuccug

SEQ ID NO: 4217877 - RNA, 14 nt, Yersinia pestis KIM
cucagccucauuca

SEQ ID NO: 4217878 - RNA, 16 nt, Yersinia pestis KIM
cucagccucauucaug

SEQ ID NO: 4217879 - RNA, 17 nt, Yersinia pestis KIM
cucagccucauucauga

SEQ ID NO: 4217880 - RNA, 16 nt, Yersinia pestis KIM
cucagccuuuuuugcu

SEQ ID NO: 4217881 - RNA, 17 nt, Yersinia pestis KIM
cucagcgacuccuggca

SEQ ID NO: 4217882 - RNA, 19 nt, Yersinia pestis KIM
cucagcgccauauccaacu

SEQ ID NO: 4217883 - RNA, 22 nt, Yersinia pestis KIM
cucagcgucacggaaagcaggu

SEQ ID NO: 4217884 - RNA, 16 nt, Yersinia pestis KIM
cucagcuucaggccaa

SEQ ID NO: 4217885 - RNA, 21 nt, Yersinia pestis KIM
cucaggauuagcuucugcuau

SEQ ID NO: 4217886 - RNA, 19 nt, Yersinia pestis KIM
cucaggcacauagcuggcu

SEQ ID NO: 4217887 - RNA, 13 nt, Yersinia pestis KIM
cucaggcccgcua

SEQ ID NO: 4217888 - RNA, 12 nt, Yersinia pestis KIM
cucaggccuugc

SEQ ID NO: 4217889 - RNA, 19 nt, Yersinia pestis KIM
cucgacucucaagcccagu

SEQ ID NO: 4217890 - RNA, 19 nt, Yersinia pestis KIM
cucgagccuacauggaugu

SEQ ID NO: 4217891 - RNA, 21 nt, Yersinia pestis KIM
cucgauaauaucgacuccuuu

SEQ ID NO: 4217892 - RNA, 22 nt, Yersinia pestis KIM
cucgauaauaucgacuccuuua

SEQ ID NO: 4217893 - RNA, 18 nt, Yersinia pestis KIM
cucgauugaauaacuucg

SEQ ID NO: 4217894 - RNA, 21 nt, Yersinia pestis KIM
cucgauugccuuuuuugaacg

SEQ ID NO: 4217895 - RNA, 22 nt, Yersinia pestis KIM
cucgcaaugaaaguggccacuc

SEQ ID NO: 4217896 - RNA, 16 nt, Yersinia pestis KIM
cucgccccgugcuacu

SEQ ID NO: 4217897 - RNA, 18 nt, Yersinia pestis KIM
cucgccccgugcuacucc

SEQ ID NO: 4217898 - RNA, 19 nt, Yersinia pestis KIM
cucgcggaaaucagcuuca

SEQ ID NO: 4217899 - RNA, 20 nt, Yersinia pestis KIM
cucgcgguucgcagcuucca

SEQ ID NO: 4217900 - RNA, 19 nt, Yersinia pestis KIM
cucgcucaacaugccagaa

SEQ ID NO: 4217901 - RNA, 17 nt, Yersinia pestis KIM
cucgcucaccacugagu

SEQ ID NO: 4217902 - RNA, 19 nt, Yersinia pestis KIM
cucgcucgauacuaauuuc

SEQ ID NO: 4217903 - RNA, 19 nt, Yersinia pestis KIM
cucgcuguggcuaccauag

SEQ ID NO: 4217904 - RNA, 17 nt, Yersinia pestis KIM
cucggcgcgcuugccac

SEQ ID NO: 4217905 - RNA, 16 nt, Yersinia pestis KIM
cucgguaacuuaucga

SEQ ID NO: 4217906 - RNA, 14 nt, Yersinia pestis KIM
cucggucacugccu

SEQ ID NO: 4217907 - RNA, 18 nt, Yersinia pestis KIM
cucggucugaauaagaga

SEQ ID NO: 4217908 - RNA, 17 nt, Yersinia pestis KIM
cucggucugauuggcac

SEQ ID NO: 4217909 - RNA, 15 nt, Yersinia pestis KIM
cucgguuguucagca

SEQ ID NO: 4217910 - RNA, 13 nt, Yersinia pestis KIM
cucguaauuauug

SEQ ID NO: 4217911 - RNA, 13 nt, Yersinia pestis KIM
cucguauuacccu

SEQ ID NO: 4217912 - RNA, 20 nt, Yersinia pestis KIM
cucguggacauagagaugaa

SEQ ID NO: 4217913 - RNA, 14 nt, Yersinia pestis KIM
cucguuaucuguaa

SEQ ID NO: 4217914 - RNA, 19 nt, Yersinia pestis KIM
cucguuaucuucauauaca

SEQ ID NO: 4217915 - RNA, 15 nt, Yersinia pestis KIM
cucuaauaaaccugc

SEQ ID NO: 4217916 - RNA, 16 nt, Yersinia pestis KIM
cucuacucgcucacca

SEQ ID NO: 4217917 - RNA, 20 nt, Yersinia pestis KIM
cucuagaccugaggauaaaa

SEQ ID NO: 4217918 - RNA, 13 nt, Yersinia pestis KIM
cucuagcuguguu

SEQ ID NO: 4217919 - RNA, 13 nt, Yersinia pestis KIM
cucuaucucuucc

SEQ ID NO: 4217920 - RNA, 14 nt, Yersinia pestis KIM
cucuauucugcuuu

SEQ ID NO: 4217921 - RNA, 19 nt, Yersinia pestis KIM
cucuauucugcuuuuugcu

SEQ ID NO: 4217922 - RNA, 20 nt, Yersinia pestis KIM
cucuauucugcuuuuugcuu

SEQ ID NO: 4217923 - RNA, 20 nt, Yersinia pestis KIM
cucuauugaucacaguaaau

SEQ ID NO: 4217924 - RNA, 15 nt, Yersinia pestis KIM
cucuauugcucauca

SEQ ID NO: 4217925 - RNA, 20 nt, Yersinia pestis KIM
cucucaccgcugcuccgccc

SEQ ID NO: 4217926 - RNA, 14 nt, Yersinia pestis KIM
cucucagaacaggu

SEQ ID NO: 4217927 - RNA, 13 nt, Yersinia pestis KIM
cucucauuuaaua

SEQ ID NO: 4217928 - RNA, 23 nt, Yersinia pestis KIM
cucuccagccugcgauagcccca

SEQ ID NO: 4217929 - RNA, 13 nt, Yersinia pestis KIM
cucuccaugauau

SEQ ID NO: 4217930 - RNA, 17 nt, Yersinia pestis KIM
cucuccgggcauaaaug

SEQ ID NO: 4217931 - RNA, 16 nt, Yersinia pestis KIM
cucuccgucgcgggca

SEQ ID NO: 4217932 - RNA, 15 nt, Yersinia pestis KIM
cucuccguugcaggc

SEQ ID NO: 4217933 - RNA, 13 nt, Yersinia pestis KIM
cucucgaacccgc

SEQ ID NO: 4217934 - RNA, 19 nt, Yersinia pestis KIM
cucucuacuucgucugccc

SEQ ID NO: 4217935 - RNA, 13 nt, Yersinia pestis KIM
cucucuauugauc

SEQ ID NO: 4217936 - RNA, 22 nt, Yersinia pestis KIM
cucucuuuccagcaaaagccuc

SEQ ID NO: 4217937 - RNA, 23 nt, Yersinia pestis KIM
cucucuuuccagcaaaagccucu

SEQ ID NO: 4217938 - RNA, 14 nt, Yersinia pestis KIM
cucucuuuuuucuc

SEQ ID NO: 4217939 - RNA, 17 nt, Yersinia pestis KIM
cucucuuuuuucucuuu

SEQ ID NO: 4217940 - RNA, 17 nt, Yersinia pestis KIM
cucugaagccuucaugu

SEQ ID NO: 4217941 - RNA, 17 nt, Yersinia pestis KIM
cucugaauaaaaaauua

SEQ ID NO: 4217942 - RNA, 22 nt, Yersinia pestis KIM
cucugacaaaaugccagaaugc

SEQ ID NO: 4217943 - RNA, 23 nt, Yersinia pestis KIM
cucugacaaaaugccagaaugcg

SEQ ID NO: 4217944 - RNA, 14 nt, Yersinia pestis KIM
cucugacacugaca

SEQ ID NO: 4217945 - RNA, 15 nt, Yersinia pestis KIM
cucugagccauccag

SEQ ID NO: 4217946 - RNA, 16 nt, Yersinia pestis KIM
cucugaggauguaguc

SEQ ID NO: 4217947 - RNA, 18 nt, Yersinia pestis KIM
cucugauaguauuagaug

SEQ ID NO: 4217948 - RNA, 18 nt, Yersinia pestis KIM
cucugaugguaucagaaa

SEQ ID NO: 4217949 - RNA, 17 nt, Yersinia pestis KIM
cucugauuguaacaauc

SEQ ID NO: 4217950 - RNA, 19 nt, Yersinia pestis KIM
cucugcaaugcccagagcg

SEQ ID NO: 4217951 - RNA, 18 nt, Yersinia pestis KIM
cucugcaguacagauaau

SEQ ID NO: 4217952 - RNA, 16 nt, Yersinia pestis KIM
cucugcaucucugcau

SEQ ID NO: 4217953 - RNA, 22 nt, Yersinia pestis KIM
cucugccccuaagaaucggcca

SEQ ID NO: 4217954 - RNA, 22 nt, Yersinia pestis KIM
cucugccuauccucaccguuca

SEQ ID NO: 4217955 - RNA, 18 nt, Yersinia pestis KIM
cucugcguacaacacauc

SEQ ID NO: 4217956 - RNA, 15 nt, Yersinia pestis KIM
cucugcugggacaga

SEQ ID NO: 4217957 - RNA, 16 nt, Yersinia pestis KIM
cucuggagcuucuggc

SEQ ID NO: 4217958 - RNA, 21 nt, Yersinia pestis KIM
cucuggcaacggcacauccca

SEQ ID NO: 4217959 - RNA, 17 nt, Yersinia pestis KIM
cucuggcuaaugucucu

SEQ ID NO: 4217960 - RNA, 16 nt, Yersinia pestis KIM
cucugggacgugcaua

SEQ ID NO: 4217961 - RNA, 16 nt, Yersinia pestis KIM
cucuggguaagaacag

SEQ ID NO: 4217962 - RNA, 22 nt, Yersinia pestis KIM
cucuguagagaaauucauaccu

SEQ ID NO: 4217963 - RNA, 14 nt, Yersinia pestis KIM
cucuguauuuucaa

SEQ ID NO: 4217964 - RNA, 22 nt, Yersinia pestis KIM
cucuguauuuucaaucgcuuuc

SEQ ID NO: 4217965 - RNA, 16 nt, Yersinia pestis KIM
cucuguuuuaaaaaaa

SEQ ID NO: 4217966 - RNA, 18 nt, Yersinia pestis KIM
cucuuacauaaagaccca

SEQ ID NO: 4217967 - RNA, 15 nt, Yersinia pestis KIM
cucuuauuaaaugga

SEQ ID NO: 4217968 - RNA, 23 nt, Yersinia pestis KIM
cucuucaccaaaggaagccgagc

SEQ ID NO: 4217969 - RNA, 20 nt, Yersinia pestis KIM
cucuucagccuauccucacc

SEQ ID NO: 4217970 - RNA, 22 nt, Yersinia pestis KIM
cucuuccgacaggcuaacaacu

SEQ ID NO: 4217971 - RNA, 13 nt, Yersinia pestis KIM
cucuuccuguuca

SEQ ID NO: 4217972 - RNA, 13 nt, Yersinia pestis KIM
cucuucguugcuc

SEQ ID NO: 4217973 - RNA, 16 nt, Yersinia pestis KIM
cucuucuaacacuuca

SEQ ID NO: 4217974 - RNA, 18 nt, Yersinia pestis KIM
cucuucugcccauccuca

SEQ ID NO: 4217975 - RNA, 19 nt, Yersinia pestis KIM
cucuucugggcugaacgug

SEQ ID NO: 4217976 - RNA, 15 nt, Yersinia pestis KIM
cucuugaacggugag

SEQ ID NO: 4217977 - RNA, 21 nt, Yersinia pestis KIM
cucuugauuaccaauaauuaa

SEQ ID NO: 4217978 - RNA, 16 nt, Yersinia pestis KIM
cucuugcucuucgggu

SEQ ID NO: 4217979 - RNA, 13 nt, Yersinia pestis KIM
cucuuggagccag

SEQ ID NO: 4217980 - RNA, 15 nt, Yersinia pestis KIM
cucuuggcugacucc

SEQ ID NO: 4217981 - RNA, 18 nt, Yersinia pestis KIM
cucuuguuuugcaaugcu

SEQ ID NO: 4217982 - RNA, 19 nt, Yersinia pestis KIM
cucuuuagccgcuacgugu

SEQ ID NO: 4217983 - RNA, 21 nt, Yersinia pestis KIM
cucuuuauaaccgucaccaaa

SEQ ID NO: 4217984 - RNA, 14 nt, Yersinia pestis KIM
cucuuucaauggcu

SEQ ID NO: 4217985 - RNA, 21 nt, Yersinia pestis KIM
cucuuuccaacaguagcuuga

SEQ ID NO: 4217986 - RNA, 17 nt, Yersinia pestis KIM
cucuuuccccauuuuuu

SEQ ID NO: 4217987 - RNA, 18 nt, Yersinia pestis KIM
cucuuuccccauuuuuuu

SEQ ID NO: 4217988 - RNA, 12 nt, Yersinia pestis KIM
cucuuucccuuc

SEQ ID NO: 4217989 - RNA, 16 nt, Yersinia pestis KIM
cucuuucccuucaggu

SEQ ID NO: 4217990 - RNA, 19 nt, Yersinia pestis KIM
cugaaaaaggcaccagcgc

SEQ ID NO: 4217991 - RNA, 13 nt, Yersinia pestis KIM
cugaaaaucauga

SEQ ID NO: 4217992 - RNA, 17 nt, Yersinia pestis KIM
cugaaacggugaggaua

SEQ ID NO: 4217993 - RNA, 18 nt, Yersinia pestis KIM
cugaaacuucaaaaucaa

SEQ ID NO: 4217994 - RNA, 13 nt, Yersinia pestis KIM
cugaaagcaaaca

SEQ ID NO: 4217995 - RNA, 21 nt, Yersinia pestis KIM
cugaaagcaaacaauuaguca

SEQ ID NO: 4217996 - RNA, 16 nt, Yersinia pestis KIM
cugaaaguguauuucu

SEQ ID NO: 4217997 - RNA, 17 nt, Yersinia pestis KIM
cugaaaguguauuucuc

SEQ ID NO: 4217998 - RNA, 19 nt, Yersinia pestis KIM
cugaaaguguauuucucaa

SEQ ID NO: 4217999 - RNA, 12 nt, Yersinia pestis KIM
cugaaauuuauu

SEQ ID NO: 4218000 - RNA, 12 nt, Yersinia pestis KIM
cugaaauuuuuu

SEQ ID NO: 4218001 - RNA, 23 nt, Yersinia pestis KIM
cugaaauuuuuuaauuugcuccu

SEQ ID NO: 4218002 - RNA, 21 nt, Yersinia pestis KIM
cugaacaaaauagucaguggg

SEQ ID NO: 4218003 - RNA, 14 nt, Yersinia pestis KIM
cugaaccauggcuu

SEQ ID NO: 4218004 - RNA, 14 nt, Yersinia pestis KIM
cugagucuguuucc

SEQ ID NO: 4218005 - RNA, 18 nt, Yersinia pestis KIM
cugagucuguuuccacuc

SEQ ID NO: 4218006 - RNA, 18 nt, Yersinia pestis KIM
cugaguggacgauaaauu

SEQ ID NO: 4218007 - RNA, 18 nt, Yersinia pestis KIM
cugaguggucgcuggcau

SEQ ID NO: 4218008 - RNA, 11 nt, Yersinia pestis KIM
cugaguucugc

SEQ ID NO: 4218009 - RNA, 15 nt, Yersinia pestis KIM
cugaguucugcugcc

SEQ ID NO: 4218010 - RNA, 18 nt, Yersinia pestis KIM
cugaguuugcuacuggcc

SEQ ID NO: 4218011 - RNA, 15 nt, Yersinia pestis KIM
cugauaaaacaguuc

SEQ ID NO: 4218012 - RNA, 11 nt, Yersinia pestis KIM
cugauaaaauu

SEQ ID NO: 4218013 - RNA, 23 nt, Yersinia pestis KIM
cugauaaaauuaccgccccuguu

SEQ ID NO: 4218014 - RNA, 22 nt, Yersinia pestis KIM
cugauaaaccgcuauaucauca

SEQ ID NO: 4218015 - RNA, 14 nt, Yersinia pestis KIM
cugauaccgauaug

SEQ ID NO: 4218016 - RNA, 13 nt, Yersinia pestis KIM
cugauagagacgg

SEQ ID NO: 4218017 - RNA, 16 nt, Yersinia pestis KIM
cugauagcagaaaccc

SEQ ID NO: 4218018 - RNA, 18 nt, Yersinia pestis KIM
cugauagccaacacgacc

SEQ ID NO: 4218019 - RNA, 14 nt, Yersinia pestis KIM
cugauagccaauaa

SEQ ID NO: 4218020 - RNA, 15 nt, Yersinia pestis KIM
cugauagucaauaaa

SEQ ID NO: 4218021 - RNA, 15 nt, Yersinia pestis KIM
cugauauaaagcauu

SEQ ID NO: 4218022 - RNA, 22 nt, Yersinia pestis KIM
cugauauaacaaguuacauuuu

SEQ ID NO: 4218023 - RNA, 15 nt, Yersinia pestis KIM
cugauaucucuuuau

SEQ ID NO: 4218024 - RNA, 22 nt, Yersinia pestis KIM
cugaucacgcugaauuugugcu

SEQ ID NO: 4218025 - RNA, 14 nt, Yersinia pestis KIM
cugaucaucaucaa

SEQ ID NO: 4218026 - RNA, 20 nt, Yersinia pestis KIM
cugaucaugccacgaccauu

SEQ ID NO: 4218027 - RNA, 22 nt, Yersinia pestis KIM
cugauccucuaaggggcgagaa

SEQ ID NO: 4218028 - RNA, 21 nt, Yersinia pestis KIM
cugaucucaucaaacaccccg

SEQ ID NO: 4218029 - RNA, 21 nt, Yersinia pestis KIM
cugaugacgccguacaaauau

SEQ ID NO: 4218030 - RNA, 23 nt, Yersinia pestis KIM
cugaugacgccguacaaauauaa

SEQ ID NO: 4218031 - RNA, 16 nt, Yersinia pestis KIM
cugaugagcuggcaaa

SEQ ID NO: 4218032 - RNA, 15 nt, Yersinia pestis KIM
cugaugaucauugca

SEQ ID NO: 4218033 - RNA, 15 nt, Yersinia pestis KIM
cugaugcaauaacuc

SEQ ID NO: 4218034 - RNA, 13 nt, Yersinia pestis KIM
cugaugcaccuca

SEQ ID NO: 4218035 - RNA, 19 nt, Yersinia pestis KIM
cugauggugucaacucagu

SEQ ID NO: 4218036 - RNA, 18 nt, Yersinia pestis KIM
cugaugucagugcuccau

SEQ ID NO: 4218037 - RNA, 17 nt, Yersinia pestis KIM
cugaugugcauguggaa

SEQ ID NO: 4218038 - RNA, 19 nt, Yersinia pestis KIM
cugaugugcauguggaagc

SEQ ID NO: 4218039 - RNA, 16 nt, Yersinia pestis KIM
cugauguguauauuuu

SEQ ID NO: 4218040 - RNA, 17 nt, Yersinia pestis KIM
cugauuaacacaguaaa

SEQ ID NO: 4218041 - RNA, 11 nt, Yersinia pestis KIM
cugauuaauag

SEQ ID NO: 4218042 - RNA, 22 nt, Yersinia pestis KIM
cugauucaacacggugaauaaa

SEQ ID NO: 4218043 - RNA, 14 nt, Yersinia pestis KIM
cugauucacuggca

SEQ ID NO: 4218044 - RNA, 19 nt, Yersinia pestis KIM
cugauucgcgaccagcaga

SEQ ID NO: 4218045 - RNA, 20 nt, Yersinia pestis KIM
cugauucgcgaccagcagaa

SEQ ID NO: 4218046 - RNA, 22 nt, Yersinia pestis KIM
cugauucgcgaccagcagaagu

SEQ ID NO: 4218047 - RNA, 16 nt, Yersinia pestis KIM
cugauucucuucaccu

SEQ ID NO: 4218048 - RNA, 18 nt, Yersinia pestis KIM
cugauuugggaacaacag

SEQ ID NO: 4218049 - RNA, 21 nt, Yersinia pestis KIM
cugcaaacggcucaucacacc

SEQ ID NO: 4218050 - RNA, 23 nt, Yersinia pestis KIM
cugcaaaugggugugaacaguga

SEQ ID NO: 4218051 - RNA, 19 nt, Yersinia pestis KIM
cugcaaauuaaccugcugg

SEQ ID NO: 4218052 - RNA, 21 nt, Yersinia pestis KIM
cugcaacguuaaagaugaagg

SEQ ID NO: 4218053 - RNA, 14 nt, Yersinia pestis KIM
cugcaacucaguga

SEQ ID NO: 4218054 - RNA, 14 nt, Yersinia pestis KIM
cugcaacucauuaa

SEQ ID NO: 4218055 - RNA, 21 nt, Yersinia pestis KIM
cugcaacuucagccaccagau

SEQ ID NO: 4218056 - RNA, 17 nt, Yersinia pestis KIM
cugcaagauaaccgguu

SEQ ID NO: 4218057 - RNA, 23 nt, Yersinia pestis KIM
cugcaauaagccagauaucacuc

SEQ ID NO: 4218058 - RNA, 12 nt, Yersinia pestis KIM
cugcaauccucc

SEQ ID NO: 4218059 - RNA, 14 nt, Yersinia pestis KIM
cugcaaugcauaag

SEQ ID NO: 4218060 - RNA, 20 nt, Yersinia pestis KIM
cugcaaugcccagagcgcgg

SEQ ID NO: 4218061 - RNA, 20 nt, Yersinia pestis KIM
cugcaauggcuggcaaggca

SEQ ID NO: 4218062 - RNA, 20 nt, Yersinia pestis KIM
cugcacaccacacuggaugc

SEQ ID NO: 4218063 - RNA, 19 nt, Yersinia pestis KIM
cugcacauacucaccuccc

SEQ ID NO: 4218064 - RNA, 13 nt, Yersinia pestis KIM
cugcacaucaaua

SEQ ID NO: 4218065 - RNA, 17 nt, Yersinia pestis KIM
cugcacaucauuuauuu

SEQ ID NO: 4218066 - RNA, 23 nt, Yersinia pestis KIM
cugcaccaaucauuacaucaucu

SEQ ID NO: 4218067 - RNA, 18 nt, Yersinia pestis KIM
cugcaccaaugacuaauu

SEQ ID NO: 4218068 - RNA, 13 nt, Yersinia pestis KIM
cugcaccagugcc

SEQ ID NO: 4218069 - RNA, 21 nt, Yersinia pestis KIM
cugcaccccaaauguuggaua

SEQ ID NO: 4218070 - RNA, 16 nt, Yersinia pestis KIM
cugcacguuuaauuuc

SEQ ID NO: 4218071 - RNA, 21 nt, Yersinia pestis KIM
cugcacuggcguuggcaauuc

SEQ ID NO: 4218072 - RNA, 20 nt, Yersinia pestis KIM
cugcagaaugaaguuauccu

SEQ ID NO: 4218073 - RNA, 17 nt, Yersinia pestis KIM
cugcagcgauauacauc

SEQ ID NO: 4218074 - RNA, 20 nt, Yersinia pestis KIM
cugcagcgauauacaucacg

SEQ ID NO: 4218075 - RNA, 15 nt, Yersinia pestis KIM
cugcaguagagcggu

SEQ ID NO: 4218076 - RNA, 21 nt, Yersinia pestis KIM
cugcaguuuccaacacgauau

SEQ ID NO: 4218077 - RNA, 15 nt, Yersinia pestis KIM
cugcauacagaucga

SEQ ID NO: 4218078 - RNA, 15 nt, Yersinia pestis KIM
cugcauagcuaaccu

SEQ ID NO: 4218079 - RNA, 18 nt, Yersinia pestis KIM
cugcauagcuaaccuuaa

SEQ ID NO: 4218080 - RNA, 17 nt, Yersinia pestis KIM
cugcauauccucccgcu

SEQ ID NO: 4218081 - RNA, 15 nt, Yersinia pestis KIM
cugcaucaagccgcu

SEQ ID NO: 4218082 - RNA, 11 nt, Yersinia pestis KIM
cugcaucaucg

SEQ ID NO: 4218083 - RNA, 22 nt, Yersinia pestis KIM
cugcauugcguugauuugcgcg

SEQ ID NO: 4218084 - RNA, 13 nt, Yersinia pestis KIM
cugccaaaaaaua

SEQ ID NO: 4218085 - RNA, 21 nt, Yersinia pestis KIM
cugccaaaaaauaagggccac

SEQ ID NO: 4218086 - RNA, 21 nt, Yersinia pestis KIM
cugccaaccaccaaagauaca

SEQ ID NO: 4218087 - RNA, 14 nt, Yersinia pestis KIM
cugccaaucgcucu

SEQ ID NO: 4218088 - RNA, 23 nt, Yersinia pestis KIM
cugccaaucgcucugcguuuuuc

SEQ ID NO: 4218089 - RNA, 17 nt, Yersinia pestis KIM
cugccaauucaaggcca

SEQ ID NO: 4218090 - RNA, 23 nt, Yersinia pestis KIM
cugccaccggggaggaugguaaa

SEQ ID NO: 4218091 - RNA, 19 nt, Yersinia pestis KIM
cugccagaaucgccugcac

SEQ ID NO: 4218092 - RNA, 15 nt, Yersinia pestis KIM
cugccagauagucau

SEQ ID NO: 4218093 - RNA, 19 nt, Yersinia pestis KIM
cugccagauagucaucuuu

SEQ ID NO: 4218094 - RNA, 16 nt, Yersinia pestis KIM
cugccagcccacgagg

SEQ ID NO: 4218095 - RNA, 20 nt, Yersinia pestis KIM
cugccaguaaaaucaucagc

SEQ ID NO: 4218096 - RNA, 20 nt, Yersinia pestis KIM
cugccaguucaucagcccag

SEQ ID NO: 4218097 - RNA, 14 nt, Yersinia pestis KIM
cugccauaaccgcu

SEQ ID NO: 4218098 - RNA, 20 nt, Yersinia pestis KIM
cugccauaauccagaagcca

SEQ ID NO: 4218099 - RNA, 22 nt, Yersinia pestis KIM
cugccauacggcgucuugauca

SEQ ID NO: 4218100 - RNA, 19 nt, Yersinia pestis KIM
cugccauaugcauggcaua

SEQ ID NO: 4218101 - RNA, 17 nt, Yersinia pestis KIM
cugccaugggaaaucaa

SEQ ID NO: 4218102 - RNA, 18 nt, Yersinia pestis KIM
cugccaugggaaaucaaa

SEQ ID NO: 4218103 - RNA, 15 nt, Yersinia pestis KIM
cugccaugucacugu

SEQ ID NO: 4218104 - RNA, 23 nt, Yersinia pestis KIM
cugccauuuugccugcaauugug

SEQ ID NO: 4218105 - RNA, 23 nt, Yersinia pestis KIM
cugcccagcggccaugacgguca

SEQ ID NO: 4218106 - RNA, 21 nt, Yersinia pestis KIM
cugcccccccgaugacacgau

SEQ ID NO: 4218107 - RNA, 22 nt, Yersinia pestis KIM
cugcccccccggguggcgcuga

SEQ ID NO: 4218108 - RNA, 12 nt, Yersinia pestis KIM
cugcccccgacg

SEQ ID NO: 4218109 - RNA, 14 nt, Yersinia pestis KIM
cugcccgccccggc

SEQ ID NO: 4218110 - RNA, 18 nt, Yersinia pestis KIM
cugcccgucacucagaaa

SEQ ID NO: 4218111 - RNA, 15 nt, Yersinia pestis KIM
cugccgcaacggcac

SEQ ID NO: 4218112 - RNA, 21 nt, Yersinia pestis KIM
cugccgccaccauaucagaac

SEQ ID NO: 4218113 - RNA, 21 nt, Yersinia pestis KIM
cugccgccagauuauccagcc

SEQ ID NO: 4218114 - RNA, 19 nt, Yersinia pestis KIM
cugccgccccuuccaaugu

SEQ ID NO: 4218115 - RNA, 14 nt, Yersinia pestis KIM
cugccgccucugcu

SEQ ID NO: 4218116 - RNA, 14 nt, Yersinia pestis KIM
cugccguaaacaau

SEQ ID NO: 4218117 - RNA, 19 nt, Yersinia pestis KIM
cugccguaccaaugucuca

SEQ ID NO: 4218118 - RNA, 13 nt, Yersinia pestis KIM
cuggcgcacgccg

SEQ ID NO: 4218119 - RNA, 16 nt, Yersinia pestis KIM
cuggcgcagaguaucc

SEQ ID NO: 4218120 - RNA, 19 nt, Yersinia pestis KIM
cuggcgcauccccacuugu

SEQ ID NO: 4218121 - RNA, 14 nt, Yersinia pestis KIM
cuggcgcgcuuugg

SEQ ID NO: 4218122 - RNA, 14 nt, Yersinia pestis KIM
cuggcggaagcacg

SEQ ID NO: 4218123 - RNA, 15 nt, Yersinia pestis KIM
cuggcggauaaaaau

SEQ ID NO: 4218124 - RNA, 19 nt, Yersinia pestis KIM
cuggcggauaacggcggca

SEQ ID NO: 4218125 - RNA, 20 nt, Yersinia pestis KIM
cuggcggauaacggcggcaa

SEQ ID NO: 4218126 - RNA, 18 nt, Yersinia pestis KIM
cuggcgggaauugaaccu

SEQ ID NO: 4218127 - RNA, 15 nt, Yersinia pestis KIM
cuggcgguaauaaau

SEQ ID NO: 4218128 - RNA, 24 nt, Yersinia pestis KIM
cuggcguugccgugcugucagcca

SEQ ID NO: 4218129 - RNA, 22 nt, Yersinia pestis KIM
cuggcguuuuccucgugaaaaa

SEQ ID NO: 4218130 - RNA, 23 nt, Yersinia pestis KIM
cuggcguuuugcaucaacgacag

SEQ ID NO: 4218131 - RNA, 18 nt, Yersinia pestis KIM
cuggcuaacguggccuua

SEQ ID NO: 4218132 - RNA, 21 nt, Yersinia pestis KIM
cuggcuaacuggcggggcaaa

SEQ ID NO: 4218133 - RNA, 15 nt, Yersinia pestis KIM
cuggcucggcgcgcu

SEQ ID NO: 4218134 - RNA, 15 nt, Yersinia pestis KIM
cuggcucugcgacca

SEQ ID NO: 4218135 - RNA, 13 nt, Yersinia pestis KIM
cuggcuuucgcuu

SEQ ID NO: 4218136 - RNA, 24 nt, Yersinia pestis KIM
cuggcuuuuucacacgcccaggcc

SEQ ID NO: 4218137 - RNA, 23 nt, Yersinia pestis KIM
cuggcuuuuuuguuuuuauauca

SEQ ID NO: 4218138 - RNA, 13 nt, Yersinia pestis KIM
cugggaaugcacc

SEQ ID NO: 4218139 - RNA, 16 nt, Yersinia pestis KIM
cugggccaucaagcca

SEQ ID NO: 4218140 - RNA, 22 nt, Yersinia pestis KIM
cugggccgcuggcgauccccuu

SEQ ID NO: 4218141 - RNA, 13 nt, Yersinia pestis KIM
cugggcgauccaa

SEQ ID NO: 4218142 - RNA, 15 nt, Yersinia pestis KIM
cugggcugcauagcg

SEQ ID NO: 4218143 - RNA, 23 nt, Yersinia pestis KIM
cugggggugagcaagggcagcua

SEQ ID NO: 4218144 - RNA, 22 nt, Yersinia pestis KIM
cugggguauguaaugccacacu

SEQ ID NO: 4218145 - RNA, 18 nt, Yersinia pestis KIM
cuggggucaucaacgcac

SEQ ID NO: 4218146 - RNA, 14 nt, Yersinia pestis KIM
cugggucaucaccc

SEQ ID NO: 4218147 - RNA, 22 nt, Yersinia pestis KIM
cugggucaucacccagcaaaau

SEQ ID NO: 4218148 - RNA, 21 nt, Yersinia pestis KIM
cugggugacgcgaaacgccca

SEQ ID NO: 4218149 - RNA, 15 nt, Yersinia pestis KIM
cugggugcugcuccc

SEQ ID NO: 4218150 - RNA, 22 nt, Yersinia pestis KIM
cuggguuuuauugcaacugggc

SEQ ID NO: 4218151 - RNA, 22 nt, Yersinia pestis KIM
cugguaauucgcuauaugguaa

SEQ ID NO: 4218152 - RNA, 14 nt, Yersinia pestis KIM
cugguaccaaauaa

SEQ ID NO: 4218153 - RNA, 16 nt, Yersinia pestis KIM
cugguaccaaauaaca

SEQ ID NO: 4218154 - RNA, 21 nt, Yersinia pestis KIM
cugguaccaaauaacaacaca

SEQ ID NO: 4218155 - RNA, 19 nt, Yersinia pestis KIM
cugguaccaaucuccaaug

SEQ ID NO: 4218156 - RNA, 17 nt, Yersinia pestis KIM
cugguagcugcucacga

SEQ ID NO: 4218157 - RNA, 19 nt, Yersinia pestis KIM
cugguagucauauucaggc

SEQ ID NO: 4218158 - RNA, 21 nt, Yersinia pestis KIM
cugguagucauauucaggcug

SEQ ID NO: 4218159 - RNA, 18 nt, Yersinia pestis KIM
cugguaguuuugcauaau

SEQ ID NO: 4218160 - RNA, 17 nt, Yersinia pestis KIM
cugguccagaucggcaa

SEQ ID NO: 4218161 - RNA, 18 nt, Yersinia pestis KIM
cuggucgauaagcacucc

SEQ ID NO: 4218162 - RNA, 20 nt, Yersinia pestis KIM
cuggucgggugcaggccauu

SEQ ID NO: 4218163 - RNA, 16 nt, Yersinia pestis KIM
cuggucguugaccuua

SEQ ID NO: 4218164 - RNA, 21 nt, Yersinia pestis KIM
cuggucuuaaucauuuguuuc

SEQ ID NO: 4218165 - RNA, 19 nt, Yersinia pestis KIM
cugguggcuugggcuucac

SEQ ID NO: 4218166 - RNA, 16 nt, Yersinia pestis KIM
cugguugcagcacgcc

SEQ ID NO: 4218167 - RNA, 12 nt, Yersinia pestis KIM
cugguugcuuca

SEQ ID NO: 4218168 - RNA, 15 nt, Yersinia pestis KIM
cugguugcuucauca

SEQ ID NO: 4218169 - RNA, 21 nt, Yersinia pestis KIM
cuguaaaauaccaauuaauaa

SEQ ID NO: 4218170 - RNA, 23 nt, Yersinia pestis KIM
cuguaaaaucuuucuguucagca

SEQ ID NO: 4218171 - RNA, 12 nt, Yersinia pestis KIM
cuguaaagccag

SEQ ID NO: 4218172 - RNA, 13 nt, Yersinia pestis KIM
cuguaaccgccug

SEQ ID NO: 4218173 - RNA, 19 nt, Yersinia pestis KIM
cuguaaccucacgccaccu

SEQ ID NO: 4218174 - RNA, 17 nt, Yersinia pestis KIM
cuguaacuaccugcuuu

SEQ ID NO: 4218175 - RNA, 23 nt, Yersinia pestis KIM
cuguaacugccaguucaucagcc

SEQ ID NO: 4218176 - RNA, 14 nt, Yersinia pestis KIM
cuguaaggccaaac

SEQ ID NO: 4218177 - RNA, 23 nt, Yersinia pestis KIM
cuguaagguugaccugcagcggu

SEQ ID NO: 4218178 - RNA, 19 nt, Yersinia pestis KIM
cuguaauaucgaaggggau

SEQ ID NO: 4218179 - RNA, 17 nt, Yersinia pestis KIM
cuguaaugccuggugca

SEQ ID NO: 4218180 - RNA, 19 nt, Yersinia pestis KIM
cuguaauggcgcacauuac

SEQ ID NO: 4218181 - RNA, 17 nt, Yersinia pestis KIM
cuguaauugcgucaggg

SEQ ID NO: 4218182 - RNA, 19 nt, Yersinia pestis KIM
cuguaauugcgucagggca

SEQ ID NO: 4218183 - RNA, 17 nt, Yersinia pestis KIM
cuguacaacaagauccc

SEQ ID NO: 4218184 - RNA, 16 nt, Yersinia pestis KIM
cuguacauaaauuugu

SEQ ID NO: 4218185 - RNA, 12 nt, Yersinia pestis KIM
cuguaccaccac

SEQ ID NO: 4218186 - RNA, 14 nt, Yersinia pestis KIM
cuguaccaccacca

SEQ ID NO: 4218187 - RNA, 20 nt, Yersinia pestis KIM
cuguaccaccaccaacagca

SEQ ID NO: 4218188 - RNA, 18 nt, Yersinia pestis KIM
cuguagaacaccugccuu

SEQ ID NO: 4218189 - RNA, 23 nt, Yersinia pestis KIM
cuguagccgcaggcgaugcaagg

SEQ ID NO: 4218190 - RNA, 20 nt, Yersinia pestis KIM
cuguagcgccagguaagaaa

SEQ ID NO: 4218191 - RNA, 18 nt, Yersinia pestis KIM
cuguaggugucaccaacg

SEQ ID NO: 4218192 - RNA, 22 nt, Yersinia pestis KIM
cuguaguucaauggucaugcac

SEQ ID NO: 4218193 - RNA, 23 nt, Yersinia pestis KIM
cuguaguucaauggucaugcaca

SEQ ID NO: 4218194 - RNA, 14 nt, Yersinia pestis KIM
cuguauaaaaauag

SEQ ID NO: 4218195 - RNA, 17 nt, Yersinia pestis KIM
cuguauaaaagaaugaa

SEQ ID NO: 4218196 - RNA, 14 nt, Yersinia pestis KIM
cuguauguguuugu

SEQ ID NO: 4218197 - RNA, 13 nt, Yersinia pestis KIM
cuguauugaugca

SEQ ID NO: 4218198 - RNA, 18 nt, Yersinia pestis KIM
cuguauuguugcucaaca

SEQ ID NO: 4218199 - RNA, 15 nt, Yersinia pestis KIM
cugucaaaaagcacc

SEQ ID NO: 4218200 - RNA, 17 nt, Yersinia pestis KIM
cugucaaucgaugagcu

SEQ ID NO: 4218201 - RNA, 20 nt, Yersinia pestis KIM
cugucaaucgaugagcuggu

SEQ ID NO: 4218202 - RNA, 20 nt, Yersinia pestis KIM
cugucacuguugcgggcauc

SEQ ID NO: 4218203 - RNA, 17 nt, Yersinia pestis KIM
cugucagcccuaauauc

SEQ ID NO: 4218204 - RNA, 20 nt, Yersinia pestis KIM
cugucauuacacuuucuuug

SEQ ID NO: 4218205 - RNA, 13 nt, Yersinia pestis KIM
cugucauugcugu

SEQ ID NO: 4218206 - RNA, 15 nt, Yersinia pestis KIM
cuguccaagaagcca

SEQ ID NO: 4218207 - RNA, 17 nt, Yersinia pestis KIM
cuguccaagaagccaag

SEQ ID NO: 4218208 - RNA, 20 nt, Yersinia pestis KIM
cugucgauuuguggauaacu

SEQ ID NO: 4218209 - RNA, 16 nt, Yersinia pestis KIM
cugucgcauaagacaa

SEQ ID NO: 4218210 - RNA, 20 nt, Yersinia pestis KIM
cugucggaagagauagagca

SEQ ID NO: 4218211 - RNA, 14 nt, Yersinia pestis KIM
cugucggagccuga

SEQ ID NO: 4218212 - RNA, 21 nt, Yersinia pestis KIM
cugucuaaauugcuuaaaaaa

SEQ ID NO: 4218213 - RNA, 13 nt, Yersinia pestis KIM
cugucuauugauu

SEQ ID NO: 4218214 - RNA, 15 nt, Yersinia pestis KIM
cugucugaugauuug

SEQ ID NO: 4218215 - RNA, 19 nt, Yersinia pestis KIM
cugucuggguggcugaaau

SEQ ID NO: 4218216 - RNA, 15 nt, Yersinia pestis KIM
cugucuuauuuuuug

SEQ ID NO: 4218217 - RNA, 17 nt, Yersinia pestis KIM
cugugaaucuuuuugcu

SEQ ID NO: 4218218 - RNA, 16 nt, Yersinia pestis KIM
cugugacacgagaagg

SEQ ID NO: 4218219 - RNA, 14 nt, Yersinia pestis KIM
cugugagcgcagac

SEQ ID NO: 4218220 - RNA, 18 nt, Yersinia pestis KIM
cugugagcggcauccagu

SEQ ID NO: 4218221 - RNA, 15 nt, Yersinia pestis KIM
cugugauaaacccca

SEQ ID NO: 4218222 - RNA, 20 nt, Yersinia pestis KIM
cugugaucgcugccgcaaga

SEQ ID NO: 4218223 - RNA, 16 nt, Yersinia pestis KIM
cugugauuugcccggu

SEQ ID NO: 4218224 - RNA, 14 nt, Yersinia pestis KIM
cugugcaaauggcu

SEQ ID NO: 4218225 - RNA, 19 nt, Yersinia pestis KIM
cugugccaacaucgcgcug

SEQ ID NO: 4218226 - RNA, 21 nt, Yersinia pestis KIM
cugugccaacaucgcgcugcu

SEQ ID NO: 4218227 - RNA, 19 nt, Yersinia pestis KIM
cugugccaaugccucuuca

SEQ ID NO: 4218228 - RNA, 18 nt, Yersinia pestis KIM
cugugcgaauggaaaaac

SEQ ID NO: 4218229 - RNA, 19 nt, Yersinia pestis KIM
cugugcggaucccguuuca

SEQ ID NO: 4218230 - RNA, 22 nt, Yersinia pestis KIM
cugugcggaucccguuucagcu

SEQ ID NO: 4218231 - RNA, 15 nt, Yersinia pestis KIM
cugugcggcagugaa

SEQ ID NO: 4218232 - RNA, 13 nt, Yersinia pestis KIM
cuuaucagcgaaa

SEQ ID NO: 4218233 - RNA, 17 nt, Yersinia pestis KIM
cuuaucagcgaaaaauu

SEQ ID NO: 4218234 - RNA, 14 nt, Yersinia pestis KIM
cuuauccacagcau

SEQ ID NO: 4218235 - RNA, 15 nt, Yersinia pestis KIM
cuuauccacagcaug

SEQ ID NO: 4218236 - RNA, 19 nt, Yersinia pestis KIM
cuuaucccuccaucaagcc

SEQ ID NO: 4218237 - RNA, 15 nt, Yersinia pestis KIM
cuuauccguuaaccc

SEQ ID NO: 4218238 - RNA, 16 nt, Yersinia pestis KIM
cuuauccugcaaccca

SEQ ID NO: 4218239 - RNA, 13 nt, Yersinia pestis KIM
cuuaucuaaaaaa

SEQ ID NO: 4218240 - RNA, 22 nt, Yersinia pestis KIM
cuuaucuaucucaggcucagcg

SEQ ID NO: 4218241 - RNA, 23 nt, Yersinia pestis KIM
cuuaucuuuucugauuuuuuacu

SEQ ID NO: 4218242 - RNA, 21 nt, Yersinia pestis KIM
cuuaugaucuugaauaauauu

SEQ ID NO: 4218243 - RNA, 15 nt, Yersinia pestis KIM
cuuauggcguuugau

SEQ ID NO: 4218244 - RNA, 24 nt, Yersinia pestis KIM
cuuauggggacucuuuauuuaugg

SEQ ID NO: 4218245 - RNA, 17 nt, Yersinia pestis KIM
cuuaugguuaucacauc

SEQ ID NO: 4218246 - RNA, 18 nt, Yersinia pestis KIM
cuuauuaauuaaugaaau

SEQ ID NO: 4218247 - RNA, 21 nt, Yersinia pestis KIM
cuuauucccacuuauuauaaa

SEQ ID NO: 4218248 - RNA, 23 nt, Yersinia pestis KIM
cuuauucgaguagggauuuaugc

SEQ ID NO: 4218249 - RNA, 17 nt, Yersinia pestis KIM
cuuauucuaauugauau

SEQ ID NO: 4218250 - RNA, 23 nt, Yersinia pestis KIM
cuuauucuaauugauauuauuua

SEQ ID NO: 4218251 - RNA, 22 nt, Yersinia pestis KIM
cuuauugggcgcgauaaaagau

SEQ ID NO: 4218252 - RNA, 13 nt, Yersinia pestis KIM
cuuauuugaaaca

SEQ ID NO: 4218253 - RNA, 14 nt, Yersinia pestis KIM
cuuauuuuuaccaa

SEQ ID NO: 4218254 - RNA, 13 nt, Yersinia pestis KIM
cuucaacuuuuuu

SEQ ID NO: 4218255 - RNA, 14 nt, Yersinia pestis KIM
cuucaacuuuuuuc

SEQ ID NO: 4218256 - RNA, 22 nt, Yersinia pestis KIM
cuucaacuuuuuucuuaaggac

SEQ ID NO: 4218257 - RNA, 12 nt, Yersinia pestis KIM
cuucaagcccga

SEQ ID NO: 4218258 - RNA, 22 nt, Yersinia pestis KIM
cuucaauacguucguagccacg

SEQ ID NO: 4218259 - RNA, 13 nt, Yersinia pestis KIM
cuucaaucaggug

SEQ ID NO: 4218260 - RNA, 14 nt, Yersinia pestis KIM
cuucaauuuugugg

SEQ ID NO: 4218261 - RNA, 15 nt, Yersinia pestis KIM
cuucacauuuucucc

SEQ ID NO: 4218262 - RNA, 14 nt, Yersinia pestis KIM
cuucaccaaaaaaa

SEQ ID NO: 4218263 - RNA, 16 nt, Yersinia pestis KIM
cuucaccaaaggaagc

SEQ ID NO: 4218264 - RNA, 14 nt, Yersinia pestis KIM
cuucaccaauacaa

SEQ ID NO: 4218265 - RNA, 18 nt, Yersinia pestis KIM
cuucaccaauacaaacag

SEQ ID NO: 4218266 - RNA, 13 nt, Yersinia pestis KIM
cuucaccacugug

SEQ ID NO: 4218267 - RNA, 20 nt, Yersinia pestis KIM
cuucacccaccuuuugcgcg

SEQ ID NO: 4218268 - RNA, 15 nt, Yersinia pestis KIM
cuucacccuggcucu

SEQ ID NO: 4218269 - RNA, 17 nt, Yersinia pestis KIM
cuucacgcucuugcucu

SEQ ID NO: 4218270 - RNA, 13 nt, Yersinia pestis KIM
cuucacucagcgc

SEQ ID NO: 4218271 - RNA, 17 nt, Yersinia pestis KIM
cuucacucagcgcuggc

SEQ ID NO: 4218272 - RNA, 19 nt, Yersinia pestis KIM
cuucacucagcgcuggcga

SEQ ID NO: 4218273 - RNA, 13 nt, Yersinia pestis KIM
cuucacuucuggg

SEQ ID NO: 4218274 - RNA, 14 nt, Yersinia pestis KIM
cuucacuucugggg

SEQ ID NO: 4218275 - RNA, 13 nt, Yersinia pestis KIM
cuucagacaguaa

SEQ ID NO: 4218276 - RNA, 23 nt, Yersinia pestis KIM
cuucagacugaaaguagaaauaa

SEQ ID NO: 4218277 - RNA, 14 nt, Yersinia pestis KIM
cuucagccaccaga

SEQ ID NO: 4218278 - RNA, 15 nt, Yersinia pestis KIM
cuucagcccauggcu

SEQ ID NO: 4218279 - RNA, 20 nt, Yersinia pestis KIM
cuucagcccauggcugaaau

SEQ ID NO: 4218280 - RNA, 19 nt, Yersinia pestis KIM
cuucagccgcucaucaucc

SEQ ID NO: 4218281 - RNA, 15 nt, Yersinia pestis KIM
cuucagcucuucuaa

SEQ ID NO: 4218282 - RNA, 22 nt, Yersinia pestis KIM
cuucagcuuccgcuucaacuuc

SEQ ID NO: 4218283 - RNA, 15 nt, Yersinia pestis KIM
cuucaggaauaaaca

SEQ ID NO: 4218284 - RNA, 14 nt, Yersinia pestis KIM
cuucaggccaagcc

SEQ ID NO: 4218285 - RNA, 18 nt, Yersinia pestis KIM
cuucagucaguguuucua

SEQ ID NO: 4218286 - RNA, 17 nt, Yersinia pestis KIM
cuucaguggcuggaaag

SEQ ID NO: 4218287 - RNA, 19 nt, Yersinia pestis KIM
cuucaguuuauuuaagcug

SEQ ID NO: 4218288 - RNA, 23 nt, Yersinia pestis KIM
cuucauagcuacgggcaaacucc

SEQ ID NO: 4218289 - RNA, 20 nt, Yersinia pestis KIM
cuucauaucggccaaguuua

SEQ ID NO: 4218290 - RNA, 12 nt, Yersinia pestis KIM
cuucauauugag

SEQ ID NO: 4218291 - RNA, 22 nt, Yersinia pestis KIM
cuucaucagucacuaaaccauu

SEQ ID NO: 4218292 - RNA, 18 nt, Yersinia pestis KIM
cuucaucgauaguaaaca

SEQ ID NO: 4218293 - RNA, 13 nt, Yersinia pestis KIM
cuucaucuaaaua

SEQ ID NO: 4218294 - RNA, 15 nt, Yersinia pestis KIM
cuucaucuaaauauu

SEQ ID NO: 4218295 - RNA, 16 nt, Yersinia pestis KIM
cuucaucugcacuggu

SEQ ID NO: 4218296 - RNA, 19 nt, Yersinia pestis KIM
cuucauguuuaucaaacag

SEQ ID NO: 4218297 - RNA, 20 nt, Yersinia pestis KIM
cuucauuaaggagugccauc

SEQ ID NO: 4218298 - RNA, 16 nt, Yersinia pestis KIM
cuucauuaucauguaa

SEQ ID NO: 4218299 - RNA, 14 nt, Yersinia pestis KIM
cuucauuucaggua

SEQ ID NO: 4218300 - RNA, 13 nt, Yersinia pestis KIM
cuuccaaaggaag

SEQ ID NO: 4218301 - RNA, 14 nt, Yersinia pestis KIM
cuuccaaaggaagg

SEQ ID NO: 4218302 - RNA, 21 nt, Yersinia pestis KIM
cuuccaacucaccuaaaucau

SEQ ID NO: 4218303 - RNA, 16 nt, Yersinia pestis KIM
cuuccaauaagugauu

SEQ ID NO: 4218304 - RNA, 12 nt, Yersinia pestis KIM
cuuccaauauug

SEQ ID NO: 4218305 - RNA, 15 nt, Yersinia pestis KIM
cuuccagcgcccggc

SEQ ID NO: 4218306 - RNA, 23 nt, Yersinia pestis KIM
cuuccaggauauucacguuuuuc

SEQ ID NO: 4218307 - RNA, 12 nt, Yersinia pestis KIM
cuuccaguggcu

SEQ ID NO: 4218308 - RNA, 14 nt, Yersinia pestis KIM
cuuccaucaggaag

SEQ ID NO: 4218309 - RNA, 22 nt, Yersinia pestis KIM
cuuccaucgucagaaccugcau

SEQ ID NO: 4218310 - RNA, 14 nt, Yersinia pestis KIM
cuuccaugacacau

SEQ ID NO: 4218311 - RNA, 16 nt, Yersinia pestis KIM
cuuccaugacacauau

SEQ ID NO: 4218312 - RNA, 19 nt, Yersinia pestis KIM
cuuccaugacacauauuuc

SEQ ID NO: 4218313 - RNA, 19 nt, Yersinia pestis KIM
cuuccauuccguuauuaaa

SEQ ID NO: 4218314 - RNA, 18 nt, Yersinia pestis KIM
cuucccauagacggcgaa

SEQ ID NO: 4218315 - RNA, 19 nt, Yersinia pestis KIM
cuucccggcgauucuccac

SEQ ID NO: 4218316 - RNA, 16 nt, Yersinia pestis KIM
cuucccuauucaaaau

SEQ ID NO: 4218317 - RNA, 20 nt, Yersinia pestis KIM
cuuccgauaaccagaccgau

SEQ ID NO: 4218318 - RNA, 14 nt, Yersinia pestis KIM
cuuccgccagcaga

SEQ ID NO: 4218319 - RNA, 22 nt, Yersinia pestis KIM
cuuccgccaguugcucacggug

SEQ ID NO: 4218320 - RNA, 14 nt, Yersinia pestis KIM
cuuccggcaucuuu

SEQ ID NO: 4218321 - RNA, 15 nt, Yersinia pestis KIM
cuuccggcaucuuuu

SEQ ID NO: 4218322 - RNA, 13 nt, Yersinia pestis KIM
cuuccgucccaag

SEQ ID NO: 4218323 - RNA, 18 nt, Yersinia pestis KIM
cuuccugccaacaacuua

SEQ ID NO: 4218324 - RNA, 13 nt, Yersinia pestis KIM
cuuccugcccagc

SEQ ID NO: 4218325 - RNA, 14 nt, Yersinia pestis KIM
cuuccuguacguua

SEQ ID NO: 4218326 - RNA, 17 nt, Yersinia pestis KIM
cuuccuugauuuucauu

SEQ ID NO: 4218327 - RNA, 12 nt, Yersinia pestis KIM
cuuccuugcucu

SEQ ID NO: 4218328 - RNA, 18 nt, Yersinia pestis KIM
cuuccuugcucucuucau

SEQ ID NO: 4218329 - RNA, 14 nt, Yersinia pestis KIM
cuuccuuuuauuua

SEQ ID NO: 4218330 - RNA, 20 nt, Yersinia pestis KIM
cuuccuuuuuaugccauaaa

SEQ ID NO: 4218331 - RNA, 21 nt, Yersinia pestis KIM
cuucgaaagaaauaaaagaaa

SEQ ID NO: 4218332 - RNA, 17 nt, Yersinia pestis KIM
cuucgacaggcaauuau

SEQ ID NO: 4218333 - RNA, 12 nt, Yersinia pestis KIM
cuucgagcaccg

SEQ ID NO: 4218334 - RNA, 21 nt, Yersinia pestis KIM
cuucgccaggucaggaagaga

SEQ ID NO: 4218335 - RNA, 22 nt, Yersinia pestis KIM
cuucgccaggucaggaagagaa

SEQ ID NO: 4218336 - RNA, 21 nt, Yersinia pestis KIM
cuucgccgggucaggaagaga

SEQ ID NO: 4218337 - RNA, 15 nt, Yersinia pestis KIM
cuucgcgaacacaau

SEQ ID NO: 4218338 - RNA, 19 nt, Yersinia pestis KIM
cuucgcgaucagguuguuc

SEQ ID NO: 4218339 - RNA, 18 nt, Yersinia pestis KIM
cuucgcggugauuccaau

SEQ ID NO: 4218340 - RNA, 22 nt, Yersinia pestis KIM
cuucgcuuuacccugguuagca

SEQ ID NO: 4218341 - RNA, 15 nt, Yersinia pestis KIM
cuucgcuuucaucuu

SEQ ID NO: 4218342 - RNA, 15 nt, Yersinia pestis KIM
cuucggacggcugac

SEQ ID NO: 4218343 - RNA, 16 nt, Yersinia pestis KIM
cuucgguaaauuuaua

SEQ ID NO: 4218344 - RNA, 22 nt, Yersinia pestis KIM
cuucgguauauuucccguugau

SEQ ID NO: 4218345 - RNA, 16 nt, Yersinia pestis KIM
cuucggucucuggaug

SEQ ID NO: 4218346 - RNA, 21 nt, Yersinia pestis KIM
cuucgguuugagcuugcugcu

SEQ ID NO: 4218347 - RNA, 13 nt, Yersinia pestis KIM
cuuuaauaaaauc

SEQ ID NO: 4218348 - RNA, 14 nt, Yersinia pestis KIM
cuuuaauaaaauca

SEQ ID NO: 4218349 - RNA, 18 nt, Yersinia pestis KIM
cuuuaaucagcccuucuu

SEQ ID NO: 4218350 - RNA, 17 nt, Yersinia pestis KIM
cuuuaaucgccugaugc

SEQ ID NO: 4218351 - RNA, 22 nt, Yersinia pestis KIM
cuuuaccaugcucauguucaug

SEQ ID NO: 4218352 - RNA, 15 nt, Yersinia pestis KIM
cuuuaccuacaaccu

SEQ ID NO: 4218353 - RNA, 20 nt, Yersinia pestis KIM
cuuuacgcagcuuguugaua

SEQ ID NO: 4218354 - RNA, 23 nt, Yersinia pestis KIM
cuuuacgcagcuuguugauauca

SEQ ID NO: 4218355 - RNA, 23 nt, Yersinia pestis KIM
cuuuacggccgcuaguuugacgc

SEQ ID NO: 4218356 - RNA, 20 nt, Yersinia pestis KIM
cuuuacgggcggcauaaucc

SEQ ID NO: 4218357 - RNA, 23 nt, Yersinia pestis KIM
cuuuacggucgucgagaauaacg

SEQ ID NO: 4218358 - RNA, 18 nt, Yersinia pestis KIM
cuuuacuccccugccuau

SEQ ID NO: 4218359 - RNA, 23 nt, Yersinia pestis KIM
cuuuacuccccugccuauccuca

SEQ ID NO: 4218360 - RNA, 16 nt, Yersinia pestis KIM
cuuuacuccucugccu

SEQ ID NO: 4218361 - RNA, 17 nt, Yersinia pestis KIM
cuuuacuccucugccua

SEQ ID NO: 4218362 - RNA, 19 nt, Yersinia pestis KIM
cuuuacuccucugccuauc

SEQ ID NO: 4218363 - RNA, 22 nt, Yersinia pestis KIM
cuuuacuccucugccuauccuc

SEQ ID NO: 4218364 - RNA, 14 nt, Yersinia pestis KIM
cuuuacucuucaau

SEQ ID NO: 4218365 - RNA, 20 nt, Yersinia pestis KIM
cuuuacucuucugccuaucc

SEQ ID NO: 4218366 - RNA, 18 nt, Yersinia pestis KIM
cuuuacugguuugaauuc

SEQ ID NO: 4218367 - RNA, 12 nt, Yersinia pestis KIM
cuuuacugucag

SEQ ID NO: 4218368 - RNA, 14 nt, Yersinia pestis KIM
cuuuacuugguuac

SEQ ID NO: 4218369 - RNA, 14 nt, Yersinia pestis KIM
cuuuagcauugcag

SEQ ID NO: 4218370 - RNA, 18 nt, Yersinia pestis KIM
cuuuagccagucaccgcu

SEQ ID NO: 4218371 - RNA, 13 nt, Yersinia pestis KIM
cuuuaggaaagcc

SEQ ID NO: 4218372 - RNA, 14 nt, Yersinia pestis KIM
cuuuaggcaagagu

SEQ ID NO: 4218373 - RNA, 18 nt, Yersinia pestis KIM
cuuuagggcggccuuaau

SEQ ID NO: 4218374 - RNA, 21 nt, Yersinia pestis KIM
cuuuauacauauguugaguca

SEQ ID NO: 4218375 - RNA, 18 nt, Yersinia pestis KIM
cuuuauacccaaaauaau

SEQ ID NO: 4218376 - RNA, 17 nt, Yersinia pestis KIM
cuuuaucaauuuauacc

SEQ ID NO: 4218377 - RNA, 21 nt, Yersinia pestis KIM
cuuuaucauugaguucugauc

SEQ ID NO: 4218378 - RNA, 15 nt, Yersinia pestis KIM
cuuuauccacuuggc

SEQ ID NO: 4218379 - RNA, 21 nt, Yersinia pestis KIM
cuuuauccagccaccuuaagu

SEQ ID NO: 4218380 - RNA, 19 nt, Yersinia pestis KIM
cuuuauguaacacauauuu

SEQ ID NO: 4218381 - RNA, 23 nt, Yersinia pestis KIM
cuuuauguacauccaauuuuuuc

SEQ ID NO: 4218382 - RNA, 17 nt, Yersinia pestis KIM
cuuuauguauucuugua

SEQ ID NO: 4218383 - RNA, 21 nt, Yersinia pestis KIM
cuuuauguauucuuguauccu

SEQ ID NO: 4218384 - RNA, 12 nt, Yersinia pestis KIM
cuuuauuauaug

SEQ ID NO: 4218385 - RNA, 13 nt, Yersinia pestis KIM
cuuuauucaauac

SEQ ID NO: 4218386 - RNA, 14 nt, Yersinia pestis KIM
cuuuauucaauacu

SEQ ID NO: 4218387 - RNA, 18 nt, Yersinia pestis KIM
cuuuauucauucagagua

SEQ ID NO: 4218388 - RNA, 15 nt, Yersinia pestis KIM
cuuuauuuuuuucca

SEQ ID NO: 4218389 - RNA, 20 nt, Yersinia pestis KIM
cuuucaaaauugagauauuu

SEQ ID NO: 4218390 - RNA, 22 nt, Yersinia pestis KIM
cuuucaacaaauucaccagcaa

SEQ ID NO: 4218391 - RNA, 13 nt, Yersinia pestis KIM
cuuucacauuacc

SEQ ID NO: 4218392 - RNA, 15 nt, Yersinia pestis KIM
cuuucaccacugcca

SEQ ID NO: 4218393 - RNA, 21 nt, Yersinia pestis KIM
cuuucaccgcuguagguguca

SEQ ID NO: 4218394 - RNA, 13 nt, Yersinia pestis KIM
cuuucacguuggu

SEQ ID NO: 4218395 - RNA, 20 nt, Yersinia pestis KIM
cuuucagauaaugccuaagc

SEQ ID NO: 4218396 - RNA, 21 nt, Yersinia pestis KIM
cuuucaggagugaauuucuuc

SEQ ID NO: 4218397 - RNA, 23 nt, Yersinia pestis KIM
cuuucagggaguaacuugacgac

SEQ ID NO: 4218398 - RNA, 16 nt, Yersinia pestis KIM
cuuucagugagcauuu

SEQ ID NO: 4218399 - RNA, 17 nt, Yersinia pestis KIM
cuuucauacaucauuug

SEQ ID NO: 4218400 - RNA, 17 nt, Yersinia pestis KIM
cuuucaucgauugcugg

SEQ ID NO: 4218401 - RNA, 16 nt, Yersinia pestis KIM
cuuucaucuucuucuu

SEQ ID NO: 4218402 - RNA, 20 nt, Yersinia pestis KIM
cuuuccacgcccaacucuuu

SEQ ID NO: 4218403 - RNA, 12 nt, Yersinia pestis KIM
cuuuccagcaaa

SEQ ID NO: 4218404 - RNA, 12 nt, Yersinia pestis KIM
cuuuccagccaa

SEQ ID NO: 4218405 - RNA, 16 nt, Yersinia pestis KIM
cuuuccagccaauaca

SEQ ID NO: 4218406 - RNA, 14 nt, Yersinia pestis KIM
cuuuccauccagaa

SEQ ID NO: 4218407 - RNA, 12 nt, Yersinia pestis KIM
cuuuccccagau

SEQ ID NO: 4218408 - RNA, 24 nt, Yersinia pestis KIM
cuuucccccauaauucugccgacu

SEQ ID NO: 4218409 - RNA, 19 nt, Yersinia pestis KIM
cuuucccgcgucgugauga

SEQ ID NO: 4218410 - RNA, 22 nt, Yersinia pestis KIM
cuuucgauagucagcuucacuu

SEQ ID NO: 4218411 - RNA, 21 nt, Yersinia pestis KIM
cuuucgccaucgucucugcau

SEQ ID NO: 4218412 - RNA, 17 nt, Yersinia pestis KIM
cuuucgggcaaaaaaau

SEQ ID NO: 4218413 - RNA, 15 nt, Yersinia pestis KIM
cuuucguuucugucu

SEQ ID NO: 4218414 - RNA, 17 nt, Yersinia pestis KIM
cuuucuaagcugccugu

SEQ ID NO: 4218415 - RNA, 18 nt, Yersinia pestis KIM
cuuucuaagcugccugug

SEQ ID NO: 4218416 - RNA, 14 nt, Yersinia pestis KIM
cuuucuaauuauua

SEQ ID NO: 4218417 - RNA, 22 nt, Yersinia pestis KIM
cuuucucauuagcgucuuuuuu

SEQ ID NO: 4218418 - RNA, 17 nt, Yersinia pestis KIM
cuuucuccuuugauuug

SEQ ID NO: 4218419 - RNA, 20 nt, Yersinia pestis KIM
cuuucucgacauccaauuca

SEQ ID NO: 4218420 - RNA, 16 nt, Yersinia pestis KIM
cuuucucgauacaauu

SEQ ID NO: 4218421 - RNA, 18 nt, Yersinia pestis KIM
cuuucucuccuuauacua

SEQ ID NO: 4218422 - RNA, 14 nt, Yersinia pestis KIM
cuuucugcaauagc

SEQ ID NO: 4218423 - RNA, 16 nt, Yersinia pestis KIM
cuuucuguucaucaau

SEQ ID NO: 4218424 - RNA, 14 nt, Yersinia pestis KIM
cuuucuucagcggu

SEQ ID NO: 4218425 - RNA, 20 nt, Yersinia pestis KIM
cuuucuuuaaucacucucau

SEQ ID NO: 4218426 - RNA, 22 nt, Yersinia pestis KIM
cuuucuuuucgcuauuucucuc

SEQ ID NO: 4218427 - RNA, 16 nt, Yersinia pestis KIM
cuuugaacugcacccc

SEQ ID NO: 4218428 - RNA, 13 nt, Yersinia pestis KIM
cuuugacagcauc

SEQ ID NO: 4218429 - RNA, 15 nt, Yersinia pestis KIM
cuuugacagcaucug

SEQ ID NO: 4218430 - RNA, 17 nt, Yersinia pestis KIM
cuuugaccgaaccaccg

SEQ ID NO: 4218431 - RNA, 13 nt, Yersinia pestis KIM
cuuugauagaaau

SEQ ID NO: 4218432 - RNA, 12 nt, Yersinia pestis KIM
cuuugcgugaca

SEQ ID NO: 4218433 - RNA, 17 nt, Yersinia pestis KIM
cuuugcgugacauacuu

SEQ ID NO: 4218434 - RNA, 14 nt, Yersinia pestis KIM
cuuugcuuugacua

SEQ ID NO: 4218435 - RNA, 14 nt, Yersinia pestis KIM
cuuuggaaccgcca

SEQ ID NO: 4218436 - RNA, 15 nt, Yersinia pestis KIM
cuuuggaaccgccau

SEQ ID NO: 4218437 - RNA, 21 nt, Yersinia pestis KIM
cuuuggcaaucacaacccccc

SEQ ID NO: 4218438 - RNA, 18 nt, Yersinia pestis KIM
cuuugggauucaauaagu

SEQ ID NO: 4218439 - RNA, 15 nt, Yersinia pestis KIM
cuuugggcugaucau

SEQ ID NO: 4218440 - RNA, 18 nt, Yersinia pestis KIM
cuuuggguauaugacugu

SEQ ID NO: 4218441 - RNA, 19 nt, Yersinia pestis KIM
cuuugggucaguuauaaaa

SEQ ID NO: 4218442 - RNA, 18 nt, Yersinia pestis KIM
cuuugguugccagauaau

SEQ ID NO: 4218443 - RNA, 23 nt, Yersinia pestis KIM
cuuugucaauaaccucagccuca

SEQ ID NO: 4218444 - RNA, 18 nt, Yersinia pestis KIM
cuuuguuuuuuagcauca

SEQ ID NO: 4218445 - RNA, 22 nt, Yersinia pestis KIM
cuuuuaaaugaagcaguucacu

SEQ ID NO: 4218446 - RNA, 18 nt, Yersinia pestis KIM
cuuuuaacguuagagcac

SEQ ID NO: 4218447 - RNA, 15 nt, Yersinia pestis KIM
cuuuuaccaacccag

SEQ ID NO: 4218448 - RNA, 21 nt, Yersinia pestis KIM
cuuuuauacagcauauaaaaa

SEQ ID NO: 4218449 - RNA, 22 nt, Yersinia pestis KIM
cuuuuauacagcauauaaaaaa

SEQ ID NO: 4218450 - RNA, 19 nt, Yersinia pestis KIM
cuuuuaugacggcaucgag

SEQ ID NO: 4218451 - RNA, 17 nt, Yersinia pestis KIM
cuuuuaugcaucuuuua

SEQ ID NO: 4218452 - RNA, 22 nt, Yersinia pestis KIM
cuuuuauuugauucgucugcca

SEQ ID NO: 4218453 - RNA, 23 nt, Yersinia pestis KIM
cuuuuauuuuuuaugacuucuua

SEQ ID NO: 4218454 - RNA, 20 nt, Yersinia pestis KIM
cuuuuccgccaugagaacca

SEQ ID NO: 4218455 - RNA, 16 nt, Yersinia pestis KIM
cuuuucugauuuuuua

SEQ ID NO: 4218456 - RNA, 12 nt, Yersinia pestis KIM
cuuuucugccua

SEQ ID NO: 4218457 - RNA, 16 nt, Yersinia pestis KIM
cuuuucuucuuugaca

SEQ ID NO: 4218458 - RNA, 21 nt, Yersinia pestis KIM
cuuuucuuuaugucuuuuucu

SEQ ID NO: 4218459 - RNA, 16 nt, Yersinia pestis KIM
cuuuugaauucaccaa

SEQ ID NO: 4218460 - RNA, 17 nt, Yersinia pestis KIM
cuuuugcauauuucucu

SEQ ID NO: 4218461 - RNA, 21 nt, Yersinia pestis KIM
gaaaucuccuguggcacauca

SEQ ID NO: 4218462 - RNA, 14 nt, Yersinia pestis KIM
gaaaugacaaauca

SEQ ID NO: 4218463 - RNA, 16 nt, Yersinia pestis KIM
gaaaugauaucugaau

SEQ ID NO: 4218464 - RNA, 17 nt, Yersinia pestis KIM
gaaaugccgauaaaaac

SEQ ID NO: 4218465 - RNA, 19 nt, Yersinia pestis KIM
gaaaugccgauaaaaacua

SEQ ID NO: 4218466 - RNA, 20 nt, Yersinia pestis KIM
gaaauuaaaaauuaauuauu

SEQ ID NO: 4218467 - RNA, 13 nt, Yersinia pestis KIM
gaaauuauauucu

SEQ ID NO: 4218468 - RNA, 20 nt, Yersinia pestis KIM
gaaauucaaccucuuguaaa

SEQ ID NO: 4218469 - RNA, 19 nt, Yersinia pestis KIM
gaaauucauuaucaggcac

SEQ ID NO: 4218470 - RNA, 16 nt, Yersinia pestis KIM
gaaauucgggcugagu

SEQ ID NO: 4218471 - RNA, 23 nt, Yersinia pestis KIM
gaaauucgggcugaguaaagccc

SEQ ID NO: 4218472 - RNA, 19 nt, Yersinia pestis KIM
gaaauucuguagaguaaaa

SEQ ID NO: 4218473 - RNA, 23 nt, Yersinia pestis KIM
gaaauucuguagaguaaaacuga

SEQ ID NO: 4218474 - RNA, 18 nt, Yersinia pestis KIM
gaaauuuaaaaacccucu

SEQ ID NO: 4218475 - RNA, 20 nt, Yersinia pestis KIM
gaaauuuaagaaaucuauua

SEQ ID NO: 4218476 - RNA, 15 nt, Yersinia pestis KIM
gaaauuugcacugca

SEQ ID NO: 4218477 - RNA, 17 nt, Yersinia pestis KIM
gaaauuuguucaagcgu

SEQ ID NO: 4218478 - RNA, 14 nt, Yersinia pestis KIM
gaacaaaacaagcc

SEQ ID NO: 4218479 - RNA, 16 nt, Yersinia pestis KIM
gaacaagacuuucccc

SEQ ID NO: 4218480 - RNA, 15 nt, Yersinia pestis KIM
gaacaccauacuuuu

SEQ ID NO: 4218481 - RNA, 19 nt, Yersinia pestis KIM
gaacacgacgccauaaaag

SEQ ID NO: 4218482 - RNA, 20 nt, Yersinia pestis KIM
gaacacgacgccauaaaaga

SEQ ID NO: 4218483 - RNA, 21 nt, Yersinia pestis KIM
gaacacgauaagcgggguuaa

SEQ ID NO: 4218484 - RNA, 18 nt, Yersinia pestis KIM
gaacacgcucgcguguca

SEQ ID NO: 4218485 - RNA, 21 nt, Yersinia pestis KIM
gaacacuuaauuccaugcaaa

SEQ ID NO: 4218486 - RNA, 14 nt, Yersinia pestis KIM
gaacagauugcagg

SEQ ID NO: 4218487 - RNA, 21 nt, Yersinia pestis KIM
gaacagcaggccgcgaauaug

SEQ ID NO: 4218488 - RNA, 14 nt, Yersinia pestis KIM
gaacagccccaacc

SEQ ID NO: 4218489 - RNA, 18 nt, Yersinia pestis KIM
gaacagccccgcaggugg

SEQ ID NO: 4218490 - RNA, 12 nt, Yersinia pestis KIM
gaacagcccucc

SEQ ID NO: 4218491 - RNA, 19 nt, Yersinia pestis KIM
gaacagccuaacgggugac

SEQ ID NO: 4218492 - RNA, 15 nt, Yersinia pestis KIM
gaacaggcagaucgu

SEQ ID NO: 4218493 - RNA, 18 nt, Yersinia pestis KIM
gaacaggccaaagcuguu

SEQ ID NO: 4218494 - RNA, 16 nt, Yersinia pestis KIM
gaacagugccaacagc

SEQ ID NO: 4218495 - RNA, 20 nt, Yersinia pestis KIM
gaacaugcguugaugcucuu

SEQ ID NO: 4218496 - RNA, 18 nt, Yersinia pestis KIM
gaacauuauuuuucacga

SEQ ID NO: 4218497 - RNA, 19 nt, Yersinia pestis KIM
gaacauuauuuuucacgag

SEQ ID NO: 4218498 - RNA, 18 nt, Yersinia pestis KIM
gaacauugcaguauuuug

SEQ ID NO: 4218499 - RNA, 13 nt, Yersinia pestis KIM
gaacauuuucuaa

SEQ ID NO: 4218500 - RNA, 20 nt, Yersinia pestis KIM
gaacauuuucuaagcugccu

SEQ ID NO: 4218501 - RNA, 22 nt, Yersinia pestis KIM
gaacauuuucuaagcugccugu

SEQ ID NO: 4218502 - RNA, 18 nt, Yersinia pestis KIM
gaaccaauuuuucuguau

SEQ ID NO: 4218503 - RNA, 17 nt, Yersinia pestis KIM
gaaccaccgcagccgca

SEQ ID NO: 4218504 - RNA, 24 nt, Yersinia pestis KIM
gaaccauaaacaaguugaaccaua

SEQ ID NO: 4218505 - RNA, 13 nt, Yersinia pestis KIM
gaaccaucaacaa

SEQ ID NO: 4218506 - RNA, 19 nt, Yersinia pestis KIM
gaaccaugagaaugcgaca

SEQ ID NO: 4218507 - RNA, 22 nt, Yersinia pestis KIM
gaaccauuuuuuguagugaaag

SEQ ID NO: 4218508 - RNA, 18 nt, Yersinia pestis KIM
gaacccccgcgaacagca

SEQ ID NO: 4218509 - RNA, 18 nt, Yersinia pestis KIM
gaacccgcuaacaugcca

SEQ ID NO: 4218510 - RNA, 13 nt, Yersinia pestis KIM
gaacccugacggc

SEQ ID NO: 4218511 - RNA, 17 nt, Yersinia pestis KIM
gaaccgcgcucugcugg

SEQ ID NO: 4218512 - RNA, 20 nt, Yersinia pestis KIM
gaaccgcuaucugcugacca

SEQ ID NO: 4218513 - RNA, 14 nt, Yersinia pestis KIM
gaaccguacagaua

SEQ ID NO: 4218514 - RNA, 17 nt, Yersinia pestis KIM
gaaccugacgcacagca

SEQ ID NO: 4218515 - RNA, 20 nt, Yersinia pestis KIM
gaaccuguuacaucagagcu

SEQ ID NO: 4218516 - RNA, 22 nt, Yersinia pestis KIM
gaaccuguuacaucagagcuca

SEQ ID NO: 4218517 - RNA, 17 nt, Yersinia pestis KIM
gaacgaggacuuccugc

SEQ ID NO: 4218518 - RNA, 22 nt, Yersinia pestis KIM
gaacgaggcccgauaaacugac

SEQ ID NO: 4218519 - RNA, 17 nt, Yersinia pestis KIM
gaacgauauuuucgaca

SEQ ID NO: 4218520 - RNA, 14 nt, Yersinia pestis KIM
gaacgauauuuuua

SEQ ID NO: 4218521 - RNA, 13 nt, Yersinia pestis KIM
gaacgcacaaugg

SEQ ID NO: 4218522 - RNA, 19 nt, Yersinia pestis KIM
gaacgccaaguaugcaggc

SEQ ID NO: 4218523 - RNA, 14 nt, Yersinia pestis KIM
gaacgcucuguuga

SEQ ID NO: 4218524 - RNA, 20 nt, Yersinia pestis KIM
gaacgcuuguggaaauagaa

SEQ ID NO: 4218525 - RNA, 19 nt, Yersinia pestis KIM
gaacggacauuuagcacug

SEQ ID NO: 4218526 - RNA, 21 nt, Yersinia pestis KIM
gaacggacauuuuacucccug

SEQ ID NO: 4218527 - RNA, 13 nt, Yersinia pestis KIM
gaacggagaugau

SEQ ID NO: 4218528 - RNA, 23 nt, Yersinia pestis KIM
gaacggccaucaauaaagcuggc

SEQ ID NO: 4218529 - RNA, 16 nt, Yersinia pestis KIM
gaacggugaggauagg

SEQ ID NO: 4218530 - RNA, 21 nt, Yersinia pestis KIM
gaacguaagauaauacggaua

SEQ ID NO: 4218531 - RNA, 17 nt, Yersinia pestis KIM
gaacuaauaucaacaga

SEQ ID NO: 4218532 - RNA, 20 nt, Yersinia pestis KIM
gaacuaccgugcggcuucuu

SEQ ID NO: 4218533 - RNA, 15 nt, Yersinia pestis KIM
gaacucauuuuuugc

SEQ ID NO: 4218534 - RNA, 15 nt, Yersinia pestis KIM
gaacucgauaauaaa

SEQ ID NO: 4218535 - RNA, 13 nt, Yersinia pestis KIM
gaacucgguguau

SEQ ID NO: 4218536 - RNA, 15 nt, Yersinia pestis KIM
gaacuguaaauauca

SEQ ID NO: 4218537 - RNA, 14 nt, Yersinia pestis KIM
gaacuuacucccuu

SEQ ID NO: 4218538 - RNA, 13 nt, Yersinia pestis KIM
gaacuucgaaaga

SEQ ID NO: 4218539 - RNA, 22 nt, Yersinia pestis KIM
gaagaaaagagucgcuuuggga

SEQ ID NO: 4218540 - RNA, 13 nt, Yersinia pestis KIM
gaagaaacccagu

SEQ ID NO: 4218541 - RNA, 22 nt, Yersinia pestis KIM
gaagaaaccuaaugccagacac

SEQ ID NO: 4218542 - RNA, 15 nt, Yersinia pestis KIM
gaagaacaaauucau

SEQ ID NO: 4218543 - RNA, 14 nt, Yersinia pestis KIM
gaagaacagcccuc

SEQ ID NO: 4218544 - RNA, 19 nt, Yersinia pestis KIM
gaagaaucaccgaaagaag

SEQ ID NO: 4218545 - RNA, 12 nt, Yersinia pestis KIM
gaagaauugcag

SEQ ID NO: 4218546 - RNA, 17 nt, Yersinia pestis KIM
gaagacaacucuucuau

SEQ ID NO: 4218547 - RNA, 17 nt, Yersinia pestis KIM
gaagacagauccugccg

SEQ ID NO: 4218548 - RNA, 22 nt, Yersinia pestis KIM
gaagacaucgccagauucgcaa

SEQ ID NO: 4218549 - RNA, 15 nt, Yersinia pestis KIM
gaagacgaguaauga

SEQ ID NO: 4218550 - RNA, 18 nt, Yersinia pestis KIM
gaagacgaguaaugaaau

SEQ ID NO: 4218551 - RNA, 19 nt, Yersinia pestis KIM
gaagacgaguaaugaaauc

SEQ ID NO: 4218552 - RNA, 13 nt, Yersinia pestis KIM
gaagacuuccagc

SEQ ID NO: 4218553 - RNA, 23 nt, Yersinia pestis KIM
gaagagaacaggcagcaaauaaa

SEQ ID NO: 4218554 - RNA, 16 nt, Yersinia pestis KIM
gaagagauagauuuua

SEQ ID NO: 4218555 - RNA, 22 nt, Yersinia pestis KIM
gaagaguuugaucauggcucag

SEQ ID NO: 4218556 - RNA, 19 nt, Yersinia pestis KIM
gaagauacaauagauaacu

SEQ ID NO: 4218557 - RNA, 18 nt, Yersinia pestis KIM
gaagaucagugaacugcu

SEQ ID NO: 4218558 - RNA, 17 nt, Yersinia pestis KIM
gaagauucaaccaauua

SEQ ID NO: 4218559 - RNA, 12 nt, Yersinia pestis KIM
gaagcaagaaac

SEQ ID NO: 4218560 - RNA, 16 nt, Yersinia pestis KIM
gaagcaaucaggaaau

SEQ ID NO: 4218561 - RNA, 12 nt, Yersinia pestis KIM
gaagcaaugaaa

SEQ ID NO: 4218562 - RNA, 15 nt, Yersinia pestis KIM
gaagcacaaaaagag

SEQ ID NO: 4218563 - RNA, 19 nt, Yersinia pestis KIM
gaagcaguucacugaguug

SEQ ID NO: 4218564 - RNA, 21 nt, Yersinia pestis KIM
gaagccuacgagagaucguag

SEQ ID NO: 4218565 - RNA, 17 nt, Yersinia pestis KIM
gaagccucaugaaugag

SEQ ID NO: 4218566 - RNA, 21 nt, Yersinia pestis KIM
gaagccugaauauucaccauc

SEQ ID NO: 4218567 - RNA, 20 nt, Yersinia pestis KIM
gaagccuguucgauuugauc

SEQ ID NO: 4218568 - RNA, 22 nt, Yersinia pestis KIM
gaagcgacacuuauuggucgcu

SEQ ID NO: 4218569 - RNA, 18 nt, Yersinia pestis KIM
gaagcgccgacacccagc

SEQ ID NO: 4218570 - RNA, 14 nt, Yersinia pestis KIM
gaagcgcgcccucc

SEQ ID NO: 4218571 - RNA, 22 nt, Yersinia pestis KIM
gaagcgggcggccucugcugcu

SEQ ID NO: 4218572 - RNA, 15 nt, Yersinia pestis KIM
gaagcguaaagcacc

SEQ ID NO: 4218573 - RNA, 14 nt, Yersinia pestis KIM
gaagcuaccagcac

SEQ ID NO: 4218574 - RNA, 15 nt, Yersinia pestis KIM
gaagcucauaugcag

SEQ ID NO: 4218575 - RNA, 19 nt, Yersinia pestis KIM
gacaaaagugucauuugga

SEQ ID NO: 4218576 - RNA, 14 nt, Yersinia pestis KIM
gacaaaauacgguu

SEQ ID NO: 4218577 - RNA, 15 nt, Yersinia pestis KIM
gacaaaccccgauaa

SEQ ID NO: 4218578 - RNA, 19 nt, Yersinia pestis KIM
gacaaauaaaacagaaccc

SEQ ID NO: 4218579 - RNA, 10 nt, Yersinia pestis KIM
gacaaauaag

SEQ ID NO: 4218580 - RNA, 13 nt, Yersinia pestis KIM
gacaaccaauaca

SEQ ID NO: 4218581 - RNA, 12 nt, Yersinia pestis KIM
gacaacgcuauu

SEQ ID NO: 4218582 - RNA, 16 nt, Yersinia pestis KIM
gacaacgucacuucca

SEQ ID NO: 4218583 - RNA, 20 nt, Yersinia pestis KIM
gacaacuuagguucaaucgg

SEQ ID NO: 4218584 - RNA, 22 nt, Yersinia pestis KIM
gacaagucaugguacaacugcg

SEQ ID NO: 4218585 - RNA, 23 nt, Yersinia pestis KIM
gacaauaacggaaaaucaucgcu

SEQ ID NO: 4218586 - RNA, 21 nt, Yersinia pestis KIM
gacaauaccgccacacaauac

SEQ ID NO: 4218587 - RNA, 15 nt, Yersinia pestis KIM
gacaauauaauaaug

SEQ ID NO: 4218588 - RNA, 14 nt, Yersinia pestis KIM
gacaauauuccaaa

SEQ ID NO: 4218589 - RNA, 19 nt, Yersinia pestis KIM
gacaauccuaucguuuauu

SEQ ID NO: 4218590 - RNA, 21 nt, Yersinia pestis KIM
gacaaucuguuccugauucca

SEQ ID NO: 4218591 - RNA, 14 nt, Yersinia pestis KIM
gacaaugacugugc

SEQ ID NO: 4218592 - RNA, 15 nt, Yersinia pestis KIM
gacaaugaucgucaa

SEQ ID NO: 4218593 - RNA, 12 nt, Yersinia pestis KIM
gacaaugcguua

SEQ ID NO: 4218594 - RNA, 18 nt, Yersinia pestis KIM
gacaauugagucgcucuu

SEQ ID NO: 4218595 - RNA, 18 nt, Yersinia pestis KIM
gacacaaaugcugugcca

SEQ ID NO: 4218596 - RNA, 18 nt, Yersinia pestis KIM
gacacaauagaugcagua

SEQ ID NO: 4218597 - RNA, 13 nt, Yersinia pestis KIM
gacacaauucccg

SEQ ID NO: 4218598 - RNA, 15 nt, Yersinia pestis KIM
gacacauaaguguau

SEQ ID NO: 4218599 - RNA, 14 nt, Yersinia pestis KIM
gacaccaauaccga

SEQ ID NO: 4218600 - RNA, 18 nt, Yersinia pestis KIM
gacacccgcuucauucgc

SEQ ID NO: 4218601 - RNA, 22 nt, Yersinia pestis KIM
gacacccguuccuucagccacc

SEQ ID NO: 4218602 - RNA, 16 nt, Yersinia pestis KIM
gacaccggggauccau

SEQ ID NO: 4218603 - RNA, 14 nt, Yersinia pestis KIM
gacacgcucaucca

SEQ ID NO: 4218604 - RNA, 14 nt, Yersinia pestis KIM
gacacuaaccagac

SEQ ID NO: 4218605 - RNA, 17 nt, Yersinia pestis KIM
gacacugacaucaucac

SEQ ID NO: 4218606 - RNA, 13 nt, Yersinia pestis KIM
gacacugcaucuc

SEQ ID NO: 4218607 - RNA, 17 nt, Yersinia pestis KIM
gacacugcaucucugca

SEQ ID NO: 4218608 - RNA, 15 nt, Yersinia pestis KIM
gacacuuuugucgcu

SEQ ID NO: 4218609 - RNA, 15 nt, Yersinia pestis KIM
gacagaaaaaucaca

SEQ ID NO: 4218610 - RNA, 15 nt, Yersinia pestis KIM
gacagaauauccagc

SEQ ID NO: 4218611 - RNA, 17 nt, Yersinia pestis KIM
gacagauccugccgccu

SEQ ID NO: 4218612 - RNA, 20 nt, Yersinia pestis KIM
gacagauuauuucagcuuca

SEQ ID NO: 4218613 - RNA, 21 nt, Yersinia pestis KIM
gacagcauacauccuaaauaa

SEQ ID NO: 4218614 - RNA, 22 nt, Yersinia pestis KIM
gacagcauacauccuaaauaau

SEQ ID NO: 4218615 - RNA, 22 nt, Yersinia pestis KIM
gacagcaucugcaauggcuggc

SEQ ID NO: 4218616 - RNA, 14 nt, Yersinia pestis KIM
gacagccugugccc

SEQ ID NO: 4218617 - RNA, 12 nt, Yersinia pestis KIM
gacagcgcgcag

SEQ ID NO: 4218618 - RNA, 17 nt, Yersinia pestis KIM
gacagcgcgcagccaac

SEQ ID NO: 4218619 - RNA, 19 nt, Yersinia pestis KIM
gacaggauaagcagggcga

SEQ ID NO: 4218620 - RNA, 18 nt, Yersinia pestis KIM
gacaggcaauuauccauc

SEQ ID NO: 4218621 - RNA, 22 nt, Yersinia pestis KIM
gacaggcuaacaacuaacgauu

SEQ ID NO: 4218622 - RNA, 22 nt, Yersinia pestis KIM
gacaguagugaguuaacgagug

SEQ ID NO: 4218623 - RNA, 17 nt, Yersinia pestis KIM
gacaguauuugcagugg

SEQ ID NO: 4218624 - RNA, 14 nt, Yersinia pestis KIM
gacauaaagaaaag

SEQ ID NO: 4218625 - RNA, 17 nt, Yersinia pestis KIM
gacauaagaugaccacc

SEQ ID NO: 4218626 - RNA, 18 nt, Yersinia pestis KIM
gacauaagaugaccacca

SEQ ID NO: 4218627 - RNA, 22 nt, Yersinia pestis KIM
gacauaagaugaccaccaauuu

SEQ ID NO: 4218628 - RNA, 18 nt, Yersinia pestis KIM
gacauaaugccggcggcc

SEQ ID NO: 4218629 - RNA, 15 nt, Yersinia pestis KIM
gacauacuuugccuu

SEQ ID NO: 4218630 - RNA, 22 nt, Yersinia pestis KIM
gacauauuguccaacaucuccg

SEQ ID NO: 4218631 - RNA, 19 nt, Yersinia pestis KIM
gacaucagguuguauuuug

SEQ ID NO: 4218632 - RNA, 21 nt, Yersinia pestis KIM
gacauccaccauuuggggugu

SEQ ID NO: 4218633 - RNA, 19 nt, Yersinia pestis KIM
gacaucgacggcagugacg

SEQ ID NO: 4218634 - RNA, 14 nt, Yersinia pestis KIM
gacaucgccagauu

SEQ ID NO: 4218635 - RNA, 21 nt, Yersinia pestis KIM
gacaugcaccguaacuucuuc

SEQ ID NO: 4218636 - RNA, 14 nt, Yersinia pestis KIM
gacaugcucuucug

SEQ ID NO: 4218637 - RNA, 16 nt, Yersinia pestis KIM
gacauggcaacagcau

SEQ ID NO: 4218638 - RNA, 17 nt, Yersinia pestis KIM
gacaugugaguggugua

SEQ ID NO: 4218639 - RNA, 18 nt, Yersinia pestis KIM
gacauguugcccuuaguu

SEQ ID NO: 4218640 - RNA, 13 nt, Yersinia pestis KIM
gacauuauguucu

SEQ ID NO: 4218641 - RNA, 22 nt, Yersinia pestis KIM
gacauucucuacucgcucacca

SEQ ID NO: 4218642 - RNA, 17 nt, Yersinia pestis KIM
gacauucuggcuuuuca

SEQ ID NO: 4218643 - RNA, 16 nt, Yersinia pestis KIM
gacauugcccgccaga

SEQ ID NO: 4218644 - RNA, 23 nt, Yersinia pestis KIM
gacauuuccuuguggauccagca

SEQ ID NO: 4218645 - RNA, 14 nt, Yersinia pestis KIM
gacauuucggccac

SEQ ID NO: 4218646 - RNA, 18 nt, Yersinia pestis KIM
gacauuuuacucccugac

SEQ ID NO: 4218647 - RNA, 22 nt, Yersinia pestis KIM
gacauuuuuuagcccuaacugc

SEQ ID NO: 4218648 - RNA, 13 nt, Yersinia pestis KIM
gaccaaacagaau

SEQ ID NO: 4218649 - RNA, 13 nt, Yersinia pestis KIM
gaccaaacauugu

SEQ ID NO: 4218650 - RNA, 16 nt, Yersinia pestis KIM
gaccaaauagcaagcc

SEQ ID NO: 4218651 - RNA, 23 nt, Yersinia pestis KIM
gaccaaauagcaagccaaaacag

SEQ ID NO: 4218652 - RNA, 21 nt, Yersinia pestis KIM
gaccaaauggacgaacagccc

SEQ ID NO: 4218653 - RNA, 13 nt, Yersinia pestis KIM
gaccaaauucccc

SEQ ID NO: 4218654 - RNA, 15 nt, Yersinia pestis KIM
gaccaaccuguuuca

SEQ ID NO: 4218655 - RNA, 17 nt, Yersinia pestis KIM
gaccaacuggcaaucau

SEQ ID NO: 4218656 - RNA, 17 nt, Yersinia pestis KIM
gaccaauauaaaagcca

SEQ ID NO: 4218657 - RNA, 19 nt, Yersinia pestis KIM
gaccaauauaaaagccagc

SEQ ID NO: 4218658 - RNA, 20 nt, Yersinia pestis KIM
gaccaauauaaaagccagca

SEQ ID NO: 4218659 - RNA, 16 nt, Yersinia pestis KIM
gaccaauucaucagcg

SEQ ID NO: 4218660 - RNA, 19 nt, Yersinia pestis KIM
gaccaauugguaagaaugg

SEQ ID NO: 4218661 - RNA, 21 nt, Yersinia pestis KIM
gaccacagauaaauaaaauaa

SEQ ID NO: 4218662 - RNA, 14 nt, Yersinia pestis KIM
gaccaccaauuuca

SEQ ID NO: 4218663 - RNA, 14 nt, Yersinia pestis KIM
gaccaccacugcau

SEQ ID NO: 4218664 - RNA, 23 nt, Yersinia pestis KIM
gaccacuuccuguauugauacuc

SEQ ID NO: 4218665 - RNA, 21 nt, Yersinia pestis KIM
gaccacuugcugaugcccauc

SEQ ID NO: 4218666 - RNA, 21 nt, Yersinia pestis KIM
gaccacuuuuuguguuuuggc

SEQ ID NO: 4218667 - RNA, 21 nt, Yersinia pestis KIM
gaccagacaacagucacacca

SEQ ID NO: 4218668 - RNA, 16 nt, Yersinia pestis KIM
gaccagauaaucgcca

SEQ ID NO: 4218669 - RNA, 17 nt, Yersinia pestis KIM
gaccagauaaucgccaa

SEQ ID NO: 4218670 - RNA, 15 nt, Yersinia pestis KIM
gaccaguaagugauu

SEQ ID NO: 4218671 - RNA, 13 nt, Yersinia pestis KIM
gaccagugagcca

SEQ ID NO: 4218672 - RNA, 14 nt, Yersinia pestis KIM
gaccagugcaccca

SEQ ID NO: 4218673 - RNA, 23 nt, Yersinia pestis KIM
gaccagugcacccagcucgguga

SEQ ID NO: 4218674 - RNA, 19 nt, Yersinia pestis KIM
gaccaguggugcucccgca

SEQ ID NO: 4218675 - RNA, 17 nt, Yersinia pestis KIM
gaccauaaaaggauggc

SEQ ID NO: 4218676 - RNA, 20 nt, Yersinia pestis KIM
gaccauaaaaggauggccca

SEQ ID NO: 4218677 - RNA, 20 nt, Yersinia pestis KIM
gaccauggcgaucaaaggcg

SEQ ID NO: 4218678 - RNA, 13 nt, Yersinia pestis KIM
gaccauuucucug

SEQ ID NO: 4218679 - RNA, 15 nt, Yersinia pestis KIM
gacccaagggcuauu

SEQ ID NO: 4218680 - RNA, 17 nt, Yersinia pestis KIM
gacccaauauucgccag

SEQ ID NO: 4218681 - RNA, 13 nt, Yersinia pestis KIM
gacccgauuucaa

SEQ ID NO: 4218682 - RNA, 15 nt, Yersinia pestis KIM
gacccguuuauaaag

SEQ ID NO: 4218683 - RNA, 12 nt, Yersinia pestis KIM
gaccgagaagcu

SEQ ID NO: 4218684 - RNA, 24 nt, Yersinia pestis KIM
gaccgagaagcuucaacuuaauuu

SEQ ID NO: 4218685 - RNA, 18 nt, Yersinia pestis KIM
gaccgaguguaaaaagca

SEQ ID NO: 4218686 - RNA, 17 nt, Yersinia pestis KIM
gaccgauaaacgccagu

SEQ ID NO: 4218687 - RNA, 22 nt, Yersinia pestis KIM
gaccgcagccuucagaugaaug

SEQ ID NO: 4218688 - RNA, 22 nt, Yersinia pestis KIM
gaccgccagugccgcggcggcc

SEQ ID NO: 4218689 - RNA, 17 nt, Yersinia pestis KIM
gaccgcguaagccgugc

SEQ ID NO: 4218690 - RNA, 23 nt, Yersinia pestis KIM
gaccgcuaacaugguaugccacu

SEQ ID NO: 4218691 - RNA, 20 nt, Yersinia pestis KIM
gaccgcuguuugauuaaaac

SEQ ID NO: 4218692 - RNA, 13 nt, Yersinia pestis KIM
gaccguaccuauc

SEQ ID NO: 4218693 - RNA, 22 nt, Yersinia pestis KIM
gaccguagccaacacaugcugc

SEQ ID NO: 4218694 - RNA, 13 nt, Yersinia pestis KIM
gaccgucaccaaa

SEQ ID NO: 4218695 - RNA, 20 nt, Yersinia pestis KIM
gaccuaaaccgcucucaccu

SEQ ID NO: 4218696 - RNA, 20 nt, Yersinia pestis KIM
gaccucauuauuaaacugau

SEQ ID NO: 4218697 - RNA, 22 nt, Yersinia pestis KIM
gaccugacguucuuguaaccac

SEQ ID NO: 4218698 - RNA, 14 nt, Yersinia pestis KIM
gaccugcugcaccu

SEQ ID NO: 4218699 - RNA, 13 nt, Yersinia pestis KIM
gaccuuaauaccg

SEQ ID NO: 4218700 - RNA, 14 nt, Yersinia pestis KIM
gaccuuagauaaau

SEQ ID NO: 4218701 - RNA, 18 nt, Yersinia pestis KIM
gaccuucaucucugacac

SEQ ID NO: 4218702 - RNA, 15 nt, Yersinia pestis KIM
gaccuuccauaacuc

SEQ ID NO: 4218703 - RNA, 15 nt, Yersinia pestis KIM
gaccuugauucucaa

SEQ ID NO: 4218704 - RNA, 13 nt, Yersinia pestis KIM
gaccuugguaucu

SEQ ID NO: 4218705 - RNA, 15 nt, Yersinia pestis KIM
gacgaaagauaauuu

SEQ ID NO: 4218706 - RNA, 15 nt, Yersinia pestis KIM
gacgaaugagcagua

SEQ ID NO: 4218707 - RNA, 13 nt, Yersinia pestis KIM
gacgacagauuau

SEQ ID NO: 4218708 - RNA, 17 nt, Yersinia pestis KIM
gacgacauccacauuga

SEQ ID NO: 4218709 - RNA, 22 nt, Yersinia pestis KIM
gacgacauuaauuugcaacgca

SEQ ID NO: 4218710 - RNA, 15 nt, Yersinia pestis KIM
gacgagcggcauuga

SEQ ID NO: 4218711 - RNA, 16 nt, Yersinia pestis KIM
gacgaggguaauaaug

SEQ ID NO: 4218712 - RNA, 22 nt, Yersinia pestis KIM
gacgagucuauugaaaaaauaa

SEQ ID NO: 4218713 - RNA, 19 nt, Yersinia pestis KIM
gacgaugucggcaggcaac

SEQ ID NO: 4218714 - RNA, 19 nt, Yersinia pestis KIM
gacgcaaacggguggccgc

SEQ ID NO: 4218715 - RNA, 13 nt, Yersinia pestis KIM
gacgcaguaagau

SEQ ID NO: 4218716 - RNA, 15 nt, Yersinia pestis KIM
gacgccaacuucaag

SEQ ID NO: 4218717 - RNA, 16 nt, Yersinia pestis KIM
gacgccacaccacguu

SEQ ID NO: 4218718 - RNA, 14 nt, Yersinia pestis KIM
gacgcccgcagacu

SEQ ID NO: 4218719 - RNA, 16 nt, Yersinia pestis KIM
gacgcgaucugaaacg

SEQ ID NO: 4218720 - RNA, 15 nt, Yersinia pestis KIM
gacgcgaucuugaac

SEQ ID NO: 4218721 - RNA, 22 nt, Yersinia pestis KIM
gacgcuaaccaccgucaccaaa

SEQ ID NO: 4218722 - RNA, 13 nt, Yersinia pestis KIM
gacgcucucccca

SEQ ID NO: 4218723 - RNA, 15 nt, Yersinia pestis KIM
gacgcuggcacugga

SEQ ID NO: 4218724 - RNA, 16 nt, Yersinia pestis KIM
gacgcuggcagccuuu

SEQ ID NO: 4218725 - RNA, 20 nt, Yersinia pestis KIM
gacgcuguauacggacaaug

SEQ ID NO: 4218726 - RNA, 23 nt, Yersinia pestis KIM
gacgcuguauacggacaaugcca

SEQ ID NO: 4218727 - RNA, 16 nt, Yersinia pestis KIM
gacgcuugaauauagc

SEQ ID NO: 4218728 - RNA, 12 nt, Yersinia pestis KIM
gacggaacacgu

SEQ ID NO: 4218729 - RNA, 17 nt, Yersinia pestis KIM
gacggaauccaacaucc

SEQ ID NO: 4218730 - RNA, 22 nt, Yersinia pestis KIM
gacggagaaucgcuggacaaug

SEQ ID NO: 4218731 - RNA, 19 nt, Yersinia pestis KIM
gacggcggcgagcacugcc

SEQ ID NO: 4218732 - RNA, 18 nt, Yersinia pestis KIM
gacggcuucuguaauaaa

SEQ ID NO: 4218733 - RNA, 23 nt, Yersinia pestis KIM
gacggcuucuguaauaaaggcug

SEQ ID NO: 4218734 - RNA, 15 nt, Yersinia pestis KIM
gacgguauuuaggcg

SEQ ID NO: 4218735 - RNA, 17 nt, Yersinia pestis KIM
gacguaucuauaaacuu

SEQ ID NO: 4218736 - RNA, 14 nt, Yersinia pestis KIM
gacgucauaaaaag

SEQ ID NO: 4218737 - RNA, 13 nt, Yersinia pestis KIM
gacgucauagaau

SEQ ID NO: 4218738 - RNA, 18 nt, Yersinia pestis KIM
gacgugagcguucaaaau

SEQ ID NO: 4218739 - RNA, 17 nt, Yersinia pestis KIM
gacgugaugccaguaau

SEQ ID NO: 4218740 - RNA, 23 nt, Yersinia pestis KIM
gacgugcagcgcgcagccaacgg

SEQ ID NO: 4218741 - RNA, 24 nt, Yersinia pestis KIM
gacguggauuuucaaaucaugcau

SEQ ID NO: 4218742 - RNA, 18 nt, Yersinia pestis KIM
gacgugugcuguaagaaa

SEQ ID NO: 4218743 - RNA, 16 nt, Yersinia pestis KIM
gacguuaucaauacug

SEQ ID NO: 4218744 - RNA, 19 nt, Yersinia pestis KIM
gacguuaucaauacugcaa

SEQ ID NO: 4218745 - RNA, 16 nt, Yersinia pestis KIM
gacguuauuauugauu

SEQ ID NO: 4218746 - RNA, 17 nt, Yersinia pestis KIM
gacguucaggccugcac

SEQ ID NO: 4218747 - RNA, 21 nt, Yersinia pestis KIM
gacguugcaggggguuagcug

SEQ ID NO: 4218748 - RNA, 14 nt, Yersinia pestis KIM
gacuaaaaaccauc

SEQ ID NO: 4218749 - RNA, 15 nt, Yersinia pestis KIM
gacuaaaaaccgcca

SEQ ID NO: 4218750 - RNA, 20 nt, Yersinia pestis KIM
gacuaacagaauauugacac

SEQ ID NO: 4218751 - RNA, 15 nt, Yersinia pestis KIM
gacuaaccaagccau

SEQ ID NO: 4218752 - RNA, 19 nt, Yersinia pestis KIM
gacuaaccaagccaucggc

SEQ ID NO: 4218753 - RNA, 17 nt, Yersinia pestis KIM
gacuaccaaccgcuuua

SEQ ID NO: 4218754 - RNA, 20 nt, Yersinia pestis KIM
gacuacggcuacagcgucag

SEQ ID NO: 4218755 - RNA, 15 nt, Yersinia pestis KIM
gacuacuggcugggg

SEQ ID NO: 4218756 - RNA, 20 nt, Yersinia pestis KIM
gacuauagauacccacuuua

SEQ ID NO: 4218757 - RNA, 19 nt, Yersinia pestis KIM
gacuaucccuucaaucagc

SEQ ID NO: 4218758 - RNA, 19 nt, Yersinia pestis KIM
gacuauucccuuguuugcg

SEQ ID NO: 4218759 - RNA, 23 nt, Yersinia pestis KIM
gacuauucugccuauccucaccg

SEQ ID NO: 4218760 - RNA, 14 nt, Yersinia pestis KIM
gacucaagccucua

SEQ ID NO: 4218761 - RNA, 16 nt, Yersinia pestis KIM
gacucaauaauauggg

SEQ ID NO: 4218762 - RNA, 15 nt, Yersinia pestis KIM
gacucauaaucgcuu

SEQ ID NO: 4218763 - RNA, 18 nt, Yersinia pestis KIM
gacucaucuaauuuucuc

SEQ ID NO: 4218764 - RNA, 15 nt, Yersinia pestis KIM
gacucauuaaaucca

SEQ ID NO: 4218765 - RNA, 23 nt, Yersinia pestis KIM
gacucauuaaauccaauauuccc

SEQ ID NO: 4218766 - RNA, 23 nt, Yersinia pestis KIM
gacuccaguuucgucaugauaau

SEQ ID NO: 4218767 - RNA, 15 nt, Yersinia pestis KIM
gacucccugacuccc

SEQ ID NO: 4218768 - RNA, 16 nt, Yersinia pestis KIM
gacucccugacucccu

SEQ ID NO: 4218769 - RNA, 17 nt, Yersinia pestis KIM
gacucccugacucccuc

SEQ ID NO: 4218770 - RNA, 18 nt, Yersinia pestis KIM
gacucccugacucccuca

SEQ ID NO: 4218771 - RNA, 15 nt, Yersinia pestis KIM
gacuccugccccccc

SEQ ID NO: 4218772 - RNA, 21 nt, Yersinia pestis KIM
gacucgaugacaggggauagc

SEQ ID NO: 4218773 - RNA, 19 nt, Yersinia pestis KIM
gacucugcuaccaggaagc

SEQ ID NO: 4218774 - RNA, 18 nt, Yersinia pestis KIM
gacugaaaguagaaauaa

SEQ ID NO: 4218775 - RNA, 16 nt, Yersinia pestis KIM
gacugaccauaaaagg

SEQ ID NO: 4218776 - RNA, 15 nt, Yersinia pestis KIM
gacugagauuauuau

SEQ ID NO: 4218777 - RNA, 22 nt, Yersinia pestis KIM
gacugauagcaaacaaacagua

SEQ ID NO: 4218778 - RNA, 21 nt, Yersinia pestis KIM
gacugcauuaccuuuaaaacu

SEQ ID NO: 4218779 - RNA, 11 nt, Yersinia pestis KIM
gacugcccaaa

SEQ ID NO: 4218780 - RNA, 14 nt, Yersinia pestis KIM
gacugcuaauacca

SEQ ID NO: 4218781 - RNA, 15 nt, Yersinia pestis KIM
gacugcuggcagggu

SEQ ID NO: 4218782 - RNA, 19 nt, Yersinia pestis KIM
gacuggucacucgaugacg

SEQ ID NO: 4218783 - RNA, 20 nt, Yersinia pestis KIM
gacuggucacucgaugacgu

SEQ ID NO: 4218784 - RNA, 22 nt, Yersinia pestis KIM
gacuguacggcgcguuucuuag

SEQ ID NO: 4218785 - RNA, 22 nt, Yersinia pestis KIM
gacuguuuugcuaacugugcca

SEQ ID NO: 4218786 - RNA, 16 nt, Yersinia pestis KIM
gacuuacccuacccau

SEQ ID NO: 4218787 - RNA, 24 nt, Yersinia pestis KIM
gacuuacccuacccauuauaaaua

SEQ ID NO: 4218788 - RNA, 23 nt, Yersinia pestis KIM
gacuucacucgcgacuacagaaa

SEQ ID NO: 4218789 - RNA, 14 nt, Yersinia pestis KIM
gacuugggcuucca

SEQ ID NO: 4218790 - RNA, 23 nt, Yersinia pestis KIM
gacuuggguaaccaaucacauca

SEQ ID NO: 4218791 - RNA, 19 nt, Yersinia pestis KIM
gacuuucuaagcugccugu

SEQ ID NO: 4218792 - RNA, 17 nt, Yersinia pestis KIM
gacuuuuuuaucgccag

SEQ ID NO: 4218793 - RNA, 15 nt, Yersinia pestis KIM
gagaaacaaaaccaa

SEQ ID NO: 4218794 - RNA, 16 nt, Yersinia pestis KIM
gagaaacccauagcaa

SEQ ID NO: 4218795 - RNA, 22 nt, Yersinia pestis KIM
gagaaaggauuugaagacaacu

SEQ ID NO: 4218796 - RNA, 19 nt, Yersinia pestis KIM
gagaaaggcgcgggcgauc

SEQ ID NO: 4218797 - RNA, 15 nt, Yersinia pestis KIM
gagaacaaugguuca

SEQ ID NO: 4218798 - RNA, 20 nt, Yersinia pestis KIM
gagaacaaugguucaucauu

SEQ ID NO: 4218799 - RNA, 22 nt, Yersinia pestis KIM
gagaaccgauaacgccccggcc

SEQ ID NO: 4218800 - RNA, 18 nt, Yersinia pestis KIM
gagaacgggcaaccugua

SEQ ID NO: 4218801 - RNA, 19 nt, Yersinia pestis KIM
gagaauagacagaagcgua

SEQ ID NO: 4218802 - RNA, 21 nt, Yersinia pestis KIM
gagaauaucuauauagggaaa

SEQ ID NO: 4218803 - RNA, 14 nt, Yersinia pestis KIM
gagaaucaaucaau

SEQ ID NO: 4218804 - RNA, 23 nt, Yersinia pestis KIM
gauagaguugauaaacaauaaac

SEQ ID NO: 4218805 - RNA, 16 nt, Yersinia pestis KIM
gauagauuuuucaccu

SEQ ID NO: 4218806 - RNA, 17 nt, Yersinia pestis KIM
gauagcaaaagaaucag

SEQ ID NO: 4218807 - RNA, 19 nt, Yersinia pestis KIM
gauagcaaacaaacaguaa

SEQ ID NO: 4218808 - RNA, 17 nt, Yersinia pestis KIM
gauagcaucauccagcu

SEQ ID NO: 4218809 - RNA, 19 nt, Yersinia pestis KIM
gauagcauuuugucaugag

SEQ ID NO: 4218810 - RNA, 15 nt, Yersinia pestis KIM
gauagccacuaacua

SEQ ID NO: 4218811 - RNA, 12 nt, Yersinia pestis KIM
gauagccauaau

SEQ ID NO: 4218812 - RNA, 17 nt, Yersinia pestis KIM
gauagccauaauaaugc

SEQ ID NO: 4218813 - RNA, 14 nt, Yersinia pestis KIM
gauagccccauaua

SEQ ID NO: 4218814 - RNA, 20 nt, Yersinia pestis KIM
gauagcggcuaaagggcuga

SEQ ID NO: 4218815 - RNA, 21 nt, Yersinia pestis KIM
gauagcggcuaaagggcugag

SEQ ID NO: 4218816 - RNA, 20 nt, Yersinia pestis KIM
gauagcgggccuuugcuuuu

SEQ ID NO: 4218817 - RNA, 15 nt, Yersinia pestis KIM
gauagcuucagcauu

SEQ ID NO: 4218818 - RNA, 20 nt, Yersinia pestis KIM
gauaggccggggagccaagu

SEQ ID NO: 4218819 - RNA, 15 nt, Yersinia pestis KIM
gauaggcgaaauuga

SEQ ID NO: 4218820 - RNA, 16 nt, Yersinia pestis KIM
gauagggagccaauag

SEQ ID NO: 4218821 - RNA, 23 nt, Yersinia pestis KIM
gauagggggcaaccauauuaaac

SEQ ID NO: 4218822 - RNA, 23 nt, Yersinia pestis KIM
gauaguacguagcgauaacagau

SEQ ID NO: 4218823 - RNA, 16 nt, Yersinia pestis KIM
gauagugaguauguau

SEQ ID NO: 4218824 - RNA, 18 nt, Yersinia pestis KIM
gauagugucacucugguu

SEQ ID NO: 4218825 - RNA, 22 nt, Yersinia pestis KIM
gauaguuaccauggcaggucuc

SEQ ID NO: 4218826 - RNA, 14 nt, Yersinia pestis KIM
gauaguuaucuccc

SEQ ID NO: 4218827 - RNA, 15 nt, Yersinia pestis KIM
gauaguuaucuccca

SEQ ID NO: 4218828 - RNA, 12 nt, Yersinia pestis KIM
gauaguuuccau

SEQ ID NO: 4218829 - RNA, 23 nt, Yersinia pestis KIM
gauaguuuuuuuuauggcugcgu

SEQ ID NO: 4218830 - RNA, 22 nt, Yersinia pestis KIM
gauauaaacuaauaucuuucau

SEQ ID NO: 4218831 - RNA, 15 nt, Yersinia pestis KIM
gauauaaauaaaaua

SEQ ID NO: 4218832 - RNA, 18 nt, Yersinia pestis KIM
gauauaaauaaaauagcg

SEQ ID NO: 4218833 - RNA, 12 nt, Yersinia pestis KIM
gauauaacgaau

SEQ ID NO: 4218834 - RNA, 17 nt, Yersinia pestis KIM
gauauacccaccagaga

SEQ ID NO: 4218835 - RNA, 14 nt, Yersinia pestis KIM
gauauagccuucuu

SEQ ID NO: 4218836 - RNA, 23 nt, Yersinia pestis KIM
gauauagccuucuucacgcaagg

SEQ ID NO: 4218837 - RNA, 18 nt, Yersinia pestis KIM
gauauauagaaauaagga

SEQ ID NO: 4218838 - RNA, 16 nt, Yersinia pestis KIM
gauaucaauaaagaac

SEQ ID NO: 4218839 - RNA, 14 nt, Yersinia pestis KIM
gauaucagccagug

SEQ ID NO: 4218840 - RNA, 17 nt, Yersinia pestis KIM
gauauccagugccaaaa

SEQ ID NO: 4218841 - RNA, 19 nt, Yersinia pestis KIM
gauauccagugccaaaaua

SEQ ID NO: 4218842 - RNA, 17 nt, Yersinia pestis KIM
gauaucccaacugaaac

SEQ ID NO: 4218843 - RNA, 18 nt, Yersinia pestis KIM
gauaucccaacugaaacg

SEQ ID NO: 4218844 - RNA, 15 nt, Yersinia pestis KIM
gauauccgccaaaga

SEQ ID NO: 4218845 - RNA, 15 nt, Yersinia pestis KIM
gauauccugcgucuc

SEQ ID NO: 4218846 - RNA, 21 nt, Yersinia pestis KIM
gauaucgccaacguguauucc

SEQ ID NO: 4218847 - RNA, 20 nt, Yersinia pestis KIM
gauaucuaugugcaaucuaa

SEQ ID NO: 4218848 - RNA, 12 nt, Yersinia pestis KIM
gauaucugcuca

SEQ ID NO: 4218849 - RNA, 12 nt, Yersinia pestis KIM
gauaugaauaaa

SEQ ID NO: 4218850 - RNA, 17 nt, Yersinia pestis KIM
gauaugacuaaacugau

SEQ ID NO: 4218851 - RNA, 20 nt, Yersinia pestis KIM
gauaugaugcggaagaaggc

SEQ ID NO: 4218852 - RNA, 22 nt, Yersinia pestis KIM
gauaugcauuauugauguuauu

SEQ ID NO: 4218853 - RNA, 20 nt, Yersinia pestis KIM
gauaugccggggauauuuug

SEQ ID NO: 4218854 - RNA, 13 nt, Yersinia pestis KIM
gauauuaacuggu

SEQ ID NO: 4218855 - RNA, 13 nt, Yersinia pestis KIM
gauauuacuucuu

SEQ ID NO: 4218856 - RNA, 17 nt, Yersinia pestis KIM
gauauuauuagccaaau

SEQ ID NO: 4218857 - RNA, 19 nt, Yersinia pestis KIM
gauauucacguuuuuccau

SEQ ID NO: 4218858 - RNA, 20 nt, Yersinia pestis KIM
gauauucacguuuuuccauu

SEQ ID NO: 4218859 - RNA, 23 nt, Yersinia pestis KIM
gauauuccggugaucuugaccga

SEQ ID NO: 4218860 - RNA, 16 nt, Yersinia pestis KIM
gauauuccugcaaagu

SEQ ID NO: 4218861 - RNA, 20 nt, Yersinia pestis KIM
gauauucgcccgcugauucu

SEQ ID NO: 4218862 - RNA, 20 nt, Yersinia pestis KIM
gauauugagaaucagugguc

SEQ ID NO: 4218863 - RNA, 16 nt, Yersinia pestis KIM
gauauuguuggcgaua

SEQ ID NO: 4218864 - RNA, 18 nt, Yersinia pestis KIM
gauauuuaagccaugaca

SEQ ID NO: 4218865 - RNA, 23 nt, Yersinia pestis KIM
gauauuuauuuauccuauuuuua

SEQ ID NO: 4218866 - RNA, 18 nt, Yersinia pestis KIM
gauauuucacguucauca

SEQ ID NO: 4218867 - RNA, 20 nt, Yersinia pestis KIM
gauauuucacguucaucaau

SEQ ID NO: 4218868 - RNA, 23 nt, Yersinia pestis KIM
gauauuugggucgguaaccugaa

SEQ ID NO: 4218869 - RNA, 12 nt, Yersinia pestis KIM
gauauuuucggg

SEQ ID NO: 4218870 - RNA, 12 nt, Yersinia pestis KIM
gauauuuugcag

SEQ ID NO: 4218871 - RNA, 21 nt, Yersinia pestis KIM
gaucaaaaacguccaggcuuu

SEQ ID NO: 4218872 - RNA, 21 nt, Yersinia pestis KIM
gaucaaaaucacuucuucaau

SEQ ID NO: 4218873 - RNA, 18 nt, Yersinia pestis KIM
gaucaaacauaaccugca

SEQ ID NO: 4218874 - RNA, 20 nt, Yersinia pestis KIM
gaucaaacauaaccugcaac

SEQ ID NO: 4218875 - RNA, 19 nt, Yersinia pestis KIM
gaucaaaggcgaccaaugg

SEQ ID NO: 4218876 - RNA, 23 nt, Yersinia pestis KIM
gaucaaauuauauaagagaugaa

SEQ ID NO: 4218877 - RNA, 15 nt, Yersinia pestis KIM
gaucaaggagauucc

SEQ ID NO: 4218878 - RNA, 22 nt, Yersinia pestis KIM
gaucaauaaacgcuuuugcugc

SEQ ID NO: 4218879 - RNA, 16 nt, Yersinia pestis KIM
gaucaaucucaucaau

SEQ ID NO: 4218880 - RNA, 18 nt, Yersinia pestis KIM
gaucaauguuaucgccaa

SEQ ID NO: 4218881 - RNA, 19 nt, Yersinia pestis KIM
gaucacaaccccaccucuu

SEQ ID NO: 4218882 - RNA, 20 nt, Yersinia pestis KIM
gaucacaauacagcaaauag

SEQ ID NO: 4218883 - RNA, 19 nt, Yersinia pestis KIM
gaucacagcucucugagcc

SEQ ID NO: 4218884 - RNA, 20 nt, Yersinia pestis KIM
gaucacaucacagugccaaa

SEQ ID NO: 4218885 - RNA, 22 nt, Yersinia pestis KIM
gaucacaucacagugccaaaag

SEQ ID NO: 4218886 - RNA, 23 nt, Yersinia pestis KIM
gaucaccaaucggaucgagcugu

SEQ ID NO: 4218887 - RNA, 19 nt, Yersinia pestis KIM
gaucaccaccgcauuuuca

SEQ ID NO: 4218888 - RNA, 19 nt, Yersinia pestis KIM
gaucaccaggcucucauau

SEQ ID NO: 4218889 - RNA, 22 nt, Yersinia pestis KIM
gaucaccgaugauaagugaaua

SEQ ID NO: 4218890 - RNA, 18 nt, Yersinia pestis KIM
gaucaccgccugcguauu

SEQ ID NO: 4218891 - RNA, 19 nt, Yersinia pestis KIM
gaucacggauaucaauaac

SEQ ID NO: 4218892 - RNA, 14 nt, Yersinia pestis KIM
gaucagcaagauug

SEQ ID NO: 4218893 - RNA, 13 nt, Yersinia pestis KIM
gaucagcauuucg

SEQ ID NO: 4218894 - RNA, 17 nt, Yersinia pestis KIM
gaucagcguauaaaacu

SEQ ID NO: 4218895 - RNA, 17 nt, Yersinia pestis KIM
gaucaggaucaccagca

SEQ ID NO: 4218896 - RNA, 16 nt, Yersinia pestis KIM
gaucagugaacugcuc

SEQ ID NO: 4218897 - RNA, 16 nt, Yersinia pestis KIM
gaucagugaagagaua

SEQ ID NO: 4218898 - RNA, 22 nt, Yersinia pestis KIM
gaucaguggcuuaauugaagca

SEQ ID NO: 4218899 - RNA, 17 nt, Yersinia pestis KIM
gaucaucaacgcgccuu

SEQ ID NO: 4218900 - RNA, 19 nt, Yersinia pestis KIM
gaucaucaagccaauggcc

SEQ ID NO: 4218901 - RNA, 16 nt, Yersinia pestis KIM
gaucaucaggcaggua

SEQ ID NO: 4218902 - RNA, 19 nt, Yersinia pestis KIM
gaucauccgcucagcaaaa

SEQ ID NO: 4218903 - RNA, 21 nt, Yersinia pestis KIM
gaucauccgcucagcaaaaau

SEQ ID NO: 4218904 - RNA, 17 nt, Yersinia pestis KIM
gaucaucgcaccauaac

SEQ ID NO: 4218905 - RNA, 13 nt, Yersinia pestis KIM
gaucaucugguga

SEQ ID NO: 4218906 - RNA, 16 nt, Yersinia pestis KIM
gaucaugguagagcug

SEQ ID NO: 4218907 - RNA, 23 nt, Yersinia pestis KIM
gauccaaaacaucggccagcguc

SEQ ID NO: 4218908 - RNA, 21 nt, Yersinia pestis KIM
gauccacacaguauucugcuu

SEQ ID NO: 4218909 - RNA, 16 nt, Yersinia pestis KIM
gauccacuacuuauuu

SEQ ID NO: 4218910 - RNA, 16 nt, Yersinia pestis KIM
gauccacuccagugcc

SEQ ID NO: 4218911 - RNA, 18 nt, Yersinia pestis KIM
gauccagaauuucauugu

SEQ ID NO: 4218912 - RNA, 17 nt, Yersinia pestis KIM
gauccagcaacguaaca

SEQ ID NO: 4218913 - RNA, 14 nt, Yersinia pestis KIM
gauccauaggaucc

SEQ ID NO: 4218914 - RNA, 14 nt, Yersinia pestis KIM
gauccauaggaucu

SEQ ID NO: 4218915 - RNA, 15 nt, Yersinia pestis KIM
gauccauaggaucuc

SEQ ID NO: 4218916 - RNA, 18 nt, Yersinia pestis KIM
gauccaucugauaaguuu

SEQ ID NO: 4218917 - RNA, 14 nt, Yersinia pestis KIM
gaucccgugccaga

SEQ ID NO: 4218918 - RNA, 22 nt, Yersinia pestis KIM
gauguggauaauuucagcagca

SEQ ID NO: 4218919 - RNA, 11 nt, Yersinia pestis KIM
gauguguaccu

SEQ ID NO: 4218920 - RNA, 17 nt, Yersinia pestis KIM
gauguguggcagucacu

SEQ ID NO: 4218921 - RNA, 22 nt, Yersinia pestis KIM
gauguguuuaaaucuuucucca

SEQ ID NO: 4218922 - RNA, 16 nt, Yersinia pestis KIM
gauguuaacucagcca

SEQ ID NO: 4218923 - RNA, 20 nt, Yersinia pestis KIM
gauguuacgcuaucgcuaaa

SEQ ID NO: 4218924 - RNA, 12 nt, Yersinia pestis KIM
gauguuaugagg

SEQ ID NO: 4218925 - RNA, 18 nt, Yersinia pestis KIM
gauguuauuugaauaaaa

SEQ ID NO: 4218926 - RNA, 20 nt, Yersinia pestis KIM
gauguuauuugaauaaaaga

SEQ ID NO: 4218927 - RNA, 15 nt, Yersinia pestis KIM
gauguucgcuccccc

SEQ ID NO: 4218928 - RNA, 18 nt, Yersinia pestis KIM
gauuaaauucuaccuggc

SEQ ID NO: 4218929 - RNA, 13 nt, Yersinia pestis KIM
gauuaacauccau

SEQ ID NO: 4218930 - RNA, 21 nt, Yersinia pestis KIM
gauuaacccuuucgaguuuau

SEQ ID NO: 4218931 - RNA, 14 nt, Yersinia pestis KIM
gauuaaccuuaauu

SEQ ID NO: 4218932 - RNA, 21 nt, Yersinia pestis KIM
gauuaacuuuucuucauugcu

SEQ ID NO: 4218933 - RNA, 15 nt, Yersinia pestis KIM
gauuaagacuuucuc

SEQ ID NO: 4218934 - RNA, 15 nt, Yersinia pestis KIM
gauuaagccaugggu

SEQ ID NO: 4218935 - RNA, 16 nt, Yersinia pestis KIM
gauuaauacaucauca

SEQ ID NO: 4218936 - RNA, 19 nt, Yersinia pestis KIM
gauuaauaucaaaacugau

SEQ ID NO: 4218937 - RNA, 23 nt, Yersinia pestis KIM
gauuaauuaacacccaauaauaa

SEQ ID NO: 4218938 - RNA, 18 nt, Yersinia pestis KIM
gauuaauuauugggggga

SEQ ID NO: 4218939 - RNA, 13 nt, Yersinia pestis KIM
gauuaccaauaau

SEQ ID NO: 4218940 - RNA, 15 nt, Yersinia pestis KIM
gauuaccaauaauua

SEQ ID NO: 4218941 - RNA, 15 nt, Yersinia pestis KIM
gauuaccugcauauc

SEQ ID NO: 4218942 - RNA, 17 nt, Yersinia pestis KIM
gauuaccugcauauccu

SEQ ID NO: 4218943 - RNA, 16 nt, Yersinia pestis KIM
gauuacgcaucgucag

SEQ ID NO: 4218944 - RNA, 19 nt, Yersinia pestis KIM
gauuacgggucagcucacc

SEQ ID NO: 4218945 - RNA, 18 nt, Yersinia pestis KIM
gauuacuggcuaucuuau

SEQ ID NO: 4218946 - RNA, 16 nt, Yersinia pestis KIM
gauuagccauaagaua

SEQ ID NO: 4218947 - RNA, 20 nt, Yersinia pestis KIM
gauuagccugaccgguaaua

SEQ ID NO: 4218948 - RNA, 19 nt, Yersinia pestis KIM
gauuagcuggcuguuggua

SEQ ID NO: 4218949 - RNA, 20 nt, Yersinia pestis KIM
gauuagucuuagacgucaga

SEQ ID NO: 4218950 - RNA, 20 nt, Yersinia pestis KIM
gauuaguuuuagacgucaga

SEQ ID NO: 4218951 - RNA, 12 nt, Yersinia pestis KIM
gauuauuauuca

SEQ ID NO: 4218952 - RNA, 16 nt, Yersinia pestis KIM
gauuauugggcugccu

SEQ ID NO: 4218953 - RNA, 16 nt, Yersinia pestis KIM
gauuauuguuauccac

SEQ ID NO: 4218954 - RNA, 21 nt, Yersinia pestis KIM
gauuauuuuguuuguaaauuu

SEQ ID NO: 4218955 - RNA, 15 nt, Yersinia pestis KIM
gauucaagaaccgca

SEQ ID NO: 4218956 - RNA, 16 nt, Yersinia pestis KIM
gauucaauauuuaucc

SEQ ID NO: 4218957 - RNA, 13 nt, Yersinia pestis KIM
gauucacaggcga

SEQ ID NO: 4218958 - RNA, 14 nt, Yersinia pestis KIM
gauucacaggcgag

SEQ ID NO: 4218959 - RNA, 14 nt, Yersinia pestis KIM
gauucagaaaggua

SEQ ID NO: 4218960 - RNA, 19 nt, Yersinia pestis KIM
gauuccaucagcgcacugc

SEQ ID NO: 4218961 - RNA, 20 nt, Yersinia pestis KIM
gauuccaucagcgcacugca

SEQ ID NO: 4218962 - RNA, 16 nt, Yersinia pestis KIM
gauucgcgaccagcag

SEQ ID NO: 4218963 - RNA, 23 nt, Yersinia pestis KIM
gauucggcuucgguuugagcuug

SEQ ID NO: 4218964 - RNA, 16 nt, Yersinia pestis KIM
gauucgggugagugaa

SEQ ID NO: 4218965 - RNA, 16 nt, Yersinia pestis KIM
gauucgggugagugag

SEQ ID NO: 4218966 - RNA, 14 nt, Yersinia pestis KIM
gauucguagaaaca

SEQ ID NO: 4218967 - RNA, 14 nt, Yersinia pestis KIM
gauucgucugccau

SEQ ID NO: 4218968 - RNA, 13 nt, Yersinia pestis KIM
gauucuccacuga

SEQ ID NO: 4218969 - RNA, 16 nt, Yersinia pestis KIM
gauucucggcggggag

SEQ ID NO: 4218970 - RNA, 16 nt, Yersinia pestis KIM
gauucucuauucugcu

SEQ ID NO: 4218971 - RNA, 22 nt, Yersinia pestis KIM
gauugacggaaaauuaacuuau

SEQ ID NO: 4218972 - RNA, 17 nt, Yersinia pestis KIM
gauugacugaaugugaa

SEQ ID NO: 4218973 - RNA, 16 nt, Yersinia pestis KIM
gauugaucagccaaca

SEQ ID NO: 4218974 - RNA, 15 nt, Yersinia pestis KIM
gauugaucaguggcu

SEQ ID NO: 4218975 - RNA, 16 nt, Yersinia pestis KIM
gauugcagauaaacau

SEQ ID NO: 4218976 - RNA, 22 nt, Yersinia pestis KIM
gauugcaucaucaguauugacg

SEQ ID NO: 4218977 - RNA, 19 nt, Yersinia pestis KIM
gauuggacccgucaccaca

SEQ ID NO: 4218978 - RNA, 22 nt, Yersinia pestis KIM
gauuggagucaugaggcaguga

SEQ ID NO: 4218979 - RNA, 21 nt, Yersinia pestis KIM
gauuggcacccucuagcagcg

SEQ ID NO: 4218980 - RNA, 16 nt, Yersinia pestis KIM
gauugugcuccagcac

SEQ ID NO: 4218981 - RNA, 15 nt, Yersinia pestis KIM
gauuuaaaaucccuc

SEQ ID NO: 4218982 - RNA, 13 nt, Yersinia pestis KIM
gauuuaaacccuc

SEQ ID NO: 4218983 - RNA, 23 nt, Yersinia pestis KIM
gauuuaaauaacagcuaaaauga

SEQ ID NO: 4218984 - RNA, 15 nt, Yersinia pestis KIM
gauuuagacaagcgc

SEQ ID NO: 4218985 - RNA, 17 nt, Yersinia pestis KIM
gauuuauaaauaauuau

SEQ ID NO: 4218986 - RNA, 23 nt, Yersinia pestis KIM
gauuuaucggcgguguaauaaga

SEQ ID NO: 4218987 - RNA, 16 nt, Yersinia pestis KIM
gauuuauuucucugau

SEQ ID NO: 4218988 - RNA, 24 nt, Yersinia pestis KIM
gauuucaccuauaauuaacagcau

SEQ ID NO: 4218989 - RNA, 20 nt, Yersinia pestis KIM
gauuucagacugcugacaac

SEQ ID NO: 4218990 - RNA, 14 nt, Yersinia pestis KIM
gauuucagcugcuu

SEQ ID NO: 4218991 - RNA, 22 nt, Yersinia pestis KIM
gauuucaggucgcaagcaauau

SEQ ID NO: 4218992 - RNA, 23 nt, Yersinia pestis KIM
gauuucaucagcguuacccagau

SEQ ID NO: 4218993 - RNA, 14 nt, Yersinia pestis KIM
gauuucaucauuca

SEQ ID NO: 4218994 - RNA, 15 nt, Yersinia pestis KIM
gauuucaucauucaa

SEQ ID NO: 4218995 - RNA, 18 nt, Yersinia pestis KIM
gauuucaucauucaauac

SEQ ID NO: 4218996 - RNA, 19 nt, Yersinia pestis KIM
gauuucaucggcaaaaaca

SEQ ID NO: 4218997 - RNA, 16 nt, Yersinia pestis KIM
gauuugcccgguaccg

SEQ ID NO: 4218998 - RNA, 14 nt, Yersinia pestis KIM
gauuuguaauaacg

SEQ ID NO: 4218999 - RNA, 19 nt, Yersinia pestis KIM
gauuuucaugauccacaau

SEQ ID NO: 4219000 - RNA, 14 nt, Yersinia pestis KIM
gauuuuccgcagcu

SEQ ID NO: 4219001 - RNA, 19 nt, Yersinia pestis KIM
gauuuugauugcugacaaa

SEQ ID NO: 4219002 - RNA, 19 nt, Yersinia pestis KIM
gauuuuuaacgucagauaa

SEQ ID NO: 4219003 - RNA, 15 nt, Yersinia pestis KIM
gauuuuuaucuuucu

SEQ ID NO: 4219004 - RNA, 13 nt, Yersinia pestis KIM
gauuuuuuguucu

SEQ ID NO: 4219005 - RNA, 20 nt, Yersinia pestis KIM
gcaaaaaaauccccggacca

SEQ ID NO: 4219006 - RNA, 14 nt, Yersinia pestis KIM
gcaaaaaauauuaa

SEQ ID NO: 4219007 - RNA, 20 nt, Yersinia pestis KIM
gcaaaaacagucauuaacac

SEQ ID NO: 4219008 - RNA, 15 nt, Yersinia pestis KIM
gcaaaaauugacgaa

SEQ ID NO: 4219009 - RNA, 18 nt, Yersinia pestis KIM
gcaaaacguauaaaagca

SEQ ID NO: 4219010 - RNA, 13 nt, Yersinia pestis KIM
gcaaaagcgauca

SEQ ID NO: 4219011 - RNA, 15 nt, Yersinia pestis KIM
gcaaaauagcacaga

SEQ ID NO: 4219012 - RNA, 21 nt, Yersinia pestis KIM
gcaaaaugaucaucagcagca

SEQ ID NO: 4219013 - RNA, 13 nt, Yersinia pestis KIM
gcaaaaugccaac

SEQ ID NO: 4219014 - RNA, 15 nt, Yersinia pestis KIM
gcaaaaugcucuuca

SEQ ID NO: 4219015 - RNA, 13 nt, Yersinia pestis KIM
gcaaacagguaaa

SEQ ID NO: 4219016 - RNA, 15 nt, Yersinia pestis KIM
gcaaacaucacaccu

SEQ ID NO: 4219017 - RNA, 18 nt, Yersinia pestis KIM
gcaaaccugguuugcgcc

SEQ ID NO: 4219018 - RNA, 18 nt, Yersinia pestis KIM
gcaaacgcugcacaucau

SEQ ID NO: 4219019 - RNA, 14 nt, Yersinia pestis KIM
gcaaacggauaaug

SEQ ID NO: 4219020 - RNA, 16 nt, Yersinia pestis KIM
gcaaacggauaauguu

SEQ ID NO: 4219021 - RNA, 19 nt, Yersinia pestis KIM
gcaaacggauaauguugca

SEQ ID NO: 4219022 - RNA, 19 nt, Yersinia pestis KIM
gcaaacuuaaaaaucaaaa

SEQ ID NO: 4219023 - RNA, 13 nt, Yersinia pestis KIM
gcaaagaagaaua

SEQ ID NO: 4219024 - RNA, 16 nt, Yersinia pestis KIM
gcaaagcgggccagca

SEQ ID NO: 4219025 - RNA, 14 nt, Yersinia pestis KIM
gcaaagggcaacaa

SEQ ID NO: 4219026 - RNA, 19 nt, Yersinia pestis KIM
gcaaagguuggaacaccaa

SEQ ID NO: 4219027 - RNA, 21 nt, Yersinia pestis KIM
gcaaagugcugcaaggcauua

SEQ ID NO: 4219028 - RNA, 12 nt, Yersinia pestis KIM
gcaaaguguaau

SEQ ID NO: 4219029 - RNA, 20 nt, Yersinia pestis KIM
gcaaaguuauugaccaauau

SEQ ID NO: 4219030 - RNA, 23 nt, Yersinia pestis KIM
gcaaaguuuguguagcccacugg

SEQ ID NO: 4219031 - RNA, 21 nt, Yersinia pestis KIM
gcaaauaaagggccugcaaac

SEQ ID NO: 4219032 - RNA, 21 nt, Yersinia pestis KIM
gcaaauaaauaccggcaggaa

SEQ ID NO: 4219033 - RNA, 18 nt, Yersinia pestis KIM
gcaccaacgcuaccgacu

SEQ ID NO: 4219034 - RNA, 21 nt, Yersinia pestis KIM
gcaccaaucauuacaucaucu

SEQ ID NO: 4219035 - RNA, 14 nt, Yersinia pestis KIM
gcaccaaugccggu

SEQ ID NO: 4219036 - RNA, 16 nt, Yersinia pestis KIM
gcaccacuaaggucau

SEQ ID NO: 4219037 - RNA, 17 nt, Yersinia pestis KIM
gcaccagaaaguuguuc

SEQ ID NO: 4219038 - RNA, 11 nt, Yersinia pestis KIM
gcaccagcgca

SEQ ID NO: 4219039 - RNA, 22 nt, Yersinia pestis KIM
gcaccagggaugggcgccgcuu

SEQ ID NO: 4219040 - RNA, 22 nt, Yersinia pestis KIM
gcaccaguugaccauuuuuauc

SEQ ID NO: 4219041 - RNA, 17 nt, Yersinia pestis KIM
gcaccauaaccaaucca

SEQ ID NO: 4219042 - RNA, 21 nt, Yersinia pestis KIM
gcaccauaaccaauccaugcc

SEQ ID NO: 4219043 - RNA, 18 nt, Yersinia pestis KIM
gcaccauauucccagcca

SEQ ID NO: 4219044 - RNA, 13 nt, Yersinia pestis KIM
gcaccauccagca

SEQ ID NO: 4219045 - RNA, 14 nt, Yersinia pestis KIM
gcaccauccagcaa

SEQ ID NO: 4219046 - RNA, 18 nt, Yersinia pestis KIM
gcaccauccagcaaauca

SEQ ID NO: 4219047 - RNA, 19 nt, Yersinia pestis KIM
gcaccauccagcaaaucau

SEQ ID NO: 4219048 - RNA, 15 nt, Yersinia pestis KIM
gcaccauuugcccug

SEQ ID NO: 4219049 - RNA, 16 nt, Yersinia pestis KIM
gcacccaauggcaaca

SEQ ID NO: 4219050 - RNA, 12 nt, Yersinia pestis KIM
gcacccacaccg

SEQ ID NO: 4219051 - RNA, 21 nt, Yersinia pestis KIM
gcacccacggcgggcaacaga

SEQ ID NO: 4219052 - RNA, 23 nt, Yersinia pestis KIM
gcacccacggcgggcaacagaga

SEQ ID NO: 4219053 - RNA, 13 nt, Yersinia pestis KIM
gcacccagugacc

SEQ ID NO: 4219054 - RNA, 15 nt, Yersinia pestis KIM
gcaccccacaugcca

SEQ ID NO: 4219055 - RNA, 22 nt, Yersinia pestis KIM
gcaccgaugucuaacaaacuca

SEQ ID NO: 4219056 - RNA, 22 nt, Yersinia pestis KIM
gcaccgccgucaaaccaagccc

SEQ ID NO: 4219057 - RNA, 21 nt, Yersinia pestis KIM
gcaccgcgcuauaaaacagcu

SEQ ID NO: 4219058 - RNA, 21 nt, Yersinia pestis KIM
gcaccgcugauaaccagcagc

SEQ ID NO: 4219059 - RNA, 15 nt, Yersinia pestis KIM
gcaccgguguucacu

SEQ ID NO: 4219060 - RNA, 18 nt, Yersinia pestis KIM
gcaccguggauaaacaaa

SEQ ID NO: 4219061 - RNA, 20 nt, Yersinia pestis KIM
gcaccucugcugaugucagu

SEQ ID NO: 4219062 - RNA, 20 nt, Yersinia pestis KIM
gcaccucuuccggcguacca

SEQ ID NO: 4219063 - RNA, 16 nt, Yersinia pestis KIM
gcaccugaucgugcca

SEQ ID NO: 4219064 - RNA, 16 nt, Yersinia pestis KIM
gcaccuucugauuuuu

SEQ ID NO: 4219065 - RNA, 21 nt, Yersinia pestis KIM
gcacgacggauuugguuggcu

SEQ ID NO: 4219066 - RNA, 23 nt, Yersinia pestis KIM
gcacgacggauuugguuggcuuu

SEQ ID NO: 4219067 - RNA, 15 nt, Yersinia pestis KIM
gcacggccgggugca

SEQ ID NO: 4219068 - RNA, 13 nt, Yersinia pestis KIM
gcacgggccuugg

SEQ ID NO: 4219069 - RNA, 17 nt, Yersinia pestis KIM
gcacgggcuuuaaugag

SEQ ID NO: 4219070 - RNA, 20 nt, Yersinia pestis KIM
gcacgucaguuaaauaugac

SEQ ID NO: 4219071 - RNA, 16 nt, Yersinia pestis KIM
gcacguuuccccuuca

SEQ ID NO: 4219072 - RNA, 12 nt, Yersinia pestis KIM
gcacuaucaccg

SEQ ID NO: 4219073 - RNA, 15 nt, Yersinia pestis KIM
gcacucauaaugcug

SEQ ID NO: 4219074 - RNA, 19 nt, Yersinia pestis KIM
gcacuccacuaugcccagu

SEQ ID NO: 4219075 - RNA, 22 nt, Yersinia pestis KIM
gcacuccccgcccguagaaaau

SEQ ID NO: 4219076 - RNA, 14 nt, Yersinia pestis KIM
gcacucuguaacug

SEQ ID NO: 4219077 - RNA, 16 nt, Yersinia pestis KIM
gcacugagucgucugu

SEQ ID NO: 4219078 - RNA, 14 nt, Yersinia pestis KIM
gcacugaguucugc

SEQ ID NO: 4219079 - RNA, 17 nt, Yersinia pestis KIM
gcacugaguucugcugc

SEQ ID NO: 4219080 - RNA, 16 nt, Yersinia pestis KIM
gcacugauagccaaca

SEQ ID NO: 4219081 - RNA, 19 nt, Yersinia pestis KIM
gcacugauucucuucaccu

SEQ ID NO: 4219082 - RNA, 23 nt, Yersinia pestis KIM
gcacugcagaaaaugcggcggcu

SEQ ID NO: 4219083 - RNA, 17 nt, Yersinia pestis KIM
gcacugcaucugaccag

SEQ ID NO: 4219084 - RNA, 18 nt, Yersinia pestis KIM
gcacugcauuugauacua

SEQ ID NO: 4219085 - RNA, 13 nt, Yersinia pestis KIM
gcacugccccgaa

SEQ ID NO: 4219086 - RNA, 18 nt, Yersinia pestis KIM
gcacugccccgaagcuca

SEQ ID NO: 4219087 - RNA, 20 nt, Yersinia pestis KIM
gcacugccccgaagcucaag

SEQ ID NO: 4219088 - RNA, 18 nt, Yersinia pestis KIM
gcacugcgcgaucccaga

SEQ ID NO: 4219089 - RNA, 14 nt, Yersinia pestis KIM
gcacugcucugccc

SEQ ID NO: 4219090 - RNA, 11 nt, Yersinia pestis KIM
gcacuggaugu

SEQ ID NO: 4219091 - RNA, 15 nt, Yersinia pestis KIM
gcacugguugcuuca

SEQ ID NO: 4219092 - RNA, 16 nt, Yersinia pestis KIM
gcacuguagaccucuu

SEQ ID NO: 4219093 - RNA, 22 nt, Yersinia pestis KIM
gcacugugagcggcauccagua

SEQ ID NO: 4219094 - RNA, 19 nt, Yersinia pestis KIM
gcacuucaaccugauccag

SEQ ID NO: 4219095 - RNA, 13 nt, Yersinia pestis KIM
gcacuucaccugg

SEQ ID NO: 4219096 - RNA, 14 nt, Yersinia pestis KIM
gcacuucauuggcu

SEQ ID NO: 4219097 - RNA, 16 nt, Yersinia pestis KIM
gcacuuguuuugccag

SEQ ID NO: 4219098 - RNA, 15 nt, Yersinia pestis KIM
gcacuuuaaauaccc

SEQ ID NO: 4219099 - RNA, 17 nt, Yersinia pestis KIM
gcacuuuaaauacccag

SEQ ID NO: 4219100 - RNA, 19 nt, Yersinia pestis KIM
gcacuuuucgucauuauua

SEQ ID NO: 4219101 - RNA, 23 nt, Yersinia pestis KIM
gcagaaaagcaaaggcccgcuau

SEQ ID NO: 4219102 - RNA, 18 nt, Yersinia pestis KIM
gcagaaaaugcggcggcu

SEQ ID NO: 4219103 - RNA, 12 nt, Yersinia pestis KIM
gcagaaacggug

SEQ ID NO: 4219104 - RNA, 21 nt, Yersinia pestis KIM
gcagaaagugacccaagauga

SEQ ID NO: 4219105 - RNA, 20 nt, Yersinia pestis KIM
gcagaaauaaauauccuccg

SEQ ID NO: 4219106 - RNA, 16 nt, Yersinia pestis KIM
gcagaaauaauaucaa

SEQ ID NO: 4219107 - RNA, 14 nt, Yersinia pestis KIM
gcagaacaaaacaa

SEQ ID NO: 4219108 - RNA, 18 nt, Yersinia pestis KIM
gcagaacaaaacaagccc

SEQ ID NO: 4219109 - RNA, 16 nt, Yersinia pestis KIM
gcagaaccauggcacu

SEQ ID NO: 4219110 - RNA, 13 nt, Yersinia pestis KIM
gcagaaccuuguu

SEQ ID NO: 4219111 - RNA, 12 nt, Yersinia pestis KIM
gcagaacuaaca

SEQ ID NO: 4219112 - RNA, 12 nt, Yersinia pestis KIM
gcagaagagguu

SEQ ID NO: 4219113 - RNA, 19 nt, Yersinia pestis KIM
gcagaagggcggccagcaa

SEQ ID NO: 4219114 - RNA, 20 nt, Yersinia pestis KIM
gcagaaguccugauucgcga

SEQ ID NO: 4219115 - RNA, 22 nt, Yersinia pestis KIM
gcagacauuccgucagcaugaa

SEQ ID NO: 4219116 - RNA, 21 nt, Yersinia pestis KIM
gcagacgcacccggcuggcac

SEQ ID NO: 4219117 - RNA, 20 nt, Yersinia pestis KIM
gcagacgcguaacuguugca

SEQ ID NO: 4219118 - RNA, 22 nt, Yersinia pestis KIM
gcagacgcguaacuguugcaaa

SEQ ID NO: 4219119 - RNA, 20 nt, Yersinia pestis KIM
gcagacggggaggacuuccg

SEQ ID NO: 4219120 - RNA, 16 nt, Yersinia pestis KIM
gcagacucgacagcau

SEQ ID NO: 4219121 - RNA, 19 nt, Yersinia pestis KIM
gcagacugcugacaaaccc

SEQ ID NO: 4219122 - RNA, 20 nt, Yersinia pestis KIM
gcagagagcgacucacgacg

SEQ ID NO: 4219123 - RNA, 21 nt, Yersinia pestis KIM
gcagagaucauguaguacuua

SEQ ID NO: 4219124 - RNA, 15 nt, Yersinia pestis KIM
gcagagaugcagugu

SEQ ID NO: 4219125 - RNA, 15 nt, Yersinia pestis KIM
gcagagcaaaacugg

SEQ ID NO: 4219126 - RNA, 23 nt, Yersinia pestis KIM
gcagagccaauccccagaagcgc

SEQ ID NO: 4219127 - RNA, 18 nt, Yersinia pestis KIM
gcagagccugacucacag

SEQ ID NO: 4219128 - RNA, 18 nt, Yersinia pestis KIM
gcagaguccucucaccaa

SEQ ID NO: 4219129 - RNA, 19 nt, Yersinia pestis KIM
gcagaguccucucaccaag

SEQ ID NO: 4219130 - RNA, 18 nt, Yersinia pestis KIM
gcagauaaaucuguggca

SEQ ID NO: 4219131 - RNA, 15 nt, Yersinia pestis KIM
gcagauaccacauca

SEQ ID NO: 4219132 - RNA, 20 nt, Yersinia pestis KIM
gcagauacucggcaaaggcu

SEQ ID NO: 4219133 - RNA, 19 nt, Yersinia pestis KIM
gcagauaucagccagugcu

SEQ ID NO: 4219134 - RNA, 19 nt, Yersinia pestis KIM
gcagauauccuuuuucgug

SEQ ID NO: 4219135 - RNA, 19 nt, Yersinia pestis KIM
gcagauauuggcgaccauc

SEQ ID NO: 4219136 - RNA, 17 nt, Yersinia pestis KIM
gcagaucggcauuauua

SEQ ID NO: 4219137 - RNA, 21 nt, Yersinia pestis KIM
gcagauguauuagcgcugcuc

SEQ ID NO: 4219138 - RNA, 16 nt, Yersinia pestis KIM
gcagcaaaaccaagcu

SEQ ID NO: 4219139 - RNA, 21 nt, Yersinia pestis KIM
gcagcaaaaccaagcugauga

SEQ ID NO: 4219140 - RNA, 14 nt, Yersinia pestis KIM
gcagcaagcugagu

SEQ ID NO: 4219141 - RNA, 14 nt, Yersinia pestis KIM
gcagcacaccggcc

SEQ ID NO: 4219142 - RNA, 21 nt, Yersinia pestis KIM
gcagcacaccggccaaaauca

SEQ ID NO: 4219143 - RNA, 22 nt, Yersinia pestis KIM
gcagcagagaauguuggcguug

SEQ ID NO: 4219144 - RNA, 24 nt, Yersinia pestis KIM
gcagcagugcgguucaagccgaua

SEQ ID NO: 4219145 - RNA, 13 nt, Yersinia pestis KIM
gcagcauccagcu

SEQ ID NO: 4219146 - RNA, 19 nt, Yersinia pestis KIM
gcagcccccuuauggcaca

SEQ ID NO: 4219147 - RNA, 22 nt, Yersinia pestis KIM
gcauccgcgaugacacaauucc

SEQ ID NO: 4219148 - RNA, 19 nt, Yersinia pestis KIM
gcauccggcgguaaaucug

SEQ ID NO: 4219149 - RNA, 23 nt, Yersinia pestis KIM
gcauccgggaaccccuucaggcc

SEQ ID NO: 4219150 - RNA, 18 nt, Yersinia pestis KIM
gcauccuccugaucuuca

SEQ ID NO: 4219151 - RNA, 22 nt, Yersinia pestis KIM
gcauccuugaucgccaaauaaa

SEQ ID NO: 4219152 - RNA, 20 nt, Yersinia pestis KIM
gcaucgaguccguuaaaaaa

SEQ ID NO: 4219153 - RNA, 20 nt, Yersinia pestis KIM
gcaucgcgacugagaagcgg

SEQ ID NO: 4219154 - RNA, 21 nt, Yersinia pestis KIM
gcaucgcgaucugacauuugc

SEQ ID NO: 4219155 - RNA, 12 nt, Yersinia pestis KIM
gcaucgcgggcg

SEQ ID NO: 4219156 - RNA, 15 nt, Yersinia pestis KIM
gcaucgcgggcgcgc

SEQ ID NO: 4219157 - RNA, 23 nt, Yersinia pestis KIM
gcaucgcgggcgcgcugcugcuc

SEQ ID NO: 4219158 - RNA, 14 nt, Yersinia pestis KIM
gcaucgcuugcuca

SEQ ID NO: 4219159 - RNA, 19 nt, Yersinia pestis KIM
gcaucgucaaauuccccca

SEQ ID NO: 4219160 - RNA, 16 nt, Yersinia pestis KIM
gcaucgucauugccag

SEQ ID NO: 4219161 - RNA, 16 nt, Yersinia pestis KIM
gcaucuaugcuaucca

SEQ ID NO: 4219162 - RNA, 17 nt, Yersinia pestis KIM
gcaucuaugcuauccag

SEQ ID NO: 4219163 - RNA, 11 nt, Yersinia pestis KIM
gcaucucugca

SEQ ID NO: 4219164 - RNA, 22 nt, Yersinia pestis KIM
gcaucuggccagaugauaccgc

SEQ ID NO: 4219165 - RNA, 19 nt, Yersinia pestis KIM
gcaucuggucaucauguag

SEQ ID NO: 4219166 - RNA, 11 nt, Yersinia pestis KIM
gcaucuuccaa

SEQ ID NO: 4219167 - RNA, 15 nt, Yersinia pestis KIM
gcaucuuccaaagga

SEQ ID NO: 4219168 - RNA, 18 nt, Yersinia pestis KIM
gcaucuuccaaaggaagg

SEQ ID NO: 4219169 - RNA, 21 nt, Yersinia pestis KIM
gcaucuugaaggauggcggau

SEQ ID NO: 4219170 - RNA, 15 nt, Yersinia pestis KIM
gcaucuuuugcuauu

SEQ ID NO: 4219171 - RNA, 12 nt, Yersinia pestis KIM
gcaugaauaaua

SEQ ID NO: 4219172 - RNA, 14 nt, Yersinia pestis KIM
gcaugcccagccuc

SEQ ID NO: 4219173 - RNA, 17 nt, Yersinia pestis KIM
gcaugcccggucaugau

SEQ ID NO: 4219174 - RNA, 15 nt, Yersinia pestis KIM
gcaugcuuccagaua

SEQ ID NO: 4219175 - RNA, 19 nt, Yersinia pestis KIM
gcauggcuaaaauuaagcc

SEQ ID NO: 4219176 - RNA, 15 nt, Yersinia pestis KIM
gcaugggcuugcaua

SEQ ID NO: 4219177 - RNA, 17 nt, Yersinia pestis KIM
gcaugggcuugcauauc

SEQ ID NO: 4219178 - RNA, 23 nt, Yersinia pestis KIM
gcaugguuaaaacucaaacugau

SEQ ID NO: 4219179 - RNA, 20 nt, Yersinia pestis KIM
gcaugugauguggcuugcaa

SEQ ID NO: 4219180 - RNA, 16 nt, Yersinia pestis KIM
gcauguggaagcgggc

SEQ ID NO: 4219181 - RNA, 20 nt, Yersinia pestis KIM
gcaugugggcagggcagcuu

SEQ ID NO: 4219182 - RNA, 15 nt, Yersinia pestis KIM
gcauuaaaaucaccc

SEQ ID NO: 4219183 - RNA, 22 nt, Yersinia pestis KIM
gcauuaaggcgcgacugauuga

SEQ ID NO: 4219184 - RNA, 15 nt, Yersinia pestis KIM
gcauuacaacuugaa

SEQ ID NO: 4219185 - RNA, 19 nt, Yersinia pestis KIM
gcauuaccuuuaaaacugg

SEQ ID NO: 4219186 - RNA, 15 nt, Yersinia pestis KIM
gcauuagacauucaa

SEQ ID NO: 4219187 - RNA, 14 nt, Yersinia pestis KIM
gcauuauaaggaga

SEQ ID NO: 4219188 - RNA, 15 nt, Yersinia pestis KIM
gcauuaucuuuaauu

SEQ ID NO: 4219189 - RNA, 16 nt, Yersinia pestis KIM
gcauucaggcuuuuuu

SEQ ID NO: 4219190 - RNA, 20 nt, Yersinia pestis KIM
gcauucagguguucagccaa

SEQ ID NO: 4219191 - RNA, 22 nt, Yersinia pestis KIM
gcauucagguguucagccaagu

SEQ ID NO: 4219192 - RNA, 23 nt, Yersinia pestis KIM
gcauucauaucguccaaagggag

SEQ ID NO: 4219193 - RNA, 22 nt, Yersinia pestis KIM
gcauucccugcgguuauuugcu

SEQ ID NO: 4219194 - RNA, 21 nt, Yersinia pestis KIM
gcauucgugccauaaaguuuu

SEQ ID NO: 4219195 - RNA, 16 nt, Yersinia pestis KIM
gcauucugcugguuca

SEQ ID NO: 4219196 - RNA, 18 nt, Yersinia pestis KIM
gcauugauuucaaugccg

SEQ ID NO: 4219197 - RNA, 14 nt, Yersinia pestis KIM
gcauuggauaauuu

SEQ ID NO: 4219198 - RNA, 16 nt, Yersinia pestis KIM
gcauuggcaaaucauc

SEQ ID NO: 4219199 - RNA, 24 nt, Yersinia pestis KIM
gcauugugcuuuuuggcaaacuca

SEQ ID NO: 4219200 - RNA, 16 nt, Yersinia pestis KIM
gcauuguuggcccgca

SEQ ID NO: 4219201 - RNA, 21 nt, Yersinia pestis KIM
gcauuguuggcccgcaucuuu

SEQ ID NO: 4219202 - RNA, 13 nt, Yersinia pestis KIM
gcauuuaaaaggc

SEQ ID NO: 4219203 - RNA, 19 nt, Yersinia pestis KIM
gcauuuaauguucgcugac

SEQ ID NO: 4219204 - RNA, 20 nt, Yersinia pestis KIM
gcauuuaucauauuaacaua

SEQ ID NO: 4219205 - RNA, 16 nt, Yersinia pestis KIM
gcauuuaugaugcauu

SEQ ID NO: 4219206 - RNA, 19 nt, Yersinia pestis KIM
gcauuuuagugaugauauu

SEQ ID NO: 4219207 - RNA, 12 nt, Yersinia pestis KIM
gcauuuucagua

SEQ ID NO: 4219208 - RNA, 22 nt, Yersinia pestis KIM
gcauuuuucuguucagauuuac

SEQ ID NO: 4219209 - RNA, 19 nt, Yersinia pestis KIM
gccaaaaaauaagggccac

SEQ ID NO: 4219210 - RNA, 13 nt, Yersinia pestis KIM
gccaaaaauguaa

SEQ ID NO: 4219211 - RNA, 15 nt, Yersinia pestis KIM
gccaaaacagccuaa

SEQ ID NO: 4219212 - RNA, 20 nt, Yersinia pestis KIM
gccaaaauaaacaucaaugu

SEQ ID NO: 4219213 - RNA, 14 nt, Yersinia pestis KIM
gccaaacaaaugaa

SEQ ID NO: 4219214 - RNA, 13 nt, Yersinia pestis KIM
gccaaacaguaaa

SEQ ID NO: 4219215 - RNA, 22 nt, Yersinia pestis KIM
gccaaauacauauaaccaucaa

SEQ ID NO: 4219216 - RNA, 19 nt, Yersinia pestis KIM
gccaaauuacgugcccaaa

SEQ ID NO: 4219217 - RNA, 18 nt, Yersinia pestis KIM
gccaaauuuggccuuucu

SEQ ID NO: 4219218 - RNA, 12 nt, Yersinia pestis KIM
gccaacaacuua

SEQ ID NO: 4219219 - RNA, 18 nt, Yersinia pestis KIM
gccaacaauugcuccagu

SEQ ID NO: 4219220 - RNA, 14 nt, Yersinia pestis KIM
gccaacaggccccu

SEQ ID NO: 4219221 - RNA, 12 nt, Yersinia pestis KIM
gccaacagugaa

SEQ ID NO: 4219222 - RNA, 18 nt, Yersinia pestis KIM
gccaacgcccugcaucuu

SEQ ID NO: 4219223 - RNA, 21 nt, Yersinia pestis KIM
gccaacggacggaauccaaca

SEQ ID NO: 4219224 - RNA, 20 nt, Yersinia pestis KIM
gccaagcaagcggcagcgcu

SEQ ID NO: 4219225 - RNA, 23 nt, Yersinia pestis KIM
gccaagcuacggccuguaccacc

SEQ ID NO: 4219226 - RNA, 17 nt, Yersinia pestis KIM
gccaaggauggcgcggc

SEQ ID NO: 4219227 - RNA, 20 nt, Yersinia pestis KIM
gccaaggccagcgccccauc

SEQ ID NO: 4219228 - RNA, 15 nt, Yersinia pestis KIM
gccaagguucgaaaa

SEQ ID NO: 4219229 - RNA, 14 nt, Yersinia pestis KIM
gccaauaaagucca

SEQ ID NO: 4219230 - RNA, 18 nt, Yersinia pestis KIM
gccaauaccggugguuua

SEQ ID NO: 4219231 - RNA, 16 nt, Yersinia pestis KIM
gccaauagcaaaccca

SEQ ID NO: 4219232 - RNA, 18 nt, Yersinia pestis KIM
gccaauauugccuucacc

SEQ ID NO: 4219233 - RNA, 16 nt, Yersinia pestis KIM
gccaaucaaaaaaccg

SEQ ID NO: 4219234 - RNA, 21 nt, Yersinia pestis KIM
gccaaucaaaaugaccuuauc

SEQ ID NO: 4219235 - RNA, 12 nt, Yersinia pestis KIM
gccaauccccag

SEQ ID NO: 4219236 - RNA, 20 nt, Yersinia pestis KIM
gccaaucccgauaaaaacca

SEQ ID NO: 4219237 - RNA, 14 nt, Yersinia pestis KIM
gccaauccuuccug

SEQ ID NO: 4219238 - RNA, 12 nt, Yersinia pestis KIM
gccaaucgcucu

SEQ ID NO: 4219239 - RNA, 21 nt, Yersinia pestis KIM
gccaaucggccuuaaccaagc

SEQ ID NO: 4219240 - RNA, 20 nt, Yersinia pestis KIM
gccaaucucuuguuuugcaa

SEQ ID NO: 4219241 - RNA, 22 nt, Yersinia pestis KIM
gccaaugacaaaggguaauuaa

SEQ ID NO: 4219242 - RNA, 16 nt, Yersinia pestis KIM
gccaaugcugcuguca

SEQ ID NO: 4219243 - RNA, 19 nt, Yersinia pestis KIM
gccaaugcuuuuugcaucg

SEQ ID NO: 4219244 - RNA, 23 nt, Yersinia pestis KIM
gccaauggaaccgcuaaagucac

SEQ ID NO: 4219245 - RNA, 17 nt, Yersinia pestis KIM
gccacaacccaauaaua

SEQ ID NO: 4219246 - RNA, 15 nt, Yersinia pestis KIM
gccacaauaaaauaa

SEQ ID NO: 4219247 - RNA, 13 nt, Yersinia pestis KIM
gccacacaauaca

SEQ ID NO: 4219248 - RNA, 18 nt, Yersinia pestis KIM
gccacacaauacauagaa

SEQ ID NO: 4219249 - RNA, 20 nt, Yersinia pestis KIM
gccacacagaaucaccaaca

SEQ ID NO: 4219250 - RNA, 13 nt, Yersinia pestis KIM
gccacacucagac

SEQ ID NO: 4219251 - RNA, 14 nt, Yersinia pestis KIM
gccaccaaaaaacg

SEQ ID NO: 4219252 - RNA, 17 nt, Yersinia pestis KIM
gccaccagaaucaucag

SEQ ID NO: 4219253 - RNA, 23 nt, Yersinia pestis KIM
gccaccagauuacgcgucaucau

SEQ ID NO: 4219254 - RNA, 14 nt, Yersinia pestis KIM
gccacccauugcuc

SEQ ID NO: 4219255 - RNA, 19 nt, Yersinia pestis KIM
gccaccccguggcaggccu

SEQ ID NO: 4219256 - RNA, 18 nt, Yersinia pestis KIM
gccaccgcauuccagcgu

SEQ ID NO: 4219257 - RNA, 13 nt, Yersinia pestis KIM
gccaccgcuggug

SEQ ID NO: 4219258 - RNA, 17 nt, Yersinia pestis KIM
gccaccucacucagcga

SEQ ID NO: 4219259 - RNA, 14 nt, Yersinia pestis KIM
gccaccuuaaguaa

SEQ ID NO: 4219260 - RNA, 22 nt, Yersinia pestis KIM
gccacgaauggcgacuaauggc

SEQ ID NO: 4219261 - RNA, 12 nt, Yersinia pestis KIM
gccauuuugcug

SEQ ID NO: 4219262 - RNA, 15 nt, Yersinia pestis KIM
gccauuuuuuauaaa

SEQ ID NO: 4219263 - RNA, 11 nt, Yersinia pestis KIM
gcccaagccau

SEQ ID NO: 4219264 - RNA, 22 nt, Yersinia pestis KIM
gcccaaggcgacuuugaugcca

SEQ ID NO: 4219265 - RNA, 22 nt, Yersinia pestis KIM
gcccaauaaaaacgccuccagu

SEQ ID NO: 4219266 - RNA, 16 nt, Yersinia pestis KIM
gcccaauaagugaaac

SEQ ID NO: 4219267 - RNA, 21 nt, Yersinia pestis KIM
gcccaauaagugaaacaaaua

SEQ ID NO: 4219268 - RNA, 21 nt, Yersinia pestis KIM
gcccaauacggcacucaaaua

SEQ ID NO: 4219269 - RNA, 18 nt, Yersinia pestis KIM
gcccaaucuaacuggccc

SEQ ID NO: 4219270 - RNA, 17 nt, Yersinia pestis KIM
gcccacaccaaucagcu

SEQ ID NO: 4219271 - RNA, 22 nt, Yersinia pestis KIM
gcccacagggugagucucaggg

SEQ ID NO: 4219272 - RNA, 19 nt, Yersinia pestis KIM
gcccacauaaagauagcca

SEQ ID NO: 4219273 - RNA, 15 nt, Yersinia pestis KIM
gcccacgaggacagg

SEQ ID NO: 4219274 - RNA, 15 nt, Yersinia pestis KIM
gcccagaaacauugc

SEQ ID NO: 4219275 - RNA, 17 nt, Yersinia pestis KIM
gcccagacgccggccgg

SEQ ID NO: 4219276 - RNA, 13 nt, Yersinia pestis KIM
gcccagagcgcgg

SEQ ID NO: 4219277 - RNA, 14 nt, Yersinia pestis KIM
gcccagauauccau

SEQ ID NO: 4219278 - RNA, 18 nt, Yersinia pestis KIM
gcccagcaaggcgggcaa

SEQ ID NO: 4219279 - RNA, 14 nt, Yersinia pestis KIM
gcccagcaggcugu

SEQ ID NO: 4219280 - RNA, 22 nt, Yersinia pestis KIM
gcccagcagugcugcgcccagu

SEQ ID NO: 4219281 - RNA, 20 nt, Yersinia pestis KIM
gcccagccgggguaucauag

SEQ ID NO: 4219282 - RNA, 14 nt, Yersinia pestis KIM
gcccagccucugga

SEQ ID NO: 4219283 - RNA, 18 nt, Yersinia pestis KIM
gcccagccugguuuuuua

SEQ ID NO: 4219284 - RNA, 16 nt, Yersinia pestis KIM
gcccagcgguaaauug

SEQ ID NO: 4219285 - RNA, 22 nt, Yersinia pestis KIM
gcccagcgguaaauugcucacu

SEQ ID NO: 4219286 - RNA, 16 nt, Yersinia pestis KIM
gcccagcguucucugg

SEQ ID NO: 4219287 - RNA, 21 nt, Yersinia pestis KIM
gcccagcguuggcagaaagug

SEQ ID NO: 4219288 - RNA, 21 nt, Yersinia pestis KIM
gcccaggcaaucucuccccaa

SEQ ID NO: 4219289 - RNA, 23 nt, Yersinia pestis KIM
gcccaguauugcagagcaaaacu

SEQ ID NO: 4219290 - RNA, 14 nt, Yersinia pestis KIM
gcccaguggagcca

SEQ ID NO: 4219291 - RNA, 12 nt, Yersinia pestis KIM
gcccaucagcau

SEQ ID NO: 4219292 - RNA, 14 nt, Yersinia pestis KIM
gcccauccgcagga

SEQ ID NO: 4219293 - RNA, 22 nt, Yersinia pestis KIM
gcccaucuuucggccuccccug

SEQ ID NO: 4219294 - RNA, 12 nt, Yersinia pestis KIM
gcccauugcgcu

SEQ ID NO: 4219295 - RNA, 22 nt, Yersinia pestis KIM
gccccaaauaaucagcucauua

SEQ ID NO: 4219296 - RNA, 14 nt, Yersinia pestis KIM
gccccaaaugccag

SEQ ID NO: 4219297 - RNA, 15 nt, Yersinia pestis KIM
gccccaaaugccagc

SEQ ID NO: 4219298 - RNA, 15 nt, Yersinia pestis KIM
gccccaaccaucucc

SEQ ID NO: 4219299 - RNA, 15 nt, Yersinia pestis KIM
gccccaagcauagaa

SEQ ID NO: 4219300 - RNA, 14 nt, Yersinia pestis KIM
gccccacaaugaau

SEQ ID NO: 4219301 - RNA, 15 nt, Yersinia pestis KIM
gccccacaaugaauu

SEQ ID NO: 4219302 - RNA, 18 nt, Yersinia pestis KIM
gcccccaauaagggccac

SEQ ID NO: 4219303 - RNA, 19 nt, Yersinia pestis KIM
gcccccaauaagggccacc

SEQ ID NO: 4219304 - RNA, 13 nt, Yersinia pestis KIM
gcccccaaugaca

SEQ ID NO: 4219305 - RNA, 17 nt, Yersinia pestis KIM
gcccccccgaugacacg

SEQ ID NO: 4219306 - RNA, 22 nt, Yersinia pestis KIM
gcccccuagugaugggggcaau

SEQ ID NO: 4219307 - RNA, 16 nt, Yersinia pestis KIM
gcccccuuucuuaucg

SEQ ID NO: 4219308 - RNA, 14 nt, Yersinia pestis KIM
gccccgauaaacca

SEQ ID NO: 4219309 - RNA, 21 nt, Yersinia pestis KIM
gccccgcaacgccgaugaagg

SEQ ID NO: 4219310 - RNA, 15 nt, Yersinia pestis KIM
gccccgcaggugggc

SEQ ID NO: 4219311 - RNA, 18 nt, Yersinia pestis KIM
gccccgcgcuaaccaacg

SEQ ID NO: 4219312 - RNA, 24 nt, Yersinia pestis KIM
gccccgcuaauugcugcucggaug

SEQ ID NO: 4219313 - RNA, 16 nt, Yersinia pestis KIM
gccccgcuaccaagcc

SEQ ID NO: 4219314 - RNA, 17 nt, Yersinia pestis KIM
gccccggauugcugccc

SEQ ID NO: 4219315 - RNA, 22 nt, Yersinia pestis KIM
gccccggcaaguugaucacccg

SEQ ID NO: 4219316 - RNA, 13 nt, Yersinia pestis KIM
gccccucagacug

SEQ ID NO: 4219317 - RNA, 17 nt, Yersinia pestis KIM
gccccucagacugcuga

SEQ ID NO: 4219318 - RNA, 18 nt, Yersinia pestis KIM
gccccucagacugcugac

SEQ ID NO: 4219319 - RNA, 21 nt, Yersinia pestis KIM
gccccugaauucgauaacagc

SEQ ID NO: 4219320 - RNA, 19 nt, Yersinia pestis KIM
gccccugauagucaauaaa

SEQ ID NO: 4219321 - RNA, 14 nt, Yersinia pestis KIM
gccccugauugcag

SEQ ID NO: 4219322 - RNA, 15 nt, Yersinia pestis KIM
gccccuguaaauaaa

SEQ ID NO: 4219323 - RNA, 13 nt, Yersinia pestis KIM
gccccuucuggug

SEQ ID NO: 4219324 - RNA, 20 nt, Yersinia pestis KIM
gccccuugcuucaguuuugc

SEQ ID NO: 4219325 - RNA, 23 nt, Yersinia pestis KIM
gccccuuguugccgguaggguuc

SEQ ID NO: 4219326 - RNA, 20 nt, Yersinia pestis KIM
gcccgaugguggcagccugc

SEQ ID NO: 4219327 - RNA, 21 nt, Yersinia pestis KIM
gcccgcaauuuuaaaggcaac

SEQ ID NO: 4219328 - RNA, 15 nt, Yersinia pestis KIM
gcccgcacacugagc

SEQ ID NO: 4219329 - RNA, 17 nt, Yersinia pestis KIM
gcccgcacacugagccg

SEQ ID NO: 4219330 - RNA, 13 nt, Yersinia pestis KIM
gcccgcagacugc

SEQ ID NO: 4219331 - RNA, 19 nt, Yersinia pestis KIM
gcccgccagguauuacagg

SEQ ID NO: 4219332 - RNA, 16 nt, Yersinia pestis KIM
gcccgccccaauagau

SEQ ID NO: 4219333 - RNA, 17 nt, Yersinia pestis KIM
gcccgcgacgagagaac

SEQ ID NO: 4219334 - RNA, 22 nt, Yersinia pestis KIM
gcccgcgacggagagaacaggc

SEQ ID NO: 4219335 - RNA, 14 nt, Yersinia pestis KIM
gcccgcgcauauag

SEQ ID NO: 4219336 - RNA, 22 nt, Yersinia pestis KIM
gcccgcggccaauagcaaaccc

SEQ ID NO: 4219337 - RNA, 13 nt, Yersinia pestis KIM
gcccgcgggggcc

SEQ ID NO: 4219338 - RNA, 21 nt, Yersinia pestis KIM
gcccgcuagugauagcgggcc

SEQ ID NO: 4219339 - RNA, 22 nt, Yersinia pestis KIM
gcccgcuagugauagcgggccu

SEQ ID NO: 4219340 - RNA, 15 nt, Yersinia pestis KIM
gcccgcuaucacuag

SEQ ID NO: 4219341 - RNA, 22 nt, Yersinia pestis KIM
gcccgcuaucacuagcgggccu

SEQ ID NO: 4219342 - RNA, 14 nt, Yersinia pestis KIM
gcccggaagguuuc

SEQ ID NO: 4219343 - RNA, 19 nt, Yersinia pestis KIM
gcccggcauggacgagcac

SEQ ID NO: 4219344 - RNA, 16 nt, Yersinia pestis KIM
gcccgguaucaccuuu

SEQ ID NO: 4219345 - RNA, 14 nt, Yersinia pestis KIM
gcccguaaacgggc

SEQ ID NO: 4219346 - RNA, 14 nt, Yersinia pestis KIM
gcccgucaauauca

SEQ ID NO: 4219347 - RNA, 16 nt, Yersinia pestis KIM
gcccgucaauaucauc

SEQ ID NO: 4219348 - RNA, 18 nt, Yersinia pestis KIM
gcccgucaauaucaucau

SEQ ID NO: 4219349 - RNA, 19 nt, Yersinia pestis KIM
gcccgucguuaugagauuu

SEQ ID NO: 4219350 - RNA, 14 nt, Yersinia pestis KIM
gcccuaacauugag

SEQ ID NO: 4219351 - RNA, 23 nt, Yersinia pestis KIM
gcccuaaccgcuuuuuacccagu

SEQ ID NO: 4219352 - RNA, 21 nt, Yersinia pestis KIM
gcccuaacugcucagccgacu

SEQ ID NO: 4219353 - RNA, 16 nt, Yersinia pestis KIM
gcccuaauaaccgaca

SEQ ID NO: 4219354 - RNA, 22 nt, Yersinia pestis KIM
gcccuccagccgguuuuuucca

SEQ ID NO: 4219355 - RNA, 19 nt, Yersinia pestis KIM
gcccucccuggcgcggacg

SEQ ID NO: 4219356 - RNA, 22 nt, Yersinia pestis KIM
gcccucguuguuguaugacaag

SEQ ID NO: 4219357 - RNA, 19 nt, Yersinia pestis KIM
gcccugaauagccugagca

SEQ ID NO: 4219358 - RNA, 22 nt, Yersinia pestis KIM
gcccugaauuucaauaacaccg

SEQ ID NO: 4219359 - RNA, 22 nt, Yersinia pestis KIM
gcccugagguuauugacaaagu

SEQ ID NO: 4219360 - RNA, 15 nt, Yersinia pestis KIM
gcccugcaucuugaa

SEQ ID NO: 4219361 - RNA, 17 nt, Yersinia pestis KIM
gcccugccauaaccgcu

SEQ ID NO: 4219362 - RNA, 14 nt, Yersinia pestis KIM
gcccugccuggcag

SEQ ID NO: 4219363 - RNA, 20 nt, Yersinia pestis KIM
gcccugccugguauuuucua

SEQ ID NO: 4219364 - RNA, 23 nt, Yersinia pestis KIM
gcccugcuaauuugacgccgccg

SEQ ID NO: 4219365 - RNA, 17 nt, Yersinia pestis KIM
gcccuguaaagccagua

SEQ ID NO: 4219366 - RNA, 21 nt, Yersinia pestis KIM
gcccuguaaagccaguaaacg

SEQ ID NO: 4219367 - RNA, 19 nt, Yersinia pestis KIM
gcccuuacuauuuuucuca

SEQ ID NO: 4219368 - RNA, 19 nt, Yersinia pestis KIM
gcccuuaucuacugggcca

SEQ ID NO: 4219369 - RNA, 21 nt, Yersinia pestis KIM
gcccuucagaugaauccagcc

SEQ ID NO: 4219370 - RNA, 14 nt, Yersinia pestis KIM
gcccuucggacggc

SEQ ID NO: 4219371 - RNA, 19 nt, Yersinia pestis KIM
gcccuucgggucaacgcug

SEQ ID NO: 4219372 - RNA, 13 nt, Yersinia pestis KIM
gcccuugcagcgu

SEQ ID NO: 4219373 - RNA, 19 nt, Yersinia pestis KIM
gcccuuugcuauucagacg

SEQ ID NO: 4219374 - RNA, 17 nt, Yersinia pestis KIM
gcccuuuugugcaucca

SEQ ID NO: 4219375 - RNA, 16 nt, Yersinia pestis KIM
gccucgcuuacuggua

SEQ ID NO: 4219376 - RNA, 21 nt, Yersinia pestis KIM
gccucgcuucugcgaggccgc

SEQ ID NO: 4219377 - RNA, 23 nt, Yersinia pestis KIM
gccucgcuucugcgaggccgcug

SEQ ID NO: 4219378 - RNA, 13 nt, Yersinia pestis KIM
gccucucagacug

SEQ ID NO: 4219379 - RNA, 17 nt, Yersinia pestis KIM
gccucugcugcugcccg

SEQ ID NO: 4219380 - RNA, 16 nt, Yersinia pestis KIM
gccucuggugccaacg

SEQ ID NO: 4219381 - RNA, 16 nt, Yersinia pestis KIM
gccucuguagccgcag

SEQ ID NO: 4219382 - RNA, 21 nt, Yersinia pestis KIM
gccucuucugucggagccuga

SEQ ID NO: 4219383 - RNA, 17 nt, Yersinia pestis KIM
gccugaauauucaccau

SEQ ID NO: 4219384 - RNA, 18 nt, Yersinia pestis KIM
gccugaauggaaaaauua

SEQ ID NO: 4219385 - RNA, 15 nt, Yersinia pestis KIM
gccugagaacccaug

SEQ ID NO: 4219386 - RNA, 19 nt, Yersinia pestis KIM
gccugagguucccaacggc

SEQ ID NO: 4219387 - RNA, 21 nt, Yersinia pestis KIM
gccugauaaaauuaccgcccc

SEQ ID NO: 4219388 - RNA, 14 nt, Yersinia pestis KIM
gccugauacaccau

SEQ ID NO: 4219389 - RNA, 16 nt, Yersinia pestis KIM
gccugcaccagugcca

SEQ ID NO: 4219390 - RNA, 17 nt, Yersinia pestis KIM
gccugcaccagugccaa

SEQ ID NO: 4219391 - RNA, 22 nt, Yersinia pestis KIM
gccugccagaacagcaggccgc

SEQ ID NO: 4219392 - RNA, 21 nt, Yersinia pestis KIM
gccugcgaauuaucauccaga

SEQ ID NO: 4219393 - RNA, 13 nt, Yersinia pestis KIM
gccugcggcggcu

SEQ ID NO: 4219394 - RNA, 14 nt, Yersinia pestis KIM
gccugcggcggcua

SEQ ID NO: 4219395 - RNA, 11 nt, Yersinia pestis KIM
gccugcucaac

SEQ ID NO: 4219396 - RNA, 16 nt, Yersinia pestis KIM
gccugcucaccgccga

SEQ ID NO: 4219397 - RNA, 13 nt, Yersinia pestis KIM
gccugcuggcaaa

SEQ ID NO: 4219398 - RNA, 17 nt, Yersinia pestis KIM
gccugcuguucuggcag

SEQ ID NO: 4219399 - RNA, 14 nt, Yersinia pestis KIM
gccuggugcaaccg

SEQ ID NO: 4219400 - RNA, 13 nt, Yersinia pestis KIM
gccuguaaaauau

SEQ ID NO: 4219401 - RNA, 16 nt, Yersinia pestis KIM
gccuguaccaccacca

SEQ ID NO: 4219402 - RNA, 22 nt, Yersinia pestis KIM
gccuguaccaccaccaacagca

SEQ ID NO: 4219403 - RNA, 23 nt, Yersinia pestis KIM
gccuguaccaccaccaacagcau

SEQ ID NO: 4219404 - RNA, 14 nt, Yersinia pestis KIM
gccugugcauugag

SEQ ID NO: 4219405 - RNA, 16 nt, Yersinia pestis KIM
gccugugcggcaguga

SEQ ID NO: 4219406 - RNA, 18 nt, Yersinia pestis KIM
gccugugcggcagugaac

SEQ ID NO: 4219407 - RNA, 22 nt, Yersinia pestis KIM
gccuguucucuccgccgcaggc

SEQ ID NO: 4219408 - RNA, 22 nt, Yersinia pestis KIM
gccuuaaaugcguagagucagu

SEQ ID NO: 4219409 - RNA, 23 nt, Yersinia pestis KIM
gccuuaacugcauagcuaaccuu

SEQ ID NO: 4219410 - RNA, 18 nt, Yersinia pestis KIM
gccuuaauggccgccauu

SEQ ID NO: 4219411 - RNA, 17 nt, Yersinia pestis KIM
gccuuaucagcgaaaaa

SEQ ID NO: 4219412 - RNA, 22 nt, Yersinia pestis KIM
gccuuaucagcgaaaaauuuca

SEQ ID NO: 4219413 - RNA, 15 nt, Yersinia pestis KIM
gccuucacugguuuu

SEQ ID NO: 4219414 - RNA, 20 nt, Yersinia pestis KIM
gccuuccuuggcgcggacgc

SEQ ID NO: 4219415 - RNA, 14 nt, Yersinia pestis KIM
gccuugaaucaaaa

SEQ ID NO: 4219416 - RNA, 15 nt, Yersinia pestis KIM
gccuuggcauguuca

SEQ ID NO: 4219417 - RNA, 18 nt, Yersinia pestis KIM
gccuugugggcaucuguc

SEQ ID NO: 4219418 - RNA, 14 nt, Yersinia pestis KIM
gccuuuauucauuc

SEQ ID NO: 4219419 - RNA, 12 nt, Yersinia pestis KIM
gccuuucugggc

SEQ ID NO: 4219420 - RNA, 14 nt, Yersinia pestis KIM
gccuuucugggcug

SEQ ID NO: 4219421 - RNA, 21 nt, Yersinia pestis KIM
gccuuucugggcugcauagcg

SEQ ID NO: 4219422 - RNA, 16 nt, Yersinia pestis KIM
gccuuuuaauuuucag

SEQ ID NO: 4219423 - RNA, 17 nt, Yersinia pestis KIM
gcgaaaaaccaugagaa

SEQ ID NO: 4219424 - RNA, 13 nt, Yersinia pestis KIM
gcgaaauugacuu

SEQ ID NO: 4219425 - RNA, 13 nt, Yersinia pestis KIM
gcgaagaagagau

SEQ ID NO: 4219426 - RNA, 24 nt, Yersinia pestis KIM
gcgaaggugugcucacaaucuucu

SEQ ID NO: 4219427 - RNA, 16 nt, Yersinia pestis KIM
gcgaauaauggcagcc

SEQ ID NO: 4219428 - RNA, 15 nt, Yersinia pestis KIM
gcgaauaucaggcac

SEQ ID NO: 4219429 - RNA, 12 nt, Yersinia pestis KIM
gcgaaucccccc

SEQ ID NO: 4219430 - RNA, 21 nt, Yersinia pestis KIM
gcgaaugcccugcuaauuuga

SEQ ID NO: 4219431 - RNA, 13 nt, Yersinia pestis KIM
gcgaauuaucauc

SEQ ID NO: 4219432 - RNA, 19 nt, Yersinia pestis KIM
gcgacaaucaauggccagc

SEQ ID NO: 4219433 - RNA, 19 nt, Yersinia pestis KIM
gcgacaccaagaggcugcg

SEQ ID NO: 4219434 - RNA, 16 nt, Yersinia pestis KIM
gcgacaggcgccacaa

SEQ ID NO: 4219435 - RNA, 17 nt, Yersinia pestis KIM
gcgacauuucggccacc

SEQ ID NO: 4219436 - RNA, 14 nt, Yersinia pestis KIM
gcgaccaauucauc

SEQ ID NO: 4219437 - RNA, 15 nt, Yersinia pestis KIM
gcgaccagcagaagu

SEQ ID NO: 4219438 - RNA, 17 nt, Yersinia pestis KIM
gcgacggagagaacagg

SEQ ID NO: 4219439 - RNA, 15 nt, Yersinia pestis KIM
gcgacuaauggccag

SEQ ID NO: 4219440 - RNA, 12 nt, Yersinia pestis KIM
gcgacucauccg

SEQ ID NO: 4219441 - RNA, 13 nt, Yersinia pestis KIM
gcgacuccuggca

SEQ ID NO: 4219442 - RNA, 20 nt, Yersinia pestis KIM
gcgacugauugaccaucaac

SEQ ID NO: 4219443 - RNA, 19 nt, Yersinia pestis KIM
gcgacugcgcgcugaacgu

SEQ ID NO: 4219444 - RNA, 19 nt, Yersinia pestis KIM
gcgacuuacgucgcuacga

SEQ ID NO: 4219445 - RNA, 13 nt, Yersinia pestis KIM
gcgacuuuuauuu

SEQ ID NO: 4219446 - RNA, 19 nt, Yersinia pestis KIM
gcgagaaagucaaagcgcu

SEQ ID NO: 4219447 - RNA, 18 nt, Yersinia pestis KIM
gcgagauagucagcgacg

SEQ ID NO: 4219448 - RNA, 13 nt, Yersinia pestis KIM
gcgagauggcguu

SEQ ID NO: 4219449 - RNA, 20 nt, Yersinia pestis KIM
gcgagauggucauggcgguu

SEQ ID NO: 4219450 - RNA, 14 nt, Yersinia pestis KIM
gcgagcaaggcauc

SEQ ID NO: 4219451 - RNA, 14 nt, Yersinia pestis KIM
gcgagcaauaccaa

SEQ ID NO: 4219452 - RNA, 13 nt, Yersinia pestis KIM
gcgagcacugccc

SEQ ID NO: 4219453 - RNA, 23 nt, Yersinia pestis KIM
gcgagcacugccccgaagcucaa

SEQ ID NO: 4219454 - RNA, 20 nt, Yersinia pestis KIM
gcgagcagugauuucuuaca

SEQ ID NO: 4219455 - RNA, 22 nt, Yersinia pestis KIM
gcgagcagugauuucuuacagu

SEQ ID NO: 4219456 - RNA, 22 nt, Yersinia pestis KIM
gcgagcgaccuugauucucaaa

SEQ ID NO: 4219457 - RNA, 22 nt, Yersinia pestis KIM
gcgagcucucacugcuccagcc

SEQ ID NO: 4219458 - RNA, 16 nt, Yersinia pestis KIM
gcgaggccgcugcaag

SEQ ID NO: 4219459 - RNA, 17 nt, Yersinia pestis KIM
gcgaggccgcugcaagc

SEQ ID NO: 4219460 - RNA, 15 nt, Yersinia pestis KIM
gcgaggcuucucagc

SEQ ID NO: 4219461 - RNA, 22 nt, Yersinia pestis KIM
gcgagggccuuucugaacaaaa

SEQ ID NO: 4219462 - RNA, 23 nt, Yersinia pestis KIM
gcgaguaguugucaagagugcga

SEQ ID NO: 4219463 - RNA, 23 nt, Yersinia pestis KIM
gcgauaaaagauuuccuuucgca

SEQ ID NO: 4219464 - RNA, 18 nt, Yersinia pestis KIM
gcgauaaacacccaagaa

SEQ ID NO: 4219465 - RNA, 19 nt, Yersinia pestis KIM
gcgauaaagagugaaauau

SEQ ID NO: 4219466 - RNA, 21 nt, Yersinia pestis KIM
gcgauacaccauuuccaggcu

SEQ ID NO: 4219467 - RNA, 15 nt, Yersinia pestis KIM
gcgauagcuucagca

SEQ ID NO: 4219468 - RNA, 18 nt, Yersinia pestis KIM
gcgauauccaccugauca

SEQ ID NO: 4219469 - RNA, 17 nt, Yersinia pestis KIM
gcgaucaauacaccaga

SEQ ID NO: 4219470 - RNA, 16 nt, Yersinia pestis KIM
gcgaucaggaagcccg

SEQ ID NO: 4219471 - RNA, 16 nt, Yersinia pestis KIM
gcgaucagguuguucc

SEQ ID NO: 4219472 - RNA, 23 nt, Yersinia pestis KIM
gcgauccaaaacaucggccagcg

SEQ ID NO: 4219473 - RNA, 19 nt, Yersinia pestis KIM
gcgaucccagaauggcaaa

SEQ ID NO: 4219474 - RNA, 22 nt, Yersinia pestis KIM
gcgaucuauucucuguaauggc

SEQ ID NO: 4219475 - RNA, 15 nt, Yersinia pestis KIM
gcgaugaaaaacaga

SEQ ID NO: 4219476 - RNA, 20 nt, Yersinia pestis KIM
gcgaugaaaaacagauauac

SEQ ID NO: 4219477 - RNA, 12 nt, Yersinia pestis KIM
gcgaugacugag

SEQ ID NO: 4219478 - RNA, 14 nt, Yersinia pestis KIM
gcgaugacugagua

SEQ ID NO: 4219479 - RNA, 20 nt, Yersinia pestis KIM
gcgaugaggcucuucugggc

SEQ ID NO: 4219480 - RNA, 22 nt, Yersinia pestis KIM
gcgaugaggcucuucugggcug

SEQ ID NO: 4219481 - RNA, 23 nt, Yersinia pestis KIM
gcgaugccaacaauugcuccagu

SEQ ID NO: 4219482 - RNA, 19 nt, Yersinia pestis KIM
gcgauuaaggguuaaccag

SEQ ID NO: 4219483 - RNA, 16 nt, Yersinia pestis KIM
gcgauuaggacaaaua

SEQ ID NO: 4219484 - RNA, 22 nt, Yersinia pestis KIM
gcgauuuaugcaugaaaacccu

SEQ ID NO: 4219485 - RNA, 14 nt, Yersinia pestis KIM
gcgcaaaaggcauc

SEQ ID NO: 4219486 - RNA, 14 nt, Yersinia pestis KIM
gcgcaacugccaug

SEQ ID NO: 4219487 - RNA, 17 nt, Yersinia pestis KIM
gcgcaacugccauggaa

SEQ ID NO: 4219488 - RNA, 17 nt, Yersinia pestis KIM
gcgcacauagggcucgg

SEQ ID NO: 4219489 - RNA, 22 nt, Yersinia pestis KIM
gcgcacguucccaggccaaggu

SEQ ID NO: 4219490 - RNA, 16 nt, Yersinia pestis KIM
gcguaaaauauuguug

SEQ ID NO: 4219491 - RNA, 22 nt, Yersinia pestis KIM
gcguaaacaacgcuaucuggcg

SEQ ID NO: 4219492 - RNA, 13 nt, Yersinia pestis KIM
gcguaaagcaccc

SEQ ID NO: 4219493 - RNA, 17 nt, Yersinia pestis KIM
gcguaagccuucaaccu

SEQ ID NO: 4219494 - RNA, 21 nt, Yersinia pestis KIM
gcguacaucagggugaccgca

SEQ ID NO: 4219495 - RNA, 22 nt, Yersinia pestis KIM
gcguaccauaguuuuucuccua

SEQ ID NO: 4219496 - RNA, 22 nt, Yersinia pestis KIM
gcguaccauauggaugaugcac

SEQ ID NO: 4219497 - RNA, 16 nt, Yersinia pestis KIM
gcguacgucacgguau

SEQ ID NO: 4219498 - RNA, 18 nt, Yersinia pestis KIM
gcguagagccuuuacggg

SEQ ID NO: 4219499 - RNA, 13 nt, Yersinia pestis KIM
gcguagagucagu

SEQ ID NO: 4219500 - RNA, 16 nt, Yersinia pestis KIM
gcguagguuucagccu

SEQ ID NO: 4219501 - RNA, 19 nt, Yersinia pestis KIM
gcguagguuucagccucug

SEQ ID NO: 4219502 - RNA, 14 nt, Yersinia pestis KIM
gcguauaaacagag

SEQ ID NO: 4219503 - RNA, 17 nt, Yersinia pestis KIM
gcgucaguucaagcagc

SEQ ID NO: 4219504 - RNA, 22 nt, Yersinia pestis KIM
gcgucauaccauucucugucuu

SEQ ID NO: 4219505 - RNA, 21 nt, Yersinia pestis KIM
gcgucaucgggguuugucagc

SEQ ID NO: 4219506 - RNA, 19 nt, Yersinia pestis KIM
gcguccgcgccaaggcaag

SEQ ID NO: 4219507 - RNA, 17 nt, Yersinia pestis KIM
gcguccgcgccagggag

SEQ ID NO: 4219508 - RNA, 16 nt, Yersinia pestis KIM
gcguccgucauccaau

SEQ ID NO: 4219509 - RNA, 21 nt, Yersinia pestis KIM
gcgucuacgggcgcuuuucuu

SEQ ID NO: 4219510 - RNA, 11 nt, Yersinia pestis KIM
gcgucucuacg

SEQ ID NO: 4219511 - RNA, 16 nt, Yersinia pestis KIM
gcgucucuacgacgcc

SEQ ID NO: 4219512 - RNA, 22 nt, Yersinia pestis KIM
gcgucucuacgacgcccgcaga

SEQ ID NO: 4219513 - RNA, 14 nt, Yersinia pestis KIM
gcgucuucugugau

SEQ ID NO: 4219514 - RNA, 21 nt, Yersinia pestis KIM
gcgucuuuagauuucaccuau

SEQ ID NO: 4219515 - RNA, 18 nt, Yersinia pestis KIM
gcgucuuuaucgccagcu

SEQ ID NO: 4219516 - RNA, 17 nt, Yersinia pestis KIM
gcgugacuauucugccu

SEQ ID NO: 4219517 - RNA, 17 nt, Yersinia pestis KIM
gcgugaguuccagcccc

SEQ ID NO: 4219518 - RNA, 21 nt, Yersinia pestis KIM
gcgugauauccccaccguggc

SEQ ID NO: 4219519 - RNA, 22 nt, Yersinia pestis KIM
gcgugauuuuuauauuuugaga

SEQ ID NO: 4219520 - RNA, 15 nt, Yersinia pestis KIM
gcgugcgaacaaaaa

SEQ ID NO: 4219521 - RNA, 21 nt, Yersinia pestis KIM
gcgugcgggcauugaggccau

SEQ ID NO: 4219522 - RNA, 16 nt, Yersinia pestis KIM
gcgugcugcuuccugc

SEQ ID NO: 4219523 - RNA, 15 nt, Yersinia pestis KIM
gcguggaugaccagu

SEQ ID NO: 4219524 - RNA, 18 nt, Yersinia pestis KIM
gcgugggugaugugacgu

SEQ ID NO: 4219525 - RNA, 16 nt, Yersinia pestis KIM
gcguggugcgguaguu

SEQ ID NO: 4219526 - RNA, 19 nt, Yersinia pestis KIM
gcguguucuucucaccccg

SEQ ID NO: 4219527 - RNA, 14 nt, Yersinia pestis KIM
gcguuaacagcgcu

SEQ ID NO: 4219528 - RNA, 15 nt, Yersinia pestis KIM
gcguuaaccaguagc

SEQ ID NO: 4219529 - RNA, 15 nt, Yersinia pestis KIM
gcguuaaugccaccc

SEQ ID NO: 4219530 - RNA, 19 nt, Yersinia pestis KIM
gcguuacacaucaggcugu

SEQ ID NO: 4219531 - RNA, 20 nt, Yersinia pestis KIM
gcguuacagcaaggcagcaa

SEQ ID NO: 4219532 - RNA, 16 nt, Yersinia pestis KIM
gcguuacccacauuaa

SEQ ID NO: 4219533 - RNA, 21 nt, Yersinia pestis KIM
gcguuagcguacaagacaaua

SEQ ID NO: 4219534 - RNA, 23 nt, Yersinia pestis KIM
gcguuaucucgucuuccgcccgu

SEQ ID NO: 4219535 - RNA, 19 nt, Yersinia pestis KIM
gcguuaucuuuuauuuaug

SEQ ID NO: 4219536 - RNA, 14 nt, Yersinia pestis KIM
gcguuauugagaag

SEQ ID NO: 4219537 - RNA, 21 nt, Yersinia pestis KIM
gcguuauugcgacauaaagca

SEQ ID NO: 4219538 - RNA, 15 nt, Yersinia pestis KIM
gcguucaaaaucaaa

SEQ ID NO: 4219539 - RNA, 14 nt, Yersinia pestis KIM
gcguucagcaauau

SEQ ID NO: 4219540 - RNA, 18 nt, Yersinia pestis KIM
gcguuccaaucugcgccc

SEQ ID NO: 4219541 - RNA, 23 nt, Yersinia pestis KIM
gcguucuacugcguccuuugccc

SEQ ID NO: 4219542 - RNA, 16 nt, Yersinia pestis KIM
gcguucugcaaacccu

SEQ ID NO: 4219543 - RNA, 21 nt, Yersinia pestis KIM
gcguugacagacaacgggcgg

SEQ ID NO: 4219544 - RNA, 19 nt, Yersinia pestis KIM
gcguugacuuucuaagcug

SEQ ID NO: 4219545 - RNA, 22 nt, Yersinia pestis KIM
gcguugacuuucuaagcugccu

SEQ ID NO: 4219546 - RNA, 15 nt, Yersinia pestis KIM
gcguugcgcugacca

SEQ ID NO: 4219547 - RNA, 15 nt, Yersinia pestis KIM
gcguuguaauaacgc

SEQ ID NO: 4219548 - RNA, 23 nt, Yersinia pestis KIM
gcguuuacucgcuccgagcgugc

SEQ ID NO: 4219549 - RNA, 17 nt, Yersinia pestis KIM
gcguuuucugcauaagc

SEQ ID NO: 4219550 - RNA, 19 nt, Yersinia pestis KIM
gcguuuugcaucaacgaca

SEQ ID NO: 4219551 - RNA, 19 nt, Yersinia pestis KIM
gcguuuuuauugggcagcg

SEQ ID NO: 4219552 - RNA, 19 nt, Yersinia pestis KIM
gcguuuuuucguuuacuug

SEQ ID NO: 4219553 - RNA, 12 nt, Yersinia pestis KIM
gcuaaacagggu

SEQ ID NO: 4219554 - RNA, 22 nt, Yersinia pestis KIM
gcuaaacuaaaacagcuaacac

SEQ ID NO: 4219555 - RNA, 22 nt, Yersinia pestis KIM
gcuaaagggcugagcggaucga

SEQ ID NO: 4219556 - RNA, 14 nt, Yersinia pestis KIM
gcuaaauacugcug

SEQ ID NO: 4219557 - RNA, 13 nt, Yersinia pestis KIM
gcuaaaucaucaa

SEQ ID NO: 4219558 - RNA, 13 nt, Yersinia pestis KIM
gcuaaaugacaua

SEQ ID NO: 4219559 - RNA, 15 nt, Yersinia pestis KIM
gcuaaaugacauauu

SEQ ID NO: 4219560 - RNA, 19 nt, Yersinia pestis KIM
gcuaacaaccgugcaccau

SEQ ID NO: 4219561 - RNA, 18 nt, Yersinia pestis KIM
gcuaacaacuaacgauug

SEQ ID NO: 4219562 - RNA, 22 nt, Yersinia pestis KIM
gcuaacacgaccuucaucucug

SEQ ID NO: 4219563 - RNA, 13 nt, Yersinia pestis KIM
gcuaacagugacc

SEQ ID NO: 4219564 - RNA, 14 nt, Yersinia pestis KIM
gcuaaccacagcaa

SEQ ID NO: 4219565 - RNA, 16 nt, Yersinia pestis KIM
gcuaaccacagcaaug

SEQ ID NO: 4219566 - RNA, 16 nt, Yersinia pestis KIM
gcuaaccaccgucacc

SEQ ID NO: 4219567 - RNA, 17 nt, Yersinia pestis KIM
gcuaaccaccgucacca

SEQ ID NO: 4219568 - RNA, 16 nt, Yersinia pestis KIM
gcuaaccccugcaucu

SEQ ID NO: 4219569 - RNA, 17 nt, Yersinia pestis KIM
gcuaaccccugcaucuu

SEQ ID NO: 4219570 - RNA, 12 nt, Yersinia pestis KIM
gcuaaccgccuu

SEQ ID NO: 4219571 - RNA, 15 nt, Yersinia pestis KIM
gcuaaccuauagcaa

SEQ ID NO: 4219572 - RNA, 16 nt, Yersinia pestis KIM
gcuaacgucgcuguua

SEQ ID NO: 4219573 - RNA, 21 nt, Yersinia pestis KIM
gcuaacuggcggggcaaauag

SEQ ID NO: 4219574 - RNA, 16 nt, Yersinia pestis KIM
gcuaacugucauuguc

SEQ ID NO: 4219575 - RNA, 19 nt, Yersinia pestis KIM
gcuaagugucaauaacagu

SEQ ID NO: 4219576 - RNA, 17 nt, Yersinia pestis KIM
gcuaauacuggcuaaau

SEQ ID NO: 4219577 - RNA, 19 nt, Yersinia pestis KIM
gcuaauagaucagccaaau

SEQ ID NO: 4219578 - RNA, 15 nt, Yersinia pestis KIM
gcuaauauuuauaaa

SEQ ID NO: 4219579 - RNA, 16 nt, Yersinia pestis KIM
gcuaauauuuauaaaa

SEQ ID NO: 4219580 - RNA, 19 nt, Yersinia pestis KIM
gcuaauauuuauaaaaaau

SEQ ID NO: 4219581 - RNA, 18 nt, Yersinia pestis KIM
gcuaaugcucgcucauca

SEQ ID NO: 4219582 - RNA, 24 nt, Yersinia pestis KIM
gcuaauuaaaccugacugguucac

SEQ ID NO: 4219583 - RNA, 18 nt, Yersinia pestis KIM
gcuaauuaauuuaaacaa

SEQ ID NO: 4219584 - RNA, 18 nt, Yersinia pestis KIM
gcuaauuagaugaguggu

SEQ ID NO: 4219585 - RNA, 19 nt, Yersinia pestis KIM
gcuaauucugcgccuauac

SEQ ID NO: 4219586 - RNA, 23 nt, Yersinia pestis KIM
gcuaauucugcgccuauaccugc

SEQ ID NO: 4219587 - RNA, 14 nt, Yersinia pestis KIM
gcuaauugucacag

SEQ ID NO: 4219588 - RNA, 21 nt, Yersinia pestis KIM
gcuaauuugggugccauagca

SEQ ID NO: 4219589 - RNA, 15 nt, Yersinia pestis KIM
gcuaauuuucccugu

SEQ ID NO: 4219590 - RNA, 13 nt, Yersinia pestis KIM
gcuacagcgucag

SEQ ID NO: 4219591 - RNA, 21 nt, Yersinia pestis KIM
gcuacaggcgcaacugccaug

SEQ ID NO: 4219592 - RNA, 22 nt, Yersinia pestis KIM
gcuaccaagacuucaugacuac

SEQ ID NO: 4219593 - RNA, 21 nt, Yersinia pestis KIM
gcuaccaaggcugguggcuga

SEQ ID NO: 4219594 - RNA, 17 nt, Yersinia pestis KIM
gcuaccaauuauucggg

SEQ ID NO: 4219595 - RNA, 19 nt, Yersinia pestis KIM
gcuaccagagaaccgacag

SEQ ID NO: 4219596 - RNA, 15 nt, Yersinia pestis KIM
gcuaccagcagugca

SEQ ID NO: 4219597 - RNA, 13 nt, Yersinia pestis KIM
gcuaccaggaagc

SEQ ID NO: 4219598 - RNA, 19 nt, Yersinia pestis KIM
gcuaccaggaagcggccag

SEQ ID NO: 4219599 - RNA, 19 nt, Yersinia pestis KIM
gcuaccgcgcugcuugcaa

SEQ ID NO: 4219600 - RNA, 18 nt, Yersinia pestis KIM
gcuacggcaccuuuuuug

SEQ ID NO: 4219601 - RNA, 22 nt, Yersinia pestis KIM
gcuacugcgcguugccauguug

SEQ ID NO: 4219602 - RNA, 23 nt, Yersinia pestis KIM
gcuacugcuuuuuauugucucua

SEQ ID NO: 4219603 - RNA, 14 nt, Yersinia pestis KIM
gcuacugguaauaa

SEQ ID NO: 4219604 - RNA, 14 nt, Yersinia pestis KIM
gcucugucagcccu

SEQ ID NO: 4219605 - RNA, 19 nt, Yersinia pestis KIM
gcucuuacguuucauaugu

SEQ ID NO: 4219606 - RNA, 16 nt, Yersinia pestis KIM
gcucuucaccaaagga

SEQ ID NO: 4219607 - RNA, 18 nt, Yersinia pestis KIM
gcucuucaccaaaggaag

SEQ ID NO: 4219608 - RNA, 22 nt, Yersinia pestis KIM
gcucuucaccaaaggaagccga

SEQ ID NO: 4219609 - RNA, 19 nt, Yersinia pestis KIM
gcucuucaucaucaaauga

SEQ ID NO: 4219610 - RNA, 16 nt, Yersinia pestis KIM
gcucuucuucacugag

SEQ ID NO: 4219611 - RNA, 22 nt, Yersinia pestis KIM
gcucuucuucacugagcagguu

SEQ ID NO: 4219612 - RNA, 22 nt, Yersinia pestis KIM
gcucuugagguuauugacaaag

SEQ ID NO: 4219613 - RNA, 16 nt, Yersinia pestis KIM
gcucuuugauuccucu

SEQ ID NO: 4219614 - RNA, 16 nt, Yersinia pestis KIM
gcugaaaaucaugaaa

SEQ ID NO: 4219615 - RNA, 15 nt, Yersinia pestis KIM
gcugaaaucaggcug

SEQ ID NO: 4219616 - RNA, 16 nt, Yersinia pestis KIM
gcugaacccugacggc

SEQ ID NO: 4219617 - RNA, 12 nt, Yersinia pestis KIM
gcugaagccagc

SEQ ID NO: 4219618 - RNA, 13 nt, Yersinia pestis KIM
gcugaaggccugc

SEQ ID NO: 4219619 - RNA, 23 nt, Yersinia pestis KIM
gcugaaguggcugaauaucaucu

SEQ ID NO: 4219620 - RNA, 19 nt, Yersinia pestis KIM
gcugaauaaacggcaagcg

SEQ ID NO: 4219621 - RNA, 21 nt, Yersinia pestis KIM
gcugaauaucaucuuuuucug

SEQ ID NO: 4219622 - RNA, 16 nt, Yersinia pestis KIM
gcugaauugauuuauu

SEQ ID NO: 4219623 - RNA, 15 nt, Yersinia pestis KIM
gcugaauugcuuauc

SEQ ID NO: 4219624 - RNA, 17 nt, Yersinia pestis KIM
gcugaauuggaagagcc

SEQ ID NO: 4219625 - RNA, 22 nt, Yersinia pestis KIM
gcugaauuuuugugcuagcuca

SEQ ID NO: 4219626 - RNA, 13 nt, Yersinia pestis KIM
gcugacauugccc

SEQ ID NO: 4219627 - RNA, 16 nt, Yersinia pestis KIM
gcugacauuuucuauc

SEQ ID NO: 4219628 - RNA, 14 nt, Yersinia pestis KIM
gcugaccacaaaaa

SEQ ID NO: 4219629 - RNA, 21 nt, Yersinia pestis KIM
gcugaccauggcgaucaaagg

SEQ ID NO: 4219630 - RNA, 16 nt, Yersinia pestis KIM
gcugaccccaaauuug

SEQ ID NO: 4219631 - RNA, 22 nt, Yersinia pestis KIM
gcugaccuguuguaacacuuga

SEQ ID NO: 4219632 - RNA, 16 nt, Yersinia pestis KIM
gcugacgucagaucgc

SEQ ID NO: 4219633 - RNA, 23 nt, Yersinia pestis KIM
gcugagcauauacagcccgguau

SEQ ID NO: 4219634 - RNA, 15 nt, Yersinia pestis KIM
gcugagcgggcggca

SEQ ID NO: 4219635 - RNA, 18 nt, Yersinia pestis KIM
gcugaggauaggccgggg

SEQ ID NO: 4219636 - RNA, 19 nt, Yersinia pestis KIM
gcugaggcgacacccgcuu

SEQ ID NO: 4219637 - RNA, 18 nt, Yersinia pestis KIM
gcugaggucagugcugca

SEQ ID NO: 4219638 - RNA, 18 nt, Yersinia pestis KIM
gcugaguaaagaucccca

SEQ ID NO: 4219639 - RNA, 20 nt, Yersinia pestis KIM
gcugaguaaagcccagcagg

SEQ ID NO: 4219640 - RNA, 14 nt, Yersinia pestis KIM
gcugagugaagaca

SEQ ID NO: 4219641 - RNA, 15 nt, Yersinia pestis KIM
gcugagugaagacau

SEQ ID NO: 4219642 - RNA, 21 nt, Yersinia pestis KIM
gcugagugaagacaucgccag

SEQ ID NO: 4219643 - RNA, 22 nt, Yersinia pestis KIM
gcugagugaagacaucgccaga

SEQ ID NO: 4219644 - RNA, 15 nt, Yersinia pestis KIM
gcugauaaccagcag

SEQ ID NO: 4219645 - RNA, 21 nt, Yersinia pestis KIM
gcugauacagcaguuccagua

SEQ ID NO: 4219646 - RNA, 17 nt, Yersinia pestis KIM
gcugauagccaauaacc

SEQ ID NO: 4219647 - RNA, 15 nt, Yersinia pestis KIM
gcugauaugaaaaau

SEQ ID NO: 4219648 - RNA, 18 nt, Yersinia pestis KIM
gcugaugcgcccaugcca

SEQ ID NO: 4219649 - RNA, 15 nt, Yersinia pestis KIM
gcugauuaauaucaa

SEQ ID NO: 4219650 - RNA, 17 nt, Yersinia pestis KIM
gcugauuaauaucaaaa

SEQ ID NO: 4219651 - RNA, 22 nt, Yersinia pestis KIM
gcugauuaauaucaaaacugau

SEQ ID NO: 4219652 - RNA, 14 nt, Yersinia pestis KIM
gcugauuaaugagg

SEQ ID NO: 4219653 - RNA, 21 nt, Yersinia pestis KIM
gcugauuaccugcaucaagcc

SEQ ID NO: 4219654 - RNA, 14 nt, Yersinia pestis KIM
gcugauugugccuu

SEQ ID NO: 4219655 - RNA, 20 nt, Yersinia pestis KIM
gcugcaaacaggcccacugc

SEQ ID NO: 4219656 - RNA, 13 nt, Yersinia pestis KIM
gcugcaacucauu

SEQ ID NO: 4219657 - RNA, 21 nt, Yersinia pestis KIM
gcugcaacucauuaacaauua

SEQ ID NO: 4219658 - RNA, 21 nt, Yersinia pestis KIM
gcugcaagccgcguucaaauc

SEQ ID NO: 4219659 - RNA, 21 nt, Yersinia pestis KIM
gcugcacaucauuuauuucca

SEQ ID NO: 4219660 - RNA, 12 nt, Yersinia pestis KIM
gcugcacuuuua

SEQ ID NO: 4219661 - RNA, 13 nt, Yersinia pestis KIM
gcugcagcaucaa

SEQ ID NO: 4219662 - RNA, 19 nt, Yersinia pestis KIM
gcugcagccgggaugauca

SEQ ID NO: 4219663 - RNA, 19 nt, Yersinia pestis KIM
gcugcagcgugauuagcag

SEQ ID NO: 4219664 - RNA, 13 nt, Yersinia pestis KIM
gcugcaucagcag

SEQ ID NO: 4219665 - RNA, 15 nt, Yersinia pestis KIM
gcugcaugugcguug

SEQ ID NO: 4219666 - RNA, 19 nt, Yersinia pestis KIM
gcugccagugccgccgccu

SEQ ID NO: 4219667 - RNA, 23 nt, Yersinia pestis KIM
gcugcccaaccgcaucgugcucc

SEQ ID NO: 4219668 - RNA, 16 nt, Yersinia pestis KIM
gcugcccgcacacuga

SEQ ID NO: 4219669 - RNA, 21 nt, Yersinia pestis KIM
gcugcccuuugcuggcaugga

SEQ ID NO: 4219670 - RNA, 23 nt, Yersinia pestis KIM
gcugccugccugagguucccaac

SEQ ID NO: 4219671 - RNA, 16 nt, Yersinia pestis KIM
gcugccugugcggcag

SEQ ID NO: 4219672 - RNA, 23 nt, Yersinia pestis KIM
gcugccuguucucuucgccauag

SEQ ID NO: 4219673 - RNA, 17 nt, Yersinia pestis KIM
gcugcgauaauccgcca

SEQ ID NO: 4219674 - RNA, 17 nt, Yersinia pestis KIM
gcugcgccaauacccgu

SEQ ID NO: 4219675 - RNA, 20 nt, Yersinia pestis KIM
gcugcggcuugggagucaga

SEQ ID NO: 4219676 - RNA, 18 nt, Yersinia pestis KIM
gcugcgggugccgcauua

SEQ ID NO: 4219677 - RNA, 23 nt, Yersinia pestis KIM
gcugcgucuuuaucgccagcugc

SEQ ID NO: 4219678 - RNA, 20 nt, Yersinia pestis KIM
gcugcuaaacaggguugagc

SEQ ID NO: 4219679 - RNA, 23 nt, Yersinia pestis KIM
gcugcuaaacaggguugagccaa

SEQ ID NO: 4219680 - RNA, 20 nt, Yersinia pestis KIM
gcugcucgacuugggcuucc

SEQ ID NO: 4219681 - RNA, 11 nt, Yersinia pestis KIM
gcugcugcucg

SEQ ID NO: 4219682 - RNA, 18 nt, Yersinia pestis KIM
gcugcuuuaucguagcca

SEQ ID NO: 4219683 - RNA, 13 nt, Yersinia pestis KIM
gcuggaaguuggc

SEQ ID NO: 4219684 - RNA, 16 nt, Yersinia pestis KIM
gcuggacaacuucacu

SEQ ID NO: 4219685 - RNA, 14 nt, Yersinia pestis KIM
gcuggaucagcaga

SEQ ID NO: 4219686 - RNA, 21 nt, Yersinia pestis KIM
gcuggcaaccgguaacauaua

SEQ ID NO: 4219687 - RNA, 13 nt, Yersinia pestis KIM
gcuggcauacuga

SEQ ID NO: 4219688 - RNA, 14 nt, Yersinia pestis KIM
gcuggcauacugac

SEQ ID NO: 4219689 - RNA, 12 nt, Yersinia pestis KIM
gcuggcauuuuu

SEQ ID NO: 4219690 - RNA, 21 nt, Yersinia pestis KIM
gcuggccaguuucgguaccau

SEQ ID NO: 4219691 - RNA, 17 nt, Yersinia pestis KIM
gcuggcccccaaugaca

SEQ ID NO: 4219692 - RNA, 18 nt, Yersinia pestis KIM
gcuggcccccaaugacac

SEQ ID NO: 4219693 - RNA, 18 nt, Yersinia pestis KIM
gcuggcgaccacuuccug

SEQ ID NO: 4219694 - RNA, 23 nt, Yersinia pestis KIM
gcuggcgauaaacacccaagaau

SEQ ID NO: 4219695 - RNA, 16 nt, Yersinia pestis KIM
gcuggcggauaaaaau

SEQ ID NO: 4219696 - RNA, 20 nt, Yersinia pestis KIM
gcuggcuaauacuggcuaaa

SEQ ID NO: 4219697 - RNA, 23 nt, Yersinia pestis KIM
gcuggcuuuuugcugacgggguc

SEQ ID NO: 4219698 - RNA, 16 nt, Yersinia pestis KIM
gcugggaauuaagaag

SEQ ID NO: 4219699 - RNA, 17 nt, Yersinia pestis KIM
gcugggcguaacagccg

SEQ ID NO: 4219700 - RNA, 20 nt, Yersinia pestis KIM
gcugguaauccacccggcau

SEQ ID NO: 4219701 - RNA, 18 nt, Yersinia pestis KIM
gcugguagugauccccca

SEQ ID NO: 4219702 - RNA, 15 nt, Yersinia pestis KIM
gcuggucaucacgcu

SEQ ID NO: 4219703 - RNA, 15 nt, Yersinia pestis KIM
gcuggugaaugguca

SEQ ID NO: 4219704 - RNA, 16 nt, Yersinia pestis KIM
gcugguggcuugggcu

SEQ ID NO: 4219705 - RNA, 19 nt, Yersinia pestis KIM
gcugguguaacggcugcug

SEQ ID NO: 4219706 - RNA, 17 nt, Yersinia pestis KIM
gcugguuaucacagcaa

SEQ ID NO: 4219707 - RNA, 19 nt, Yersinia pestis KIM
gcugguuaucacagcaaau

SEQ ID NO: 4219708 - RNA, 17 nt, Yersinia pestis KIM
gcuguaaacuggcagau

SEQ ID NO: 4219709 - RNA, 14 nt, Yersinia pestis KIM
gcuguaaauaaaua

SEQ ID NO: 4219710 - RNA, 23 nt, Yersinia pestis KIM
gcuguaacuaccugcuuuaccau

SEQ ID NO: 4219711 - RNA, 20 nt, Yersinia pestis KIM
gcuguacaacaagaucccaa

SEQ ID NO: 4219712 - RNA, 19 nt, Yersinia pestis KIM
gcuguacugcugcaacuca

SEQ ID NO: 4219713 - RNA, 21 nt, Yersinia pestis KIM
gcuguauuuuucgcaguaacg

SEQ ID NO: 4219714 - RNA, 14 nt, Yersinia pestis KIM
gcugucauaaaaaa

SEQ ID NO: 4219715 - RNA, 16 nt, Yersinia pestis KIM
gcugucauaaaaaaag

SEQ ID NO: 4219716 - RNA, 19 nt, Yersinia pestis KIM
gcuguccaguugcuggaac

SEQ ID NO: 4219717 - RNA, 13 nt, Yersinia pestis KIM
gcugugagccaga

SEQ ID NO: 4219718 - RNA, 21 nt, Yersinia pestis KIM
ggaacagcucggccagcauuc

SEQ ID NO: 4219719 - RNA, 12 nt, Yersinia pestis KIM
ggaacaggccaa

SEQ ID NO: 4219720 - RNA, 21 nt, Yersinia pestis KIM
ggaacccauuugcacagcauu

SEQ ID NO: 4219721 - RNA, 19 nt, Yersinia pestis KIM
ggaacgaaguuagacccaa

SEQ ID NO: 4219722 - RNA, 15 nt, Yersinia pestis KIM
ggaacggacauuuag

SEQ ID NO: 4219723 - RNA, 20 nt, Yersinia pestis KIM
ggaacggacauuuagcacug

SEQ ID NO: 4219724 - RNA, 21 nt, Yersinia pestis KIM
ggaacgucugcaauagcucau

SEQ ID NO: 4219725 - RNA, 21 nt, Yersinia pestis KIM
ggaacguggguggucauuuaa

SEQ ID NO: 4219726 - RNA, 14 nt, Yersinia pestis KIM
ggaacuuacucccu

SEQ ID NO: 4219727 - RNA, 16 nt, Yersinia pestis KIM
ggaagcaagaaacugu

SEQ ID NO: 4219728 - RNA, 22 nt, Yersinia pestis KIM
ggaagccgccaaguuggggaua

SEQ ID NO: 4219729 - RNA, 20 nt, Yersinia pestis KIM
ggaagccggcgucuuuacga

SEQ ID NO: 4219730 - RNA, 19 nt, Yersinia pestis KIM
ggaagcgccgacacccagc

SEQ ID NO: 4219731 - RNA, 13 nt, Yersinia pestis KIM
ggaagcggccagg

SEQ ID NO: 4219732 - RNA, 16 nt, Yersinia pestis KIM
ggaaggcccagccggg

SEQ ID NO: 4219733 - RNA, 17 nt, Yersinia pestis KIM
ggaagggguucuuccaa

SEQ ID NO: 4219734 - RNA, 21 nt, Yersinia pestis KIM
ggaaggguuuugugggagagg

SEQ ID NO: 4219735 - RNA, 17 nt, Yersinia pestis KIM
ggaagguaccugaucag

SEQ ID NO: 4219736 - RNA, 14 nt, Yersinia pestis KIM
ggaauaaccuacaa

SEQ ID NO: 4219737 - RNA, 23 nt, Yersinia pestis KIM
ggaauauuccauacuguugcuag

SEQ ID NO: 4219738 - RNA, 15 nt, Yersinia pestis KIM
ggaauccccauggcu

SEQ ID NO: 4219739 - RNA, 15 nt, Yersinia pestis KIM
ggaaucuaccgcaga

SEQ ID NO: 4219740 - RNA, 16 nt, Yersinia pestis KIM
ggaaucuucaauggug

SEQ ID NO: 4219741 - RNA, 14 nt, Yersinia pestis KIM
ggaaugacuuucag

SEQ ID NO: 4219742 - RNA, 18 nt, Yersinia pestis KIM
ggaaugaguugcccuaaa

SEQ ID NO: 4219743 - RNA, 21 nt, Yersinia pestis KIM
ggaauuaagaagccucaugaa

SEQ ID NO: 4219744 - RNA, 14 nt, Yersinia pestis KIM
ggaauucuuuggca

SEQ ID NO: 4219745 - RNA, 19 nt, Yersinia pestis KIM
ggaauugugucaucgcgga

SEQ ID NO: 4219746 - RNA, 18 nt, Yersinia pestis KIM
ggacaaauaaaacagaac

SEQ ID NO: 4219747 - RNA, 19 nt, Yersinia pestis KIM
ggacagcgcgcagccaacg

SEQ ID NO: 4219748 - RNA, 15 nt, Yersinia pestis KIM
ggacaggcuccuccu

SEQ ID NO: 4219749 - RNA, 18 nt, Yersinia pestis KIM
ggacaggcuccuccuugg

SEQ ID NO: 4219750 - RNA, 12 nt, Yersinia pestis KIM
ggacaucugcuu

SEQ ID NO: 4219751 - RNA, 18 nt, Yersinia pestis KIM
ggacauuuuacucccuga

SEQ ID NO: 4219752 - RNA, 17 nt, Yersinia pestis KIM
ggacgaauacacagcga

SEQ ID NO: 4219753 - RNA, 14 nt, Yersinia pestis KIM
ggacgcuccucacu

SEQ ID NO: 4219754 - RNA, 21 nt, Yersinia pestis KIM
ggacgcuuuacuccccugccu

SEQ ID NO: 4219755 - RNA, 15 nt, Yersinia pestis KIM
ggacgcuuuacuccu

SEQ ID NO: 4219756 - RNA, 22 nt, Yersinia pestis KIM
ggacggaugguaaagcagguag

SEQ ID NO: 4219757 - RNA, 19 nt, Yersinia pestis KIM
ggacggcggccuuauuggg

SEQ ID NO: 4219758 - RNA, 19 nt, Yersinia pestis KIM
ggacuaauacggguuucug

SEQ ID NO: 4219759 - RNA, 20 nt, Yersinia pestis KIM
ggacuaauacggguuucugc

SEQ ID NO: 4219760 - RNA, 17 nt, Yersinia pestis KIM
ggacucuuaguuucuac

SEQ ID NO: 4219761 - RNA, 21 nt, Yersinia pestis KIM
ggacuucugcgaccugaucca

SEQ ID NO: 4219762 - RNA, 17 nt, Yersinia pestis KIM
ggagaccgcaugcugca

SEQ ID NO: 4219763 - RNA, 23 nt, Yersinia pestis KIM
ggagacgccuucacggguucgcg

SEQ ID NO: 4219764 - RNA, 15 nt, Yersinia pestis KIM
ggagagaaauaggca

SEQ ID NO: 4219765 - RNA, 15 nt, Yersinia pestis KIM
ggagagaacaggcag

SEQ ID NO: 4219766 - RNA, 11 nt, Yersinia pestis KIM
ggagaggcgcu

SEQ ID NO: 4219767 - RNA, 23 nt, Yersinia pestis KIM
ggagauacccauagcgcauuaua

SEQ ID NO: 4219768 - RNA, 17 nt, Yersinia pestis KIM
ggagauaguuaucuccc

SEQ ID NO: 4219769 - RNA, 17 nt, Yersinia pestis KIM
ggagauuucagacugcu

SEQ ID NO: 4219770 - RNA, 19 nt, Yersinia pestis KIM
ggagauuucagacugcuga

SEQ ID NO: 4219771 - RNA, 23 nt, Yersinia pestis KIM
ggagcaagacguccgucguuugc

SEQ ID NO: 4219772 - RNA, 15 nt, Yersinia pestis KIM
ggagcaagugcuuca

SEQ ID NO: 4219773 - RNA, 21 nt, Yersinia pestis KIM
ggaggagauuucagacugcug

SEQ ID NO: 4219774 - RNA, 15 nt, Yersinia pestis KIM
ggaggagguagcaac

SEQ ID NO: 4219775 - RNA, 19 nt, Yersinia pestis KIM
ggaggcacgugccgcuggg

SEQ ID NO: 4219776 - RNA, 15 nt, Yersinia pestis KIM
ggaggcguuuccccu

SEQ ID NO: 4219777 - RNA, 12 nt, Yersinia pestis KIM
ggaggggggauc

SEQ ID NO: 4219778 - RNA, 18 nt, Yersinia pestis KIM
ggagguugccgguuuauu

SEQ ID NO: 4219779 - RNA, 12 nt, Yersinia pestis KIM
ggaguaaagcgu

SEQ ID NO: 4219780 - RNA, 21 nt, Yersinia pestis KIM
ggaguaaagcguccgcgccaa

SEQ ID NO: 4219781 - RNA, 21 nt, Yersinia pestis KIM
ggagucagaugccgcuuuagu

SEQ ID NO: 4219782 - RNA, 13 nt, Yersinia pestis KIM
ggagucagggagu

SEQ ID NO: 4219783 - RNA, 15 nt, Yersinia pestis KIM
ggagucagggaguca

SEQ ID NO: 4219784 - RNA, 16 nt, Yersinia pestis KIM
ggagucgcuccucagc

SEQ ID NO: 4219785 - RNA, 20 nt, Yersinia pestis KIM
ggagugauguaauccauaca

SEQ ID NO: 4219786 - RNA, 13 nt, Yersinia pestis KIM
ggauaaaaaugca

SEQ ID NO: 4219787 - RNA, 22 nt, Yersinia pestis KIM
ggauacaaaugagagcgcagca

SEQ ID NO: 4219788 - RNA, 23 nt, Yersinia pestis KIM
ggauaccaaucccuacggcaauc

SEQ ID NO: 4219789 - RNA, 15 nt, Yersinia pestis KIM
ggauacuggugucuu

SEQ ID NO: 4219790 - RNA, 12 nt, Yersinia pestis KIM
ggauagccccug

SEQ ID NO: 4219791 - RNA, 16 nt, Yersinia pestis KIM
ggauauagagauaaaa

SEQ ID NO: 4219792 - RNA, 15 nt, Yersinia pestis KIM
ggauaucuucaauca

SEQ ID NO: 4219793 - RNA, 17 nt, Yersinia pestis KIM
ggauauucucaacuuca

SEQ ID NO: 4219794 - RNA, 14 nt, Yersinia pestis KIM
ggaucaaauguccc

SEQ ID NO: 4219795 - RNA, 11 nt, Yersinia pestis KIM
ggaucaacaug

SEQ ID NO: 4219796 - RNA, 13 nt, Yersinia pestis KIM
ggaucaacauggu

SEQ ID NO: 4219797 - RNA, 18 nt, Yersinia pestis KIM
ggaucaacgcccgcggcc

SEQ ID NO: 4219798 - RNA, 17 nt, Yersinia pestis KIM
ggaucaaguuagcaggc

SEQ ID NO: 4219799 - RNA, 20 nt, Yersinia pestis KIM
ggaucaccaccgcauuuuca

SEQ ID NO: 4219800 - RNA, 14 nt, Yersinia pestis KIM
ggaucaccucuuca

SEQ ID NO: 4219801 - RNA, 18 nt, Yersinia pestis KIM
ggaucacgcuguucaccg

SEQ ID NO: 4219802 - RNA, 17 nt, Yersinia pestis KIM
ggaucaggaucaccagc

SEQ ID NO: 4219803 - RNA, 19 nt, Yersinia pestis KIM
ggaucaugaaaaaugagca

SEQ ID NO: 4219804 - RNA, 14 nt, Yersinia pestis KIM
ggauccauaggauc

SEQ ID NO: 4219805 - RNA, 13 nt, Yersinia pestis KIM
ggauccaucugau

SEQ ID NO: 4219806 - RNA, 19 nt, Yersinia pestis KIM
ggaucgacgugaagugagc

SEQ ID NO: 4219807 - RNA, 22 nt, Yersinia pestis KIM
ggaucgagcuguuugcuguaaa

SEQ ID NO: 4219808 - RNA, 20 nt, Yersinia pestis KIM
ggaucgggcuaucaucaaag

SEQ ID NO: 4219809 - RNA, 14 nt, Yersinia pestis KIM
ggaucucacccaca

SEQ ID NO: 4219810 - RNA, 21 nt, Yersinia pestis KIM
ggaucucacccacacgacaug

SEQ ID NO: 4219811 - RNA, 17 nt, Yersinia pestis KIM
ggaucucaggugugagg

SEQ ID NO: 4219812 - RNA, 23 nt, Yersinia pestis KIM
ggaucugaucaaucucaucaauc

SEQ ID NO: 4219813 - RNA, 15 nt, Yersinia pestis KIM
ggaucugcaacuuca

SEQ ID NO: 4219814 - RNA, 23 nt, Yersinia pestis KIM
ggaucugcacaccacacuggaug

SEQ ID NO: 4219815 - RNA, 21 nt, Yersinia pestis KIM
ggaugacaguauuugcagugg

SEQ ID NO: 4219816 - RNA, 18 nt, Yersinia pestis KIM
ggaugaucaacagugagg

SEQ ID NO: 4219817 - RNA, 15 nt, Yersinia pestis KIM
ggaugaugaucaccg

SEQ ID NO: 4219818 - RNA, 20 nt, Yersinia pestis KIM
ggaugccggaaucagccaga

SEQ ID NO: 4219819 - RNA, 19 nt, Yersinia pestis KIM
ggaugccuuguuucuggca

SEQ ID NO: 4219820 - RNA, 14 nt, Yersinia pestis KIM
ggauggcccaagcc

SEQ ID NO: 4219821 - RNA, 19 nt, Yersinia pestis KIM
ggauggcccaagccauccu

SEQ ID NO: 4219822 - RNA, 16 nt, Yersinia pestis KIM
ggauggccgggcuguc

SEQ ID NO: 4219823 - RNA, 19 nt, Yersinia pestis KIM
ggauguagucccccuccgg

SEQ ID NO: 4219824 - RNA, 19 nt, Yersinia pestis KIM
ggauuacauaugauggcau

SEQ ID NO: 4219825 - RNA, 16 nt, Yersinia pestis KIM
ggauuagcuucugcua

SEQ ID NO: 4219826 - RNA, 15 nt, Yersinia pestis KIM
ggauuaugugcggca

SEQ ID NO: 4219827 - RNA, 15 nt, Yersinia pestis KIM
ggauucaaacaaggc

SEQ ID NO: 4219828 - RNA, 11 nt, Yersinia pestis KIM
ggauugcugcc

SEQ ID NO: 4219829 - RNA, 20 nt, Yersinia pestis KIM
ggauuggagucaugaggcag

SEQ ID NO: 4219830 - RNA, 14 nt, Yersinia pestis KIM
ggauuuaaaauccc

SEQ ID NO: 4219831 - RNA, 23 nt, Yersinia pestis KIM
ggauuuauuagagauaaauagcc

SEQ ID NO: 4219832 - RNA, 14 nt, Yersinia pestis KIM
ggauuuucaaauca

SEQ ID NO: 4219833 - RNA, 20 nt, Yersinia pestis KIM
ggccagcuuuuuaucauuua

SEQ ID NO: 4219834 - RNA, 20 nt, Yersinia pestis KIM
ggccaggcaaugagugcagc

SEQ ID NO: 4219835 - RNA, 17 nt, Yersinia pestis KIM
ggccagucaaaagaaac

SEQ ID NO: 4219836 - RNA, 15 nt, Yersinia pestis KIM
ggccagugcgccggc

SEQ ID NO: 4219837 - RNA, 14 nt, Yersinia pestis KIM
ggccaguguuuucu

SEQ ID NO: 4219838 - RNA, 17 nt, Yersinia pestis KIM
ggccaguugccacucau

SEQ ID NO: 4219839 - RNA, 21 nt, Yersinia pestis KIM
ggccaguuuccacgaaggcac

SEQ ID NO: 4219840 - RNA, 18 nt, Yersinia pestis KIM
ggccaugaaucaaauuau

SEQ ID NO: 4219841 - RNA, 16 nt, Yersinia pestis KIM
ggccauguguguucuu

SEQ ID NO: 4219842 - RNA, 15 nt, Yersinia pestis KIM
ggccauguuggucaa

SEQ ID NO: 4219843 - RNA, 11 nt, Yersinia pestis KIM
ggccauuaccc

SEQ ID NO: 4219844 - RNA, 23 nt, Yersinia pestis KIM
ggccauugaacauaacuuugcca

SEQ ID NO: 4219845 - RNA, 17 nt, Yersinia pestis KIM
ggccauuguuaugguau

SEQ ID NO: 4219846 - RNA, 16 nt, Yersinia pestis KIM
ggccauuugcucuggc

SEQ ID NO: 4219847 - RNA, 18 nt, Yersinia pestis KIM
ggcccaaaugagcagcaa

SEQ ID NO: 4219848 - RNA, 14 nt, Yersinia pestis KIM
ggcccaagccaucc

SEQ ID NO: 4219849 - RNA, 14 nt, Yersinia pestis KIM
ggcccaauaaaagg

SEQ ID NO: 4219850 - RNA, 17 nt, Yersinia pestis KIM
ggcccaauaaaagguag

SEQ ID NO: 4219851 - RNA, 19 nt, Yersinia pestis KIM
ggccccuaaugcgcucacc

SEQ ID NO: 4219852 - RNA, 20 nt, Yersinia pestis KIM
ggccccuaaugcgcucacca

SEQ ID NO: 4219853 - RNA, 18 nt, Yersinia pestis KIM
ggccccuuaaauaugaug

SEQ ID NO: 4219854 - RNA, 19 nt, Yersinia pestis KIM
ggcccgaugguuucuccac

SEQ ID NO: 4219855 - RNA, 13 nt, Yersinia pestis KIM
ggcccgcuaguga

SEQ ID NO: 4219856 - RNA, 14 nt, Yersinia pestis KIM
ggcccgcuagugau

SEQ ID NO: 4219857 - RNA, 20 nt, Yersinia pestis KIM
ggcccgcuagugauagcggg

SEQ ID NO: 4219858 - RNA, 14 nt, Yersinia pestis KIM
ggcccgcuucccua

SEQ ID NO: 4219859 - RNA, 11 nt, Yersinia pestis KIM
ggcccggcaug

SEQ ID NO: 4219860 - RNA, 13 nt, Yersinia pestis KIM
ggcccggccaggc

SEQ ID NO: 4219861 - RNA, 22 nt, Yersinia pestis KIM
ggcccuccucucucuggggagg

SEQ ID NO: 4219862 - RNA, 23 nt, Yersinia pestis KIM
ggcccugagguugcucagcgggc

SEQ ID NO: 4219863 - RNA, 15 nt, Yersinia pestis KIM
ggccgacucugcaug

SEQ ID NO: 4219864 - RNA, 19 nt, Yersinia pestis KIM
ggccgacucugcaugauag

SEQ ID NO: 4219865 - RNA, 16 nt, Yersinia pestis KIM
ggccgaggaauaugcc

SEQ ID NO: 4219866 - RNA, 21 nt, Yersinia pestis KIM
ggccgauacgcgccgcagcag

SEQ ID NO: 4219867 - RNA, 18 nt, Yersinia pestis KIM
ggccgauaucauggccau

SEQ ID NO: 4219868 - RNA, 18 nt, Yersinia pestis KIM
ggccgauggaaccacauc

SEQ ID NO: 4219869 - RNA, 22 nt, Yersinia pestis KIM
ggccgcccagauaaagaugaag

SEQ ID NO: 4219870 - RNA, 19 nt, Yersinia pestis KIM
ggccgccgcggugaagaac

SEQ ID NO: 4219871 - RNA, 13 nt, Yersinia pestis KIM
ggccgcgcacagc

SEQ ID NO: 4219872 - RNA, 20 nt, Yersinia pestis KIM
ggccgcuugccaaucacggu

SEQ ID NO: 4219873 - RNA, 14 nt, Yersinia pestis KIM
ggccgguuaauuga

SEQ ID NO: 4219874 - RNA, 14 nt, Yersinia pestis KIM
ggccgugaccaccg

SEQ ID NO: 4219875 - RNA, 23 nt, Yersinia pestis KIM
ggccgugcgggaugacucggccu

SEQ ID NO: 4219876 - RNA, 22 nt, Yersinia pestis KIM
ggccuaagccggucuuuuuaca

SEQ ID NO: 4219877 - RNA, 21 nt, Yersinia pestis KIM
ggccuacggaggucaaaugag

SEQ ID NO: 4219878 - RNA, 20 nt, Yersinia pestis KIM
ggccuagcccaguaccgcug

SEQ ID NO: 4219879 - RNA, 22 nt, Yersinia pestis KIM
ggccuaucaucaccauucaaga

SEQ ID NO: 4219880 - RNA, 18 nt, Yersinia pestis KIM
ggccuccgaagcauuaca

SEQ ID NO: 4219881 - RNA, 12 nt, Yersinia pestis KIM
ggccugagaacc

SEQ ID NO: 4219882 - RNA, 17 nt, Yersinia pestis KIM
ggccugaugcaccucag

SEQ ID NO: 4219883 - RNA, 18 nt, Yersinia pestis KIM
ggccugcaaacggcucau

SEQ ID NO: 4219884 - RNA, 20 nt, Yersinia pestis KIM
ggccuggguagacauggcaa

SEQ ID NO: 4219885 - RNA, 21 nt, Yersinia pestis KIM
ggccuguaccaccaccaacag

SEQ ID NO: 4219886 - RNA, 13 nt, Yersinia pestis KIM
ggccuucuaacuc

SEQ ID NO: 4219887 - RNA, 18 nt, Yersinia pestis KIM
ggccuuucggcaaauuaa

SEQ ID NO: 4219888 - RNA, 13 nt, Yersinia pestis KIM
ggcgaaaggcgca

SEQ ID NO: 4219889 - RNA, 15 nt, Yersinia pestis KIM
ggcgaaugcccugcu

SEQ ID NO: 4219890 - RNA, 21 nt, Yersinia pestis KIM
ggcgacaaucaauggccagcg

SEQ ID NO: 4219891 - RNA, 17 nt, Yersinia pestis KIM
ggcgacugugcuuugcc

SEQ ID NO: 4219892 - RNA, 24 nt, Yersinia pestis KIM
ggcgaguuucccuuuuccaucaga

SEQ ID NO: 4219893 - RNA, 21 nt, Yersinia pestis KIM
ggcgauacaacguaggccgag

SEQ ID NO: 4219894 - RNA, 12 nt, Yersinia pestis KIM
ggcgauauauuu

SEQ ID NO: 4219895 - RNA, 18 nt, Yersinia pestis KIM
ggcgaucaggaagcccgu

SEQ ID NO: 4219896 - RNA, 12 nt, Yersinia pestis KIM
ggcgauccgccc

SEQ ID NO: 4219897 - RNA, 14 nt, Yersinia pestis KIM
ggcgaucucuucgg

SEQ ID NO: 4219898 - RNA, 22 nt, Yersinia pestis KIM
ggcgaugaccgauuauaugaau

SEQ ID NO: 4219899 - RNA, 16 nt, Yersinia pestis KIM
ggcgauuuaauguauu

SEQ ID NO: 4219900 - RNA, 17 nt, Yersinia pestis KIM
ggcgauuucagcugcuu

SEQ ID NO: 4219901 - RNA, 23 nt, Yersinia pestis KIM
ggcgcaagaguuagggcuggaug

SEQ ID NO: 4219902 - RNA, 14 nt, Yersinia pestis KIM
ggcgcaauggaaga

SEQ ID NO: 4219903 - RNA, 21 nt, Yersinia pestis KIM
ggcgcacauuacaagugccaa

SEQ ID NO: 4219904 - RNA, 17 nt, Yersinia pestis KIM
ggcgcacugauucucuu

SEQ ID NO: 4219905 - RNA, 20 nt, Yersinia pestis KIM
ggcgcaguuagugccuaucu

SEQ ID NO: 4219906 - RNA, 19 nt, Yersinia pestis KIM
ggcgcaucgcgaucugaca

SEQ ID NO: 4219907 - RNA, 20 nt, Yersinia pestis KIM
ggcgcugaucaucaucaaug

SEQ ID NO: 4219908 - RNA, 23 nt, Yersinia pestis KIM
ggcgcuguugcauguaacgguca

SEQ ID NO: 4219909 - RNA, 15 nt, Yersinia pestis KIM
ggcggaagacuucca

SEQ ID NO: 4219910 - RNA, 19 nt, Yersinia pestis KIM
ggcggauauaaaagugagc

SEQ ID NO: 4219911 - RNA, 21 nt, Yersinia pestis KIM
ggcggcauaauccucaaccug

SEQ ID NO: 4219912 - RNA, 12 nt, Yersinia pestis KIM
ggcggccagcaa

SEQ ID NO: 4219913 - RNA, 13 nt, Yersinia pestis KIM
ggcggccauguug

SEQ ID NO: 4219914 - RNA, 14 nt, Yersinia pestis KIM
ggcggcgagcacug

SEQ ID NO: 4219915 - RNA, 20 nt, Yersinia pestis KIM
ggcgguaguauuuguaguga

SEQ ID NO: 4219916 - RNA, 17 nt, Yersinia pestis KIM
ggcgguucgagcggcau

SEQ ID NO: 4219917 - RNA, 17 nt, Yersinia pestis KIM
ggcguaaacaaucgucu

SEQ ID NO: 4219918 - RNA, 22 nt, Yersinia pestis KIM
ggcguaccauaguuuuucuccu

SEQ ID NO: 4219919 - RNA, 14 nt, Yersinia pestis KIM
ggcguauaaacaga

SEQ ID NO: 4219920 - RNA, 19 nt, Yersinia pestis KIM
ggcguauaucguuggugcg

SEQ ID NO: 4219921 - RNA, 13 nt, Yersinia pestis KIM
ggcgucagccgcg

SEQ ID NO: 4219922 - RNA, 23 nt, Yersinia pestis KIM
ggcgugaguuccagccccaaaca

SEQ ID NO: 4219923 - RNA, 16 nt, Yersinia pestis KIM
ggcguggcacaccgcu

SEQ ID NO: 4219924 - RNA, 23 nt, Yersinia pestis KIM
ggcguuaauauaacaauguuuau

SEQ ID NO: 4219925 - RNA, 20 nt, Yersinia pestis KIM
ggcguuacaguaaggcagca

SEQ ID NO: 4219926 - RNA, 14 nt, Yersinia pestis KIM
ggcguugaugacua

SEQ ID NO: 4219927 - RNA, 16 nt, Yersinia pestis KIM
ggcguuuucugcgcca

SEQ ID NO: 4219928 - RNA, 19 nt, Yersinia pestis KIM
ggcuaaaacucaaauagau

SEQ ID NO: 4219929 - RNA, 22 nt, Yersinia pestis KIM
ggcuaaaagggaguucaucaaa

SEQ ID NO: 4219930 - RNA, 18 nt, Yersinia pestis KIM
ggcuaacgguaaauaagu

SEQ ID NO: 4219931 - RNA, 14 nt, Yersinia pestis KIM
ggcuaagcggcgua

SEQ ID NO: 4219932 - RNA, 17 nt, Yersinia pestis KIM
ggcuaauaccaggcugg

SEQ ID NO: 4219933 - RNA, 19 nt, Yersinia pestis KIM
ggcuaauuaauuuaaacaa

SEQ ID NO: 4219934 - RNA, 12 nt, Yersinia pestis KIM
ggcuaccaauua

SEQ ID NO: 4219935 - RNA, 18 nt, Yersinia pestis KIM
ggcuacugcgcuuaccgu

SEQ ID NO: 4219936 - RNA, 17 nt, Yersinia pestis KIM
ggcuagccagcguucaa

SEQ ID NO: 4219937 - RNA, 18 nt, Yersinia pestis KIM
ggcuagcccccagggagg

SEQ ID NO: 4219938 - RNA, 22 nt, Yersinia pestis KIM
ggcuagcguuuacuuuaaauuu

SEQ ID NO: 4219939 - RNA, 21 nt, Yersinia pestis KIM
ggcuauagaucggccaguaag

SEQ ID NO: 4219940 - RNA, 20 nt, Yersinia pestis KIM
ggcuaucuuaugacgcugca

SEQ ID NO: 4219941 - RNA, 16 nt, Yersinia pestis KIM
ggcuauuuuuaugcag

SEQ ID NO: 4219942 - RNA, 15 nt, Yersinia pestis KIM
ggcucaaagaaaaau

SEQ ID NO: 4219943 - RNA, 19 nt, Yersinia pestis KIM
ggcucaauccaaaugacac

SEQ ID NO: 4219944 - RNA, 19 nt, Yersinia pestis KIM
ggcucagcacaaacauggc

SEQ ID NO: 4219945 - RNA, 15 nt, Yersinia pestis KIM
ggcucaucaaaggag

SEQ ID NO: 4219946 - RNA, 14 nt, Yersinia pestis KIM
ggcucaugcagcau

SEQ ID NO: 4219947 - RNA, 16 nt, Yersinia pestis KIM
gggcuuuuggggcgcu

SEQ ID NO: 4219948 - RNA, 12 nt, Yersinia pestis KIM
ggggaccagcac

SEQ ID NO: 4219949 - RNA, 13 nt, Yersinia pestis KIM
ggggauggccgug

SEQ ID NO: 4219950 - RNA, 15 nt, Yersinia pestis KIM
ggggauugcugccaa

SEQ ID NO: 4219951 - RNA, 17 nt, Yersinia pestis KIM
ggggccaacaggccccu

SEQ ID NO: 4219952 - RNA, 12 nt, Yersinia pestis KIM
gggggcgacgau

SEQ ID NO: 4219953 - RNA, 21 nt, Yersinia pestis KIM
gggggcgauggccaauaccca

SEQ ID NO: 4219954 - RNA, 17 nt, Yersinia pestis KIM
ggggguugucagcaguc

SEQ ID NO: 4219955 - RNA, 20 nt, Yersinia pestis KIM
ggggguugucagcagucuga

SEQ ID NO: 4219956 - RNA, 13 nt, Yersinia pestis KIM
ggguaaaaucccc

SEQ ID NO: 4219957 - RNA, 18 nt, Yersinia pestis KIM
ggguaaaccaaucaagca

SEQ ID NO: 4219958 - RNA, 14 nt, Yersinia pestis KIM
ggguaaagcgucag

SEQ ID NO: 4219959 - RNA, 14 nt, Yersinia pestis KIM
ggguaacgccauag

SEQ ID NO: 4219960 - RNA, 23 nt, Yersinia pestis KIM
ggguaacgccgcuaaaucaucaa

SEQ ID NO: 4219961 - RNA, 14 nt, Yersinia pestis KIM
ggguaagaacagag

SEQ ID NO: 4219962 - RNA, 17 nt, Yersinia pestis KIM
ggguaauccccaccaac

SEQ ID NO: 4219963 - RNA, 19 nt, Yersinia pestis KIM
ggguacagaucagcgugac

SEQ ID NO: 4219964 - RNA, 20 nt, Yersinia pestis KIM
ggguauauggauuaucgccu

SEQ ID NO: 4219965 - RNA, 21 nt, Yersinia pestis KIM
ggguauauugcccgguaacau

SEQ ID NO: 4219966 - RNA, 16 nt, Yersinia pestis KIM
ggguaucagcgaccaa

SEQ ID NO: 4219967 - RNA, 12 nt, Yersinia pestis KIM
ggguauccagug

SEQ ID NO: 4219968 - RNA, 11 nt, Yersinia pestis KIM
ggguaucugug

SEQ ID NO: 4219969 - RNA, 11 nt, Yersinia pestis KIM
ggguaucuguu

SEQ ID NO: 4219970 - RNA, 16 nt, Yersinia pestis KIM
ggguauuccacccgca

SEQ ID NO: 4219971 - RNA, 23 nt, Yersinia pestis KIM
ggguauuccauagccaggcagcc

SEQ ID NO: 4219972 - RNA, 22 nt, Yersinia pestis KIM
ggguauuugucgucccaggccu

SEQ ID NO: 4219973 - RNA, 15 nt, Yersinia pestis KIM
gggucagggcggcgg

SEQ ID NO: 4219974 - RNA, 14 nt, Yersinia pestis KIM
gggucgguaaccug

SEQ ID NO: 4219975 - RNA, 21 nt, Yersinia pestis KIM
gggugacgcuggcacuggaug

SEQ ID NO: 4219976 - RNA, 13 nt, Yersinia pestis KIM
gggugagugaaca

SEQ ID NO: 4219977 - RNA, 13 nt, Yersinia pestis KIM
gggugagugaacg

SEQ ID NO: 4219978 - RNA, 22 nt, Yersinia pestis KIM
gggugagugaacguagcuaaca

SEQ ID NO: 4219979 - RNA, 12 nt, Yersinia pestis KIM
gggugagugagc

SEQ ID NO: 4219980 - RNA, 17 nt, Yersinia pestis KIM
gggugagugagcgcagg

SEQ ID NO: 4219981 - RNA, 19 nt, Yersinia pestis KIM
gggugauggcugucugaug

SEQ ID NO: 4219982 - RNA, 12 nt, Yersinia pestis KIM
ggguuaaauagu

SEQ ID NO: 4219983 - RNA, 20 nt, Yersinia pestis KIM
ggguuauaggccuaaacccc

SEQ ID NO: 4219984 - RNA, 14 nt, Yersinia pestis KIM
ggguucaaggaaac

SEQ ID NO: 4219985 - RNA, 23 nt, Yersinia pestis KIM
ggguucaguaaagcuuucagcuu

SEQ ID NO: 4219986 - RNA, 11 nt, Yersinia pestis KIM
ggguucaucau

SEQ ID NO: 4219987 - RNA, 19 nt, Yersinia pestis KIM
ggguucuaaauccugcaaa

SEQ ID NO: 4219988 - RNA, 11 nt, Yersinia pestis KIM
gguaaaacugc

SEQ ID NO: 4219989 - RNA, 21 nt, Yersinia pestis KIM
gguaaaaucacguuuccaaaa

SEQ ID NO: 4219990 - RNA, 14 nt, Yersinia pestis KIM
gguaaaauccccau

SEQ ID NO: 4219991 - RNA, 14 nt, Yersinia pestis KIM
gguaaauccuucug

SEQ ID NO: 4219992 - RNA, 13 nt, Yersinia pestis KIM
gguaacauauaaa

SEQ ID NO: 4219993 - RNA, 17 nt, Yersinia pestis KIM
gguaaccaaucacauca

SEQ ID NO: 4219994 - RNA, 19 nt, Yersinia pestis KIM
gguaaccgauguauugccc

SEQ ID NO: 4219995 - RNA, 18 nt, Yersinia pestis KIM
gguaacgcagaaauauuc

SEQ ID NO: 4219996 - RNA, 16 nt, Yersinia pestis KIM
gguaacgcagauaaau

SEQ ID NO: 4219997 - RNA, 22 nt, Yersinia pestis KIM
gguaacgccgcuguagcgccaa

SEQ ID NO: 4219998 - RNA, 12 nt, Yersinia pestis KIM
gguaagaaagag

SEQ ID NO: 4219999 - RNA, 15 nt, Yersinia pestis KIM
gguaagaauaaauaa

SEQ ID NO: 4220000 - RNA, 16 nt, Yersinia pestis KIM
gguaagaauaggcagg

SEQ ID NO: 4220001 - RNA, 16 nt, Yersinia pestis KIM
gguaagccuuucucca

SEQ ID NO: 4220002 - RNA, 17 nt, Yersinia pestis KIM
gguaauaaacagacaaa

SEQ ID NO: 4220003 - RNA, 13 nt, Yersinia pestis KIM
gguaauaaaucau

SEQ ID NO: 4220004 - RNA, 16 nt, Yersinia pestis KIM
gguaauaagugaucag

SEQ ID NO: 4220005 - RNA, 15 nt, Yersinia pestis KIM
gguaauaccaaugcu

SEQ ID NO: 4220006 - RNA, 17 nt, Yersinia pestis KIM
gguaaucaauuuuugcg

SEQ ID NO: 4220007 - RNA, 15 nt, Yersinia pestis KIM
gguaaucagacugcu

SEQ ID NO: 4220008 - RNA, 13 nt, Yersinia pestis KIM
gguaaucaugggg

SEQ ID NO: 4220009 - RNA, 21 nt, Yersinia pestis KIM
gguaaucccgauauaaauaaa

SEQ ID NO: 4220010 - RNA, 16 nt, Yersinia pestis KIM
gguaaugaaugccccu

SEQ ID NO: 4220011 - RNA, 19 nt, Yersinia pestis KIM
gguaaugcgcgcagcaagc

SEQ ID NO: 4220012 - RNA, 15 nt, Yersinia pestis KIM
gguaauggccugcgg

SEQ ID NO: 4220013 - RNA, 21 nt, Yersinia pestis KIM
gguaaugucacguuaaguuca

SEQ ID NO: 4220014 - RNA, 14 nt, Yersinia pestis KIM
gguacaaaggcaau

SEQ ID NO: 4220015 - RNA, 20 nt, Yersinia pestis KIM
gguacaauucgcaagaagcg

SEQ ID NO: 4220016 - RNA, 21 nt, Yersinia pestis KIM
gguaccaaucaaaaauugccc

SEQ ID NO: 4220017 - RNA, 15 nt, Yersinia pestis KIM
gguaccgcaggucag

SEQ ID NO: 4220018 - RNA, 20 nt, Yersinia pestis KIM
gguaccgggccauagcccau

SEQ ID NO: 4220019 - RNA, 16 nt, Yersinia pestis KIM
gguaccguugagaaca

SEQ ID NO: 4220020 - RNA, 16 nt, Yersinia pestis KIM
gguaccugcaucauca

SEQ ID NO: 4220021 - RNA, 23 nt, Yersinia pestis KIM
gguacuccucgccgguaauaccg

SEQ ID NO: 4220022 - RNA, 15 nt, Yersinia pestis KIM
gguagaccaccaacu

SEQ ID NO: 4220023 - RNA, 16 nt, Yersinia pestis KIM
gguagaccaccaacuc

SEQ ID NO: 4220024 - RNA, 19 nt, Yersinia pestis KIM
gguagaucaaacauaaccu

SEQ ID NO: 4220025 - RNA, 16 nt, Yersinia pestis KIM
gguagguauaauuauu

SEQ ID NO: 4220026 - RNA, 15 nt, Yersinia pestis KIM
gguagugacucauca

SEQ ID NO: 4220027 - RNA, 17 nt, Yersinia pestis KIM
gguauagagugcaucca

SEQ ID NO: 4220028 - RNA, 21 nt, Yersinia pestis KIM
gguauagcuaucacgacuacc

SEQ ID NO: 4220029 - RNA, 11 nt, Yersinia pestis KIM
gguaucaguca

SEQ ID NO: 4220030 - RNA, 18 nt, Yersinia pestis KIM
gguaucuaggugcaguaa

SEQ ID NO: 4220031 - RNA, 15 nt, Yersinia pestis KIM
gguaucuggagccau

SEQ ID NO: 4220032 - RNA, 19 nt, Yersinia pestis KIM
gguauggcgcuuaacugca

SEQ ID NO: 4220033 - RNA, 18 nt, Yersinia pestis KIM
gguauucagccaaaucau

SEQ ID NO: 4220034 - RNA, 19 nt, Yersinia pestis KIM
gguauucagccgccagcca

SEQ ID NO: 4220035 - RNA, 22 nt, Yersinia pestis KIM
gguauuccauagccaggcagcc

SEQ ID NO: 4220036 - RNA, 16 nt, Yersinia pestis KIM
gguauugaccacuugc

SEQ ID NO: 4220037 - RNA, 15 nt, Yersinia pestis KIM
gguauuggagcugaa

SEQ ID NO: 4220038 - RNA, 16 nt, Yersinia pestis KIM
gguauuuaggcgcuga

SEQ ID NO: 4220039 - RNA, 20 nt, Yersinia pestis KIM
gguauuugaacuucaaaucg

SEQ ID NO: 4220040 - RNA, 19 nt, Yersinia pestis KIM
ggucaaccguuguguauca

SEQ ID NO: 4220041 - RNA, 14 nt, Yersinia pestis KIM
ggucaacugugcca

SEQ ID NO: 4220042 - RNA, 15 nt, Yersinia pestis KIM
ggucaauaaaauuaa

SEQ ID NO: 4220043 - RNA, 18 nt, Yersinia pestis KIM
ggucaauaccauauccac

SEQ ID NO: 4220044 - RNA, 17 nt, Yersinia pestis KIM
ggucagaaccuguuaca

SEQ ID NO: 4220045 - RNA, 21 nt, Yersinia pestis KIM
ggucagaaccuguuacaucag

SEQ ID NO: 4220046 - RNA, 22 nt, Yersinia pestis KIM
ggucagagauauaaacgacuuc

SEQ ID NO: 4220047 - RNA, 23 nt, Yersinia pestis KIM
ggucagcgguaucccacuggacg

SEQ ID NO: 4220048 - RNA, 23 nt, Yersinia pestis KIM
ggucaguugaauauuccauuugu

SEQ ID NO: 4220049 - RNA, 15 nt, Yersinia pestis KIM
ggucaguuggcuuau

SEQ ID NO: 4220050 - RNA, 21 nt, Yersinia pestis KIM
ggucaguuuagcgagaaaguc

SEQ ID NO: 4220051 - RNA, 23 nt, Yersinia pestis KIM
ggucauacacaugaaaaucaagu

SEQ ID NO: 4220052 - RNA, 16 nt, Yersinia pestis KIM
ggucauaccggcggca

SEQ ID NO: 4220053 - RNA, 22 nt, Yersinia pestis KIM
ggucauauacaccgcaccacga

SEQ ID NO: 4220054 - RNA, 14 nt, Yersinia pestis KIM
ggucaucaaggugc

SEQ ID NO: 4220055 - RNA, 10 nt, Yersinia pestis KIM
ggucaucaug

SEQ ID NO: 4220056 - RNA, 14 nt, Yersinia pestis KIM
ggucauuagccguu

SEQ ID NO: 4220057 - RNA, 19 nt, Yersinia pestis KIM
ggucauugcgugcaauaaa

SEQ ID NO: 4220058 - RNA, 20 nt, Yersinia pestis KIM
ggucauugcgugcaauaaag

SEQ ID NO: 4220059 - RNA, 17 nt, Yersinia pestis KIM
ggucauuguagauggcc

SEQ ID NO: 4220060 - RNA, 15 nt, Yersinia pestis KIM
ggucauuuuucccuu

SEQ ID NO: 4220061 - RNA, 19 nt, Yersinia pestis KIM
gguccccagagcgcaaaag

SEQ ID NO: 4220062 - RNA, 12 nt, Yersinia pestis KIM
guaaauccuucu

SEQ ID NO: 4220063 - RNA, 12 nt, Yersinia pestis KIM
guaaaucgucag

SEQ ID NO: 4220064 - RNA, 19 nt, Yersinia pestis KIM
guaaaugccccauuuuggc

SEQ ID NO: 4220065 - RNA, 19 nt, Yersinia pestis KIM
guaaauuagccacugguug

SEQ ID NO: 4220066 - RNA, 23 nt, Yersinia pestis KIM
guaaauuauuuuccagaugaaua

SEQ ID NO: 4220067 - RNA, 12 nt, Yersinia pestis KIM
guaaauuccuau

SEQ ID NO: 4220068 - RNA, 18 nt, Yersinia pestis KIM
guaaauugcgagucucau

SEQ ID NO: 4220069 - RNA, 13 nt, Yersinia pestis KIM
guaaauuuauuua

SEQ ID NO: 4220070 - RNA, 13 nt, Yersinia pestis KIM
guaacaacucacc

SEQ ID NO: 4220071 - RNA, 21 nt, Yersinia pestis KIM
guaacacuucagacugaaagu

SEQ ID NO: 4220072 - RNA, 22 nt, Yersinia pestis KIM
guaacacuucagacugaaagua

SEQ ID NO: 4220073 - RNA, 13 nt, Yersinia pestis KIM
guaacagcggcga

SEQ ID NO: 4220074 - RNA, 23 nt, Yersinia pestis KIM
guaacauauaaaccagccaguga

SEQ ID NO: 4220075 - RNA, 16 nt, Yersinia pestis KIM
guaacauauccugugc

SEQ ID NO: 4220076 - RNA, 18 nt, Yersinia pestis KIM
guaaccaauaacauuucg

SEQ ID NO: 4220077 - RNA, 22 nt, Yersinia pestis KIM
guaaccggcuaggcucagcaug

SEQ ID NO: 4220078 - RNA, 13 nt, Yersinia pestis KIM
guaacgaacgcuc

SEQ ID NO: 4220079 - RNA, 21 nt, Yersinia pestis KIM
guaacgaacgcucuuuaacaa

SEQ ID NO: 4220080 - RNA, 22 nt, Yersinia pestis KIM
guaacgaaucugcacuguaauu

SEQ ID NO: 4220081 - RNA, 22 nt, Yersinia pestis KIM
guaacgcagauaaaucaguggg

SEQ ID NO: 4220082 - RNA, 17 nt, Yersinia pestis KIM
guaacggaaggggaaua

SEQ ID NO: 4220083 - RNA, 16 nt, Yersinia pestis KIM
guaacggaauucagaa

SEQ ID NO: 4220084 - RNA, 20 nt, Yersinia pestis KIM
guaacgggucucaaugcagu

SEQ ID NO: 4220085 - RNA, 20 nt, Yersinia pestis KIM
guaacguccaacugacgcca

SEQ ID NO: 4220086 - RNA, 13 nt, Yersinia pestis KIM
guaacuaagagua

SEQ ID NO: 4220087 - RNA, 19 nt, Yersinia pestis KIM
guaacuaccugcuuuacca

SEQ ID NO: 4220088 - RNA, 22 nt, Yersinia pestis KIM
guaacucaggauccucgucgua

SEQ ID NO: 4220089 - RNA, 20 nt, Yersinia pestis KIM
guaacuccaucaggcuacgg

SEQ ID NO: 4220090 - RNA, 18 nt, Yersinia pestis KIM
guaacuguguuugauuaa

SEQ ID NO: 4220091 - RNA, 20 nt, Yersinia pestis KIM
guaagaaagagaugacccaa

SEQ ID NO: 4220092 - RNA, 16 nt, Yersinia pestis KIM
guaagaauaaauaaua

SEQ ID NO: 4220093 - RNA, 19 nt, Yersinia pestis KIM
guaagauccaccacaucau

SEQ ID NO: 4220094 - RNA, 15 nt, Yersinia pestis KIM
guaagauuucaagca

SEQ ID NO: 4220095 - RNA, 18 nt, Yersinia pestis KIM
guaagccgugccugcugg

SEQ ID NO: 4220096 - RNA, 19 nt, Yersinia pestis KIM
guaagcgguuuguuaaaaa

SEQ ID NO: 4220097 - RNA, 14 nt, Yersinia pestis KIM
guaagcugauaguu

SEQ ID NO: 4220098 - RNA, 23 nt, Yersinia pestis KIM
guaagcuuugugcaaaauacaaa

SEQ ID NO: 4220099 - RNA, 15 nt, Yersinia pestis KIM
guaaggccaaacccg

SEQ ID NO: 4220100 - RNA, 17 nt, Yersinia pestis KIM
guaaggccucggcgauu

SEQ ID NO: 4220101 - RNA, 15 nt, Yersinia pestis KIM
guaaggucaguucac

SEQ ID NO: 4220102 - RNA, 20 nt, Yersinia pestis KIM
guaaguaccaccgcagugcc

SEQ ID NO: 4220103 - RNA, 14 nt, Yersinia pestis KIM
guaagugauucggg

SEQ ID NO: 4220104 - RNA, 16 nt, Yersinia pestis KIM
guaaguucgucaguga

SEQ ID NO: 4220105 - RNA, 17 nt, Yersinia pestis KIM
guaaguuggcaucagcu

SEQ ID NO: 4220106 - RNA, 17 nt, Yersinia pestis KIM
guaauaaacagacaaaa

SEQ ID NO: 4220107 - RNA, 13 nt, Yersinia pestis KIM
guaauaaaggcug

SEQ ID NO: 4220108 - RNA, 12 nt, Yersinia pestis KIM
guaauaaaucau

SEQ ID NO: 4220109 - RNA, 18 nt, Yersinia pestis KIM
guaauaaaucaugucccu

SEQ ID NO: 4220110 - RNA, 20 nt, Yersinia pestis KIM
guaauaacucagccauugcu

SEQ ID NO: 4220111 - RNA, 15 nt, Yersinia pestis KIM
guaauaaggucacug

SEQ ID NO: 4220112 - RNA, 17 nt, Yersinia pestis KIM
guaauaaggucacuguu

SEQ ID NO: 4220113 - RNA, 23 nt, Yersinia pestis KIM
guaauaauaauucauaugacaaa

SEQ ID NO: 4220114 - RNA, 18 nt, Yersinia pestis KIM
guaauaccacaccuuauc

SEQ ID NO: 4220115 - RNA, 20 nt, Yersinia pestis KIM
guaauacccucgacaccaaa

SEQ ID NO: 4220116 - RNA, 22 nt, Yersinia pestis KIM
guaauacccucgacaccaaaac

SEQ ID NO: 4220117 - RNA, 13 nt, Yersinia pestis KIM
guaauaucaccau

SEQ ID NO: 4220118 - RNA, 14 nt, Yersinia pestis KIM
guaaucaaacauaa

SEQ ID NO: 4220119 - RNA, 20 nt, Yersinia pestis KIM
guaaucaacacauaaaauca

SEQ ID NO: 4220120 - RNA, 19 nt, Yersinia pestis KIM
guaauccauacagaacugg

SEQ ID NO: 4220121 - RNA, 19 nt, Yersinia pestis KIM
guaaucccgauauaaauaa

SEQ ID NO: 4220122 - RNA, 21 nt, Yersinia pestis KIM
guaaucccgauauaaauaaaa

SEQ ID NO: 4220123 - RNA, 16 nt, Yersinia pestis KIM
guaaucgccaaugguc

SEQ ID NO: 4220124 - RNA, 20 nt, Yersinia pestis KIM
guaaugacgcccgcagcggc

SEQ ID NO: 4220125 - RNA, 21 nt, Yersinia pestis KIM
guaaugacucuggcagugagg

SEQ ID NO: 4220126 - RNA, 21 nt, Yersinia pestis KIM
guaaugagccgcauugauccu

SEQ ID NO: 4220127 - RNA, 14 nt, Yersinia pestis KIM
guaaugaggcuacc

SEQ ID NO: 4220128 - RNA, 22 nt, Yersinia pestis KIM
guaaugauacugcccgucguua

SEQ ID NO: 4220129 - RNA, 17 nt, Yersinia pestis KIM
guaaugaugaugaguau

SEQ ID NO: 4220130 - RNA, 18 nt, Yersinia pestis KIM
guaaugcaccuguuaaaa

SEQ ID NO: 4220131 - RNA, 15 nt, Yersinia pestis KIM
guaaugccacacuca

SEQ ID NO: 4220132 - RNA, 18 nt, Yersinia pestis KIM
guaaugguuuauuuaacu

SEQ ID NO: 4220133 - RNA, 21 nt, Yersinia pestis KIM
guaaugguuuauuuaacuguu

SEQ ID NO: 4220134 - RNA, 16 nt, Yersinia pestis KIM
guaaugucacugccau

SEQ ID NO: 4220135 - RNA, 14 nt, Yersinia pestis KIM
guaaugucaugaau

SEQ ID NO: 4220136 - RNA, 20 nt, Yersinia pestis KIM
guaauuaauuaguaauaaga

SEQ ID NO: 4220137 - RNA, 15 nt, Yersinia pestis KIM
guaauuaauuauaag

SEQ ID NO: 4220138 - RNA, 19 nt, Yersinia pestis KIM
guaauuacaguugauauua

SEQ ID NO: 4220139 - RNA, 22 nt, Yersinia pestis KIM
guaauuacaguugauauuauua

SEQ ID NO: 4220140 - RNA, 21 nt, Yersinia pestis KIM
guaauucacccuuuaaaucua

SEQ ID NO: 4220141 - RNA, 19 nt, Yersinia pestis KIM
guaauucccaccacuugcu

SEQ ID NO: 4220142 - RNA, 17 nt, Yersinia pestis KIM
guaauugaucggcaucg

SEQ ID NO: 4220143 - RNA, 19 nt, Yersinia pestis KIM
guaauuggcgcauaaucgc

SEQ ID NO: 4220144 - RNA, 21 nt, Yersinia pestis KIM
guaauuuacgagaguguaauu

SEQ ID NO: 4220145 - RNA, 20 nt, Yersinia pestis KIM
guaauuucagauaaaaauaa

SEQ ID NO: 4220146 - RNA, 23 nt, Yersinia pestis KIM
guacaaaaauaaacgggcuucca

SEQ ID NO: 4220147 - RNA, 15 nt, Yersinia pestis KIM
guacaacaagauccc

SEQ ID NO: 4220148 - RNA, 20 nt, Yersinia pestis KIM
guacaacacaaaaaccggcg

SEQ ID NO: 4220149 - RNA, 23 nt, Yersinia pestis KIM
guacaacauccagauauggcauu

SEQ ID NO: 4220150 - RNA, 18 nt, Yersinia pestis KIM
guacaaucucugggugcu

SEQ ID NO: 4220151 - RNA, 23 nt, Yersinia pestis KIM
guacacuauuuuaccuauuuauu

SEQ ID NO: 4220152 - RNA, 21 nt, Yersinia pestis KIM
guacagaaaauacugucgauu

SEQ ID NO: 4220153 - RNA, 15 nt, Yersinia pestis KIM
guacauauaucacua

SEQ ID NO: 4220154 - RNA, 23 nt, Yersinia pestis KIM
guacaucacgcagugcaucuucc

SEQ ID NO: 4220155 - RNA, 15 nt, Yersinia pestis KIM
guacaugaauaaugu

SEQ ID NO: 4220156 - RNA, 14 nt, Yersinia pestis KIM
guacauuaaaugaa

SEQ ID NO: 4220157 - RNA, 16 nt, Yersinia pestis KIM
guacauuaaaugaaua

SEQ ID NO: 4220158 - RNA, 21 nt, Yersinia pestis KIM
guaccaaauaaaccagaugug

SEQ ID NO: 4220159 - RNA, 12 nt, Yersinia pestis KIM
guaccaaauaac

SEQ ID NO: 4220160 - RNA, 19 nt, Yersinia pestis KIM
guaccaaucuccaaugacc

SEQ ID NO: 4220161 - RNA, 21 nt, Yersinia pestis KIM
guaccaccaccaacagcauua

SEQ ID NO: 4220162 - RNA, 15 nt, Yersinia pestis KIM
guaccaucgacuggc

SEQ ID NO: 4220163 - RNA, 16 nt, Yersinia pestis KIM
guaccaucgacuggcc

SEQ ID NO: 4220164 - RNA, 14 nt, Yersinia pestis KIM
guacccauuauucu

SEQ ID NO: 4220165 - RNA, 17 nt, Yersinia pestis KIM
guacccgaucugagcca

SEQ ID NO: 4220166 - RNA, 13 nt, Yersinia pestis KIM
guacccucauugg

SEQ ID NO: 4220167 - RNA, 13 nt, Yersinia pestis KIM
guaccgcagguca

SEQ ID NO: 4220168 - RNA, 14 nt, Yersinia pestis KIM
guaccgcaggucag

SEQ ID NO: 4220169 - RNA, 16 nt, Yersinia pestis KIM
guaccggauacaccgu

SEQ ID NO: 4220170 - RNA, 22 nt, Yersinia pestis KIM
guaccugcuaaccgaagauaac

SEQ ID NO: 4220171 - RNA, 20 nt, Yersinia pestis KIM
guaccuugacgccgaugaau

SEQ ID NO: 4220172 - RNA, 15 nt, Yersinia pestis KIM
guacggugccagcag

SEQ ID NO: 4220173 - RNA, 17 nt, Yersinia pestis KIM
guacggugccagcagca

SEQ ID NO: 4220174 - RNA, 20 nt, Yersinia pestis KIM
guacguagcgauaacagaua

SEQ ID NO: 4220175 - RNA, 15 nt, Yersinia pestis KIM
guacgugaagauaac

SEQ ID NO: 4220176 - RNA, 20 nt, Yersinia pestis KIM
gucaauaaaacagagcgcga

SEQ ID NO: 4220177 - RNA, 23 nt, Yersinia pestis KIM
gucaauaaaaugggccugagugg

SEQ ID NO: 4220178 - RNA, 23 nt, Yersinia pestis KIM
gucaauaaccucacgggcuucca

SEQ ID NO: 4220179 - RNA, 17 nt, Yersinia pestis KIM
gucaauaaccucagccu

SEQ ID NO: 4220180 - RNA, 20 nt, Yersinia pestis KIM
gucaauaaccucagccucau

SEQ ID NO: 4220181 - RNA, 21 nt, Yersinia pestis KIM
gucaauaaccucagccucauu

SEQ ID NO: 4220182 - RNA, 13 nt, Yersinia pestis KIM
gucaauaauaaaa

SEQ ID NO: 4220183 - RNA, 15 nt, Yersinia pestis KIM
gucaauauaacguuu

SEQ ID NO: 4220184 - RNA, 16 nt, Yersinia pestis KIM
gucaauaucaucaucu

SEQ ID NO: 4220185 - RNA, 19 nt, Yersinia pestis KIM
gucaauccaaucauucugu

SEQ ID NO: 4220186 - RNA, 17 nt, Yersinia pestis KIM
gucaaucgaugagcugg

SEQ ID NO: 4220187 - RNA, 18 nt, Yersinia pestis KIM
gucaaucuuauugaaaac

SEQ ID NO: 4220188 - RNA, 16 nt, Yersinia pestis KIM
gucaauuaaaauugcu

SEQ ID NO: 4220189 - RNA, 19 nt, Yersinia pestis KIM
gucaauuaaaauugcuagc

SEQ ID NO: 4220190 - RNA, 18 nt, Yersinia pestis KIM
gucaauugagaauaacgc

SEQ ID NO: 4220191 - RNA, 14 nt, Yersinia pestis KIM
gucacaauagucuc

SEQ ID NO: 4220192 - RNA, 23 nt, Yersinia pestis KIM
gucacaccagacagaauauccag

SEQ ID NO: 4220193 - RNA, 17 nt, Yersinia pestis KIM
gucacacguuaaacccu

SEQ ID NO: 4220194 - RNA, 18 nt, Yersinia pestis KIM
gucacaguaaaucaggcc

SEQ ID NO: 4220195 - RNA, 22 nt, Yersinia pestis KIM
gucaccaaaaucccaaaauaug

SEQ ID NO: 4220196 - RNA, 23 nt, Yersinia pestis KIM
gucaccaaaaucccaaaauauga

SEQ ID NO: 4220197 - RNA, 15 nt, Yersinia pestis KIM
gucaccaaauauuac

SEQ ID NO: 4220198 - RNA, 19 nt, Yersinia pestis KIM
gucaccaacggccccucag

SEQ ID NO: 4220199 - RNA, 16 nt, Yersinia pestis KIM
gucaccacaaagguca

SEQ ID NO: 4220200 - RNA, 15 nt, Yersinia pestis KIM
gucaccacaugccau

SEQ ID NO: 4220201 - RNA, 21 nt, Yersinia pestis KIM
gucaccacggcuuucaauaaa

SEQ ID NO: 4220202 - RNA, 16 nt, Yersinia pestis KIM
gucaccagauugccgu

SEQ ID NO: 4220203 - RNA, 16 nt, Yersinia pestis KIM
gucaccaucaauauaa

SEQ ID NO: 4220204 - RNA, 22 nt, Yersinia pestis KIM
gucaccaucaauauaagagaaa

SEQ ID NO: 4220205 - RNA, 21 nt, Yersinia pestis KIM
gucacccaaccgaccaaaggc

SEQ ID NO: 4220206 - RNA, 22 nt, Yersinia pestis KIM
gucacccuuuugaauucaccaa

SEQ ID NO: 4220207 - RNA, 19 nt, Yersinia pestis KIM
gucaccgaacucgauaaua

SEQ ID NO: 4220208 - RNA, 17 nt, Yersinia pestis KIM
gucaccgccaaaugaaa

SEQ ID NO: 4220209 - RNA, 16 nt, Yersinia pestis KIM
gucaccugaaccugac

SEQ ID NO: 4220210 - RNA, 22 nt, Yersinia pestis KIM
gucacgcggcggcgucaaauua

SEQ ID NO: 4220211 - RNA, 17 nt, Yersinia pestis KIM
gucacggaaagcagguc

SEQ ID NO: 4220212 - RNA, 13 nt, Yersinia pestis KIM
gucacgucuucac

SEQ ID NO: 4220213 - RNA, 16 nt, Yersinia pestis KIM
gucacuaaaacugaag

SEQ ID NO: 4220214 - RNA, 22 nt, Yersinia pestis KIM
gucacuaaaacugaagcaucaa

SEQ ID NO: 4220215 - RNA, 20 nt, Yersinia pestis KIM
gucacuaaauccaaaugccc

SEQ ID NO: 4220216 - RNA, 21 nt, Yersinia pestis KIM
gucacucaagccaguaacuac

SEQ ID NO: 4220217 - RNA, 15 nt, Yersinia pestis KIM
gucacucagaaaaca

SEQ ID NO: 4220218 - RNA, 17 nt, Yersinia pestis KIM
gucacucagaaaacagc

SEQ ID NO: 4220219 - RNA, 19 nt, Yersinia pestis KIM
gucacugaugcuuggcccg

SEQ ID NO: 4220220 - RNA, 16 nt, Yersinia pestis KIM
gucacugccaucucau

SEQ ID NO: 4220221 - RNA, 18 nt, Yersinia pestis KIM
gucacugccugcacaaau

SEQ ID NO: 4220222 - RNA, 18 nt, Yersinia pestis KIM
gucacuggcaccauuugc

SEQ ID NO: 4220223 - RNA, 16 nt, Yersinia pestis KIM
gucacuguucuugaug

SEQ ID NO: 4220224 - RNA, 17 nt, Yersinia pestis KIM
gucacuguucuugaugg

SEQ ID NO: 4220225 - RNA, 17 nt, Yersinia pestis KIM
gucacuuaaauaacuca

SEQ ID NO: 4220226 - RNA, 20 nt, Yersinia pestis KIM
gucacuuaaauaacucagug

SEQ ID NO: 4220227 - RNA, 16 nt, Yersinia pestis KIM
gucagaaacaucuuca

SEQ ID NO: 4220228 - RNA, 13 nt, Yersinia pestis KIM
gucagaaccugca

SEQ ID NO: 4220229 - RNA, 22 nt, Yersinia pestis KIM
gucagacacgguauucaggaug

SEQ ID NO: 4220230 - RNA, 21 nt, Yersinia pestis KIM
gucagaugcugacgggcgcgg

SEQ ID NO: 4220231 - RNA, 20 nt, Yersinia pestis KIM
gucagauuagucuuagacgu

SEQ ID NO: 4220232 - RNA, 20 nt, Yersinia pestis KIM
gucagauuaguuuuagacgu

SEQ ID NO: 4220233 - RNA, 19 nt, Yersinia pestis KIM
gucagauuaguuuuagaug

SEQ ID NO: 4220234 - RNA, 18 nt, Yersinia pestis KIM
gucagcagacgaaccgcu

SEQ ID NO: 4220235 - RNA, 19 nt, Yersinia pestis KIM
gucagcagucugacaccgg

SEQ ID NO: 4220236 - RNA, 16 nt, Yersinia pestis KIM
gucagcagucugagcc

SEQ ID NO: 4220237 - RNA, 12 nt, Yersinia pestis KIM
gucagcgguauc

SEQ ID NO: 4220238 - RNA, 19 nt, Yersinia pestis KIM
gucagcgguaucccacugg

SEQ ID NO: 4220239 - RNA, 16 nt, Yersinia pestis KIM
gucaggaacccauuug

SEQ ID NO: 4220240 - RNA, 12 nt, Yersinia pestis KIM
gucaggaagaga

SEQ ID NO: 4220241 - RNA, 18 nt, Yersinia pestis KIM
gucagggagucagggagu

SEQ ID NO: 4220242 - RNA, 14 nt, Yersinia pestis KIM
gucagggcaauaac

SEQ ID NO: 4220243 - RNA, 14 nt, Yersinia pestis KIM
gucagggugaaagc

SEQ ID NO: 4220244 - RNA, 18 nt, Yersinia pestis KIM
gucagguuaauaccugca

SEQ ID NO: 4220245 - RNA, 14 nt, Yersinia pestis KIM
gucaguaaugaauu

SEQ ID NO: 4220246 - RNA, 16 nt, Yersinia pestis KIM
gucaguaauucacccu

SEQ ID NO: 4220247 - RNA, 13 nt, Yersinia pestis KIM
gucaguaucaccc

SEQ ID NO: 4220248 - RNA, 22 nt, Yersinia pestis KIM
gucaguaucagcgauuuuaaaa

SEQ ID NO: 4220249 - RNA, 15 nt, Yersinia pestis KIM
gucagucagggugaa

SEQ ID NO: 4220250 - RNA, 14 nt, Yersinia pestis KIM
gucaguccaaaaua

SEQ ID NO: 4220251 - RNA, 14 nt, Yersinia pestis KIM
gucagucuugcugc

SEQ ID NO: 4220252 - RNA, 18 nt, Yersinia pestis KIM
gucagugcggccaccuau

SEQ ID NO: 4220253 - RNA, 12 nt, Yersinia pestis KIM
gucagugguggu

SEQ ID NO: 4220254 - RNA, 19 nt, Yersinia pestis KIM
gucagugguuuuaucaaua

SEQ ID NO: 4220255 - RNA, 23 nt, Yersinia pestis KIM
gucaguguuucggcauugagcac

SEQ ID NO: 4220256 - RNA, 13 nt, Yersinia pestis KIM
gucaguuauaaaa

SEQ ID NO: 4220257 - RNA, 23 nt, Yersinia pestis KIM
gucaguugaauauuccauuuguc

SEQ ID NO: 4220258 - RNA, 13 nt, Yersinia pestis KIM
gucaguuucagua

SEQ ID NO: 4220259 - RNA, 19 nt, Yersinia pestis KIM
gucauaaauaaagauaccc

SEQ ID NO: 4220260 - RNA, 23 nt, Yersinia pestis KIM
gucauaagguuaaugagcguuau

SEQ ID NO: 4220261 - RNA, 14 nt, Yersinia pestis KIM
gucauaaucaggga

SEQ ID NO: 4220262 - RNA, 20 nt, Yersinia pestis KIM
gucauaccggcggcacacug

SEQ ID NO: 4220263 - RNA, 14 nt, Yersinia pestis KIM
gucauauauuuuuc

SEQ ID NO: 4220264 - RNA, 13 nt, Yersinia pestis KIM
gucaucaaccucg

SEQ ID NO: 4220265 - RNA, 13 nt, Yersinia pestis KIM
gucaucccagcac

SEQ ID NO: 4220266 - RNA, 18 nt, Yersinia pestis KIM
gucaucgggguuugucag

SEQ ID NO: 4220267 - RNA, 19 nt, Yersinia pestis KIM
gucaucgucggcccggcca

SEQ ID NO: 4220268 - RNA, 23 nt, Yersinia pestis KIM
gucaucucuaaaaaaugauuuua

SEQ ID NO: 4220269 - RNA, 13 nt, Yersinia pestis KIM
gucaugaaaaucu

SEQ ID NO: 4220270 - RNA, 17 nt, Yersinia pestis KIM
gucaugaaguugauaaa

SEQ ID NO: 4220271 - RNA, 19 nt, Yersinia pestis KIM
gucaugauagacagcaaac

SEQ ID NO: 4220272 - RNA, 18 nt, Yersinia pestis KIM
gucaugaugaauacgaua

SEQ ID NO: 4220273 - RNA, 18 nt, Yersinia pestis KIM
gucaugcaauuacugcau

SEQ ID NO: 4220274 - RNA, 22 nt, Yersinia pestis KIM
gucaugucgcuguagcgccagg

SEQ ID NO: 4220275 - RNA, 18 nt, Yersinia pestis KIM
gucauguugaccaaacag

SEQ ID NO: 4220276 - RNA, 20 nt, Yersinia pestis KIM
gucauguugaccaaacagaa

SEQ ID NO: 4220277 - RNA, 12 nt, Yersinia pestis KIM
gucauuaacaca

SEQ ID NO: 4220278 - RNA, 13 nt, Yersinia pestis KIM
gucauuaacacau

SEQ ID NO: 4220279 - RNA, 20 nt, Yersinia pestis KIM
gucauuaacuguuaaaacag

SEQ ID NO: 4220280 - RNA, 20 nt, Yersinia pestis KIM
gucauuaccgcacacuacag

SEQ ID NO: 4220281 - RNA, 17 nt, Yersinia pestis KIM
gucauuggcguuacagc

SEQ ID NO: 4220282 - RNA, 17 nt, Yersinia pestis KIM
gucauugguguuacagc

SEQ ID NO: 4220283 - RNA, 19 nt, Yersinia pestis KIM
gucauugguguuacagcaa

SEQ ID NO: 4220284 - RNA, 17 nt, Yersinia pestis KIM
gucauuguagauggcca

SEQ ID NO: 4220285 - RNA, 14 nt, Yersinia pestis KIM
gucauuuacugaug

SEQ ID NO: 4220286 - RNA, 17 nt, Yersinia pestis KIM
guccaacucccaaauau

SEQ ID NO: 4220287 - RNA, 20 nt, Yersinia pestis KIM
guccaagaagauaacuuuuu

SEQ ID NO: 4220288 - RNA, 14 nt, Yersinia pestis KIM
guccaagaagccaa

SEQ ID NO: 4220289 - RNA, 22 nt, Yersinia pestis KIM
guccagaacaauaccgccaaua

SEQ ID NO: 4220290 - RNA, 19 nt, Yersinia pestis KIM
gugagcugaacugagguga

SEQ ID NO: 4220291 - RNA, 15 nt, Yersinia pestis KIM
gugaggauaggcaga

SEQ ID NO: 4220292 - RNA, 18 nt, Yersinia pestis KIM
gugagguuuuugauggug

SEQ ID NO: 4220293 - RNA, 18 nt, Yersinia pestis KIM
gugagucagguggcuauu

SEQ ID NO: 4220294 - RNA, 11 nt, Yersinia pestis KIM
gugagugacau

SEQ ID NO: 4220295 - RNA, 13 nt, Yersinia pestis KIM
gugagugagcgca

SEQ ID NO: 4220296 - RNA, 13 nt, Yersinia pestis KIM
gugagugagcgcg

SEQ ID NO: 4220297 - RNA, 20 nt, Yersinia pestis KIM
gugaguuaacgaguguacag

SEQ ID NO: 4220298 - RNA, 16 nt, Yersinia pestis KIM
gugaguuccagcccca

SEQ ID NO: 4220299 - RNA, 20 nt, Yersinia pestis KIM
gugaguuuuuggccuccgaa

SEQ ID NO: 4220300 - RNA, 19 nt, Yersinia pestis KIM
gugauacaucucggcuuuc

SEQ ID NO: 4220301 - RNA, 13 nt, Yersinia pestis KIM
gugauagcgggcc

SEQ ID NO: 4220302 - RNA, 14 nt, Yersinia pestis KIM
gugauauaaaucca

SEQ ID NO: 4220303 - RNA, 21 nt, Yersinia pestis KIM
gugauauaacgaauauucaag

SEQ ID NO: 4220304 - RNA, 14 nt, Yersinia pestis KIM
gugaucaccugagc

SEQ ID NO: 4220305 - RNA, 12 nt, Yersinia pestis KIM
gugaucaucgca

SEQ ID NO: 4220306 - RNA, 22 nt, Yersinia pestis KIM
gugaucgcucaggcggucaccg

SEQ ID NO: 4220307 - RNA, 15 nt, Yersinia pestis KIM
gugaugaaauuaaaa

SEQ ID NO: 4220308 - RNA, 16 nt, Yersinia pestis KIM
gugaugaaauuaaaau

SEQ ID NO: 4220309 - RNA, 17 nt, Yersinia pestis KIM
gugaugaaugacuggcu

SEQ ID NO: 4220310 - RNA, 17 nt, Yersinia pestis KIM
gugaugacaaugcguua

SEQ ID NO: 4220311 - RNA, 14 nt, Yersinia pestis KIM
gugaugcaguaaau

SEQ ID NO: 4220312 - RNA, 20 nt, Yersinia pestis KIM
gugauguggcuugcaaucag

SEQ ID NO: 4220313 - RNA, 20 nt, Yersinia pestis KIM
gugauguguaccaaauaaac

SEQ ID NO: 4220314 - RNA, 15 nt, Yersinia pestis KIM
gugauugaagcgugg

SEQ ID NO: 4220315 - RNA, 16 nt, Yersinia pestis KIM
gugauuuuaaccacuc

SEQ ID NO: 4220316 - RNA, 17 nt, Yersinia pestis KIM
gugcaaaaugcucuuca

SEQ ID NO: 4220317 - RNA, 17 nt, Yersinia pestis KIM
gugcaacauuaaaaaua

SEQ ID NO: 4220318 - RNA, 13 nt, Yersinia pestis KIM
gugcaaugcagau

SEQ ID NO: 4220319 - RNA, 13 nt, Yersinia pestis KIM
gugcaccacacag

SEQ ID NO: 4220320 - RNA, 22 nt, Yersinia pestis KIM
gugcaccacacagcguagacaa

SEQ ID NO: 4220321 - RNA, 19 nt, Yersinia pestis KIM
gugcagcgcgcagccaacg

SEQ ID NO: 4220322 - RNA, 18 nt, Yersinia pestis KIM
gugcaggcuaccagaaau

SEQ ID NO: 4220323 - RNA, 13 nt, Yersinia pestis KIM
gugcauccccacu

SEQ ID NO: 4220324 - RNA, 15 nt, Yersinia pestis KIM
gugcauguaacugua

SEQ ID NO: 4220325 - RNA, 19 nt, Yersinia pestis KIM
gugcauguggaagcgggcg

SEQ ID NO: 4220326 - RNA, 16 nt, Yersinia pestis KIM
gugccaaauagugauu

SEQ ID NO: 4220327 - RNA, 23 nt, Yersinia pestis KIM
gugccaaauggaauaaaaaguca

SEQ ID NO: 4220328 - RNA, 19 nt, Yersinia pestis KIM
gugccaacucagcggccug

SEQ ID NO: 4220329 - RNA, 15 nt, Yersinia pestis KIM
gugccaauccccacc

SEQ ID NO: 4220330 - RNA, 15 nt, Yersinia pestis KIM
gugccaaugccucuu

SEQ ID NO: 4220331 - RNA, 17 nt, Yersinia pestis KIM
gugccaaugccucuuca

SEQ ID NO: 4220332 - RNA, 15 nt, Yersinia pestis KIM
gugccagauccucuu

SEQ ID NO: 4220333 - RNA, 12 nt, Yersinia pestis KIM
gugccagcagca

SEQ ID NO: 4220334 - RNA, 13 nt, Yersinia pestis KIM
gugccagcagcaa

SEQ ID NO: 4220335 - RNA, 17 nt, Yersinia pestis KIM
gugccauaaauaccaau

SEQ ID NO: 4220336 - RNA, 21 nt, Yersinia pestis KIM
gugccauaaauaccaauuuca

SEQ ID NO: 4220337 - RNA, 13 nt, Yersinia pestis KIM
gugccaucgccaa

SEQ ID NO: 4220338 - RNA, 23 nt, Yersinia pestis KIM
gugccaucgcuugauaacacauu

SEQ ID NO: 4220339 - RNA, 12 nt, Yersinia pestis KIM
gugcccaaaaac

SEQ ID NO: 4220340 - RNA, 22 nt, Yersinia pestis KIM
gugcccaaaaacgcuggccagc

SEQ ID NO: 4220341 - RNA, 15 nt, Yersinia pestis KIM
gugcccaaucuauga

SEQ ID NO: 4220342 - RNA, 14 nt, Yersinia pestis KIM
gugcccagaaaacc

SEQ ID NO: 4220343 - RNA, 17 nt, Yersinia pestis KIM
gugcccagaaaaccccc

SEQ ID NO: 4220344 - RNA, 12 nt, Yersinia pestis KIM
gugccccaagaa

SEQ ID NO: 4220345 - RNA, 23 nt, Yersinia pestis KIM
gugcccgcuuguuguaucacagc

SEQ ID NO: 4220346 - RNA, 16 nt, Yersinia pestis KIM
gugcccggcaccuuca

SEQ ID NO: 4220347 - RNA, 21 nt, Yersinia pestis KIM
gugcccuuuuugguuuucuau

SEQ ID NO: 4220348 - RNA, 13 nt, Yersinia pestis KIM
gugccgcggcggc

SEQ ID NO: 4220349 - RNA, 13 nt, Yersinia pestis KIM
gugccgcuggggu

SEQ ID NO: 4220350 - RNA, 22 nt, Yersinia pestis KIM
gugccguagguaauuaaacgcu

SEQ ID NO: 4220351 - RNA, 19 nt, Yersinia pestis KIM
gugccgugucuuccagaca

SEQ ID NO: 4220352 - RNA, 20 nt, Yersinia pestis KIM
gugccucaaauugcuaacaa

SEQ ID NO: 4220353 - RNA, 18 nt, Yersinia pestis KIM
gugccugaauggaaaaau

SEQ ID NO: 4220354 - RNA, 20 nt, Yersinia pestis KIM
gugccugcacuuaacgcuuu

SEQ ID NO: 4220355 - RNA, 11 nt, Yersinia pestis KIM
gugccugcugg

SEQ ID NO: 4220356 - RNA, 23 nt, Yersinia pestis KIM
gugccuuacuuuuuugccugcuc

SEQ ID NO: 4220357 - RNA, 14 nt, Yersinia pestis KIM
gugcgaacaaaaau

SEQ ID NO: 4220358 - RNA, 20 nt, Yersinia pestis KIM
gugcgaagcgcacccaaaau

SEQ ID NO: 4220359 - RNA, 16 nt, Yersinia pestis KIM
gugcgaauggaaaaac

SEQ ID NO: 4220360 - RNA, 14 nt, Yersinia pestis KIM
gugcgcaucaauga

SEQ ID NO: 4220361 - RNA, 13 nt, Yersinia pestis KIM
gugcgccaaccgc

SEQ ID NO: 4220362 - RNA, 22 nt, Yersinia pestis KIM
gugcgccacgcagugccgauga

SEQ ID NO: 4220363 - RNA, 19 nt, Yersinia pestis KIM
gugcgcccgguaauaauga

SEQ ID NO: 4220364 - RNA, 14 nt, Yersinia pestis KIM
gugcgccggccugc

SEQ ID NO: 4220365 - RNA, 15 nt, Yersinia pestis KIM
gugcgcggcuagcca

SEQ ID NO: 4220366 - RNA, 22 nt, Yersinia pestis KIM
gugcgcuacgcaugaugcugcc

SEQ ID NO: 4220367 - RNA, 14 nt, Yersinia pestis KIM
gugcggcagugaac

SEQ ID NO: 4220368 - RNA, 15 nt, Yersinia pestis KIM
gugcggcagugaacg

SEQ ID NO: 4220369 - RNA, 15 nt, Yersinia pestis KIM
gugcggcagugaacu

SEQ ID NO: 4220370 - RNA, 17 nt, Yersinia pestis KIM
gugcgggaaucuugauu

SEQ ID NO: 4220371 - RNA, 16 nt, Yersinia pestis KIM
gugcgggccagaauaa

SEQ ID NO: 4220372 - RNA, 16 nt, Yersinia pestis KIM
gugcguaaagaaaaaa

SEQ ID NO: 4220373 - RNA, 12 nt, Yersinia pestis KIM
gugcguaggcaa

SEQ ID NO: 4220374 - RNA, 24 nt, Yersinia pestis KIM
gugcguuuuauucaagugcucacu

SEQ ID NO: 4220375 - RNA, 23 nt, Yersinia pestis KIM
gugcuaaaucccaggcguucugu

SEQ ID NO: 4220376 - RNA, 14 nt, Yersinia pestis KIM
gugcuacagcagca

SEQ ID NO: 4220377 - RNA, 13 nt, Yersinia pestis KIM
gugcuacggcaaa

SEQ ID NO: 4220378 - RNA, 14 nt, Yersinia pestis KIM
gugcucauuaaaac

SEQ ID NO: 4220379 - RNA, 20 nt, Yersinia pestis KIM
gugcucgggugccucacgua

SEQ ID NO: 4220380 - RNA, 18 nt, Yersinia pestis KIM
gugcucgucuucgacagc

SEQ ID NO: 4220381 - RNA, 14 nt, Yersinia pestis KIM
gugcucugccuuau

SEQ ID NO: 4220382 - RNA, 19 nt, Yersinia pestis KIM
gugcugcuaauauuuauaa

SEQ ID NO: 4220383 - RNA, 18 nt, Yersinia pestis KIM
gugcuguuccaaccaacc

SEQ ID NO: 4220384 - RNA, 20 nt, Yersinia pestis KIM
gugcuguuggugauauaaau

SEQ ID NO: 4220385 - RNA, 16 nt, Yersinia pestis KIM
gugcuucaucacuguu

SEQ ID NO: 4220386 - RNA, 12 nt, Yersinia pestis KIM
gugcuuugccau

SEQ ID NO: 4220387 - RNA, 18 nt, Yersinia pestis KIM
guggaagauauucugcau

SEQ ID NO: 4220388 - RNA, 14 nt, Yersinia pestis KIM
guggaaucggccuu

SEQ ID NO: 4220389 - RNA, 14 nt, Yersinia pestis KIM
guggacacgccguu

SEQ ID NO: 4220390 - RNA, 12 nt, Yersinia pestis KIM
guggagccauga

SEQ ID NO: 4220391 - RNA, 17 nt, Yersinia pestis KIM
guggaguaguucuuggg

SEQ ID NO: 4220392 - RNA, 15 nt, Yersinia pestis KIM
guggauaaacaaaua

SEQ ID NO: 4220393 - RNA, 23 nt, Yersinia pestis KIM
guggaugacaguauuugcagugg

SEQ ID NO: 4220394 - RNA, 15 nt, Yersinia pestis KIM
guggcagucacugcu

SEQ ID NO: 4220395 - RNA, 21 nt, Yersinia pestis KIM
guggccaguaacgcuucauca

SEQ ID NO: 4220396 - RNA, 15 nt, Yersinia pestis KIM
guggcgaagcccaua

SEQ ID NO: 4220397 - RNA, 18 nt, Yersinia pestis KIM
guggcguucccgcaggcg

SEQ ID NO: 4220398 - RNA, 23 nt, Yersinia pestis KIM
guggcucgacggccaauuucagu

SEQ ID NO: 4220399 - RNA, 20 nt, Yersinia pestis KIM
guggcugaaucguacuucuu

SEQ ID NO: 4220400 - RNA, 15 nt, Yersinia pestis KIM
guggcugagacuucu

SEQ ID NO: 4220401 - RNA, 20 nt, Yersinia pestis KIM
guggcugaggccagcggcau

SEQ ID NO: 4220402 - RNA, 19 nt, Yersinia pestis KIM
guggcuguaaauaaauaau

SEQ ID NO: 4220403 - RNA, 21 nt, Yersinia pestis KIM
guggcuguaaauaaauaauca

SEQ ID NO: 4220404 - RNA, 13 nt, Yersinia pestis KIM
guggcuuggcaug

SEQ ID NO: 4220405 - RNA, 22 nt, Yersinia pestis KIM
gugggaaugcccuuuugugcau

SEQ ID NO: 4220406 - RNA, 13 nt, Yersinia pestis KIM
guucaagagugag

SEQ ID NO: 4220407 - RNA, 14 nt, Yersinia pestis KIM
guucaagagugagu

SEQ ID NO: 4220408 - RNA, 12 nt, Yersinia pestis KIM
guucaagaucgu

SEQ ID NO: 4220409 - RNA, 15 nt, Yersinia pestis KIM
guucaagcagcuuuu

SEQ ID NO: 4220410 - RNA, 20 nt, Yersinia pestis KIM
guucaagcagcuuuucacga

SEQ ID NO: 4220411 - RNA, 14 nt, Yersinia pestis KIM
guucaaggaaacca

SEQ ID NO: 4220412 - RNA, 12 nt, Yersinia pestis KIM
guucaauaauua

SEQ ID NO: 4220413 - RNA, 19 nt, Yersinia pestis KIM
guucaauggucaugcacag

SEQ ID NO: 4220414 - RNA, 18 nt, Yersinia pestis KIM
guucacggaaaguagcca

SEQ ID NO: 4220415 - RNA, 20 nt, Yersinia pestis KIM
guucacugaguugcaggaau

SEQ ID NO: 4220416 - RNA, 20 nt, Yersinia pestis KIM
guucagagauaaucagaggu

SEQ ID NO: 4220417 - RNA, 17 nt, Yersinia pestis KIM
guucagauaaucccuug

SEQ ID NO: 4220418 - RNA, 23 nt, Yersinia pestis KIM
guucagcgacgauaauuugcagc

SEQ ID NO: 4220419 - RNA, 15 nt, Yersinia pestis KIM
guucaggauccgccu

SEQ ID NO: 4220420 - RNA, 21 nt, Yersinia pestis KIM
guucagugcucccugaacgcc

SEQ ID NO: 4220421 - RNA, 18 nt, Yersinia pestis KIM
guucauaaauuaaaacug

SEQ ID NO: 4220422 - RNA, 20 nt, Yersinia pestis KIM
guucauaaauuaaaacugaa

SEQ ID NO: 4220423 - RNA, 22 nt, Yersinia pestis KIM
guucauauaguugcuuaucguc

SEQ ID NO: 4220424 - RNA, 15 nt, Yersinia pestis KIM
guucauauuggccag

SEQ ID NO: 4220425 - RNA, 19 nt, Yersinia pestis KIM
guucaucaaucgagaagaa

SEQ ID NO: 4220426 - RNA, 18 nt, Yersinia pestis KIM
guucaucagcccagcggu

SEQ ID NO: 4220427 - RNA, 19 nt, Yersinia pestis KIM
guucauggccaugaaucaa

SEQ ID NO: 4220428 - RNA, 17 nt, Yersinia pestis KIM
guucauuccccaucgcc

SEQ ID NO: 4220429 - RNA, 22 nt, Yersinia pestis KIM
guucauuuagcagcgcacuggg

SEQ ID NO: 4220430 - RNA, 20 nt, Yersinia pestis KIM
guucauuuugaccagcauac

SEQ ID NO: 4220431 - RNA, 18 nt, Yersinia pestis KIM
guuccaacgcacaccccc

SEQ ID NO: 4220432 - RNA, 17 nt, Yersinia pestis KIM
guuccaggcaagaaacu

SEQ ID NO: 4220433 - RNA, 21 nt, Yersinia pestis KIM
guuccagugagcaauccaacc

SEQ ID NO: 4220434 - RNA, 15 nt, Yersinia pestis KIM
guuccaguggucauc

SEQ ID NO: 4220435 - RNA, 14 nt, Yersinia pestis KIM
guucccaugacgau

SEQ ID NO: 4220436 - RNA, 23 nt, Yersinia pestis KIM
guucccgauuauugugccgccuu

SEQ ID NO: 4220437 - RNA, 18 nt, Yersinia pestis KIM
guucccuuaugguuauca

SEQ ID NO: 4220438 - RNA, 19 nt, Yersinia pestis KIM
guuccuggaaccagugaau

SEQ ID NO: 4220439 - RNA, 15 nt, Yersinia pestis KIM
guuccuguuuuugaa

SEQ ID NO: 4220440 - RNA, 16 nt, Yersinia pestis KIM
guuccuucagccacca

SEQ ID NO: 4220441 - RNA, 19 nt, Yersinia pestis KIM
guuccuucagccaccagau

SEQ ID NO: 4220442 - RNA, 15 nt, Yersinia pestis KIM
guucgacuaucccac

SEQ ID NO: 4220443 - RNA, 14 nt, Yersinia pestis KIM
guucgagcggcaua

SEQ ID NO: 4220444 - RNA, 19 nt, Yersinia pestis KIM
guucgaggauaucacucug

SEQ ID NO: 4220445 - RNA, 15 nt, Yersinia pestis KIM
guucgcaaugaaccc

SEQ ID NO: 4220446 - RNA, 13 nt, Yersinia pestis KIM
guucgguaaauaa

SEQ ID NO: 4220447 - RNA, 23 nt, Yersinia pestis KIM
guucgguuaagagugcuggcaag

SEQ ID NO: 4220448 - RNA, 19 nt, Yersinia pestis KIM
guucguagccacgaucgau

SEQ ID NO: 4220449 - RNA, 13 nt, Yersinia pestis KIM
guucgugaaagca

SEQ ID NO: 4220450 - RNA, 21 nt, Yersinia pestis KIM
guucuaucucaucuuaaucac

SEQ ID NO: 4220451 - RNA, 23 nt, Yersinia pestis KIM
guucucacuuggguagcagccca

SEQ ID NO: 4220452 - RNA, 21 nt, Yersinia pestis KIM
guucuccaguugccagcaggc

SEQ ID NO: 4220453 - RNA, 21 nt, Yersinia pestis KIM
guucucgcuguacugcugcaa

SEQ ID NO: 4220454 - RNA, 19 nt, Yersinia pestis KIM
guucucuggguaagaacag

SEQ ID NO: 4220455 - RNA, 16 nt, Yersinia pestis KIM
guucugcccguagaga

SEQ ID NO: 4220456 - RNA, 11 nt, Yersinia pestis KIM
guucuggcagg

SEQ ID NO: 4220457 - RNA, 20 nt, Yersinia pestis KIM
guucuuauugcuaucuguua

SEQ ID NO: 4220458 - RNA, 18 nt, Yersinia pestis KIM
guucuucugauaaaacag

SEQ ID NO: 4220459 - RNA, 21 nt, Yersinia pestis KIM
guucuucuuguggcaguucac

SEQ ID NO: 4220460 - RNA, 13 nt, Yersinia pestis KIM
guucuugaugguc

SEQ ID NO: 4220461 - RNA, 15 nt, Yersinia pestis KIM
guucuuggaacaggc

SEQ ID NO: 4220462 - RNA, 12 nt, Yersinia pestis KIM
guugaacucaua

SEQ ID NO: 4220463 - RNA, 18 nt, Yersinia pestis KIM
guugaauuuuuauaauua

SEQ ID NO: 4220464 - RNA, 15 nt, Yersinia pestis KIM
guugaccaaacagaa

SEQ ID NO: 4220465 - RNA, 19 nt, Yersinia pestis KIM
guugaccugaagaaagguc

SEQ ID NO: 4220466 - RNA, 12 nt, Yersinia pestis KIM
guugacgccauu

SEQ ID NO: 4220467 - RNA, 12 nt, Yersinia pestis KIM
guugacguucag

SEQ ID NO: 4220468 - RNA, 21 nt, Yersinia pestis KIM
guugagaauuaaggaaacuca

SEQ ID NO: 4220469 - RNA, 19 nt, Yersinia pestis KIM
guugaggagaucgauaaag

SEQ ID NO: 4220470 - RNA, 20 nt, Yersinia pestis KIM
guugauaaacaauaaacaga

SEQ ID NO: 4220471 - RNA, 21 nt, Yersinia pestis KIM
guugauaaguugagaucaacu

SEQ ID NO: 4220472 - RNA, 16 nt, Yersinia pestis KIM
guugauauaccgauua

SEQ ID NO: 4220473 - RNA, 20 nt, Yersinia pestis KIM
guugauccgauaaacuucac

SEQ ID NO: 4220474 - RNA, 13 nt, Yersinia pestis KIM
guugaugcaguga

SEQ ID NO: 4220475 - RNA, 18 nt, Yersinia pestis KIM
guugauggcgcaguaacu

SEQ ID NO: 4220476 - RNA, 20 nt, Yersinia pestis KIM
guugauugcaggccgcuuua

SEQ ID NO: 4220477 - RNA, 18 nt, Yersinia pestis KIM
guugcaaacggauaaugu

SEQ ID NO: 4220478 - RNA, 13 nt, Yersinia pestis KIM
guugcacccugcu

SEQ ID NO: 4220479 - RNA, 15 nt, Yersinia pestis KIM
guugcacccugcuug

SEQ ID NO: 4220480 - RNA, 19 nt, Yersinia pestis KIM
guugcacugacggcagaca

SEQ ID NO: 4220481 - RNA, 21 nt, Yersinia pestis KIM
guugcauugccucccauugcu

SEQ ID NO: 4220482 - RNA, 13 nt, Yersinia pestis KIM
guugccaaccgga

SEQ ID NO: 4220483 - RNA, 15 nt, Yersinia pestis KIM
guugccaauguugcu

SEQ ID NO: 4220484 - RNA, 13 nt, Yersinia pestis KIM
guugccacagagg

SEQ ID NO: 4220485 - RNA, 22 nt, Yersinia pestis KIM
guugccaccagcguugacacuc

SEQ ID NO: 4220486 - RNA, 12 nt, Yersinia pestis KIM
guugccagcagg

SEQ ID NO: 4220487 - RNA, 17 nt, Yersinia pestis KIM
guugccauaaccugagc

SEQ ID NO: 4220488 - RNA, 19 nt, Yersinia pestis KIM
guugccauggccgccagca

SEQ ID NO: 4220489 - RNA, 19 nt, Yersinia pestis KIM
guugccauguugaguuuac

SEQ ID NO: 4220490 - RNA, 19 nt, Yersinia pestis KIM
guugcccgaauaauuggua

SEQ ID NO: 4220491 - RNA, 18 nt, Yersinia pestis KIM
guugcgauacagcgcauc

SEQ ID NO: 4220492 - RNA, 14 nt, Yersinia pestis KIM
guugcggcaccugc

SEQ ID NO: 4220493 - RNA, 15 nt, Yersinia pestis KIM
guugcugucucgcuu

SEQ ID NO: 4220494 - RNA, 15 nt, Yersinia pestis KIM
guugcuguucucucc

SEQ ID NO: 4220495 - RNA, 18 nt, Yersinia pestis KIM
guuggauauacauauuca

SEQ ID NO: 4220496 - RNA, 22 nt, Yersinia pestis KIM
guuggaucauccgcucagcaaa

SEQ ID NO: 4220497 - RNA, 13 nt, Yersinia pestis KIM
guuggcaaacauc

SEQ ID NO: 4220498 - RNA, 11 nt, Yersinia pestis KIM
guuggcuuuaa

SEQ ID NO: 4220499 - RNA, 16 nt, Yersinia pestis KIM
guuggcuuuaucucac

SEQ ID NO: 4220500 - RNA, 21 nt, Yersinia pestis KIM
guugggaaaaguggcuaucug

SEQ ID NO: 4220501 - RNA, 14 nt, Yersinia pestis KIM
guugggcaguaacg

SEQ ID NO: 4220502 - RNA, 17 nt, Yersinia pestis KIM
guugguagcguuuuuuc

SEQ ID NO: 4220503 - RNA, 14 nt, Yersinia pestis KIM
guuggucaccacuu

SEQ ID NO: 4220504 - RNA, 17 nt, Yersinia pestis KIM
guuggucaccacuugca

SEQ ID NO: 4220505 - RNA, 17 nt, Yersinia pestis KIM
guuggucagcacuucca

SEQ ID NO: 4220506 - RNA, 13 nt, Yersinia pestis KIM
guuguagcgccag

SEQ ID NO: 4220507 - RNA, 18 nt, Yersinia pestis KIM
guuguauacuguuuauua

SEQ ID NO: 4220508 - RNA, 13 nt, Yersinia pestis KIM
guuguaugucaau

SEQ ID NO: 4220509 - RNA, 14 nt, Yersinia pestis KIM
guuguauuagccgc

SEQ ID NO: 4220510 - RNA, 20 nt, Yersinia pestis KIM
guugucagauaucugcucau

SEQ ID NO: 4220511 - RNA, 20 nt, Yersinia pestis KIM
guugucagcagucugaaauc

SEQ ID NO: 4220512 - RNA, 17 nt, Yersinia pestis KIM
guugucuauguuugaug

SEQ ID NO: 4220513 - RNA, 14 nt, Yersinia pestis KIM
guugugcauauauu

SEQ ID NO: 4220514 - RNA, 18 nt, Yersinia pestis KIM
guugugggguuuuuuaau

SEQ ID NO: 4220515 - RNA, 16 nt, Yersinia pestis KIM
guuguucgugaaagca

SEQ ID NO: 4220516 - RNA, 13 nt, Yersinia pestis KIM
guuguuggcgaag

SEQ ID NO: 4220517 - RNA, 15 nt, Yersinia pestis KIM
guuguuucaauaaau

SEQ ID NO: 4220518 - RNA, 15 nt, Yersinia pestis KIM
guuguuucugaaggg

SEQ ID NO: 4220519 - RNA, 14 nt, Yersinia pestis KIM
guuuaaaaaauauc

SEQ ID NO: 4220520 - RNA, 21 nt, Yersinia pestis KIM
guuuaaaaaggcguuauccuu

SEQ ID NO: 4220521 - RNA, 21 nt, Yersinia pestis KIM
uaaaaagcgacugauauuagu

SEQ ID NO: 4220522 - RNA, 13 nt, Yersinia pestis KIM
uaaaaagucagcu

SEQ ID NO: 4220523 - RNA, 22 nt, Yersinia pestis KIM
uaaaaagucauuaacuguuaaa

SEQ ID NO: 4220524 - RNA, 15 nt, Yersinia pestis KIM
uaaaaauaaucaaug

SEQ ID NO: 4220525 - RNA, 16 nt, Yersinia pestis KIM
uaaaaauaaucaauga

SEQ ID NO: 4220526 - RNA, 14 nt, Yersinia pestis KIM
uaaaaauacaacca

SEQ ID NO: 4220527 - RNA, 19 nt, Yersinia pestis KIM
uaaaaauacauaauaauga

SEQ ID NO: 4220528 - RNA, 21 nt, Yersinia pestis KIM
uaaaaauacauaucaacacug

SEQ ID NO: 4220529 - RNA, 20 nt, Yersinia pestis KIM
uaaaaaucaccucaaacuga

SEQ ID NO: 4220530 - RNA, 20 nt, Yersinia pestis KIM
uaaaaaucccggcauauuau

SEQ ID NO: 4220531 - RNA, 19 nt, Yersinia pestis KIM
uaaaaauucacaacagugc

SEQ ID NO: 4220532 - RNA, 14 nt, Yersinia pestis KIM
uaaaacaaaguagu

SEQ ID NO: 4220533 - RNA, 15 nt, Yersinia pestis KIM
uaaaacagaaccccc

SEQ ID NO: 4220534 - RNA, 15 nt, Yersinia pestis KIM
uaaaacagauaaaaa

SEQ ID NO: 4220535 - RNA, 17 nt, Yersinia pestis KIM
uaaaacagauaaaaaau

SEQ ID NO: 4220536 - RNA, 20 nt, Yersinia pestis KIM
uaaaacagcagccaccaaaa

SEQ ID NO: 4220537 - RNA, 14 nt, Yersinia pestis KIM
uaaaacagcucacu

SEQ ID NO: 4220538 - RNA, 10 nt, Yersinia pestis KIM
uaaaaccaau

SEQ ID NO: 4220539 - RNA, 12 nt, Yersinia pestis KIM
uaaaaccacuga

SEQ ID NO: 4220540 - RNA, 21 nt, Yersinia pestis KIM
uaaaaccacugaccuauugau

SEQ ID NO: 4220541 - RNA, 22 nt, Yersinia pestis KIM
uaaaaccacugaccuauugaua

SEQ ID NO: 4220542 - RNA, 23 nt, Yersinia pestis KIM
uaaaaccacugaccuauugauaa

SEQ ID NO: 4220543 - RNA, 19 nt, Yersinia pestis KIM
uaaaaccuaauaacgcuca

SEQ ID NO: 4220544 - RNA, 19 nt, Yersinia pestis KIM
uaaaaccuuuacaauuaca

SEQ ID NO: 4220545 - RNA, 21 nt, Yersinia pestis KIM
uaaaacgaguaaauacaaaua

SEQ ID NO: 4220546 - RNA, 23 nt, Yersinia pestis KIM
uaaaacgcuaaccgauguagccu

SEQ ID NO: 4220547 - RNA, 14 nt, Yersinia pestis KIM
uaaaacucaaacug

SEQ ID NO: 4220548 - RNA, 20 nt, Yersinia pestis KIM
uaaaacugauauaaagcauu

SEQ ID NO: 4220549 - RNA, 15 nt, Yersinia pestis KIM
uaaaagaaaaccuug

SEQ ID NO: 4220550 - RNA, 21 nt, Yersinia pestis KIM
uaaaagaaaaccuugacucuu

SEQ ID NO: 4220551 - RNA, 12 nt, Yersinia pestis KIM
uaaaagauaacg

SEQ ID NO: 4220552 - RNA, 13 nt, Yersinia pestis KIM
uaaaagauaacga

SEQ ID NO: 4220553 - RNA, 17 nt, Yersinia pestis KIM
uaaaagauucauaaaaa

SEQ ID NO: 4220554 - RNA, 18 nt, Yersinia pestis KIM
uaaaagcacagacaaaca

SEQ ID NO: 4220555 - RNA, 19 nt, Yersinia pestis KIM
uaaaagcacagacaaacaa

SEQ ID NO: 4220556 - RNA, 17 nt, Yersinia pestis KIM
uaaaagcaugcccagcc

SEQ ID NO: 4220557 - RNA, 15 nt, Yersinia pestis KIM
uaaaagccagucagg

SEQ ID NO: 4220558 - RNA, 22 nt, Yersinia pestis KIM
uaaaagcggguuaccaguaacu

SEQ ID NO: 4220559 - RNA, 15 nt, Yersinia pestis KIM
uaaaaggggauaaca

SEQ ID NO: 4220560 - RNA, 14 nt, Yersinia pestis KIM
uaaaagucagcaaa

SEQ ID NO: 4220561 - RNA, 22 nt, Yersinia pestis KIM
uaaaauaaaucgucgaacauuu

SEQ ID NO: 4220562 - RNA, 21 nt, Yersinia pestis KIM
uaaaauaagcaggcaguaaaa

SEQ ID NO: 4220563 - RNA, 13 nt, Yersinia pestis KIM
uaaaauaauaaug

SEQ ID NO: 4220564 - RNA, 15 nt, Yersinia pestis KIM
uaaaauaauaauggu

SEQ ID NO: 4220565 - RNA, 11 nt, Yersinia pestis KIM
uaaaauaauga

SEQ ID NO: 4220566 - RNA, 16 nt, Yersinia pestis KIM
uaaaauaccaauuaau

SEQ ID NO: 4220567 - RNA, 17 nt, Yersinia pestis KIM
uaaaauaccaauuaaua

SEQ ID NO: 4220568 - RNA, 22 nt, Yersinia pestis KIM
uaaaauagguguuuuucgucau

SEQ ID NO: 4220569 - RNA, 20 nt, Yersinia pestis KIM
uaaaauaguggcacaaauaa

SEQ ID NO: 4220570 - RNA, 15 nt, Yersinia pestis KIM
uaaaauauggcaggu

SEQ ID NO: 4220571 - RNA, 13 nt, Yersinia pestis KIM
uaaaauauugaua

SEQ ID NO: 4220572 - RNA, 14 nt, Yersinia pestis KIM
uaaaauauuuugcu

SEQ ID NO: 4220573 - RNA, 15 nt, Yersinia pestis KIM
uaaaaucaaaacagg

SEQ ID NO: 4220574 - RNA, 12 nt, Yersinia pestis KIM
uaaaaucaucag

SEQ ID NO: 4220575 - RNA, 20 nt, Yersinia pestis KIM
uaaaaucaucagccucuaac

SEQ ID NO: 4220576 - RNA, 17 nt, Yersinia pestis KIM
uaaaauccccauuccaa

SEQ ID NO: 4220577 - RNA, 20 nt, Yersinia pestis KIM
uaaaauccccauuccaauua

SEQ ID NO: 4220578 - RNA, 15 nt, Yersinia pestis KIM
uaaaaucgauaguca

SEQ ID NO: 4220579 - RNA, 17 nt, Yersinia pestis KIM
uaaaaucuguaauuaau

SEQ ID NO: 4220580 - RNA, 18 nt, Yersinia pestis KIM
uaaaaucuguaauuaauu

SEQ ID NO: 4220581 - RNA, 20 nt, Yersinia pestis KIM
uaaaaugggccugagugggg

SEQ ID NO: 4220582 - RNA, 17 nt, Yersinia pestis KIM
uaaaauuaauaaauuau

SEQ ID NO: 4220583 - RNA, 20 nt, Yersinia pestis KIM
uaaaauuaauaaauuauaau

SEQ ID NO: 4220584 - RNA, 15 nt, Yersinia pestis KIM
uaaaauuaauuacuu

SEQ ID NO: 4220585 - RNA, 15 nt, Yersinia pestis KIM
uaaaauucgcuauga

SEQ ID NO: 4220586 - RNA, 22 nt, Yersinia pestis KIM
uaaaauucguuucucuaaaauu

SEQ ID NO: 4220587 - RNA, 12 nt, Yersinia pestis KIM
uaaaauuuuaag

SEQ ID NO: 4220588 - RNA, 16 nt, Yersinia pestis KIM
uaaaauuuuggcaacc

SEQ ID NO: 4220589 - RNA, 13 nt, Yersinia pestis KIM
uaaacaaaauagg

SEQ ID NO: 4220590 - RNA, 14 nt, Yersinia pestis KIM
uaaacaacacauuc

SEQ ID NO: 4220591 - RNA, 19 nt, Yersinia pestis KIM
uaaacaaccaaaaaucuug

SEQ ID NO: 4220592 - RNA, 13 nt, Yersinia pestis KIM
uaaacaacgcuga

SEQ ID NO: 4220593 - RNA, 18 nt, Yersinia pestis KIM
uaaacaacgcugaaaaau

SEQ ID NO: 4220594 - RNA, 17 nt, Yersinia pestis KIM
uaaacaagcuuauauua

SEQ ID NO: 4220595 - RNA, 16 nt, Yersinia pestis KIM
uaaacaaguugaacca

SEQ ID NO: 4220596 - RNA, 20 nt, Yersinia pestis KIM
uaaacaaucugaugaauuaa

SEQ ID NO: 4220597 - RNA, 14 nt, Yersinia pestis KIM
uaaacaaugaaauu

SEQ ID NO: 4220598 - RNA, 17 nt, Yersinia pestis KIM
uaaacaauguuaaacuu

SEQ ID NO: 4220599 - RNA, 16 nt, Yersinia pestis KIM
uaaacacaaaauagaa

SEQ ID NO: 4220600 - RNA, 22 nt, Yersinia pestis KIM
uaaacaccggcaauaugaaggc

SEQ ID NO: 4220601 - RNA, 21 nt, Yersinia pestis KIM
uaaacacgucuaauuccgcca

SEQ ID NO: 4220602 - RNA, 14 nt, Yersinia pestis KIM
uaaacagacaaaaa

SEQ ID NO: 4220603 - RNA, 16 nt, Yersinia pestis KIM
uaaacagacaaaaaau

SEQ ID NO: 4220604 - RNA, 14 nt, Yersinia pestis KIM
uaaacagacacagc

SEQ ID NO: 4220605 - RNA, 16 nt, Yersinia pestis KIM
uaaacagacacagcaa

SEQ ID NO: 4220606 - RNA, 21 nt, Yersinia pestis KIM
uaaacagacuaaaaaccgcca

SEQ ID NO: 4220607 - RNA, 17 nt, Yersinia pestis KIM
uaaacagggcagaaaau

SEQ ID NO: 4220608 - RNA, 20 nt, Yersinia pestis KIM
uaaacaguaggaauuauagu

SEQ ID NO: 4220609 - RNA, 20 nt, Yersinia pestis KIM
uaaacauaaaaaaugccagc

SEQ ID NO: 4220610 - RNA, 19 nt, Yersinia pestis KIM
uaaacaucaugacaaaaau

SEQ ID NO: 4220611 - RNA, 19 nt, Yersinia pestis KIM
uaaacauuuacuuauaaac

SEQ ID NO: 4220612 - RNA, 15 nt, Yersinia pestis KIM
uaaaccaaagauaau

SEQ ID NO: 4220613 - RNA, 13 nt, Yersinia pestis KIM
uaaaccaaauggu

SEQ ID NO: 4220614 - RNA, 14 nt, Yersinia pestis KIM
uaaaccagccagug

SEQ ID NO: 4220615 - RNA, 15 nt, Yersinia pestis KIM
uaaaccaucagaguc

SEQ ID NO: 4220616 - RNA, 15 nt, Yersinia pestis KIM
uaaacccaaccccau

SEQ ID NO: 4220617 - RNA, 17 nt, Yersinia pestis KIM
uaaacccacagacauuu

SEQ ID NO: 4220618 - RNA, 20 nt, Yersinia pestis KIM
uaaacccugucguuacugcc

SEQ ID NO: 4220619 - RNA, 15 nt, Yersinia pestis KIM
uaaaccgcaccacaa

SEQ ID NO: 4220620 - RNA, 17 nt, Yersinia pestis KIM
uaaaccgcaccacaaag

SEQ ID NO: 4220621 - RNA, 18 nt, Yersinia pestis KIM
uaaaccggcacaggcgcu

SEQ ID NO: 4220622 - RNA, 16 nt, Yersinia pestis KIM
uaaaccgguuaaaaca

SEQ ID NO: 4220623 - RNA, 17 nt, Yersinia pestis KIM
uaaaccgguuaaaacag

SEQ ID NO: 4220624 - RNA, 15 nt, Yersinia pestis KIM
uaaaccgugauuggu

SEQ ID NO: 4220625 - RNA, 16 nt, Yersinia pestis KIM
uaaaccuacagccauc

SEQ ID NO: 4220626 - RNA, 23 nt, Yersinia pestis KIM
uaaaccugacugguucacaccaa

SEQ ID NO: 4220627 - RNA, 13 nt, Yersinia pestis KIM
uaaaccugcaaua

SEQ ID NO: 4220628 - RNA, 18 nt, Yersinia pestis KIM
uaaaccugcaauaaccag

SEQ ID NO: 4220629 - RNA, 19 nt, Yersinia pestis KIM
uaaaccugcaauaaccaga

SEQ ID NO: 4220630 - RNA, 15 nt, Yersinia pestis KIM
uaaacgaguuuccag

SEQ ID NO: 4220631 - RNA, 15 nt, Yersinia pestis KIM
uaaacgcauacucaa

SEQ ID NO: 4220632 - RNA, 20 nt, Yersinia pestis KIM
uaaacgcauacucaaaaaug

SEQ ID NO: 4220633 - RNA, 13 nt, Yersinia pestis KIM
uaaacgcccagcu

SEQ ID NO: 4220634 - RNA, 14 nt, Yersinia pestis KIM
uaaacgcccagcua

SEQ ID NO: 4220635 - RNA, 20 nt, Yersinia pestis KIM
uaaacgcccagcuaauugau

SEQ ID NO: 4220636 - RNA, 14 nt, Yersinia pestis KIM
uaaauccaaggcgg

SEQ ID NO: 4220637 - RNA, 13 nt, Yersinia pestis KIM
uaaauccagccca

SEQ ID NO: 4220638 - RNA, 17 nt, Yersinia pestis KIM
uaaaucccgcuugucgc

SEQ ID NO: 4220639 - RNA, 21 nt, Yersinia pestis KIM
uaaauccguggcccccuuucc

SEQ ID NO: 4220640 - RNA, 12 nt, Yersinia pestis KIM
uaaaucgcccaa

SEQ ID NO: 4220641 - RNA, 13 nt, Yersinia pestis KIM
uaaaucgggcaaa

SEQ ID NO: 4220642 - RNA, 18 nt, Yersinia pestis KIM
uaaaucgucgaacauuuu

SEQ ID NO: 4220643 - RNA, 16 nt, Yersinia pestis KIM
uaaaucuacuuuauuc

SEQ ID NO: 4220644 - RNA, 17 nt, Yersinia pestis KIM
uaaaucuacuuuauuca

SEQ ID NO: 4220645 - RNA, 22 nt, Yersinia pestis KIM
uaaaucucuuaccccuuucaau

SEQ ID NO: 4220646 - RNA, 18 nt, Yersinia pestis KIM
uaaaucuuguuuaaucac

SEQ ID NO: 4220647 - RNA, 14 nt, Yersinia pestis KIM
uaaaugaacgugcc

SEQ ID NO: 4220648 - RNA, 21 nt, Yersinia pestis KIM
uaaaugaagcaguucacugag

SEQ ID NO: 4220649 - RNA, 19 nt, Yersinia pestis KIM
uaaaugaccaacuguaaaa

SEQ ID NO: 4220650 - RNA, 23 nt, Yersinia pestis KIM
uaaaugcaauauugcuugccagc

SEQ ID NO: 4220651 - RNA, 22 nt, Yersinia pestis KIM
uaaauggcacuggaaacaaaac

SEQ ID NO: 4220652 - RNA, 21 nt, Yersinia pestis KIM
uaaauggcgaaaggaacaaaa

SEQ ID NO: 4220653 - RNA, 22 nt, Yersinia pestis KIM
uaaaugggguaaugaccacuga

SEQ ID NO: 4220654 - RNA, 16 nt, Yersinia pestis KIM
uaaauggucaguuuaa

SEQ ID NO: 4220655 - RNA, 16 nt, Yersinia pestis KIM
uaaaugguuuauuuaa

SEQ ID NO: 4220656 - RNA, 15 nt, Yersinia pestis KIM
uaaauguacagucau

SEQ ID NO: 4220657 - RNA, 19 nt, Yersinia pestis KIM
uaaaugucacuugcccuga

SEQ ID NO: 4220658 - RNA, 17 nt, Yersinia pestis KIM
uaaaugucgcuaauagg

SEQ ID NO: 4220659 - RNA, 13 nt, Yersinia pestis KIM
uaaauguucaccg

SEQ ID NO: 4220660 - RNA, 13 nt, Yersinia pestis KIM
uaaauuaaaaaga

SEQ ID NO: 4220661 - RNA, 17 nt, Yersinia pestis KIM
uaaauuaaaaagagugu

SEQ ID NO: 4220662 - RNA, 17 nt, Yersinia pestis KIM
uaaauuaaaacugaaaa

SEQ ID NO: 4220663 - RNA, 16 nt, Yersinia pestis KIM
uaaauuaccggugguc

SEQ ID NO: 4220664 - RNA, 19 nt, Yersinia pestis KIM
uaaauuacucguauaaaaa

SEQ ID NO: 4220665 - RNA, 14 nt, Yersinia pestis KIM
uaaauuagaaaaca

SEQ ID NO: 4220666 - RNA, 15 nt, Yersinia pestis KIM
uaaauuagaaaacaa

SEQ ID NO: 4220667 - RNA, 15 nt, Yersinia pestis KIM
uaaauuagccacugg

SEQ ID NO: 4220668 - RNA, 20 nt, Yersinia pestis KIM
uaaauuaucccguucaauaa

SEQ ID NO: 4220669 - RNA, 13 nt, Yersinia pestis KIM
uaaauucaaaaua

SEQ ID NO: 4220670 - RNA, 16 nt, Yersinia pestis KIM
uaaauucaaauaucau

SEQ ID NO: 4220671 - RNA, 20 nt, Yersinia pestis KIM
uaaauucaacuucuccugua

SEQ ID NO: 4220672 - RNA, 22 nt, Yersinia pestis KIM
uaaauucagguugaggcagggu

SEQ ID NO: 4220673 - RNA, 16 nt, Yersinia pestis KIM
uaaauuccguggcuua

SEQ ID NO: 4220674 - RNA, 18 nt, Yersinia pestis KIM
uaaauucuaccuggcuca

SEQ ID NO: 4220675 - RNA, 21 nt, Yersinia pestis KIM
uaaauucuaccuggcucaaau

SEQ ID NO: 4220676 - RNA, 15 nt, Yersinia pestis KIM
uaaauucuuuauacc

SEQ ID NO: 4220677 - RNA, 15 nt, Yersinia pestis KIM
uaaauugcuuaaaaa

SEQ ID NO: 4220678 - RNA, 16 nt, Yersinia pestis KIM
uaaauugcuuaaaaaa

SEQ ID NO: 4220679 - RNA, 17 nt, Yersinia pestis KIM
uaaauugcuuaaaaaaa

SEQ ID NO: 4220680 - RNA, 15 nt, Yersinia pestis KIM
uaaauuuaauaugac

SEQ ID NO: 4220681 - RNA, 13 nt, Yersinia pestis KIM
uaaauuuauauuu

SEQ ID NO: 4220682 - RNA, 18 nt, Yersinia pestis KIM
uaaauuuauauuuacgca

SEQ ID NO: 4220683 - RNA, 18 nt, Yersinia pestis KIM
uaaauuugauacaguaau

SEQ ID NO: 4220684 - RNA, 11 nt, Yersinia pestis KIM
uaaauuuuaaa

SEQ ID NO: 4220685 - RNA, 15 nt, Yersinia pestis KIM
uaaauuuuauauuau

SEQ ID NO: 4220686 - RNA, 17 nt, Yersinia pestis KIM
uaaauuuuauauuaucu

SEQ ID NO: 4220687 - RNA, 13 nt, Yersinia pestis KIM
uaaauuuucuaag

SEQ ID NO: 4220688 - RNA, 17 nt, Yersinia pestis KIM
uaaauuuuuauauaauu

SEQ ID NO: 4220689 - RNA, 12 nt, Yersinia pestis KIM
uaacaaacacau

SEQ ID NO: 4220690 - RNA, 19 nt, Yersinia pestis KIM
uaacaaacuguuuuuuaaa

SEQ ID NO: 4220691 - RNA, 21 nt, Yersinia pestis KIM
uaacaaagccgcuuaauuuau

SEQ ID NO: 4220692 - RNA, 20 nt, Yersinia pestis KIM
uaacaaauggucaggaaccc

SEQ ID NO: 4220693 - RNA, 19 nt, Yersinia pestis KIM
uaacaacaucgagcgggcu

SEQ ID NO: 4220694 - RNA, 21 nt, Yersinia pestis KIM
uaacaacccuaacaccgagua

SEQ ID NO: 4220695 - RNA, 17 nt, Yersinia pestis KIM
uaacaacgacuccauca

SEQ ID NO: 4220696 - RNA, 11 nt, Yersinia pestis KIM
uaacaacugcc

SEQ ID NO: 4220697 - RNA, 21 nt, Yersinia pestis KIM
uaacaacugguuaucacuguc

SEQ ID NO: 4220698 - RNA, 14 nt, Yersinia pestis KIM
uaacaauauucauu

SEQ ID NO: 4220699 - RNA, 14 nt, Yersinia pestis KIM
uaacaaucagugca

SEQ ID NO: 4220700 - RNA, 15 nt, Yersinia pestis KIM
uaacaauccgaacaa

SEQ ID NO: 4220701 - RNA, 17 nt, Yersinia pestis KIM
uaacaauccgaacaaaa

SEQ ID NO: 4220702 - RNA, 19 nt, Yersinia pestis KIM
uaacaauguuuauccgcua

SEQ ID NO: 4220703 - RNA, 18 nt, Yersinia pestis KIM
uaacaauuaauuggcuca

SEQ ID NO: 4220704 - RNA, 17 nt, Yersinia pestis KIM
uaacaauuacuuuggca

SEQ ID NO: 4220705 - RNA, 12 nt, Yersinia pestis KIM
uaacaauucucu

SEQ ID NO: 4220706 - RNA, 14 nt, Yersinia pestis KIM
uaacaauucucucg

SEQ ID NO: 4220707 - RNA, 14 nt, Yersinia pestis KIM
uaacaauuuaucag

SEQ ID NO: 4220708 - RNA, 15 nt, Yersinia pestis KIM
uaacaauuuuauugu

SEQ ID NO: 4220709 - RNA, 20 nt, Yersinia pestis KIM
uaacaauuuuauuguuuucg

SEQ ID NO: 4220710 - RNA, 22 nt, Yersinia pestis KIM
uaacaauuuuauuguuuucguu

SEQ ID NO: 4220711 - RNA, 20 nt, Yersinia pestis KIM
uaacacagucggcauagcua

SEQ ID NO: 4220712 - RNA, 16 nt, Yersinia pestis KIM
uaacacauuaauuuau

SEQ ID NO: 4220713 - RNA, 22 nt, Yersinia pestis KIM
uaacacauuaauuuaucugcua

SEQ ID NO: 4220714 - RNA, 14 nt, Yersinia pestis KIM
uaacacauuauucu

SEQ ID NO: 4220715 - RNA, 19 nt, Yersinia pestis KIM
uaacacauuauucuguacg

SEQ ID NO: 4220716 - RNA, 18 nt, Yersinia pestis KIM
uaacacauuccaguaaaa

SEQ ID NO: 4220717 - RNA, 21 nt, Yersinia pestis KIM
uaacacauuccaguaaaaaaa

SEQ ID NO: 4220718 - RNA, 23 nt, Yersinia pestis KIM
uaacacauuccaguaaaaaaaua

SEQ ID NO: 4220719 - RNA, 21 nt, Yersinia pestis KIM
uaacaccagcaggugauacau

SEQ ID NO: 4220720 - RNA, 19 nt, Yersinia pestis KIM
uaacaccagcauccugcaa

SEQ ID NO: 4220721 - RNA, 16 nt, Yersinia pestis KIM
uaacacccaauaauaa

SEQ ID NO: 4220722 - RNA, 21 nt, Yersinia pestis KIM
uaacacccaauaauaaaaaaa

SEQ ID NO: 4220723 - RNA, 19 nt, Yersinia pestis KIM
uaacacgaaaagcagcagu

SEQ ID NO: 4220724 - RNA, 20 nt, Yersinia pestis KIM
uaacacgaaaagcagcaguu

SEQ ID NO: 4220725 - RNA, 13 nt, Yersinia pestis KIM
uaacagagcagaa

SEQ ID NO: 4220726 - RNA, 21 nt, Yersinia pestis KIM
uaacagagcagaaagcagcag

SEQ ID NO: 4220727 - RNA, 23 nt, Yersinia pestis KIM
uaacagagcagaaagcagcagcu

SEQ ID NO: 4220728 - RNA, 22 nt, Yersinia pestis KIM
uaacagauauuacgcagccaua

SEQ ID NO: 4220729 - RNA, 22 nt, Yersinia pestis KIM
uaacagaucggucgggaaucaa

SEQ ID NO: 4220730 - RNA, 14 nt, Yersinia pestis KIM
uaacagccccgucu

SEQ ID NO: 4220731 - RNA, 21 nt, Yersinia pestis KIM
uaacagcguugaccaacuguc

SEQ ID NO: 4220732 - RNA, 16 nt, Yersinia pestis KIM
uaacaguaucaaguau

SEQ ID NO: 4220733 - RNA, 15 nt, Yersinia pestis KIM
uaacauauaaaccag

SEQ ID NO: 4220734 - RNA, 19 nt, Yersinia pestis KIM
uaacauauaaaccagccag

SEQ ID NO: 4220735 - RNA, 16 nt, Yersinia pestis KIM
uaacauauccugugcc

SEQ ID NO: 4220736 - RNA, 17 nt, Yersinia pestis KIM
uaacauauccugugcca

SEQ ID NO: 4220737 - RNA, 18 nt, Yersinia pestis KIM
uaacaucagcgauucauu

SEQ ID NO: 4220738 - RNA, 20 nt, Yersinia pestis KIM
uaacaucagcgauucauuga

SEQ ID NO: 4220739 - RNA, 18 nt, Yersinia pestis KIM
uaacaugccacauagcgu

SEQ ID NO: 4220740 - RNA, 13 nt, Yersinia pestis KIM
uaacaugcugaua

SEQ ID NO: 4220741 - RNA, 13 nt, Yersinia pestis KIM
uaacauguagcac

SEQ ID NO: 4220742 - RNA, 21 nt, Yersinia pestis KIM
uaacauuacuuugaauagcac

SEQ ID NO: 4220743 - RNA, 14 nt, Yersinia pestis KIM
uaacauuuuuucuu

SEQ ID NO: 4220744 - RNA, 21 nt, Yersinia pestis KIM
uaaccaacaguuauuuuaauu

SEQ ID NO: 4220745 - RNA, 17 nt, Yersinia pestis KIM
uaaccaauaacauuucg

SEQ ID NO: 4220746 - RNA, 11 nt, Yersinia pestis KIM
uaaccacagca

SEQ ID NO: 4220747 - RNA, 20 nt, Yersinia pestis KIM
uaaccaccgucaccaaauau

SEQ ID NO: 4220748 - RNA, 20 nt, Yersinia pestis KIM
uaaccagaagaacagcccuc

SEQ ID NO: 4220749 - RNA, 21 nt, Yersinia pestis KIM
uaaccagcaguugcugcucug

SEQ ID NO: 4220750 - RNA, 16 nt, Yersinia pestis KIM
uaaccagcaucaguag

SEQ ID NO: 4220751 - RNA, 12 nt, Yersinia pestis KIM
uaagcauuggca

SEQ ID NO: 4220752 - RNA, 18 nt, Yersinia pestis KIM
uaagcauuggcaaaucau

SEQ ID NO: 4220753 - RNA, 14 nt, Yersinia pestis KIM
uaagccaauaauau

SEQ ID NO: 4220754 - RNA, 12 nt, Yersinia pestis KIM
uaagccagugug

SEQ ID NO: 4220755 - RNA, 18 nt, Yersinia pestis KIM
uaagccaugggucauuaa

SEQ ID NO: 4220756 - RNA, 22 nt, Yersinia pestis KIM
uaagccauuaaacguuugggau

SEQ ID NO: 4220757 - RNA, 19 nt, Yersinia pestis KIM
uaagccauuuuuuauaaac

SEQ ID NO: 4220758 - RNA, 18 nt, Yersinia pestis KIM
uaagccgcaauaaauggc

SEQ ID NO: 4220759 - RNA, 18 nt, Yersinia pestis KIM
uaagccgcagaugccaga

SEQ ID NO: 4220760 - RNA, 21 nt, Yersinia pestis KIM
uaagccgcagaugccagacuu

SEQ ID NO: 4220761 - RNA, 21 nt, Yersinia pestis KIM
uaagccuaauggugcuauuuc

SEQ ID NO: 4220762 - RNA, 23 nt, Yersinia pestis KIM
uaagccuaauggugcuauuucug

SEQ ID NO: 4220763 - RNA, 20 nt, Yersinia pestis KIM
uaagccucgcguaucaugag

SEQ ID NO: 4220764 - RNA, 17 nt, Yersinia pestis KIM
uaagccugaugccuuga

SEQ ID NO: 4220765 - RNA, 17 nt, Yersinia pestis KIM
uaagcgacgacauuaau

SEQ ID NO: 4220766 - RNA, 18 nt, Yersinia pestis KIM
uaagcggcguauuaucag

SEQ ID NO: 4220767 - RNA, 18 nt, Yersinia pestis KIM
uaagcgggcuuuaauagc

SEQ ID NO: 4220768 - RNA, 16 nt, Yersinia pestis KIM
uaagcgguuuguuaaa

SEQ ID NO: 4220769 - RNA, 21 nt, Yersinia pestis KIM
uaagcguauuuugucaugaaa

SEQ ID NO: 4220770 - RNA, 20 nt, Yersinia pestis KIM
uaagcuagagccgcgcuaua

SEQ ID NO: 4220771 - RNA, 19 nt, Yersinia pestis KIM
uaagcuauugguuauugau

SEQ ID NO: 4220772 - RNA, 19 nt, Yersinia pestis KIM
uaagcucugggacgugcau

SEQ ID NO: 4220773 - RNA, 15 nt, Yersinia pestis KIM
uaagcucuuccaaua

SEQ ID NO: 4220774 - RNA, 22 nt, Yersinia pestis KIM
uaagcugaaauuuuuuaauuug

SEQ ID NO: 4220775 - RNA, 14 nt, Yersinia pestis KIM
uaagcugcagaggu

SEQ ID NO: 4220776 - RNA, 15 nt, Yersinia pestis KIM
uaagcugccucagac

SEQ ID NO: 4220777 - RNA, 14 nt, Yersinia pestis KIM
uaagcugccugugc

SEQ ID NO: 4220778 - RNA, 20 nt, Yersinia pestis KIM
uaagcuggcgcacucauccu

SEQ ID NO: 4220779 - RNA, 19 nt, Yersinia pestis KIM
uaagcuucgagcaggcuuu

SEQ ID NO: 4220780 - RNA, 14 nt, Yersinia pestis KIM
uaaggagugccauc

SEQ ID NO: 4220781 - RNA, 13 nt, Yersinia pestis KIM
uaaggcccauuug

SEQ ID NO: 4220782 - RNA, 20 nt, Yersinia pestis KIM
uaaggcguuacccacauuaa

SEQ ID NO: 4220783 - RNA, 14 nt, Yersinia pestis KIM
uaagggaaauaccc

SEQ ID NO: 4220784 - RNA, 16 nt, Yersinia pestis KIM
uaaggguaaaaucccc

SEQ ID NO: 4220785 - RNA, 13 nt, Yersinia pestis KIM
uaagguaaagaaa

SEQ ID NO: 4220786 - RNA, 15 nt, Yersinia pestis KIM
uaaggucacuguuuc

SEQ ID NO: 4220787 - RNA, 19 nt, Yersinia pestis KIM
uaaggucaguucacgaauu

SEQ ID NO: 4220788 - RNA, 19 nt, Yersinia pestis KIM
uaaggugaugaaugacugg

SEQ ID NO: 4220789 - RNA, 21 nt, Yersinia pestis KIM
uaaggugaugaaugacuggcu

SEQ ID NO: 4220790 - RNA, 20 nt, Yersinia pestis KIM
uaagguguuacaacaugaaa

SEQ ID NO: 4220791 - RNA, 15 nt, Yersinia pestis KIM
uaaguaauaacucag

SEQ ID NO: 4220792 - RNA, 15 nt, Yersinia pestis KIM
uaaguauuucaaaua

SEQ ID NO: 4220793 - RNA, 14 nt, Yersinia pestis KIM
uaagucaauuucag

SEQ ID NO: 4220794 - RNA, 15 nt, Yersinia pestis KIM
uaagucaauuucagc

SEQ ID NO: 4220795 - RNA, 15 nt, Yersinia pestis KIM
uaaguccaagacaga

SEQ ID NO: 4220796 - RNA, 19 nt, Yersinia pestis KIM
uaagucgucugauauuaaa

SEQ ID NO: 4220797 - RNA, 18 nt, Yersinia pestis KIM
uaagugaaacaaauacac

SEQ ID NO: 4220798 - RNA, 16 nt, Yersinia pestis KIM
uaagugccaguuaaua

SEQ ID NO: 4220799 - RNA, 16 nt, Yersinia pestis KIM
uaaguuacgucagaaa

SEQ ID NO: 4220800 - RNA, 20 nt, Yersinia pestis KIM
uaaguucagcgcuuaauauu

SEQ ID NO: 4220801 - RNA, 22 nt, Yersinia pestis KIM
uaaguucgucagugaugacauc

SEQ ID NO: 4220802 - RNA, 18 nt, Yersinia pestis KIM
uaaguugaugcagugagg

SEQ ID NO: 4220803 - RNA, 14 nt, Yersinia pestis KIM
uaauaaaaaaaaau

SEQ ID NO: 4220804 - RNA, 15 nt, Yersinia pestis KIM
uaauaaaaaaaaaua

SEQ ID NO: 4220805 - RNA, 20 nt, Yersinia pestis KIM
uaauaaaaaaaaauaaaauu

SEQ ID NO: 4220806 - RNA, 13 nt, Yersinia pestis KIM
uaauaaaaucaaa

SEQ ID NO: 4220807 - RNA, 14 nt, Yersinia pestis KIM
uaauaaaggcugua

SEQ ID NO: 4220808 - RNA, 13 nt, Yersinia pestis KIM
uaauaaauuaaua

SEQ ID NO: 4220809 - RNA, 18 nt, Yersinia pestis KIM
uaauaacaguaucaagua

SEQ ID NO: 4220810 - RNA, 12 nt, Yersinia pestis KIM
uaauaaccauua

SEQ ID NO: 4220811 - RNA, 15 nt, Yersinia pestis KIM
uaauaacgaauuuca

SEQ ID NO: 4220812 - RNA, 15 nt, Yersinia pestis KIM
uaauaacgccgagua

SEQ ID NO: 4220813 - RNA, 20 nt, Yersinia pestis KIM
uaauaacgccgaguaaguca

SEQ ID NO: 4220814 - RNA, 18 nt, Yersinia pestis KIM
uaauaacuuaaauaauuu

SEQ ID NO: 4220815 - RNA, 22 nt, Yersinia pestis KIM
uaauaagacguuauuauugauu

SEQ ID NO: 4220816 - RNA, 21 nt, Yersinia pestis KIM
uaauaagccgcaggcaaacaa

SEQ ID NO: 4220817 - RNA, 14 nt, Yersinia pestis KIM
uaauaagggcgcau

SEQ ID NO: 4220818 - RNA, 14 nt, Yersinia pestis KIM
uaauaaguuaauaa

SEQ ID NO: 4220819 - RNA, 16 nt, Yersinia pestis KIM
uaauaaguuaauaaug

SEQ ID NO: 4220820 - RNA, 14 nt, Yersinia pestis KIM
uaauaauagauagu

SEQ ID NO: 4220821 - RNA, 13 nt, Yersinia pestis KIM
uaauaauaucaaa

SEQ ID NO: 4220822 - RNA, 19 nt, Yersinia pestis KIM
uaauaaucuuaaguaaauu

SEQ ID NO: 4220823 - RNA, 13 nt, Yersinia pestis KIM
uaauaaugaugaa

SEQ ID NO: 4220824 - RNA, 18 nt, Yersinia pestis KIM
uaauacacccgaaggcca

SEQ ID NO: 4220825 - RNA, 22 nt, Yersinia pestis KIM
uaauacacuaggagaaacauua

SEQ ID NO: 4220826 - RNA, 20 nt, Yersinia pestis KIM
uaauacaggcugacauuucu

SEQ ID NO: 4220827 - RNA, 12 nt, Yersinia pestis KIM
uaauacauaaaa

SEQ ID NO: 4220828 - RNA, 13 nt, Yersinia pestis KIM
uaauacauaaaau

SEQ ID NO: 4220829 - RNA, 24 nt, Yersinia pestis KIM
uaauacauaaaaucaauaucgcua

SEQ ID NO: 4220830 - RNA, 16 nt, Yersinia pestis KIM
uaauacaucaucaaaa

SEQ ID NO: 4220831 - RNA, 15 nt, Yersinia pestis KIM
uaauaccacaccuua

SEQ ID NO: 4220832 - RNA, 18 nt, Yersinia pestis KIM
uaauaccguuuucuuuca

SEQ ID NO: 4220833 - RNA, 13 nt, Yersinia pestis KIM
uaauacucuguua

SEQ ID NO: 4220834 - RNA, 22 nt, Yersinia pestis KIM
uaauacugcgguccuacccuuu

SEQ ID NO: 4220835 - RNA, 14 nt, Yersinia pestis KIM
uaauagauaguacg

SEQ ID NO: 4220836 - RNA, 20 nt, Yersinia pestis KIM
uaauagauuguaaguaacua

SEQ ID NO: 4220837 - RNA, 13 nt, Yersinia pestis KIM
uaauagcaaaaaa

SEQ ID NO: 4220838 - RNA, 21 nt, Yersinia pestis KIM
uaauagccucugucucuggua

SEQ ID NO: 4220839 - RNA, 17 nt, Yersinia pestis KIM
uaauagcuuaaucauca

SEQ ID NO: 4220840 - RNA, 17 nt, Yersinia pestis KIM
uaauagguuggcauuag

SEQ ID NO: 4220841 - RNA, 19 nt, Yersinia pestis KIM
uaauaguguuguaagauuu

SEQ ID NO: 4220842 - RNA, 12 nt, Yersinia pestis KIM
uaauaguucauu

SEQ ID NO: 4220843 - RNA, 16 nt, Yersinia pestis KIM
uaauaguucauuuugu

SEQ ID NO: 4220844 - RNA, 12 nt, Yersinia pestis KIM
uaauauaauuca

SEQ ID NO: 4220845 - RNA, 19 nt, Yersinia pestis KIM
uaauauaauucaauauaua

SEQ ID NO: 4220846 - RNA, 15 nt, Yersinia pestis KIM
uaauauaccaacucu

SEQ ID NO: 4220847 - RNA, 15 nt, Yersinia pestis KIM
uaauaucaaaacuga

SEQ ID NO: 4220848 - RNA, 16 nt, Yersinia pestis KIM
uaauaucaacagaacu

SEQ ID NO: 4220849 - RNA, 14 nt, Yersinia pestis KIM
uaauaucaaugagu

SEQ ID NO: 4220850 - RNA, 14 nt, Yersinia pestis KIM
uaauaucaaugaug

SEQ ID NO: 4220851 - RNA, 13 nt, Yersinia pestis KIM
uaauaucagcgau

SEQ ID NO: 4220852 - RNA, 18 nt, Yersinia pestis KIM
uaauaucagucgcuuuuu

SEQ ID NO: 4220853 - RNA, 20 nt, Yersinia pestis KIM
uaauauccaaccaaccaugc

SEQ ID NO: 4220854 - RNA, 22 nt, Yersinia pestis KIM
uaauaucggcaaauuaaauuau

SEQ ID NO: 4220855 - RNA, 16 nt, Yersinia pestis KIM
uaauaucgguaaaaaa

SEQ ID NO: 4220856 - RNA, 11 nt, Yersinia pestis KIM
uaauaucugcc

SEQ ID NO: 4220857 - RNA, 22 nt, Yersinia pestis KIM
uaauaugcaaaaaaagacacua

SEQ ID NO: 4220858 - RNA, 19 nt, Yersinia pestis KIM
uaauaugcacgucauuuuu

SEQ ID NO: 4220859 - RNA, 15 nt, Yersinia pestis KIM
uaauauugaauaacc

SEQ ID NO: 4220860 - RNA, 14 nt, Yersinia pestis KIM
uaauauugccgcag

SEQ ID NO: 4220861 - RNA, 17 nt, Yersinia pestis KIM
uaauauuuucagcccua

SEQ ID NO: 4220862 - RNA, 17 nt, Yersinia pestis KIM
uaaucaacgcucaauca

SEQ ID NO: 4220863 - RNA, 20 nt, Yersinia pestis KIM
uaaucaauccuacauucagu

SEQ ID NO: 4220864 - RNA, 21 nt, Yersinia pestis KIM
uaaucaauccuacauucagua

SEQ ID NO: 4220865 - RNA, 15 nt, Yersinia pestis KIM
uaaucaccauuaaua

SEQ ID NO: 4220866 - RNA, 20 nt, Yersinia pestis KIM
uaauuggcccauaacaauua

SEQ ID NO: 4220867 - RNA, 16 nt, Yersinia pestis KIM
uaauuggguucaucau

SEQ ID NO: 4220868 - RNA, 20 nt, Yersinia pestis KIM
uaauuuaaacaaccaaaaau

SEQ ID NO: 4220869 - RNA, 11 nt, Yersinia pestis KIM
uaauuuaaacu

SEQ ID NO: 4220870 - RNA, 21 nt, Yersinia pestis KIM
uaauuuacugguaccaaauaa

SEQ ID NO: 4220871 - RNA, 23 nt, Yersinia pestis KIM
uaauuuacugguaccaaauaaca

SEQ ID NO: 4220872 - RNA, 22 nt, Yersinia pestis KIM
uaauuuagcaaagcgauaucgu

SEQ ID NO: 4220873 - RNA, 22 nt, Yersinia pestis KIM
uaauuuauacauaucagaacag

SEQ ID NO: 4220874 - RNA, 14 nt, Yersinia pestis KIM
uaauuuaucugcua

SEQ ID NO: 4220875 - RNA, 23 nt, Yersinia pestis KIM
uaauuuaucugcuaauuaaaccu

SEQ ID NO: 4220876 - RNA, 22 nt, Yersinia pestis KIM
uaauuucaccacaucuugcauc

SEQ ID NO: 4220877 - RNA, 18 nt, Yersinia pestis KIM
uaauuucagauaaaaaua

SEQ ID NO: 4220878 - RNA, 19 nt, Yersinia pestis KIM
uaauuucggaucagcgccu

SEQ ID NO: 4220879 - RNA, 21 nt, Yersinia pestis KIM
uaauuucuacgccgucaucau

SEQ ID NO: 4220880 - RNA, 12 nt, Yersinia pestis KIM
uaauuugccugg

SEQ ID NO: 4220881 - RNA, 16 nt, Yersinia pestis KIM
uaauuugcuuuaaaua

SEQ ID NO: 4220882 - RNA, 18 nt, Yersinia pestis KIM
uaauuugcuuuaaauaac

SEQ ID NO: 4220883 - RNA, 9 nt, Yersinia pestis KIM
uaauuugua

SEQ ID NO: 4220884 - RNA, 12 nt, Yersinia pestis KIM
uaauuuguaaau

SEQ ID NO: 4220885 - RNA, 14 nt, Yersinia pestis KIM
uaauuuguaaauuu

SEQ ID NO: 4220886 - RNA, 14 nt, Yersinia pestis KIM
uaauuugucaguaa

SEQ ID NO: 4220887 - RNA, 15 nt, Yersinia pestis KIM
uaauuuuauuaccaa

SEQ ID NO: 4220888 - RNA, 21 nt, Yersinia pestis KIM
uaauuuucgcgcaccaacucu

SEQ ID NO: 4220889 - RNA, 19 nt, Yersinia pestis KIM
uacaaaaagcgacuaauau

SEQ ID NO: 4220890 - RNA, 21 nt, Yersinia pestis KIM
uacaaacagggcagccaauua

SEQ ID NO: 4220891 - RNA, 22 nt, Yersinia pestis KIM
uacaaacgcguuaauuaagacc

SEQ ID NO: 4220892 - RNA, 13 nt, Yersinia pestis KIM
uacaaauaaaaua

SEQ ID NO: 4220893 - RNA, 15 nt, Yersinia pestis KIM
uacaaauagcgcugc

SEQ ID NO: 4220894 - RNA, 16 nt, Yersinia pestis KIM
uacaacaagaucccaa

SEQ ID NO: 4220895 - RNA, 13 nt, Yersinia pestis KIM
uacaacaauaaua

SEQ ID NO: 4220896 - RNA, 14 nt, Yersinia pestis KIM
uacaacaauaauaa

SEQ ID NO: 4220897 - RNA, 16 nt, Yersinia pestis KIM
uacaaccacugaacac

SEQ ID NO: 4220898 - RNA, 19 nt, Yersinia pestis KIM
uacaacgguuuaugcccag

SEQ ID NO: 4220899 - RNA, 17 nt, Yersinia pestis KIM
uacaacuucuucauaac

SEQ ID NO: 4220900 - RNA, 15 nt, Yersinia pestis KIM
uacaagacaagcccg

SEQ ID NO: 4220901 - RNA, 13 nt, Yersinia pestis KIM
uacaagacaauau

SEQ ID NO: 4220902 - RNA, 18 nt, Yersinia pestis KIM
uacaagacaauauguuua

SEQ ID NO: 4220903 - RNA, 18 nt, Yersinia pestis KIM
uacaagcacucaauguca

SEQ ID NO: 4220904 - RNA, 15 nt, Yersinia pestis KIM
uacaauaaaucaauu

SEQ ID NO: 4220905 - RNA, 17 nt, Yersinia pestis KIM
uacaauagagaauagac

SEQ ID NO: 4220906 - RNA, 13 nt, Yersinia pestis KIM
uacaauaugggua

SEQ ID NO: 4220907 - RNA, 18 nt, Yersinia pestis KIM
uacaauccaaccuauaua

SEQ ID NO: 4220908 - RNA, 23 nt, Yersinia pestis KIM
uacaauuuuuggucguauucaua

SEQ ID NO: 4220909 - RNA, 23 nt, Yersinia pestis KIM
uacacacccucaacucaaaacaa

SEQ ID NO: 4220910 - RNA, 23 nt, Yersinia pestis KIM
uacacagcacggcaacaggcuuu

SEQ ID NO: 4220911 - RNA, 13 nt, Yersinia pestis KIM
uacacagucuuuu

SEQ ID NO: 4220912 - RNA, 16 nt, Yersinia pestis KIM
uacacagucuuuuucc

SEQ ID NO: 4220913 - RNA, 18 nt, Yersinia pestis KIM
uacacagucuuuuuccca

SEQ ID NO: 4220914 - RNA, 15 nt, Yersinia pestis KIM
uacacaugaaaauca

SEQ ID NO: 4220915 - RNA, 16 nt, Yersinia pestis KIM
uacacaugaaaaucaa

SEQ ID NO: 4220916 - RNA, 22 nt, Yersinia pestis KIM
uacaccaccgccgcaacaauaa

SEQ ID NO: 4220917 - RNA, 17 nt, Yersinia pestis KIM
uacaccagacucugcua

SEQ ID NO: 4220918 - RNA, 14 nt, Yersinia pestis KIM
uacaccauguucuu

SEQ ID NO: 4220919 - RNA, 18 nt, Yersinia pestis KIM
uacaccauuuccaggcua

SEQ ID NO: 4220920 - RNA, 14 nt, Yersinia pestis KIM
uacaccccaucagc

SEQ ID NO: 4220921 - RNA, 19 nt, Yersinia pestis KIM
uacacccgaaggccauugc

SEQ ID NO: 4220922 - RNA, 13 nt, Yersinia pestis KIM
uacacccgcuugc

SEQ ID NO: 4220923 - RNA, 22 nt, Yersinia pestis KIM
uacaccgauaaaagugaccaca

SEQ ID NO: 4220924 - RNA, 23 nt, Yersinia pestis KIM
uacaccuccaaaugucagggggu

SEQ ID NO: 4220925 - RNA, 14 nt, Yersinia pestis KIM
uacaccuuaaaaca

SEQ ID NO: 4220926 - RNA, 23 nt, Yersinia pestis KIM
uacaccuugcagcacaccggcca

SEQ ID NO: 4220927 - RNA, 14 nt, Yersinia pestis KIM
uacacuauuuuacc

SEQ ID NO: 4220928 - RNA, 22 nt, Yersinia pestis KIM
uacacuuucuuugaugcauaug

SEQ ID NO: 4220929 - RNA, 14 nt, Yersinia pestis KIM
uacagacuggccaa

SEQ ID NO: 4220930 - RNA, 21 nt, Yersinia pestis KIM
uacagagcaaaaagccagcga

SEQ ID NO: 4220931 - RNA, 20 nt, Yersinia pestis KIM
uacagauauauccaggcacu

SEQ ID NO: 4220932 - RNA, 13 nt, Yersinia pestis KIM
uacagaucauuag

SEQ ID NO: 4220933 - RNA, 18 nt, Yersinia pestis KIM
uacagcaaacaucgguaa

SEQ ID NO: 4220934 - RNA, 23 nt, Yersinia pestis KIM
uacagcaaacaucgguaaaucgc

SEQ ID NO: 4220935 - RNA, 17 nt, Yersinia pestis KIM
uacagcaaauagguuuu

SEQ ID NO: 4220936 - RNA, 13 nt, Yersinia pestis KIM
uacagcaaggcag

SEQ ID NO: 4220937 - RNA, 15 nt, Yersinia pestis KIM
uacagcaaggcagca

SEQ ID NO: 4220938 - RNA, 12 nt, Yersinia pestis KIM
uacagcaccauu

SEQ ID NO: 4220939 - RNA, 14 nt, Yersinia pestis KIM
uacagcaccauuca

SEQ ID NO: 4220940 - RNA, 22 nt, Yersinia pestis KIM
uacagcaccauucaauguaaaa

SEQ ID NO: 4220941 - RNA, 23 nt, Yersinia pestis KIM
uacagcagguggcugaggccagc

SEQ ID NO: 4220942 - RNA, 17 nt, Yersinia pestis KIM
uacagcccaagagaaau

SEQ ID NO: 4220943 - RNA, 19 nt, Yersinia pestis KIM
uacagcccgguaucaccuu

SEQ ID NO: 4220944 - RNA, 22 nt, Yersinia pestis KIM
uacagccgcccccuuucuuauc

SEQ ID NO: 4220945 - RNA, 20 nt, Yersinia pestis KIM
uacagccggauaggcuuaau

SEQ ID NO: 4220946 - RNA, 15 nt, Yersinia pestis KIM
uacagcgucaguaca

SEQ ID NO: 4220947 - RNA, 18 nt, Yersinia pestis KIM
uacaggauuaaauaaaga

SEQ ID NO: 4220948 - RNA, 17 nt, Yersinia pestis KIM
uacaggccccaauccac

SEQ ID NO: 4220949 - RNA, 14 nt, Yersinia pestis KIM
uacaggccccuucu

SEQ ID NO: 4220950 - RNA, 21 nt, Yersinia pestis KIM
uacaggccgcuuccgauaacc

SEQ ID NO: 4220951 - RNA, 23 nt, Yersinia pestis KIM
uacaggcucuaucucuucagggc

SEQ ID NO: 4220952 - RNA, 15 nt, Yersinia pestis KIM
uacagggaagccggc

SEQ ID NO: 4220953 - RNA, 18 nt, Yersinia pestis KIM
uacaggggcguuauucuc

SEQ ID NO: 4220954 - RNA, 21 nt, Yersinia pestis KIM
uacagguguaccgcuucgcgc

SEQ ID NO: 4220955 - RNA, 21 nt, Yersinia pestis KIM
uacagguguugaguaacgcca

SEQ ID NO: 4220956 - RNA, 18 nt, Yersinia pestis KIM
uacaguaaggcagcaagu

SEQ ID NO: 4220957 - RNA, 13 nt, Yersinia pestis KIM
uacaguaagguau

SEQ ID NO: 4220958 - RNA, 21 nt, Yersinia pestis KIM
uacagucccugugcgcccacg

SEQ ID NO: 4220959 - RNA, 15 nt, Yersinia pestis KIM
uacagugauaaauuu

SEQ ID NO: 4220960 - RNA, 19 nt, Yersinia pestis KIM
uacaguuccuguuuuugaa

SEQ ID NO: 4220961 - RNA, 15 nt, Yersinia pestis KIM
uacauaaaaauagcu

SEQ ID NO: 4220962 - RNA, 14 nt, Yersinia pestis KIM
uacauaaaaucaau

SEQ ID NO: 4220963 - RNA, 23 nt, Yersinia pestis KIM
uacauaaaccgugugcuuccacc

SEQ ID NO: 4220964 - RNA, 22 nt, Yersinia pestis KIM
uacauaaucuuuacugcauuga

SEQ ID NO: 4220965 - RNA, 22 nt, Yersinia pestis KIM
uacauaccacuuaguggcauug

SEQ ID NO: 4220966 - RNA, 15 nt, Yersinia pestis KIM
uacauagaaaauaau

SEQ ID NO: 4220967 - RNA, 16 nt, Yersinia pestis KIM
uacauagaagcucaua

SEQ ID NO: 4220968 - RNA, 22 nt, Yersinia pestis KIM
uacauagaagcucauaugcagc

SEQ ID NO: 4220969 - RNA, 15 nt, Yersinia pestis KIM
uacauagauguauuu

SEQ ID NO: 4220970 - RNA, 16 nt, Yersinia pestis KIM
uacauauaaccaucaa

SEQ ID NO: 4220971 - RNA, 22 nt, Yersinia pestis KIM
uacauauaauccaaaauaauau

SEQ ID NO: 4220972 - RNA, 18 nt, Yersinia pestis KIM
uacauauaggaaaugucg

SEQ ID NO: 4220973 - RNA, 14 nt, Yersinia pestis KIM
uacauauaucacua

SEQ ID NO: 4220974 - RNA, 18 nt, Yersinia pestis KIM
uacauauaucacuauuuc

SEQ ID NO: 4220975 - RNA, 22 nt, Yersinia pestis KIM
uacauaucuuuauuaucaaugg

SEQ ID NO: 4220976 - RNA, 13 nt, Yersinia pestis KIM
uacaucaggguga

SEQ ID NO: 4220977 - RNA, 22 nt, Yersinia pestis KIM
uacaucagggugaccgcacugc

SEQ ID NO: 4220978 - RNA, 14 nt, Yersinia pestis KIM
uacaucaucuucua

SEQ ID NO: 4220979 - RNA, 13 nt, Yersinia pestis KIM
uacauccuaaaua

SEQ ID NO: 4220980 - RNA, 21 nt, Yersinia pestis KIM
uaccuucaggccuuuacuguu

SEQ ID NO: 4220981 - RNA, 15 nt, Yersinia pestis KIM
uaccuugugucacca

SEQ ID NO: 4220982 - RNA, 18 nt, Yersinia pestis KIM
uaccuuuaacuguuuuau

SEQ ID NO: 4220983 - RNA, 17 nt, Yersinia pestis KIM
uaccuuuacggccgcua

SEQ ID NO: 4220984 - RNA, 20 nt, Yersinia pestis KIM
uaccuuuugcauauuucucu

SEQ ID NO: 4220985 - RNA, 22 nt, Yersinia pestis KIM
uaccuuuugcauauuucucuuu

SEQ ID NO: 4220986 - RNA, 19 nt, Yersinia pestis KIM
uacgaacaguagccccuga

SEQ ID NO: 4220987 - RNA, 22 nt, Yersinia pestis KIM
uacgacaauccuaucguuuauu

SEQ ID NO: 4220988 - RNA, 16 nt, Yersinia pestis KIM
uacgaccgucaccaaa

SEQ ID NO: 4220989 - RNA, 13 nt, Yersinia pestis KIM
uacgacgcccgca

SEQ ID NO: 4220990 - RNA, 20 nt, Yersinia pestis KIM
uacgagagaucguaggcuug

SEQ ID NO: 4220991 - RNA, 20 nt, Yersinia pestis KIM
uacgagagaucguaggcuuu

SEQ ID NO: 4220992 - RNA, 13 nt, Yersinia pestis KIM
uacgauaacgcuc

SEQ ID NO: 4220993 - RNA, 20 nt, Yersinia pestis KIM
uacgaucugccuguucucuc

SEQ ID NO: 4220994 - RNA, 15 nt, Yersinia pestis KIM
uacgaucuuauuaau

SEQ ID NO: 4220995 - RNA, 22 nt, Yersinia pestis KIM
uacgaucuuauuaauugguauu

SEQ ID NO: 4220996 - RNA, 23 nt, Yersinia pestis KIM
uacgcaacguaauaucugccacc

SEQ ID NO: 4220997 - RNA, 12 nt, Yersinia pestis KIM
uacgcaggcggu

SEQ ID NO: 4220998 - RNA, 11 nt, Yersinia pestis KIM
uacgccagcag

SEQ ID NO: 4220999 - RNA, 15 nt, Yersinia pestis KIM
uacgccauccacuca

SEQ ID NO: 4221000 - RNA, 23 nt, Yersinia pestis KIM
uacgcgauauucgcgcccaaaug

SEQ ID NO: 4221001 - RNA, 21 nt, Yersinia pestis KIM
uacgcgucaucauauucaaug

SEQ ID NO: 4221002 - RNA, 23 nt, Yersinia pestis KIM
uacgcuguaugccgcucaaggag

SEQ ID NO: 4221003 - RNA, 14 nt, Yersinia pestis KIM
uacggagaagagga

SEQ ID NO: 4221004 - RNA, 23 nt, Yersinia pestis KIM
uacggaucuccaguugcacacca

SEQ ID NO: 4221005 - RNA, 18 nt, Yersinia pestis KIM
uacggccccagcccagca

SEQ ID NO: 4221006 - RNA, 20 nt, Yersinia pestis KIM
uacggcgaaauauaaaacag

SEQ ID NO: 4221007 - RNA, 20 nt, Yersinia pestis KIM
uacggcgacuugccguggcu

SEQ ID NO: 4221008 - RNA, 21 nt, Yersinia pestis KIM
uacggcggcuacugguagcag

SEQ ID NO: 4221009 - RNA, 20 nt, Yersinia pestis KIM
uacggcugcgcgacaaaacc

SEQ ID NO: 4221010 - RNA, 23 nt, Yersinia pestis KIM
uacgggccucgcggaaaucagcu

SEQ ID NO: 4221011 - RNA, 17 nt, Yersinia pestis KIM
uacgggcggcauaaucc

SEQ ID NO: 4221012 - RNA, 18 nt, Yersinia pestis KIM
uacgggugugcugggugu

SEQ ID NO: 4221013 - RNA, 14 nt, Yersinia pestis KIM
uacgguaauaaaca

SEQ ID NO: 4221014 - RNA, 19 nt, Yersinia pestis KIM
uacgguaauaaacagacaa

SEQ ID NO: 4221015 - RNA, 17 nt, Yersinia pestis KIM
uacgguaccgcagguca

SEQ ID NO: 4221016 - RNA, 18 nt, Yersinia pestis KIM
uacgguagcgauauccuu

SEQ ID NO: 4221017 - RNA, 12 nt, Yersinia pestis KIM
uacggucacuga

SEQ ID NO: 4221018 - RNA, 16 nt, Yersinia pestis KIM
uacgguccauaaaauc

SEQ ID NO: 4221019 - RNA, 16 nt, Yersinia pestis KIM
uacggugccagcagca

SEQ ID NO: 4221020 - RNA, 17 nt, Yersinia pestis KIM
uacggugccagcagcaa

SEQ ID NO: 4221021 - RNA, 19 nt, Yersinia pestis KIM
uacgguucacuagccugag

SEQ ID NO: 4221022 - RNA, 15 nt, Yersinia pestis KIM
uacguaaauuuauuu

SEQ ID NO: 4221023 - RNA, 12 nt, Yersinia pestis KIM
uacguaauuuac

SEQ ID NO: 4221024 - RNA, 18 nt, Yersinia pestis KIM
uacgucagaaauaaauuc

SEQ ID NO: 4221025 - RNA, 22 nt, Yersinia pestis KIM
uacgugacggcagcgagcacug

SEQ ID NO: 4221026 - RNA, 22 nt, Yersinia pestis KIM
uacgugacggcggcgagcacug

SEQ ID NO: 4221027 - RNA, 15 nt, Yersinia pestis KIM
uacgugaucaucuuu

SEQ ID NO: 4221028 - RNA, 13 nt, Yersinia pestis KIM
uacguuguaccag

SEQ ID NO: 4221029 - RNA, 14 nt, Yersinia pestis KIM
uacuaaaauaucac

SEQ ID NO: 4221030 - RNA, 21 nt, Yersinia pestis KIM
uacuaaacccggugguugaac

SEQ ID NO: 4221031 - RNA, 17 nt, Yersinia pestis KIM
uacuaaauuagaaaaca

SEQ ID NO: 4221032 - RNA, 13 nt, Yersinia pestis KIM
uacuaauuucuaa

SEQ ID NO: 4221033 - RNA, 20 nt, Yersinia pestis KIM
uacuaugauagauuaaucga

SEQ ID NO: 4221034 - RNA, 22 nt, Yersinia pestis KIM
uacuaugauagauuaaucgaaa

SEQ ID NO: 4221035 - RNA, 13 nt, Yersinia pestis KIM
uacuauuuucauu

SEQ ID NO: 4221036 - RNA, 17 nt, Yersinia pestis KIM
uacuauuuucauuguuc

SEQ ID NO: 4221037 - RNA, 18 nt, Yersinia pestis KIM
uacucaaaaauggcaaca

SEQ ID NO: 4221038 - RNA, 21 nt, Yersinia pestis KIM
uacucaauaugcaguuuuccu

SEQ ID NO: 4221039 - RNA, 15 nt, Yersinia pestis KIM
uacucagcauccucc

SEQ ID NO: 4221040 - RNA, 19 nt, Yersinia pestis KIM
uacucauauuguccaaagg

SEQ ID NO: 4221041 - RNA, 22 nt, Yersinia pestis KIM
uacucauauuguccaaaggaag

SEQ ID NO: 4221042 - RNA, 19 nt, Yersinia pestis KIM
uacuccauuugaacugugg

SEQ ID NO: 4221043 - RNA, 23 nt, Yersinia pestis KIM
uacuccccaaagccuacgagaga

SEQ ID NO: 4221044 - RNA, 14 nt, Yersinia pestis KIM
uacuccucugccua

SEQ ID NO: 4221045 - RNA, 11 nt, Yersinia pestis KIM
uacuccugcuc

SEQ ID NO: 4221046 - RNA, 22 nt, Yersinia pestis KIM
uacucgagcguauugccuucuc

SEQ ID NO: 4221047 - RNA, 13 nt, Yersinia pestis KIM
uacucggcauugc

SEQ ID NO: 4221048 - RNA, 20 nt, Yersinia pestis KIM
uacucgguccaucugaaauu

SEQ ID NO: 4221049 - RNA, 15 nt, Yersinia pestis KIM
uacucuauugcucau

SEQ ID NO: 4221050 - RNA, 14 nt, Yersinia pestis KIM
uacucucuauugau

SEQ ID NO: 4221051 - RNA, 14 nt, Yersinia pestis KIM
uacucucuguuuug

SEQ ID NO: 4221052 - RNA, 17 nt, Yersinia pestis KIM
uacucuguguagugggg

SEQ ID NO: 4221053 - RNA, 13 nt, Yersinia pestis KIM
uacugaagguuau

SEQ ID NO: 4221054 - RNA, 21 nt, Yersinia pestis KIM
uacugaauaagguucuuucau

SEQ ID NO: 4221055 - RNA, 23 nt, Yersinia pestis KIM
uacugacacuuucgauagucagc

SEQ ID NO: 4221056 - RNA, 17 nt, Yersinia pestis KIM
uacugaccguaccuauc

SEQ ID NO: 4221057 - RNA, 19 nt, Yersinia pestis KIM
uacugaucucaucaaacac

SEQ ID NO: 4221058 - RNA, 19 nt, Yersinia pestis KIM
uacugaugaagccgccgga

SEQ ID NO: 4221059 - RNA, 20 nt, Yersinia pestis KIM
uacugcaagccguaauucag

SEQ ID NO: 4221060 - RNA, 22 nt, Yersinia pestis KIM
uacugcauugagacccguuacu

SEQ ID NO: 4221061 - RNA, 14 nt, Yersinia pestis KIM
uacugccaaccacc

SEQ ID NO: 4221062 - RNA, 14 nt, Yersinia pestis KIM
uacugcccgucguu

SEQ ID NO: 4221063 - RNA, 18 nt, Yersinia pestis KIM
uacugcgguccuacccuu

SEQ ID NO: 4221064 - RNA, 16 nt, Yersinia pestis KIM
uacugcguucuucuug

SEQ ID NO: 4221065 - RNA, 14 nt, Yersinia pestis KIM
uacugcucgcccaa

SEQ ID NO: 4221066 - RNA, 16 nt, Yersinia pestis KIM
uacugcucuaucucuu

SEQ ID NO: 4221067 - RNA, 15 nt, Yersinia pestis KIM
uacugcuuaccuugu

SEQ ID NO: 4221068 - RNA, 13 nt, Yersinia pestis KIM
uacugcuuuucua

SEQ ID NO: 4221069 - RNA, 15 nt, Yersinia pestis KIM
uacuggcaguaaaac

SEQ ID NO: 4221070 - RNA, 23 nt, Yersinia pestis KIM
uacuggcauacagcucaucacca

SEQ ID NO: 4221071 - RNA, 18 nt, Yersinia pestis KIM
uacuggcuaucuuaugac

SEQ ID NO: 4221072 - RNA, 18 nt, Yersinia pestis KIM
uacugucgauaauaaauu

SEQ ID NO: 4221073 - RNA, 15 nt, Yersinia pestis KIM
uacugucuuuuuugg

SEQ ID NO: 4221074 - RNA, 22 nt, Yersinia pestis KIM
uacuguuaccgcgcuugcauca

SEQ ID NO: 4221075 - RNA, 14 nt, Yersinia pestis KIM
uacuguuaguucag

SEQ ID NO: 4221076 - RNA, 16 nt, Yersinia pestis KIM
uacuguuccggcgcga

SEQ ID NO: 4221077 - RNA, 18 nt, Yersinia pestis KIM
uacuguuggcaauuucac

SEQ ID NO: 4221078 - RNA, 17 nt, Yersinia pestis KIM
uacuguuuggucgccau

SEQ ID NO: 4221079 - RNA, 14 nt, Yersinia pestis KIM
uacuguuuucauua

SEQ ID NO: 4221080 - RNA, 16 nt, Yersinia pestis KIM
uacuuagcaauaauag

SEQ ID NO: 4221081 - RNA, 14 nt, Yersinia pestis KIM
uacuuauaaacacu

SEQ ID NO: 4221082 - RNA, 14 nt, Yersinia pestis KIM
uacuucuuacggug

SEQ ID NO: 4221083 - RNA, 15 nt, Yersinia pestis KIM
uacuugauggcuguu

SEQ ID NO: 4221084 - RNA, 12 nt, Yersinia pestis KIM
uacuuuaaauuu

SEQ ID NO: 4221085 - RNA, 15 nt, Yersinia pestis KIM
uacuuuauuuaaaau

SEQ ID NO: 4221086 - RNA, 23 nt, Yersinia pestis KIM
uacuuuauuuaaaauuaauaguu

SEQ ID NO: 4221087 - RNA, 23 nt, Yersinia pestis KIM
uacuuuauuuuaauggagcaaga

SEQ ID NO: 4221088 - RNA, 22 nt, Yersinia pestis KIM
uacuuucccauagcuggcuuca

SEQ ID NO: 4221089 - RNA, 14 nt, Yersinia pestis KIM
uacuuuccugcugc

SEQ ID NO: 4221090 - RNA, 16 nt, Yersinia pestis KIM
uacuuucggguaucug

SEQ ID NO: 4221091 - RNA, 17 nt, Yersinia pestis KIM
uacuuuggguauccucu

SEQ ID NO: 4221092 - RNA, 18 nt, Yersinia pestis KIM
uacuuugucaauagccua

SEQ ID NO: 4221093 - RNA, 19 nt, Yersinia pestis KIM
uacuuuucauuuccucugg

SEQ ID NO: 4221094 - RNA, 14 nt, Yersinia pestis KIM
uagcgauagaguug

SEQ ID NO: 4221095 - RNA, 15 nt, Yersinia pestis KIM
uagcgaugacugagu

SEQ ID NO: 4221096 - RNA, 19 nt, Yersinia pestis KIM
uagcgaugacugaguauga

SEQ ID NO: 4221097 - RNA, 14 nt, Yersinia pestis KIM
uagcgcaauucagc

SEQ ID NO: 4221098 - RNA, 14 nt, Yersinia pestis KIM
uagcgcauccaacc

SEQ ID NO: 4221099 - RNA, 12 nt, Yersinia pestis KIM
uagcgccagcaa

SEQ ID NO: 4221100 - RNA, 22 nt, Yersinia pestis KIM
uagcgccgauggugugcagcaa

SEQ ID NO: 4221101 - RNA, 13 nt, Yersinia pestis KIM
uagcgccuuuuuu

SEQ ID NO: 4221102 - RNA, 22 nt, Yersinia pestis KIM
uagcgccuuuuuuauaauaaug

SEQ ID NO: 4221103 - RNA, 23 nt, Yersinia pestis KIM
uagcgcgggugaucgucaucagc

SEQ ID NO: 4221104 - RNA, 16 nt, Yersinia pestis KIM
uagcgcugcaucagca

SEQ ID NO: 4221105 - RNA, 18 nt, Yersinia pestis KIM
uagcgcugcaucagcagu

SEQ ID NO: 4221106 - RNA, 17 nt, Yersinia pestis KIM
uagcgcugcaucugguc

SEQ ID NO: 4221107 - RNA, 15 nt, Yersinia pestis KIM
uagcgcuucagugau

SEQ ID NO: 4221108 - RNA, 22 nt, Yersinia pestis KIM
uagcgcuuuuacaucaaccccu

SEQ ID NO: 4221109 - RNA, 14 nt, Yersinia pestis KIM
uagcggcaacgauc

SEQ ID NO: 4221110 - RNA, 16 nt, Yersinia pestis KIM
uagcggcguucagcaa

SEQ ID NO: 4221111 - RNA, 22 nt, Yersinia pestis KIM
uagcgguguuagcccaaggcga

SEQ ID NO: 4221112 - RNA, 15 nt, Yersinia pestis KIM
uagcuaacaccgcug

SEQ ID NO: 4221113 - RNA, 14 nt, Yersinia pestis KIM
uagcuaaccuuaac

SEQ ID NO: 4221114 - RNA, 17 nt, Yersinia pestis KIM
uagcuacagcaccauua

SEQ ID NO: 4221115 - RNA, 13 nt, Yersinia pestis KIM
uagcucaagggca

SEQ ID NO: 4221116 - RNA, 17 nt, Yersinia pestis KIM
uagcucaauuugguauu

SEQ ID NO: 4221117 - RNA, 15 nt, Yersinia pestis KIM
uagcucgcuacgccu

SEQ ID NO: 4221118 - RNA, 15 nt, Yersinia pestis KIM
uagcucgcucaacau

SEQ ID NO: 4221119 - RNA, 16 nt, Yersinia pestis KIM
uagcucgcuguggcua

SEQ ID NO: 4221120 - RNA, 12 nt, Yersinia pestis KIM
uagcucuucacg

SEQ ID NO: 4221121 - RNA, 18 nt, Yersinia pestis KIM
uagcugcgcccgguuacu

SEQ ID NO: 4221122 - RNA, 18 nt, Yersinia pestis KIM
uagcuggcggauaaaaau

SEQ ID NO: 4221123 - RNA, 21 nt, Yersinia pestis KIM
uagcuggcuucaaaaucaccu

SEQ ID NO: 4221124 - RNA, 17 nt, Yersinia pestis KIM
uagcugucguaauaguu

SEQ ID NO: 4221125 - RNA, 22 nt, Yersinia pestis KIM
uagcuuauccccugagaaacau

SEQ ID NO: 4221126 - RNA, 23 nt, Yersinia pestis KIM
uagcuuauccccugagaaacauc

SEQ ID NO: 4221127 - RNA, 15 nt, Yersinia pestis KIM
uaggacggugccaug

SEQ ID NO: 4221128 - RNA, 17 nt, Yersinia pestis KIM
uaggagaacagcggcuu

SEQ ID NO: 4221129 - RNA, 21 nt, Yersinia pestis KIM
uaggcaaccuuggugaagauc

SEQ ID NO: 4221130 - RNA, 15 nt, Yersinia pestis KIM
uaggcagaauaguca

SEQ ID NO: 4221131 - RNA, 21 nt, Yersinia pestis KIM
uaggccaauagaaaaacacug

SEQ ID NO: 4221132 - RNA, 14 nt, Yersinia pestis KIM
uaggccacuagcca

SEQ ID NO: 4221133 - RNA, 23 nt, Yersinia pestis KIM
uaggccagacccggcaaauaaau

SEQ ID NO: 4221134 - RNA, 22 nt, Yersinia pestis KIM
uaggcccacaaucaagcccgca

SEQ ID NO: 4221135 - RNA, 21 nt, Yersinia pestis KIM
uaggcccgaugguuucuccac

SEQ ID NO: 4221136 - RNA, 12 nt, Yersinia pestis KIM
uaggccgcauuu

SEQ ID NO: 4221137 - RNA, 15 nt, Yersinia pestis KIM
uaggccuaaacccca

SEQ ID NO: 4221138 - RNA, 18 nt, Yersinia pestis KIM
uaggccuaaaccccacag

SEQ ID NO: 4221139 - RNA, 20 nt, Yersinia pestis KIM
uaggcgaaauugacuuuaaa

SEQ ID NO: 4221140 - RNA, 15 nt, Yersinia pestis KIM
uaggcgcagcagggc

SEQ ID NO: 4221141 - RNA, 22 nt, Yersinia pestis KIM
uaggcguagguuucagccucug

SEQ ID NO: 4221142 - RNA, 16 nt, Yersinia pestis KIM
uaggcuauugacaaag

SEQ ID NO: 4221143 - RNA, 16 nt, Yersinia pestis KIM
uaggcucagcauggaa

SEQ ID NO: 4221144 - RNA, 14 nt, Yersinia pestis KIM
uaggcucgagccgc

SEQ ID NO: 4221145 - RNA, 22 nt, Yersinia pestis KIM
uaggcucgagccgcgccauccu

SEQ ID NO: 4221146 - RNA, 15 nt, Yersinia pestis KIM
uaggcuucuaacaau

SEQ ID NO: 4221147 - RNA, 18 nt, Yersinia pestis KIM
uaggcuugaaguucucau

SEQ ID NO: 4221148 - RNA, 18 nt, Yersinia pestis KIM
uagggaagguguuuaaaa

SEQ ID NO: 4221149 - RNA, 20 nt, Yersinia pestis KIM
uagggagagucuauuauauu

SEQ ID NO: 4221150 - RNA, 12 nt, Yersinia pestis KIM
uagggagccaau

SEQ ID NO: 4221151 - RNA, 20 nt, Yersinia pestis KIM
uagggagccaauagaggcuc

SEQ ID NO: 4221152 - RNA, 19 nt, Yersinia pestis KIM
uagggauuuaugcaaauaa

SEQ ID NO: 4221153 - RNA, 21 nt, Yersinia pestis KIM
uaggggccaccaaauaaaaca

SEQ ID NO: 4221154 - RNA, 22 nt, Yersinia pestis KIM
uaggggccaccaaauaaaacaa

SEQ ID NO: 4221155 - RNA, 17 nt, Yersinia pestis KIM
uaggguaaguccaucag

SEQ ID NO: 4221156 - RNA, 13 nt, Yersinia pestis KIM
uaggguugugugg

SEQ ID NO: 4221157 - RNA, 20 nt, Yersinia pestis KIM
uaggguuguuggucagcaga

SEQ ID NO: 4221158 - RNA, 16 nt, Yersinia pestis KIM
uagguaauaccaaugc

SEQ ID NO: 4221159 - RNA, 13 nt, Yersinia pestis KIM
uaggucagugguu

SEQ ID NO: 4221160 - RNA, 17 nt, Yersinia pestis KIM
uaggucagugguuuuau

SEQ ID NO: 4221161 - RNA, 17 nt, Yersinia pestis KIM
uaggucaucccagcaca

SEQ ID NO: 4221162 - RNA, 19 nt, Yersinia pestis KIM
uaggugguaccugcacuga

SEQ ID NO: 4221163 - RNA, 14 nt, Yersinia pestis KIM
uagguuauaagcca

SEQ ID NO: 4221164 - RNA, 13 nt, Yersinia pestis KIM
uagguuucugggc

SEQ ID NO: 4221165 - RNA, 15 nt, Yersinia pestis KIM
uaguaaacaguuuca

SEQ ID NO: 4221166 - RNA, 20 nt, Yersinia pestis KIM
uaguaaacuuaucgaucucc

SEQ ID NO: 4221167 - RNA, 18 nt, Yersinia pestis KIM
uaguaacaaaaugcggug

SEQ ID NO: 4221168 - RNA, 14 nt, Yersinia pestis KIM
uaguaacaccagca

SEQ ID NO: 4221169 - RNA, 23 nt, Yersinia pestis KIM
uaguacguagcgauaacagauau

SEQ ID NO: 4221170 - RNA, 17 nt, Yersinia pestis KIM
uaguaguaauagauugu

SEQ ID NO: 4221171 - RNA, 21 nt, Yersinia pestis KIM
uaguauugcggaauggcaacg

SEQ ID NO: 4221172 - RNA, 17 nt, Yersinia pestis KIM
uagucaaaacaauaucu

SEQ ID NO: 4221173 - RNA, 20 nt, Yersinia pestis KIM
uagucacgggguguguggca

SEQ ID NO: 4221174 - RNA, 16 nt, Yersinia pestis KIM
uagucacucaagccag

SEQ ID NO: 4221175 - RNA, 19 nt, Yersinia pestis KIM
uagucauagugauaaaaag

SEQ ID NO: 4221176 - RNA, 16 nt, Yersinia pestis KIM
uagucucuugggcagc

SEQ ID NO: 4221177 - RNA, 19 nt, Yersinia pestis KIM
uagucuguuaccuaaucga

SEQ ID NO: 4221178 - RNA, 16 nt, Yersinia pestis KIM
uagucuuagacgucag

SEQ ID NO: 4221179 - RNA, 18 nt, Yersinia pestis KIM
uagucuuuuuaauaugug

SEQ ID NO: 4221180 - RNA, 18 nt, Yersinia pestis KIM
uagugaaguaauaaaaau

SEQ ID NO: 4221181 - RNA, 15 nt, Yersinia pestis KIM
uagugacguaaaaag

SEQ ID NO: 4221182 - RNA, 14 nt, Yersinia pestis KIM
uagugacucaucaa

SEQ ID NO: 4221183 - RNA, 21 nt, Yersinia pestis KIM
uagugaguuauucgccccuua

SEQ ID NO: 4221184 - RNA, 13 nt, Yersinia pestis KIM
uagugaugcagua

SEQ ID NO: 4221185 - RNA, 21 nt, Yersinia pestis KIM
uagugaugcaguaaauagucu

SEQ ID NO: 4221186 - RNA, 21 nt, Yersinia pestis KIM
uagugaugggggcaauugauu

SEQ ID NO: 4221187 - RNA, 15 nt, Yersinia pestis KIM
uagugauuauuuaaa

SEQ ID NO: 4221188 - RNA, 18 nt, Yersinia pestis KIM
uagugauuguuugauuau

SEQ ID NO: 4221189 - RNA, 20 nt, Yersinia pestis KIM
uagugcaaaauuccaccauu

SEQ ID NO: 4221190 - RNA, 14 nt, Yersinia pestis KIM
uagugccuaucuga

SEQ ID NO: 4221191 - RNA, 11 nt, Yersinia pestis KIM
uagugcuucca

SEQ ID NO: 4221192 - RNA, 17 nt, Yersinia pestis KIM
uaguggcacaaauaaaa

SEQ ID NO: 4221193 - RNA, 12 nt, Yersinia pestis KIM
uaguuaaauaau

SEQ ID NO: 4221194 - RNA, 21 nt, Yersinia pestis KIM
uaguuaacacgaaaagcagca

SEQ ID NO: 4221195 - RNA, 17 nt, Yersinia pestis KIM
uaguuaaucgcagcaga

SEQ ID NO: 4221196 - RNA, 16 nt, Yersinia pestis KIM
uaguuacaauaaauca

SEQ ID NO: 4221197 - RNA, 16 nt, Yersinia pestis KIM
uaguuaggugaaauau

SEQ ID NO: 4221198 - RNA, 20 nt, Yersinia pestis KIM
uaguuaucucccauuaauua

SEQ ID NO: 4221199 - RNA, 21 nt, Yersinia pestis KIM
uaguuaucucccauuaauuaa

SEQ ID NO: 4221200 - RNA, 19 nt, Yersinia pestis KIM
uaguucacgauggaaaaaa

SEQ ID NO: 4221201 - RNA, 22 nt, Yersinia pestis KIM
uaguucacgauggaaaaaauac

SEQ ID NO: 4221202 - RNA, 21 nt, Yersinia pestis KIM
uaguucuucugauaaaacagu

SEQ ID NO: 4221203 - RNA, 13 nt, Yersinia pestis KIM
uaguugcuaucaa

SEQ ID NO: 4221204 - RNA, 18 nt, Yersinia pestis KIM
uaguuggcaagacgguau

SEQ ID NO: 4221205 - RNA, 15 nt, Yersinia pestis KIM
uaguuguuagccacu

SEQ ID NO: 4221206 - RNA, 22 nt, Yersinia pestis KIM
uaguuuagauagaaaucacuga

SEQ ID NO: 4221207 - RNA, 17 nt, Yersinia pestis KIM
uaguuuuaauaaccauu

SEQ ID NO: 4221208 - RNA, 16 nt, Yersinia pestis KIM
uaguuuuagacgucag

SEQ ID NO: 4221209 - RNA, 20 nt, Yersinia pestis KIM
uaucagaaauacgcuuucca

SEQ ID NO: 4221210 - RNA, 18 nt, Yersinia pestis KIM
uaucagaaccaagcaaua

SEQ ID NO: 4221211 - RNA, 22 nt, Yersinia pestis KIM
uaucagccccuaaauccugcaa

SEQ ID NO: 4221212 - RNA, 17 nt, Yersinia pestis KIM
uaucagcgauuuuaaaa

SEQ ID NO: 4221213 - RNA, 20 nt, Yersinia pestis KIM
uaucagcgauuuuaaaaaau

SEQ ID NO: 4221214 - RNA, 14 nt, Yersinia pestis KIM
uaucaguaacgccg

SEQ ID NO: 4221215 - RNA, 12 nt, Yersinia pestis KIM
uaucagucuuuu

SEQ ID NO: 4221216 - RNA, 17 nt, Yersinia pestis KIM
uaucagugacaccauug

SEQ ID NO: 4221217 - RNA, 14 nt, Yersinia pestis KIM
uaucaguugguuua

SEQ ID NO: 4221218 - RNA, 23 nt, Yersinia pestis KIM
uaucauaucgaccaugaauaauu

SEQ ID NO: 4221219 - RNA, 15 nt, Yersinia pestis KIM
uaucaucaccaaaca

SEQ ID NO: 4221220 - RNA, 23 nt, Yersinia pestis KIM
uaucaucaccaagcuuaauauua

SEQ ID NO: 4221221 - RNA, 14 nt, Yersinia pestis KIM
uaucaucaccaccc

SEQ ID NO: 4221222 - RNA, 13 nt, Yersinia pestis KIM
uaucaucagcaga

SEQ ID NO: 4221223 - RNA, 15 nt, Yersinia pestis KIM
uaucaucauaaaugg

SEQ ID NO: 4221224 - RNA, 16 nt, Yersinia pestis KIM
uaucauccccuauaua

SEQ ID NO: 4221225 - RNA, 12 nt, Yersinia pestis KIM
uaucauucaaga

SEQ ID NO: 4221226 - RNA, 13 nt, Yersinia pestis KIM
uaucauuguccuc

SEQ ID NO: 4221227 - RNA, 12 nt, Yersinia pestis KIM
uauccaauaagc

SEQ ID NO: 4221228 - RNA, 20 nt, Yersinia pestis KIM
uauccaaucuugguuaauag

SEQ ID NO: 4221229 - RNA, 12 nt, Yersinia pestis KIM
uauccaauggcu

SEQ ID NO: 4221230 - RNA, 19 nt, Yersinia pestis KIM
uauccaauggcucaccuuu

SEQ ID NO: 4221231 - RNA, 15 nt, Yersinia pestis KIM
uauccagccaccuua

SEQ ID NO: 4221232 - RNA, 11 nt, Yersinia pestis KIM
uauccagcccu

SEQ ID NO: 4221233 - RNA, 13 nt, Yersinia pestis KIM
uauccagccgcuc

SEQ ID NO: 4221234 - RNA, 12 nt, Yersinia pestis KIM
uauccaggcacu

SEQ ID NO: 4221235 - RNA, 17 nt, Yersinia pestis KIM
uauccaggcacugccau

SEQ ID NO: 4221236 - RNA, 18 nt, Yersinia pestis KIM
uauccauauuaaaugcau

SEQ ID NO: 4221237 - RNA, 16 nt, Yersinia pestis KIM
uauccaucugaugagu

SEQ ID NO: 4221238 - RNA, 14 nt, Yersinia pestis KIM
uaucccccucacug

SEQ ID NO: 4221239 - RNA, 16 nt, Yersinia pestis KIM
uaucccuauuuuuucc

SEQ ID NO: 4221240 - RNA, 22 nt, Yersinia pestis KIM
uaucccuauuuuuuccgaaaaa

SEQ ID NO: 4221241 - RNA, 13 nt, Yersinia pestis KIM
uaucccuccauca

SEQ ID NO: 4221242 - RNA, 16 nt, Yersinia pestis KIM
uaucccuccccacugg

SEQ ID NO: 4221243 - RNA, 20 nt, Yersinia pestis KIM
uauccgcaccauagauuaag

SEQ ID NO: 4221244 - RNA, 15 nt, Yersinia pestis KIM
uauccggauuaaauu

SEQ ID NO: 4221245 - RNA, 21 nt, Yersinia pestis KIM
uauccggggcauucccccgga

SEQ ID NO: 4221246 - RNA, 18 nt, Yersinia pestis KIM
uauccggguggcuuggca

SEQ ID NO: 4221247 - RNA, 15 nt, Yersinia pestis KIM
uauccguuaacccaa

SEQ ID NO: 4221248 - RNA, 16 nt, Yersinia pestis KIM
uauccguuaacccaaa

SEQ ID NO: 4221249 - RNA, 22 nt, Yersinia pestis KIM
uauccuaagaauuaguugcccg

SEQ ID NO: 4221250 - RNA, 12 nt, Yersinia pestis KIM
uauccuauuuuu

SEQ ID NO: 4221251 - RNA, 19 nt, Yersinia pestis KIM
uauccucaccguucaagau

SEQ ID NO: 4221252 - RNA, 14 nt, Yersinia pestis KIM
uauccuccauucug

SEQ ID NO: 4221253 - RNA, 11 nt, Yersinia pestis KIM
uauccuccggc

SEQ ID NO: 4221254 - RNA, 17 nt, Yersinia pestis KIM
uauccucggccaguguu

SEQ ID NO: 4221255 - RNA, 20 nt, Yersinia pestis KIM
uauccuggccguguuuuucc

SEQ ID NO: 4221256 - RNA, 16 nt, Yersinia pestis KIM
uauccuuuuuauuuaa

SEQ ID NO: 4221257 - RNA, 13 nt, Yersinia pestis KIM
uaucgaaacacau

SEQ ID NO: 4221258 - RNA, 17 nt, Yersinia pestis KIM
uaucgaaacacauacaa

SEQ ID NO: 4221259 - RNA, 13 nt, Yersinia pestis KIM
uaucgaauugauc

SEQ ID NO: 4221260 - RNA, 20 nt, Yersinia pestis KIM
uaucgaauugaucugauauu

SEQ ID NO: 4221261 - RNA, 16 nt, Yersinia pestis KIM
uaucgaugguuggcua

SEQ ID NO: 4221262 - RNA, 23 nt, Yersinia pestis KIM
uaucgccaacacuauuguggaua

SEQ ID NO: 4221263 - RNA, 15 nt, Yersinia pestis KIM
uaucgccaagccagu

SEQ ID NO: 4221264 - RNA, 19 nt, Yersinia pestis KIM
uaucgcgguuuuaaauaca

SEQ ID NO: 4221265 - RNA, 13 nt, Yersinia pestis KIM
uaucgcucuugag

SEQ ID NO: 4221266 - RNA, 17 nt, Yersinia pestis KIM
uaucgcuguaugguaua

SEQ ID NO: 4221267 - RNA, 17 nt, Yersinia pestis KIM
uaucggcaaacaucaca

SEQ ID NO: 4221268 - RNA, 19 nt, Yersinia pestis KIM
uaucggugcugacaaacag

SEQ ID NO: 4221269 - RNA, 22 nt, Yersinia pestis KIM
uaucggugcugacaaacagaua

SEQ ID NO: 4221270 - RNA, 12 nt, Yersinia pestis KIM
uaucgucacugg

SEQ ID NO: 4221271 - RNA, 23 nt, Yersinia pestis KIM
uaucgugaacaggccccaaaaua

SEQ ID NO: 4221272 - RNA, 22 nt, Yersinia pestis KIM
uaucgugcgucaauaauaaaau

SEQ ID NO: 4221273 - RNA, 15 nt, Yersinia pestis KIM
uaucuaaaacugccu

SEQ ID NO: 4221274 - RNA, 17 nt, Yersinia pestis KIM
uaucuagcguccaugua

SEQ ID NO: 4221275 - RNA, 20 nt, Yersinia pestis KIM
uaucuagcguccauguaucc

SEQ ID NO: 4221276 - RNA, 16 nt, Yersinia pestis KIM
uaucuaggugcaguaa

SEQ ID NO: 4221277 - RNA, 13 nt, Yersinia pestis KIM
uaucuaucuguuc

SEQ ID NO: 4221278 - RNA, 12 nt, Yersinia pestis KIM
uaucuauuucca

SEQ ID NO: 4221279 - RNA, 14 nt, Yersinia pestis KIM
uaucuauuuccauc

SEQ ID NO: 4221280 - RNA, 14 nt, Yersinia pestis KIM
uaucucauccagca

SEQ ID NO: 4221281 - RNA, 19 nt, Yersinia pestis KIM
uaucucccauuaauuaauc

SEQ ID NO: 4221282 - RNA, 21 nt, Yersinia pestis KIM
uaucuccguugaaaccuacau

SEQ ID NO: 4221283 - RNA, 22 nt, Yersinia pestis KIM
uaucucgauugccuuuuuugaa

SEQ ID NO: 4221284 - RNA, 14 nt, Yersinia pestis KIM
uaucucgccuuuaa

SEQ ID NO: 4221285 - RNA, 14 nt, Yersinia pestis KIM
uaucugccaauuca

SEQ ID NO: 4221286 - RNA, 10 nt, Yersinia pestis KIM
uaucugcuau

SEQ ID NO: 4221287 - RNA, 16 nt, Yersinia pestis KIM
uaucuguaaucaccag

SEQ ID NO: 4221288 - RNA, 16 nt, Yersinia pestis KIM
uaucuguccgcuuaua

SEQ ID NO: 4221289 - RNA, 16 nt, Yersinia pestis KIM
uaucuguuguauacug

SEQ ID NO: 4221290 - RNA, 15 nt, Yersinia pestis KIM
uaucuguuucaaaua

SEQ ID NO: 4221291 - RNA, 20 nt, Yersinia pestis KIM
uaucuguuucaaauaaguau

SEQ ID NO: 4221292 - RNA, 16 nt, Yersinia pestis KIM
uaucuuauccacagca

SEQ ID NO: 4221293 - RNA, 19 nt, Yersinia pestis KIM
uaucuucauauacagaaga

SEQ ID NO: 4221294 - RNA, 19 nt, Yersinia pestis KIM
uaucuuccacaugcuuuuu

SEQ ID NO: 4221295 - RNA, 15 nt, Yersinia pestis KIM
uaucuuccauagaua

SEQ ID NO: 4221296 - RNA, 18 nt, Yersinia pestis KIM
uaucuuguaaauagucau

SEQ ID NO: 4221297 - RNA, 15 nt, Yersinia pestis KIM
uaucuuuaauuuucu

SEQ ID NO: 4221298 - RNA, 16 nt, Yersinia pestis KIM
uaucuuuaauuuucug

SEQ ID NO: 4221299 - RNA, 16 nt, Yersinia pestis KIM
uaucuuuaauuuuucc

SEQ ID NO: 4221300 - RNA, 15 nt, Yersinia pestis KIM
uaucuuuauuaucaa

SEQ ID NO: 4221301 - RNA, 13 nt, Yersinia pestis KIM
uaucuuucacccu

SEQ ID NO: 4221302 - RNA, 12 nt, Yersinia pestis KIM
uaucuuuccagc

SEQ ID NO: 4221303 - RNA, 16 nt, Yersinia pestis KIM
uaucuuuccagccaau

SEQ ID NO: 4221304 - RNA, 19 nt, Yersinia pestis KIM
uaucuuuccagccaauaca

SEQ ID NO: 4221305 - RNA, 16 nt, Yersinia pestis KIM
uaucuuuuaaaaaauu

SEQ ID NO: 4221306 - RNA, 13 nt, Yersinia pestis KIM
uaugaaaguaaga

SEQ ID NO: 4221307 - RNA, 20 nt, Yersinia pestis KIM
uaugaaugagguuuacauuu

SEQ ID NO: 4221308 - RNA, 19 nt, Yersinia pestis KIM
uaugaaugaguuucaaguc

SEQ ID NO: 4221309 - RNA, 21 nt, Yersinia pestis KIM
uaugaaugaguuucaagucaa

SEQ ID NO: 4221310 - RNA, 19 nt, Yersinia pestis KIM
uaugaauggaaguuaaaaa

SEQ ID NO: 4221311 - RNA, 21 nt, Yersinia pestis KIM
uaugaauggaaguuaaaaaaa

SEQ ID NO: 4221312 - RNA, 21 nt, Yersinia pestis KIM
uaugacgccaacuucaagccg

SEQ ID NO: 4221313 - RNA, 14 nt, Yersinia pestis KIM
uaugacgcgcugcu

SEQ ID NO: 4221314 - RNA, 22 nt, Yersinia pestis KIM
uaugacggggauauauggccgc

SEQ ID NO: 4221315 - RNA, 16 nt, Yersinia pestis KIM
uaugacuucuuaucuu

SEQ ID NO: 4221316 - RNA, 20 nt, Yersinia pestis KIM
uaugaggaucccuucugaaa

SEQ ID NO: 4221317 - RNA, 15 nt, Yersinia pestis KIM
uaugauaauaguuca

SEQ ID NO: 4221318 - RNA, 16 nt, Yersinia pestis KIM
uaugauauagcuguuu

SEQ ID NO: 4221319 - RNA, 21 nt, Yersinia pestis KIM
uaugauccuuuagcgcugcau

SEQ ID NO: 4221320 - RNA, 18 nt, Yersinia pestis KIM
uaugauggcaucuuauua

SEQ ID NO: 4221321 - RNA, 14 nt, Yersinia pestis KIM
uaugcaaauaauaa

SEQ ID NO: 4221322 - RNA, 13 nt, Yersinia pestis KIM
uaugcaacaguga

SEQ ID NO: 4221323 - RNA, 16 nt, Yersinia pestis KIM
uaugccauaacaucgu

SEQ ID NO: 4221324 - RNA, 18 nt, Yersinia pestis KIM
uaugccauauuacucucu

SEQ ID NO: 4221325 - RNA, 21 nt, Yersinia pestis KIM
uauugaugggggauauucauu

SEQ ID NO: 4221326 - RNA, 19 nt, Yersinia pestis KIM
uauugauuaauuuuucaua

SEQ ID NO: 4221327 - RNA, 18 nt, Yersinia pestis KIM
uauugauuacaaaauaua

SEQ ID NO: 4221328 - RNA, 16 nt, Yersinia pestis KIM
uauugcaacgcuugca

SEQ ID NO: 4221329 - RNA, 17 nt, Yersinia pestis KIM
uauugccgcagauaaau

SEQ ID NO: 4221330 - RNA, 16 nt, Yersinia pestis KIM
uauugccgcaguccaa

SEQ ID NO: 4221331 - RNA, 22 nt, Yersinia pestis KIM
uauugcucagggccacuucggu

SEQ ID NO: 4221332 - RNA, 18 nt, Yersinia pestis KIM
uauugcugugguugaucc

SEQ ID NO: 4221333 - RNA, 16 nt, Yersinia pestis KIM
uauuggccaguugcca

SEQ ID NO: 4221334 - RNA, 21 nt, Yersinia pestis KIM
uauuggccgucagcagauaag

SEQ ID NO: 4221335 - RNA, 22 nt, Yersinia pestis KIM
uauuggcuaaaguguacuguua

SEQ ID NO: 4221336 - RNA, 17 nt, Yersinia pestis KIM
uauuggggacaggcucc

SEQ ID NO: 4221337 - RNA, 22 nt, Yersinia pestis KIM
uauuggggacaggcuccuccuu

SEQ ID NO: 4221338 - RNA, 20 nt, Yersinia pestis KIM
uauuggucauuuuucccuuc

SEQ ID NO: 4221339 - RNA, 22 nt, Yersinia pestis KIM
uauuggucguaccaauggugcc

SEQ ID NO: 4221340 - RNA, 14 nt, Yersinia pestis KIM
uauuguaagucagc

SEQ ID NO: 4221341 - RNA, 17 nt, Yersinia pestis KIM
uauuguccaaaggaagg

SEQ ID NO: 4221342 - RNA, 17 nt, Yersinia pestis KIM
uauugucucuacucucu

SEQ ID NO: 4221343 - RNA, 22 nt, Yersinia pestis KIM
uauuguguggcacgccaaucaa

SEQ ID NO: 4221344 - RNA, 21 nt, Yersinia pestis KIM
uauuguuggcgauauucugau

SEQ ID NO: 4221345 - RNA, 13 nt, Yersinia pestis KIM
uauuuaaauacaa

SEQ ID NO: 4221346 - RNA, 17 nt, Yersinia pestis KIM
uauuuaaauacaaaaau

SEQ ID NO: 4221347 - RNA, 20 nt, Yersinia pestis KIM
uauuuaaauacaaaaauaca

SEQ ID NO: 4221348 - RNA, 19 nt, Yersinia pestis KIM
uauuuaacauuagccgguu

SEQ ID NO: 4221349 - RNA, 19 nt, Yersinia pestis KIM
uauuuaaccgcccucuuga

SEQ ID NO: 4221350 - RNA, 17 nt, Yersinia pestis KIM
uauuuacaaauaaccgc

SEQ ID NO: 4221351 - RNA, 21 nt, Yersinia pestis KIM
uauuuacaagccaacauugau

SEQ ID NO: 4221352 - RNA, 15 nt, Yersinia pestis KIM
uauuuaccugcucaa

SEQ ID NO: 4221353 - RNA, 18 nt, Yersinia pestis KIM
uauuuaccuguuugcaac

SEQ ID NO: 4221354 - RNA, 12 nt, Yersinia pestis KIM
uauuuacgguga

SEQ ID NO: 4221355 - RNA, 16 nt, Yersinia pestis KIM
uauuuagagcguccug

SEQ ID NO: 4221356 - RNA, 21 nt, Yersinia pestis KIM
uauuuagccugccaauaucca

SEQ ID NO: 4221357 - RNA, 14 nt, Yersinia pestis KIM
uauuuaggcuacag

SEQ ID NO: 4221358 - RNA, 17 nt, Yersinia pestis KIM
uauuuauaaaaaaugga

SEQ ID NO: 4221359 - RNA, 16 nt, Yersinia pestis KIM
uauuuauaaaaccacu

SEQ ID NO: 4221360 - RNA, 14 nt, Yersinia pestis KIM
uauuuauaugauaa

SEQ ID NO: 4221361 - RNA, 18 nt, Yersinia pestis KIM
uauuuauccauuuaauaa

SEQ ID NO: 4221362 - RNA, 20 nt, Yersinia pestis KIM
uauuuauccauuuaauaacu

SEQ ID NO: 4221363 - RNA, 17 nt, Yersinia pestis KIM
uauuuaucgccaacaua

SEQ ID NO: 4221364 - RNA, 14 nt, Yersinia pestis KIM
uauuuauuaaucua

SEQ ID NO: 4221365 - RNA, 16 nt, Yersinia pestis KIM
uauuuauucaaaaaau

SEQ ID NO: 4221366 - RNA, 19 nt, Yersinia pestis KIM
uauuuauugccauuuuaau

SEQ ID NO: 4221367 - RNA, 20 nt, Yersinia pestis KIM
uauuuauuggucaauaaaau

SEQ ID NO: 4221368 - RNA, 17 nt, Yersinia pestis KIM
uauuuauuuacagccac

SEQ ID NO: 4221369 - RNA, 19 nt, Yersinia pestis KIM
uauuucaacccgaucacca

SEQ ID NO: 4221370 - RNA, 16 nt, Yersinia pestis KIM
uauuucacguucauca

SEQ ID NO: 4221371 - RNA, 20 nt, Yersinia pestis KIM
uauuucacguucaucaauac

SEQ ID NO: 4221372 - RNA, 17 nt, Yersinia pestis KIM
uauuucaugauucucua

SEQ ID NO: 4221373 - RNA, 23 nt, Yersinia pestis KIM
uauuucgccuuucauacaucauu

SEQ ID NO: 4221374 - RNA, 19 nt, Yersinia pestis KIM
uauuucuccccacuucauc

SEQ ID NO: 4221375 - RNA, 12 nt, Yersinia pestis KIM
uauuucucucua

SEQ ID NO: 4221376 - RNA, 15 nt, Yersinia pestis KIM
uauuucuuacucugu

SEQ ID NO: 4221377 - RNA, 15 nt, Yersinia pestis KIM
uauuugaaauacuua

SEQ ID NO: 4221378 - RNA, 16 nt, Yersinia pestis KIM
uauuugaaauacuuau

SEQ ID NO: 4221379 - RNA, 13 nt, Yersinia pestis KIM
uauuugaacuuca

SEQ ID NO: 4221380 - RNA, 19 nt, Yersinia pestis KIM
uauuugacagucauaaggu

SEQ ID NO: 4221381 - RNA, 14 nt, Yersinia pestis KIM
uauuugaguuuuag

SEQ ID NO: 4221382 - RNA, 17 nt, Yersinia pestis KIM
uauuugcaaugcggagc

SEQ ID NO: 4221383 - RNA, 24 nt, Yersinia pestis KIM
uauuugcagaaaguaaucuuugag

SEQ ID NO: 4221384 - RNA, 22 nt, Yersinia pestis KIM
uauuugcaguggaugauaaaua

SEQ ID NO: 4221385 - RNA, 23 nt, Yersinia pestis KIM
uauuugcaguggaugauaaauau

SEQ ID NO: 4221386 - RNA, 15 nt, Yersinia pestis KIM
uauuugcgugaaaac

SEQ ID NO: 4221387 - RNA, 17 nt, Yersinia pestis KIM
uauuuggugaguaaaug

SEQ ID NO: 4221388 - RNA, 17 nt, Yersinia pestis KIM
uauuuguacauccaacu

SEQ ID NO: 4221389 - RNA, 22 nt, Yersinia pestis KIM
uauuuguagugacguaaaaagg

SEQ ID NO: 4221390 - RNA, 18 nt, Yersinia pestis KIM
uauuugucgcauuuauuu

SEQ ID NO: 4221391 - RNA, 13 nt, Yersinia pestis KIM
uauuuuaaauaug

SEQ ID NO: 4221392 - RNA, 13 nt, Yersinia pestis KIM
uauuuuaagaaaa

SEQ ID NO: 4221393 - RNA, 14 nt, Yersinia pestis KIM
uauuuuaagaaaac

SEQ ID NO: 4221394 - RNA, 15 nt, Yersinia pestis KIM
uauuuuaccuauuua

SEQ ID NO: 4221395 - RNA, 17 nt, Yersinia pestis KIM
uauuuuaccuauuuauu

SEQ ID NO: 4221396 - RNA, 23 nt, Yersinia pestis KIM
uauuuuaccuauuuauugccauu

SEQ ID NO: 4221397 - RNA, 16 nt, Yersinia pestis KIM
uauuuuacuuugaaau

SEQ ID NO: 4221398 - RNA, 16 nt, Yersinia pestis KIM
uauuuuauuuaaaauu

SEQ ID NO: 4221399 - RNA, 14 nt, Yersinia pestis KIM
uauuuucauuauuu

SEQ ID NO: 4221400 - RNA, 18 nt, Yersinia pestis KIM
uauuuucauuauuuucaa

SEQ ID NO: 4221401 - RNA, 14 nt, Yersinia pestis KIM
uauuuucccuuucu

SEQ ID NO: 4221402 - RNA, 22 nt, Yersinia pestis KIM
uauuuuccgggucaaacucagc

SEQ ID NO: 4221403 - RNA, 16 nt, Yersinia pestis KIM
uauuuucggguaucug

SEQ ID NO: 4221404 - RNA, 20 nt, Yersinia pestis KIM
uauuuucuacugaauaaaca

SEQ ID NO: 4221405 - RNA, 21 nt, Yersinia pestis KIM
uauuuugaaccguaugcuuuc

SEQ ID NO: 4221406 - RNA, 22 nt, Yersinia pestis KIM
uauuuugaauacggcggugagu

SEQ ID NO: 4221407 - RNA, 18 nt, Yersinia pestis KIM
uauuuugaauauuuuuaa

SEQ ID NO: 4221408 - RNA, 18 nt, Yersinia pestis KIM
uauuuuggguauauaguu

SEQ ID NO: 4221409 - RNA, 12 nt, Yersinia pestis KIM
uauuuuuauuaa

SEQ ID NO: 4221410 - RNA, 19 nt, Yersinia pestis KIM
uauuuuuauuaauauauuu

SEQ ID NO: 4221411 - RNA, 21 nt, Yersinia pestis KIM
uauuuuuggucguuuaaauaa

SEQ ID NO: 4221412 - RNA, 18 nt, Yersinia pestis KIM
uauuuuuguauuuaaaua

SEQ ID NO: 4221413 - RNA, 14 nt, Yersinia pestis KIM
ucaaaaacccauua

SEQ ID NO: 4221414 - RNA, 14 nt, Yersinia pestis KIM
ucaaaacaaucacu

SEQ ID NO: 4221415 - RNA, 23 nt, Yersinia pestis KIM
ucaaaaccgaugagugaaaucuc

SEQ ID NO: 4221416 - RNA, 16 nt, Yersinia pestis KIM
ucaaaacggcaauuaa

SEQ ID NO: 4221417 - RNA, 14 nt, Yersinia pestis KIM
ucaaaacuauuuau

SEQ ID NO: 4221418 - RNA, 16 nt, Yersinia pestis KIM
ucaaaacugauuaaua

SEQ ID NO: 4221419 - RNA, 20 nt, Yersinia pestis KIM
ucaaaagcagagaaugagua

SEQ ID NO: 4221420 - RNA, 14 nt, Yersinia pestis KIM
ucaaaagcggcucu

SEQ ID NO: 4221421 - RNA, 19 nt, Yersinia pestis KIM
ucaaaaggauggcccaagc

SEQ ID NO: 4221422 - RNA, 20 nt, Yersinia pestis KIM
ucaaaaggauggcccaagcc

SEQ ID NO: 4221423 - RNA, 21 nt, Yersinia pestis KIM
ucaaaaggauggcccaagcca

SEQ ID NO: 4221424 - RNA, 23 nt, Yersinia pestis KIM
ucaaaaggauggcccaagccauc

SEQ ID NO: 4221425 - RNA, 21 nt, Yersinia pestis KIM
ucaaaauaaaaauucacaaca

SEQ ID NO: 4221426 - RNA, 15 nt, Yersinia pestis KIM
ucaaaauaaaucagu

SEQ ID NO: 4221427 - RNA, 11 nt, Yersinia pestis KIM
ucaaaauaccc

SEQ ID NO: 4221428 - RNA, 13 nt, Yersinia pestis KIM
ucaaaauacccau

SEQ ID NO: 4221429 - RNA, 22 nt, Yersinia pestis KIM
ucaaaauacuuaacaaucagug

SEQ ID NO: 4221430 - RNA, 18 nt, Yersinia pestis KIM
ucaaaauagaggaaauaa

SEQ ID NO: 4221431 - RNA, 12 nt, Yersinia pestis KIM
ucaaaaucacuu

SEQ ID NO: 4221432 - RNA, 17 nt, Yersinia pestis KIM
ucaaaaucugauacuga

SEQ ID NO: 4221433 - RNA, 19 nt, Yersinia pestis KIM
ucaaaauuagguuuucccu

SEQ ID NO: 4221434 - RNA, 13 nt, Yersinia pestis KIM
ucaaacaaaucuu

SEQ ID NO: 4221435 - RNA, 17 nt, Yersinia pestis KIM
ucaaacagguugguaua

SEQ ID NO: 4221436 - RNA, 20 nt, Yersinia pestis KIM
ucaaaccaagcccuuuggca

SEQ ID NO: 4221437 - RNA, 17 nt, Yersinia pestis KIM
ucaaacggcuuuuuaaa

SEQ ID NO: 4221438 - RNA, 18 nt, Yersinia pestis KIM
ucaaacgggugauguuua

SEQ ID NO: 4221439 - RNA, 23 nt, Yersinia pestis KIM
ucaauagcuaauaauuguucaua

SEQ ID NO: 4221440 - RNA, 15 nt, Yersinia pestis KIM
ucaauaggauuuuca

SEQ ID NO: 4221441 - RNA, 20 nt, Yersinia pestis KIM
ucaauaggucagugguuuua

SEQ ID NO: 4221442 - RNA, 16 nt, Yersinia pestis KIM
ucaauagugauuguuu

SEQ ID NO: 4221443 - RNA, 12 nt, Yersinia pestis KIM
ucaauauccgca

SEQ ID NO: 4221444 - RNA, 18 nt, Yersinia pestis KIM
ucaauaucgauuuuuaag

SEQ ID NO: 4221445 - RNA, 22 nt, Yersinia pestis KIM
ucaauaugcaguuuuccucccu

SEQ ID NO: 4221446 - RNA, 19 nt, Yersinia pestis KIM
ucaaucaccgaaucaccga

SEQ ID NO: 4221447 - RNA, 19 nt, Yersinia pestis KIM
ucaaucacgacaagucaug

SEQ ID NO: 4221448 - RNA, 17 nt, Yersinia pestis KIM
ucaauccaaaugacacu

SEQ ID NO: 4221449 - RNA, 16 nt, Yersinia pestis KIM
ucaauccaaucauucu

SEQ ID NO: 4221450 - RNA, 23 nt, Yersinia pestis KIM
ucaauccgggcaaacgccagugc

SEQ ID NO: 4221451 - RNA, 22 nt, Yersinia pestis KIM
ucaauccuacaauaucuucccu

SEQ ID NO: 4221452 - RNA, 14 nt, Yersinia pestis KIM
ucaaucgagaagaa

SEQ ID NO: 4221453 - RNA, 14 nt, Yersinia pestis KIM
ucaaucggcagugc

SEQ ID NO: 4221454 - RNA, 11 nt, Yersinia pestis KIM
ucaaucggcug

SEQ ID NO: 4221455 - RNA, 23 nt, Yersinia pestis KIM
ucaaucuaaugacuacuaaucaa

SEQ ID NO: 4221456 - RNA, 23 nt, Yersinia pestis KIM
ucaaucuagaggacggcggccuu

SEQ ID NO: 4221457 - RNA, 13 nt, Yersinia pestis KIM
ucaaucucaucaa

SEQ ID NO: 4221458 - RNA, 14 nt, Yersinia pestis KIM
ucaaucucaucaau

SEQ ID NO: 4221459 - RNA, 15 nt, Yersinia pestis KIM
ucaaugaccacuaaa

SEQ ID NO: 4221460 - RNA, 14 nt, Yersinia pestis KIM
ucaaugagcauacc

SEQ ID NO: 4221461 - RNA, 15 nt, Yersinia pestis KIM
ucaaugagucucaau

SEQ ID NO: 4221462 - RNA, 17 nt, Yersinia pestis KIM
ucaaugaugucaucuuc

SEQ ID NO: 4221463 - RNA, 17 nt, Yersinia pestis KIM
ucaaugccgauccacgg

SEQ ID NO: 4221464 - RNA, 14 nt, Yersinia pestis KIM
ucaaugccuuggca

SEQ ID NO: 4221465 - RNA, 12 nt, Yersinia pestis KIM
ucaauggccagc

SEQ ID NO: 4221466 - RNA, 23 nt, Yersinia pestis KIM
ucaauggcugcccagagugacaa

SEQ ID NO: 4221467 - RNA, 14 nt, Yersinia pestis KIM
ucaaugguucacua

SEQ ID NO: 4221468 - RNA, 18 nt, Yersinia pestis KIM
ucaaugugguaacccgca

SEQ ID NO: 4221469 - RNA, 21 nt, Yersinia pestis KIM
ucaauguuggcccaagauacu

SEQ ID NO: 4221470 - RNA, 13 nt, Yersinia pestis KIM
ucaauuaucaaaa

SEQ ID NO: 4221471 - RNA, 11 nt, Yersinia pestis KIM
ucaauucaaua

SEQ ID NO: 4221472 - RNA, 19 nt, Yersinia pestis KIM
ucaauuccauaucggcaaa

SEQ ID NO: 4221473 - RNA, 16 nt, Yersinia pestis KIM
ucaauugagucucugg

SEQ ID NO: 4221474 - RNA, 22 nt, Yersinia pestis KIM
ucaauugccgucguauagaaaa

SEQ ID NO: 4221475 - RNA, 22 nt, Yersinia pestis KIM
ucaauuggacuaaccccaauau

SEQ ID NO: 4221476 - RNA, 21 nt, Yersinia pestis KIM
ucaauuggcagcggcaaauag

SEQ ID NO: 4221477 - RNA, 21 nt, Yersinia pestis KIM
ucaauugugcaaaaucagcau

SEQ ID NO: 4221478 - RNA, 21 nt, Yersinia pestis KIM
ucaauuugguauuggcuagaa

SEQ ID NO: 4221479 - RNA, 23 nt, Yersinia pestis KIM
ucaauuuuugcgugauauugaug

SEQ ID NO: 4221480 - RNA, 15 nt, Yersinia pestis KIM
ucacaacagugcaac

SEQ ID NO: 4221481 - RNA, 19 nt, Yersinia pestis KIM
ucacaacccccccgaccca

SEQ ID NO: 4221482 - RNA, 16 nt, Yersinia pestis KIM
ucacaacuuucccagu

SEQ ID NO: 4221483 - RNA, 17 nt, Yersinia pestis KIM
ucacaacuuuuauuggc

SEQ ID NO: 4221484 - RNA, 20 nt, Yersinia pestis KIM
ucacaacuuuuauuggcauu

SEQ ID NO: 4221485 - RNA, 18 nt, Yersinia pestis KIM
ucacaauacagcaaauag

SEQ ID NO: 4221486 - RNA, 18 nt, Yersinia pestis KIM
ucacaaucucuggcaacg

SEQ ID NO: 4221487 - RNA, 21 nt, Yersinia pestis KIM
ucacaaucucuggcaacggca

SEQ ID NO: 4221488 - RNA, 12 nt, Yersinia pestis KIM
ucacaauuucac

SEQ ID NO: 4221489 - RNA, 22 nt, Yersinia pestis KIM
ucacacacuaauaauaauuaau

SEQ ID NO: 4221490 - RNA, 14 nt, Yersinia pestis KIM
ucacaccaacacug

SEQ ID NO: 4221491 - RNA, 18 nt, Yersinia pestis KIM
ucacaccacggcgcugca

SEQ ID NO: 4221492 - RNA, 22 nt, Yersinia pestis KIM
ucacaccagacagaauauccag

SEQ ID NO: 4221493 - RNA, 16 nt, Yersinia pestis KIM
ucacaccaguuacuuu

SEQ ID NO: 4221494 - RNA, 17 nt, Yersinia pestis KIM
ucacaccauagcgguuu

SEQ ID NO: 4221495 - RNA, 16 nt, Yersinia pestis KIM
ucacacgcccaggcca

SEQ ID NO: 4221496 - RNA, 20 nt, Yersinia pestis KIM
ucacacgcccaggccauagc

SEQ ID NO: 4221497 - RNA, 17 nt, Yersinia pestis KIM
ucacacgggaucuacau

SEQ ID NO: 4221498 - RNA, 19 nt, Yersinia pestis KIM
ucacacuggcggacaucuu

SEQ ID NO: 4221499 - RNA, 19 nt, Yersinia pestis KIM
ucacacuguuuaguucacg

SEQ ID NO: 4221500 - RNA, 12 nt, Yersinia pestis KIM
ucacagauaaac

SEQ ID NO: 4221501 - RNA, 13 nt, Yersinia pestis KIM
ucacagauaaaca

SEQ ID NO: 4221502 - RNA, 22 nt, Yersinia pestis KIM
ucacaggcuucgacaggcaauu

SEQ ID NO: 4221503 - RNA, 16 nt, Yersinia pestis KIM
ucacaggggcaauaau

SEQ ID NO: 4221504 - RNA, 21 nt, Yersinia pestis KIM
ucacaucacagugccaaaaga

SEQ ID NO: 4221505 - RNA, 22 nt, Yersinia pestis KIM
ucacaucucggcguaaacaauc

SEQ ID NO: 4221506 - RNA, 15 nt, Yersinia pestis KIM
ucacaugacugaaca

SEQ ID NO: 4221507 - RNA, 23 nt, Yersinia pestis KIM
ucacaugcggauugaacugcgcu

SEQ ID NO: 4221508 - RNA, 19 nt, Yersinia pestis KIM
ucacaugcucaguuguauu

SEQ ID NO: 4221509 - RNA, 20 nt, Yersinia pestis KIM
ucacauuaacuucagguuca

SEQ ID NO: 4221510 - RNA, 18 nt, Yersinia pestis KIM
ucacauuuuuaauaaugu

SEQ ID NO: 4221511 - RNA, 23 nt, Yersinia pestis KIM
ucaccaaaaaaaccaccaaaaua

SEQ ID NO: 4221512 - RNA, 16 nt, Yersinia pestis KIM
ucaccaaagcaacagc

SEQ ID NO: 4221513 - RNA, 19 nt, Yersinia pestis KIM
ucaccaaaggaagccgagc

SEQ ID NO: 4221514 - RNA, 15 nt, Yersinia pestis KIM
ucaccaacaccacca

SEQ ID NO: 4221515 - RNA, 20 nt, Yersinia pestis KIM
ucaccaacaccaccaucacu

SEQ ID NO: 4221516 - RNA, 15 nt, Yersinia pestis KIM
ucaccaagaccaguu

SEQ ID NO: 4221517 - RNA, 17 nt, Yersinia pestis KIM
ucaccaagauaccgagu

SEQ ID NO: 4221518 - RNA, 15 nt, Yersinia pestis KIM
ucaccaagcuuuuau

SEQ ID NO: 4221519 - RNA, 20 nt, Yersinia pestis KIM
ucaccaauauguucaucagg

SEQ ID NO: 4221520 - RNA, 23 nt, Yersinia pestis KIM
ucaccaaucggaucgagcuguuu

SEQ ID NO: 4221521 - RNA, 12 nt, Yersinia pestis KIM
ucaccaccauua

SEQ ID NO: 4221522 - RNA, 24 nt, Yersinia pestis KIM
ucaccaccauuaacaagcgaccau

SEQ ID NO: 4221523 - RNA, 18 nt, Yersinia pestis KIM
ucaccacgauuagccaua

SEQ ID NO: 4221524 - RNA, 22 nt, Yersinia pestis KIM
ucaccacggcuuucaauaaaac

SEQ ID NO: 4221525 - RNA, 14 nt, Yersinia pestis KIM
ucaccagacaacca

SEQ ID NO: 4221526 - RNA, 21 nt, Yersinia pestis KIM
ucaccagacaaccaauacaca

SEQ ID NO: 4221527 - RNA, 15 nt, Yersinia pestis KIM
ucaccagauggcgau

SEQ ID NO: 4221528 - RNA, 15 nt, Yersinia pestis KIM
ucaccagcaaaggcc

SEQ ID NO: 4221529 - RNA, 14 nt, Yersinia pestis KIM
ucaccagguccgcc

SEQ ID NO: 4221530 - RNA, 17 nt, Yersinia pestis KIM
ucaccaguagcccagcc

SEQ ID NO: 4221531 - RNA, 17 nt, Yersinia pestis KIM
ucaccauaacugcugcu

SEQ ID NO: 4221532 - RNA, 22 nt, Yersinia pestis KIM
ucaccaucagacaggauaauca

SEQ ID NO: 4221533 - RNA, 20 nt, Yersinia pestis KIM
ucaccaucgccuuuagcuuu

SEQ ID NO: 4221534 - RNA, 14 nt, Yersinia pestis KIM
ucaccaucugccug

SEQ ID NO: 4221535 - RNA, 20 nt, Yersinia pestis KIM
ucaccauguacauggccgug

SEQ ID NO: 4221536 - RNA, 15 nt, Yersinia pestis KIM
ucaccauuauguuca

SEQ ID NO: 4221537 - RNA, 12 nt, Yersinia pestis KIM
ucaccauucaag

SEQ ID NO: 4221538 - RNA, 14 nt, Yersinia pestis KIM
ucaccauugaccag

SEQ ID NO: 4221539 - RNA, 15 nt, Yersinia pestis KIM
ucaccauuuauugcc

SEQ ID NO: 4221540 - RNA, 12 nt, Yersinia pestis KIM
ucacccagcaaa

SEQ ID NO: 4221541 - RNA, 16 nt, Yersinia pestis KIM
ucacccauaccaacca

SEQ ID NO: 4221542 - RNA, 14 nt, Yersinia pestis KIM
ucacccauuuuauc

SEQ ID NO: 4221543 - RNA, 15 nt, Yersinia pestis KIM
ucacccauuuuaucc

SEQ ID NO: 4221544 - RNA, 15 nt, Yersinia pestis KIM
ucacccccacaucag

SEQ ID NO: 4221545 - RNA, 21 nt, Yersinia pestis KIM
ucacccuuuaaaucuagcccu

SEQ ID NO: 4221546 - RNA, 22 nt, Yersinia pestis KIM
ucacccuuuugaauucaccaaa

SEQ ID NO: 4221547 - RNA, 23 nt, Yersinia pestis KIM
ucaccgaugauaagugaauaaau

SEQ ID NO: 4221548 - RNA, 14 nt, Yersinia pestis KIM
ucaccgcaaccugu

SEQ ID NO: 4221549 - RNA, 13 nt, Yersinia pestis KIM
ucaccgccgacca

SEQ ID NO: 4221550 - RNA, 18 nt, Yersinia pestis KIM
ucaccgccuuucauucug

SEQ ID NO: 4221551 - RNA, 12 nt, Yersinia pestis KIM
ucaccgcgggcu

SEQ ID NO: 4221552 - RNA, 18 nt, Yersinia pestis KIM
ucaccgcuggaagccgcc

SEQ ID NO: 4221553 - RNA, 19 nt, Yersinia pestis KIM
ucagauuguuuauaaauua

SEQ ID NO: 4221554 - RNA, 21 nt, Yersinia pestis KIM
ucagauuguuuauaaauuaaa

SEQ ID NO: 4221555 - RNA, 17 nt, Yersinia pestis KIM
ucagauuuacuccccaa

SEQ ID NO: 4221556 - RNA, 20 nt, Yersinia pestis KIM
ucagauuuagcgauauaacu

SEQ ID NO: 4221557 - RNA, 22 nt, Yersinia pestis KIM
ucagauuuucguucggugcaaa

SEQ ID NO: 4221558 - RNA, 16 nt, Yersinia pestis KIM
ucagcaaaguauuuau

SEQ ID NO: 4221559 - RNA, 17 nt, Yersinia pestis KIM
ucagcaaaguauuuaua

SEQ ID NO: 4221560 - RNA, 14 nt, Yersinia pestis KIM
ucagcaaaucaaac

SEQ ID NO: 4221561 - RNA, 18 nt, Yersinia pestis KIM
ucagcaagguucucgcug

SEQ ID NO: 4221562 - RNA, 21 nt, Yersinia pestis KIM
ucagcacauccaugccauggc

SEQ ID NO: 4221563 - RNA, 12 nt, Yersinia pestis KIM
ucagcaccuauc

SEQ ID NO: 4221564 - RNA, 18 nt, Yersinia pestis KIM
ucagcacgcuuuccagcu

SEQ ID NO: 4221565 - RNA, 11 nt, Yersinia pestis KIM
ucagcagagag

SEQ ID NO: 4221566 - RNA, 20 nt, Yersinia pestis KIM
ucagcagagucgcaaaaaau

SEQ ID NO: 4221567 - RNA, 11 nt, Yersinia pestis KIM
ucagcagucug

SEQ ID NO: 4221568 - RNA, 15 nt, Yersinia pestis KIM
ucagcagucugaaau

SEQ ID NO: 4221569 - RNA, 19 nt, Yersinia pestis KIM
ucagcagucugagccucau

SEQ ID NO: 4221570 - RNA, 20 nt, Yersinia pestis KIM
ucagcagucugauuaccuuc

SEQ ID NO: 4221571 - RNA, 20 nt, Yersinia pestis KIM
ucagcauaucccuguuuucu

SEQ ID NO: 4221572 - RNA, 15 nt, Yersinia pestis KIM
ucagcauauuaccca

SEQ ID NO: 4221573 - RNA, 23 nt, Yersinia pestis KIM
ucagccaagucagggaucaccuc

SEQ ID NO: 4221574 - RNA, 16 nt, Yersinia pestis KIM
ucagccacaagauagu

SEQ ID NO: 4221575 - RNA, 13 nt, Yersinia pestis KIM
ucagccaccagau

SEQ ID NO: 4221576 - RNA, 13 nt, Yersinia pestis KIM
ucagccagcuccu

SEQ ID NO: 4221577 - RNA, 19 nt, Yersinia pestis KIM
ucagcccccucaauaccgg

SEQ ID NO: 4221578 - RNA, 19 nt, Yersinia pestis KIM
ucagcccuaauauccucaa

SEQ ID NO: 4221579 - RNA, 16 nt, Yersinia pestis KIM
ucagccgcgaaaaacc

SEQ ID NO: 4221580 - RNA, 20 nt, Yersinia pestis KIM
ucagccgcggcgcuggcaug

SEQ ID NO: 4221581 - RNA, 15 nt, Yersinia pestis KIM
ucagccuauccucac

SEQ ID NO: 4221582 - RNA, 15 nt, Yersinia pestis KIM
ucagccucauucaug

SEQ ID NO: 4221583 - RNA, 16 nt, Yersinia pestis KIM
ucagccucauucauga

SEQ ID NO: 4221584 - RNA, 17 nt, Yersinia pestis KIM
ucagccucauucaugag

SEQ ID NO: 4221585 - RNA, 20 nt, Yersinia pestis KIM
ucagccucauucaugaggcu

SEQ ID NO: 4221586 - RNA, 21 nt, Yersinia pestis KIM
ucagccucuaaaggguaggua

SEQ ID NO: 4221587 - RNA, 11 nt, Yersinia pestis KIM
ucagccucuga

SEQ ID NO: 4221588 - RNA, 12 nt, Yersinia pestis KIM
ucagccuuuuuu

SEQ ID NO: 4221589 - RNA, 19 nt, Yersinia pestis KIM
ucagccuuuuuugcuuaaa

SEQ ID NO: 4221590 - RNA, 15 nt, Yersinia pestis KIM
ucagcgaaaaauuuc

SEQ ID NO: 4221591 - RNA, 14 nt, Yersinia pestis KIM
ucagcgguagcaaa

SEQ ID NO: 4221592 - RNA, 17 nt, Yersinia pestis KIM
ucagcgguagcaaagcg

SEQ ID NO: 4221593 - RNA, 18 nt, Yersinia pestis KIM
ucagcgguugaaaaguuu

SEQ ID NO: 4221594 - RNA, 15 nt, Yersinia pestis KIM
ucagcguauagccuu

SEQ ID NO: 4221595 - RNA, 16 nt, Yersinia pestis KIM
ucagcgucacggaaag

SEQ ID NO: 4221596 - RNA, 14 nt, Yersinia pestis KIM
ucagcgucagcaga

SEQ ID NO: 4221597 - RNA, 14 nt, Yersinia pestis KIM
ucagcgucuucaau

SEQ ID NO: 4221598 - RNA, 16 nt, Yersinia pestis KIM
ucagcgucuucaauua

SEQ ID NO: 4221599 - RNA, 22 nt, Yersinia pestis KIM
ucagcgugacguuaucucaacc

SEQ ID NO: 4221600 - RNA, 17 nt, Yersinia pestis KIM
ucagcguggaauuaaua

SEQ ID NO: 4221601 - RNA, 20 nt, Yersinia pestis KIM
ucagcguuggaugaguuuga

SEQ ID NO: 4221602 - RNA, 21 nt, Yersinia pestis KIM
ucagcguuuuaaucacaucuc

SEQ ID NO: 4221603 - RNA, 20 nt, Yersinia pestis KIM
ucagcguuuugaucaucaaa

SEQ ID NO: 4221604 - RNA, 13 nt, Yersinia pestis KIM
ucagcuagccugc

SEQ ID NO: 4221605 - RNA, 15 nt, Yersinia pestis KIM
ucagcucaccaccuc

SEQ ID NO: 4221606 - RNA, 20 nt, Yersinia pestis KIM
ucagcucauuaaacuguucu

SEQ ID NO: 4221607 - RNA, 21 nt, Yersinia pestis KIM
ucagcucuucuaacacuucau

SEQ ID NO: 4221608 - RNA, 17 nt, Yersinia pestis KIM
ucagcuucaggccaagc

SEQ ID NO: 4221609 - RNA, 21 nt, Yersinia pestis KIM
ucagcuugcaacaaaauggcc

SEQ ID NO: 4221610 - RNA, 14 nt, Yersinia pestis KIM
ucaggaaauuacca

SEQ ID NO: 4221611 - RNA, 14 nt, Yersinia pestis KIM
ucaggaagagaaaa

SEQ ID NO: 4221612 - RNA, 19 nt, Yersinia pestis KIM
ucaggaagagaaaagcaga

SEQ ID NO: 4221613 - RNA, 18 nt, Yersinia pestis KIM
ucaggaaggcggccacug

SEQ ID NO: 4221614 - RNA, 15 nt, Yersinia pestis KIM
ucaggcauuacagac

SEQ ID NO: 4221615 - RNA, 18 nt, Yersinia pestis KIM
ucaggcauuacagacugg

SEQ ID NO: 4221616 - RNA, 22 nt, Yersinia pestis KIM
ucaggcauuacagacuggccaa

SEQ ID NO: 4221617 - RNA, 13 nt, Yersinia pestis KIM
ucaggcccugaga

SEQ ID NO: 4221618 - RNA, 20 nt, Yersinia pestis KIM
ucaggccgguauucagccaa

SEQ ID NO: 4221619 - RNA, 18 nt, Yersinia pestis KIM
ucaggcuguugacauaaa

SEQ ID NO: 4221620 - RNA, 15 nt, Yersinia pestis KIM
ucagggagccaauag

SEQ ID NO: 4221621 - RNA, 17 nt, Yersinia pestis KIM
ucagggagccaauagag

SEQ ID NO: 4221622 - RNA, 21 nt, Yersinia pestis KIM
ucagggagccaauagaggcuc

SEQ ID NO: 4221623 - RNA, 16 nt, Yersinia pestis KIM
ucagggagucagggag

SEQ ID NO: 4221624 - RNA, 13 nt, Yersinia pestis KIM
ucagggcaauaac

SEQ ID NO: 4221625 - RNA, 21 nt, Yersinia pestis KIM
ucagggcaauaacaaacacau

SEQ ID NO: 4221626 - RNA, 19 nt, Yersinia pestis KIM
ucagggcauaagcgcccug

SEQ ID NO: 4221627 - RNA, 22 nt, Yersinia pestis KIM
ucagggccacuucgguggcccu

SEQ ID NO: 4221628 - RNA, 19 nt, Yersinia pestis KIM
ucagggcgucucuacgacg

SEQ ID NO: 4221629 - RNA, 22 nt, Yersinia pestis KIM
ucaggggcaauuaucuuaucca

SEQ ID NO: 4221630 - RNA, 20 nt, Yersinia pestis KIM
ucaggguacuguugaugcag

SEQ ID NO: 4221631 - RNA, 14 nt, Yersinia pestis KIM
ucagggugaaagcc

SEQ ID NO: 4221632 - RNA, 12 nt, Yersinia pestis KIM
ucagggugaccg

SEQ ID NO: 4221633 - RNA, 18 nt, Yersinia pestis KIM
ucaggguuagccgacugg

SEQ ID NO: 4221634 - RNA, 21 nt, Yersinia pestis KIM
ucagguaaaccgguuaaaaca

SEQ ID NO: 4221635 - RNA, 16 nt, Yersinia pestis KIM
ucaggucgauuacaua

SEQ ID NO: 4221636 - RNA, 23 nt, Yersinia pestis KIM
ucaggugaguaaauaccuucaga

SEQ ID NO: 4221637 - RNA, 19 nt, Yersinia pestis KIM
ucagguguucagccaaguc

SEQ ID NO: 4221638 - RNA, 16 nt, Yersinia pestis KIM
ucagguguuguauaac

SEQ ID NO: 4221639 - RNA, 18 nt, Yersinia pestis KIM
ucagguugaaauaaauaa

SEQ ID NO: 4221640 - RNA, 16 nt, Yersinia pestis KIM
ucagguugaggcaggg

SEQ ID NO: 4221641 - RNA, 13 nt, Yersinia pestis KIM
ucagguugaucag

SEQ ID NO: 4221642 - RNA, 12 nt, Yersinia pestis KIM
ucaguaaaacca

SEQ ID NO: 4221643 - RNA, 16 nt, Yersinia pestis KIM
ucaguaaaaccagcag

SEQ ID NO: 4221644 - RNA, 15 nt, Yersinia pestis KIM
ucaguaaagcuuuca

SEQ ID NO: 4221645 - RNA, 12 nt, Yersinia pestis KIM
ucaguaacgccu

SEQ ID NO: 4221646 - RNA, 13 nt, Yersinia pestis KIM
ucaguaauucacc

SEQ ID NO: 4221647 - RNA, 17 nt, Yersinia pestis KIM
ucaguaauucacccuuu

SEQ ID NO: 4221648 - RNA, 20 nt, Yersinia pestis KIM
ucaguacaccgauaaaagug

SEQ ID NO: 4221649 - RNA, 23 nt, Yersinia pestis KIM
ucaguacauaaaccgugugcuuc

SEQ ID NO: 4221650 - RNA, 18 nt, Yersinia pestis KIM
ucaguagcgucaguuuca

SEQ ID NO: 4221651 - RNA, 18 nt, Yersinia pestis KIM
ucaguagucaauacaauu

SEQ ID NO: 4221652 - RNA, 18 nt, Yersinia pestis KIM
ucaguaguggcuccacua

SEQ ID NO: 4221653 - RNA, 20 nt, Yersinia pestis KIM
ucaguaucagcgauuuuaaa

SEQ ID NO: 4221654 - RNA, 22 nt, Yersinia pestis KIM
ucaguaucagcgauuuuaaaaa

SEQ ID NO: 4221655 - RNA, 17 nt, Yersinia pestis KIM
ucaguaucuuuccagcc

SEQ ID NO: 4221656 - RNA, 21 nt, Yersinia pestis KIM
ucagucaguguuucuauuuuc

SEQ ID NO: 4221657 - RNA, 16 nt, Yersinia pestis KIM
ucagucgcuuuuuaac

SEQ ID NO: 4221658 - RNA, 17 nt, Yersinia pestis KIM
ucagucucuuuacggaa

SEQ ID NO: 4221659 - RNA, 21 nt, Yersinia pestis KIM
ucagugaaagggaaguuucuu

SEQ ID NO: 4221660 - RNA, 15 nt, Yersinia pestis KIM
ucagugaagagauaa

SEQ ID NO: 4221661 - RNA, 15 nt, Yersinia pestis KIM
ucagugaaggaugaa

SEQ ID NO: 4221662 - RNA, 20 nt, Yersinia pestis KIM
ucagugaaggaugaauaaau

SEQ ID NO: 4221663 - RNA, 22 nt, Yersinia pestis KIM
ucagugagcauuuuguuaccca

SEQ ID NO: 4221664 - RNA, 18 nt, Yersinia pestis KIM
ucagugccaauaauucac

SEQ ID NO: 4221665 - RNA, 13 nt, Yersinia pestis KIM
ucaguggcuggaa

SEQ ID NO: 4221666 - RNA, 16 nt, Yersinia pestis KIM
ucagugggcuauuuau

SEQ ID NO: 4221667 - RNA, 23 nt, Yersinia pestis KIM
ucaguggugguagauacaauuca

SEQ ID NO: 4221668 - RNA, 21 nt, Yersinia pestis KIM
ucaucggggguugucugcaga

SEQ ID NO: 4221669 - RNA, 21 nt, Yersinia pestis KIM
ucaucgggguuugucagcagu

SEQ ID NO: 4221670 - RNA, 13 nt, Yersinia pestis KIM
ucaucgguaccag

SEQ ID NO: 4221671 - RNA, 17 nt, Yersinia pestis KIM
ucaucuacaacaucauc

SEQ ID NO: 4221672 - RNA, 15 nt, Yersinia pestis KIM
ucaucucugccccua

SEQ ID NO: 4221673 - RNA, 18 nt, Yersinia pestis KIM
ucaucuggugagaacacg

SEQ ID NO: 4221674 - RNA, 17 nt, Yersinia pestis KIM
ucaucuucgcuuucauc

SEQ ID NO: 4221675 - RNA, 12 nt, Yersinia pestis KIM
ucaucuucuuca

SEQ ID NO: 4221676 - RNA, 13 nt, Yersinia pestis KIM
ucaucuucuucau

SEQ ID NO: 4221677 - RNA, 17 nt, Yersinia pestis KIM
ucaucuucuucauccca

SEQ ID NO: 4221678 - RNA, 19 nt, Yersinia pestis KIM
ucaucuugggcgggaucuc

SEQ ID NO: 4221679 - RNA, 16 nt, Yersinia pestis KIM
ucaucuuuaauaauag

SEQ ID NO: 4221680 - RNA, 17 nt, Yersinia pestis KIM
ucaucuuuaauaauaga

SEQ ID NO: 4221681 - RNA, 13 nt, Yersinia pestis KIM
ucaucuuucucau

SEQ ID NO: 4221682 - RNA, 17 nt, Yersinia pestis KIM
ucaucuuuugcuauuaa

SEQ ID NO: 4221683 - RNA, 13 nt, Yersinia pestis KIM
ucaucuuuuucug

SEQ ID NO: 4221684 - RNA, 15 nt, Yersinia pestis KIM
ucaucuuuuucugcc

SEQ ID NO: 4221685 - RNA, 18 nt, Yersinia pestis KIM
ucaucuuuuucugccuga

SEQ ID NO: 4221686 - RNA, 14 nt, Yersinia pestis KIM
ucaucuuuuuuaau

SEQ ID NO: 4221687 - RNA, 21 nt, Yersinia pestis KIM
ucaugaaaaaugagcaauuca

SEQ ID NO: 4221688 - RNA, 14 nt, Yersinia pestis KIM
ucaugaauaggaua

SEQ ID NO: 4221689 - RNA, 13 nt, Yersinia pestis KIM
ucaugacaaaaau

SEQ ID NO: 4221690 - RNA, 16 nt, Yersinia pestis KIM
ucaugacaucccagca

SEQ ID NO: 4221691 - RNA, 23 nt, Yersinia pestis KIM
ucaugacaucccagcacaaugca

SEQ ID NO: 4221692 - RNA, 15 nt, Yersinia pestis KIM
ucaugacgcuggaaa

SEQ ID NO: 4221693 - RNA, 16 nt, Yersinia pestis KIM
ucaugaggcucagacu

SEQ ID NO: 4221694 - RNA, 17 nt, Yersinia pestis KIM
ucaugaguguuggccuc

SEQ ID NO: 4221695 - RNA, 14 nt, Yersinia pestis KIM
ucaugauaaugcca

SEQ ID NO: 4221696 - RNA, 17 nt, Yersinia pestis KIM
ucaugauagacagcaaa

SEQ ID NO: 4221697 - RNA, 15 nt, Yersinia pestis KIM
ucaugaugaauacga

SEQ ID NO: 4221698 - RNA, 20 nt, Yersinia pestis KIM
ucaugcagauacucggcaaa

SEQ ID NO: 4221699 - RNA, 13 nt, Yersinia pestis KIM
ucaugcucacaau

SEQ ID NO: 4221700 - RNA, 19 nt, Yersinia pestis KIM
ucaugcucacaaucaucgu

SEQ ID NO: 4221701 - RNA, 18 nt, Yersinia pestis KIM
ucaugcugaaucuguaag

SEQ ID NO: 4221702 - RNA, 19 nt, Yersinia pestis KIM
ucaugcugaaucuguaagu

SEQ ID NO: 4221703 - RNA, 20 nt, Yersinia pestis KIM
ucaugcuguagcagccugua

SEQ ID NO: 4221704 - RNA, 20 nt, Yersinia pestis KIM
ucauggcacgcuuaaucuuu

SEQ ID NO: 4221705 - RNA, 21 nt, Yersinia pestis KIM
ucauggccaugaaucaaauua

SEQ ID NO: 4221706 - RNA, 18 nt, Yersinia pestis KIM
ucauggccugaugcaccu

SEQ ID NO: 4221707 - RNA, 21 nt, Yersinia pestis KIM
ucauggccugaugcaccucag

SEQ ID NO: 4221708 - RNA, 23 nt, Yersinia pestis KIM
ucauggcgcuuuagccagucacc

SEQ ID NO: 4221709 - RNA, 17 nt, Yersinia pestis KIM
ucaugguagagcuguuu

SEQ ID NO: 4221710 - RNA, 13 nt, Yersinia pestis KIM
ucauguaagccaa

SEQ ID NO: 4221711 - RNA, 19 nt, Yersinia pestis KIM
ucauguaaggcaauaccaa

SEQ ID NO: 4221712 - RNA, 21 nt, Yersinia pestis KIM
ucauguaaggcaauaccaaua

SEQ ID NO: 4221713 - RNA, 15 nt, Yersinia pestis KIM
ucaugugagauaaca

SEQ ID NO: 4221714 - RNA, 17 nt, Yersinia pestis KIM
ucauguucgcacugcuc

SEQ ID NO: 4221715 - RNA, 13 nt, Yersinia pestis KIM
ucauguugaccaa

SEQ ID NO: 4221716 - RNA, 13 nt, Yersinia pestis KIM
ucauguugcaaca

SEQ ID NO: 4221717 - RNA, 18 nt, Yersinia pestis KIM
ucauuaacuguuaaaaca

SEQ ID NO: 4221718 - RNA, 22 nt, Yersinia pestis KIM
ucauuaaggagugccaucauau

SEQ ID NO: 4221719 - RNA, 23 nt, Yersinia pestis KIM
ucauuaauccccggucacuuaaa

SEQ ID NO: 4221720 - RNA, 18 nt, Yersinia pestis KIM
ucauuaauuucaccacau

SEQ ID NO: 4221721 - RNA, 13 nt, Yersinia pestis KIM
ucauuacaucauc

SEQ ID NO: 4221722 - RNA, 15 nt, Yersinia pestis KIM
ucauuacaucaucuu

SEQ ID NO: 4221723 - RNA, 16 nt, Yersinia pestis KIM
ucauuaccaauaccau

SEQ ID NO: 4221724 - RNA, 22 nt, Yersinia pestis KIM
ucauuacccucauguaagccaa

SEQ ID NO: 4221725 - RNA, 21 nt, Yersinia pestis KIM
ucauuaccgcacacuacagcc

SEQ ID NO: 4221726 - RNA, 23 nt, Yersinia pestis KIM
ucauuacguaaucccagaaacgg

SEQ ID NO: 4221727 - RNA, 20 nt, Yersinia pestis KIM
ucauuagccguuguucaccc

SEQ ID NO: 4221728 - RNA, 13 nt, Yersinia pestis KIM
ucauuagucugag

SEQ ID NO: 4221729 - RNA, 11 nt, Yersinia pestis KIM
ucauuaucaug

SEQ ID NO: 4221730 - RNA, 14 nt, Yersinia pestis KIM
ucauuauggauaau

SEQ ID NO: 4221731 - RNA, 19 nt, Yersinia pestis KIM
ucauuauggauaauuuaau

SEQ ID NO: 4221732 - RNA, 14 nt, Yersinia pestis KIM
ucauuauuaaacug

SEQ ID NO: 4221733 - RNA, 16 nt, Yersinia pestis KIM
ucauuauuaaacugau

SEQ ID NO: 4221734 - RNA, 23 nt, Yersinia pestis KIM
ucauuauuaaacuugcucuuuca

SEQ ID NO: 4221735 - RNA, 19 nt, Yersinia pestis KIM
ucauuauuuucaaccaguu

SEQ ID NO: 4221736 - RNA, 22 nt, Yersinia pestis KIM
ucauuauuuucaaccaguuaga

SEQ ID NO: 4221737 - RNA, 13 nt, Yersinia pestis KIM
ucauuauuuucac

SEQ ID NO: 4221738 - RNA, 17 nt, Yersinia pestis KIM
ucauucagguuuacgcu

SEQ ID NO: 4221739 - RNA, 15 nt, Yersinia pestis KIM
ucauucaugaggcuu

SEQ ID NO: 4221740 - RNA, 17 nt, Yersinia pestis KIM
ucauucauuuuaaaaaa

SEQ ID NO: 4221741 - RNA, 14 nt, Yersinia pestis KIM
ucauuccgccuguu

SEQ ID NO: 4221742 - RNA, 13 nt, Yersinia pestis KIM
ucauucuuaucgu

SEQ ID NO: 4221743 - RNA, 21 nt, Yersinia pestis KIM
ucauugauauuaacuggucua

SEQ ID NO: 4221744 - RNA, 22 nt, Yersinia pestis KIM
ucauugccacgacgcagcucca

SEQ ID NO: 4221745 - RNA, 13 nt, Yersinia pestis KIM
ucauugcccccuu

SEQ ID NO: 4221746 - RNA, 18 nt, Yersinia pestis KIM
ucauugcugcuguuauua

SEQ ID NO: 4221747 - RNA, 20 nt, Yersinia pestis KIM
ucauuggcguuacagcaagg

SEQ ID NO: 4221748 - RNA, 23 nt, Yersinia pestis KIM
ucauuggcguuacagcaaggcag

SEQ ID NO: 4221749 - RNA, 18 nt, Yersinia pestis KIM
ucauugguguuacagcaa

SEQ ID NO: 4221750 - RNA, 19 nt, Yersinia pestis KIM
ucauugguuaacuuauagc

SEQ ID NO: 4221751 - RNA, 17 nt, Yersinia pestis KIM
ucauuguagauggccau

SEQ ID NO: 4221752 - RNA, 19 nt, Yersinia pestis KIM
ucauuguagauggccaucu

SEQ ID NO: 4221753 - RNA, 15 nt, Yersinia pestis KIM
ucauuguccucaaga

SEQ ID NO: 4221754 - RNA, 11 nt, Yersinia pestis KIM
ucauuuaacug

SEQ ID NO: 4221755 - RNA, 21 nt, Yersinia pestis KIM
ucauuuaucuaaaacugccua

SEQ ID NO: 4221756 - RNA, 19 nt, Yersinia pestis KIM
ucauuucaacuauuuggug

SEQ ID NO: 4221757 - RNA, 14 nt, Yersinia pestis KIM
ucauuucagguaaa

SEQ ID NO: 4221758 - RNA, 20 nt, Yersinia pestis KIM
ucauuugcucgauuucacuu

SEQ ID NO: 4221759 - RNA, 16 nt, Yersinia pestis KIM
ucauuuuaacaauuuu

SEQ ID NO: 4221760 - RNA, 14 nt, Yersinia pestis KIM
ucauuuuacgccug

SEQ ID NO: 4221761 - RNA, 15 nt, Yersinia pestis KIM
ucauuuuaggugcag

SEQ ID NO: 4221762 - RNA, 16 nt, Yersinia pestis KIM
ucauuuuccugcauau

SEQ ID NO: 4221763 - RNA, 18 nt, Yersinia pestis KIM
ucauuuuuaaguggcauc

SEQ ID NO: 4221764 - RNA, 13 nt, Yersinia pestis KIM
ucauuuuucccuu

SEQ ID NO: 4221765 - RNA, 18 nt, Yersinia pestis KIM
ucauuuuucuugccuuuu

SEQ ID NO: 4221766 - RNA, 21 nt, Yersinia pestis KIM
ucauuuuucuugccuuuuuau

SEQ ID NO: 4221767 - RNA, 22 nt, Yersinia pestis KIM
ucauuuuuugggaugaaaaaua

SEQ ID NO: 4221768 - RNA, 23 nt, Yersinia pestis KIM
ucauuuuuugggaugaaaaauac

SEQ ID NO: 4221769 - RNA, 15 nt, Yersinia pestis KIM
uccaaaaaacugcgg

SEQ ID NO: 4221770 - RNA, 22 nt, Yersinia pestis KIM
uccaaagcaccaacuaagcaga

SEQ ID NO: 4221771 - RNA, 14 nt, Yersinia pestis KIM
uccaaaggaagggg

SEQ ID NO: 4221772 - RNA, 22 nt, Yersinia pestis KIM
uccaaaugacagcaucaauauc

SEQ ID NO: 4221773 - RNA, 12 nt, Yersinia pestis KIM
uccaacaacugc

SEQ ID NO: 4221774 - RNA, 13 nt, Yersinia pestis KIM
uccaacaacugcc

SEQ ID NO: 4221775 - RNA, 23 nt, Yersinia pestis KIM
uccaacaguagcuugaucggaua

SEQ ID NO: 4221776 - RNA, 11 nt, Yersinia pestis KIM
uccaaccaacc

SEQ ID NO: 4221777 - RNA, 19 nt, Yersinia pestis KIM
uccaaccaaccaugcugcc

SEQ ID NO: 4221778 - RNA, 20 nt, Yersinia pestis KIM
uccaaccaaccaugcugccc

SEQ ID NO: 4221779 - RNA, 17 nt, Yersinia pestis KIM
uccaacgcacaccccca

SEQ ID NO: 4221780 - RNA, 16 nt, Yersinia pestis KIM
uccaacguaaacauug

SEQ ID NO: 4221781 - RNA, 23 nt, Yersinia pestis KIM
uccaacuaaacagggcagaaaau

SEQ ID NO: 4221782 - RNA, 15 nt, Yersinia pestis KIM
uccaacucaccuaaa

SEQ ID NO: 4221783 - RNA, 15 nt, Yersinia pestis KIM
ucccagcacagccug

SEQ ID NO: 4221784 - RNA, 11 nt, Yersinia pestis KIM
ucccagccacu

SEQ ID NO: 4221785 - RNA, 14 nt, Yersinia pestis KIM
ucccaguaagcucu

SEQ ID NO: 4221786 - RNA, 16 nt, Yersinia pestis KIM
ucccagucgucuucag

SEQ ID NO: 4221787 - RNA, 15 nt, Yersinia pestis KIM
ucccaguuuuuaauu

SEQ ID NO: 4221788 - RNA, 16 nt, Yersinia pestis KIM
ucccauacccacuaau

SEQ ID NO: 4221789 - RNA, 18 nt, Yersinia pestis KIM
ucccauacccacuaauac

SEQ ID NO: 4221790 - RNA, 22 nt, Yersinia pestis KIM
ucccauagcuggcuucaaaauc

SEQ ID NO: 4221791 - RNA, 15 nt, Yersinia pestis KIM
ucccaucccuuugau

SEQ ID NO: 4221792 - RNA, 15 nt, Yersinia pestis KIM
ucccauuaauuaauc

SEQ ID NO: 4221793 - RNA, 14 nt, Yersinia pestis KIM
ucccauuuauggca

SEQ ID NO: 4221794 - RNA, 13 nt, Yersinia pestis KIM
ucccauuuauuac

SEQ ID NO: 4221795 - RNA, 12 nt, Yersinia pestis KIM
uccccaccaaca

SEQ ID NO: 4221796 - RNA, 18 nt, Yersinia pestis KIM
uccccacggcgacguuca

SEQ ID NO: 4221797 - RNA, 18 nt, Yersinia pestis KIM
uccccacuucaucaucaa

SEQ ID NO: 4221798 - RNA, 15 nt, Yersinia pestis KIM
uccccagaacagcua

SEQ ID NO: 4221799 - RNA, 21 nt, Yersinia pestis KIM
uccccauaagcgggguauuuu

SEQ ID NO: 4221800 - RNA, 14 nt, Yersinia pestis KIM
uccccauggcuuuc

SEQ ID NO: 4221801 - RNA, 18 nt, Yersinia pestis KIM
uccccauggcuuucagga

SEQ ID NO: 4221802 - RNA, 14 nt, Yersinia pestis KIM
ucccccaaguaaaa

SEQ ID NO: 4221803 - RNA, 20 nt, Yersinia pestis KIM
ucccccaccaguaaacgcca

SEQ ID NO: 4221804 - RNA, 23 nt, Yersinia pestis KIM
ucccccauggggccaccuaaucc

SEQ ID NO: 4221805 - RNA, 15 nt, Yersinia pestis KIM
uccccccuucaucga

SEQ ID NO: 4221806 - RNA, 17 nt, Yersinia pestis KIM
uccccccuucaucgaca

SEQ ID NO: 4221807 - RNA, 18 nt, Yersinia pestis KIM
ucccccgcgccgacugcu

SEQ ID NO: 4221808 - RNA, 19 nt, Yersinia pestis KIM
ucccccggaucacuggcua

SEQ ID NO: 4221809 - RNA, 17 nt, Yersinia pestis KIM
ucccccgguuaaugcca

SEQ ID NO: 4221810 - RNA, 18 nt, Yersinia pestis KIM
ucccccuucagccuucau

SEQ ID NO: 4221811 - RNA, 20 nt, Yersinia pestis KIM
ucccccuugauucacugauu

SEQ ID NO: 4221812 - RNA, 17 nt, Yersinia pestis KIM
ucccccuuuggccgcuc

SEQ ID NO: 4221813 - RNA, 18 nt, Yersinia pestis KIM
uccccgcuugggugagga

SEQ ID NO: 4221814 - RNA, 18 nt, Yersinia pestis KIM
uccccggcaacacccugu

SEQ ID NO: 4221815 - RNA, 15 nt, Yersinia pestis KIM
uccccggcaccaacg

SEQ ID NO: 4221816 - RNA, 19 nt, Yersinia pestis KIM
uccccuaauucuccuuucu

SEQ ID NO: 4221817 - RNA, 14 nt, Yersinia pestis KIM
uccccucagagaca

SEQ ID NO: 4221818 - RNA, 22 nt, Yersinia pestis KIM
uccccuucaauugacuuugcca

SEQ ID NO: 4221819 - RNA, 18 nt, Yersinia pestis KIM
ucccgauauaaauaaaau

SEQ ID NO: 4221820 - RNA, 14 nt, Yersinia pestis KIM
ucccgcaaagccug

SEQ ID NO: 4221821 - RNA, 15 nt, Yersinia pestis KIM
ucccgguuucagugc

SEQ ID NO: 4221822 - RNA, 20 nt, Yersinia pestis KIM
ucccgucagguucaauuccc

SEQ ID NO: 4221823 - RNA, 17 nt, Yersinia pestis KIM
ucccgugugauuuccau

SEQ ID NO: 4221824 - RNA, 16 nt, Yersinia pestis KIM
ucccguuucagcuccg

SEQ ID NO: 4221825 - RNA, 14 nt, Yersinia pestis KIM
ucccuaaaaucauu

SEQ ID NO: 4221826 - RNA, 13 nt, Yersinia pestis KIM
ucccuaaagccau

SEQ ID NO: 4221827 - RNA, 14 nt, Yersinia pestis KIM
ucccuaacgccgug

SEQ ID NO: 4221828 - RNA, 15 nt, Yersinia pestis KIM
ucccuaccaaauguu

SEQ ID NO: 4221829 - RNA, 21 nt, Yersinia pestis KIM
ucccuacgguaccgcagguca

SEQ ID NO: 4221830 - RNA, 13 nt, Yersinia pestis KIM
ucccuauucaaaa

SEQ ID NO: 4221831 - RNA, 12 nt, Yersinia pestis KIM
ucccucagugag

SEQ ID NO: 4221832 - RNA, 18 nt, Yersinia pestis KIM
ucccuccccacuggguaa

SEQ ID NO: 4221833 - RNA, 11 nt, Yersinia pestis KIM
ucccucggcuu

SEQ ID NO: 4221834 - RNA, 13 nt, Yersinia pestis KIM
ucccucggcuuau

SEQ ID NO: 4221835 - RNA, 21 nt, Yersinia pestis KIM
ucccucuguccccgcuauuau

SEQ ID NO: 4221836 - RNA, 15 nt, Yersinia pestis KIM
ucccugaacgccuug

SEQ ID NO: 4221837 - RNA, 16 nt, Yersinia pestis KIM
ucccugacucccugac

SEQ ID NO: 4221838 - RNA, 18 nt, Yersinia pestis KIM
ucccugauggggcaauca

SEQ ID NO: 4221839 - RNA, 21 nt, Yersinia pestis KIM
ucccugcguugcgaaauaaau

SEQ ID NO: 4221840 - RNA, 12 nt, Yersinia pestis KIM
ucccuguauaaa

SEQ ID NO: 4221841 - RNA, 14 nt, Yersinia pestis KIM
ucccuguuacggua

SEQ ID NO: 4221842 - RNA, 13 nt, Yersinia pestis KIM
ucccuucugaaac

SEQ ID NO: 4221843 - RNA, 14 nt, Yersinia pestis KIM
ucccuucugaaacu

SEQ ID NO: 4221844 - RNA, 19 nt, Yersinia pestis KIM
ucccuugacugaccauaaa

SEQ ID NO: 4221845 - RNA, 20 nt, Yersinia pestis KIM
ucccuugagcauuuuaguga

SEQ ID NO: 4221846 - RNA, 16 nt, Yersinia pestis KIM
ucccuuguucaggcag

SEQ ID NO: 4221847 - RNA, 14 nt, Yersinia pestis KIM
ucccuuguugccuu

SEQ ID NO: 4221848 - RNA, 16 nt, Yersinia pestis KIM
ucccuuguugccuuuc

SEQ ID NO: 4221849 - RNA, 15 nt, Yersinia pestis KIM
ucccuuuuaccgaaa

SEQ ID NO: 4221850 - RNA, 14 nt, Yersinia pestis KIM
uccgcaauagccaa

SEQ ID NO: 4221851 - RNA, 17 nt, Yersinia pestis KIM
uccgcaccuuugucauu

SEQ ID NO: 4221852 - RNA, 18 nt, Yersinia pestis KIM
uccgcacuuggccccauc

SEQ ID NO: 4221853 - RNA, 17 nt, Yersinia pestis KIM
uccgccaaggccagcgc

SEQ ID NO: 4221854 - RNA, 15 nt, Yersinia pestis KIM
uccgcccucuugcug

SEQ ID NO: 4221855 - RNA, 23 nt, Yersinia pestis KIM
uccgccugaccgacgagggcuuc

SEQ ID NO: 4221856 - RNA, 17 nt, Yersinia pestis KIM
uccgccugagauuaacc

SEQ ID NO: 4221857 - RNA, 21 nt, Yersinia pestis KIM
uccgccugcguuguuuuucaa

SEQ ID NO: 4221858 - RNA, 17 nt, Yersinia pestis KIM
uccgccuguuuucaggc

SEQ ID NO: 4221859 - RNA, 20 nt, Yersinia pestis KIM
uccgcgaugacacaauuccc

SEQ ID NO: 4221860 - RNA, 14 nt, Yersinia pestis KIM
uccgcgccaaggca

SEQ ID NO: 4221861 - RNA, 21 nt, Yersinia pestis KIM
uccgcgccauaaaagauaacg

SEQ ID NO: 4221862 - RNA, 15 nt, Yersinia pestis KIM
uccgcggugcuuuuu

SEQ ID NO: 4221863 - RNA, 15 nt, Yersinia pestis KIM
uccgcuauuuuccac

SEQ ID NO: 4221864 - RNA, 11 nt, Yersinia pestis KIM
uccgcuggaca

SEQ ID NO: 4221865 - RNA, 17 nt, Yersinia pestis KIM
uccgcuggcauacugac

SEQ ID NO: 4221866 - RNA, 22 nt, Yersinia pestis KIM
uccgcuuagcaggcccuuucac

SEQ ID NO: 4221867 - RNA, 15 nt, Yersinia pestis KIM
uccgcuugcagcaac

SEQ ID NO: 4221868 - RNA, 16 nt, Yersinia pestis KIM
uccggaaucagcguuu

SEQ ID NO: 4221869 - RNA, 13 nt, Yersinia pestis KIM
uccggacaggcuu

SEQ ID NO: 4221870 - RNA, 19 nt, Yersinia pestis KIM
uccggauuaaauucuaccu

SEQ ID NO: 4221871 - RNA, 22 nt, Yersinia pestis KIM
uccggccacgggcauccgcuuc

SEQ ID NO: 4221872 - RNA, 15 nt, Yersinia pestis KIM
uccggcggcuagcag

SEQ ID NO: 4221873 - RNA, 13 nt, Yersinia pestis KIM
uccgggcaagcgg

SEQ ID NO: 4221874 - RNA, 21 nt, Yersinia pestis KIM
uccgggucaaacucagcgaau

SEQ ID NO: 4221875 - RNA, 15 nt, Yersinia pestis KIM
uccgguacugugcug

SEQ ID NO: 4221876 - RNA, 13 nt, Yersinia pestis KIM
uccgguguauuug

SEQ ID NO: 4221877 - RNA, 15 nt, Yersinia pestis KIM
uccgguguuuuugac

SEQ ID NO: 4221878 - RNA, 13 nt, Yersinia pestis KIM
uccguaaaaaacc

SEQ ID NO: 4221879 - RNA, 20 nt, Yersinia pestis KIM
uccguaaaucauagccagcg

SEQ ID NO: 4221880 - RNA, 19 nt, Yersinia pestis KIM
uccguaacccgccucgcuu

SEQ ID NO: 4221881 - RNA, 21 nt, Yersinia pestis KIM
uccguacccgcucuaaguuaa

SEQ ID NO: 4221882 - RNA, 13 nt, Yersinia pestis KIM
uccgucaaucguu

SEQ ID NO: 4221883 - RNA, 17 nt, Yersinia pestis KIM
uccgucguuugcuccau

SEQ ID NO: 4221884 - RNA, 16 nt, Yersinia pestis KIM
uccgucuaccucgguu

SEQ ID NO: 4221885 - RNA, 18 nt, Yersinia pestis KIM
uccgugcugguccuuuug

SEQ ID NO: 4221886 - RNA, 12 nt, Yersinia pestis KIM
uccguuaaaaaa

SEQ ID NO: 4221887 - RNA, 19 nt, Yersinia pestis KIM
uccguuaacccaaagccau

SEQ ID NO: 4221888 - RNA, 15 nt, Yersinia pestis KIM
uccguuaucaucccu

SEQ ID NO: 4221889 - RNA, 13 nt, Yersinia pestis KIM
uccguugaaaccu

SEQ ID NO: 4221890 - RNA, 15 nt, Yersinia pestis KIM
uccguuuucacccaa

SEQ ID NO: 4221891 - RNA, 19 nt, Yersinia pestis KIM
uccuaaugaacacuuaauu

SEQ ID NO: 4221892 - RNA, 14 nt, Yersinia pestis KIM
uccuacauucagua

SEQ ID NO: 4221893 - RNA, 20 nt, Yersinia pestis KIM
uccuacgccggagucuaucu

SEQ ID NO: 4221894 - RNA, 13 nt, Yersinia pestis KIM
uccuauaaauuuu

SEQ ID NO: 4221895 - RNA, 15 nt, Yersinia pestis KIM
uccuauaaauuuuaa

SEQ ID NO: 4221896 - RNA, 15 nt, Yersinia pestis KIM
uccuauauacaaggc

SEQ ID NO: 4221897 - RNA, 14 nt, Yersinia pestis KIM
uccuaucguuuauu

SEQ ID NO: 4221898 - RNA, 12 nt, Yersinia pestis KIM
uccucaugauuu

SEQ ID NO: 4221899 - RNA, 14 nt, Yersinia pestis KIM
ucgcauugucaccc

SEQ ID NO: 4221900 - RNA, 16 nt, Yersinia pestis KIM
ucgccaaaguaaucag

SEQ ID NO: 4221901 - RNA, 22 nt, Yersinia pestis KIM
ucgccaacacguggguauccag

SEQ ID NO: 4221902 - RNA, 22 nt, Yersinia pestis KIM
ucgccaacauaaguaauaagua

SEQ ID NO: 4221903 - RNA, 14 nt, Yersinia pestis KIM
ucgccaaucucaaa

SEQ ID NO: 4221904 - RNA, 17 nt, Yersinia pestis KIM
ucgccacggauaaggug

SEQ ID NO: 4221905 - RNA, 18 nt, Yersinia pestis KIM
ucgccagcggguacacug

SEQ ID NO: 4221906 - RNA, 18 nt, Yersinia pestis KIM
ucgccaggaaaucaugac

SEQ ID NO: 4221907 - RNA, 16 nt, Yersinia pestis KIM
ucgccauaaaugcgua

SEQ ID NO: 4221908 - RNA, 16 nt, Yersinia pestis KIM
ucgccaucgucucugc

SEQ ID NO: 4221909 - RNA, 20 nt, Yersinia pestis KIM
ucgccccuuagcgcacgggg

SEQ ID NO: 4221910 - RNA, 14 nt, Yersinia pestis KIM
ucgcccucuggugc

SEQ ID NO: 4221911 - RNA, 19 nt, Yersinia pestis KIM
ucgcccuguaaagccagua

SEQ ID NO: 4221912 - RNA, 15 nt, Yersinia pestis KIM
ucgcccuguaacuuu

SEQ ID NO: 4221913 - RNA, 14 nt, Yersinia pestis KIM
ucgcccuucuucca

SEQ ID NO: 4221914 - RNA, 15 nt, Yersinia pestis KIM
ucgccgcaaggcaaa

SEQ ID NO: 4221915 - RNA, 16 nt, Yersinia pestis KIM
ucgccgcuucuguacc

SEQ ID NO: 4221916 - RNA, 16 nt, Yersinia pestis KIM
ucgccgggucaggaag

SEQ ID NO: 4221917 - RNA, 14 nt, Yersinia pestis KIM
ucgccguauuugua

SEQ ID NO: 4221918 - RNA, 18 nt, Yersinia pestis KIM
ucgccugaugcuuuucuu

SEQ ID NO: 4221919 - RNA, 22 nt, Yersinia pestis KIM
ucgccuuaaaugcguagaguca

SEQ ID NO: 4221920 - RNA, 16 nt, Yersinia pestis KIM
ucgcgaauagccaagc

SEQ ID NO: 4221921 - RNA, 15 nt, Yersinia pestis KIM
ucgcgacgaaaaccu

SEQ ID NO: 4221922 - RNA, 19 nt, Yersinia pestis KIM
ucgcgauaaaauucagcca

SEQ ID NO: 4221923 - RNA, 15 nt, Yersinia pestis KIM
ucgcgcccugccaua

SEQ ID NO: 4221924 - RNA, 17 nt, Yersinia pestis KIM
ucgcgcugcuuuccuga

SEQ ID NO: 4221925 - RNA, 17 nt, Yersinia pestis KIM
ucgcggguuuuuaacuu

SEQ ID NO: 4221926 - RNA, 14 nt, Yersinia pestis KIM
ucgcguaucaugag

SEQ ID NO: 4221927 - RNA, 22 nt, Yersinia pestis KIM
ucgcgugcgcccgguaauaaug

SEQ ID NO: 4221928 - RNA, 23 nt, Yersinia pestis KIM
ucgcgugcgcccgguaauaauga

SEQ ID NO: 4221929 - RNA, 12 nt, Yersinia pestis KIM
ucgcguggcaga

SEQ ID NO: 4221930 - RNA, 18 nt, Yersinia pestis KIM
ucgcuaaaaccuaauaac

SEQ ID NO: 4221931 - RNA, 20 nt, Yersinia pestis KIM
ucgcuaucgagauuacgguc

SEQ ID NO: 4221932 - RNA, 22 nt, Yersinia pestis KIM
ucgcuaucugugucaguaccug

SEQ ID NO: 4221933 - RNA, 20 nt, Yersinia pestis KIM
ucgcucaggcggucaccgaa

SEQ ID NO: 4221934 - RNA, 17 nt, Yersinia pestis KIM
ucgcucugcguuuuucc

SEQ ID NO: 4221935 - RNA, 21 nt, Yersinia pestis KIM
ucgcugaaaucaggcuguucu

SEQ ID NO: 4221936 - RNA, 16 nt, Yersinia pestis KIM
ucgcugacaauuuaca

SEQ ID NO: 4221937 - RNA, 16 nt, Yersinia pestis KIM
ucgcugugcccuuuuu

SEQ ID NO: 4221938 - RNA, 15 nt, Yersinia pestis KIM
ucgcuguggcuacca

SEQ ID NO: 4221939 - RNA, 15 nt, Yersinia pestis KIM
ucgcuucgcucggcu

SEQ ID NO: 4221940 - RNA, 21 nt, Yersinia pestis KIM
ucggaaaucugaugauuggag

SEQ ID NO: 4221941 - RNA, 19 nt, Yersinia pestis KIM
ucggacggcugacaaaccc

SEQ ID NO: 4221942 - RNA, 20 nt, Yersinia pestis KIM
ucggauaaccgcgaagaggg

SEQ ID NO: 4221943 - RNA, 16 nt, Yersinia pestis KIM
ucggaucagcgccugc

SEQ ID NO: 4221944 - RNA, 19 nt, Yersinia pestis KIM
ucggaucagcgccugcugu

SEQ ID NO: 4221945 - RNA, 20 nt, Yersinia pestis KIM
ucggcacugcccugccuggu

SEQ ID NO: 4221946 - RNA, 20 nt, Yersinia pestis KIM
ucggcagcggagaaucgcug

SEQ ID NO: 4221947 - RNA, 16 nt, Yersinia pestis KIM
ucggcaggcaacugag

SEQ ID NO: 4221948 - RNA, 18 nt, Yersinia pestis KIM
ucggcauacuccauuuuu

SEQ ID NO: 4221949 - RNA, 17 nt, Yersinia pestis KIM
ucggcauacuccuuaau

SEQ ID NO: 4221950 - RNA, 19 nt, Yersinia pestis KIM
ucggcauugccagcgguac

SEQ ID NO: 4221951 - RNA, 16 nt, Yersinia pestis KIM
ucggccacccgccauc

SEQ ID NO: 4221952 - RNA, 23 nt, Yersinia pestis KIM
ucggccacccgccaucaggcaaa

SEQ ID NO: 4221953 - RNA, 20 nt, Yersinia pestis KIM
ucggccauauuaccgcugaa

SEQ ID NO: 4221954 - RNA, 15 nt, Yersinia pestis KIM
ucggccccuuaccua

SEQ ID NO: 4221955 - RNA, 20 nt, Yersinia pestis KIM
ucggcgcgguaggggugcug

SEQ ID NO: 4221956 - RNA, 16 nt, Yersinia pestis KIM
ucggcggagagaaugg

SEQ ID NO: 4221957 - RNA, 22 nt, Yersinia pestis KIM
ucggcguucgguaaugccagcc

SEQ ID NO: 4221958 - RNA, 13 nt, Yersinia pestis KIM
ucggcuuaaccaa

SEQ ID NO: 4221959 - RNA, 17 nt, Yersinia pestis KIM
ucgggaaaacaggcaau

SEQ ID NO: 4221960 - RNA, 22 nt, Yersinia pestis KIM
ucgggaaauugugauucaacug

SEQ ID NO: 4221961 - RNA, 19 nt, Yersinia pestis KIM
ucgggaugaccuucccuuc

SEQ ID NO: 4221962 - RNA, 17 nt, Yersinia pestis KIM
ucgggcuugguguugca

SEQ ID NO: 4221963 - RNA, 19 nt, Yersinia pestis KIM
ucggggguugucagcaguc

SEQ ID NO: 4221964 - RNA, 13 nt, Yersinia pestis KIM
ucggguagcaucc

SEQ ID NO: 4221965 - RNA, 21 nt, Yersinia pestis KIM
ucgggugauggcugucugaug

SEQ ID NO: 4221966 - RNA, 17 nt, Yersinia pestis KIM
ucgguauauuucccguu

SEQ ID NO: 4221967 - RNA, 20 nt, Yersinia pestis KIM
ucggucaguuucauaccggu

SEQ ID NO: 4221968 - RNA, 19 nt, Yersinia pestis KIM
ucggucgauuuuuauuuuc

SEQ ID NO: 4221969 - RNA, 23 nt, Yersinia pestis KIM
ucggugcauguaacuguaacgau

SEQ ID NO: 4221970 - RNA, 11 nt, Yersinia pestis KIM
ucgguggcccu

SEQ ID NO: 4221971 - RNA, 22 nt, Yersinia pestis KIM
ucgguuaauauugaauaaccua

SEQ ID NO: 4221972 - RNA, 16 nt, Yersinia pestis KIM
ucgguuucacccucuu

SEQ ID NO: 4221973 - RNA, 15 nt, Yersinia pestis KIM
ucguaaagacgccgu

SEQ ID NO: 4221974 - RNA, 19 nt, Yersinia pestis KIM
ucguaauggcgauaauauu

SEQ ID NO: 4221975 - RNA, 12 nt, Yersinia pestis KIM
ucguaccggccc

SEQ ID NO: 4221976 - RNA, 18 nt, Yersinia pestis KIM
ucguacuuuccuuccucu

SEQ ID NO: 4221977 - RNA, 17 nt, Yersinia pestis KIM
ucguaggccgcuuuagu

SEQ ID NO: 4221978 - RNA, 17 nt, Yersinia pestis KIM
ucguaguaauagguggu

SEQ ID NO: 4221979 - RNA, 20 nt, Yersinia pestis KIM
ucguaugaauggaaguuaaa

SEQ ID NO: 4221980 - RNA, 21 nt, Yersinia pestis KIM
ucguaugaauggaaguuaaaa

SEQ ID NO: 4221981 - RNA, 19 nt, Yersinia pestis KIM
ucgucagccccugccagaa

SEQ ID NO: 4221982 - RNA, 15 nt, Yersinia pestis KIM
ucgucagugaugaca

SEQ ID NO: 4221983 - RNA, 11 nt, Yersinia pestis KIM
ucguccaaagg

SEQ ID NO: 4221984 - RNA, 14 nt, Yersinia pestis KIM
ucguccaaagggag

SEQ ID NO: 4221985 - RNA, 14 nt, Yersinia pestis KIM
ucguccugcuuaau

SEQ ID NO: 4221986 - RNA, 19 nt, Yersinia pestis KIM
ucgucggcccggccaggcu

SEQ ID NO: 4221987 - RNA, 16 nt, Yersinia pestis KIM
ucgucucugcauuaca

SEQ ID NO: 4221988 - RNA, 16 nt, Yersinia pestis KIM
ucgucugucgggaaca

SEQ ID NO: 4221989 - RNA, 17 nt, Yersinia pestis KIM
ucgucuucgacagcagu

SEQ ID NO: 4221990 - RNA, 19 nt, Yersinia pestis KIM
ucgucuucgcccagaucau

SEQ ID NO: 4221991 - RNA, 18 nt, Yersinia pestis KIM
ucgugauugagcguugau

SEQ ID NO: 4221992 - RNA, 22 nt, Yersinia pestis KIM
ucgugccgcacacagcccugcc

SEQ ID NO: 4221993 - RNA, 20 nt, Yersinia pestis KIM
ucguggcguucccgcaggcg

SEQ ID NO: 4221994 - RNA, 18 nt, Yersinia pestis KIM
ucguguauaucacuauuu

SEQ ID NO: 4221995 - RNA, 21 nt, Yersinia pestis KIM
ucguguggagaacucauuuuu

SEQ ID NO: 4221996 - RNA, 12 nt, Yersinia pestis KIM
ucguguucggua

SEQ ID NO: 4221997 - RNA, 22 nt, Yersinia pestis KIM
ucguuacaucaugaguaaaaga

SEQ ID NO: 4221998 - RNA, 16 nt, Yersinia pestis KIM
ucguuaucuucauaua

SEQ ID NO: 4221999 - RNA, 14 nt, Yersinia pestis KIM
ucguuauuuaccgu

SEQ ID NO: 4222000 - RNA, 18 nt, Yersinia pestis KIM
ucguucacuuaucccuua

SEQ ID NO: 4222001 - RNA, 16 nt, Yersinia pestis KIM
ucguucggugcaaaac

SEQ ID NO: 4222002 - RNA, 18 nt, Yersinia pestis KIM
ucguugccccaucagcac

SEQ ID NO: 4222003 - RNA, 21 nt, Yersinia pestis KIM
ucguugcggguuaacucuuca

SEQ ID NO: 4222004 - RNA, 13 nt, Yersinia pestis KIM
ucguuuaaauaaa

SEQ ID NO: 4222005 - RNA, 12 nt, Yersinia pestis KIM
ucguuuacgguu

SEQ ID NO: 4222006 - RNA, 15 nt, Yersinia pestis KIM
ucguuuccagcggcg

SEQ ID NO: 4222007 - RNA, 22 nt, Yersinia pestis KIM
ucguuuccagcggcguaucaaa

SEQ ID NO: 4222008 - RNA, 16 nt, Yersinia pestis KIM
ucguuucucuaaaauu

SEQ ID NO: 4222009 - RNA, 13 nt, Yersinia pestis KIM
ucguuucugucug

SEQ ID NO: 4222010 - RNA, 14 nt, Yersinia pestis KIM
ucguuuguaccugu

SEQ ID NO: 4222011 - RNA, 12 nt, Yersinia pestis KIM
ucguuuuucauu

SEQ ID NO: 4222012 - RNA, 15 nt, Yersinia pestis KIM
ucguuuuucauuuuu

SEQ ID NO: 4222013 - RNA, 23 nt, Yersinia pestis KIM
ucuaaaaggauagggagccaaua

SEQ ID NO: 4222014 - RNA, 23 nt, Yersinia pestis KIM
ucucuguaauggcgcacauuaca

SEQ ID NO: 4222015 - RNA, 13 nt, Yersinia pestis KIM
ucucuuacauaaa

SEQ ID NO: 4222016 - RNA, 14 nt, Yersinia pestis KIM
ucucuuaccccuuu

SEQ ID NO: 4222017 - RNA, 14 nt, Yersinia pestis KIM
ucucuuaggcaacc

SEQ ID NO: 4222018 - RNA, 21 nt, Yersinia pestis KIM
ucucuuaggcaaccuugguga

SEQ ID NO: 4222019 - RNA, 14 nt, Yersinia pestis KIM
ucucuucagagauu

SEQ ID NO: 4222020 - RNA, 16 nt, Yersinia pestis KIM
ucucuucagagauuca

SEQ ID NO: 4222021 - RNA, 18 nt, Yersinia pestis KIM
ucucuucagggcggcguu

SEQ ID NO: 4222022 - RNA, 11 nt, Yersinia pestis KIM
ucucuucccac

SEQ ID NO: 4222023 - RNA, 16 nt, Yersinia pestis KIM
ucucuucgccuuugau

SEQ ID NO: 4222024 - RNA, 17 nt, Yersinia pestis KIM
ucucuugauuaccaaua

SEQ ID NO: 4222025 - RNA, 16 nt, Yersinia pestis KIM
ucucuuuccagcaaaa

SEQ ID NO: 4222026 - RNA, 14 nt, Yersinia pestis KIM
ucucuuucuccaac

SEQ ID NO: 4222027 - RNA, 13 nt, Yersinia pestis KIM
ucucuuuuuucuc

SEQ ID NO: 4222028 - RNA, 18 nt, Yersinia pestis KIM
ucugaaacgccagccucu

SEQ ID NO: 4222029 - RNA, 15 nt, Yersinia pestis KIM
ucugaaacggugagg

SEQ ID NO: 4222030 - RNA, 16 nt, Yersinia pestis KIM
ucugaaagugcccccu

SEQ ID NO: 4222031 - RNA, 22 nt, Yersinia pestis KIM
ucugaaaucuccuccggagagg

SEQ ID NO: 4222032 - RNA, 16 nt, Yersinia pestis KIM
ucugaagaugccaauc

SEQ ID NO: 4222033 - RNA, 18 nt, Yersinia pestis KIM
ucugaagccuacgagaga

SEQ ID NO: 4222034 - RNA, 21 nt, Yersinia pestis KIM
ucugaagcgacacuuauuggu

SEQ ID NO: 4222035 - RNA, 19 nt, Yersinia pestis KIM
ucugaaggguauugaagau

SEQ ID NO: 4222036 - RNA, 19 nt, Yersinia pestis KIM
ucugaauagcgcugcauca

SEQ ID NO: 4222037 - RNA, 22 nt, Yersinia pestis KIM
ucugaauagcgcugcaucagca

SEQ ID NO: 4222038 - RNA, 15 nt, Yersinia pestis KIM
ucugaaucgcugcca

SEQ ID NO: 4222039 - RNA, 19 nt, Yersinia pestis KIM
ucugaaugguuuuagucau

SEQ ID NO: 4222040 - RNA, 13 nt, Yersinia pestis KIM
ucugaccaaacau

SEQ ID NO: 4222041 - RNA, 17 nt, Yersinia pestis KIM
ucugacggguauaucac

SEQ ID NO: 4222042 - RNA, 13 nt, Yersinia pestis KIM
ucugacuaacucu

SEQ ID NO: 4222043 - RNA, 17 nt, Yersinia pestis KIM
ucugacuaacucuucug

SEQ ID NO: 4222044 - RNA, 19 nt, Yersinia pestis KIM
ucugacuaacucuucuggc

SEQ ID NO: 4222045 - RNA, 18 nt, Yersinia pestis KIM
ucugacucuguaaaaauc

SEQ ID NO: 4222046 - RNA, 12 nt, Yersinia pestis KIM
ucugagccaucc

SEQ ID NO: 4222047 - RNA, 16 nt, Yersinia pestis KIM
ucugagccucaugaau

SEQ ID NO: 4222048 - RNA, 19 nt, Yersinia pestis KIM
ucugagccucaugaaugag

SEQ ID NO: 4222049 - RNA, 19 nt, Yersinia pestis KIM
ucugaggauguaguccccc

SEQ ID NO: 4222050 - RNA, 13 nt, Yersinia pestis KIM
ucugaggccaaca

SEQ ID NO: 4222051 - RNA, 19 nt, Yersinia pestis KIM
ucugagguggcacccagug

SEQ ID NO: 4222052 - RNA, 16 nt, Yersinia pestis KIM
ucugaguaccagcaaa

SEQ ID NO: 4222053 - RNA, 21 nt, Yersinia pestis KIM
ucugagucgauagcuuucucc

SEQ ID NO: 4222054 - RNA, 20 nt, Yersinia pestis KIM
ucugagugauuuuccuccca

SEQ ID NO: 4222055 - RNA, 13 nt, Yersinia pestis KIM
ucugauaaaacag

SEQ ID NO: 4222056 - RNA, 20 nt, Yersinia pestis KIM
ucugauaaccguuuuuucaa

SEQ ID NO: 4222057 - RNA, 14 nt, Yersinia pestis KIM
ucugauacugaacg

SEQ ID NO: 4222058 - RNA, 15 nt, Yersinia pestis KIM
ucugauauuaaaaaa

SEQ ID NO: 4222059 - RNA, 14 nt, Yersinia pestis KIM
ucugaugaugguua

SEQ ID NO: 4222060 - RNA, 17 nt, Yersinia pestis KIM
ucugcaacaacuccuuc

SEQ ID NO: 4222061 - RNA, 11 nt, Yersinia pestis KIM
ucugcaacuca

SEQ ID NO: 4222062 - RNA, 16 nt, Yersinia pestis KIM
ucugcaacucagugaa

SEQ ID NO: 4222063 - RNA, 19 nt, Yersinia pestis KIM
ucugcaauacugggcuuau

SEQ ID NO: 4222064 - RNA, 22 nt, Yersinia pestis KIM
ucugcauacagaucgagcauca

SEQ ID NO: 4222065 - RNA, 19 nt, Yersinia pestis KIM
ucugccaaauauugcacaa

SEQ ID NO: 4222066 - RNA, 15 nt, Yersinia pestis KIM
ucugccaaccaggcc

SEQ ID NO: 4222067 - RNA, 20 nt, Yersinia pestis KIM
ucugccaacuggccgccauc

SEQ ID NO: 4222068 - RNA, 21 nt, Yersinia pestis KIM
ucugccaauaaaguccaccuc

SEQ ID NO: 4222069 - RNA, 17 nt, Yersinia pestis KIM
ucugccaauucaaggcc

SEQ ID NO: 4222070 - RNA, 17 nt, Yersinia pestis KIM
ucugccacacugaauuu

SEQ ID NO: 4222071 - RNA, 15 nt, Yersinia pestis KIM
ucugccaccgcacag

SEQ ID NO: 4222072 - RNA, 19 nt, Yersinia pestis KIM
ucugccagauagucaucuu

SEQ ID NO: 4222073 - RNA, 16 nt, Yersinia pestis KIM
ucugccaguucuuuca

SEQ ID NO: 4222074 - RNA, 15 nt, Yersinia pestis KIM
ucugccaugguuggg

SEQ ID NO: 4222075 - RNA, 16 nt, Yersinia pestis KIM
ucugcccagccugguu

SEQ ID NO: 4222076 - RNA, 22 nt, Yersinia pestis KIM
ucugcccagccugguuuuuuaa

SEQ ID NO: 4222077 - RNA, 23 nt, Yersinia pestis KIM
ucugcccccgguuuagauaggca

SEQ ID NO: 4222078 - RNA, 15 nt, Yersinia pestis KIM
ucugccgauuuaaac

SEQ ID NO: 4222079 - RNA, 21 nt, Yersinia pestis KIM
ucugccgccccuuccaauguc

SEQ ID NO: 4222080 - RNA, 19 nt, Yersinia pestis KIM
ucugccuauccucaccguu

SEQ ID NO: 4222081 - RNA, 17 nt, Yersinia pestis KIM
ucugccuaucuuaaaaa

SEQ ID NO: 4222082 - RNA, 13 nt, Yersinia pestis KIM
ucugccuuaucaa

SEQ ID NO: 4222083 - RNA, 15 nt, Yersinia pestis KIM
ucugccuuaugaaua

SEQ ID NO: 4222084 - RNA, 17 nt, Yersinia pestis KIM
ucugcgaauuagucucu

SEQ ID NO: 4222085 - RNA, 19 nt, Yersinia pestis KIM
ucugcgagcguuuaaauac

SEQ ID NO: 4222086 - RNA, 20 nt, Yersinia pestis KIM
ucugcgagcguuuaaauacc

SEQ ID NO: 4222087 - RNA, 17 nt, Yersinia pestis KIM
ucugcgaggccgcugca

SEQ ID NO: 4222088 - RNA, 18 nt, Yersinia pestis KIM
ucugcgccaaaugucacc

SEQ ID NO: 4222089 - RNA, 13 nt, Yersinia pestis KIM
ucugcgcccuuau

SEQ ID NO: 4222090 - RNA, 15 nt, Yersinia pestis KIM
ucugcgcccuuaucu

SEQ ID NO: 4222091 - RNA, 16 nt, Yersinia pestis KIM
ucugcgccuauaccug

SEQ ID NO: 4222092 - RNA, 14 nt, Yersinia pestis KIM
ucugcggauaaaca

SEQ ID NO: 4222093 - RNA, 18 nt, Yersinia pestis KIM
ucugcguuuuucccugua

SEQ ID NO: 4222094 - RNA, 16 nt, Yersinia pestis KIM
ucugcugaaaaucaug

SEQ ID NO: 4222095 - RNA, 13 nt, Yersinia pestis KIM
ucugcugcugccc

SEQ ID NO: 4222096 - RNA, 14 nt, Yersinia pestis KIM
ucugcugggauacu

SEQ ID NO: 4222097 - RNA, 18 nt, Yersinia pestis KIM
ucugcuguugccacagac

SEQ ID NO: 4222098 - RNA, 23 nt, Yersinia pestis KIM
ucugcuuaacucaaucuuugccu

SEQ ID NO: 4222099 - RNA, 16 nt, Yersinia pestis KIM
ucugcuuaguuggugc

SEQ ID NO: 4222100 - RNA, 23 nt, Yersinia pestis KIM
ucuggcgacuaagcgaagauaca

SEQ ID NO: 4222101 - RNA, 16 nt, Yersinia pestis KIM
ucuggcgugucaucuu

SEQ ID NO: 4222102 - RNA, 21 nt, Yersinia pestis KIM
ucuggcguugccgugcuguca

SEQ ID NO: 4222103 - RNA, 18 nt, Yersinia pestis KIM
ucuggcugcuaauggucu

SEQ ID NO: 4222104 - RNA, 23 nt, Yersinia pestis KIM
ucuggcuuaaucgccagcaaauc

SEQ ID NO: 4222105 - RNA, 19 nt, Yersinia pestis KIM
ucuggcuuucucaacagca

SEQ ID NO: 4222106 - RNA, 22 nt, Yersinia pestis KIM
ucuggcuuucucaacagcauca

SEQ ID NO: 4222107 - RNA, 19 nt, Yersinia pestis KIM
ucugggacgugcauaaaac

SEQ ID NO: 4222108 - RNA, 15 nt, Yersinia pestis KIM
ucuggggcaaucaau

SEQ ID NO: 4222109 - RNA, 14 nt, Yersinia pestis KIM
ucuggguaagaaca

SEQ ID NO: 4222110 - RNA, 15 nt, Yersinia pestis KIM
ucuggguaagaacag

SEQ ID NO: 4222111 - RNA, 18 nt, Yersinia pestis KIM
ucuggguaagaacagaga

SEQ ID NO: 4222112 - RNA, 14 nt, Yersinia pestis KIM
ucugggugcugcuc

SEQ ID NO: 4222113 - RNA, 17 nt, Yersinia pestis KIM
ucuggguggcugaaaua

SEQ ID NO: 4222114 - RNA, 18 nt, Yersinia pestis KIM
ucugguagccugcacuuc

SEQ ID NO: 4222115 - RNA, 15 nt, Yersinia pestis KIM
ucugguagcugcuca

SEQ ID NO: 4222116 - RNA, 20 nt, Yersinia pestis KIM
ucugguagucauauucaggc

SEQ ID NO: 4222117 - RNA, 15 nt, Yersinia pestis KIM
ucugguaguuuugca

SEQ ID NO: 4222118 - RNA, 21 nt, Yersinia pestis KIM
ucuggucaucauguagccauu

SEQ ID NO: 4222119 - RNA, 15 nt, Yersinia pestis KIM
ucuggucuugcaccu

SEQ ID NO: 4222120 - RNA, 13 nt, Yersinia pestis KIM
ucuggugccaacg

SEQ ID NO: 4222121 - RNA, 16 nt, Yersinia pestis KIM
ucuguaaaaaucaccu

SEQ ID NO: 4222122 - RNA, 13 nt, Yersinia pestis KIM
ucuguaauaauaa

SEQ ID NO: 4222123 - RNA, 17 nt, Yersinia pestis KIM
ucuguaccacugauacc

SEQ ID NO: 4222124 - RNA, 16 nt, Yersinia pestis KIM
ucuguacgcaauauug

SEQ ID NO: 4222125 - RNA, 18 nt, Yersinia pestis KIM
ucuguacguaaauagguu

SEQ ID NO: 4222126 - RNA, 18 nt, Yersinia pestis KIM
ucuguagaguaaaacuga

SEQ ID NO: 4222127 - RNA, 22 nt, Yersinia pestis KIM
ucugucagcccuaauauccuca

SEQ ID NO: 4222128 - RNA, 16 nt, Yersinia pestis KIM
ucugucguacuuuccu

SEQ ID NO: 4222129 - RNA, 15 nt, Yersinia pestis KIM
ucuuugucaauaacc

SEQ ID NO: 4222130 - RNA, 13 nt, Yersinia pestis KIM
ucuuuguuacaua

SEQ ID NO: 4222131 - RNA, 14 nt, Yersinia pestis KIM
ucuuuuaaagaaga

SEQ ID NO: 4222132 - RNA, 21 nt, Yersinia pestis KIM
ucuuuuagcgcuuuuacauca

SEQ ID NO: 4222133 - RNA, 13 nt, Yersinia pestis KIM
ucuuuucugccaa

SEQ ID NO: 4222134 - RNA, 11 nt, Yersinia pestis KIM
ucuuuuuaauu

SEQ ID NO: 4222135 - RNA, 16 nt, Yersinia pestis KIM
ucuuuuuccacacccu

SEQ ID NO: 4222136 - RNA, 16 nt, Yersinia pestis KIM
ucuuuuucugccugag

SEQ ID NO: 4222137 - RNA, 13 nt, Yersinia pestis KIM
ugaaaaaauaaug

SEQ ID NO: 4222138 - RNA, 12 nt, Yersinia pestis KIM
ugaaaaaauauc

SEQ ID NO: 4222139 - RNA, 13 nt, Yersinia pestis KIM
ugaaaaacugugc

SEQ ID NO: 4222140 - RNA, 14 nt, Yersinia pestis KIM
ugaaaaauaauguu

SEQ ID NO: 4222141 - RNA, 18 nt, Yersinia pestis KIM
ugaaaagguuaacugcag

SEQ ID NO: 4222142 - RNA, 12 nt, Yersinia pestis KIM
ugaaaauauuau

SEQ ID NO: 4222143 - RNA, 14 nt, Yersinia pestis KIM
ugaaaaucaugaaa

SEQ ID NO: 4222144 - RNA, 16 nt, Yersinia pestis KIM
ugaaaaucaugaaauu

SEQ ID NO: 4222145 - RNA, 22 nt, Yersinia pestis KIM
ugaaacacaacaacggugaaca

SEQ ID NO: 4222146 - RNA, 24 nt, Yersinia pestis KIM
ugaaacacaacaacggugaacaga

SEQ ID NO: 4222147 - RNA, 17 nt, Yersinia pestis KIM
ugaaacacuuauuugaa

SEQ ID NO: 4222148 - RNA, 21 nt, Yersinia pestis KIM
ugaaaccauugguaauaaugc

SEQ ID NO: 4222149 - RNA, 19 nt, Yersinia pestis KIM
ugaaaccccuuguuuuaca

SEQ ID NO: 4222150 - RNA, 19 nt, Yersinia pestis KIM
ugaaaccgguaauguucau

SEQ ID NO: 4222151 - RNA, 22 nt, Yersinia pestis KIM
ugaaaccuacaucacacccagc

SEQ ID NO: 4222152 - RNA, 18 nt, Yersinia pestis KIM
ugaaacggugaggauagg

SEQ ID NO: 4222153 - RNA, 19 nt, Yersinia pestis KIM
ugaaacuucaaaaucaagu

SEQ ID NO: 4222154 - RNA, 16 nt, Yersinia pestis KIM
ugaaagccaaucucuu

SEQ ID NO: 4222155 - RNA, 17 nt, Yersinia pestis KIM
ugaaaguggccacucac

SEQ ID NO: 4222156 - RNA, 24 nt, Yersinia pestis KIM
ugaaaguggccacucaccucaguc

SEQ ID NO: 4222157 - RNA, 14 nt, Yersinia pestis KIM
ugaaaguuuauaug

SEQ ID NO: 4222158 - RNA, 12 nt, Yersinia pestis KIM
ugaaauaaacuu

SEQ ID NO: 4222159 - RNA, 19 nt, Yersinia pestis KIM
ugaaauaaacuuuuaugca

SEQ ID NO: 4222160 - RNA, 15 nt, Yersinia pestis KIM
ugaaauaaauaaguu

SEQ ID NO: 4222161 - RNA, 14 nt, Yersinia pestis KIM
ugaaauacuuauuu

SEQ ID NO: 4222162 - RNA, 20 nt, Yersinia pestis KIM
ugaaauacuuauuugaaaca

SEQ ID NO: 4222163 - RNA, 13 nt, Yersinia pestis KIM
ugaaauagucaca

SEQ ID NO: 4222164 - RNA, 20 nt, Yersinia pestis KIM
ugaaauagucacauuucagc

SEQ ID NO: 4222165 - RNA, 14 nt, Yersinia pestis KIM
ugaaauaucaucag

SEQ ID NO: 4222166 - RNA, 16 nt, Yersinia pestis KIM
ugaaaucaguguauua

SEQ ID NO: 4222167 - RNA, 16 nt, Yersinia pestis KIM
ugaaaucgaucauaau

SEQ ID NO: 4222168 - RNA, 17 nt, Yersinia pestis KIM
ugaaaucgaucauaauc

SEQ ID NO: 4222169 - RNA, 23 nt, Yersinia pestis KIM
ugaaauuaaaaugauaugcuuau

SEQ ID NO: 4222170 - RNA, 15 nt, Yersinia pestis KIM
ugaaauuauauucuu

SEQ ID NO: 4222171 - RNA, 21 nt, Yersinia pestis KIM
ugaaauucuguagaguaaaac

SEQ ID NO: 4222172 - RNA, 15 nt, Yersinia pestis KIM
ugaaauuuuuuaauu

SEQ ID NO: 4222173 - RNA, 16 nt, Yersinia pestis KIM
ugaaauuuuuuaauuu

SEQ ID NO: 4222174 - RNA, 17 nt, Yersinia pestis KIM
ugaacaauugccaggcc

SEQ ID NO: 4222175 - RNA, 13 nt, Yersinia pestis KIM
ugaacacagaaac

SEQ ID NO: 4222176 - RNA, 15 nt, Yersinia pestis KIM
ugaacacagaaacga

SEQ ID NO: 4222177 - RNA, 15 nt, Yersinia pestis KIM
ugaacacuuaauucc

SEQ ID NO: 4222178 - RNA, 20 nt, Yersinia pestis KIM
ugaacagauagauaaauguu

SEQ ID NO: 4222179 - RNA, 16 nt, Yersinia pestis KIM
ugaacauagcuaacac

SEQ ID NO: 4222180 - RNA, 19 nt, Yersinia pestis KIM
ugaacauagcuaacaccgc

SEQ ID NO: 4222181 - RNA, 15 nt, Yersinia pestis KIM
ugaacauuauuuuuc

SEQ ID NO: 4222182 - RNA, 23 nt, Yersinia pestis KIM
ugaaccccgguuuuuacuguucu

SEQ ID NO: 4222183 - RNA, 23 nt, Yersinia pestis KIM
ugaacccgccacauugagcaaaa

SEQ ID NO: 4222184 - RNA, 18 nt, Yersinia pestis KIM
ugaaccgcgcucugcugg

SEQ ID NO: 4222185 - RNA, 18 nt, Yersinia pestis KIM
ugaaccgcuaucugcuga

SEQ ID NO: 4222186 - RNA, 14 nt, Yersinia pestis KIM
ugaaccugaaauac

SEQ ID NO: 4222187 - RNA, 19 nt, Yersinia pestis KIM
ugaaccugacgcacagcac

SEQ ID NO: 4222188 - RNA, 15 nt, Yersinia pestis KIM
ugaacgcucuuucug

SEQ ID NO: 4222189 - RNA, 16 nt, Yersinia pestis KIM
ugaacguagcuaacac

SEQ ID NO: 4222190 - RNA, 19 nt, Yersinia pestis KIM
ugaacguagcuaacaccgc

SEQ ID NO: 4222191 - RNA, 14 nt, Yersinia pestis KIM
ugaacguuuaucgc

SEQ ID NO: 4222192 - RNA, 15 nt, Yersinia pestis KIM
ugaacguuuaucgcu

SEQ ID NO: 4222193 - RNA, 22 nt, Yersinia pestis KIM
ugaacucaacuuucucuggcac

SEQ ID NO: 4222194 - RNA, 23 nt, Yersinia pestis KIM
ugaacugaaucacaggccacugc

SEQ ID NO: 4222195 - RNA, 15 nt, Yersinia pestis KIM
ugaacuguggcauga

SEQ ID NO: 4222196 - RNA, 18 nt, Yersinia pestis KIM
ugaacuucaaaucgccaa

SEQ ID NO: 4222197 - RNA, 22 nt, Yersinia pestis KIM
ugaacuucaaaucgccaaacug

SEQ ID NO: 4222198 - RNA, 16 nt, Yersinia pestis KIM
ugaacuucgaaagaaa

SEQ ID NO: 4222199 - RNA, 14 nt, Yersinia pestis KIM
ugaagaaaccuaau

SEQ ID NO: 4222200 - RNA, 12 nt, Yersinia pestis KIM
ugaagaacagca

SEQ ID NO: 4222201 - RNA, 18 nt, Yersinia pestis KIM
ugaagaauuacgcacuaa

SEQ ID NO: 4222202 - RNA, 15 nt, Yersinia pestis KIM
ugaagacaacucuuc

SEQ ID NO: 4222203 - RNA, 15 nt, Yersinia pestis KIM
ugaagacacccguca

SEQ ID NO: 4222204 - RNA, 15 nt, Yersinia pestis KIM
ugaagacacuuuggu

SEQ ID NO: 4222205 - RNA, 18 nt, Yersinia pestis KIM
ugaagagaaauaacccau

SEQ ID NO: 4222206 - RNA, 18 nt, Yersinia pestis KIM
ugaagaggguuuuuaaau

SEQ ID NO: 4222207 - RNA, 20 nt, Yersinia pestis KIM
ugaagaggguuuuuaaauuu

SEQ ID NO: 4222208 - RNA, 22 nt, Yersinia pestis KIM
ugaagaggguuuuuaaauuucu

SEQ ID NO: 4222209 - RNA, 18 nt, Yersinia pestis KIM
ugaagagugaccaaagca

SEQ ID NO: 4222210 - RNA, 21 nt, Yersinia pestis KIM
ugaagagugaccaaagcagua

SEQ ID NO: 4222211 - RNA, 17 nt, Yersinia pestis KIM
ugaagaguuugaucaug

SEQ ID NO: 4222212 - RNA, 12 nt, Yersinia pestis KIM
ugaagauaacgc

SEQ ID NO: 4222213 - RNA, 20 nt, Yersinia pestis KIM
ugaagauacccuucucuuua

SEQ ID NO: 4222214 - RNA, 22 nt, Yersinia pestis KIM
ugaagauacccuucucuuuauc

SEQ ID NO: 4222215 - RNA, 22 nt, Yersinia pestis KIM
ugaagauacccuugagguuauu

SEQ ID NO: 4222216 - RNA, 17 nt, Yersinia pestis KIM
ugaagcgacacuuauug

SEQ ID NO: 4222217 - RNA, 19 nt, Yersinia pestis KIM
ugaagcucauuaauccccg

SEQ ID NO: 4222218 - RNA, 16 nt, Yersinia pestis KIM
ugaagcuguuuccuga

SEQ ID NO: 4222219 - RNA, 14 nt, Yersinia pestis KIM
ugaaggccauaauc

SEQ ID NO: 4222220 - RNA, 16 nt, Yersinia pestis KIM
ugaaggcguagguggu

SEQ ID NO: 4222221 - RNA, 17 nt, Yersinia pestis KIM
ugaaggcugauuaauau

SEQ ID NO: 4222222 - RNA, 18 nt, Yersinia pestis KIM
ugaaggcugauuaauauc

SEQ ID NO: 4222223 - RNA, 21 nt, Yersinia pestis KIM
ugaaggcugauuaauaucaaa

SEQ ID NO: 4222224 - RNA, 18 nt, Yersinia pestis KIM
ugaaguaucaccacguug

SEQ ID NO: 4222225 - RNA, 13 nt, Yersinia pestis KIM
ugaagugagcuga

SEQ ID NO: 4222226 - RNA, 17 nt, Yersinia pestis KIM
ugaagugugcaaauaaa

SEQ ID NO: 4222227 - RNA, 19 nt, Yersinia pestis KIM
ugaaguuaaaaagccugaa

SEQ ID NO: 4222228 - RNA, 16 nt, Yersinia pestis KIM
ugaaguuauuuuuauu

SEQ ID NO: 4222229 - RNA, 20 nt, Yersinia pestis KIM
ugaaguucucaucaaacuca

SEQ ID NO: 4222230 - RNA, 15 nt, Yersinia pestis KIM
ugaaguugauaaaag

SEQ ID NO: 4222231 - RNA, 18 nt, Yersinia pestis KIM
ugaaguuuaccgcaugaa

SEQ ID NO: 4222232 - RNA, 19 nt, Yersinia pestis KIM
ugaaguuuauacuauuuau

SEQ ID NO: 4222233 - RNA, 15 nt, Yersinia pestis KIM
ugaauaaaaccgccc

SEQ ID NO: 4222234 - RNA, 13 nt, Yersinia pestis KIM
ugaauaaaagaga

SEQ ID NO: 4222235 - RNA, 14 nt, Yersinia pestis KIM
ugaauaaauaugac

SEQ ID NO: 4222236 - RNA, 12 nt, Yersinia pestis KIM
ugaauaagacag

SEQ ID NO: 4222237 - RNA, 15 nt, Yersinia pestis KIM
ugaauaauauucaau

SEQ ID NO: 4222238 - RNA, 17 nt, Yersinia pestis KIM
ugaauacaaucauuuaa

SEQ ID NO: 4222239 - RNA, 14 nt, Yersinia pestis KIM
ugaauaccauaaca

SEQ ID NO: 4222240 - RNA, 15 nt, Yersinia pestis KIM
ugaauaccauaacaa

SEQ ID NO: 4222241 - RNA, 12 nt, Yersinia pestis KIM
ugaauaccgcua

SEQ ID NO: 4222242 - RNA, 17 nt, Yersinia pestis KIM
ugaauacgaauuuuuuc

SEQ ID NO: 4222243 - RNA, 17 nt, Yersinia pestis KIM
ugaauacgauaaagaag

SEQ ID NO: 4222244 - RNA, 18 nt, Yersinia pestis KIM
ugaauacguucaaaugau

SEQ ID NO: 4222245 - RNA, 16 nt, Yersinia pestis KIM
ugacguaaaaaggcag

SEQ ID NO: 4222246 - RNA, 13 nt, Yersinia pestis KIM
ugacuaaacugau

SEQ ID NO: 4222247 - RNA, 19 nt, Yersinia pestis KIM
ugacuaacucuucuggcaa

SEQ ID NO: 4222248 - RNA, 23 nt, Yersinia pestis KIM
ugacuaauuaauaaccauaaaau

SEQ ID NO: 4222249 - RNA, 22 nt, Yersinia pestis KIM
ugacuaauuguuugcuuucaga

SEQ ID NO: 4222250 - RNA, 18 nt, Yersinia pestis KIM
ugacuaucccuucaauca

SEQ ID NO: 4222251 - RNA, 16 nt, Yersinia pestis KIM
ugacuauucccuuguu

SEQ ID NO: 4222252 - RNA, 17 nt, Yersinia pestis KIM
ugacuauuuaaauacaa

SEQ ID NO: 4222253 - RNA, 15 nt, Yersinia pestis KIM
ugacucacguauuuu

SEQ ID NO: 4222254 - RNA, 22 nt, Yersinia pestis KIM
ugacucacguauuuucauuuua

SEQ ID NO: 4222255 - RNA, 16 nt, Yersinia pestis KIM
ugacucaucaaaacaa

SEQ ID NO: 4222256 - RNA, 21 nt, Yersinia pestis KIM
ugacucaucuggcguucuacu

SEQ ID NO: 4222257 - RNA, 20 nt, Yersinia pestis KIM
ugacucccuguucguuuccc

SEQ ID NO: 4222258 - RNA, 21 nt, Yersinia pestis KIM
ugacugaaaguuguucauuac

SEQ ID NO: 4222259 - RNA, 22 nt, Yersinia pestis KIM
ugacugaauggcuauuuacucu

SEQ ID NO: 4222260 - RNA, 14 nt, Yersinia pestis KIM
ugacugcuggcagg

SEQ ID NO: 4222261 - RNA, 20 nt, Yersinia pestis KIM
ugacugugcgcggcuagcca

SEQ ID NO: 4222262 - RNA, 21 nt, Yersinia pestis KIM
ugacuuaaauaguucuucgca

SEQ ID NO: 4222263 - RNA, 17 nt, Yersinia pestis KIM
ugacuuacaauaaucug

SEQ ID NO: 4222264 - RNA, 20 nt, Yersinia pestis KIM
ugacuuauaagugcgggaaa

SEQ ID NO: 4222265 - RNA, 14 nt, Yersinia pestis KIM
ugacuucuuaucuu

SEQ ID NO: 4222266 - RNA, 12 nt, Yersinia pestis KIM
ugacuugauuaa

SEQ ID NO: 4222267 - RNA, 17 nt, Yersinia pestis KIM
ugacuuuccuugcuuaa

SEQ ID NO: 4222268 - RNA, 17 nt, Yersinia pestis KIM
ugacuuucuaagcugcc

SEQ ID NO: 4222269 - RNA, 18 nt, Yersinia pestis KIM
ugacuuugucagcagucu

SEQ ID NO: 4222270 - RNA, 23 nt, Yersinia pestis KIM
ugagaaaggauuugaagacaacu

SEQ ID NO: 4222271 - RNA, 16 nt, Yersinia pestis KIM
ugagaaccaguucugg

SEQ ID NO: 4222272 - RNA, 18 nt, Yersinia pestis KIM
ugagaaccaguucuggua

SEQ ID NO: 4222273 - RNA, 21 nt, Yersinia pestis KIM
ugagaaggguauugaagauac

SEQ ID NO: 4222274 - RNA, 23 nt, Yersinia pestis KIM
ugagacagcgcgguuugguacau

SEQ ID NO: 4222275 - RNA, 17 nt, Yersinia pestis KIM
ugagacccgauuucacg

SEQ ID NO: 4222276 - RNA, 14 nt, Yersinia pestis KIM
ugagacuccucuuc

SEQ ID NO: 4222277 - RNA, 12 nt, Yersinia pestis KIM
ugagagaaacuu

SEQ ID NO: 4222278 - RNA, 18 nt, Yersinia pestis KIM
ugagagcauaaccccaac

SEQ ID NO: 4222279 - RNA, 15 nt, Yersinia pestis KIM
ugagauaaggaucug

SEQ ID NO: 4222280 - RNA, 18 nt, Yersinia pestis KIM
ugagauccugaaaauaga

SEQ ID NO: 4222281 - RNA, 15 nt, Yersinia pestis KIM
ugagaugaacacaga

SEQ ID NO: 4222282 - RNA, 13 nt, Yersinia pestis KIM
ugagauuauuggc

SEQ ID NO: 4222283 - RNA, 14 nt, Yersinia pestis KIM
ugagcaaacagugc

SEQ ID NO: 4222284 - RNA, 13 nt, Yersinia pestis KIM
ugagcaaaucccg

SEQ ID NO: 4222285 - RNA, 18 nt, Yersinia pestis KIM
ugagcaaauuuaucagua

SEQ ID NO: 4222286 - RNA, 21 nt, Yersinia pestis KIM
ugagcagcaacuguuuuauug

SEQ ID NO: 4222287 - RNA, 12 nt, Yersinia pestis KIM
ugagcagcucua

SEQ ID NO: 4222288 - RNA, 23 nt, Yersinia pestis KIM
ugagcauacuguuggcaauuuca

SEQ ID NO: 4222289 - RNA, 19 nt, Yersinia pestis KIM
ugagcauauucaguaacaa

SEQ ID NO: 4222290 - RNA, 18 nt, Yersinia pestis KIM
ugagcaucacuucauaca

SEQ ID NO: 4222291 - RNA, 18 nt, Yersinia pestis KIM
ugagccacacauucaguc

SEQ ID NO: 4222292 - RNA, 20 nt, Yersinia pestis KIM
ugagccagaaacgaucuugg

SEQ ID NO: 4222293 - RNA, 21 nt, Yersinia pestis KIM
ugagccagguuuuuuuuacuu

SEQ ID NO: 4222294 - RNA, 20 nt, Yersinia pestis KIM
ugagccgcauugauccucgu

SEQ ID NO: 4222295 - RNA, 22 nt, Yersinia pestis KIM
ugagcgaacugaaugcguugcc

SEQ ID NO: 4222296 - RNA, 23 nt, Yersinia pestis KIM
ugagcgcagaguccucucaccaa

SEQ ID NO: 4222297 - RNA, 14 nt, Yersinia pestis KIM
ugagcgcuauuuau

SEQ ID NO: 4222298 - RNA, 14 nt, Yersinia pestis KIM
ugagcuauuccagu

SEQ ID NO: 4222299 - RNA, 17 nt, Yersinia pestis KIM
ugagcucagccaggcag

SEQ ID NO: 4222300 - RNA, 16 nt, Yersinia pestis KIM
ugagcugaauagccuu

SEQ ID NO: 4222301 - RNA, 15 nt, Yersinia pestis KIM
ugagcugaucugcca

SEQ ID NO: 4222302 - RNA, 18 nt, Yersinia pestis KIM
ugagcuggcaaaacucag

SEQ ID NO: 4222303 - RNA, 15 nt, Yersinia pestis KIM
ugagcuguaaauaua

SEQ ID NO: 4222304 - RNA, 22 nt, Yersinia pestis KIM
ugagcuguaaauauaaaauaau

SEQ ID NO: 4222305 - RNA, 16 nt, Yersinia pestis KIM
ugaggagccauugauu

SEQ ID NO: 4222306 - RNA, 15 nt, Yersinia pestis KIM
ugaggauaggcagaa

SEQ ID NO: 4222307 - RNA, 15 nt, Yersinia pestis KIM
ugaggauaggcagag

SEQ ID NO: 4222308 - RNA, 23 nt, Yersinia pestis KIM
ugaggauaggccggggagccaag

SEQ ID NO: 4222309 - RNA, 17 nt, Yersinia pestis KIM
ugaggaugggcagaaga

SEQ ID NO: 4222310 - RNA, 20 nt, Yersinia pestis KIM
ugaggauuauaauucauuuu

SEQ ID NO: 4222311 - RNA, 15 nt, Yersinia pestis KIM
ugaggauucaagaac

SEQ ID NO: 4222312 - RNA, 21 nt, Yersinia pestis KIM
ugaggcagugaauagggaaua

SEQ ID NO: 4222313 - RNA, 23 nt, Yersinia pestis KIM
ugaggccaacacucaugacaaaa

SEQ ID NO: 4222314 - RNA, 17 nt, Yersinia pestis KIM
ugaggcuaccugcacca

SEQ ID NO: 4222315 - RNA, 18 nt, Yersinia pestis KIM
ugaggcuaccugcaccaa

SEQ ID NO: 4222316 - RNA, 20 nt, Yersinia pestis KIM
ugaggcuaccugcaccaauc

SEQ ID NO: 4222317 - RNA, 12 nt, Yersinia pestis KIM
ugagggccacuu

SEQ ID NO: 4222318 - RNA, 22 nt, Yersinia pestis KIM
ugagggccacuucgguggcccu

SEQ ID NO: 4222319 - RNA, 19 nt, Yersinia pestis KIM
ugagggcguucucaggaac

SEQ ID NO: 4222320 - RNA, 23 nt, Yersinia pestis KIM
ugaggguaagugaauaccgcuaa

SEQ ID NO: 4222321 - RNA, 22 nt, Yersinia pestis KIM
ugagggugaugacaaugcguua

SEQ ID NO: 4222322 - RNA, 15 nt, Yersinia pestis KIM
ugaggguugucagca

SEQ ID NO: 4222323 - RNA, 18 nt, Yersinia pestis KIM
ugaggguugucagcaguc

SEQ ID NO: 4222324 - RNA, 21 nt, Yersinia pestis KIM
ugaggguugucagcagucuga

SEQ ID NO: 4222325 - RNA, 22 nt, Yersinia pestis KIM
ugaggguugucagcagucugaa

SEQ ID NO: 4222326 - RNA, 11 nt, Yersinia pestis KIM
ugaggucagcg

SEQ ID NO: 4222327 - RNA, 20 nt, Yersinia pestis KIM
ugagguggcacccagugacc

SEQ ID NO: 4222328 - RNA, 21 nt, Yersinia pestis KIM
ugagguuagcgagggacgcga

SEQ ID NO: 4222329 - RNA, 13 nt, Yersinia pestis KIM
ugagguucccaac

SEQ ID NO: 4222330 - RNA, 13 nt, Yersinia pestis KIM
ugaguaaaaauuc

SEQ ID NO: 4222331 - RNA, 23 nt, Yersinia pestis KIM
ugaguaaaaauucaagagaggua

SEQ ID NO: 4222332 - RNA, 15 nt, Yersinia pestis KIM
ugaguaaaagauuca

SEQ ID NO: 4222333 - RNA, 20 nt, Yersinia pestis KIM
ugaguaaaccguacauuaaa

SEQ ID NO: 4222334 - RNA, 16 nt, Yersinia pestis KIM
ugaguaagacaacuua

SEQ ID NO: 4222335 - RNA, 17 nt, Yersinia pestis KIM
ugaguaauauuauucaa

SEQ ID NO: 4222336 - RNA, 15 nt, Yersinia pestis KIM
ugaguaauuucagau

SEQ ID NO: 4222337 - RNA, 17 nt, Yersinia pestis KIM
ugaguaauuucagauaa

SEQ ID NO: 4222338 - RNA, 19 nt, Yersinia pestis KIM
ugaguacugcgcuagacca

SEQ ID NO: 4222339 - RNA, 15 nt, Yersinia pestis KIM
ugaguagcauaaaaa

SEQ ID NO: 4222340 - RNA, 23 nt, Yersinia pestis KIM
ugaguauccaauaagcguauuuu

SEQ ID NO: 4222341 - RNA, 13 nt, Yersinia pestis KIM
ugaguaucgauaa

SEQ ID NO: 4222342 - RNA, 21 nt, Yersinia pestis KIM
ugagucacuggggugaaucaa

SEQ ID NO: 4222343 - RNA, 18 nt, Yersinia pestis KIM
ugagucagguggcuauuc

SEQ ID NO: 4222344 - RNA, 12 nt, Yersinia pestis KIM
ugagucagucag

SEQ ID NO: 4222345 - RNA, 23 nt, Yersinia pestis KIM
ugagucguaaaauuuuggcaacc

SEQ ID NO: 4222346 - RNA, 22 nt, Yersinia pestis KIM
ugagucgucugucgggaacacu

SEQ ID NO: 4222347 - RNA, 13 nt, Yersinia pestis KIM
ugagucuauuuau

SEQ ID NO: 4222348 - RNA, 14 nt, Yersinia pestis KIM
ugagucucuggccc

SEQ ID NO: 4222349 - RNA, 20 nt, Yersinia pestis KIM
ugagucugcggauaaacacu

SEQ ID NO: 4222350 - RNA, 17 nt, Yersinia pestis KIM
ugagugaaaauauguag

SEQ ID NO: 4222351 - RNA, 21 nt, Yersinia pestis KIM
ugagugaaaucuccuguggca

SEQ ID NO: 4222352 - RNA, 20 nt, Yersinia pestis KIM
ugagugaaggguugaccgca

SEQ ID NO: 4222353 - RNA, 19 nt, Yersinia pestis KIM
ugaguggacgauaaauuca

SEQ ID NO: 4222354 - RNA, 20 nt, Yersinia pestis KIM
ugaguguuuuucucagcaua

SEQ ID NO: 4222355 - RNA, 17 nt, Yersinia pestis KIM
ugaguuaucuguuucaa

SEQ ID NO: 4222356 - RNA, 12 nt, Yersinia pestis KIM
ugaguuccagcc

SEQ ID NO: 4222357 - RNA, 14 nt, Yersinia pestis KIM
ugaguuccagcccc

SEQ ID NO: 4222358 - RNA, 17 nt, Yersinia pestis KIM
ugaguucugaucauuau

SEQ ID NO: 4222359 - RNA, 21 nt, Yersinia pestis KIM
ugaugugacgucacugaugcu

SEQ ID NO: 4222360 - RNA, 16 nt, Yersinia pestis KIM
ugauguucugccaacc

SEQ ID NO: 4222361 - RNA, 13 nt, Yersinia pestis KIM
ugauuaaaacccc

SEQ ID NO: 4222362 - RNA, 14 nt, Yersinia pestis KIM
ugauuaaaagucaa

SEQ ID NO: 4222363 - RNA, 20 nt, Yersinia pestis KIM
ugauuaaaagucaacugcuc

SEQ ID NO: 4222364 - RNA, 18 nt, Yersinia pestis KIM
ugauuaacauccauugua

SEQ ID NO: 4222365 - RNA, 13 nt, Yersinia pestis KIM
ugauuaaccuuaa

SEQ ID NO: 4222366 - RNA, 13 nt, Yersinia pestis KIM
ugauuaauaucaa

SEQ ID NO: 4222367 - RNA, 14 nt, Yersinia pestis KIM
ugauuaauuuuuca

SEQ ID NO: 4222368 - RNA, 21 nt, Yersinia pestis KIM
ugauuaccaauaauuaauuuc

SEQ ID NO: 4222369 - RNA, 18 nt, Yersinia pestis KIM
ugauuacgggucagcuca

SEQ ID NO: 4222370 - RNA, 16 nt, Yersinia pestis KIM
ugauuacguuccacug

SEQ ID NO: 4222371 - RNA, 18 nt, Yersinia pestis KIM
ugauuaggcauaaauaau

SEQ ID NO: 4222372 - RNA, 13 nt, Yersinia pestis KIM
ugauuauucugcu

SEQ ID NO: 4222373 - RNA, 13 nt, Yersinia pestis KIM
ugauucaauuucg

SEQ ID NO: 4222374 - RNA, 17 nt, Yersinia pestis KIM
ugauucacugauuagcc

SEQ ID NO: 4222375 - RNA, 17 nt, Yersinia pestis KIM
ugauucacuggcaaaaa

SEQ ID NO: 4222376 - RNA, 18 nt, Yersinia pestis KIM
ugauuccgguacugugcu

SEQ ID NO: 4222377 - RNA, 18 nt, Yersinia pestis KIM
ugauuccguauuauuuac

SEQ ID NO: 4222378 - RNA, 16 nt, Yersinia pestis KIM
ugauuccuaagcaaau

SEQ ID NO: 4222379 - RNA, 16 nt, Yersinia pestis KIM
ugauucgcgaccagca

SEQ ID NO: 4222380 - RNA, 19 nt, Yersinia pestis KIM
ugauucgggugagugagcg

SEQ ID NO: 4222381 - RNA, 16 nt, Yersinia pestis KIM
ugauucgucugccauu

SEQ ID NO: 4222382 - RNA, 21 nt, Yersinia pestis KIM
ugauucguuuucggugcaugu

SEQ ID NO: 4222383 - RNA, 17 nt, Yersinia pestis KIM
ugauucucuauucugcu

SEQ ID NO: 4222384 - RNA, 15 nt, Yersinia pestis KIM
ugauucugacguugg

SEQ ID NO: 4222385 - RNA, 23 nt, Yersinia pestis KIM
ugauugaaaaucaguuuacauga

SEQ ID NO: 4222386 - RNA, 13 nt, Yersinia pestis KIM
ugauugauuauca

SEQ ID NO: 4222387 - RNA, 18 nt, Yersinia pestis KIM
ugauugcagaccaaucaa

SEQ ID NO: 4222388 - RNA, 22 nt, Yersinia pestis KIM
ugauuggcgaugcgcuccgcca

SEQ ID NO: 4222389 - RNA, 14 nt, Yersinia pestis KIM
ugauuggcuccuau

SEQ ID NO: 4222390 - RNA, 22 nt, Yersinia pestis KIM
ugauugguggucuuaucauaau

SEQ ID NO: 4222391 - RNA, 18 nt, Yersinia pestis KIM
ugauuguuuuauggcgau

SEQ ID NO: 4222392 - RNA, 15 nt, Yersinia pestis KIM
ugauuuagcuauuga

SEQ ID NO: 4222393 - RNA, 12 nt, Yersinia pestis KIM
ugauuucaaacg

SEQ ID NO: 4222394 - RNA, 15 nt, Yersinia pestis KIM
ugauuucagccaggc

SEQ ID NO: 4222395 - RNA, 13 nt, Yersinia pestis KIM
ugauuuccaucua

SEQ ID NO: 4222396 - RNA, 17 nt, Yersinia pestis KIM
ugauuuguuaaaacagu

SEQ ID NO: 4222397 - RNA, 18 nt, Yersinia pestis KIM
ugauuuguuaaaacaguu

SEQ ID NO: 4222398 - RNA, 14 nt, Yersinia pestis KIM
ugauuuuuauauuu

SEQ ID NO: 4222399 - RNA, 18 nt, Yersinia pestis KIM
ugauuuuuauauuuugag

SEQ ID NO: 4222400 - RNA, 16 nt, Yersinia pestis KIM
ugauuuuuuacuuuuu

SEQ ID NO: 4222401 - RNA, 11 nt, Yersinia pestis KIM
ugcaaaaaaag

SEQ ID NO: 4222402 - RNA, 22 nt, Yersinia pestis KIM
ugcaaaaaaagacacuaaccag

SEQ ID NO: 4222403 - RNA, 14 nt, Yersinia pestis KIM
ugcaaaaucagcau

SEQ ID NO: 4222404 - RNA, 16 nt, Yersinia pestis KIM
ugcaaaaucguuaccg

SEQ ID NO: 4222405 - RNA, 17 nt, Yersinia pestis KIM
ugcaaacauugucuggu

SEQ ID NO: 4222406 - RNA, 23 nt, Yersinia pestis KIM
ugcaaauaauaacgccugcaauu

SEQ ID NO: 4222407 - RNA, 14 nt, Yersinia pestis KIM
ugcaaauggcaggg

SEQ ID NO: 4222408 - RNA, 22 nt, Yersinia pestis KIM
ugcaaaugggugugaacaguga

SEQ ID NO: 4222409 - RNA, 15 nt, Yersinia pestis KIM
ugcaaauguucaaca

SEQ ID NO: 4222410 - RNA, 18 nt, Yersinia pestis KIM
ugcaaauguucaacaaga

SEQ ID NO: 4222411 - RNA, 23 nt, Yersinia pestis KIM
ugcaaauuuaugcgcuuucucga

SEQ ID NO: 4222412 - RNA, 21 nt, Yersinia pestis KIM
ugcaaauuuccagauggcggu

SEQ ID NO: 4222413 - RNA, 13 nt, Yersinia pestis KIM
ugcaacaacuccu

SEQ ID NO: 4222414 - RNA, 20 nt, Yersinia pestis KIM
ugcaacagcgcucauagcaa

SEQ ID NO: 4222415 - RNA, 14 nt, Yersinia pestis KIM
ugcaacauuaaaaa

SEQ ID NO: 4222416 - RNA, 23 nt, Yersinia pestis KIM
ugcaacauuauccguuugcaaca

SEQ ID NO: 4222417 - RNA, 14 nt, Yersinia pestis KIM
ugcaaccaacacca

SEQ ID NO: 4222418 - RNA, 18 nt, Yersinia pestis KIM
ugcaaccgcugaaguggc

SEQ ID NO: 4222419 - RNA, 15 nt, Yersinia pestis KIM
ugcaacgcaggcacu

SEQ ID NO: 4222420 - RNA, 18 nt, Yersinia pestis KIM
ugcaacguuaaagaugaa

SEQ ID NO: 4222421 - RNA, 14 nt, Yersinia pestis KIM
ugcaacuucagcca

SEQ ID NO: 4222422 - RNA, 15 nt, Yersinia pestis KIM
ugcaacuucagccac

SEQ ID NO: 4222423 - RNA, 23 nt, Yersinia pestis KIM
ugcaacuuccuugauuuucauuu

SEQ ID NO: 4222424 - RNA, 19 nt, Yersinia pestis KIM
ugcaaggggcgagccacga

SEQ ID NO: 4222425 - RNA, 16 nt, Yersinia pestis KIM
ugcaauaaauucaaaa

SEQ ID NO: 4222426 - RNA, 15 nt, Yersinia pestis KIM
ugcaauaacaccagc

SEQ ID NO: 4222427 - RNA, 18 nt, Yersinia pestis KIM
ugcaauagcucauuuuaa

SEQ ID NO: 4222428 - RNA, 17 nt, Yersinia pestis KIM
ugcaaucaagggcgaua

SEQ ID NO: 4222429 - RNA, 13 nt, Yersinia pestis KIM
ugcaauccgcuga

SEQ ID NO: 4222430 - RNA, 19 nt, Yersinia pestis KIM
ugcaauccgcugacauugc

SEQ ID NO: 4222431 - RNA, 23 nt, Yersinia pestis KIM
ugcaaucuaaaggccaugcgguu

SEQ ID NO: 4222432 - RNA, 16 nt, Yersinia pestis KIM
ugcaaucuaacuaaua

SEQ ID NO: 4222433 - RNA, 17 nt, Yersinia pestis KIM
ugcaaucuguuauaaaa

SEQ ID NO: 4222434 - RNA, 19 nt, Yersinia pestis KIM
ugcaaugaaggcucauagu

SEQ ID NO: 4222435 - RNA, 14 nt, Yersinia pestis KIM
ugcaaugcccagag

SEQ ID NO: 4222436 - RNA, 21 nt, Yersinia pestis KIM
ugcaauggcuggcaaggcacg

SEQ ID NO: 4222437 - RNA, 23 nt, Yersinia pestis KIM
ugcaauuaauuggcccauaacaa

SEQ ID NO: 4222438 - RNA, 15 nt, Yersinia pestis KIM
ugcaauuauaagcac

SEQ ID NO: 4222439 - RNA, 22 nt, Yersinia pestis KIM
ugcacacgggcgguaaucugcg

SEQ ID NO: 4222440 - RNA, 17 nt, Yersinia pestis KIM
ugcacagguaguaagca

SEQ ID NO: 4222441 - RNA, 22 nt, Yersinia pestis KIM
ugcacaguaggcugaaggccug

SEQ ID NO: 4222442 - RNA, 17 nt, Yersinia pestis KIM
ugcaccaauaacugccc

SEQ ID NO: 4222443 - RNA, 17 nt, Yersinia pestis KIM
ugcacccaauggcaaca

SEQ ID NO: 4222444 - RNA, 16 nt, Yersinia pestis KIM
ugcacccauagcucag

SEQ ID NO: 4222445 - RNA, 20 nt, Yersinia pestis KIM
ugcaccgcugauaaccagca

SEQ ID NO: 4222446 - RNA, 23 nt, Yersinia pestis KIM
ugcaccgcugauaaccagcagcu

SEQ ID NO: 4222447 - RNA, 20 nt, Yersinia pestis KIM
ugcaccucugcugaugucag

SEQ ID NO: 4222448 - RNA, 19 nt, Yersinia pestis KIM
ugcaccugaucgugccauu

SEQ ID NO: 4222449 - RNA, 13 nt, Yersinia pestis KIM
ugcaccuguuaaa

SEQ ID NO: 4222450 - RNA, 20 nt, Yersinia pestis KIM
ugcaccuuccgggcagugaa

SEQ ID NO: 4222451 - RNA, 18 nt, Yersinia pestis KIM
ugcacgacaacaaagccg

SEQ ID NO: 4222452 - RNA, 22 nt, Yersinia pestis KIM
ugcacguuuaauuucacuucca

SEQ ID NO: 4222453 - RNA, 19 nt, Yersinia pestis KIM
ugcacuucuacagggcaua

SEQ ID NO: 4222454 - RNA, 16 nt, Yersinia pestis KIM
ugcagaaaguaaucuu

SEQ ID NO: 4222455 - RNA, 18 nt, Yersinia pestis KIM
ugcagaagggcggccagc

SEQ ID NO: 4222456 - RNA, 15 nt, Yersinia pestis KIM
ugcagagaugcagug

SEQ ID NO: 4222457 - RNA, 17 nt, Yersinia pestis KIM
ugcagauaccacaucaa

SEQ ID NO: 4222458 - RNA, 17 nt, Yersinia pestis KIM
ugcagauacucggcaaa

SEQ ID NO: 4222459 - RNA, 17 nt, Yersinia pestis KIM
ugcagaucggcauuauu

SEQ ID NO: 4222460 - RNA, 19 nt, Yersinia pestis KIM
ugcagaucggcauuauuau

SEQ ID NO: 4222461 - RNA, 23 nt, Yersinia pestis KIM
ugcagauuuuugcuuuccacgcc

SEQ ID NO: 4222462 - RNA, 21 nt, Yersinia pestis KIM
ugcagcaagccgauaaucaau

SEQ ID NO: 4222463 - RNA, 21 nt, Yersinia pestis KIM
ugcagcauuuucagcaacuga

SEQ ID NO: 4222464 - RNA, 21 nt, Yersinia pestis KIM
ugcagccguuccuuggcuaua

SEQ ID NO: 4222465 - RNA, 17 nt, Yersinia pestis KIM
ugcagcgauauacauca

SEQ ID NO: 4222466 - RNA, 18 nt, Yersinia pestis KIM
ugcagcgauauacaucac

SEQ ID NO: 4222467 - RNA, 21 nt, Yersinia pestis KIM
ugcagcgucauggucucacug

SEQ ID NO: 4222468 - RNA, 17 nt, Yersinia pestis KIM
ugcagcuaaaagaugca

SEQ ID NO: 4222469 - RNA, 21 nt, Yersinia pestis KIM
ugcagcucaaagaccacauca

SEQ ID NO: 4222470 - RNA, 22 nt, Yersinia pestis KIM
ugcaggauaaaccuacagccau

SEQ ID NO: 4222471 - RNA, 19 nt, Yersinia pestis KIM
ugcaggauagccaaccccu

SEQ ID NO: 4222472 - RNA, 16 nt, Yersinia pestis KIM
ugcaggcccagcagug

SEQ ID NO: 4222473 - RNA, 17 nt, Yersinia pestis KIM
ugcccagccugguuuuu

SEQ ID NO: 4222474 - RNA, 21 nt, Yersinia pestis KIM
ugcccagucacuaccgcucag

SEQ ID NO: 4222475 - RNA, 19 nt, Yersinia pestis KIM
ugcccaguuuaccauccac

SEQ ID NO: 4222476 - RNA, 20 nt, Yersinia pestis KIM
ugcccaguuuaccauccacu

SEQ ID NO: 4222477 - RNA, 16 nt, Yersinia pestis KIM
ugcccaucagcaucaa

SEQ ID NO: 4222478 - RNA, 11 nt, Yersinia pestis KIM
ugcccauccuc

SEQ ID NO: 4222479 - RNA, 13 nt, Yersinia pestis KIM
ugccccacuucac

SEQ ID NO: 4222480 - RNA, 17 nt, Yersinia pestis KIM
ugcccccagguuucagu

SEQ ID NO: 4222481 - RNA, 17 nt, Yersinia pestis KIM
ugcccccuguaacgcua

SEQ ID NO: 4222482 - RNA, 21 nt, Yersinia pestis KIM
ugccccgaagcucaagcuggc

SEQ ID NO: 4222483 - RNA, 21 nt, Yersinia pestis KIM
ugccccgaagcucaagcuggu

SEQ ID NO: 4222484 - RNA, 20 nt, Yersinia pestis KIM
ugccccucacccguaaacac

SEQ ID NO: 4222485 - RNA, 15 nt, Yersinia pestis KIM
ugccccugauaguca

SEQ ID NO: 4222486 - RNA, 21 nt, Yersinia pestis KIM
ugcccgaucaggugaugucag

SEQ ID NO: 4222487 - RNA, 14 nt, Yersinia pestis KIM
ugcccgcacacuga

SEQ ID NO: 4222488 - RNA, 21 nt, Yersinia pestis KIM
ugcccgcacacugagccgccc

SEQ ID NO: 4222489 - RNA, 14 nt, Yersinia pestis KIM
ugcccgcgcuucca

SEQ ID NO: 4222490 - RNA, 17 nt, Yersinia pestis KIM
ugcccgcgcuuccaggc

SEQ ID NO: 4222491 - RNA, 19 nt, Yersinia pestis KIM
ugcccgcgcuuccaggcug

SEQ ID NO: 4222492 - RNA, 13 nt, Yersinia pestis KIM
ugcccgcgggggc

SEQ ID NO: 4222493 - RNA, 12 nt, Yersinia pestis KIM
ugcccggcugau

SEQ ID NO: 4222494 - RNA, 15 nt, Yersinia pestis KIM
ugcccgguugccuga

SEQ ID NO: 4222495 - RNA, 19 nt, Yersinia pestis KIM
ugcccgguugccugacggc

SEQ ID NO: 4222496 - RNA, 19 nt, Yersinia pestis KIM
ugcccguuaauauuaaucg

SEQ ID NO: 4222497 - RNA, 20 nt, Yersinia pestis KIM
ugcccguuagccaugcauua

SEQ ID NO: 4222498 - RNA, 13 nt, Yersinia pestis KIM
ugcccuaaacagc

SEQ ID NO: 4222499 - RNA, 15 nt, Yersinia pestis KIM
ugcccugauccaggg

SEQ ID NO: 4222500 - RNA, 17 nt, Yersinia pestis KIM
ugcccugccugguauuu

SEQ ID NO: 4222501 - RNA, 16 nt, Yersinia pestis KIM
ugcccuuacuauuuuu

SEQ ID NO: 4222502 - RNA, 21 nt, Yersinia pestis KIM
ugcccuucagaugaauccagc

SEQ ID NO: 4222503 - RNA, 17 nt, Yersinia pestis KIM
ugcccuuugcuauucag

SEQ ID NO: 4222504 - RNA, 14 nt, Yersinia pestis KIM
ugcccuuuuagccu

SEQ ID NO: 4222505 - RNA, 14 nt, Yersinia pestis KIM
ugccgacaaccaac

SEQ ID NO: 4222506 - RNA, 16 nt, Yersinia pestis KIM
ugccgaugucaauaaa

SEQ ID NO: 4222507 - RNA, 19 nt, Yersinia pestis KIM
ugccgcaagaaagaaaaau

SEQ ID NO: 4222508 - RNA, 16 nt, Yersinia pestis KIM
ugccgcaggucccucu

SEQ ID NO: 4222509 - RNA, 13 nt, Yersinia pestis KIM
ugccgcauuaccc

SEQ ID NO: 4222510 - RNA, 16 nt, Yersinia pestis KIM
ugccgccccuuccaau

SEQ ID NO: 4222511 - RNA, 14 nt, Yersinia pestis KIM
ugccgccucugcuc

SEQ ID NO: 4222512 - RNA, 19 nt, Yersinia pestis KIM
ugccgccucugcuccggua

SEQ ID NO: 4222513 - RNA, 17 nt, Yersinia pestis KIM
ugccgcgcccccagcca

SEQ ID NO: 4222514 - RNA, 19 nt, Yersinia pestis KIM
ugccgcgcccccagccauu

SEQ ID NO: 4222515 - RNA, 23 nt, Yersinia pestis KIM
ugccgcuaacgucgcuguuacuc

SEQ ID NO: 4222516 - RNA, 12 nt, Yersinia pestis KIM
ugccgcuuuagu

SEQ ID NO: 4222517 - RNA, 15 nt, Yersinia pestis KIM
ugccggcggcgcugg

SEQ ID NO: 4222518 - RNA, 17 nt, Yersinia pestis KIM
ugccgggcaauguguag

SEQ ID NO: 4222519 - RNA, 16 nt, Yersinia pestis KIM
ugccggugagcacgau

SEQ ID NO: 4222520 - RNA, 15 nt, Yersinia pestis KIM
ugccguaaacaauaa

SEQ ID NO: 4222521 - RNA, 18 nt, Yersinia pestis KIM
ugccguacaacaauaaua

SEQ ID NO: 4222522 - RNA, 19 nt, Yersinia pestis KIM
ugccgucauuaugcauuuc

SEQ ID NO: 4222523 - RNA, 15 nt, Yersinia pestis KIM
ugccgugucuuccag

SEQ ID NO: 4222524 - RNA, 18 nt, Yersinia pestis KIM
ugccgugucuuccagaca

SEQ ID NO: 4222525 - RNA, 22 nt, Yersinia pestis KIM
ugccguucuccaguugccagca

SEQ ID NO: 4222526 - RNA, 18 nt, Yersinia pestis KIM
ugccguuuaaaucgggca

SEQ ID NO: 4222527 - RNA, 23 nt, Yersinia pestis KIM
ugccguuuugcagaucaaucgca

SEQ ID NO: 4222528 - RNA, 15 nt, Yersinia pestis KIM
ugccuacugaagagu

SEQ ID NO: 4222529 - RNA, 14 nt, Yersinia pestis KIM
ugccuauccucacc

SEQ ID NO: 4222530 - RNA, 17 nt, Yersinia pestis KIM
ugccuauccucaccguu

SEQ ID NO: 4222531 - RNA, 21 nt, Yersinia pestis KIM
ugccugacagccugugcccaa

SEQ ID NO: 4222532 - RNA, 14 nt, Yersinia pestis KIM
ugccugcuggcaaa

SEQ ID NO: 4222533 - RNA, 21 nt, Yersinia pestis KIM
ugccugguauuuucuauacca

SEQ ID NO: 4222534 - RNA, 12 nt, Yersinia pestis KIM
ugccugucauca

SEQ ID NO: 4222535 - RNA, 14 nt, Yersinia pestis KIM
ugccugugcggcag

SEQ ID NO: 4222536 - RNA, 19 nt, Yersinia pestis KIM
ugccugugcggcagugaac

SEQ ID NO: 4222537 - RNA, 20 nt, Yersinia pestis KIM
ugccugugcggcagugaacg

SEQ ID NO: 4222538 - RNA, 20 nt, Yersinia pestis KIM
ugccugugcggcagugaacu

SEQ ID NO: 4222539 - RNA, 13 nt, Yersinia pestis KIM
ugccuguucucuc

SEQ ID NO: 4222540 - RNA, 15 nt, Yersinia pestis KIM
ugccuuauccccgcc

SEQ ID NO: 4222541 - RNA, 19 nt, Yersinia pestis KIM
ugccuucacugguuuucag

SEQ ID NO: 4222542 - RNA, 22 nt, Yersinia pestis KIM
ugccuucuccuuucuguuccau

SEQ ID NO: 4222543 - RNA, 15 nt, Yersinia pestis KIM
ugccuugccauccau

SEQ ID NO: 4222544 - RNA, 20 nt, Yersinia pestis KIM
ugccuuggucucagaacaag

SEQ ID NO: 4222545 - RNA, 16 nt, Yersinia pestis KIM
ugccuuucuguaacuc

SEQ ID NO: 4222546 - RNA, 23 nt, Yersinia pestis KIM
ugccuuucuguaacucaaauuau

SEQ ID NO: 4222547 - RNA, 16 nt, Yersinia pestis KIM
ugcgaaaauuuaacua

SEQ ID NO: 4222548 - RNA, 16 nt, Yersinia pestis KIM
ugcgaaauaaaugcga

SEQ ID NO: 4222549 - RNA, 16 nt, Yersinia pestis KIM
ugcgaagaucacucau

SEQ ID NO: 4222550 - RNA, 19 nt, Yersinia pestis KIM
ugcgaauauugcguuaccu

SEQ ID NO: 4222551 - RNA, 23 nt, Yersinia pestis KIM
ugcgaauggaaaaacgugaauau

SEQ ID NO: 4222552 - RNA, 17 nt, Yersinia pestis KIM
ugcgacaccugcuauca

SEQ ID NO: 4222553 - RNA, 17 nt, Yersinia pestis KIM
ugcgacacgcucaucca

SEQ ID NO: 4222554 - RNA, 21 nt, Yersinia pestis KIM
ugcgacaggcucagcacaaac

SEQ ID NO: 4222555 - RNA, 22 nt, Yersinia pestis KIM
ugcgacauaaagcaaacgccgc

SEQ ID NO: 4222556 - RNA, 21 nt, Yersinia pestis KIM
ugcgagcguuuaaauacccgg

SEQ ID NO: 4222557 - RNA, 22 nt, Yersinia pestis KIM
ugcgauacaccauuuccaggcu

SEQ ID NO: 4222558 - RNA, 23 nt, Yersinia pestis KIM
ugcgauacaccauuuccaggcua

SEQ ID NO: 4222559 - RNA, 18 nt, Yersinia pestis KIM
ugcgaucaauuggcccuu

SEQ ID NO: 4222560 - RNA, 20 nt, Yersinia pestis KIM
ugcgauuucacggauaucaa

SEQ ID NO: 4222561 - RNA, 12 nt, Yersinia pestis KIM
ugcgcaaaauua

SEQ ID NO: 4222562 - RNA, 20 nt, Yersinia pestis KIM
ugcgcaaauccugaauggca

SEQ ID NO: 4222563 - RNA, 13 nt, Yersinia pestis KIM
ugcgcaacuugcu

SEQ ID NO: 4222564 - RNA, 14 nt, Yersinia pestis KIM
ugcgcagcaaauaa

SEQ ID NO: 4222565 - RNA, 20 nt, Yersinia pestis KIM
ugcgcaucaaugauucgcug

SEQ ID NO: 4222566 - RNA, 14 nt, Yersinia pestis KIM
ugcgcaucagccag

SEQ ID NO: 4222567 - RNA, 15 nt, Yersinia pestis KIM
ugcgcaucagccagc

SEQ ID NO: 4222568 - RNA, 17 nt, Yersinia pestis KIM
ugcgccaaguccuccuu

SEQ ID NO: 4222569 - RNA, 13 nt, Yersinia pestis KIM
ugcgccaaucgcc

SEQ ID NO: 4222570 - RNA, 14 nt, Yersinia pestis KIM
ugcgccagccaauc

SEQ ID NO: 4222571 - RNA, 17 nt, Yersinia pestis KIM
ugcgccaguggcaucaa

SEQ ID NO: 4222572 - RNA, 21 nt, Yersinia pestis KIM
ugcgccauuaccacuguuacc

SEQ ID NO: 4222573 - RNA, 22 nt, Yersinia pestis KIM
ugcgcccgguaauaaugaacaa

SEQ ID NO: 4222574 - RNA, 21 nt, Yersinia pestis KIM
ugcgcccuuaucuaucucagg

SEQ ID NO: 4222575 - RNA, 19 nt, Yersinia pestis KIM
ugcgcccuuuuccgucagc

SEQ ID NO: 4222576 - RNA, 15 nt, Yersinia pestis KIM
ugcgcuaacagcguu

SEQ ID NO: 4222577 - RNA, 23 nt, Yersinia pestis KIM
ugcgcucaaccgaagcugcggcu

SEQ ID NO: 4222578 - RNA, 18 nt, Yersinia pestis KIM
ugcgcuccauuucugguu

SEQ ID NO: 4222579 - RNA, 15 nt, Yersinia pestis KIM
ugcgcucuaaacgaa

SEQ ID NO: 4222580 - RNA, 19 nt, Yersinia pestis KIM
ugcgcucuguauuguaaua

SEQ ID NO: 4222581 - RNA, 16 nt, Yersinia pestis KIM
ugcgcugagugauagu

SEQ ID NO: 4222582 - RNA, 18 nt, Yersinia pestis KIM
ugcgcugaguuugcuacu

SEQ ID NO: 4222583 - RNA, 12 nt, Yersinia pestis KIM
ugcgcuggcucu

SEQ ID NO: 4222584 - RNA, 23 nt, Yersinia pestis KIM
ugcgcuuucagcacgcuuuccag

SEQ ID NO: 4222585 - RNA, 23 nt, Yersinia pestis KIM
ugcggaauucaggccuugauggc

SEQ ID NO: 4222586 - RNA, 19 nt, Yersinia pestis KIM
ugcggaguaacacuucaga

SEQ ID NO: 4222587 - RNA, 20 nt, Yersinia pestis KIM
ugcugugguugauccgaguu

SEQ ID NO: 4222588 - RNA, 17 nt, Yersinia pestis KIM
ugcuguguguucaaacu

SEQ ID NO: 4222589 - RNA, 18 nt, Yersinia pestis KIM
ugcuguuacgcacaaaca

SEQ ID NO: 4222590 - RNA, 23 nt, Yersinia pestis KIM
ugcuguuaguaacuguaaggcca

SEQ ID NO: 4222591 - RNA, 14 nt, Yersinia pestis KIM
ugcuguuauuacug

SEQ ID NO: 4222592 - RNA, 16 nt, Yersinia pestis KIM
ugcuguuauuacuguc

SEQ ID NO: 4222593 - RNA, 13 nt, Yersinia pestis KIM
ugcuguugccaca

SEQ ID NO: 4222594 - RNA, 13 nt, Yersinia pestis KIM
ugcuuaaaacagg

SEQ ID NO: 4222595 - RNA, 20 nt, Yersinia pestis KIM
ugcuuaccacuggccuccca

SEQ ID NO: 4222596 - RNA, 13 nt, Yersinia pestis KIM
ugcuuauccagcc

SEQ ID NO: 4222597 - RNA, 14 nt, Yersinia pestis KIM
ugcuuauuucacac

SEQ ID NO: 4222598 - RNA, 19 nt, Yersinia pestis KIM
ugcuucaaauccucggguu

SEQ ID NO: 4222599 - RNA, 13 nt, Yersinia pestis KIM
ugcuucaagcccg

SEQ ID NO: 4222600 - RNA, 21 nt, Yersinia pestis KIM
ugcuucaagcccgaaauucag

SEQ ID NO: 4222601 - RNA, 13 nt, Yersinia pestis KIM
ugcuucacaucau

SEQ ID NO: 4222602 - RNA, 15 nt, Yersinia pestis KIM
ugcuucacggacagc

SEQ ID NO: 4222603 - RNA, 21 nt, Yersinia pestis KIM
ugcuucacggacagcaaccac

SEQ ID NO: 4222604 - RNA, 11 nt, Yersinia pestis KIM
ugcuucagaca

SEQ ID NO: 4222605 - RNA, 16 nt, Yersinia pestis KIM
ugcuucaucacuguug

SEQ ID NO: 4222606 - RNA, 14 nt, Yersinia pestis KIM
ugcuuccaacucac

SEQ ID NO: 4222607 - RNA, 21 nt, Yersinia pestis KIM
ugcuucuccuguaaugcauuc

SEQ ID NO: 4222608 - RNA, 20 nt, Yersinia pestis KIM
ugcuugaagugcgaagcgca

SEQ ID NO: 4222609 - RNA, 15 nt, Yersinia pestis KIM
ugcuugauggcauca

SEQ ID NO: 4222610 - RNA, 22 nt, Yersinia pestis KIM
ugcuugcgcguuaaucugcugc

SEQ ID NO: 4222611 - RNA, 22 nt, Yersinia pestis KIM
ugcuuggauuccgucgccaaca

SEQ ID NO: 4222612 - RNA, 18 nt, Yersinia pestis KIM
ugcuuguuguugauaguu

SEQ ID NO: 4222613 - RNA, 22 nt, Yersinia pestis KIM
ugcuuuaaauaacgcaaaaauc

SEQ ID NO: 4222614 - RNA, 21 nt, Yersinia pestis KIM
ugcuuuaaugaguuggcauuc

SEQ ID NO: 4222615 - RNA, 17 nt, Yersinia pestis KIM
ugcuuucagauaaugcc

SEQ ID NO: 4222616 - RNA, 16 nt, Yersinia pestis KIM
ugcuuucuaacaaacc

SEQ ID NO: 4222617 - RNA, 12 nt, Yersinia pestis KIM
ugcuuuuaacuc

SEQ ID NO: 4222618 - RNA, 18 nt, Yersinia pestis KIM
ugcuuuucuuucccgccg

SEQ ID NO: 4222619 - RNA, 20 nt, Yersinia pestis KIM
ugcuuuuugcuguucuaucu

SEQ ID NO: 4222620 - RNA, 13 nt, Yersinia pestis KIM
ugcuuuuugcuuu

SEQ ID NO: 4222621 - RNA, 13 nt, Yersinia pestis KIM
uggaaaaacugaa

SEQ ID NO: 4222622 - RNA, 21 nt, Yersinia pestis KIM
uggaaaaauuagccaagcaac

SEQ ID NO: 4222623 - RNA, 13 nt, Yersinia pestis KIM
uggaaaacagcaa

SEQ ID NO: 4222624 - RNA, 23 nt, Yersinia pestis KIM
uggaaaaguaggacggugccaug

SEQ ID NO: 4222625 - RNA, 16 nt, Yersinia pestis KIM
uggaaacaaaaccuaa

SEQ ID NO: 4222626 - RNA, 17 nt, Yersinia pestis KIM
uggaaaccggcaauagc

SEQ ID NO: 4222627 - RNA, 15 nt, Yersinia pestis KIM
uggaagcagaauacu

SEQ ID NO: 4222628 - RNA, 17 nt, Yersinia pestis KIM
uggaagcagaauacugu

SEQ ID NO: 4222629 - RNA, 20 nt, Yersinia pestis KIM
uggaagccgacgaucuugcc

SEQ ID NO: 4222630 - RNA, 14 nt, Yersinia pestis KIM
uggaagggccgcua

SEQ ID NO: 4222631 - RNA, 15 nt, Yersinia pestis KIM
uggaaguacuuauuu

SEQ ID NO: 4222632 - RNA, 15 nt, Yersinia pestis KIM
uggaaguuaaaaaaa

SEQ ID NO: 4222633 - RNA, 15 nt, Yersinia pestis KIM
uggaauuaaaguauc

SEQ ID NO: 4222634 - RNA, 13 nt, Yersinia pestis KIM
uggaauuaauauc

SEQ ID NO: 4222635 - RNA, 16 nt, Yersinia pestis KIM
uggaauucgacaauga

SEQ ID NO: 4222636 - RNA, 16 nt, Yersinia pestis KIM
uggaauuuaugcacca

SEQ ID NO: 4222637 - RNA, 24 nt, Yersinia pestis KIM
uggacaguaaguugaugacaugcu

SEQ ID NO: 4222638 - RNA, 23 nt, Yersinia pestis KIM
uggacgaacagccccaaccaucu

SEQ ID NO: 4222639 - RNA, 14 nt, Yersinia pestis KIM
uggacgcaucagau

SEQ ID NO: 4222640 - RNA, 18 nt, Yersinia pestis KIM
uggacgcuggcagccuuu

SEQ ID NO: 4222641 - RNA, 15 nt, Yersinia pestis KIM
uggacguuugcugcu

SEQ ID NO: 4222642 - RNA, 19 nt, Yersinia pestis KIM
uggacuacacagacuggug

SEQ ID NO: 4222643 - RNA, 14 nt, Yersinia pestis KIM
uggagaauaguggg

SEQ ID NO: 4222644 - RNA, 12 nt, Yersinia pestis KIM
uggagagcaggg

SEQ ID NO: 4222645 - RNA, 21 nt, Yersinia pestis KIM
uggagagcagggcccgccauu

SEQ ID NO: 4222646 - RNA, 18 nt, Yersinia pestis KIM
uggagccagccauucuga

SEQ ID NO: 4222647 - RNA, 11 nt, Yersinia pestis KIM
uggagccugua

SEQ ID NO: 4222648 - RNA, 22 nt, Yersinia pestis KIM
uggagccuguacauaaauuugu

SEQ ID NO: 4222649 - RNA, 13 nt, Yersinia pestis KIM
uggagcuauggaa

SEQ ID NO: 4222650 - RNA, 16 nt, Yersinia pestis KIM
uggagcuauggaagaa

SEQ ID NO: 4222651 - RNA, 14 nt, Yersinia pestis KIM
uggaggaaggcggu

SEQ ID NO: 4222652 - RNA, 19 nt, Yersinia pestis KIM
uggagguguauuuuuaugg

SEQ ID NO: 4222653 - RNA, 22 nt, Yersinia pestis KIM
uggaguuaaaucccugugcuga

SEQ ID NO: 4222654 - RNA, 14 nt, Yersinia pestis KIM
uggauaaaaacauu

SEQ ID NO: 4222655 - RNA, 17 nt, Yersinia pestis KIM
uggauaaggugaugaau

SEQ ID NO: 4222656 - RNA, 15 nt, Yersinia pestis KIM
uggauaauuuaauua

SEQ ID NO: 4222657 - RNA, 21 nt, Yersinia pestis KIM
uggauaauuugccuggcgaau

SEQ ID NO: 4222658 - RNA, 16 nt, Yersinia pestis KIM
uggauagcuucaggaa

SEQ ID NO: 4222659 - RNA, 20 nt, Yersinia pestis KIM
uggauauagagauaaaaagg

SEQ ID NO: 4222660 - RNA, 14 nt, Yersinia pestis KIM
uggauauauuuaca

SEQ ID NO: 4222661 - RNA, 19 nt, Yersinia pestis KIM
uggauauuaucugguuggc

SEQ ID NO: 4222662 - RNA, 20 nt, Yersinia pestis KIM
uggauauuuuccgggucaaa

SEQ ID NO: 4222663 - RNA, 13 nt, Yersinia pestis KIM
uggaucacaucac

SEQ ID NO: 4222664 - RNA, 18 nt, Yersinia pestis KIM
uggaucaugaaaaaugag

SEQ ID NO: 4222665 - RNA, 22 nt, Yersinia pestis KIM
uggauccagcaccacaauggca

SEQ ID NO: 4222666 - RNA, 18 nt, Yersinia pestis KIM
uggaucucuccagccugc

SEQ ID NO: 4222667 - RNA, 19 nt, Yersinia pestis KIM
uggaugagccgcagccagc

SEQ ID NO: 4222668 - RNA, 15 nt, Yersinia pestis KIM
uggaugcucauuggu

SEQ ID NO: 4222669 - RNA, 17 nt, Yersinia pestis KIM
uggauuaaguccaagaa

SEQ ID NO: 4222670 - RNA, 15 nt, Yersinia pestis KIM
uggauuacuuacggc

SEQ ID NO: 4222671 - RNA, 13 nt, Yersinia pestis KIM
uggauucaccaag

SEQ ID NO: 4222672 - RNA, 17 nt, Yersinia pestis KIM
uggauugaaaucagauc

SEQ ID NO: 4222673 - RNA, 15 nt, Yersinia pestis KIM
uggauugagccaccg

SEQ ID NO: 4222674 - RNA, 18 nt, Yersinia pestis KIM
uggcaaaacucaggugag

SEQ ID NO: 4222675 - RNA, 22 nt, Yersinia pestis KIM
uggcaaaacucaggugaguaaa

SEQ ID NO: 4222676 - RNA, 18 nt, Yersinia pestis KIM
uggcaaaccggacauaau

SEQ ID NO: 4222677 - RNA, 15 nt, Yersinia pestis KIM
uggcaaacucagcca

SEQ ID NO: 4222678 - RNA, 18 nt, Yersinia pestis KIM
uggcaaauuuagccgcaa

SEQ ID NO: 4222679 - RNA, 18 nt, Yersinia pestis KIM
uggcaaccccuaauccag

SEQ ID NO: 4222680 - RNA, 19 nt, Yersinia pestis KIM
uggcaaccccuaauccagc

SEQ ID NO: 4222681 - RNA, 16 nt, Yersinia pestis KIM
uggcaacugcaaaugu

SEQ ID NO: 4222682 - RNA, 13 nt, Yersinia pestis KIM
uggcaagcccuga

SEQ ID NO: 4222683 - RNA, 14 nt, Yersinia pestis KIM
uggcaauaaaggca

SEQ ID NO: 4222684 - RNA, 18 nt, Yersinia pestis KIM
uggcaauaauucagauga

SEQ ID NO: 4222685 - RNA, 14 nt, Yersinia pestis KIM
uggcaauuucucug

SEQ ID NO: 4222686 - RNA, 19 nt, Yersinia pestis KIM
uggcaccacggucagagau

SEQ ID NO: 4222687 - RNA, 17 nt, Yersinia pestis KIM
uggcaccauuugcccug

SEQ ID NO: 4222688 - RNA, 15 nt, Yersinia pestis KIM
uggcacgggcgcagg

SEQ ID NO: 4222689 - RNA, 18 nt, Yersinia pestis KIM
uggcacucucuucaucag

SEQ ID NO: 4222690 - RNA, 19 nt, Yersinia pestis KIM
uggcacuggaaacaaaacc

SEQ ID NO: 4222691 - RNA, 16 nt, Yersinia pestis KIM
uggcagauuggcuugc

SEQ ID NO: 4222692 - RNA, 16 nt, Yersinia pestis KIM
uggcagcggcaaauag

SEQ ID NO: 4222693 - RNA, 18 nt, Yersinia pestis KIM
uggcagcggcaaauagag

SEQ ID NO: 4222694 - RNA, 23 nt, Yersinia pestis KIM
uggcagcggcaaauagagcacca

SEQ ID NO: 4222695 - RNA, 20 nt, Yersinia pestis KIM
uggcagcguuucaccaaaca

SEQ ID NO: 4222696 - RNA, 15 nt, Yersinia pestis KIM
uggcaggccccauca

SEQ ID NO: 4222697 - RNA, 17 nt, Yersinia pestis KIM
uggcagucacugcugca

SEQ ID NO: 4222698 - RNA, 21 nt, Yersinia pestis KIM
uggcagugacauuaccugcgc

SEQ ID NO: 4222699 - RNA, 14 nt, Yersinia pestis KIM
uggcauaaucaacg

SEQ ID NO: 4222700 - RNA, 15 nt, Yersinia pestis KIM
uggcauacagcucau

SEQ ID NO: 4222701 - RNA, 14 nt, Yersinia pestis KIM
uggcauauucacca

SEQ ID NO: 4222702 - RNA, 22 nt, Yersinia pestis KIM
ugggcuucagcgguagcaaagc

SEQ ID NO: 4222703 - RNA, 18 nt, Yersinia pestis KIM
uggggacaggcuccuccu

SEQ ID NO: 4222704 - RNA, 23 nt, Yersinia pestis KIM
uggggcacaauucuugaaauuau

SEQ ID NO: 4222705 - RNA, 16 nt, Yersinia pestis KIM
uggggcauuuaauuca

SEQ ID NO: 4222706 - RNA, 11 nt, Yersinia pestis KIM
uggggccaccu

SEQ ID NO: 4222707 - RNA, 21 nt, Yersinia pestis KIM
uggggccaccuaauccaaggc

SEQ ID NO: 4222708 - RNA, 22 nt, Yersinia pestis KIM
uggggccaccuaauccaaggcg

SEQ ID NO: 4222709 - RNA, 13 nt, Yersinia pestis KIM
ugggggaccagca

SEQ ID NO: 4222710 - RNA, 21 nt, Yersinia pestis KIM
uggguaaaccaaucaagcaua

SEQ ID NO: 4222711 - RNA, 13 nt, Yersinia pestis KIM
uggguaauaucac

SEQ ID NO: 4222712 - RNA, 18 nt, Yersinia pestis KIM
uggguaauucauuauuac

SEQ ID NO: 4222713 - RNA, 23 nt, Yersinia pestis KIM
uggguauauaguuuauuuuauuu

SEQ ID NO: 4222714 - RNA, 15 nt, Yersinia pestis KIM
uggguauaugacugu

SEQ ID NO: 4222715 - RNA, 16 nt, Yersinia pestis KIM
uggguaucuggagcca

SEQ ID NO: 4222716 - RNA, 17 nt, Yersinia pestis KIM
uggguaugggugacucu

SEQ ID NO: 4222717 - RNA, 15 nt, Yersinia pestis KIM
uggguauggucagca

SEQ ID NO: 4222718 - RNA, 22 nt, Yersinia pestis KIM
uggguauggucagcaauaacca

SEQ ID NO: 4222719 - RNA, 15 nt, Yersinia pestis KIM
ugggucaucacccag

SEQ ID NO: 4222720 - RNA, 23 nt, Yersinia pestis KIM
ugggucauuaauuaagcuauugg

SEQ ID NO: 4222721 - RNA, 14 nt, Yersinia pestis KIM
ugggugaacacaga

SEQ ID NO: 4222722 - RNA, 17 nt, Yersinia pestis KIM
ugggugaugugacguca

SEQ ID NO: 4222723 - RNA, 13 nt, Yersinia pestis KIM
ugggugcugcucc

SEQ ID NO: 4222724 - RNA, 17 nt, Yersinia pestis KIM
ugggugcugcucccgua

SEQ ID NO: 4222725 - RNA, 12 nt, Yersinia pestis KIM
uggguggccagu

SEQ ID NO: 4222726 - RNA, 18 nt, Yersinia pestis KIM
ugggugucaggaagcaag

SEQ ID NO: 4222727 - RNA, 13 nt, Yersinia pestis KIM
ugggugugaacag

SEQ ID NO: 4222728 - RNA, 21 nt, Yersinia pestis KIM
uggguuaaauagugggcuaaa

SEQ ID NO: 4222729 - RNA, 14 nt, Yersinia pestis KIM
uggguucaucaacu

SEQ ID NO: 4222730 - RNA, 18 nt, Yersinia pestis KIM
uggguucaucaacugaca

SEQ ID NO: 4222731 - RNA, 14 nt, Yersinia pestis KIM
uggguuugcgggca

SEQ ID NO: 4222732 - RNA, 20 nt, Yersinia pestis KIM
ugguaccaaauaacaacaca

SEQ ID NO: 4222733 - RNA, 16 nt, Yersinia pestis KIM
ugguaccaaucuccaa

SEQ ID NO: 4222734 - RNA, 19 nt, Yersinia pestis KIM
ugguaccaaucuccaauga

SEQ ID NO: 4222735 - RNA, 19 nt, Yersinia pestis KIM
ugguacgacgccagauagc

SEQ ID NO: 4222736 - RNA, 19 nt, Yersinia pestis KIM
ugguacggaaaauaggggc

SEQ ID NO: 4222737 - RNA, 14 nt, Yersinia pestis KIM
ugguacugaccgua

SEQ ID NO: 4222738 - RNA, 14 nt, Yersinia pestis KIM
ugguauaaauggca

SEQ ID NO: 4222739 - RNA, 20 nt, Yersinia pestis KIM
ugguauagacuguuuuauua

SEQ ID NO: 4222740 - RNA, 22 nt, Yersinia pestis KIM
ugguauagacuguuuuauuaua

SEQ ID NO: 4222741 - RNA, 15 nt, Yersinia pestis KIM
uggucaacagugaac

SEQ ID NO: 4222742 - RNA, 20 nt, Yersinia pestis KIM
uggucaacagugaacgggcg

SEQ ID NO: 4222743 - RNA, 18 nt, Yersinia pestis KIM
uggucaccacauccgcgg

SEQ ID NO: 4222744 - RNA, 23 nt, Yersinia pestis KIM
uggucagcaauaaccaacgggca

SEQ ID NO: 4222745 - RNA, 18 nt, Yersinia pestis KIM
uggucagcacuuccaacu

SEQ ID NO: 4222746 - RNA, 15 nt, Yersinia pestis KIM
uggucauaaaaucga

SEQ ID NO: 4222747 - RNA, 17 nt, Yersinia pestis KIM
uggucauaaucaucugc

SEQ ID NO: 4222748 - RNA, 18 nt, Yersinia pestis KIM
uggucauccacaaccaga

SEQ ID NO: 4222749 - RNA, 14 nt, Yersinia pestis KIM
uggucauuuuuccc

SEQ ID NO: 4222750 - RNA, 15 nt, Yersinia pestis KIM
ugguccagaucggca

SEQ ID NO: 4222751 - RNA, 15 nt, Yersinia pestis KIM
ugguccccagagcgc

SEQ ID NO: 4222752 - RNA, 20 nt, Yersinia pestis KIM
uggucccuaacgcaauacgg

SEQ ID NO: 4222753 - RNA, 15 nt, Yersinia pestis KIM
uggucgaugaccugc

SEQ ID NO: 4222754 - RNA, 17 nt, Yersinia pestis KIM
uggucgguuuccgccug

SEQ ID NO: 4222755 - RNA, 16 nt, Yersinia pestis KIM
uggucguuuaaauaaa

SEQ ID NO: 4222756 - RNA, 14 nt, Yersinia pestis KIM
uggucucagaacaa

SEQ ID NO: 4222757 - RNA, 17 nt, Yersinia pestis KIM
uggugaaccagauaaca

SEQ ID NO: 4222758 - RNA, 16 nt, Yersinia pestis KIM
uggugaagaaaccuaa

SEQ ID NO: 4222759 - RNA, 22 nt, Yersinia pestis KIM
uggugaagaaaccuaaugccag

SEQ ID NO: 4222760 - RNA, 18 nt, Yersinia pestis KIM
uggugauaacugccauac

SEQ ID NO: 4222761 - RNA, 11 nt, Yersinia pestis KIM
uggugcaaccg

SEQ ID NO: 4222762 - RNA, 23 nt, Yersinia pestis KIM
uggugccgggucguaccggccca

SEQ ID NO: 4222763 - RNA, 14 nt, Yersinia pestis KIM
ugguggauaagcuc

SEQ ID NO: 4222764 - RNA, 19 nt, Yersinia pestis KIM
ugguggcuugggcuucaca

SEQ ID NO: 4222765 - RNA, 17 nt, Yersinia pestis KIM
uggugguaauuugccag

SEQ ID NO: 4222766 - RNA, 14 nt, Yersinia pestis KIM
ugguuaacagcgug

SEQ ID NO: 4222767 - RNA, 18 nt, Yersinia pestis KIM
ugguuaacuuauagcuca

SEQ ID NO: 4222768 - RNA, 13 nt, Yersinia pestis KIM
ugguuaaucuacc

SEQ ID NO: 4222769 - RNA, 17 nt, Yersinia pestis KIM
ugguuaccaucaaccac

SEQ ID NO: 4222770 - RNA, 16 nt, Yersinia pestis KIM
ugguuaguucuucuga

SEQ ID NO: 4222771 - RNA, 23 nt, Yersinia pestis KIM
ugguuaucaagaucaaaagcaga

SEQ ID NO: 4222772 - RNA, 20 nt, Yersinia pestis KIM
ugguuauccuauucagcagc

SEQ ID NO: 4222773 - RNA, 16 nt, Yersinia pestis KIM
ugguucaccacuuucc

SEQ ID NO: 4222774 - RNA, 13 nt, Yersinia pestis KIM
ugguucgggcaau

SEQ ID NO: 4222775 - RNA, 18 nt, Yersinia pestis KIM
ugguugccagauaauguu

SEQ ID NO: 4222776 - RNA, 13 nt, Yersinia pestis KIM
ugguugcggcacc

SEQ ID NO: 4222777 - RNA, 19 nt, Yersinia pestis KIM
ugguugcggcaccugcccg

SEQ ID NO: 4222778 - RNA, 20 nt, Yersinia pestis KIM
ugguuggcaccacggucaga

SEQ ID NO: 4222779 - RNA, 14 nt, Yersinia pestis KIM
ugguuggcuaucaa

SEQ ID NO: 4222780 - RNA, 14 nt, Yersinia pestis KIM
ugguuuauaacaag

SEQ ID NO: 4222781 - RNA, 12 nt, Yersinia pestis KIM
ugguuucaaacu

SEQ ID NO: 4222782 - RNA, 13 nt, Yersinia pestis KIM
ugguuuccgcuga

SEQ ID NO: 4222783 - RNA, 16 nt, Yersinia pestis KIM
ugguuugaauucaaga

SEQ ID NO: 4222784 - RNA, 20 nt, Yersinia pestis KIM
ugguuugacauacucuucca

SEQ ID NO: 4222785 - RNA, 21 nt, Yersinia pestis KIM
ugguuugauaacgucauucca

SEQ ID NO: 4222786 - RNA, 12 nt, Yersinia pestis KIM
ugguuuggccau

SEQ ID NO: 4222787 - RNA, 16 nt, Yersinia pestis KIM
ugguuugguucuggug

SEQ ID NO: 4222788 - RNA, 11 nt, Yersinia pestis KIM
ugguuuuaaua

SEQ ID NO: 4222789 - RNA, 18 nt, Yersinia pestis KIM
ugguuuuaccaucaccau

SEQ ID NO: 4222790 - RNA, 19 nt, Yersinia pestis KIM
ugguuuucuauuuccacaa

SEQ ID NO: 4222791 - RNA, 20 nt, Yersinia pestis KIM
uguaaaaaccaucugaugca

SEQ ID NO: 4222792 - RNA, 20 nt, Yersinia pestis KIM
uguaaaaacuuaucuaaaaa

SEQ ID NO: 4222793 - RNA, 21 nt, Yersinia pestis KIM
uguaaaaacuuaucuaaaaaa

SEQ ID NO: 4222794 - RNA, 14 nt, Yersinia pestis KIM
uguaaaaaucaccu

SEQ ID NO: 4222795 - RNA, 15 nt, Yersinia pestis KIM
uguaaaauaccaauu

SEQ ID NO: 4222796 - RNA, 15 nt, Yersinia pestis KIM
uguaaacuccuugga

SEQ ID NO: 4222797 - RNA, 19 nt, Yersinia pestis KIM
uguaaagccaguaaacgca

SEQ ID NO: 4222798 - RNA, 14 nt, Yersinia pestis KIM
uguaaaggcaaaga

SEQ ID NO: 4222799 - RNA, 15 nt, Yersinia pestis KIM
uguaaauauaaaaua

SEQ ID NO: 4222800 - RNA, 12 nt, Yersinia pestis KIM
uguaaauaucau

SEQ ID NO: 4222801 - RNA, 13 nt, Yersinia pestis KIM
uguaaauauccug

SEQ ID NO: 4222802 - RNA, 18 nt, Yersinia pestis KIM
uguaaauguacagucauu

SEQ ID NO: 4222803 - RNA, 22 nt, Yersinia pestis KIM
uguaaauuuuaaacaagcuuau

SEQ ID NO: 4222804 - RNA, 16 nt, Yersinia pestis KIM
uguaacaacugaacca

SEQ ID NO: 4222805 - RNA, 13 nt, Yersinia pestis KIM
uguaacagcggcg

SEQ ID NO: 4222806 - RNA, 20 nt, Yersinia pestis KIM
uguaacagcggcgauuaucg

SEQ ID NO: 4222807 - RNA, 11 nt, Yersinia pestis KIM
uguaaccgccu

SEQ ID NO: 4222808 - RNA, 18 nt, Yersinia pestis KIM
uguaacgaugaauuauca

SEQ ID NO: 4222809 - RNA, 17 nt, Yersinia pestis KIM
uguaacgggcaauggua

SEQ ID NO: 4222810 - RNA, 21 nt, Yersinia pestis KIM
uguaacuaccugcuuuaccau

SEQ ID NO: 4222811 - RNA, 22 nt, Yersinia pestis KIM
uguaacugccaguucaucagcc

SEQ ID NO: 4222812 - RNA, 21 nt, Yersinia pestis KIM
uguaagcggaugguuaaucca

SEQ ID NO: 4222813 - RNA, 17 nt, Yersinia pestis KIM
uguaagcguaauucagc

SEQ ID NO: 4222814 - RNA, 16 nt, Yersinia pestis KIM
uguaaggcaauaccaa

SEQ ID NO: 4222815 - RNA, 14 nt, Yersinia pestis KIM
uguaauaaaggcug

SEQ ID NO: 4222816 - RNA, 16 nt, Yersinia pestis KIM
uguaauaacgauuaau

SEQ ID NO: 4222817 - RNA, 16 nt, Yersinia pestis KIM
uguaauccauacagaa

SEQ ID NO: 4222818 - RNA, 16 nt, Yersinia pestis KIM
uguaauccggcaaaaa

SEQ ID NO: 4222819 - RNA, 20 nt, Yersinia pestis KIM
uguaaugacucuggcaguga

SEQ ID NO: 4222820 - RNA, 24 nt, Yersinia pestis KIM
uguaaugacucuggcagugaggca

SEQ ID NO: 4222821 - RNA, 13 nt, Yersinia pestis KIM
uguaaugccuggu

SEQ ID NO: 4222822 - RNA, 15 nt, Yersinia pestis KIM
uguaauuaauuauaa

SEQ ID NO: 4222823 - RNA, 15 nt, Yersinia pestis KIM
uguaauuguauuaua

SEQ ID NO: 4222824 - RNA, 14 nt, Yersinia pestis KIM
uguaauuuguucug

SEQ ID NO: 4222825 - RNA, 18 nt, Yersinia pestis KIM
uguacaacaagaucccaa

SEQ ID NO: 4222826 - RNA, 20 nt, Yersinia pestis KIM
uguacaacuucuucauaacg

SEQ ID NO: 4222827 - RNA, 18 nt, Yersinia pestis KIM
uguacagcguuggcagca

SEQ ID NO: 4222828 - RNA, 19 nt, Yersinia pestis KIM
uguacagcguuggcagcaa

SEQ ID NO: 4222829 - RNA, 20 nt, Yersinia pestis KIM
uguaccaaaacgaacaaaau

SEQ ID NO: 4222830 - RNA, 23 nt, Yersinia pestis KIM
uguaccaaauaaaccagaugugu

SEQ ID NO: 4222831 - RNA, 20 nt, Yersinia pestis KIM
uguaccacugauacccaguu

SEQ ID NO: 4222832 - RNA, 22 nt, Yersinia pestis KIM
uguaccccggauagcugauugc

SEQ ID NO: 4222833 - RNA, 18 nt, Yersinia pestis KIM
uguacccguucaaugugg

SEQ ID NO: 4222834 - RNA, 14 nt, Yersinia pestis KIM
uguaccugugccag

SEQ ID NO: 4222835 - RNA, 21 nt, Yersinia pestis KIM
uguacggcgcguuucuuagcu

SEQ ID NO: 4222836 - RNA, 15 nt, Yersinia pestis KIM
uguacgugaagauaa

SEQ ID NO: 4222837 - RNA, 19 nt, Yersinia pestis KIM
uguacgugacuugcagugg

SEQ ID NO: 4222838 - RNA, 21 nt, Yersinia pestis KIM
uguacugcugcaacucauuaa

SEQ ID NO: 4222839 - RNA, 15 nt, Yersinia pestis KIM
uguacugggaugaag

SEQ ID NO: 4222840 - RNA, 16 nt, Yersinia pestis KIM
uguacuuucccugcug

SEQ ID NO: 4222841 - RNA, 15 nt, Yersinia pestis KIM
uguagagaaauucau

SEQ ID NO: 4222842 - RNA, 23 nt, Yersinia pestis KIM
uguagaucccgugugauuuccau

SEQ ID NO: 4222843 - RNA, 21 nt, Yersinia pestis KIM
uguagcagcaccauacagcag

SEQ ID NO: 4222844 - RNA, 12 nt, Yersinia pestis KIM
uguagccagguc

SEQ ID NO: 4222845 - RNA, 17 nt, Yersinia pestis KIM
uguagcccacugacacu

SEQ ID NO: 4222846 - RNA, 18 nt, Yersinia pestis KIM
uguagcccacugacacug

SEQ ID NO: 4222847 - RNA, 17 nt, Yersinia pestis KIM
uguagcgauaagugcag

SEQ ID NO: 4222848 - RNA, 14 nt, Yersinia pestis KIM
uguagcgccaggua

SEQ ID NO: 4222849 - RNA, 15 nt, Yersinia pestis KIM
uguagcgccagguaa

SEQ ID NO: 4222850 - RNA, 19 nt, Yersinia pestis KIM
uguagcucuuuaucacugg

SEQ ID NO: 4222851 - RNA, 15 nt, Yersinia pestis KIM
uguagcuuuuuaaau

SEQ ID NO: 4222852 - RNA, 19 nt, Yersinia pestis KIM
uguaggcaauacaccgcca

SEQ ID NO: 4222853 - RNA, 16 nt, Yersinia pestis KIM
uguaggcgaauuggca

SEQ ID NO: 4222854 - RNA, 21 nt, Yersinia pestis KIM
uguagguuggggaugaaaaug

SEQ ID NO: 4222855 - RNA, 18 nt, Yersinia pestis KIM
uguagugacguaaaaagg

SEQ ID NO: 4222856 - RNA, 14 nt, Yersinia pestis KIM
uguaguguuuggua

SEQ ID NO: 4222857 - RNA, 20 nt, Yersinia pestis KIM
uguaguguuugguaaauuuu

SEQ ID NO: 4222858 - RNA, 17 nt, Yersinia pestis KIM
uguaguuaaucuacccg

SEQ ID NO: 4222859 - RNA, 14 nt, Yersinia pestis KIM
uguaguuagaugac

SEQ ID NO: 4222860 - RNA, 18 nt, Yersinia pestis KIM
uguaguuauugauuaauu

SEQ ID NO: 4222861 - RNA, 18 nt, Yersinia pestis KIM
uguaguucaucauuauua

SEQ ID NO: 4222862 - RNA, 23 nt, Yersinia pestis KIM
uguauaaaagaaugaauuuuuuu

SEQ ID NO: 4222863 - RNA, 13 nt, Yersinia pestis KIM
uguauacaauugc

SEQ ID NO: 4222864 - RNA, 20 nt, Yersinia pestis KIM
uguauagucuccaaauucau

SEQ ID NO: 4222865 - RNA, 21 nt, Yersinia pestis KIM
uguauagucuccaaauucauu

SEQ ID NO: 4222866 - RNA, 18 nt, Yersinia pestis KIM
uguauauaaaaaaugaga

SEQ ID NO: 4222867 - RNA, 19 nt, Yersinia pestis KIM
uguauaucacuauuucaga

SEQ ID NO: 4222868 - RNA, 15 nt, Yersinia pestis KIM
uguauaugaagauaa

SEQ ID NO: 4222869 - RNA, 20 nt, Yersinia pestis KIM
uguauaugaagauaacgagu

SEQ ID NO: 4222870 - RNA, 13 nt, Yersinia pestis KIM
uguaucaauaccu

SEQ ID NO: 4222871 - RNA, 13 nt, Yersinia pestis KIM
uguaucauauguu

SEQ ID NO: 4222872 - RNA, 17 nt, Yersinia pestis KIM
uguaucauauguucgau

SEQ ID NO: 4222873 - RNA, 22 nt, Yersinia pestis KIM
uguauccuggccguguuuuucc

SEQ ID NO: 4222874 - RNA, 21 nt, Yersinia pestis KIM
uguauuacggccccagcccag

SEQ ID NO: 4222875 - RNA, 18 nt, Yersinia pestis KIM
uguauucgcaucuuccaa

SEQ ID NO: 4222876 - RNA, 14 nt, Yersinia pestis KIM
uguauuuaaauagu

SEQ ID NO: 4222877 - RNA, 15 nt, Yersinia pestis KIM
uguauuuaacauuag

SEQ ID NO: 4222878 - RNA, 21 nt, Yersinia pestis KIM
uguauuuaaccaacacguauc

SEQ ID NO: 4222879 - RNA, 14 nt, Yersinia pestis KIM
uguauuuauucaaa

SEQ ID NO: 4222880 - RNA, 15 nt, Yersinia pestis KIM
uguauuucucaaacu

SEQ ID NO: 4222881 - RNA, 14 nt, Yersinia pestis KIM
uguauuugaugguu

SEQ ID NO: 4222882 - RNA, 18 nt, Yersinia pestis KIM
uguauuugguuauauccc

SEQ ID NO: 4222883 - RNA, 18 nt, Yersinia pestis KIM
uguauuuucaaucgcuuu

SEQ ID NO: 4222884 - RNA, 19 nt, Yersinia pestis KIM
uguauuuuguuuuuuugau

SEQ ID NO: 4222885 - RNA, 20 nt, Yersinia pestis KIM
uguauuuuguuuuuuugaua

SEQ ID NO: 4222886 - RNA, 16 nt, Yersinia pestis KIM
uguauuuuuguauuua

SEQ ID NO: 4222887 - RNA, 13 nt, Yersinia pestis KIM
ugucaaaaaccca

SEQ ID NO: 4222888 - RNA, 21 nt, Yersinia pestis KIM
ugucaacaaccucuaaugcac

SEQ ID NO: 4222889 - RNA, 21 nt, Yersinia pestis KIM
ugucaauaaccucacgcagcg

SEQ ID NO: 4222890 - RNA, 22 nt, Yersinia pestis KIM
ugucaauaaccucagaggcgcu

SEQ ID NO: 4222891 - RNA, 17 nt, Yersinia pestis KIM
ugucaauaaccucagcc

SEQ ID NO: 4222892 - RNA, 18 nt, Yersinia pestis KIM
ugucaauaaccucagccu

SEQ ID NO: 4222893 - RNA, 20 nt, Yersinia pestis KIM
ugucaaugagugauauccgc

SEQ ID NO: 4222894 - RNA, 18 nt, Yersinia pestis KIM
ugucaauguguugaauau

SEQ ID NO: 4222895 - RNA, 18 nt, Yersinia pestis KIM
ugucaccgucaucauuaa

SEQ ID NO: 4222896 - RNA, 14 nt, Yersinia pestis KIM
ugucagagauaaac

SEQ ID NO: 4222897 - RNA, 23 nt, Yersinia pestis KIM
ugucagauaucugcucauuacca

SEQ ID NO: 4222898 - RNA, 12 nt, Yersinia pestis KIM
ugucagauuagu

SEQ ID NO: 4222899 - RNA, 13 nt, Yersinia pestis KIM
ugucagcagucug

SEQ ID NO: 4222900 - RNA, 23 nt, Yersinia pestis KIM
ugucagcagucugagggccacuu

SEQ ID NO: 4222901 - RNA, 14 nt, Yersinia pestis KIM
ugucaggaagcaag

SEQ ID NO: 4222902 - RNA, 12 nt, Yersinia pestis KIM
ugucaggaucau

SEQ ID NO: 4222903 - RNA, 14 nt, Yersinia pestis KIM
ugucagggcaauaa

SEQ ID NO: 4222904 - RNA, 23 nt, Yersinia pestis KIM
ugucaguaucagcgauuuuaaaa

SEQ ID NO: 4222905 - RNA, 18 nt, Yersinia pestis KIM
ugucaucaacuucacuuu

SEQ ID NO: 4222906 - RNA, 15 nt, Yersinia pestis KIM
ugucaugaguguugg

SEQ ID NO: 4222907 - RNA, 14 nt, Yersinia pestis KIM
ugucaugcaauuac

SEQ ID NO: 4222908 - RNA, 14 nt, Yersinia pestis KIM
ugucauggcacgcu

SEQ ID NO: 4222909 - RNA, 20 nt, Yersinia pestis KIM
ugucauuaccaaugguuuca

SEQ ID NO: 4222910 - RNA, 20 nt, Yersinia pestis KIM
ugucauugcuguuguuauua

SEQ ID NO: 4222911 - RNA, 13 nt, Yersinia pestis KIM
uguccaaaggaag

SEQ ID NO: 4222912 - RNA, 16 nt, Yersinia pestis KIM
uguccaaaggaagggg

SEQ ID NO: 4222913 - RNA, 18 nt, Yersinia pestis KIM
uguccacaacaccacuuu

SEQ ID NO: 4222914 - RNA, 18 nt, Yersinia pestis KIM
uguccagccaguugaucg

SEQ ID NO: 4222915 - RNA, 13 nt, Yersinia pestis KIM
uguccaguuauca

SEQ ID NO: 4222916 - RNA, 15 nt, Yersinia pestis KIM
ugucccgaugauugc

SEQ ID NO: 4222917 - RNA, 16 nt, Yersinia pestis KIM
uguccucuaccagacg

SEQ ID NO: 4222918 - RNA, 12 nt, Yersinia pestis KIM
ugucgaaagacg

SEQ ID NO: 4222919 - RNA, 21 nt, Yersinia pestis KIM
ugucggcaagcgauacagaua

SEQ ID NO: 4222920 - RNA, 19 nt, Yersinia pestis KIM
ugucggcagguaaugcauu

SEQ ID NO: 4222921 - RNA, 18 nt, Yersinia pestis KIM
ugucggcgaugaaaaaca

SEQ ID NO: 4222922 - RNA, 22 nt, Yersinia pestis KIM
ugucgggugguugucuauguuu

SEQ ID NO: 4222923 - RNA, 15 nt, Yersinia pestis KIM
ugucguacuuuccuu

SEQ ID NO: 4222924 - RNA, 15 nt, Yersinia pestis KIM
ugucgucaucaggau

SEQ ID NO: 4222925 - RNA, 14 nt, Yersinia pestis KIM
ugucgucccaggcc

SEQ ID NO: 4222926 - RNA, 21 nt, Yersinia pestis KIM
ugucguuucugcuuaacucaa

SEQ ID NO: 4222927 - RNA, 20 nt, Yersinia pestis KIM
ugucuaaauugcuuaaaaaa

SEQ ID NO: 4222928 - RNA, 15 nt, Yersinia pestis KIM
ugucuauugauuaca

SEQ ID NO: 4222929 - RNA, 14 nt, Yersinia pestis KIM
ugucuauuuucauu

SEQ ID NO: 4222930 - RNA, 20 nt, Yersinia pestis KIM
ugucuccuaucugagguuag

SEQ ID NO: 4222931 - RNA, 19 nt, Yersinia pestis KIM
ugucugagucgauagcuuu

SEQ ID NO: 4222932 - RNA, 16 nt, Yersinia pestis KIM
uuaaggcgcgacugau

SEQ ID NO: 4222933 - RNA, 20 nt, Yersinia pestis KIM
uuaagggggggaagcucccc

SEQ ID NO: 4222934 - RNA, 23 nt, Yersinia pestis KIM
uuaaggguuaaccagaagaacag

SEQ ID NO: 4222935 - RNA, 16 nt, Yersinia pestis KIM
uuaaguaauaacucag

SEQ ID NO: 4222936 - RNA, 14 nt, Yersinia pestis KIM
uuaagucaauuuca

SEQ ID NO: 4222937 - RNA, 22 nt, Yersinia pestis KIM
uuaaguguugccaaccggauaa

SEQ ID NO: 4222938 - RNA, 16 nt, Yersinia pestis KIM
uuaaguugaugcagug

SEQ ID NO: 4222939 - RNA, 23 nt, Yersinia pestis KIM
uuaaguuuucuggcaauuucugu

SEQ ID NO: 4222940 - RNA, 21 nt, Yersinia pestis KIM
uuaauaaauuauaaugaugua

SEQ ID NO: 4222941 - RNA, 18 nt, Yersinia pestis KIM
uuaauaaccauaaaauaa

SEQ ID NO: 4222942 - RNA, 17 nt, Yersinia pestis KIM
uuaauaacuuaaauaau

SEQ ID NO: 4222943 - RNA, 21 nt, Yersinia pestis KIM
uuaauaacuucaguuacucac

SEQ ID NO: 4222944 - RNA, 12 nt, Yersinia pestis KIM
uuaauaauucag

SEQ ID NO: 4222945 - RNA, 12 nt, Yersinia pestis KIM
uuaauagauugu

SEQ ID NO: 4222946 - RNA, 14 nt, Yersinia pestis KIM
uuaauauauuuaau

SEQ ID NO: 4222947 - RNA, 16 nt, Yersinia pestis KIM
uuaauaugcaaaaaaa

SEQ ID NO: 4222948 - RNA, 17 nt, Yersinia pestis KIM
uuaauaugcaaaaaaag

SEQ ID NO: 4222949 - RNA, 11 nt, Yersinia pestis KIM
uuaauauuaau

SEQ ID NO: 4222950 - RNA, 18 nt, Yersinia pestis KIM
uuaauauugcauuuuaca

SEQ ID NO: 4222951 - RNA, 16 nt, Yersinia pestis KIM
uuaaucagaaaauuca

SEQ ID NO: 4222952 - RNA, 12 nt, Yersinia pestis KIM
uuaaucagggcu

SEQ ID NO: 4222953 - RNA, 17 nt, Yersinia pestis KIM
uuaaucaucaucacaaa

SEQ ID NO: 4222954 - RNA, 21 nt, Yersinia pestis KIM
uuaauccauagugauuauuua

SEQ ID NO: 4222955 - RNA, 21 nt, Yersinia pestis KIM
uuaauccccggucacuuaaau

SEQ ID NO: 4222956 - RNA, 23 nt, Yersinia pestis KIM
uuaauccccggucacuuaaauaa

SEQ ID NO: 4222957 - RNA, 13 nt, Yersinia pestis KIM
uuaauccuucacu

SEQ ID NO: 4222958 - RNA, 18 nt, Yersinia pestis KIM
uuaaucgcagcagagaau

SEQ ID NO: 4222959 - RNA, 22 nt, Yersinia pestis KIM
uuaaucgccguggugccaucgc

SEQ ID NO: 4222960 - RNA, 16 nt, Yersinia pestis KIM
uuaaucgcugaacaga

SEQ ID NO: 4222961 - RNA, 17 nt, Yersinia pestis KIM
uuaaucgucuuguuggu

SEQ ID NO: 4222962 - RNA, 12 nt, Yersinia pestis KIM
uuaaucugcugc

SEQ ID NO: 4222963 - RNA, 17 nt, Yersinia pestis KIM
uuaaucuuguaaagacg

SEQ ID NO: 4222964 - RNA, 13 nt, Yersinia pestis KIM
uuaaucuuuaauu

SEQ ID NO: 4222965 - RNA, 16 nt, Yersinia pestis KIM
uuaaucuuuaauucau

SEQ ID NO: 4222966 - RNA, 19 nt, Yersinia pestis KIM
uuaaugagcguuauuauua

SEQ ID NO: 4222967 - RNA, 17 nt, Yersinia pestis KIM
uuaaugagucaaugaga

SEQ ID NO: 4222968 - RNA, 12 nt, Yersinia pestis KIM
uuaaugauaacg

SEQ ID NO: 4222969 - RNA, 17 nt, Yersinia pestis KIM
uuaaugauugauuauca

SEQ ID NO: 4222970 - RNA, 16 nt, Yersinia pestis KIM
uuaaugccgcugauca

SEQ ID NO: 4222971 - RNA, 14 nt, Yersinia pestis KIM
uuaaugcuguuuug

SEQ ID NO: 4222972 - RNA, 22 nt, Yersinia pestis KIM
uuaauggcaccguggauaaaca

SEQ ID NO: 4222973 - RNA, 17 nt, Yersinia pestis KIM
uuaauuaagauuaagcc

SEQ ID NO: 4222974 - RNA, 21 nt, Yersinia pestis KIM
uuaauuacuuuauuuaaaauu

SEQ ID NO: 4222975 - RNA, 16 nt, Yersinia pestis KIM
uuaauuaguuuuaaua

SEQ ID NO: 4222976 - RNA, 17 nt, Yersinia pestis KIM
uuaauuaguuuuaauaa

SEQ ID NO: 4222977 - RNA, 21 nt, Yersinia pestis KIM
uuaauuauaagcgaggguaaa

SEQ ID NO: 4222978 - RNA, 22 nt, Yersinia pestis KIM
uuaauucaucagauuguuuaua

SEQ ID NO: 4222979 - RNA, 18 nt, Yersinia pestis KIM
uuaauuccgcccugaaua

SEQ ID NO: 4222980 - RNA, 20 nt, Yersinia pestis KIM
uuaauugagaauuauaacua

SEQ ID NO: 4222981 - RNA, 22 nt, Yersinia pestis KIM
uuaauugagaauuauaacuauu

SEQ ID NO: 4222982 - RNA, 16 nt, Yersinia pestis KIM
uuaauuuaaacucuuu

SEQ ID NO: 4222983 - RNA, 20 nt, Yersinia pestis KIM
uuaauuuagcguuuacugau

SEQ ID NO: 4222984 - RNA, 14 nt, Yersinia pestis KIM
uuaauuuaugaaca

SEQ ID NO: 4222985 - RNA, 18 nt, Yersinia pestis KIM
uuaauuucaccacaucuu

SEQ ID NO: 4222986 - RNA, 14 nt, Yersinia pestis KIM
uuaauuucacuucc

SEQ ID NO: 4222987 - RNA, 22 nt, Yersinia pestis KIM
uuaauuucagucaauaaacauu

SEQ ID NO: 4222988 - RNA, 18 nt, Yersinia pestis KIM
uuaauuuuucauaauaau

SEQ ID NO: 4222989 - RNA, 19 nt, Yersinia pestis KIM
uuacaaauuugacauuucc

SEQ ID NO: 4222990 - RNA, 13 nt, Yersinia pestis KIM
uuacaauaaauca

SEQ ID NO: 4222991 - RNA, 16 nt, Yersinia pestis KIM
uuacaauaaucuggau

SEQ ID NO: 4222992 - RNA, 21 nt, Yersinia pestis KIM
uuacacacccucaacucaaaa

SEQ ID NO: 4222993 - RNA, 20 nt, Yersinia pestis KIM
uuacaccgugcaauagcuag

SEQ ID NO: 4222994 - RNA, 17 nt, Yersinia pestis KIM
uuacacgguuaauucau

SEQ ID NO: 4222995 - RNA, 18 nt, Yersinia pestis KIM
uuacagcaaggcggcaag

SEQ ID NO: 4222996 - RNA, 17 nt, Yersinia pestis KIM
uuacagcagguggcuga

SEQ ID NO: 4222997 - RNA, 19 nt, Yersinia pestis KIM
uuacaggccccuucuggug

SEQ ID NO: 4222998 - RNA, 13 nt, Yersinia pestis KIM
uuacaguuuaauu

SEQ ID NO: 4222999 - RNA, 23 nt, Yersinia pestis KIM
uuacauaugauggcaucuuauua

SEQ ID NO: 4223000 - RNA, 13 nt, Yersinia pestis KIM
uuacaucaucuuc

SEQ ID NO: 4223001 - RNA, 23 nt, Yersinia pestis KIM
uuacauugaauggugcuguauuu

SEQ ID NO: 4223002 - RNA, 23 nt, Yersinia pestis KIM
uuacauuuaaacacucaauaagu

SEQ ID NO: 4223003 - RNA, 10 nt, Yersinia pestis KIM
uuacauuuug

SEQ ID NO: 4223004 - RNA, 20 nt, Yersinia pestis KIM
uuaccaaaagcauccaauac

SEQ ID NO: 4223005 - RNA, 16 nt, Yersinia pestis KIM
uuaccaaacauuuuca

SEQ ID NO: 4223006 - RNA, 16 nt, Yersinia pestis KIM
uuaccacggccaagua

SEQ ID NO: 4223007 - RNA, 17 nt, Yersinia pestis KIM
uuaccacuggccuccca

SEQ ID NO: 4223008 - RNA, 22 nt, Yersinia pestis KIM
uuaccauccacuagguccauaa

SEQ ID NO: 4223009 - RNA, 18 nt, Yersinia pestis KIM
uuaccauccguccucagg

SEQ ID NO: 4223010 - RNA, 19 nt, Yersinia pestis KIM
uuacccacauucaggccga

SEQ ID NO: 4223011 - RNA, 15 nt, Yersinia pestis KIM
uuacccgaaagccau

SEQ ID NO: 4223012 - RNA, 23 nt, Yersinia pestis KIM
uuacccuacccauuauaaauaau

SEQ ID NO: 4223013 - RNA, 21 nt, Yersinia pestis KIM
uuaccgaggcucgacgggaac

SEQ ID NO: 4223014 - RNA, 18 nt, Yersinia pestis KIM
uuaccuaaccaaacauug

SEQ ID NO: 4223015 - RNA, 20 nt, Yersinia pestis KIM
uuaccuauaaacuugauuca

SEQ ID NO: 4223016 - RNA, 21 nt, Yersinia pestis KIM
uuaccugacacugcaucucug

SEQ ID NO: 4223017 - RNA, 23 nt, Yersinia pestis KIM
uuaccugcgcgaccccaagcggu

SEQ ID NO: 4223018 - RNA, 14 nt, Yersinia pestis KIM
uuaccugcucaacu

SEQ ID NO: 4223019 - RNA, 22 nt, Yersinia pestis KIM
uuaccuguuucgauccagcuac

SEQ ID NO: 4223020 - RNA, 16 nt, Yersinia pestis KIM
uuacgaucaacccccu

SEQ ID NO: 4223021 - RNA, 15 nt, Yersinia pestis KIM
uuacgaucugccugu

SEQ ID NO: 4223022 - RNA, 21 nt, Yersinia pestis KIM
uuacgaucugccuguucucuc

SEQ ID NO: 4223023 - RNA, 22 nt, Yersinia pestis KIM
uuacgcaacguaauaucugcca

SEQ ID NO: 4223024 - RNA, 14 nt, Yersinia pestis KIM
uuacgcaaguaaaa

SEQ ID NO: 4223025 - RNA, 20 nt, Yersinia pestis KIM
uuacgcgucaucauauucaa

SEQ ID NO: 4223026 - RNA, 22 nt, Yersinia pestis KIM
uuacgcuaucaacuuucacccc

SEQ ID NO: 4223027 - RNA, 20 nt, Yersinia pestis KIM
uuacgcucugccuguucucu

SEQ ID NO: 4223028 - RNA, 14 nt, Yersinia pestis KIM
uuacguaauaguaa

SEQ ID NO: 4223029 - RNA, 19 nt, Yersinia pestis KIM
uuacgucaaaacuauuuau

SEQ ID NO: 4223030 - RNA, 20 nt, Yersinia pestis KIM
uuacgucaaaacuauuuauu

SEQ ID NO: 4223031 - RNA, 16 nt, Yersinia pestis KIM
uuacgugaucaucuuu

SEQ ID NO: 4223032 - RNA, 17 nt, Yersinia pestis KIM
uuacgugaucaucuuuu

SEQ ID NO: 4223033 - RNA, 19 nt, Yersinia pestis KIM
uuacguuucauaugucacc

SEQ ID NO: 4223034 - RNA, 14 nt, Yersinia pestis KIM
uuacuaaaauauca

SEQ ID NO: 4223035 - RNA, 14 nt, Yersinia pestis KIM
uuacuaacuggcug

SEQ ID NO: 4223036 - RNA, 23 nt, Yersinia pestis KIM
uuacuacaaacgcguuaauuaag

SEQ ID NO: 4223037 - RNA, 14 nt, Yersinia pestis KIM
uuacuaucuuuauu

SEQ ID NO: 4223038 - RNA, 13 nt, Yersinia pestis KIM
uuacuauuuuucu

SEQ ID NO: 4223039 - RNA, 18 nt, Yersinia pestis KIM
uuacucagcacauuuuua

SEQ ID NO: 4223040 - RNA, 18 nt, Yersinia pestis KIM
uuacucaggaacaagacu

SEQ ID NO: 4223041 - RNA, 22 nt, Yersinia pestis KIM
uuacucaggauuagcuucugcu

SEQ ID NO: 4223042 - RNA, 18 nt, Yersinia pestis KIM
uuacucauuauggauaau

SEQ ID NO: 4223043 - RNA, 17 nt, Yersinia pestis KIM
uuacucccuuguugccu

SEQ ID NO: 4223044 - RNA, 14 nt, Yersinia pestis KIM
uuacucgcuccgag

SEQ ID NO: 4223045 - RNA, 16 nt, Yersinia pestis KIM
uuacucguauaaaaaa

SEQ ID NO: 4223046 - RNA, 21 nt, Yersinia pestis KIM
uuaucaucccuugacugacca

SEQ ID NO: 4223047 - RNA, 17 nt, Yersinia pestis KIM
uuaucaucguaguaaua

SEQ ID NO: 4223048 - RNA, 21 nt, Yersinia pestis KIM
uuaucauucaagaaaaugauu

SEQ ID NO: 4223049 - RNA, 20 nt, Yersinia pestis KIM
uuaucauugcuccuguauau

SEQ ID NO: 4223050 - RNA, 22 nt, Yersinia pestis KIM
uuauccaauggcucaccuuuca

SEQ ID NO: 4223051 - RNA, 16 nt, Yersinia pestis KIM
uuauccacuaauucau

SEQ ID NO: 4223052 - RNA, 23 nt, Yersinia pestis KIM
uuauccauccccgccucaaugca

SEQ ID NO: 4223053 - RNA, 17 nt, Yersinia pestis KIM
uuauccauuuucugcca

SEQ ID NO: 4223054 - RNA, 18 nt, Yersinia pestis KIM
uuauccauuuucugccaa

SEQ ID NO: 4223055 - RNA, 11 nt, Yersinia pestis KIM
uuauccccuuc

SEQ ID NO: 4223056 - RNA, 13 nt, Yersinia pestis KIM
uuauccccuucga

SEQ ID NO: 4223057 - RNA, 17 nt, Yersinia pestis KIM
uuaucccuccaucaagc

SEQ ID NO: 4223058 - RNA, 15 nt, Yersinia pestis KIM
uuauccguuugcaac

SEQ ID NO: 4223059 - RNA, 14 nt, Yersinia pestis KIM
uuauccuccauucu

SEQ ID NO: 4223060 - RNA, 13 nt, Yersinia pestis KIM
uuauccuuuuuau

SEQ ID NO: 4223061 - RNA, 21 nt, Yersinia pestis KIM
uuaucgaggugccgugggggg

SEQ ID NO: 4223062 - RNA, 18 nt, Yersinia pestis KIM
uuaucgauucaaauagcg

SEQ ID NO: 4223063 - RNA, 19 nt, Yersinia pestis KIM
uuaucgauuuaguaucauu

SEQ ID NO: 4223064 - RNA, 18 nt, Yersinia pestis KIM
uuaucgccaagccaguaa

SEQ ID NO: 4223065 - RNA, 22 nt, Yersinia pestis KIM
uuaucgccaagccaguaauuaa

SEQ ID NO: 4223066 - RNA, 21 nt, Yersinia pestis KIM
uuaucgccuaccaucaaaaua

SEQ ID NO: 4223067 - RNA, 22 nt, Yersinia pestis KIM
uuaucgccuaccaucaaaauau

SEQ ID NO: 4223068 - RNA, 17 nt, Yersinia pestis KIM
uuaucgcuguuuacuga

SEQ ID NO: 4223069 - RNA, 16 nt, Yersinia pestis KIM
uuaucggauuacuuca

SEQ ID NO: 4223070 - RNA, 15 nt, Yersinia pestis KIM
uuaucggcaggcuua

SEQ ID NO: 4223071 - RNA, 19 nt, Yersinia pestis KIM
uuaucggugcugacaaaca

SEQ ID NO: 4223072 - RNA, 19 nt, Yersinia pestis KIM
uuaucgugcgucaauaaua

SEQ ID NO: 4223073 - RNA, 16 nt, Yersinia pestis KIM
uuaucguuucuguuuu

SEQ ID NO: 4223074 - RNA, 17 nt, Yersinia pestis KIM
uuaucguuucuguuuug

SEQ ID NO: 4223075 - RNA, 14 nt, Yersinia pestis KIM
uuaucuagcgucca

SEQ ID NO: 4223076 - RNA, 17 nt, Yersinia pestis KIM
uuaucuagcguccaugu

SEQ ID NO: 4223077 - RNA, 21 nt, Yersinia pestis KIM
uuaucuagcguccauguaucc

SEQ ID NO: 4223078 - RNA, 16 nt, Yersinia pestis KIM
uuaucuaucucaggcu

SEQ ID NO: 4223079 - RNA, 19 nt, Yersinia pestis KIM
uuaucucacgcugaauaac

SEQ ID NO: 4223080 - RNA, 17 nt, Yersinia pestis KIM
uuaucucccauuaauua

SEQ ID NO: 4223081 - RNA, 16 nt, Yersinia pestis KIM
uuaucuccgccauuga

SEQ ID NO: 4223082 - RNA, 17 nt, Yersinia pestis KIM
uuaucuccgccauugag

SEQ ID NO: 4223083 - RNA, 13 nt, Yersinia pestis KIM
uuaucuccuguaa

SEQ ID NO: 4223084 - RNA, 17 nt, Yersinia pestis KIM
uuaucucgcugugcccu

SEQ ID NO: 4223085 - RNA, 22 nt, Yersinia pestis KIM
uuaucugcuaauuaaaccugac

SEQ ID NO: 4223086 - RNA, 21 nt, Yersinia pestis KIM
uuaucugugccagucuaaaau

SEQ ID NO: 4223087 - RNA, 13 nt, Yersinia pestis KIM
uuaucuguuucaa

SEQ ID NO: 4223088 - RNA, 16 nt, Yersinia pestis KIM
uuaucuguuucaaaua

SEQ ID NO: 4223089 - RNA, 18 nt, Yersinia pestis KIM
uuaucuuguaaauaguca

SEQ ID NO: 4223090 - RNA, 23 nt, Yersinia pestis KIM
uuaugaauggggggcaaccuggu

SEQ ID NO: 4223091 - RNA, 22 nt, Yersinia pestis KIM
uuaugaccaauagucacgucuu

SEQ ID NO: 4223092 - RNA, 13 nt, Yersinia pestis KIM
uuaugacggcauc

SEQ ID NO: 4223093 - RNA, 16 nt, Yersinia pestis KIM
uuaugaucuugaauaa

SEQ ID NO: 4223094 - RNA, 23 nt, Yersinia pestis KIM
uuaugaugcuggguauauauaca

SEQ ID NO: 4223095 - RNA, 18 nt, Yersinia pestis KIM
uuaugaugugauuauuuu

SEQ ID NO: 4223096 - RNA, 14 nt, Yersinia pestis KIM
uuaugcaaauaaua

SEQ ID NO: 4223097 - RNA, 23 nt, Yersinia pestis KIM
uuaugcagggaagcuggccucuu

SEQ ID NO: 4223098 - RNA, 23 nt, Yersinia pestis KIM
uuauggcaauucgcuuaugacaa

SEQ ID NO: 4223099 - RNA, 16 nt, Yersinia pestis KIM
uuauggcauaaacuga

SEQ ID NO: 4223100 - RNA, 17 nt, Yersinia pestis KIM
uuauggcauaaacugaa

SEQ ID NO: 4223101 - RNA, 16 nt, Yersinia pestis KIM
uuaugggugguuagca

SEQ ID NO: 4223102 - RNA, 19 nt, Yersinia pestis KIM
uuauguaacaacugaacca

SEQ ID NO: 4223103 - RNA, 19 nt, Yersinia pestis KIM
uuaugucagagauaaaccc

SEQ ID NO: 4223104 - RNA, 14 nt, Yersinia pestis KIM
uuauguuaaaucag

SEQ ID NO: 4223105 - RNA, 23 nt, Yersinia pestis KIM
uuauuaaacagucuuauuacuca

SEQ ID NO: 4223106 - RNA, 17 nt, Yersinia pestis KIM
uuauuaacuucaauuug

SEQ ID NO: 4223107 - RNA, 23 nt, Yersinia pestis KIM
uuauuaaucaagauauuacuucu

SEQ ID NO: 4223108 - RNA, 11 nt, Yersinia pestis KIM
uuauuacauuu

SEQ ID NO: 4223109 - RNA, 12 nt, Yersinia pestis KIM
uuauuacucagc

SEQ ID NO: 4223110 - RNA, 16 nt, Yersinia pestis KIM
uuauuacugucacugu

SEQ ID NO: 4223111 - RNA, 14 nt, Yersinia pestis KIM
uuauuacugucauu

SEQ ID NO: 4223112 - RNA, 18 nt, Yersinia pestis KIM
uuauuagccaaauacccu

SEQ ID NO: 4223113 - RNA, 19 nt, Yersinia pestis KIM
uuauuaggcauugagucac

SEQ ID NO: 4223114 - RNA, 17 nt, Yersinia pestis KIM
uuauuauaggcguugau

SEQ ID NO: 4223115 - RNA, 19 nt, Yersinia pestis KIM
uuauuauauauuuugaaua

SEQ ID NO: 4223116 - RNA, 16 nt, Yersinia pestis KIM
uuauuauaugaucagu

SEQ ID NO: 4223117 - RNA, 14 nt, Yersinia pestis KIM
uuauuaucaucuuu

SEQ ID NO: 4223118 - RNA, 20 nt, Yersinia pestis KIM
uuauuauguuugcuagggcu

SEQ ID NO: 4223119 - RNA, 12 nt, Yersinia pestis KIM
uuauuauuauuu

SEQ ID NO: 4223120 - RNA, 15 nt, Yersinia pestis KIM
uuauucagcuucagc

SEQ ID NO: 4223121 - RNA, 20 nt, Yersinia pestis KIM
uuauucauaucgcucaucau

SEQ ID NO: 4223122 - RNA, 11 nt, Yersinia pestis KIM
uuauucauuca

SEQ ID NO: 4223123 - RNA, 15 nt, Yersinia pestis KIM
uuauucccacuuauu

SEQ ID NO: 4223124 - RNA, 18 nt, Yersinia pestis KIM
uuauucgaguagggauuu

SEQ ID NO: 4223125 - RNA, 23 nt, Yersinia pestis KIM
uuauucguggugaugaugacggu

SEQ ID NO: 4223126 - RNA, 11 nt, Yersinia pestis KIM
uuauucuaauu

SEQ ID NO: 4223127 - RNA, 23 nt, Yersinia pestis KIM
uuauucucaauugacuguauaua

SEQ ID NO: 4223128 - RNA, 14 nt, Yersinia pestis KIM
uuauugagaagaaa

SEQ ID NO: 4223129 - RNA, 16 nt, Yersinia pestis KIM
uuauugccauuuuaau

SEQ ID NO: 4223130 - RNA, 17 nt, Yersinia pestis KIM
uuauuggaaguacuuau

SEQ ID NO: 4223131 - RNA, 20 nt, Yersinia pestis KIM
uuauugggcgcgauaaaaga

SEQ ID NO: 4223132 - RNA, 17 nt, Yersinia pestis KIM
uuauugggcugccugug

SEQ ID NO: 4223133 - RNA, 19 nt, Yersinia pestis KIM
uuauuggggacaggcuccu

SEQ ID NO: 4223134 - RNA, 18 nt, Yersinia pestis KIM
uuauuggucaauaaaauu

SEQ ID NO: 4223135 - RNA, 16 nt, Yersinia pestis KIM
uuauugguuauuuuau

SEQ ID NO: 4223136 - RNA, 15 nt, Yersinia pestis KIM
uuauuguacuuuauu

SEQ ID NO: 4223137 - RNA, 14 nt, Yersinia pestis KIM
uuauugucucuacu

SEQ ID NO: 4223138 - RNA, 20 nt, Yersinia pestis KIM
uuauugucucuacucucugu

SEQ ID NO: 4223139 - RNA, 12 nt, Yersinia pestis KIM
uuauugugcccc

SEQ ID NO: 4223140 - RNA, 18 nt, Yersinia pestis KIM
uuauuguggcuaccaauu

SEQ ID NO: 4223141 - RNA, 21 nt, Yersinia pestis KIM
uuauuuaaacaaugaaauugc

SEQ ID NO: 4223142 - RNA, 21 nt, Yersinia pestis KIM
uuauuuaacacauuccaguaa

SEQ ID NO: 4223143 - RNA, 17 nt, Yersinia pestis KIM
uuauuuacgauaagaau

SEQ ID NO: 4223144 - RNA, 23 nt, Yersinia pestis KIM
uuauuucacacuguuuaguucac

SEQ ID NO: 4223145 - RNA, 23 nt, Yersinia pestis KIM
uuauuucgauucauucagcgucu

SEQ ID NO: 4223146 - RNA, 16 nt, Yersinia pestis KIM
uuauuugaauaagaca

SEQ ID NO: 4223147 - RNA, 21 nt, Yersinia pestis KIM
uuauuugaguaagacaacuua

SEQ ID NO: 4223148 - RNA, 15 nt, Yersinia pestis KIM
uuauuugccuacuga

SEQ ID NO: 4223149 - RNA, 18 nt, Yersinia pestis KIM
uuauuugccuacugaaga

SEQ ID NO: 4223150 - RNA, 13 nt, Yersinia pestis KIM
uuauuugcuaucg

SEQ ID NO: 4223151 - RNA, 12 nt, Yersinia pestis KIM
uuauuugcugcc

SEQ ID NO: 4223152 - RNA, 23 nt, Yersinia pestis KIM
uuauuuggugaguaaaugcccca

SEQ ID NO: 4223153 - RNA, 23 nt, Yersinia pestis KIM
uuauuugucgccaacauuuauuu

SEQ ID NO: 4223154 - RNA, 12 nt, Yersinia pestis KIM
uuauuuuaauug

SEQ ID NO: 4223155 - RNA, 14 nt, Yersinia pestis KIM
uuauuuucgaccaa

SEQ ID NO: 4223156 - RNA, 21 nt, Yersinia pestis KIM
uuauuuuguuuguaaauuuua

SEQ ID NO: 4223157 - RNA, 21 nt, Yersinia pestis KIM
uuauuuuuggucguuuaaaua

SEQ ID NO: 4223158 - RNA, 16 nt, Yersinia pestis KIM
uuauuuuuguaacuca

SEQ ID NO: 4223159 - RNA, 17 nt, Yersinia pestis KIM
uucaaaaggugcaagca

SEQ ID NO: 4223160 - RNA, 22 nt, Yersinia pestis KIM
uucagguuuacgcuuuugccuu

SEQ ID NO: 4223161 - RNA, 20 nt, Yersinia pestis KIM
uucaguaaagcuuucagcuu

SEQ ID NO: 4223162 - RNA, 17 nt, Yersinia pestis KIM
uucaguagcgucaguuu

SEQ ID NO: 4223163 - RNA, 15 nt, Yersinia pestis KIM
uucagucaguaggcu

SEQ ID NO: 4223164 - RNA, 23 nt, Yersinia pestis KIM
uucagugauaacaacccuaacac

SEQ ID NO: 4223165 - RNA, 18 nt, Yersinia pestis KIM
uucagugccaauaauuca

SEQ ID NO: 4223166 - RNA, 13 nt, Yersinia pestis KIM
uucaguuacucac

SEQ ID NO: 4223167 - RNA, 14 nt, Yersinia pestis KIM
uucaguucuucacg

SEQ ID NO: 4223168 - RNA, 21 nt, Yersinia pestis KIM
uucaguucuucacgaagaauu

SEQ ID NO: 4223169 - RNA, 20 nt, Yersinia pestis KIM
uucaguugauugcaaaacau

SEQ ID NO: 4223170 - RNA, 20 nt, Yersinia pestis KIM
uucaguuuauuuaagcugaa

SEQ ID NO: 4223171 - RNA, 17 nt, Yersinia pestis KIM
uucaguuuuaauuuaug

SEQ ID NO: 4223172 - RNA, 18 nt, Yersinia pestis KIM
uucaguuuuuaggucaau

SEQ ID NO: 4223173 - RNA, 16 nt, Yersinia pestis KIM
uucauaaaaaaagaag

SEQ ID NO: 4223174 - RNA, 14 nt, Yersinia pestis KIM
uucauaaaccugau

SEQ ID NO: 4223175 - RNA, 18 nt, Yersinia pestis KIM
uucauaaauuaaaacuga

SEQ ID NO: 4223176 - RNA, 14 nt, Yersinia pestis KIM
uucauagcgugcag

SEQ ID NO: 4223177 - RNA, 18 nt, Yersinia pestis KIM
uucauagguagaauagca

SEQ ID NO: 4223178 - RNA, 16 nt, Yersinia pestis KIM
uucauauauugcauuu

SEQ ID NO: 4223179 - RNA, 19 nt, Yersinia pestis KIM
uucauaucgauaccgauaa

SEQ ID NO: 4223180 - RNA, 17 nt, Yersinia pestis KIM
uucauaucguccaaagg

SEQ ID NO: 4223181 - RNA, 14 nt, Yersinia pestis KIM
uucauaugacaaau

SEQ ID NO: 4223182 - RNA, 17 nt, Yersinia pestis KIM
uucauaugcgccuauaa

SEQ ID NO: 4223183 - RNA, 19 nt, Yersinia pestis KIM
uucauaugcgccuauaagg

SEQ ID NO: 4223184 - RNA, 20 nt, Yersinia pestis KIM
uucaucaaggauaagaaucu

SEQ ID NO: 4223185 - RNA, 22 nt, Yersinia pestis KIM
uucaucaauagguguugccggc

SEQ ID NO: 4223186 - RNA, 21 nt, Yersinia pestis KIM
uucaucaaucgagaagaauuu

SEQ ID NO: 4223187 - RNA, 16 nt, Yersinia pestis KIM
uucaucaccagucagc

SEQ ID NO: 4223188 - RNA, 18 nt, Yersinia pestis KIM
uucaucaccagucagccu

SEQ ID NO: 4223189 - RNA, 23 nt, Yersinia pestis KIM
uucaucacccaucaauaauuaag

SEQ ID NO: 4223190 - RNA, 16 nt, Yersinia pestis KIM
uucaucaccuuaucca

SEQ ID NO: 4223191 - RNA, 17 nt, Yersinia pestis KIM
uucaucagagucuguca

SEQ ID NO: 4223192 - RNA, 22 nt, Yersinia pestis KIM
uucaucagggcagcaucgucaa

SEQ ID NO: 4223193 - RNA, 17 nt, Yersinia pestis KIM
uucaucaucaacaacca

SEQ ID NO: 4223194 - RNA, 15 nt, Yersinia pestis KIM
uucaucauccauaaa

SEQ ID NO: 4223195 - RNA, 15 nt, Yersinia pestis KIM
uucaucauuauuaug

SEQ ID NO: 4223196 - RNA, 14 nt, Yersinia pestis KIM
uucaucauucaaua

SEQ ID NO: 4223197 - RNA, 17 nt, Yersinia pestis KIM
uucauccgcagcaaaac

SEQ ID NO: 4223198 - RNA, 24 nt, Yersinia pestis KIM
uucauccuaaagauaauuaauuca

SEQ ID NO: 4223199 - RNA, 21 nt, Yersinia pestis KIM
uucauccuguaccgcgcuuuu

SEQ ID NO: 4223200 - RNA, 14 nt, Yersinia pestis KIM
uucaucgacucuuu

SEQ ID NO: 4223201 - RNA, 16 nt, Yersinia pestis KIM
uucaucgcccuguaac

SEQ ID NO: 4223202 - RNA, 16 nt, Yersinia pestis KIM
uucaucggcaaaaaca

SEQ ID NO: 4223203 - RNA, 21 nt, Yersinia pestis KIM
uucaucugaccaaacauuguc

SEQ ID NO: 4223204 - RNA, 17 nt, Yersinia pestis KIM
uucaugacaaauugcaa

SEQ ID NO: 4223205 - RNA, 14 nt, Yersinia pestis KIM
uucaugacagguuu

SEQ ID NO: 4223206 - RNA, 19 nt, Yersinia pestis KIM
uucaugguaaauuccuaua

SEQ ID NO: 4223207 - RNA, 20 nt, Yersinia pestis KIM
uucauuaauuaauaagccca

SEQ ID NO: 4223208 - RNA, 13 nt, Yersinia pestis KIM
uucauuagucaau

SEQ ID NO: 4223209 - RNA, 20 nt, Yersinia pestis KIM
uucauuaucauguaaggcaa

SEQ ID NO: 4223210 - RNA, 16 nt, Yersinia pestis KIM
uucauucguuagcucu

SEQ ID NO: 4223211 - RNA, 21 nt, Yersinia pestis KIM
uucauucuauuauuuaacccc

SEQ ID NO: 4223212 - RNA, 21 nt, Yersinia pestis KIM
uucauugccgaugucaauaaa

SEQ ID NO: 4223213 - RNA, 18 nt, Yersinia pestis KIM
uucauugguaauuucagg

SEQ ID NO: 4223214 - RNA, 12 nt, Yersinia pestis KIM
uucauuuaacug

SEQ ID NO: 4223215 - RNA, 20 nt, Yersinia pestis KIM
uucauuuacuugauaauugc

SEQ ID NO: 4223216 - RNA, 14 nt, Yersinia pestis KIM
uucauuuccucugg

SEQ ID NO: 4223217 - RNA, 12 nt, Yersinia pestis KIM
uucauuuuaaaa

SEQ ID NO: 4223218 - RNA, 13 nt, Yersinia pestis KIM
uucauuuuaaaaa

SEQ ID NO: 4223219 - RNA, 14 nt, Yersinia pestis KIM
uucauuuuaaaaaa

SEQ ID NO: 4223220 - RNA, 16 nt, Yersinia pestis KIM
uucauuuuaaaaaaau

SEQ ID NO: 4223221 - RNA, 23 nt, Yersinia pestis KIM
uucauuuuaacaacccauuuccc

SEQ ID NO: 4223222 - RNA, 15 nt, Yersinia pestis KIM
uucauuuuguauuuu

SEQ ID NO: 4223223 - RNA, 15 nt, Yersinia pestis KIM
uuccaaaacucaugu

SEQ ID NO: 4223224 - RNA, 23 nt, Yersinia pestis KIM
uuccaaaugacagcaucaauauc

SEQ ID NO: 4223225 - RNA, 13 nt, Yersinia pestis KIM
uuccaacuccauc

SEQ ID NO: 4223226 - RNA, 16 nt, Yersinia pestis KIM
uuccaaucugcgcccu

SEQ ID NO: 4223227 - RNA, 17 nt, Yersinia pestis KIM
uuccaaugucaguggcg

SEQ ID NO: 4223228 - RNA, 15 nt, Yersinia pestis KIM
uuccaauucauaaua

SEQ ID NO: 4223229 - RNA, 20 nt, Yersinia pestis KIM
uuccaauuggugcuuuaugu

SEQ ID NO: 4223230 - RNA, 22 nt, Yersinia pestis KIM
uuccacgaaggcacccaugcuc

SEQ ID NO: 4223231 - RNA, 21 nt, Yersinia pestis KIM
uuccacgcccaacucuuuagc

SEQ ID NO: 4223232 - RNA, 21 nt, Yersinia pestis KIM
uuccagacaaagugagggaua

SEQ ID NO: 4223233 - RNA, 22 nt, Yersinia pestis KIM
uuccagauaucccaacugaaac

SEQ ID NO: 4223234 - RNA, 11 nt, Yersinia pestis KIM
uuccagcaaaa

SEQ ID NO: 4223235 - RNA, 23 nt, Yersinia pestis KIM
uuccagcgcccggcugaccuguu

SEQ ID NO: 4223236 - RNA, 16 nt, Yersinia pestis KIM
uuccagcggcaaauag

SEQ ID NO: 4223237 - RNA, 12 nt, Yersinia pestis KIM
uuccagcggcau

SEQ ID NO: 4223238 - RNA, 13 nt, Yersinia pestis KIM
uuccaguaaaaaa

SEQ ID NO: 4223239 - RNA, 15 nt, Yersinia pestis KIM
uuccaguaaaaaaau

SEQ ID NO: 4223240 - RNA, 19 nt, Yersinia pestis KIM
uuccagugccaauugagua

SEQ ID NO: 4223241 - RNA, 19 nt, Yersinia pestis KIM
uuccauacuguugcuaggc
